United States Patent 7,745,391 (HUMAN THROMBOSPONDIN POLYPEPTIDE) - sequence listing, part 221

SEQ ID NO: 567307 - DNA, 12730 bp, Homo sapiens
  misc_feature (603)..(603): n is a, c, g, or t
  misc_feature (618)..(618): n is a, c, g, or t
  misc_feature (676)..(676): n is a, c, g, or t
  misc_feature (685)..(685): n is a, c, g, or t
  misc_feature (1078)..(1078): n is a, c, g, or t
  misc_feature (1116)..(1116): n is a, c, g, or t
ttttttttttatagtgcatgcaggaaattgcaattttatttatgtttgtattgatacatatttgtacatatttatggggtgtggtagtttgatatatgcatacaatgtgtaatgatcaaatcagggtgtttaggatatctatcacctcaaacatttatcatttttgtgtttggaacatttctaatctcctagttattttgaaatatataacatattgttaactatagtcaccctactgtgctatcaaacacttgaacttattccttctatctacgtttgtacccattaaccaatctcttccctccctcccccaactccaccttcccagcctctggtacttatctctactccatgagatcaactttttaagctcccacatgagtgagaccatgggatatttgtctttctgtgccagacttatttcacttagaataatgacctccagttccgtaagatgggcagccaggaaaggccttacttagctgatgtttgaattgtgaagttatgtaatcattaagatgagtatacatacaatgggccagctgagtgcacagcaagattcaataaattcaaactaacattactcttattgccaagagagtncctgaaatgacagcncattggaaactggctactttccttccctttccttaggggtttaaggaaagcatgagtnatttcagtnttttgctggagctcctcactgacactcattgcagagcctgagccctcaactctcaatctttgcttaggtcctggcttaggctccactttgtaagaggcaccttcctagtattcactactctctctctcacaatcatgtccttacagacattgctgatcctctttcatactgacaccgggttctagtccgagttccatcactaagtcgctgtttgactttgggcaagttacttctgtggttaattatttttcatcaacaaaatcaaaaggtgaaactagacgaacaactaagaggctccagtattttttcaatctaagagtcccatatcccccactcccttctcacagctcattcaacaatcctaatggcagcgggtgcccgcagtctcaagtntctgccgaagcccaagccgctgtctcggtcagtcacanccgacgaagaggaggaattggaggaagccagcataaccacctcacactgagaacatctgacctttcccagaacgcccgcccactcgacacttcctgtccctccccagatcttgttccggggcacctactcgggtctaatcactcccctcattcactctttagggtccattgctgtttctttgaggaagcggagcatcttctgtcgttgattggtttccgtcattgttgataggttggtaacaaacaaggtgtgcctggtctcctggtaacgtcctgccgatagtcctgattggtcggtgtcttaatcccatcttccgtcccaactgctagtggctgagtccctggcggggcgcggcggtggaaggtgtcgcgtacgggcttcccgagctgacgtggcttgaattgggaggggggcagctggagcctcaggcggcagcgcttctagaaatgctgagccgattatcaggattagcaaatgttgttttgcatgaattatcaggagatgatgacactgatcagaatatgagggctcccctagaccctgaattacaccaagaatctgacatggaatttaataatactacacaagaagatgttcaggagcgcctggcttatgcagagcaattggtggtggagctaaaagatattattagacagaaggatgttcaactgcagcagaaagatgaagctctacaggaagagagaaaagctgctgataacaaaattaaaaaactaaaacttcatgcgaaggccaaattaacttctttgaataaatacatagaagaaatgaaagcacaaggagggactgttctgcctacagaacctcagtcagaggagcaactttccaagcatgacaagagttctacagaggaagagatggaaatagaaaagataaaacataagctccaggagaaggaggaactaatcagcactttgcaagcccagcttactcaggcacaggcagaacaacctgcacagagttctacagagatggaagaatttgtaatgatgaagcaacagctccaggagaaggaagaattcattagcactttacaagcccagctcagccagacacaggcagagcaagctgcacagcaggtggtccgagagaaagatgcccgctttgaaacacaagttcgtcttcatgaagatgagcttcttcagttagtaacccaggcagatgtggaaacagagatgcaacagaaattgagggtgctgcaaaggaagcttgaggaacacgaagaatccttggtgggccgtgctcaggtcgttgacttgctgcaacaggagctgactgctgctgagcagagaaaccagattctctctcagcagttacagcagatggaagctgagcataatactttgaggaacactgtggaaacagaaagagaggagtccaagattctactggaaaagatggaacttgaagtggcagagagaaaattatccttccataatctgcaggaagaaatgcatcatcttttagaacagtttgagcaagcaggccaagcccaggctgaactagagtctcggtatagtgctttggagcagaagcacaaagcagaaatggaagagaagacctctcatattttgagtcttcaaaagactggacaagagctgcagtctgcctgtgatgctctaaaggatcaaaattcaaagcttctccaagataagaatgaacaggcagttcagtcagcccagaccattcagcaactggaagatcagctccagcaaaaatccaaagaaattagccaatttctaaatagactgcccttgcaacaacatgaaacagcatctcagacttctttcccagatgtttataatgagggcacacaggcagtcactgaggagaatattgcttctttgcagaagagagtggtagaactagagaatgaaaagggagccttgctccttagttctatagagctggaggagctgaaagctgagaatgaaaaactgtcttctcagattactctcctagaggctcagaatagaactggggaggcagacagagaagtcagtgagatcagcattgttgatattgccaacaagaggagctcttctgctgaggaaagtggacaagatgttctagaaaacacattttctcagaaacataaagaattatcagttttattgttggaaatgaaagaagctcaagaggaaattgcatttcttaaattacagctccagggaaaaagggctgaggaagcagatcatgaggtccttgaccagaaagaaatgaaacagatggagggtgagggaatagctccaattaaaatgaaagtatttcttgaagatacagggcaagattttcccttaatgccaaatgaagagagcagtcttccagcagttgaaaaagaacaggcgagcactgaacatcaaagtagaacatctgaggaaatatctttaaatgatgctggagtagaattgaaatcaacaaagcaggatggtgataaatccctttctgctgtaccagatattggtcagtgtcatcaggatgagttggaaaggttaaaaagtcaaattttggagctcgagctaaactttcataaagcacaagaaatctatgagaaaaatttagatgagaaagctaaggaaattagcaacctaaaccagttgattgaggagtttaagaaaaatgctgacaacaacagcagtgcattcactgctttgtctgaagaaagagaccagcttctctctcaggtgaaggaacttagcatggtaacagaattgagggctcaggtaaagcaactggaaatgaaccttgcagaagcagaaaggcaaagaagacttgattatgaaagccaaactgcccatgacaacctgctcactgaacagatccatagtctcagcatagaagccaaatctaaagatgtgaaaattgaagttttacagaatgaactggatgatgtgcagcttcagttttctgagcagagtaccctgataagaagcctgcaaagccagctgcaaaataaggaaagtgaagtgcttgagggggcagaacgtgtaaggcatatctcaagtaaagtggaagaactgtcccaggctctttcacagaaggaacttgaaataacaaaaatggatcagctcttactagagaaaaagagagatgtggaaaccctccaacaaaccatcgaggagaaggatcaacaagtgacagaaatcagctttagtatgactgagaaaatggttcagcttaatgaagagaagttttctcttggggttgaaattaagactcttaaagaacagctaaatttattatccagagctgaggaagcaaaaaaagagcaggtggaagaagataatgaagtttcttctggccttaaacaaaattatgatgagatgagcccagcaggacaaataagtaaggaagaacttcagcatgaatttgaccttctgaagaaagaaaatgagcagagaaagagaaagctccaggcagctcttattaacagaaaggagcttctgcaaagagtcagtagattggaagaagaattagccaacttgaaagatgaatctaagaaagaaatcccactcagtgagactgagaggggagaagtggaagaagataaagaaaacaaagaatactcagaaaaatgtgtgacttctaagtgccaagaaatagaaatttatttaaaacagacaatatctgagaaagaagtggaactacagcatataaggaaggatttggaagaaaagctggcagctgaagagcaattccaggctctggtcaaacagatgaatcagaccttgcaagataaaacaaaccaaatagatttgctccaagcagaaatcagtgaaaaccaagcaattatccagaagttaatcacaagtaacacggatgcaagtgatggggactccgtagcacttgtaaaggaaacagtggtgataagtccaccttgtacaggtagtagtgaacactggaaaccagaactagaagaaaagatactggcccttgaaaaagaaaaggagcaacttcaaaagaagctacaggaagccttaacctcccgcaaggcaattcttaaaaaggcacaggagaaagaaagacatctcagggaggagctaaagcaacagaaagatgactataatcgcttgcaagaacagtttgatgagcaaagcaaggaaaatgagaatattggagaccagctaaggcaactccagattcaagtaagggaatccatagacggaaaactcccaagcacagaccagcaggaatcgtgttcttccactccaggtttagaagaacctttattcaaagccacagaacagcatcacactcaacctgttttagagtccaacttgtgcccagactggccttctcattctgaagatgcgagtgctctgcagggcggaacttctgttgcccagattaaggcccagctgaaggaaatagaggctgagaaagtagagttagaattgaaagttagttctacaacaagtgagcttactaaaaaatcagaagaggtatttcagttacaagagcagataaataaacagggtttagaaatcgagagtctaaagacagtatcccatgaagctgaagtccatgccgaaagcctgcagcagaaattggaaagcagccaactacaaattgctggcctagaacatctaagagaattgcaacctaaactggatgaactgcaaaaactcataagcaaaaaggaagaagacgttagctacctttctggacaacttagtgagaaagaagcagctctcactaaaatacagacagagataatagaacaagaagatttaattaaggctctgcatacacagctagaaatgcaagccaaagagcatgatgagaggataaagcagctacaggtggaactttgtgaaatgaagcaaaaaccagaagagattggagaagaaagtagagcaaagcaacaaatacaaaggaaactgcaagctgcccttatttcccgaaaagaagcactaaaagaaaacaaaagtctccaagaggaattgtctttggccagaggtaccattgaacgtctcaccaagtctctggcagatgtggaaagccaagtttctgctcaaaataaagaaaaagatacggtcttaggaaggttagctcttcttcaagaagaaagagacaaactcattacagaaatggacaggtctttattggaaaatcagagtctcagcagctcctgtgaaagtctaaaactagctctagagggtcttactgaagacaaggaaaagttagtgaaggaaattgaatctttgaaatcttctaagattgcagaaagtactgagtggcaagagaaacacaaggagctacaaaaagagtatgaaattcttctgcagtcctatgagaatgttagtaatgaagcagaaaggattcagcatgtggtggaagctgtgaggcaagagaaacaagaactgtatggcaagttaagaagcacagaggcaaacaagaaggagacagaaaagcagttgcaggaagctgagcaagaaatggaggaaatgaaagaaaagatgagaaagtttgctaaatctaaacagcagaaaatcctagagctggaagaagagaatgaccggcttagggcagaggtgcaccctgcaggagatacagctaaagagtgtatggaaacacttctttcttccaatgccagcatgaaggaagaacttgaaagggtcaaaatggagtatgaaaccctttctaagaagtttcagtctttaatgtctgagaaagactctctaagtgaagaggttcaagatttaaagcatcagatagaagataatgtatctaaacaagctaacctagaggccaccgagaaacatgataaccaaacgaatgtcactgaagagggaacacagtctataccaggtgagactgaagagcaagactctctgagtatgagcacaagacctacatgttcagaatcggttccatcagcgaagagtgccaaccctgctgtaagtaaggatttcagctcacatgatgaaattaataactacctacagcagattgatcagctcaaagaaagaattgctggattagaggaggagaagcagaaaaacaaggaatttagccagactttagaaaatgagaaaaataccttactgagtcagatatcaacaaaggatggtgaactaaaaatgcttcaggaggaagtaaccaaaatgaacctgttaaatcagcaaatccaagaagaactctccagagttaccaaactaaaggagacagcagaagaagagaaagatgatttggaagagaggcttatgaatcaattagcagaacttaatggaagcattgggaattactgtcaggatgttacagatgcccaaataaaaaatgagctattggaatctgaaatgaagaaccttaaaaagtgtgtgagtgaattggaagaagaaaagcagcagttagtcaaggaaaaaactaaggtggaatcagaaatacgaaaggaatatttggagaaaatacaaggtgctcagaaagaacccggaaataaaagccatgcaaaggaacttcaggaactgttaaaagaaaaacaacaagaagtaaagcagctacagaaggactgcatcaggtatcaagagaaaattagtgctctggagagaactgttaaagctctagaatttgttcaaactgaatctcaaaaagatttggaaataaccaaagaaaatctggctcaagcagttgaacaccgcaaaaaggcacaagcagaattagctagcttcaaagtcctgctagatgacactcaaagtgaagcagcaagggtcctagcagacaatctcaagttgaaaaaggaacttcagtcaaataaagaatcagttaaaagccagatgaaacaaaaggatgaagatcttgagcgaagactggaacaggcagaagagaagcacctgaaagagaagaagaatatgcaagagaaactggatgctttgcgcagagaaaaagtccacttggaagagacaattggagagattcaggttactttgaacaagaaagacaaggaagttcagcaacttcaggaaaacttggacagtactgtgacccagcttgcagcctttactaagagcatgtcttccctccaggatgatcgtgacagggtgatagatgaagctaagaaatgggagaggaagtttagtgatgcgattcaaagcaaagaagaagaaattagactcaaagaagataattgcagtgttctaaaggatcaacttagacagatgtccatccatatggaagaattaaagattaacatttccaggcttgaacatgacaagcagatttgggagtccaaggcccagacagaggtccagcttcagcagaaggtctgtgatactctacagggggaaaacaaagaacttttgtcccagctagaagagacacgccacctataccacagttctcagaatgaattagctaagttggaatcagaacttaagagtctcaaagaccagttgactgatttaagtaactctttagaaaaatgtaaggaacaaaaaggaaacttggaagggatcataaggcagcaagaggctgatattcaaaattctaagttcagttatgaacaactggagactgatcttcaggcctccagagaactgaccagtaggctgcatgaagaaataaatatgaaagagcaaaagattataagcctgctttctggcaaggaagaggcaatccaagtagctattgctgaactgcgtcagcaacatgataaagaaattaaagagctggaaaacctgctgtcccaggaggaagaggagaatattgttttagaagaggagaacaaaaaggctgttgataaaaccaatcagcttatggaaacactgaaaaccatcaaaaaggaaaacattcagcaaaaggcacagttggattcctttgttaaatccatgtcttctctccaaaatgatcgagaccgcatagtgggtgactatcaacagctggaagagcgacatctctctataatcttggaaaaagaccaactcatccaagaggctgctgcagagaataataagcttaaagaagaaatacgaggcttgagaagtcatatggatgatctcaattctgagaatgccaagctagatgcagaactgatccaatatagagaagacctgaaccaagtgataacaataaaggacagccaacaaaagcagcttcttgaagttcaacttcagcaaaataaggagctggaaaataaatatgctaaattagaagaaaagctgaaggaatctgaggaagcaaatgaggatctgcggaggtcctttaatgccctacaagaagagaaacaagatttatctaaagagattgagagtttgaaagtatctatatcccagctaacaagacaagtaacagccttgcaagaagaaggtactttaggactctatcatgcccagttaaaagtaaaagaagaagaggtacacaggttaagtgctttgttttcctcctctcaaaagagaattgcagaactggaagaagaattggtttgtgttcaaaaggaagctgccaagaaggtaggtgaaattgaagataaactgaagaaagaattaaagcatcttcatcatgatgcagggataatgagaaatgaaactgaaacagcagaagagagagtggcagagctagcaagagatttggtggagatggaacagaaattactcatggtcaccaaagaaaataaaggtctcacagcacaaattcagtcttttggaaggtctatgagttccttgcaaaatagtagagatcatgccaatgaggaacttgatgaactgaaaaggaaatatgatgccagtctgaaggaattggcacagttgaaagaacagggactcttaaacagagagagagatgctcttctttctgaaaccgccttttcaatgaactccactgaggagaatagcttgtctcaccttgagaaacttaaccaacagctcctatccaaagatgagcaattgcttcacttgtcctcacaactagaagattcttataaccaagtgcagtccttttccaaggctatggccagtctgcagaatgagagagatcacctgtggaatgagctggagaaatttcgaaagtcagaggaagggaagcagaggtctgcagctcagccttccaccagcccagctgaagtacagagtttaaaaaaagctatgtcttcactccaaaatgacagagacagactactgaaggaattgaagaatctgcagcagcaatacttacagattaatcaagagatcactgagttacatccactgaaggctcaacttcaggagtatcaagataagacaaaagcatttcagattatgcaagaagagctcaggcaggaaaacctctcctggcagcatgagctgcatcagctcaggatggagaagagttcctgggaaatacatgagaggagaatgaaggaacagtaccttatggctatctcagataaagatcagcagctcagtcatctgcagaatcttataagggaattgaggtcttcttcctcccagactcagcctctcaaagtgcaataccaaagacaggcatccccagagacatcagcttccccagatgggtcacaaaatctggtttatgagacagaacttctcaggacccagctcaatgacagcttaaaggaaattcaccaaaaggagttaagaattcagcaactgaacagcaacttctctcagctactggaagagaaaaacaccctttccattcagctctgcgataccagtcagagtcttcgtgagaaccagcagcactatggtgaccttttaaatcactgtgcagtcttggagaagcaggttcaagagctgcaggcggggccactaaatatagatgttgctccaggagctccccaggaaaagaatggagttcacagaaagagtgaccctgaggaactaagggaaccgcagcaaagcttttctgaagctcagcagcagctatgcaacaccagacaggaagtgaatgaattaaggaagctgctggaagaagaacgagaccaaagagtggctgctgagaatgctctctctgtggccgaggagcagatcagacggttagagcacagtgaatgggactcttcccggactcctatcattggctcctgtggcactcaggagcaggcactgttaatagatcttacaagcaacagttgtcgaaggacccggagtggcgttggatggaagcgagtcctgcgttcactctgtcattcacggacccgagtgccacttctagcagccatctactttctaatgattcatgtcctgctcattctgtgttttacgggccatctatagacttagttgttactctttggaccactcccctcaaaacttggaattctctcacctctaacatcagaacatcaattccagtggaacagtcttcccatttacaggtcttctctccaactcttcacggaaagtgcctgcaaaaacagaggtggatacgaggacaggttggagctgcagggactggcgagtctgctttcttctactgccctgagcctgaacgcttctgcttaatctgagaatcacatttggtttgttgagcctaatatttgttgagattttgcaggaccctgatcttttgtggtcctgtaaaagatactgaggaatgtctttcagccaagccaagaggatggtttcaataaacctaataatctgaagttcagtatcattttgattgataactttctttgccttgtttgcctgtattttctcctgtttcagggggaaggtggctctgcataaacagagttcagggaaatgaacatgtcacctcataggacatctgatttaggtctcttgcagaatagggtggtgaaagctgaaggaactccctaggggttttagctgttagatcacatgggaggacagcatcttcttccctgccaatttcagatataattggagggagaatttcaggtcttagactataaggatagaatccctttgcttttgcccttgatcacatgtatactaaggtattaagtggcccaagtctttcctttcaccaaagggcagggagaagtgtctatggacagcagggttccaattcttgtcattccaggaatatctgaatattcctggaatgtggaccctgagacagtgctcaggggccactgggagccaatattaggcattgactctcagccaggagtctgactggtctaacaccacactgcaactcctgacctcttgaagtactaagctactttgctgttagtgacagttattacagtttctcagccccattgtctctgccctctgtggcaatggaaggagaatatagagaagacaaaattaaatatagatagacctgagaaggacagccaggatagaattccatttgtgcctattccctgcctcccctcccctcccccatcctaccagttggttattttctcattgcatacgtgatgtgttcactgcctagcctctccctaaagaagagagaagacaagtgggctgactgatctgctctaaatctactgtggtgattaaatcttggttacaacatcctgggaagtttcctgaacaactgtaaaataataaaattattttcagaatgaaaaaaaaaaaaaccccgggcttatgtccggggggaacaaggttgaagggcctggccagtggtccgaccactcttgaaaggggaaccggggcccaaagggcgataataaac

SEQ ID NO: 567308 - DNA, 475 bp, Homo sapiens
  misc_feature (39)..(39): n is a, c, g, or t
ctctgggcccttttcgaggatcccccccagaaaaaccgntacattttggcccttttttccaagcggaaagccctcagcagagaactctatgaatattgtattaaagaaggctatgccgcccaaaccctggttgcaaaatggaaaaagcaaggatattagaacttgtgctgcctgcggggcattcaaacccgggaccccaacttcgggacgaactgcattttccgggggcccaaaaacaagctggaagtgggccgcatcatcgagggccccccctggggctgttgtggctgctttggcttaggctggcgcgcccccccctggactttggactttgcaggtttctgcctgtcccccccccccctttctgggagcaacgagcagtgccccaggcccgagttggagcccggtttttatggggaaggcttccctgtttatcagctgtgatttgtaaaaataaaatctttccatctctcga

SEQ ID NO: 567309 - DNA, 11975 bp, Homo sapiens
  misc_feature (603)..(603): n is a, c, g, or t
  misc_feature (618)..(618): n is a, c, g, or t
  misc_feature (676)..(676): n is a, c, g, or t
  misc_feature (685)..(685): n is a, c, g, or t
  misc_feature (1078)..(1078): n is a, c, g, or t
  misc_feature (1116)..(1116): n is a, c, g, or t
ttttttttttatagtgcatgcaggaaattgcaattttatttatgtttgtattgatacatatttgtacatatttatggggtgtggtagtttgatatatgcatacaatgtgtaatgatcaaatcagggtgtttaggatatctatcacctcaaacatttatcatttttgtgtttggaacatttctaatctcctagttattttgaaatatataacatattgttaactatagtcaccctactgtgctatcaaacacttgaacttattccttctatctacgtttgtacccattaaccaatctcttccctccctcccccaactccaccttcccagcctctggtacttatctctactccatgagatcaactttttaagctcccacatgagtgagaccatgggatatttgtctttctgtgccagacttatttcacttagaataatgacctccagttccgtaagatgggcagccaggaaaggccttacttagctgatgtttgaattgtgaagttatgtaatcattaagatgagtatacatacaatgggccagctgagtgcacagcaagattcaataaattcaaactaacattactcttattgccaagagagtncctgaaatgacagcncattggaaactggctactttccttccctttccttaggggtttaaggaaagcatgagtnatttcagtnttttgctggagctcctcactgacactcattgcagagcctgagccctcaactctcaatctttgcttaggtcctggcttaggctccactttgtaagaggcaccttcctagtattcactactctctctctcacaatcatgtccttacagacattgctgatcctctttcatactgacaccgggttctagtccgagttccatcactaagtcgctgtttgactttgggcaagttacttctgtggttaattatttttcatcaacaaaatcaaaaggtgaaactagacgaacaactaagaggctccagtattttttcaatctaagagtcccatatcccccactcccttctcacagctcattcaacaatcctaatggcagcgggtgcccgcagtctcaagtntctgccgaagcccaagccgctgtctcggtcagtcacanccgacgaagaggaggaattggaggaagccagcataaccacctcacactgagaacatctgacctttcccagaacgcccgcccactcgacacttcctgtccctccccagatcttgttccggggcacctactcgggtctaatcactcccctcattcactctttagggtccattgctgtttctttgaggaagcggagcatcttctgtcgttgattggtttccgtcattgttgataggttggtaacaaacaaggtgtgcctggtctcctggtaacgtcctgccgatagtcctgattggtcggtgtcttaatcccatcttccgtcccaactgctagtggctgagtccctggcggggcgcggcggtggaaggtgtcgcgtacgggcttcccgagctgacgtggcttgaattgggaggggggcagctggagcctcaggcggcagcgcttctagaaatgctgagccgattatcaggattagcaaatgttgttttgcatgaattatcaggagatgatgacactgatcagaatatgagggctcccctagaccctgaattacaccaagaatctgacatggaatttaataatactacacaagaagatgttcaggagcgcctggcttatgcagagcaattggtggtggagctaaaagatattattagacagaaggatgttcaactgcagcagaaagatgaagctctacaggaagagagaaaagctgctgataacaaaattaaaaaactaaaacttcatgcgaaggccaaattaacttctttgaataaatacatagaagaaatgaaagcacaaggagggactgttctgcctacagaacctcagtcagaggagcaactttccaagcatgacaagagttctacagaggaagagatggaaatagaaaagataaaacataagctccaggagaaggaggaactaatcagcactttgcaagcccagcttactcaggcacaggcagaacaacctgcacagagttctacagagatggaagaatttgtaatgatgaagcaacagctccaggagaaggaagaattcattagcactttacaagcccagctcagccagacacaggcagagcaagctgcacagcaggtggtccgagagaaagatgcccgctttgaaacacaagttcgtcttcatgaagatgagcttcttcagttagtaacccaggcagatgtggaaacagagatgcaacagaaattgagggtgctgcaaaggaagcttgaggaacacgaagaatccttggtgggccgtgctcaggtcgttgacttgctgcaacaggagctgactgctgctgagcagagaaaccagattctctctcagcagttacagcagatggaagctgagcataatactttgaggaacactgtggaaacagaaagagaggagtccaagattctactggaaaagatggaacttgaagtggcagagagaaaattatccttccataatctgcaggaagaaatgcatcatcttttagaacagtttgagcaagcaggccaagcccaggctgaactagagtctcggtatagtgctttggagcagaagcacaaagcagaaatggaagagaagacctctcatattttgagtcttcaaaagactggacaagagctgcagtctgcctgtgatgctctaaaggatcaaaattcaaagcttctccaagataagaatgaacaggcagttcagtcagcccagaccattcagcaactggaagatcagctccagcaaaaatccaaagaaattagccaatttctaaatagactgcccttgcaacaacatgaaacagcatctcagacttctttcccagatgtttataatgagggcacacaggcagtcactgaggagaatattgcttctttgcagaagagagtggtagaactagagaatgaaaagggagccttgctccttagttctatagagctggaggagctgaaagctgagaatgaaaaactgtcttctcagattactctcctagaggctcagaatagaactggggaggcagacagagaagtcagtgagatcagcattgttgatattgccaacaagaggagctcttctgctgaggaaagtggacaagatgttctagaaaacacattttctcagaaacataaagaattatcagttttattgttggaaatgaaagaagctcaagaggaaattgcatttcttaaattacagctccagggaaaaagggctgaggaagcagatcatgaggtccttgaccagaaagaaatgaaacagatggagggtgagggaatagctccaattaaaatgaaagtatttcttgaagatacagggcaagattttcccttaatgccaaatgaagagagcagtcttccagcagttgaaaaagaacaggcgagcactgaacatcaaagtagaacatctgaggaaatatctttaaatgatgctggagtagaattgaaatcaacaaagcaggatggtgataaatccctttctgctgtaccagatattggtcagtgtcatcaggatgagttggaaaggttaaaaagtcaaattttggagctcgagctaaactttcataaagcacaagaaatctatgagaaaaatttagatgagaaagctaaggaaattagcaacctaaaccagttgattgaggagtttaagaaaaatgctgacaacaacagcagtgcattcactgctttgtctgaagaaagagaccagcttctctctcaggtgaaggaacttagcatggtaacagaattgagggctcaggtaaagcaactggaaatgaaccttgcagaagcagaaaggcaaagaagacttgattatgaaagccaaactgcccatgacaacctgctcactgaacagatccatagtctcagcatagaagccaaatctaaagatgtgaaaattgaagttttacagaatgaactggatgatgtgcagcttcagttttctgagcagagtaccctgataagaagcctgcaaagccagctgcaaaataaggaaagtgaagtgcttgagggggcagaacgtgtaaggcatatctcaagtaaagtggaagaactgtcccaggctctttcacagaaggaacttgaaataacaaaaatggatcagctcttactagagaaaaagagagatgtggaaaccctccaacaaaccatcgaggagaaggatcaacaagtgacagaaatcagctttagtatgactgagaaaatggttcagcttaatgaagagaagttttctcttggggttgaaattaagactcttaaagaacagctaaatttattatccagagctgaggaagcaaaaaaagagcaggtggaagaagataatgaagtttcttctggccttaaacaaaattatgatgagatgagcccagcaggacaaataagtaaggaagaacttcagcatgaatttgaccttctgaagaaagaaaatgagcagagaaagagaaagctccaggcagctcttattaacagaaaggagcttctgcaaagagtcagtagattggaagaagaattagccaacttgaaagatgaatctaagaaagaaatcccactcagtgagactgagaggggagaagtggaagaagataaagaaaacaaagaatactcagaaaaatgtgtgacttctaagtgccaagaaatagaaatttatttaaaacagacaatatctgagaaagaagtggaactacagcatataaggaaggatttggaagaaaagctggcagctgaagagcaattccaggctctggtcaaacagatgaatcagaccttgcaagataaaacaaaccaaatagatttgctccaagcagaaatcagtgaaaaccaagcaattatccagaagttaatcacaagtaacacggatgcaagtgatggggactccgtagcacttgtaaaggaaacagtggtgataagtccaccttgtacaggtagtagtgaacactggaaaccagaactagaagaaaagatactggcccttgaaaaagaaaaggagcaacttcaaaagaagctacaggaagccttaacctcccgcaaggcaattcttaaaaaggcacaggagaaagaaagacatctcagggaggagctaaagcaacagaaagatgactataatcgcttgcaagaacagtttgatgagcaaagcaaggaaaatgagaatattggagaccagctaaggcaactccagattcaagtaagggaatccatagacggaaaactcccaagcacagaccagcaggaatcgtgttcttccactccaggtttagaagaacctttattcaaagccacagaacagcatcacactcaacctgttttagagtccaacttgtgcccagactggccttctcattctgaagatgcgagtgctctgcagggcggaacttctgttgcccagattaaggcccagctgaaggaaatagaggctgagaaagtagagttagaattgaaagttagttctacaacaagtgagcttactaaaaaatcagaagaggtatttcagttacaagagcagataaataaacagggtttagaaatcgagagtctaaagacagtatcccatgaagctgaagtccatgccgaaagcctgcagcagaaattggaaagcagccaactacaaattgctggcctagaacatctaagagaattgcaacctaaactggatgaactgcaaaaactcataagcaaaaaggaagaagacgttagctacctttctggacaacttagtgagaaagaagcagctctcactaaaatacagacagagataatagaacaagaagatttaattaaggctctgcatacacagctagaaatgcaagccaaagagcatgatgagaggataaagcagctacaggtggaactttgtgaaatgaagcaaaaaccagaagagattggagaagaaagtagagcaaagcaacaaatacaaaggaaactgcaagctgcccttatttcccgaaaagaagcactaaaagaaaacaaaagtctccaagaggaattgtctttggccagaggtaccattgaacgtctcaccaagtctctggcagatgtggaaagccaagtttctgctcaaaataaagaaaaagatacggtcttaggaaggttagctcttcttcaagaagaaagagacaaactcattacagaaatggacaggtctttattggaaaatcagagtctcagcagctcctgtgaaagtctaaaactagctctagagggtcttactgaagacaaggaaaagttagtgaaggaaattgaatctttgaaatcttctaagattgcagaaagtactgagtggcaagagaaacacaaggagctacaaaaagagtatgaaattcttctgcagtcctatgagaatgttagtaatgaagcagaaaggattcagcatgtggtggaagctgtgaggcaagagaaacaagaactgtatggcaagttaagaagcacagaggcaaacaagaaggagacagaaaagcagttgcaggaagctgagcaagaaatggaggaaatgaaagaaaagatgagaaagtttgctaaatctaaacagcagaaaatcctagagctggaagaagagaatgaccggcttagggcagaggtgcaccctgcaggagatacagctaaagagtgtatggaaacacttctttcttccaatgccagcatgaaggaagaacttgaaagggtcaaaatggagtatgaaaccctttctaagaagtttcagtctttaatgtctgagaaagactctctaagtgaagaggttcaagatttaaagcatcagatagaagataatgtatctaaacaagctaacctagaggccaccgagaaacatgataaccaaacgaatgtcactgaagagggaacacagtctataccaggtgagactgaagagcaagactctctgagtatgagcacaagacctacatgttcagaatcggttccatcagcgaagagtgccaaccctgctgtaagtaaggatttcagctcacatgatgaaattaataactacctacagcagattgatcagctcaaagaaagaattgctggattagaggaggagaagcagaaaaacaaggaatttagccagactttagaaaatgagaaaaataccttactgagtcagatatcaacaaaggatggtgaactaaaaatgcttcaggaggaagtaaccaaaatgaacctgttaaatcagcaaatccaagaagaactctccagagttaccaaactaaaggagacagcagaagaagagaaagatgatttggaagagaggcttatgaatcaattagcagaacttaatggaagcattgggaattactgtcaggatgttacagatgcccaaataaaaaatgagctattggaatctgaaatgaagaaccttaaaaagtgtgtgagtgaattggaagaagaaaagcagcagttagtcaaggaaaaaactaaggtggaatcagaaatacgaaaggaatatttggagaaaatacaaggtgctcagaaagaacccggaaataaaagccatgcaaaggaacttcaggaactgttaaaagaaaaacaacaagaagtaaagcagctacagaaggactgcatcaggtatcaagagaaaattagtgctctggagagaactgttaaagctctagaatttgttcaaactgaatctcaaaaagatttggaaataaccaaagaaaatctggctcaagcagttgaacaccgcaaaaaggcacaagcagaattagctagcttcaaagtcctgctagatgacactcaaagtgaagcagcaagggtcctagcagacaatctcaagttgaaaaaggaacttcagtcaaataaagaatcagttaaaagccagatgaaacaaaaggatgaagatcttgagcgaagactggaacaggcagaagagaagcacctgaaagagaagaagaatatgcaagagaaactggatgctttgcgcagagaaaaagtccacttggaagagacaattggagagattcaggttactttgaacaagaaagacaaggaagttcagcaacttcaggaaaacttggacagtactgtgacccagcttgcagcctttactaagagcatgtcttccctccaggatgatcgtgacagggtgatagatgaagctaagaaatgggagaggaagtttagtgatgcgattcaaagcaaagaagaagaaattagactcaaagaagataattgcagtgttctaaaggatcaacttagacagatgtccatccatatggaagaattaaagattaacatttccaggcttgaacatgacaagcagatttgggagtccaaggcccagacagaggtccagcttcagcagaaggtctgtgatactctacagggggaaaacaaagaacttttgtcccagctagaagagacacgccacctataccacagttctcagaatgaattagctaagttggaatcagaacttaagagtctcaaagaccagttgactgatttaagtaactctttagaaaaatgtaaggaacaaaaaggaaacttggaagggatcataaggcagcaagaggctgatattcaaaattctaagttcagttatgaacaactggagactgatcttcaggcctccagagaactgaccagtaggctgcatgaagaaataaatatgaaagagcaaaagattataagcctgctttctggcaaggaagaggcaatccaagtagctattgctgaactgcgtcagcaacatgataaagaaattaaagagctggaaaacctgctgtcccaggaggaagaggagaatattgttttagaagaggagaacaaaaaggctgttgataaaaccaatcagcttatggaaacactgaaaaccatcaaaaaggaaaacattcagcaaaaggcacagttggattcctttgttaaatccatgtcttctctccaaaatgatcgagaccgcatagtgggtgactatcaacagctggaagagcgacatctctctataatcttggaaaaagaccaactcatccaagaggctgctgcagagaataataagcttaaagaagaaatacgaggcttgagaagtcatatggatgatctcaattctgagaatgccaagctagatgcagaactgatccaatatagagaagacctgaaccaagtgataacaataaaggacagccaacaaaagcagcttcttgaagttcaacttcagcaaaataaggagctggaaaataaatatgctaaattagaagaaaagctgaaggaatctgaggaagcaaatgaggatctgcggaggtcctttaatgccctacaagaagagaaacaagatttatctaaagagattgagagtttgaaagtatctatatcccagctaacaagacaagtaacagccttgcaagaagaaggtactttaggactctatcatgcccagttaaaagtaaaagaagaagaggtacacaggttaagtgctttgttttcctcctctcaaaagagaattgcagaactggaagaagaattggtttgtgttcaaaaggaagctgccaagaaggtaggtgaaattgaagataaactgaagaaagaattaaagcatcttcatcatgatgcagggataatgagaaatgaaactgaaacagcagaagagagagtggcagagctagcaagagatttggtggagatggaacagaaattactcatggtcaccaaagaaaataaaggtctcacagcacaaattcagtcttttggaaggtctatgagttccttgcaaaatagtagagatcatgccaatgaggaacttgatgaactgaaaaggaaatatgatgccagtctgaaggaattggcacagttgaaagaacagggactcttaaacagagagagagatgctcttctttctgaaaccgccttttcaatgaactccactgaggagaatagcttgtctcaccttgagaaacttaaccaacagctcctatccaaagatgagcaattgcttcacttgtcctcacaactagaagattcttataaccaagtgcagtccttttccaaggctatggccagtctgcagaatgagagagatcacctgtggaatgagctggagaaatttcgaaagtcagaggaagggaagcagaggtctgcagctcagccttccaccagcccagctgaagtacagagtttaaaaaaagctatgtcttcactccaaaatgacagagacagactactgaaggaattgaagaatctgcagcagcaatacttacagattaatcaagagatcactgagttacatccactgaaggctcaacttcaggagtatcaagataagacaaaagcatttcagattatgcaagaagagctcaggcaggaaaacctctcctggcagcatgagctgcatcagctcaggatggagaagagttcctgggaaatacatgagaggagaatgaaggaacagtaccttatggctatctcagataaagatcagcagctcagtcatctgcagaatcttataagggaattgaggtcttcttcctcccagactcagcctctcaaagtgcaataccaaagacaggcatccccagagacatcagcttccccagatgggtcacaaaatctggtttatgagacagaacttctcaggacccagctcaatgacagcttaaaggaaattcaccaaaaggagttaagaattcagcaactgaacagcaacttctctcagctactggaagagaaaaacaccctttccattcagctctgcgataccagtcagagtcttcgtgagaaccagcagcactatggtgaccttttaaatcactgtgcagtcttggagaagcaggttcaagagctgcaggcggggccactaaatatagatgttgctccaggagctccccaggaaaagaatggagttcacagaaagagtgaccctgaggaactaagggaaccgcagcaaagcttttctgaagctcagcagcagctatgcaacaccagacaggaagtgaatgaattaaggaagctgctggaagaagaacgagaccaaagagtggctgctgagaatgctctctctgtggccgaggagcagatcagacggttagagcacagtgaatgggactcttcccggactcctatcattggctcctgtggcactcaggagcaggcactgttaatagatcttacaagcaacagttgtcgaaggacccggagtggcgttggatggaagcgagtcctgcgttcactctgtcattcacggacccgagtgccacttctagcagccatctactttctaatgattcatgtcctgctcattctgtgttttacgggccatctatagacttagttgttactctttggaccactcccctcaaaacttggaattctctcacctctaacatcagaacatcaattccagtggaacagtcttcccatttacaggtcttctctccaactcttcacggaaagtgcctgcaaaaacagaggtggatacgaggacaggttggagctgcagggactggcgagtctgctttcttctactgccctgagcctgaacgcttctgcttaatctgagaatcacatttggtttgttgagcctaatatttgttgagattttgcaggaccctgatcttttgtggtcctgtaaaagatactgaggaatgtctttcagccaagccaagaggatggtttcaataaacctaataatctgaagttcagtatcattttgattgataactttctttgccttgtttgcctgtattttctcctgtttcagggggaaggtggctctgcataaacagagttcagggaaatgaacatgtcacctcataggacatctgatttaggtctcttgcagaatagggtggtgaaagctgatctgctctaaatctactgtggtgattaaatcttggttacaacatcctgggaagtttcctgaacaactgtaaaataataaaattattttcagaatga

SEQ ID NO: 567310 - DNA, 1171 bp, Homo sapiens
ggttagaaaggagatgcggtgttgctgctggaccgtgattgggggtgctgtctgcagtgttcctgggcctccagtcttgtccctggaggcctctgtaggaagtggatgcttgatgccctgtcctgtgcctccccgaggctctgcgagcagggcgaacgtagccatggcagcgtgagcatggtatgcaccattgggggcacgcgctgttgccggtattgtgcatgctggagccgtggcttgcatgctgctggttggcgcaacttgtgtactaaggcaggggtcaggttcggccatggctatcctgcatggccagttgtaccggggactcggacgagggcccgccatagaatgacttgccgagacttccgtacgctgagagattgcatggcgcgcgtacgctcttgccgtgggcacgtggcgtcctattgactcgtcacttgcaagaatgctcaactctttagactgacaaaggttagacgtacctatgacgccgtgccaagcaagatcgagtggatagaagagaccctcaaaggtccccgatcacggagaccctctttccgaaataagagcaagaagtgtacgcgctcacaagtctaagaggctagcgccccttacctttgagggagcaaccattggcacacacgaagtcggactacttggacacggaagagggaaagatcctttgaccacttggccatgatacaccccttgaccgagggagaagacgaatcccggattcaaagggtgtcccggacatgataccaaggctttggccaaggggccaaaatcgcgccaaagcgtacaccccaatgaccaaaataccccggcgagattagggcccttcttacaaccgcggaagttggaggaacacaaagtggagccccttcattccaaattgtggggacggaagggaaaaaacccccgggaacaattttaggagaacgcaggcccacttttcccgtagggccatattggccagtacagccagagtcctagaggccacagcattgggcgaaacgattccttacaggacgttgaatgatgggggaaaaggaacagcctaggtttgagattagaccaccctataccagagacaacaccccagagccggagagaccaacccatatataaaccgaccctttagtcaccgttgggggtataggaaagtata

SEQ ID NO: 567311 - DNA, 254 bp, Homo sapiens
aggcacttgagtgtagcccatgtcagcacgtggtgccacaggaatttctcgtgcagtccgagacctctgtttgtcggaatgttcccaacatgacggcctgtctcctcaccacctctgcaacaccccaaccctgggggctgtgagactgtactgttcatatgctgactacctcacacacgctgcaccacatacgtctgcacgggtcagaacctggccgacctctctggctctcgtgaacgacggcccccccacca

SEQ ID NO: 567312 - DNA, 11895 bp, Homo sapiens
  misc_feature (603)..(603): n is a, c, g, or t
  misc_feature (618)..(618): n is a, c, g, or t
  misc_feature (676)..(676): n is a, c, g, or t
  misc_feature (685)..(685): n is a, c, g, or t
  misc_feature (1078)..(1078): n is a, c, g, or t
  misc_feature (1116)..(1116): n is a, c, g, or t
ttttttttttatagtgcatgcaggaaattgcaattttatttatgtttgtattgatacatatttgtacatatttatggggtgtggtagtttgatatatgcatacaatgtgtaatgatcaaatcagggtgtttaggatatctatcacctcaaacatttatcatttttgtgtttggaacatttctaatctcctagttattttgaaatatataacatattgttaactatagtcaccctactgtgctatcaaacacttgaacttattccttctatctacgtttgtacccattaaccaatctcttccctccctcccccaactccaccttcccagcctctggtacttatctctactccatgagatcaactttttaagctcccacatgagtgagaccatgggatatttgtctttctgtgccagacttatttcacttagaataatgacctccagttccgtaagatgggcagccaggaaaggccttacttagctgatgtttgaattgtgaagttatgtaatcattaagatgagtatacatacaatgggccagctgagtgcacagcaagattcaataaattcaaactaacattactcttattgccaagagagtncctgaaatgacagcncattggaaactggctactttccttccctttccttaggggtttaaggaaagcatgagtnatttcagtnttttgctggagctcctcactgacactcattgcagagcctgagccctcaactctcaatctttgcttaggtcctggcttaggctccactttgtaagaggcaccttcctagtattcactactctctctctcacaatcatgtccttacagacattgctgatcctctttcatactgacaccgggttctagtccgagttccatcactaagtcgctgtttgactttgggcaagttacttctgtggttaattatttttcatcaacaaaatcaaaaggtgaaactagacgaacaactaagaggctccagtattttttcaatctaagagtcccatatcccccactcccttctcacagctcattcaacaatcctaatggcagcgggtgcccgcagtctcaagtntctgccgaagcccaagccgctgtctcggtcagtcacanccgacgaagaggaggaattggaggaagccagcataaccacctcacactgagaacatctgacctttcccagaacgcccgcccactcgacacttcctgtccctccccagatcttgttccggggcacctactcgggtctaatcactcccctcattcactctttagggtccattgctgtttctttgaggaagcggagcatcttctgtcgttgattggtttccgtcattgttgataggttggtaacaaacaaggtgtgcctggtctcctggtaacgtcctgccgatagtcctgattggtcggtgtcttaatcccatcttccgtcccaactgctagtggctgagtccctggcggggcgcggcggtggaaggtgtcgcgtacgggcttcccgagctgacgtggcttgaattgggaggggggcagctggagcctcaggcggcagcgcttctagaaatgctgagccgattatcaggattagcaaatgttgttttgcatgaattatcaggagatgatgacactgatcagaatatgagggctcccctagaccctgaattacaccaagaatctgacatggaatttaataatactacacaagaagatgttcaggagcgcctggcttatgcagagcaattggtggtggagctaaaagatattattagacagaaggatgttcaactgcagcagaaagatgaagctctacaggaagagagaaaagctgctgataacaaaattaaaaaactaaaacttcatgcgaaggccaaattaacttctttgaataaatacatagaagaaatgaaagcacaaggagggactgttctgcctacagaacctcagtcagaggagcaactttccaagcatgacaagagttctacagaggaagagatggaaatagaaaagataaaacataagctccaggagaaggaggaactaatcagcactttgcaagcccagcttactcaggcacaggcagaacaacctgcacagagttctacagagatggaagaatttgtaatgatgaagcaacagctccaggagaaggaagaattcattagcactttacaagcccagctcagccagacacaggcagagcaagctgcacagcaggtggtccgagagaaagatgcccgctttgaaacacaagttcgtcttcatgaagatgagcttcttcagttagtaacccaggcagatgtggaaacagagatgcaacagaaattgagggtgctgcaaaggaagcttgaggaacacgaagaatccttggtgggccgtgctcaggtcgttgacttgctgcaacaggagctgactgctgctgagcagagaaaccagattctctctcagcagttacagcagatggaagctgagcataatactttgaggaacactgtggaaacagaaagagaggagtccaagattctactggaaaagatggaacttgaagtggcagagagaaaattatccttccataatctgcaggaagaaatgcatcatcttttagaacagtttgagcaagcaggccaagcccaggctgaactagagtctcggtatagtgctttggagcagaagcacaaagcagaaatggaagagaagacctctcatattttgagtcttcaaaagactggacaagagctgcagtctgcctgtgatgctctaaaggatcaaaattcaaagcttctccaagataagaatgaacaggcagttcagtcagcccagaccattcagcaactggaagatcagctccagcaaaaatccaaagaaattagccaatttctaaatagactgcccttgcaacaacatgaaacagcatctcagacttctttcccagatgtttataatgagggcacacaggcagtcactgaggagaatattgcttctttgcagaagagagtggtagaactagagaatgaaaagggagccttgctccttagttctatagagctggaggagctgaaagctgagaatgaaaaactgtcttctcagattactctcctagaggctcagaatagaactggggaggcagacagagaagtcagtgagatcagcattgttgatattgccaacaagaggagctcttctgctgaggaaagtggacaagatgttctagaaaacacattttctcagaaacataaagaattatcagttttattgttggaaatgaaagaagctcaagaggaaattgcatttcttaaattacagctccagggaaaaagggctgaggaagcagatcatgaggtccttgaccagaaagaaatgaaacagatggagggtgagggaatagctccaattaaaatgaaagtatttcttgaagatacagggcaagattttcccttaatgccaaatgaagagagcagtcttccagcagttgaaaaagaacaggcgagcactgaacatcaaagtagaacatctgaggaaatatctttaaatgatgctggagtagaattgaaatcaacaaagcaggatggtgataaatccctttctgctgtaccagatattggtcagtgtcatcaggatgagttggaaaggttaaaaagtcaaattttggagctcgagctaaactttcataaagcacaagaaatctatgagaaaaatttagatgagaaagctaaggaaattagcaacctaaaccagttgattgaggagtttaagaaaaatgctgacaacaacagcagtgcattcactgctttgtctgaagaaagagaccagcttctctctcaggtgaaggaacttagcatggtaacagaattgagggctcaggtaaagcaactggaaatgaaccttgcagaagcagaaaggcaaagaagacttgattatgaaagccaaactgcccatgacaacctgctcactgaacagatccatagtctcagcatagaagccaaatctaaagatgtgaaaattgaagttttacagaatgaactggatgatgtgcagcttcagttttctgagcagagtaccctgataagaagcctgcaaagccagctgcaaaataaggaaagtgaagtgcttgagggggcagaacgtgtaaggcatatctcaagtaaagtggaagaactgtcccaggctctttcacagaaggaacttgaaataacaaaaatggatcagctcttactagagaaaaagagagatgtggaaaccctccaacaaaccatcgaggagaaggatcaacaagtgacagaaatcagctttagtatgactgagaaaatggttcagcttaatgaagagaagttttctcttggggttgaaattaagactcttaaagaacagctaaatttattatccagagctgaggaagcaaaaaaagagcaggtggaagaagataatgaagtttcttctggccttaaacaaaattatgatgagatgagcccagcaggacaaataagtaaggaagaacttcagcatgaatttgaccttctgaagaaagaaaatgagcagagaaagagaaagctccaggcagctcttattaacagaaaggagcttctgcaaagagtcagtagattggaagaagaattagccaacttgaaagatgaatctaagaaagaaatcccactcagtgagactgagaggggagaagtggaagaagataaagaaaacaaagaatactcagaaaaatgtgtgacttctaagtgccaagaaatagaaatttatttaaaacagacaatatctgagaaagaagtggaactacagcatataaggaaggatttggaagaaaagctggcagctgaagagcaattccaggctctggtcaaacagatgaatcagaccttgcaagataaaacaaaccaaatagatttgctccaagcagaaatcagtgaaaaccaagcaattatccagaagttaatcacaagtaacacggatgcaagtgatggggactccgtagcacttgtaaaggaaacagtggtgataagtccaccttgtacaggtagtagtgaacactggaaaccagaactagaagaaaagatactggcccttgaaaaagaaaaggagcaacttcaaaagaagctacaggaagccttaacctcccgcaaggcaattcttaaaaaggcacaggagaaagaaagacatctcagggaggagctaaagcaacagaaagatgactataatcgcttgcaagaacagtttgatgagcaaagcaaggaaaatgagaatattggagaccagctaaggcaactccagattcaagtaagggaatccatagacggaaaactcccaagcacagaccagcaggaatcgtgttcttccactccaggtttagaagaacctttattcaaagccacagaacagcatcacactcaacctgttttagagtccaacttgtgcccagactggccttctcattctgaagatgcgagtgctctgcagggcggaacttctgttgcccagattaaggcccagctgaaggaaatagaggctgagaaagtagagttagaattgaaagttagttctacaacaagtgagcttactaaaaaatcagaagaggtatttcagttacaagagcagataaataaacagggtttagaaatcgagagtctaaagacagtatcccatgaagctgaagtccatgccgaaagcctgcagcagaaattggaaagcagccaactacaaattgctggcctagaacatctaagagaattgcaacctaaactggatgaactgcaaaaactcataagcaaaaaggaagaagacgttagctacctttctggacaacttagtgagaaagaagcagctctcactaaaatacagacagagataatagaacaagaagatttaattaaggctctgcatacacagctagaaatgcaagccaaagagcatgatgagaggataaagcagctacaggtggaactttgtgaaatgaagcaaaaaccagaagagattggagaagaaagtagagcaaagcaacaaatacaaaggaaactgcaagctgcccttatttcccgaaaagaagcactaaaagaaaacaaaagtctccaagaggaattgtctttggccagaggtaccattgaacgtctcaccaagtctctggcagatgtggaaagccaagtttctgctcaaaataaagaaaaagatacggtcttaggaaggttagctcttcttcaagaagaaagagacaaactcattacagaaatggacaggtctttattggaaaatcagagtctcagcagctcctgtgaaagtctaaaactagctctagagggtcttactgaagacaaggaaaagttagtgaaggaaattgaatctttgaaatcttctaagattgcagaaagtactgagtggcaagagaaacacaaggagctacaaaaagagtatgaaattcttctgcagtcctatgagaatgttagtaatgaagcagaaaggattcagcatgtggtggaagctgtgaggcaagagaaacaagaactgtatggcaagttaagaagcacagaggcaaacaagaaggagacagaaaagcagttgcaggaagctgagcaagaaatggaggaaatgaaagaaaagatgagaaagtttgctaaatctaaacagcagaaaatcctagagctggaagaagagaatgaccggcttagggcagaggtgcaccctgcaggagatacagctaaagagtgtatggaaacacttctttcttccaatgccagcatgaaggaagaacttgaaagggtcaaaatggagtatgaaaccctttctaagaagtttcagtctttaatgtctgagaaagactctctaagtgaagaggttcaagatttaaagcatcagatagaagataatgtatctaaacaagctaacctagaggccaccgagaaacatgataaccaaacgaatgtcactgaagagggaacacagtctataccaggtgagactgaagagcaagactctctgagtatgagcacaagacctacatgttcagaatcggttccatcagcgaagagtgccaaccctgctgtaagtaaggatttcagctcacatgatgaaattaataactacctacagcagattgatcagctcaaagaaagaattgctggattagaggaggagaagcagaaaaacaaggaatttagccagactttagaaaatgagaaaaataccttactgagtcagatatcaacaaaggatggtgaactaaaaatgcttcaggaggaagtaaccaaaatgaacctgttaaatcagcaaatccaagaagaactctccagagttaccaaactaaaggagacagcagaagaagagaaagatgatttggaagagaggcttatgaatcaattagcagaacttaatggaagcattgggaattactgtcaggatgttacagatgcccaaataaaaaatgagctattggaatctgaaatgaagaaccttaaaaagtgtgtgagtgaattggaagaagaaaagcagcagttagtcaaggaaaaaactaaggtggaatcagaaatacgaaaggaatatttggagaaaatacaaggtgctcagaaagaacccggaaataaaagccatgcaaaggaacttcaggaactgttaaaagaaaaacaacaagaagtaaagcagctacagaaggactgcatcaggtatcaagagaaaattagtgctctggagagaactgttaaagctctagaatttgttcaaactgaatctcaaaaagatttggaaataaccaaagaaaatctggctcaagcagttgaacaccgcaaaaaggcacaagcagaattagctagcttcaaagtcctgctagatgacactcaaagtgaagcagcaagggtcctagcagacaatctcaagttgaaaaaggaacttcagtcaaataaagaatcagttaaaagccagatgaaacaaaaggatgaagatcttgagcgaagactggaacaggcagaagagaagcacctgaaagagaagaagaatatgcaagagaaactggatgctttgcgcagagaaaaagtccacttggaagagacaattggagagattcaggttactttgaacaagaaagacaaggaagttcagcaacttcaggaaaacttggacagtactgtgacccagcttgcagcctttactaagagcatgtcttccctccaggatgatcgtgacagggtgatagatgaagctaagaaatgggagaggaagtttagtgatgcgattcaaagcaaagaagaagaaattagactcaaagaagataattgcagtgttctaaaggatcaacttagacagatgtccatccatatggaagaattaaagattaacatttccaggcttgaacatgacaagcagatttgggagtccaaggcccagacagaggtccagcttcagcagaaggtctgtgatactctacagggggaaaacaaagaacttttgtcccagctagaagagacacgccacctataccacagttctcagaatgaattagctaagttggaatcagaacttaagagtctcaaagaccagttgactgatttaagtaactctttagaaaaatgtaaggaacaaaaaggaaacttggaagggatcataaggcagcaagaggctgatattcaaaattctaagttcagttatgaacaactggagactgatcttcaggcctccagagaactgaccagtaggctgcatgaagaaataaatatgaaagagcaaaagattataagcctgctttctggcaaggaagaggcaatccaagtagctattgctgaactgcgtcagcaacatgataaagaaattaaagagctggaaaacctgctgtcccaggaggaagaggagaatattgttttagaagaggagaacaaaaaggctgttgataaaaccaatcagcttatggaaacactgaaaaccatcaaaaaggaaaacattcagcaaaaggcacagttggattcctttgttaaatccatgtcttctctccaaaatgatcgagaccgcatagtgggtgactatcaacagctggaagagcgacatctctctataatcttggaaaaagaccaactcatccaagaggctgctgcagagaataataagcttaaagaagaaatacgaggcttgagaagtcatatggatgatctcaattctgagaatgccaagctagatgcagaactgatccaatatagagaagacctgaaccaagtgataacaataaaggacagccaacaaaagcagcttcttgaagttcaacttcagcaaaataaggagctggaaaataaatatgctaaattagaagaaaagctgaaggaatctgaggaagcaaatgaggatctgcggaggtcctttaatgccctacaagaagagaaacaagatttatctaaagagattgagagtttgaaagtatctatatcccagctaacaagacaagtaacagccttgcaagaagaaggtactttaggactctatcatgcccagttaaaagtaaaagaagaagaggtacacaggttaagtgctttgttttcctcctctcaaaagagaattgcagaactggaagaagaattggtttgtgttcaaaaggaagctgccaagaaggtaggtgaaattgaagataaactgaagaaagaattaaagcatcttcatcatgatgcagggataatgagaaatgaaactgaaacagcagaagagagagtggcagagctagcaagagatttggtggagatggaacagaaattactcatggtcaccaaagaaaataaaggtctcacagcacaaattcagtcttttggaaggtctatgagttccttgcaaaatagtagagatcatgccaatgaggaacttgatgaactgaaaaggaaatatgatgccagtctgaaggaattggcacagttgaaagaacagggactcttaaacagagagagagatgctcttctttctgaaaccgccttttcaatgaactccactgaggagaatagcttgtctcaccttgagaaacttaaccaacagctcctatccaaagatgagcaattgcttcacttgtcctcacaactagaagattcttataaccaagtgcagtccttttccaaggctatggccagtctgcagaatgagagagatcacctgtggaatgagctggagaaatttcgaaagtcagaggaagggaagcagaggtctgcagctcagccttccaccagcccagctgaagtacagagtttaaaaaaagctatgtcttcactccaaaatgacagagacagactactgaaggaattgaagaatctgcagcagcaatacttacagattaatcaagagatcactgagttacatccactgaaggctcaacttcaggagtatcaagataagacaaaagcatttcagattatgcaagaagagctcaggcaggaaaacctctcctggcagcatgagctgcatcagctcaggatggagaagagttcctgggaaatacatgagaggagaatgaaggaacagtaccttatggctatctcagataaagatcagcagctcagtcatctgcagaatcttataagggaattgaggtcttcttcctcccagactcagcctctcaaagtgcaataccaaagacaggcatccccagagacatcagcttccccagatgggtcacaaaatctggtttatgagacagaacttctcaggacccagctcaatgacagcttaaaggaaattcaccaaaaggagttaagaattcagcaactgaacagcaacttctctcagctactggaagagaaaaacaccctttccattcagctctgcgataccagtcagagtcttcgtgagaaccagcagcactatggtgaccttttaaatcactgtgcagtcttggagaagcaggttcaagagctgcaggcggggccactaaatatagatgttgctccaggagctccccaggaaaagaatggagttcacagaaagagtgaccctgaggaactaagggaaccgcagcaaagcttttctgaagctcagcagcagctatgcaacaccagacaggaagtgaatgaattaaggaagctgctggaagaagaacgagaccaaagagtggctgctgagaatgctctctctgtggccgaggagcagatcagacggttagagcacagtgaatgggactcttcccggactcctatcattggctcctgtggcactcaggagcaggcactgttaatagatcttacaagcaacagttgtcgaaggacccggagtggcgttggatggaagcgagtcctgcgttcactctgtcattcacggacccgagtgccacttctagcagccatctactttctaatgattcatgtcctgctcattctgtgttttacggccactgggagccaatattaggcattgactctcagccaggagtctgactggtctaacaccacactgcaactcctgacctcttgaagtactaagctactttgctgttagtgacagttattacagtttctcagccccattgtctctgccctctgtggcaatggaaggagaatatagagaagacaaaattaaatatagatagacctgagaaggacagccaggatagaattccatttgtgcctattccctgcctcccctcccctcccccatcctaccagttggttattttctcattgcatacgtgatgtgttcactgcctagcctctccctaaagaagagagaagacaagtgggctgactgatctgctctaaatctactgtggtgattaaatcttggttacaacatcctgggaagtttcctgaacaactgtaaaataataaaattattttcagaatgaaaaaaaaaaaaaccccgggcttatgtccggggggaacaaggttgaagggcctggccagtggtccgaccactcttgaaaggggaaccggggcccaaagggcgataataaac

SEQ ID NO: 567313 - DNA, 11457 bp, Homo sapiens
  misc_feature (603)..(603): n is a, c, g, or t
  misc_feature (618)..(618): n is a, c, g, or t
  misc_feature (676)..(676): n is a, c, g, or t
  misc_feature (685)..(685): n is a, c, g, or t
  misc_feature (1078)..(1078): n is a, c, g, or t
  misc_feature (1116)..(1116): n is a, c, g, or t
ttttttttttatagtgcatgcaggaaattgcaattttatttatgtttgtattgatacatatttgtacatatttatggggtgtggtagtttgatatatgcatacaatgtgtaatgatcaaatcagggtgtttaggatatctatcacctcaaacatttatcatttttgtgtttggaacatttctaatctcctagttattttgaaatatataacatattgttaactatagtcaccctactgtgctatcaaacacttgaacttattccttctatctacgtttgtacccattaaccaatctcttccctccctcccccaactccaccttcccagcctctggtacttatctctactccatgagatcaactttttaagctcccacatgagtgagaccatgggatatttgtctttctgtgccagacttatttcacttagaataatgacctccagttccgtaagatgggcagccaggaaaggccttacttagctgatgtttgaattgtgaagttatgtaatcattaagatgagtatacatacaatgggccagctgagtgcacagcaagattcaataaattcaaactaacattactcttattgccaagagagtncctgaaatgacagcncattggaaactggctactttccttccctttccttaggggtttaaggaaagcatgagtnatttcagtnttttgctggagctcctcactgacactcattgcagagcctgagccctcaactctcaatctttgcttaggtcctggcttaggctccactttgtaagaggcaccttcctagtattcactactctctctctcacaatcatgtccttacagacattgctgatcctctttcatactgacaccgggttctagtccgagttccatcactaagtcgctgtttgactttgggcaagttacttctgtggttaattatttttcatcaacaaaatcaaaaggtgaaactagacgaacaactaagaggctccagtattttttcaatctaagagtcccatatcccccactcccttctcacagctcattcaacaatcctaatggcagcgggtgcccgcagtctcaagtntctgccgaagcccaagccgctgtctcggtcagtcacanccgacgaagaggaggaattggaggaagccagcataaccacctcacactgagaacatctgacctttcccagaacgcccgcccactcgacacttcctgtccctccccagatcttgttccggggcacctactcgggtctaatcactcccctcattcactctttagggtccattgctgtttctttgaggaagcggagcatcttctgtcgttgattggtttccgtcattgttgataggttggtaacaaacaaggtgtgcctggtctcctggtaacgtcctgccgatagtcctgattggtcggtgtcttaatcccatcttccgtcccaactgctagtggctgagtccctggcggggcgcggcggtggaaggtgtcgcgtacgggcttcccgagctgacgtggcttgaattgggaggggggcagctggagcctcaggcggcagcgcttctagaaatgctgagccgattatcaggattagcaaatgttgttttgcatgaattatcaggagatgatgacactgatcagaatatgagggctcccctagaccctgaattacaccaagaatctgacatggaatttaataatactacacaagaagatgttcaggagcgcctggcttatgcagagcaattggtggtggagctaaaagatattattagacagaaggatgttcaactgcagcagaaagatgaagctctacaggaagagagaaaagctgctgataacaaaattaaaaaactaaaacttcatgcgaaggccaaattaacttctttgaataaatacatagaagaaatgaaagcacaaggagggactgttctgcctacagaacctcagtcagaggagcaactttccaagcatgacaagagttctacagaggaagagatggaaatagaaaagataaaacataagctccaggagaaggaggaactaatcagcactttgcaagcccagcttactcaggcacaggcagaacaacctgcacagagttctacagagatggaagaatttgtaatgatgaagcaacagctccaggagaaggaagaattcattagcactttacaagcccagctcagccagacacaggcagagcaagctgcacagcaggtggtccgagagaaagatgcccgctttgaaacacaagttcgtcttcatgaagatgagcttcttcagttagtaacccaggcagatgtggaaacagagatgcaacagaaattgagggtgctgcaaaggaagcttgaggaacacgaagaatccttggtgggccgtgctcaggtcgttgacttgctgcaacaggagctgactgctgctgagcagagaaaccagattctctctcagcagttacagcagatggaagctgagcataatactttgaggaacactgtggaaacagaaagagaggagtccaagattctactggaaaagatggaacttgaagtggcagagagaaaattatccttccataatctgcaggaagaaatgcatcatcttttagaacagtttgagcaagcaggccaagcccaggctgaactagagtctcggtatagtgctttggagcagaagcacaaagcagaaatggaagagaagacctctcatattttgagtcttcaaaagactggacaagagctgcagtctgcctgtgatgctctaaaggatcaaaattcaaagcttctccaagataagaatgaacaggcagttcagtcagcccagaccattcagcaactggaagatcagctccagcaaaaatccaaagaaattagccaatttctaaatagactgcccttgcaacaacatgaaacagcatctcagacttctttcccagatgtttataatgagggcacacaggcagtcactgaggagaatattgcttctttgcagaagagagtggtagaactagagaatgaaaagggagccttgctccttagttctatagagctggaggagctgaaagctgagaatgaaaaactgtcttctcagattactctcctagaggctcagaatagaactggggaggcagacagagaagtcagtgagatcagcattgttgatattgccaacaagaggagctcttctgctgaggaaagtggacaagatgttctagaaaacacattttctcagaaacataaagaattatcagttttattgttggaaatgaaagaagctcaagaggaaattgcatttcttaaattacagctccagggaaaaagggctgaggaagcagatcatgaggtccttgaccagaaagaaatgaaacagatggagggtgagggaatagctccaattaaaatgaaagtatttcttgaagatacagggcaagattttcccttaatgccaaatgaagagagcagtcttccagcagttgaaaaagaacaggcgagcactgaacatcaaagtagaacatctgaggaaatatctttaaatgatgctggagtagaattgaaatcaacaaagcaggatggtgataaatccctttctgctgtaccagatattggtcagtgtcatcaggatgagttggaaaggttaaaaagtcaaattttggagctcgagctaaactttcataaagcacaagaaatctatgagaaaaatttagatgagaaagctaaggaaattagcaacctaaaccagttgattgaggagtttaagaaaaatgctgacaacaacagcagtgcattcactgctttgtctgaagaaagagaccagcttctctctcaggtgaaggaacttagcatggtaacagaattgagggctcaggtaaagcaactggaaatgaaccttgcagaagcagaaaggcaaagaagacttgattatgaaagccaaactgcccatgacaacctgctcactgaacagatccatagtctcagcatagaagccaaatctaaagatgtgaaaattgaagttttacagaatgaactggatgatgtgcagcttcagttttctgagcagagtaccctgataagaagcctgcaaagccagctgcaaaataaggaaagtgaagtgcttgagggggcagaacgtgtaaggcatatctcaagtaaagtggaagaactgtcccaggctctttcacagaaggaacttgaaataacaaaaatggatcagctcttactagagaaaaagagagatgtggaaaccctccaacaaaccatcgaggagaaggatcaacaagtgacagaaatcagctttagtatgactgagaaaatggttcagcttaatgaagagaagttttctcttggggttgaaattaagactcttaaagaacagctaaatttattatccagagctgaggaagcaaaaaaagagcaggtggaagaagataatgaagtttcttctggccttaaacaaaattatgatgagatgagcccagcaggacaaataagtaaggaagaacttcagcatgaatttgaccttctgaagaaagaaaatgagcagagaaagagaaagctccaggcagctcttattaacagaaaggagcttctgcaaagagtcagtagattggaagaagaattagccaacttgaaagatgaatctaagaaagaaatcccactcagtgagactgagaggggagaagtggaagaagataaagaaaacaaagaatactcagaaaaatgtgtgacttctaagtgccaagaaatagaaatttatttaaaacagacaatatctgagaaagaagtggaactacagcatataaggaaggatttggaagaaaagctggcagctgaagagcaattccaggctctggtcaaacagatgaatcagaccttgcaagataaaacaaaccaaatagatttgctccaagcagaaatcagtgaaaaccaagcaattatccagaagttaatcacaagtaacacggatgcaagtgatggggactccgtagcacttgtaaaggaaacagtggtgataagtccaccttgtacaggtagtagtgaacactggaaaccagaactagaagaaaagatactggcccttgaaaaagaaaaggagcaacttcaaaagaagctacaggaagccttaacctcccgcaaggcaattcttaaaaaggcacaggagaaagaaagacatctcagggaggagctaaagcaacagaaagatgactataatcgcttgcaagaacagtttgatgagcaaagcaaggaaaatgagaatattggagaccagctaaggcaactccagattcaagtaagggaatccatagacggaaaactcccaagcacagaccagcaggaatcgtgttcttccactccaggtttagaagaacctttattcaaagccacagaacagcatcacactcaacctgttttagagtccaacttgtgcccagactggccttctcattctgaagatgcgagtgctctgcagggcggaacttctgttgcccagattaaggcccagctgaaggaaatagaggctgagaaagtagagttagaattgaaagttagttctacaacaagtgagcttactaaaaaatcagaagaggtatttcagttacaagagcagataaataaacagggtttagaaatcgagagtctaaagacagtatcccatgaagctgaagtccatgccgaaagcctgcagcagaaattggaaagcagccaactacaaattgctggcctagaacatctaagagaattgcaacctaaactggatgaactgcaaaaactcataagcaaaaaggaagaagacgttagctacctttctggacaacttagtgagaaagaagcagctctcactaaaatacagacagagataatagaacaagaagatttaattaaggctctgcatacacagctagaaatgcaagccaaagagcatgatgagaggataaagcagctacaggtggaactttgtgaaatgaagcaaaaaccagaagagattggagaagaaagtagagcaaagcaacaaatacaaaggaaactgcaagctgcccttatttcccgaaaagaagcactaaaagaaaacaaaagtctccaagaggaattgtctttggccagaggtaccattgaacgtctcaccaagtctctggcagatgtggaaagccaagtttctgctcaaaataaagaaaaagatacggtcttaggaaggttagctcttcttcaagaagaaagagacaaactcattacagaaatggacaggtctttattggaaaatcagagtctcagcagctcctgtgaaagtctaaaactagctctagagggtcttactgaagacaaggaaaagttagtgaaggaaattgaatctttgaaatcttctaagattgcagaaagtactgagtggcaagagaaacacaaggagctacaaaaagagtatgaaattcttctgcagtcctatgagaatgttagtaatgaagcagaaaggattcagcatgtggtggaagctgtgaggcaagagaaacaagaactgtatggcaagttaagaagcacagaggcaaacaagaaggagacagaaaagcagttgcaggaagctgagcaagaaatggaggaaatgaaagaaaagatgagaaagtttgctaaatctaaacagcagaaaatcctagagctggaagaagagaatgaccggcttagggcagaggtgcaccctgcaggagatacagctaaagagtgtatggaaacacttctttcttccaatgccagcatgaaggaagaacttgaaagggtcaaaatggagtatgaaaccctttctaagaagtttcagtctttaatgtctgagaaagactctctaagtgaagaggttcaagatttaaagcatcagatagaagataatgtatctaaacaagctaacctagaggccaccgagaaacatgataaccaaacgaatgtcactgaagagggaacacagtctataccaggtgagactgaagagcaagactctctgagtatgagcacaagacctacatgttcagaatcggttccatcagcgaagagtgccaaccctgctgtaagtaaggatttcagctcacatgatgaaattaataactacctacagcagattgatcagctcaaagaaagaattgctggattagaggaggagaagcagaaaaacaaggaatttagccagactttagaaaatgagaaaaataccttactgagtcagatatcaacaaaggatggtgaactaaaaatgcttcaggaggaagtaaccaaaatgaacctgttaaatcagcaaatccaagaagaactctccagagttaccaaactaaaggagacagcagaagaagagaaagatgatttggaagagaggcttatgaatcaattagcagaacttaatggaagcattgggaattactgtcaggatgttacagatgcccaaataaaaaatgagctattggaatctgaaatgaagaaccttaaaaagtgtgtgagtgaattggaagaagaaaagcagcagttagtcaaggaaaaaactaaggtggaatcagaaatacgaaaggaatatttggagaaaatacaaggtgctcagaaagaacccggaaataaaagccatgcaaaggaacttcaggaactgttaaaagaaaaacaacaagaagtaaagcagctacagaaggactgcatcaggtatcaagagaaaattagtgctctggagagaactgttaaagctctagaatttgttcaaactgaatctcaaaaagatttggaaataaccaaagaaaatctggctcaagcagttgaacaccgcaaaaaggcacaagcagaattagctagcttcaaagtcctgctagatgacactcaaagtgaagcagcaagggtcctagcagacaatctcaagttgaaaaaggaacttcagtcaaataaagaatcagttaaaagccagatgaaacaaaaggatgaagatcttgagcgaagactggaacaggcagaagagaagcacctgaaagagaagaagaatatgcaagagaaactggatgctttgcgcagagaaaaagtccacttggaagagacaattggagagattcaggttactttgaacaagaaagacaaggaagttcagcaacttcaggaaaacttggacagtactgtgacccagcttgcagcctttactaagagcatgtcttccctccaggatgatcgtgacagggtgatagatgaagctaagaaatgggagaggaagtttagtgatgcgattcaaagcaaagaagaagaaattagactcaaagaagataattgcagtgttctaaaggatcaacttagacagatgtccatccatatggaagaattaaagattaacatttccaggcttgaacatgacaagcagatttgggagtccaaggcccagacagaggtccagcttcagcagaaggtctgtgatactctacagggggaaaacaaagaacttttgtcccagctagaagagacacgccacctataccacagttctcagaatgaattagctaagttggaatcagaacttaagagtctcaaagaccagttgactgatttaagtaactctttagaaaaatgtaaggaacaaaaaggaaacttggaagggatcataaggcagcaagaggctgatattcaaaattctaagttcagttatgaacaactggagactgatcttcaggcctccagagaactgaccagtaggctgcatgaagaaataaatatgaaagagcaaaagattataagcctgctttctggcaaggaagaggcaatccaagtagctattgctgaactgcgtcagcaacatgataaagaaattaaagagctggaaaacctgctgtcccaggaggaagaggagaatattgttttagaagaggagaacaaaaaggctgttgataaaaccaatcagcttatggaaacactgaaaaccatcaaaaaggaaaacattcagcaaaaggcacagttggattcctttgttaaatccatgtcttctctccaaaatgatcgagaccgcatagtgggtgactatcaacagctggaagagcgacatctctctataatcttggaaaaagaccaactcatccaagaggctgctgcagagaataataagcttaaagaagaaatacgaggcttgagaagtcatatggatgatctcaattctgagaatgccaagctagatgcagaactgatccaatatagagaagacctgaaccaagtgataacaataaaggacagccaacaaaagcagcttcttgaagttcaacttcagcaaaataaggagctggaaaataaatatgctaaattagaagaaaagctgaaggaatctgaggaagcaaatgaggatctgcggaggtcctttaatgccctacaagaagagaaacaagatttatctaaagagattgagagtttgaaagtatctatatcccagctaacaagacaagtaacagccttgcaagaagaaggtactttaggactctatcatgcccagttaaaagtaaaagaagaagaggtacacaggttaagtgctttgttttcctcctctcaaaagagaattgcagaactggaagaagaattggtttgtgttcaaaaggaagctgccaagaaggtaggtgaaattgaagataaactgaagaaagaattaaagcatcttcatcatgatgcagggataatgagaaatgaaactgaaacagcagaagagagagtggcagagctagcaagagatttggtggagatggaacagaaattactcatggtcaccaaagaaaataaaggtctcacagcacaaattcagtcttttggaaggtctatgagttccttgcaaaatagtagagatcatgccaatgaggaacttgatgaactgaaaaggaaatatgatgccagtctgaaggaattggcacagttgaaagaacagggactcttaaacagagagagagatgctcttctttctgaaaccgccttttcaatgaactccactgaggagaatagcttgtctcaccttgagaaacttaaccaacagctcctatccaaagatgagcaattgcttcacttgtcctcacaactagaagattcttataaccaagtgcagtccttttccaaggctatggccagtctgcagaatgagagagatcacctgtggaatgagctggagaaatttcgaaagtcagaggaagggaagcagaggtctgcagctcagccttccaccagcccagctgaagtacagagtttaaaaaaagctatgtcttcactccaaaatgacagagacagactactgaaggaattgaagaatctgcagcagcaatacttacaggtcttctctccaactcttcacggaaagtgcctgcaaaaacagaggtggatacgaggacaggttggagctgcagggactggcgagtctgctttcttctactgccctgagcctgaacgcttctgcttaatctgagaatcacatttggtttgttgagcctaatatttgttgagattttgcaggaccctgatcttttgtggtcctgtaaaagatactgaggaatgtctttcagccaagccaagaggatggtttcaataaacctaataatctgaagttcagtatcattttgattgataactttctttgccttgtttgcctgtattttctcctgtttcagggggaaggtggctctgcataaacagagttcagggaaatgaacatgtcacctcataggacatctgatttaggtctcttgcagaatagggtggtgaaagctgaaggaactccctaggggttttagctgttagatcacatgggaggacagcatcttcttccctgccaatttcagatataattggagggagaatttcaggtcttagactataaggatagaatccctttgcttttgcccttgatcacatgtatactaaggtattaagtggcccaagtctttcctttcaccaaagggcagggagaagtgtctatggacagcagggttccaattcttgtcattccaggaatatctgaatattcctggaatgtggaccctgagacagtgctcaggggccactgggagccaatattaggcattgactctcagccaggagtctgactggtctaacaccacactgcaactcctgacctcttgaagtactaagctactttgctgttagtgacagttattacagtttctcagccccattgtctctgccctctgtggcaatggaaggagaatatagagaagacaaaattaaatatagatagacctgagaaggacagccaggatagaattccatttgtgcctattccctgcctcccctcccctcccccatcctaccagttggttattttctcattgcatacgtgatgtgttcactgcctagcctctccctaaagaagagagaagacaagtgggctgactgatctgctctaaatctactgtggtgattaaatcttggttacaacatcctgggaagtttcctgaacaactgtaaaataataaaattattttcagaatga

SEQ ID NO: 567314 - DNA, 943 bp, Homo sapiens
ggggcaccggggcggcgggttggtctacgctgtgcgcggcggacgtcaggaggcagctgtgggagctggagctggggccgcctgtgggcctctccatgtggcctgcagctgtgcagcagtatgggcccccacgccccgtgccggctggcacctgaacgaaactgcatggacacgtgtggtggcctggggtgtggaatcccttgtctcactctgtgccctgtgatctctggcatggccccattgatcctctctaactgttgtgacgtactatcccttaaccgctccatctgcccactcacttccaatcccttgtcccattgcgattggtctatccccagttatcaacgcctctttgcatctagacccaactgtcaccaccgctcattatcatcctccctactcccctttatttgggtgcccatttcctaaggtggtctcagatatttcccgcctccaataagccggacctctagccacgttgcaaccccctattctaacccctggaagcccctttccccaacgcgtcttcacactcccgagttccgggtacgggtccgcccgccctttgcactgggggttggcaccctcccccaattttctacttttgccccttggacaacacgcggatcaccatgcgctattccccggatgcacattgacaacaaaaccttttctactttggacctttttcatgctctcacagttgatcaaaccttattccccccccttgacccctccttttcccccccctcaaaccacaccaacaattcgctgtgccaattctaccctttattccccccttgacaaccccttacactctcaaccactccttttatcccacaacatccaccaaaccaatccagtcatatccgcgtcccagtccccaaaaacttacagcccgcaatcctactttcctttgacacgcattccaaaatccaggcat

SEQ ID NO: 567315 - DNA, 216 bp, Homo sapiens
tactcacaaaggtttagcagtgaatgtgtggtgagtagcccatgtgtgtggtaatatgtagaggagtataggctggatagtatgcgagtctgtagtggagatgatttgatcggagacgtgtactagcacagagagtctccagtaggttatagtgggggtaggcgaggtagcgaggctgctagaagtcatcaaaaagctgtttggggaggtagcact

SEQ ID NO: 567316 - DNA, 11510 bp, Homo sapiens
  misc_feature (603)..(603): n is a, c, g, or t
  misc_feature (618)..(618): n is a, c, g, or t
  misc_feature (676)..(676): n is a, c, g, or t
  misc_feature (685)..(685): n is a, c, g, or t
  misc_feature (1078)..(1078): n is a, c, g, or t
  misc_feature (1116)..(1116): n is a, c, g, or t
  misc_feature (11510)..(11510): n is a, c, g, or t
ttttttttttatagtgcatgcaggaaattgcaattttatttatgtttgtattgatacatatttgtacatatttatggggtgtggtagtttgatatatgcatacaatgtgtaatgatcaaatcagggtgtttaggatatctatcacctcaaacatttatcatttttgtgtttggaacatttctaatctcctagttattttgaaatatataacatattgttaactatagtcaccctactgtgctatcaaacacttgaacttattccttctatctacgtttgtacccattaaccaatctcttccctccctcccccaactccaccttcccagcctctggtacttatctctactccatgagatcaactttttaagctcccacatgagtgagaccatgggatatttgtctttctgtgccagacttatttcacttagaataatgacctccagttccgtaagatgggcagccaggaaaggccttacttagctgatgtttgaattgtgaagttatgtaatcattaagatgagtatacatacaatgggccagctgagtgcacagcaagattcaataaattcaaactaacattactcttattgccaagagagtncctgaaatgacagcncattggaaactggctactttccttccctttccttaggggtttaaggaaagcatgagtnatttcagtnttttgctggagctcctcactgacactcattgcagagcctgagccctcaactctcaatctttgcttaggtcctggcttaggctccactttgtaagaggcaccttcctagtattcactactctctctctcacaatcatgtccttacagacattgctgatcctctttcatactgacaccgggttctagtccgagttccatcactaagtcgctgtttgactttgggcaagttacttctgtggttaattatttttcatcaacaaaatcaaaaggtgaaactagacgaacaactaagaggctccagtattttttcaatctaagagtcccatatcccccactcccttctcacagctcattcaacaatcctaatggcagcgggtgcccgcagtctcaagtntctgccgaagcccaagccgctgtctcggtcagtcacanccgacgaagaggaggaattggaggaagccagcataaccacctcacactgagaacatctgacctttcccagaacgcccgcccactcgacacttcctgtccctccccagatcttgttccggggcacctactcgggtctaatcactcccctcattcactctttagggtccattgctgtttctttgaggaagcggagcatcttctgtcgttgattggtttccgtcattgttgataggttggtaacaaacaaggtgtgcctggtctcctggtaacgtcctgccgatagtcctgattggtcggtgtcttaatcccatcttccgtcccaactgctagtggctgagtccctggcggggcgcggcggtggaaggtgtcgcgtacgggcttcccgagctgacgtggcttgaattgggaggggggcagctggagcctcaggcggcagcgcttctagaaatgctgagccgattatcaggattagcaaatgttgttttgcatgaattatcaggagatgatgacactgatcagaatatgagggctcccctagaccctgaattacaccaagaatctgacatggaatttaataatactacacaagaagatgttcaggagcgcctggcttatgcagagcaattggtggtggagctaaaagatattattagacagaaggatgttcaactgcagcagaaagatgaagctctacaggaagagagaaaagctgctgataacaaaattaaaaaactaaaacttcatgcgaaggccaaattaacttctttgaataaatacatagaagaaatgaaagcacaaggagggactgttctgcctacagaacctcagtcagaggagcaactttccaagcatgacaagagttctacagaggaagagatggaaatagaaaagataaaacataagctccaggagaaggaggaactaatcagcactttgcaagcccagcttactcaggcacaggcagaacaacctgcacagagttctacagagatggaagaatttgtaatgatgaagcaacagctccaggagaaggaagaattcattagcactttacaagcccagctcagccagacacaggcagagcaagctgcacagcaggtggtccgagagaaagatgcccgctttgaaacacaagttcgtcttcatgaagatgagcttcttcagttagtaacccaggcagatgtggaaacagagatgcaacagaaattgagggtgctgcaaaggaagcttgaggaacacgaagaatccttggtgggccgtgctcaggtcgttgacttgctgcaacaggagctgactgctgctgagcagagaaaccagattctctctcagcagttacagcagatggaagctgagcataatactttgaggaacactgtggaaacagaaagagaggagtccaagattctactggaaaagatggaacttgaagtggcagagagaaaattatccttccataatctgcaggaagaaatgcatcatcttttagaacagtttgagcaagcaggccaagcccaggctgaactagagtctcggtatagtgctttggagcagaagcacaaagcagaaatggaagagaagacctctcatattttgagtcttcaaaagactggacaagagctgcagtctgcctgtgatgctctaaaggatcaaaattcaaagcttctccaagataagaatgaacaggcagttcagtcagcccagaccattcagcaactggaagatcagctccagcaaaaatccaaagaaattagccaatttctaaatagactgcccttgcaacaacatgaaacagcatctcagacttctttcccagatgtttataatgagggcacacaggcagtcactgaggagaatattgcttctttgcagaagagagtggtagaactagagaatgaaaagggagccttgctccttagttctatagagctggaggagctgaaagctgagaatgaaaaactgtcttctcagattactctcctagaggctcagaatagaactggggaggcagacagagaagtcagtgagatcagcattgttgatattgccaacaagaggagctcttctgctgaggaaagtggacaagatgttctagaaaacacattttctcagaaacataaagaattatcagttttattgttggaaatgaaagaagctcaagaggaaattgcatttcttaaattacagctccagggaaaaagggctgaggaagcagatcatgaggtccttgaccagaaagaaatgaaacagatggagggtgagggaatagctccaattaaaatgaaagtatttcttgaagatacagggcaagattttcccttaatgccaaatgaagagagcagtcttccagcagttgaaaaagaacaggcgagcactgaacatcaaagtagaacatctgaggaaatatctttaaatgatgctggagtagaattgaaatcaacaaagcaggatggtgataaatccctttctgctgtaccagatattggtcagtgtcatcaggatgagttggaaaggttaaaaagtcaaattttggagctcgagctaaactttcataaagcacaagaaatctatgagaaaaatttagatgagaaagctaaggaaattagcaacctaaaccagttgattgaggagtttaagaaaaatgctgacaacaacagcagtgcattcactgctttgtctgaagaaagagaccagcttctctctcaggtgaaggaacttagcatggtaacagaattgagggctcaggtaaagcaactggaaatgaaccttgcagaagcagaaaggcaaagaagacttgattatgaaagccaaactgcccatgacaacctgctcactgaacagatccatagtctcagcatagaagccaaatctaaagatgtgaaaattgaagttttacagaatgaactggatgatgtgcagcttcagttttctgagcagagtaccctgataagaagcctgcaaagccagctgcaaaataaggaaagtgaagtgcttgagggggcagaacgtgtaaggcatatctcaagtaaagtggaagaactgtcccaggctctttcacagaaggaacttgaaataacaaaaatggatcagctcttactagagaaaaagagagatgtggaaaccctccaacaaaccatcgaggagaaggatcaacaagtgacagaaatcagctttagtatgactgagaaaatggttcagcttaatgaagagaagttttctcttggggttgaaattaagactcttaaagaacagctaaatttattatccagagctgaggaagcaaaaaaagagcaggtggaagaagataatgaagtttcttctggccttaaacaaaattatgatgagatgagcccagcaggacaaataagtaaggaagaacttcagcatgaatttgaccttctgaagaaagaaaatgagcagagaaagagaaagctccaggcagctcttattaacagaaaggagcttctgcaaagagtcagtagattggaagaagaattagccaacttgaaagatgaatctaagaaagaaatcccactcagtgagactgagaggggagaagtggaagaagataaagaaaacaaagaatactcagaaaaatgtgtgacttctaagtgccaagaaatagaaatttatttaaaacagacaatatctgagaaagaagtggaactacagcatataaggaaggatttggaagaaaagctggcagctgaagagcaattccaggctctggtcaaacagatgaatcagaccttgcaagataaaacaaaccaaatagatttgctccaagcagaaatcagtgaaaaccaagcaattatccagaagttaatcacaagtaacacggatgcaagtgatggggactccgtagcacttgtaaaggaaacagtggtgataagtccaccttgtacaggtagtagtgaacactggaaaccagaactagaagaaaagatactggcccttgaaaaagaaaaggagcaacttcaaaagaagctacaggaagccttaacctcccgcaaggcaattcttaaaaaggcacaggagaaagaaagacatctcagggaggagctaaagcaacagaaagatgactataatcgcttgcaagaacagtttgatgagcaaagcaaggaaaatgagaatattggagaccagctaaggcaactccagattcaagtaagggaatccatagacggaaaactcccaagcacagaccagcaggaatcgtgttcttccactccaggtttagaagaacctttattcaaagccacagaacagcatcacactcaacctgttttagagtccaacttgtgcccagactggccttctcattctgaagatgcgagtgctctgcagggcggaacttctgttgcccagattaaggcccagctgaaggaaatagaggctgagaaagtagagttagaattgaaagttagttctacaacaagtgagcttactaaaaaatcagaagaggtatttcagttacaagagcagataaataaacagggtttagaaatcgagagtctaaagacagtatcccatgaagctgaagtccatgccgaaagcctgcagcagaaattggaaagcagccaactacaaattgctggcctagaacatctaagagaattgcaacctaaactggatgaactgcaaaaactcataagcaaaaaggaagaagacgttagctacctttctggacaacttagtgagaaagaagcagctctcactaaaatacagacagagataatagaacaagaagatttaattaaggctctgcatacacagctagaaatgcaagccaaagagcatgatgagaggataaagcagctacaggtggaactttgtgaaatgaagcaaaaaccagaagagattggagaagaaagtagagcaaagcaacaaatacaaaggaaactgcaagctgcccttatttcccgaaaagaagcactaaaagaaaacaaaagtctccaagaggaattgtctttggccagaggtaccattgaacgtctcaccaagtctctggcagatgtggaaagccaagtttctgctcaaaataaagaaaaagatacggtcttaggaaggttagctcttcttcaagaagaaagagacaaactcattacagaaatggacaggtctttattggaaaatcagagtctcagcagctcctgtgaaagtctaaaactagctctagagggtcttactgaagacaaggaaaagttagtgaaggaaattgaatctttgaaatcttctaagattgcagaaagtactgagtggcaagagaaacacaaggagctacaaaaagagtatgaaattcttctgcagtcctatgagaatgttagtaatgaagcagaaaggattcagcatgtggtggaagctgtgaggcaagagaaacaagaactgtatggcaagttaagaagcacagaggcaaacaagaaggagacagaaaagcagttgcaggaagctgagcaagaaatggaggaaatgaaagaaaagatgagaaagtttgctaaatctaaacagcagaaaatcctagagctggaagaagagaatgaccggcttagggcagaggtgcaccctgcaggagatacagctaaagagtgtatggaaacacttctttcttccaatgccagcatgaaggaagaacttgaaagggtcaaaatggagtatgaaaccctttctaagaagtttcagtctttaatgtctgagaaagactctctaagtgaagaggttcaagatttaaagcatcagatagaagataatgtatctaaacaagctaacctagaggccaccgagaaacatgataaccaaacgaatgtcactgaagagggaacacagtctataccaggtgagactgaagagcaagactctctgagtatgagcacaagacctacatgttcagaatcggttccatcagcgaagagtgccaaccctgctgtaagtaaggatttcagctcacatgatgaaattaataactacctacagcagattgatcagctcaaagaaagaattgctggattagaggaggagaagcagaaaaacaaggaatttagccagactttagaaaatgagaaaaataccttactgagtcagatatcaacaaaggatggtgaactaaaaatgcttcaggaggaagtaaccaaaatgaacctgttaaatcagcaaatccaagaagaactctccagagttaccaaactaaaggagacagcagaagaagagaaagatgatttggaagagaggcttatgaatcaattagcagaacttaatggaagcattgggaattactgtcaggatgttacagatgcccaaataaaaaatgagctattggaatctgaaatgaagaaccttaaaaagtgtgtgagtgaattggaagaagaaaagcagcagttagtcaaggaaaaaactaaggtggaatcagaaatacgaaaggaatatttggagaaaatacaaggtgctcagaaagaacccggaaataaaagccatgcaaaggaacttcaggaactgttaaaagaaaaacaacaagaagtaaagcagctacagaaggactgcatcaggtatcaagagaaaattagtgctctggagagaactgttaaagctctagaatttgttcaaactgaatctcaaaaagatttggaaataaccaaagaaaatctggctcaagcagttgaacaccgcaaaaaggcacaagcagaattagctagcttcaaagtcctgctagatgacactcaaagtgaagcagcaagggtcctagcagacaatctcaagttgaaaaaggaacttcagtcaaataaagaatcagttaaaagccagatgaaacaaaaggatgaagatcttgagcgaagactggaacaggcagaagagaagcacctgaaagagaagaagaatatgcaagagaaactggatgctttgcgcagagaaaaagtccacttggaagagacaattggagagattcaggttactttgaacaagaaagacaaggaagttcagcaacttcaggaaaacttggacagtactgtgacccagcttgcagcctttactaagagcatgtcttccctccaggatgatcgtgacagggtgatagatgaagctaagaaatgggagaggaagtttagtgatgcgattcaaagcaaagaagaagaaattagactcaaagaagataattgcagtgttctaaaggatcaacttagacagatgtccatccatatggaagaattaaagattaacatttccaggcttgaacatgacaagcagatttgggagtccaaggcccagacagaggtccagcttcagcagaaggtctgtgatactctacagggggaaaacaaagaacttttgtcccagctagaagagacacgccacctataccacagttctcagaatgaattagctaagttggaatcagaacttaagagtctcaaagaccagttgactgatttaagtaactctttagaaaaatgtaaggaacaaaaaggaaacttggaagggatcataaggcagcaagaggctgatattcaaaattctaagttcagttatgaacaactggagactgatcttcaggcctccagagaactgaccagtaggctgcatgaagaaataaatatgaaagagcaaaagattataagcctgctttctggcaaggaagaggcaatccaagtagctattgctgaactgcgtcagcaacatgataaagaaattaaagagctggaaaacctgctgtcccaggaggaagaggagaatattgttttagaagaggagaacaaaaaggctgttgataaaaccaatcagcttatggaaacactgaaaaccatcaaaaaggaaaacattcagcaaaaggcacagttggattcctttgttaaatccatgtcttctctccaaaatgatcgagaccgcatagtgggtgactatcaacagctggaagagcgacatctctctataatcttggaaaaagaccaactcatccaagaggctgctgcagagaataataagcttaaagaagaaatacgaggcttgagaagtcatatggatgatctcaattctgagaatgccaagctagatgcagaactgatccaatatagagaagacctgaaccaagtgataacaataaaggacagccaacaaaagcagcttcttgaagttcaacttcagcaaaataaggagctggaaaataaatatgctaaattagaagaaaagctgaaggaatctgaggaagcaaatgaggatctgcggaggtcctttaatgccctacaagaagagaaacaagatttatctaaagagattgagagtttgaaagtatctatatcccagctaacaagacaagtaacagccttgcaagaagaaggtactttaggactctatcatgcccagttaaaagtaaaagaagaagaggtacacaggttaagtgctttgttttcctcctctcaaaagagaattgcagaactggaagaagaattggtttgtgttcaaaaggaagctgccaagaaggtaggtgaaattgaagataaactgaagaaagaattaaagcatcttcatcatgatgcagggataatgagaaatgaaactgaaacagcagaagagagagtggcagagctagcaagagatttggtggagatggaacagaaattactcatggtcaccaaagaaaataaaggtctcacagcacaaattcagtcttttggaaggtctatgagttccttgcaaaatagtagagatcatgccaatgaggaacttgatgaactgaaaaggaaatatgatgccagtctgaaggaattggcacagttgaaagaacagggactcttaaacagagagagagatgctcttctttctgaaaccgccttttcaatgaactccactgaggagaatagcttgtctcaccttgagaaacttaaccaacagctcctatccaaagatgagcaattgcttcacttgtcctcacaactagaagattcttataaccaagtgcagtccttttccaaggctatggccagtctgcagaatgagagagatcacctgtggaatgagctggagaaatttcgaaagtcagaggaagggaagcagaggtctgcagctcagccttccaccagcccagctgaagtacagagtttaaaaaaagctatgtcttcactccaaaatgacagagacagactactgaaggaattgaagaatctgcagcagcaatacttacagattaatcaagagatcactgagttacatccactgaaggctcaacttcaggagtatcaagataagacaaaagcatttcagattatgcaagaagagctcaggcaggaaaacctctcctggcagcatgagctgcatcagctcaggatggagaagagttcctgggaaatacatgagaggagaatgaaggaacagtaccttatggctatctcagataaagatcagcagctcagtcatctgcagaatcttataagggaattgaggtcttcttcctcccagactcagcctctcaaagtgcaataccaaagacaggcatccccagagacatcagcttccccagatgggtcacaaaatctggtttatgagacagaacttctcaggacccagctcaatgacagcttaaaggaaattcaccaaaaggagttaagaattcagcaactgaacagcaacttctctcagctactggaagagaaaaacaccctttccattcagctctgcgataccagtcagagtcttcgtgagaaccagcagcactatggtgaccttttaaatcactgtgcagtcttggagaagcaggttcaagagctgcaggcggggccactaaatatagatgttgctccaggagctccccaggaaaagaatggagttcacagaaagagtgaccctgaggaactaagggaaccgcagcaaagcttttctgaagctcagcagcagctatgcaacaccagacaggaagtgaatgaattaaggaagctgctggaagaagaacgagaccaaagagtggctgctgagaatgctctctctgtggccgaggagcagatcagacggtaaaggctgaaggagatagcctctgttcccttccgatcctttctgatcaaactcatgtacatttcctgccagacttaggatttcttaagatctttttctcatcttgaggtagttgctgcaatgagtttaccaacattgtggtcacccaagagaacactgtacttttggagtataagagagtcagtgttttctaaaacagttgttcttagagaataataatgatatctaccattactgaaagatattttatttcaccctaaccataactatatgaggtaggtgttgggttctctagaggaccaaataagtgacaacctcattttctacctgagatctgaatccatggaaatcttttttaaaagaataaaagattgagagattaaaagactgctttataaatgatggtn

SEQ ID NO: 567317 - DNA, 10643 bp, Homo sapiens
  misc_feature (603)..(603): n is a, c, g, or t
  misc_feature (618)..(618): n is a, c, g, or t
  misc_feature (676)..(676): n is a, c, g, or t
  misc_feature (685)..(685): n is a, c, g, or t
  misc_feature (1078)..(1078): n is a, c, g, or t
  misc_feature (1116)..(1116): n is a, c, g, or t
ttttttttttatagtgcatgcaggaaattgcaattttatttatgtttgtattgatacatatttgtacatatttatggggtgtggtagtttgatatatgcatacaatgtgtaatgatcaaatcagggtgtttaggatatctatcacctcaaacatttatcatttttgtgtttggaacatttctaatctcctagttattttgaaatatataacatattgttaactatagtcaccctactgtgctatcaaacacttgaacttattccttctatctacgtttgtacccattaaccaatctcttccctccctcccccaactccaccttcccagcctctggtacttatctctactccatgagatcaactttttaagctcccacatgagtgagaccatgggatatttgtctttctgtgccagacttatttcacttagaataatgacctccagttccgtaagatgggcagccaggaaaggccttacttagctgatgtttgaattgtgaagttatgtaatcattaagatgagtatacatacaatgggccagctgagtgcacagcaagattcaataaattcaaactaacattactcttattgccaagagagtncctgaaatgacagcncattggaaactggctactttccttccctttccttaggggtttaaggaaagcatgagtnatttcagtnttttgctggagctcctcactgacactcattgcagagcctgagccctcaactctcaatctttgcttaggtcctggcttaggctccactttgtaagaggcaccttcctagtattcactactctctctctcacaatcatgtccttacagacattgctgatcctctttcatactgacaccgggttctagtccgagttccatcactaagtcgctgtttgactttgggcaagttacttctgtggttaattatttttcatcaacaaaatcaaaaggtgaaactagacgaacaactaagaggctccagtattttttcaatctaagagtcccatatcccccactcccttctcacagctcattcaacaatcctaatggcagcgggtgcccgcagtctcaagtntctgccgaagcccaagccgctgtctcggtcagtcacanccgacgaagaggaggaattggaggaagccagcataaccacctcacactgagaacatctgacctttcccagaacgcccgcccactcgacacttcctgtccctccccagatcttgttccggggcacctactcgggtctaatcactcccctcattcactctttagggtccattgctgtttctttgaggaagcggagcatcttctgtcgttgattggtttccgtcattgttgataggttggtaacaaacaaggtgtgcctggtctcctggtaacgtcctgccgatagtcctgattggtcggtgtcttaatcccatcttccgtcccaactgctagtggctgagtccctggcggggcgcggcggtggaaggtgtcgcgtacgggcttcccgagctgacgtggcttgaattgggaggggggcagctggagcctcaggcggcagcgcttctagaaatgctgagccgattatcaggattagcaaatgttgttttgcatgaattatcaggagatgatgacactgatcagaatatgagggctcccctagaccctgaattacaccaagaatctgacatggaatttaataatactacacaagaagatgttcaggagcgcctggcttatgcagagcaattggtggtggagctaaaagatattattagacagaaggatgttcaactgcagcagaaagatgaagctctacaggaagagagaaaagctgctgataacaaaattaaaaaactaaaacttcatgcgaaggccaaattaacttctttgaataaatacatagaagaaatgaaagcacaaggagggactgttctgcctacagaacctcagtcagaggagcaactttccaagcatgacaagagttctacagaggaagagatggaaatagaaaagataaaacataagctccaggagaaggaggaactaatcagcactttgcaagcccagcttactcaggcacaggcagaacaacctgcacagagttctacagagatggaagaatttgtaatgatgaagcaacagctccaggagaaggaagaattcattagcactttacaagcccagctcagccagacacaggcagagcaagctgcacagcaggtggtccgagagaaagatgcccgctttgaaacacaagttcgtcttcatgaagatgagcttcttcagttagtaacccaggcagatgtggaaacagagatgcaacagaaattgagggtgctgcaaaggaagcttgaggaacacgaagaatccttggtgggccgtgctcaggtcgttgacttgctgcaacaggagctgactgctgctgagcagagaaaccagattctctctcagcagttacagcagatggaagctgagcataatactttgaggaacactgtggaaacagaaagagaggagtccaagattctactggaaaagatggaacttgaagtggcagagagaaaattatccttccataatctgcaggaagaaatgcatcatcttttagaacagtttgagcaagcaggccaagcccaggctgaactagagtctcggtatagtgctttggagcagaagcacaaagcagaaatggaagagaagacctctcatattttgagtcttcaaaagactggacaagagctgcagtctgcctgtgatgctctaaaggatcaaaattcaaagcttctccaagataagaatgaacaggcagttcagtcagcccagaccattcagcaactggaagatcagctccagcaaaaatccaaagaaattagccaatttctaaatagactgcccttgcaacaacatgaaacagcatctcagacttctttcccagatgtttataatgagggcacacaggcagtcactgaggagaatattgcttctttgcagaagagagtggtagaactagagaatgaaaagggagccttgctccttagttctatagagctggaggagctgaaagctgagaatgaaaaactgtcttctcagattactctcctagaggctcagaatagaactggggaggcagacagagaagtcagtgagatcagcattgttgatattgccaacaagaggagctcttctgctgaggaaagtggacaagatgttctagaaaacacattttctcagaaacataaagaattatcagttttattgttggaaatgaaagaagctcaagaggaaattgcatttcttaaattacagctccagggaaaaagggctgaggaagcagatcatgaggtccttgaccagaaagaaatgaaacagatggagggtgagggaatagctccaattaaaatgaaagtatttcttgaagatacagggcaagattttcccttaatgccaaatgaagagagcagtcttccagcagttgaaaaagaacaggcgagcactgaacatcaaagtagaacatctgaggaaatatctttaaatgatgctggagtagaattgaaatcaacaaagcaggatggtgataaatccctttctgctgtaccagatattggtcagtgtcatcaggatgagttggaaaggttaaaaagtcaaattttggagctcgagctaaactttcataaagcacaagaaatctatgagaaaaatttagatgagaaagctaaggaaattagcaacctaaaccagttgattgaggagtttaagaaaaatgctgacaacaacagcagtgcattcactgctttgtctgaagaaagagaccagcttctctctcaggtgaaggaacttagcatggtaacagaattgagggctcaggtaaagcaactggaaatgaaccttgcagaagcagaaaggcaaagaagacttgattatgaaagccaaactgcccatgacaacctgctcactgaacagatccatagtctcagcatagaagccaaatctaaagatgtgaaaattgaagttttacagaatgaactggatgatgtgcagcttcagttttctgagcagagtaccctgataagaagcctgcaaagccagctgcaaaataaggaaagtgaagtgcttgagggggcagaacgtgtaaggcatatctcaagtaaagtggaagaactgtcccaggctctttcacagaaggaacttgaaataacaaaaatggatcagctcttactagagaaaaagagagatgtggaaaccctccaacaaaccatcgaggagaaggatcaacaagtgacagaaatcagctttagtatgactgagaaaatggttcagcttaatgaagagaagttttctcttggggttgaaattaagactcttaaagaacagctaaatttattatccagagctgaggaagcaaaaaaagagcaggtggaagaagataatgaagtttcttctggccttaaacaaaattatgatgagatgagcccagcaggacaaataagtaaggaagaacttcagcatgaatttgaccttctgaagaaagaaaatgagcagagaaagagaaagctccaggcagctcttattaacagaaaggagcttctgcaaagagtcagtagattggaagaagaattagccaacttgaaagatgaatctaagaaagaaatcccactcagtgagactgagaggggagaagtggaagaagataaagaaaacaaagaatactcagaaaaatgtgtgacttctaagtgccaagaaatagaaatttatttaaaacagacaatatctgagaaagaagtggaactacagcatataaggaaggatttggaagaaaagctggcagctgaagagcaattccaggctctggtcaaacagatgaatcagaccttgcaagataaaacaaaccaaatagatttgctccaagcagaaatcagtgaaaaccaagcaattatccagaagttaatcacaagtaacacggatgcaagtgatggggactccgtagcacttgtaaaggaaacagtggtgataagtccaccttgtacaggtagtagtgaacactggaaaccagaactagaagaaaagatactggcccttgaaaaagaaaaggagcaacttcaaaagaagctacaggaagccttaacctcccgcaaggcaattcttaaaaaggcacaggagaaagaaagacatctcagggaggagctaaagcaacagaaagatgactataatcgcttgcaagaacagtttgatgagcaaagcaaggaaaatgagaatattggagaccagctaaggcaactccagattcaagtaagggaatccatagacggaaaactcccaagcacagaccagcaggaatcgtgttcttccactccaggtttagaagaacctttattcaaagccacagaacagcatcacactcaacctgttttagagtccaacttgtgcccagactggccttctcattctgaagatgcgagtgctctgcagggcggaacttctgttgcccagattaaggcccagctgaaggaaatagaggctgagaaagtagagttagaattgaaagttagttctacaacaagtgagcttactaaaaaatcagaagaggtatttcagttacaagagcagataaataaacagggtttagaaatcgagagtctaaagacagtatcccatgaagctgaagtccatgccgaaagcctgcagcagaaattggaaagcagccaactacaaattgctggcctagaacatctaagagaattgcaacctaaactggatgaactgcaaaaactcataagcaaaaaggaagaagacgttagctacctttctggacaacttagtgagaaagaagcagctctcactaaaatacagacagagataatagaacaagaagatttaattaaggctctgcatacacagctagaaatgcaagccaaagagcatgatgagaggataaagcagctacaggtggaactttgtgaaatgaagcaaaaaccagaagagattggagaagaaagtagagcaaagcaacaaatacaaaggaaactgcaagctgcccttatttcccgaaaagaagcactaaaagaaaacaaaagtctccaagaggaattgtctttggccagaggtaccattgaacgtctcaccaagtctctggcagatgtggaaagccaagtttctgctcaaaataaagaaaaagatacggtcttaggaaggttagctcttcttcaagaagaaagagacaaactcattacagaaatggacaggtctttattggaaaatcagagtctcagcagctcctgtgaaagtctaaaactagctctagagggtcttactgaagacaaggaaaagttagtgaaggaaattgaatctttgaaatcttctaagattgcagaaagtactgagtggcaagagaaacacaaggagctacaaaaagagtatgaaattcttctgcagtcctatgagaatgttagtaatgaagcagaaaggattcagcatgtggtggaagctgtgaggcaagagaaacaagaactgtatggcaagttaagaagcacagaggcaaacaagaaggagacagaaaagcagttgcaggaagctgagcaagaaatggaggaaatgaaagaaaagatgagaaagtttgctaaatctaaacagcagaaaatcctagagctggaagaagagaatgaccggcttagggcagaggtgcaccctgcaggagatacagctaaagagtgtatggaaacacttctttcttccaatgccagcatgaaggaagaacttgaaagggtcaaaatggagtatgaaaccctttctaagaagtttcagtctttaatgtctgagaaagactctctaagtgaagaggttcaagatttaaagcatcagatagaagataatgtatctaaacaagctaacctagaggccaccgagaaacatgataaccaaacgaatgtcactgaagagggaacacagtctataccaggtgagactgaagagcaagactctctgagtatgagcacaagacctacatgttcagaatcggttccatcagcgaagagtgccaaccctgctgtaagtaaggatttcagctcacatgatgaaattaataactacctacagcagattgatcagctcaaagaaagaattgctggattagaggaggagaagcagaaaaacaaggaatttagccagactttagaaaatgagaaaaataccttactgagtcagatatcaacaaaggatggtgaactaaaaatgcttcaggaggaagtaaccaaaatgaacctgttaaatcagcaaatccaagaagaactctccagagttaccaaactaaaggagacagcagaagaagagaaagatgatttggaagagaggcttatgaatcaattagcagaacttaatggaagcattgggaattactgtcaggatgttacagatgcccaaataaaaaatgagctattggaatctgaaatgaagaaccttaaaaagtgtgtgagtgaattggaagaagaaaagcagcagttagtcaaggaaaaaactaaggtggaatcagaaatacgaaaggaatatttggagaaaatacaaggtgctcagaaagaacccggaaataaaagccatgcaaaggaacttcaggaactgttaaaagaaaaacaacaagaagtaaagcagctacagaaggactgcatcaggtatcaagagaaaattagtgctctggagagaactgttaaagctctagaatttgttcaaactgaatctcaaaaagatttggaaataaccaaagaaaatctggctcaagcagttgaacaccgcaaaaaggcacaagcagaattagctagcttcaaagtcctgctagatgacactcaaagtgaagcagcaagggtcctagcagacaatctcaagttgaaaaaggaacttcagtcaaataaagaatcagttaaaagccagatgaaacaaaaggatgaagatcttgagcgaagactggaacaggcagaagagaagcacctgaaagagaagaagaatatgcaagagaaactggatgctttgcgcagagaaaaagtccacttggaagagacaattggagagattcaggttactttgaacaagaaagacaaggaagttcagcaacttcaggaaaacttggacagtactgtgacccagcttgcagcctttactaagagcatgtcttccctccaggatgatcgtgacagggtgatagatgaagctaagaaatgggagaggaagtttagtgatgcgattcaaagcaaagaagaagaaattagactcaaagaagataattgcagtgttctaaaggatcaacttagacagatgtccatccatatggaagaattaaagattaacatttccaggcttgaacatgacaagcagatttgggagtccaaggcccagacagaggtccagcttcagcagaaggtctgtgatactctacagggggaaaacaaagaacttttgtcccagctagaagagacacgccacctataccacagttctcagaatgaattagctaagttggaatcagaacttaagagtctcaaagaccagttgactgatttaagtaactctttagaaaaatgtaaggaacaaaaaggaaacttggaagggatcataaggcagcaagaggctgatattcaaaattctaagttcagttatgaacaactggagactgatcttcaggcctccagagaactgaccagtaggctgcatgaagaaataaatatgaaagagcaaaagattataagcctgctttctggcaaggaagaggcaatccaagtagctattgctgaactgcgtcagcaacatgataaagaaattaaagagctggaaaacctgctgtcccaggaggaagaggagaatattgttttagaagaggagaacaaaaaggctgttgataaaaccaatcagcttatggaaacactgaaaaccatcaaaaaggaaaacattcagcaaaaggcacagttggattcctttgttaaatccatgtcttctctccaaaatgatcgagaccgcatagtgggtgactatcaacagctggaagagcgacatctctctataatcttggaaaaagaccaactcatccaagaggctgctgcagagaataataagcttaaagaagaaatacgaggcttgagaagtcatatggatgatctcaattctgagaatgccaagctagatgcagaactgatccaatatagagaagacctgaaccaagtgataacaataaaggacagccaacaaaagcagcttcttgaagttcaacttcagcaaaataaggagctggaaaataaatatgctaaattagaagaaaagctgaaggaatctgaggaagcaaatgaggatctgcggaggtcctttaatgccctacaagaagagaaacaagatttatctaaagagattgagagtttgaaagtatctatatcccagctaacaagacaagtaacagccttgcaagaagaaggtactttaggactctatcatgcccagttaaaagtaaaagaagaagaggtacacaggttaagtgctttgttttcctcctctcaaaagagaattgcagaactggaagaagaattggtttgtgttcaaaaggaagctgccaagaaggtaggtgaaattgaagataaactgaagaaagaattaaagcatcttcatcatgatgcagggataatgagaaatgaaactgaaacagcagaagagagagtggcagagctagcaagagatttggtggagatggaacagaaattactcatggtcaccaaagaaaataaaggtctcacagcacaaattcagtcttttggaaggtctatgagttccttgcaaaatagtagagatcatgccaatgaggaacttgatgaactgaaaaggaaatatgatgccagtctgaaggaattggcacagttgaaagaacagggactcttaaacagagagagagatgctcttctttctgaaaccgccttttcaatgaactccactgaggagaatagcttgtctcaccttgagaaacttaaccaacagctcctatccaaagatgagcaattgcttcacttgtcctcacaactagaagattcttataaccaagtgcagtccttttccaaggctatggccagtctgcagaatgagagagatcacctgtggaatgagctggagaaatttcgaaagtcagaggaagggaagcagaggtctgcagctcagccttccaccagcccagctgaagtacagagtttaaaaaaagctatgtcttcactccaaaatgacagagacagactactgaaggaattgaagaatctgcagcagcaatacttacagattaatcaagagatcactgagttacatccactgaaggctcaacttcaggagtatcaattccagtggaacagtcttcccatttacaggtcttctctccaactcttcacggaaagtgcctgcaaaaacagaggtggatacgaggacaggttggagctgcagggactggcgagtctgctttcttctactgccctgagcctgaacgcttctgcttaatctgagaatcacatttggtttgttgagcctaatatttgttgagattttgcaggaccctgatcttttgtggtcctgtaaaagatactgaggaatgtctttcagccaagccaagaggatggtttcaataaacctaataatctgaagttcag

SEQ ID NO: 567318 - DNA, 10467 bp, Homo sapiens
  misc_feature (603)..(603): n is a, c, g, or t
  misc_feature (618)..(618): n is a, c, g, or t
  misc_feature (676)..(676): n is a, c, g, or t
  misc_feature (685)..(685): n is a, c, g, or t
  misc_feature (1078)..(1078): n is a, c, g, or t
  misc_feature (1116)..(1116): n is a, c, g, or t
ttttttttttatagtgcatgcaggaaattgcaattttatttatgtttgtattgatacatatttgtacatatttatggggtgtggtagtttgatatatgcatacaatgtgtaatgatcaaatcagggtgtttaggatatctatcacctcaaacatttatcatttttgtgtttggaacatttctaatctcctagttattttgaaatatataacatattgttaactatagtcaccctactgtgctatcaaacacttgaacttattccttctatctacgtttgtacccattaaccaatctcttccctccctcccccaactccaccttcccagcctctggtacttatctctactccatgagatcaactttttaagctcccacatgagtgagaccatgggatatttgtctttctgtgccagacttatttcacttagaataatgacctccagttccgtaagatgggcagccaggaaaggccttacttagctgatgtttgaattgtgaagttatgtaatcattaagatgagtatacatacaatgggccagctgagtgcacagcaagattcaataaattcaaactaacattactcttattgccaagagagtncctgaaatgacagcncattggaaactggctactttccttccctttccttaggggtttaaggaaagcatgagtnatttcagtnttttgctggagctcctcactgacactcattgcagagcctgagccctcaactctcaatctttgcttaggtcctggcttaggctccactttgtaagaggcaccttcctagtattcactactctctctctcacaatcatgtccttacagacattgctgatcctctttcatactgacaccgggttctagtccgagttccatcactaagtcgctgtttgactttgggcaagttacttctgtggttaattatttttcatcaacaaaatcaaaaggtgaaactagacgaacaactaagaggctccagtattttttcaatctaagagtcccatatcccccactcccttctcacagctcattcaacaatcctaatggcagcgggtgcccgcagtctcaagtntctgccgaagcccaagccgctgtctcggtcagtcacanccgacgaagaggaggaattggaggaagccagcataaccacctcacactgagaacatctgacctttcccagaacgcccgcccactcgacacttcctgtccctccccagatcttgttccggggcacctactcgggtctaatcactcccctcattcactctttagggtccattgctgtttctttgaggaagcggagcatcttctgtcgttgattggtttccgtcattgttgataggttggtaacaaacaaggtgtgcctggtctcctggtaacgtcctgccgatagtcctgattggtcggtgtcttaatcccatcttccgtcccaactgctagtggctgagtccctggcggggcgcggcggtggaaggtgtcgcgtacgggcttcccgagctgacgtggcttgaattgggaggggggcagctggagcctcaggcggcagcgcttctagaaatgctgagccgattatcaggattagcaaatgttgttttgcatgaattatcaggagatgatgacactgatcagaatatgagggctcccctagaccctgaattacaccaagaatctgacatggaatttaataatactacacaagaagatgttcaggagcgcctggcttatgcagagcaattggtggtggagctaaaagatattattagacagaaggatgttcaactgcagcagaaagatgaagctctacaggaagagagaaaagctgctgataacaaaattaaaaaactaaaacttcatgcgaaggccaaattaacttctttgaataaatacatagaagaaatgaaagcacaaggagggactgttctgcctacagaacctcagtcagaggagcaactttccaagcatgacaagagttctacagaggaagagatggaaatagaaaagataaaacataagctccaggagaaggaggaactaatcagcactttgcaagcccagcttactcaggcacaggcagaacaacctgcacagagttctacagagatggaagaatttgtaatgatgaagcaacagctccaggagaaggaagaattcattagcactttacaagcccagctcagccagacacaggcagagcaagctgcacagcaggtggtccgagagaaagatgcccgctttgaaacacaagttcgtcttcatgaagatgagcttcttcagttagtaacccaggcagatgtggaaacagagatgcaacagaaattgagggtgctgcaaaggaagcttgaggaacacgaagaatccttggtgggccgtgctcaggtcgttgacttgctgcaacaggagctgactgctgctgagcagagaaaccagattctctctcagcagttacagcagatggaagctgagcataatactttgaggaacactgtggaaacagaaagagaggagtccaagattctactggaaaagatggaacttgaagtggcagagagaaaattatccttccataatctgcaggaagaaatgcatcatcttttagaacagtttgagcaagcaggccaagcccaggctgaactagagtctcggtatagtgctttggagcagaagcacaaagcagaaatggaagagaagacctctcatattttgagtcttcaaaagactggacaagagctgcagtctgcctgtgatgctctaaaggatcaaaattcaaagcttctccaagataagaatgaacaggcagttcagtcagcccagaccattcagcaactggaagatcagctccagcaaaaatccaaagaaattagccaatttctaaatagactgcccttgcaacaacatgaaacagcatctcagacttctttcccagatgtttataatgagggcacacaggcagtcactgaggagaatattgcttctttgcagaagagagtggtagaactagagaatgaaaagggagccttgctccttagttctatagagctggaggagctgaaagctgagaatgaaaaactgtcttctcagattactctcctagaggctcagaatagaactggggaggcagacagagaagtcagtgagatcagcattgttgatattgccaacaagaggagctcttctgctgaggaaagtggacaagatgttctagaaaacacattttctcagaaacataaagaattatcagttttattgttggaaatgaaagaagctcaagaggaaattgcatttcttaaattacagctccagggaaaaagggctgaggaagcagatcatgaggtccttgaccagaaagaaatgaaacagatggagggtgagggaatagctccaattaaaatgaaagtatttcttgaagatacagggcaagattttcccttaatgccaaatgaagagagcagtcttccagcagttgaaaaagaacaggcgagcactgaacatcaaagtagaacatctgaggaaatatctttaaatgatgctggagtagaattgaaatcaacaaagcaggatggtgataaatccctttctgctgtaccagatattggtcagtgtcatcaggatgagttggaaaggttaaaaagtcaaattttggagctcgagctaaactttcataaagcacaagaaatctatgagaaaaatttagatgagaaagctaaggaaattagcaacctaaaccagttgattgaggagtttaagaaaaatgctgacaacaacagcagtgcattcactgctttgtctgaagaaagagaccagcttctctctcaggtgaaggaacttagcatggtaacagaattgagggctcaggtaaagcaactggaaatgaaccttgcagaagcagaaaggcaaagaagacttgattatgaaagccaaactgcccatgacaacctgctcactgaacagatccatagtctcagcatagaagccaaatctaaagatgtgaaaattgaagttttacagaatgaactggatgatgtgcagcttcagttttctgagcagagtaccctgataagaagcctgcaaagccagctgcaaaataaggaaagtgaagtgcttgagggggcagaacgtgtaaggcatatctcaagtaaagtggaagaactgtcccaggctctttcacagaaggaacttgaaataacaaaaatggatcagctcttactagagaaaaagagagatgtggaaaccctccaacaaaccatcgaggagaaggatcaacaagtgacagaaatcagctttagtatgactgagaaaatggttcagcttaatgaagagaagttttctcttggggttgaaattaagactcttaaagaacagctaaatttattatccagagctgaggaagcaaaaaaagagcaggtggaagaagataatgaagtttcttctggccttaaacaaaattatgatgagatgagcccagcaggacaaataagtaaggaagaacttcagcatgaatttgaccttctgaagaaagaaaatgagcagagaaagagaaagctccaggcagctcttattaacagaaaggagcttctgcaaagagtcagtagattggaagaagaattagccaacttgaaagatgaatctaagaaagaaatcccactcagtgagactgagaggggagaagtggaagaagataaagaaaacaaagaatactcagaaaaatgtgtgacttctaagtgccaagaaatagaaatttatttaaaacagacaatatctgagaaagaagtggaactacagcatataaggaaggatttggaagaaaagctggcagctgaagagcaattccaggctctggtcaaacagatgaatcagaccttgcaagataaaacaaaccaaatagatttgctccaagcagaaatcagtgaaaaccaagcaattatccagaagttaatcacaagtaacacggatgcaagtgatggggactccgtagcacttgtaaaggaaacagtggtgataagtccaccttgtacaggtagtagtgaacactggaaaccagaactagaagaaaagatactggcccttgaaaaagaaaaggagcaacttcaaaagaagctacaggaagccttaacctcccgcaaggcaattcttaaaaaggcacaggagaaagaaagacatctcagggaggagctaaagcaacagaaagatgactataatcgcttgcaagaacagtttgatgagcaaagcaaggaaaatgagaatattggagaccagctaaggcaactccagattcaagtaagggaatccatagacggaaaactcccaagcacagaccagcaggaatcgtgttcttccactccaggtttagaagaacctttattcaaagccacagaacagcatcacactcaacctgttttagagtccaacttgtgcccagactggccttctcattctgaagatgcgagtgctctgcagggcggaacttctgttgcccagattaaggcccagctgaaggaaatagaggctgagaaagtagagttagaattgaaagttagttctacaacaagtgagcttactaaaaaatcagaagaggtatttcagttacaagagcagataaataaacagggtttagaaatcgagagtctaaagacagtatcccatgaagctgaagtccatgccgaaagcctgcagcagaaattggaaagcagccaactacaaattgctggcctagaacatctaagagaattgcaacctaaactggatgaactgcaaaaactcataagcaaaaaggaagaagacgttagctacctttctggacaacttagtgagaaagaagcagctctcactaaaatacagacagagataatagaacaagaagatttaattaaggctctgcatacacagctagaaatgcaagccaaagagcatgatgagaggataaagcagctacaggtggaactttgtgaaatgaagcaaaaaccagaagagattggagaagaaagtagagcaaagcaacaaatacaaaggaaactgcaagctgcccttatttcccgaaaagaagcactaaaagaaaacaaaagtctccaagaggaattgtctttggccagaggtaccattgaacgtctcaccaagtctctggcagatgtggaaagccaagtttctgctcaaaataaagaaaaagatacggtcttaggaaggttagctcttcttcaagaagaaagagacaaactcattacagaaatggacaggtctttattggaaaatcagagtctcagcagctcctgtgaaagtctaaaactagctctagagggtcttactgaagacaaggaaaagttagtgaaggaaattgaatctttgaaatcttctaagattgcagaaagtactgagtggcaagagaaacacaaggagctacaaaaagagtatgaaattcttctgcagtcctatgagaatgttagtaatgaagcagaaaggattcagcatgtggtggaagctgtgaggcaagagaaacaagaactgtatggcaagttaagaagcacagaggcaaacaagaaggagacagaaaagcagttgcaggaagctgagcaagaaatggaggaaatgaaagaaaagatgagaaagtttgctaaatctaaacagcagaaaatcctagagctggaagaagagaatgaccggcttagggcagaggtgcaccctgcaggagatacagctaaagagtgtatggaaacacttctttcttccaatgccagcatgaaggaagaacttgaaagggtcaaaatggagtatgaaaccctttctaagaagtttcagtctttaatgtctgagaaagactctctaagtgaagaggttcaagatttaaagcatcagatagaagataatgtatctaaacaagctaacctagaggccaccgagaaacatgataaccaaacgaatgtcactgaagagggaacacagtctataccaggtgagactgaagagcaagactctctgagtatgagcacaagacctacatgttcagaatcggttccatcagcgaagagtgccaaccctgctgtaagtaaggatttcagctcacatgatgaaattaataactacctacagcagattgatcagctcaaagaaagaattgctggattagaggaggagaagcagaaaaacaaggaatttagccagactttagaaaatgagaaaaataccttactgagtcagatatcaacaaaggatggtgaactaaaaatgcttcaggaggaagtaaccaaaatgaacctgttaaatcagcaaatccaagaagaactctccagagttaccaaactaaaggagacagcagaagaagagaaagatgatttggaagagaggcttatgaatcaattagcagaacttaatggaagcattgggaattactgtcaggatgttacagatgcccaaataaaaaatgagctattggaatctgaaatgaagaaccttaaaaagtgtgtgagtgaattggaagaagaaaagcagcagttagtcaaggaaaaaactaaggtggaatcagaaatacgaaaggaatatttggagaaaatacaaggtgctcagaaagaacccggaaataaaagccatgcaaaggaacttcaggaactgttaaaagaaaaacaacaagaagtaaagcagctacagaaggactgcatcaggtatcaagagaaaattagtgctctggagagaactgttaaagctctagaatttgttcaaactgaatctcaaaaagatttggaaataaccaaagaaaatctggctcaagcagttgaacaccgcaaaaaggcacaagcagaattagctagcttcaaagtcctgctagatgacactcaaagtgaagcagcaagggtcctagcagacaatctcaagttgaaaaaggaacttcagtcaaataaagaatcagttaaaagccagatgaaacaaaaggatgaagatcttgagcgaagactggaacaggcagaagagaagcacctgaaagagaagaagaatatgcaagagaaactggatgctttgcgcagagaaaaagtccacttggaagagacaattggagagattcaggttactttgaacaagaaagacaaggaagttcagcaacttcaggaaaacttggacagtactgtgacccagcttgcagcctttactaagagcatgtcttccctccaggatgatcgtgacagggtgatagatgaagctaagaaatgggagaggaagtttagtgatgcgattcaaagcaaagaagaagaaattagactcaaagaagataattgcagtgttctaaaggatcaacttagacagatgtccatccatatggaagaattaaagattaacatttccaggcttgaacatgacaagcagatttgggagtccaaggcccagacagaggtccagcttcagcagaaggtctgtgatactctacagggggaaaacaaagaacttttgtcccagctagaagagacacgccacctataccacagttctcagaatgaattagctaagttggaatcagaacttaagagtctcaaagaccagttgactgatttaagtaactctttagaaaaatgtaaggaacaaaaaggaaacttggaagggatcataaggcagcaagaggctgatattcaaaattctaagttcagttatgaacaactggagactgatcttcaggcctccagagaactgaccagtaggctgcatgaagaaataaatatgaaagagcaaaagattataagcctgctttctggcaaggaagaggcaatccaagtagctattgctgaactgcgtcagcaacatgataaagaaattaaagagctggaaaacctgctgtcccaggaggaagaggagaatattgttttagaagaggagaacaaaaaggctgttgataaaaccaatcagcttatggaaacactgaaaaccatcaaaaaggaaaacattcagcaaaaggcacagttggattcctttgttaaatccatgtcttctctccaaaatgatcgagaccgcatagtgggtgactatcaacagctggaagagcgacatctctctataatcttggaaaaagaccaactcatccaagaggctgctgcagagaataataagcttaaagaagaaatacgaggcttgagaagtcatatggatgatctcaattctgagaatgccaagctagatgcagaactgatccaatatagagaagacctgaaccaagtgataacaataaaggacagccaacaaaagcagcttcttgaagttcaacttcagcaaaataaggagctggaaaataaatatgctaaattagaagaaaagctgaaggaatctgaggaagcaaatgaggatctgcggaggtcctttaatgccctacaagaagagaaacaagatttatctaaagagattgagagtttgaaagtatctatatcccagctaacaagacaagtaacagccttgcaagaagaaggtactttaggactctatcatgcccagttaaaagtaaaagaagaagaggtacacaggttaagtgctttgttttcctcctctcaaaagagaattgcagaactggaagaagaattggtttgtgttcaaaaggaagctgccaagaaggtaggtgaaattgaagataaactgaagaaagaattaaagcatcttcatcatgatgcagggataatgagaaatgaaactgaaacagcagaagagagagtggcagagctagcaagagatttggtggagatggaacagaaattactcatggtcaccaaagaaaataaaggtctcacagcacaaattcagtcttttggaaggtctatgagttccttgcaaaatagtagagatcatgccaatgaggaacttgatgaactgaaaaggaaatatgatgccagtctgaaggaattggcacagttgaaagaacagggactcttaaacagagagagagatgctcttctttctgaaaccgccttttcaatgaactccactgaggagaatagcttgtctcaccttgagaaacttaaccaacagctcctatccaaagatgagcaattgcttcacttgtcctcacaactagaagattcttataaccaagtgcagtccttttccaaggctatggccagtctgcagaatgagagagatcacctgtggaatgagctggagaaatttcgaaagtcagaggaagggaagcagaggtctgcagctcagccttccaccagcccagctgaagtacagagtttaaaaaaagctatgtcttcactccaaaatgacagagacagactactgagtagctagttctttctttctgatctgtttaagagtttttgaacctttctttaaatgttatttttatagaaaaggataaacacattcttatacatattatctgggaacgcagggaaagtattatgtatcccacaggttttgtttggtcttagagaagcacagaaacatgatttaaattgctaaacctgccaataccattagaaaaaaaatcagaaatttacc

SEQ ID NO: 567319 - DNA, 941 bp, Homo sapiens
tctacatagcctgacaatataaaatatatttactgtataaggcctggaatataacaatgtaatgttacaatctgttattaagtcatgttttcgaatactagatacagtcatttaaggtcatagtcccaagtgttagaatttacctatcaaatgtttctaaccaaaagttgtgttacttaagatactctgttctgtcatgaagtaatagctggtatgttagtatttgaaacaaacatacagagttcatcatacttggaagcaaggaatatcatttagatgctttttattcagatccattccttaagtggtttggtgtctgtagagtcaggcaaatgattaattatacatgtgattccagagtagtgtgttgaagcagttacagaatcagtaaggaacatttagctaggtcattgagcttgactacttacaatctaacaaataaggaaatcgtgaattagacagtagtagtggtaggaggactttgtatgatcttatcttggtttgtcagtctagttcccatcctgtggatgtgtagggggaggcaactatttcatgacagaaagttacgtcttgaggtacacaagaaggctttaactctttgaagactgctctgtgggttgagcagcaggggtcactttacttaaatagtcgacaggctgcactggcacatcagtgagctagctaccacgtgggtcccctggcatctgcaatatgtcgagtatgacctaggatcactagaatggtggcgggccgactaacatgtgccgccgagccttcaaacactggaagtgtcagggtcaaacaaaagaaaatgtctgagggaacaacacacgaaatcaaatgtcaacgtacgcaaaaacccagaataggaacggaagaagagaacaacgagagacaaacaacgcacaaagaacatgagacaacacagcagacaatgaagg

SEQ ID NO: 567320 - DNA, 1174 bp, Homo sapiens
  misc_feature (5)..(5): n is a, c, g, or t
gcgtnctagtaggactcaaacgacccgaagaccaaagacaggcatccccagagacatcagcttccccagatgggtcacaaaatctggtttatgagacagaacttctcaggacccagctcaatgacagcttaaaggaaattcaccaaaaggagttaagaattcagcaactgaacagcaacttctctcagctactggaagagaaaaacaccctttccattcagctctgcgataccagtcagagtcttcgtgagaaccagcagcactatggtgaccttttaaatcactgtgcagtcttggagaagcaggttcaagagctgcaggcggggccactaaatatagatgttgctccaggagctccccaggaaaagaatggagttcacagaaagagtgaccctgaggaactaagggaaccgcagcaaagcttttctgaagctcagcagcagctatgcaacaccagacaggaagtgaatgaattaaggaagctgctggaagaagaacgagaccaaagagtggctgctgagaatgctctctctgtggccgaggagcagatcagacggttagagcacagtgaatgggactcttcccggactcctatcattggctcctgtggcactcaggagcaggcactgttaatagatcttacaagcaacagttgtcgaaggacccggagtggcgttggatggaagcgagtcctgcgttcactctgtcattcacggacccgagtgccacttctagcagccatctactttctaatgattcatgtcctgctcattctgtgttttacgggccatctatagacttagttgttactctttggaccactcccctcaaaacttggaattctctcacctctaacatcagaacatcaattccagtggaacagtcttcccatttacaggtcttctctccaactcttcacggaaagtgcctgcaaaaacagaggtggatacgaggacaggttggagctgcagggactggcgagtctgctttcttctactgccctgagcctgaacgcttctgcttaatctgagaatcacatttggtttgttgagcctaatatttgttgagattttgcaggaccctgatcttttgtggtcctgtaaaagatactgaggaatgtctttcagccaagccaagaggatggtttcaataaacctaataatctgaagttcag

SEQ ID NO: 567321 - DNA, 398 bp, Homo sapiens
ttccatgctgctgcggtacaagggtggtgatcatcgacgagggccacgagaggagcgtgtacacggagcatcctcatcggcctcctagtgccgcaacttgtgtactcgtccgggctaagcaggaacgctggccatgtcaagtcgtgtcatcatgtcggaccacgctgctggggtggcatggacttgcaccctaggaagccccacggactcttcggcaagccgtcgccggtcgatctaaggtggaatccaggcagttcccagtgactgtgcatttcaacaagcggacaccgttggaaaactacatgtggctgagtgcttcctggaaggtctgcgaagatccacctggatgcatgcccggaaggtggcatctctgagtggttcactgtagtggggcgagg

SEQ ID NO: 567322 - DNA, 1212 bp, Homo sapiens
taatcaagctgactcttcccatcaggtgcagactccaaagactggctggcaggctcacatgaaagaggaccaaagacaggcatccccagagacatcagcttccccagatgggtcacaaaatctggtttatgagacagaacttctcaggacccagctcaatgacagcttaaaggaaattcaccaaaaggagttaagaattcagcaactgaacagcaacttctctcagctactggaagagaaaaacaccctttccattcagctctgcgataccagtcagagtcttcgtgagaaccagcagcactatggtgaccttttaaatcactgtgcagtcttggagaagcaggttcaagagctgcaggcggggccactaaatatagatgttgctccaggagctccccaggaaaagaatggagttcacagaaagagtgaccctgaggaactaagggaaccgcagcaaagcttttctgaagctcagcagcagctatgcaacaccagacaggaagtgaatgaattaaggaagctgctggaagaagaacgagaccaaagagtggctgctgagaatgctctctctgtggccgaggagcagatcagacggttagagcacagtgaatgggactcttcccggactcctatcattggctcctgtggcactcaggagcaggcactgttaatagatcttacaagcaacagttgtcgaaggacccggagtggcgttggatggaagcgagtcctgcgttcactctgtcattcacggacccgagtgccacttctagcagccatctactttctaatgattcatgtcctgctcattctgtgttttacgggccatctatagacttagttgttactctttggaccactcccctcaaaacttggaattctctcacctctaacatcagaacatcaattccagtggaacagtcttcccatttacaggtcttctctccaactcttcacggaaagtgcctgcaaaaacagaggtggatacgaggacaggttggagctgcagggactggcgagtctgctttcttctactgccctgagcctgaacgcttctgcttaatctgagaatcacatttggtttgttgagcctaatatttgttgagattttgcaggaccctgatcttttgtggtcctgtaaaagatactgaggaatgtctttcagccaagccaagaggatggtttcaataaacctaataatctgaagttcag

SEQ ID NO: 567323 - DNA, 328 bp, Homo sapiens
gatcctccctaggccctgcctaaccttgagttgtttctcaatccctctggctgcagaagtcccgtgacccttaatgagaggaggggcaggaccagatcttttgagagctgagggttgagggcattgagccaacacacagatttgtcgcctctgtccccgaagacacctgcaccctccatgcggagccaagatggggaatggaactgaggaagattataactttgtcttcaaggtggtgccgatcggcgaatcaggtgtggggaagaccaatctactctcccgattcacgcgcaatgagttcagccacgacagccgcaccaccatcggg

SEQ ID NO: 567324 - DNA, 362 bp, Homo sapiens
  misc_feature (1)..(1): n is a, c, g, or t
naaccatgccttcaggatcttttttttataagtaaccacgttgtggacaaacaaactttaacttcccctaccccattccattaaaaaggaatggttttaaaaagcttaccttaactttattaaaaggaattggccagtttccaagaatgaataaattacaagatgatacagtgagaccaatgattaaggaaataagagcggacactaaagtgcctttgggaaagacagctattgaaatgactacaaaagttttaccataaaattcagaccctatacctgaaaaatcaccatcctgtattgtaagtatatatataattcactttcctatcagaaccaagaaagcactctagttcccattttcc

SEQ ID NO: 567325 - DNA, 381 bp, Homo sapiens
taagcctcactccttcccttgagaccttgctgactgactgagctgggttggtcaggtggtgccctcaatgttgaggctcgaatacgaggggttcagtgaagggcatggcagaagaggaagctcacacaaaggaaaatacaaaaatctgggccagcagaggacccaatcccaactctctccaacaactgctgatgagcacggacggctgtgcaggaaggagagggagccagtactcagcaacagatacagtacacaggcgatggtcaactgttggctgtttgcaccccacagcatcctttggcaaaaggggaccattaatgtggattcatctttctccaaaagaaagctggttaaatacagaattgtaggacttggattacc

SEQ ID NO: 567326 - DNA, 269 bp, Homo sapiens
gtgctggcatagattaacatactcaacatcatctagagactggattgcatggtctagaacggatggtcagggctgtccctgtccgcaggtggggatgccggtgtgctgagtcctgtggatgactcaggagttggcctggatggtttcctggatccacttggtgaacttgcagaggttcgtgtagacacccggtctgttgggccgggcacaagggtaatctccccaggacacgagtccctgcagggcagccattgcaacacggtctctca

SEQ ID NO: 567327 - DNA, 311 bp, Homo sapiens
  misc_feature (32)..(32): n is a, c, g, or t
  misc_feature (37)..(37): n is a, c, g, or t
  misc_feature (46)..(46): n is a, c, g, or t
  misc_feature (110)..(110): n is a, c, g, or t
  misc_feature (116)..(116): n is a, c, g, or t
  misc_feature (128)..(128): n is a, c, g, or t
  misc_feature (168)..(168): n is a, c, g, or t
ggtctttgtgagaccggtgcaggcctggggtngtctnctgtctggncagagaagagaaaaatgtaggacactggtttagtagtggctttgttttggtttggttttggttnctcagnagtggttgtttntggtgggatcattggttatgtaaaaggaggtagtgtgtcntccttgggttgtgggttggtctttgtgagtttagtcggtctgggtgttttccagttgttttaggatccaaggaacgtttggggttttgctagcttcatctgggtccttgggttggtattatggggaatgaggttcttccactt

SEQ ID NO: 567328 - DNA, 1824 bp, Homo sapiens
  misc_feature (246)..(246): n is a, c, g, or t
  misc_feature (1767)..(1767): n is a, c, g, or t
  misc_feature (1824)..(1824): n is a, c, g, or t
gattgcttaattgccgccatctgtgacgtggaaagtcgggactactgactacctcatctttacgaagccatgatctgcagtctctgatagtactactagacttcatgacgtcctatctcgctgtatggcgcatgctggagctgagtccaggacgggctcatgcgttctaatggtgtgcgcaccaagatcatagagaaggtagctcgatagcgacgccactcaatacatttggccatttcaactacnttgcgtatcaagaacctgatatcaccatcgagtacggtaatccagtgaggtgcgttcggtgcagacgtggaacttagctgccccgcgtgcaatagttcttgtattgacccgcgctgattggtcgagcagtttaactcgcgctggaatactacggtacgcattgagagagcggaatcgtgggcaactgctattgagccctccctcgttcatgcctcctctataccgtacgcttgacattgtcgaactaattcctcgccatcatcacgatctgcgaacgagccaccgtgagagacccaggagatagagcttaggctattgctaaaatcaagccactacatcaaccgtacctcattaaagaccaagcgggagacaccttcattcgttccgacaaatcccccattggcgggaagggcctataccactgtctaacgtaaccacctttacaaaccctacttcgtataccttccaccatgtggaaccaatctcctcaagggcggaagccgctgtgatttcggtctcctttctttaacattcaatcttatagcctgggggccccattttcgcaccaatattttggccaatccctagggggaaatggattaacttttaattttgtagaactccatggatgaacaacgctcgcggcgtaggggttccaattggaagaccccgccacaatttcaaacaccacataagtccggaccctcactttgcctttagctggttgccttcggaacttccaccaggtgacgccgtaaacactaccaccccatgcccaaaggctctctcttggatacaaatgttccattcccccttgaagtgccgttcctttgctcgcccaggtgttgccccttcagggcgttagttcttagtgccccaatttcgaaggctttaaacttatcttaaaccattaataccaaagggaggcccgcgtctagaaagcataacgagagggaggcgaaccttttaccctataccgaagaacaccgggcccctgggaaagggacatgggaagagatcgtccccgcacctctgctgattatgggcgcaaaactagaagccttaaggttggtcgtcggaaatataatcccccaggggaactagagccgcctgcgcacaacgattcttcaatcaactatgacgaagtactcctccgtgaccgcaagcggggccaaacggcgggcacagtaaaagatgctgtcgccccatgaattggcttgacaacgcttcacaataggtgtccgggaacggagcaaagtgacaaccccccggggggggatacccaacaacggccaaatgatggtgcttggagggaggacggcaaagatcaacccaaggaggggggtgacacacagggagggacgaaaactgagcgggacggagcaccccacaatcaaaattgagtcagggcagacaaaagatcaccgtcgtgagtcacgccacacgtaattatatacgatcagggagagagacaatcatagctggatgcacacaaggagccggtcagaaaacgtcgagccngtgccgcgacccgaagcggagcgtgacaacatgaacagagcggacaggagcgaaaan

SEQ ID NO: 567329 - DNA, 332 bp, Homo sapiens
ctcggtctaccttgtctttaatctccattttcagatggggacattaagacaatgagaaagtatggaacctacctaaggtcacacagctagcagtgagggagctatagtcgtgaatgcagcattctggctccagagctggtatcctgtcacgctgtggctgccctcagcaagagtaaagtgaggaggaacactgtaggagggaaggaagaactcaggaaaactctgaggaggtggcgtctgctgagcagggctttgatgaatggggaggatttggtttgtgtagaaatggaaaaggatgtttggtttcttggcagagacaaggtagagccgag

SEQ ID NO: 567330 - DNA, 241 bp, Homo sapiens
tgtgtgtgtgtgtgtgtgtggcggggggggtgtccaatcaaagacttaactaggtcaggcgtggtggctcacacctgtaatcctagcactttggaaggctgagatggaaggatcacttaagcccaggagttcaaggctgtggagagctagtattgtgccagtgcattccacctgggtgaaagagcaagaccctctttctaaaaaacaaaaaacgaaacaccaaccaaaaaacgggtaccga

SEQ ID NO: 567331 - DNA, 1169 bp, Homo sapiens
cctgagataaatgaatgtgaggtttcaaagtggcttcaatgctaaagtaaatgtattaaccatttggaaaatacaagacaattactttagcagtgaagccactttgaaacctgagataaatgaatgtgaggtatctttctgctttcctcatttgtgtagatgtactgatctgtatctgttgatttaaattattttgtttccagatgggcacatgaaatatttaaactattatagtgtgcctttctgtccaaatgtagcatagttaccagggaagattagtccagtgattacataagagttgggcaccataaattctctatatttgcctcccatggaggcctttgaaatgcatctttattaaaaatcaaaatataaccaggatactgaaagtcagtatatgaatggtaaaatcgtgacatatcctatgtccatgccattcttgctaaggttgacatggtatatataaactgaggagcaactgcattccagaatcaagcaataagataagcctttaagtatggcacacttgtatatagaggtgtaaaaatccacacgtggcatgataattccctgatcactaagtatacccacacgaacttcaaatagtacactacacggactaggcactgcagacagtaagcagaggattcatcgaaaactacaaggcatcccgacatgcacctcggtaccccagaacaccactgcaacactgagggtacaaagggaaacaatagccaaaatcacggaacagacacaacataagtaatgaaacttcgcgtacctacaggacaagaacggccatcgcccacatccggcacacactagccaactcgaccttacagccatgacgacgcaaacgactttgcccaacggaacgctggaccttgcacctcaggaaacacacttacagagagagtcgagtaaaaacccaagggtgtagaaaatgaccatggggaaaacaagaacgtcgtgttggaacttagcacatgaggtagactcaggactatcagggtgcaaacgatctcgactatgtgcgtacattagagacaagcaagagaagatcacgatgtgataagtgttgcacacggaggctatgacgatacgcaatcatgaggttatccaaagcagaagaaaaggcggttgcagaaacgcagttctccactagtaat

SEQ ID NO: 567332 - DNA, 178 bp, Homo sapiens
cgggaaccaaaagcaaaaatagccaaatgggattcccccaacttaaaaagcttttgcatagttaccgaaccaattaccccagtgaagagccaccggccagattgggagaaaattttgccaattcatccattggttaaggggttaatattcaaattttatgaggacctcaacctcccca

SEQ ID NO: 567333 - DNA, 746 bp, Homo sapiens
  misc_feature (1)..(1): n is a, c, g, or t
ngccaagtcgctgggataggtgcgcccgggcattttctcccccgtccatatgttgggtgtccccccgcggtcaaatttttgtgcgtgcttgacccctcttcccgtggcccatattgatgtctctggccagtggttttgccgcctctgagttcaatcttgtgttgttccgcgcgtaggggccgctctggcgcgtgtgtaaccccaaccgtgcttccccttgcacgtgtgtgtcttcccgccagcggtttacggtggtggcctgtaccggtcccccctactgggctccttccccataggatccgtgttttcgcccacaacataggaggcttcactatcccccggatgtgtccgcctcattttccgcggggacccccctctgggccccacgcttgcgggccccaataccctcttgcgcctatcaaaaattctctcgtcgcgttaataataaacatttcttttccgcaccaacaacatttttccgcgcctttccccgggataccccccccgttttctctggggcatacccccgatgccatacgccccccatgcgacaatctcctatcaatcttgtaggcgctccccatccatttctttttcaccacgcccggggatatttaataattttccatgaatttgagaaacccctctccttttgaaaccgaaactccttataataggagacacccccccacccggggggcaattgggggccccccccccccccccctttgagaaccccttaaaaa

SEQ ID NO: 567334 - DNA, 980 bp, Homo sapiens
attcaaaagtgcgttcccttctgggtgatgctatcacaactaccaccactgggtgcagattggcctgcaggtagacctggaagatgaaacaccaacggaccgggctgatttacgttcagtaagactttcgggtcatgctctaagtagctctgggtgacgatgcggggttatagtcgtatgcgtggcagtagtttccacctgggttacattgacgcgtatagcatcaagcgtgccacgtgtaccaggattggaccagacgagtgcatggcgttagtgcttttagacactactcgtgttgtagagaggtggctttgaagaacgcttttgaataaacgttagtcggggtggttactggttccccttaggaagtctgcttggatatggccgttaaactaacaggttgcatctgctgtctggagtgcgaagtgcatatctatccccttggttgattgtttcaacggacccaatgtattttcgttaagctatgccccgtggcgaactcatgtgcactggcgagcaagctgctttggccatgcttgctcaacatttggggtgcattacggaagcgcgacgggtcagtacagatggaggcttaacgcaccgttgacagatgaacagtaggtaccacttgtggcctagatgggtcatagccgaaactctgaaattagggaaaagcccttccctttgtggcttggtcaagatggtcaaactctaggtttagaaagtgcaacgagttataaaactcaataaacccaggggcccttacacactctccgtggtccaatcggttacgatgataaggaagatatttgtgtgacgaaagatgacggagtccttggcatatggtaaggccaaagggctggaactccaagacttaccttgggctccaggttgaatcgtccaactatggggtaccttgacgtaagctggcggacaacagggcacatttgctcgagcatagaccaggtccaggggccttg

SEQ ID NO: 567335 - DNA, 201 bp, Homo sapiens
ccaaaaaggggggggggggtttccctttttgtttccacctttaggggggtgggggggccctttttttttcccccccggaaaaaaaaatttggaaaaaaatttggtttttccaaaattttgtttggggggggggggggtttttttaattaggccctttttggggggttgggggggcaaataaagccttgggacccttcccga

SEQ ID NO: 567336 - DNA, 536 bp, Homo sapiens
  misc_feature (58)..(58): n is a, c, g, or t
  misc_feature (76)..(76): n is a, c, g, or t
  misc_feature (273)..(273): n is a, c, g, or t
  misc_feature (318)..(318): n is a, c, g, or t
  misc_feature (403)..(403): n is a, c, g, or t
tctagaggatcccgtcaggtggtggtgggtagcgcatgtcgtcagaagagcggagtgngagcaggtggttctgtgnctgtgctgtcctttccggagaggggctaggtcgagttgagatttctccttcttgttttatctttgtcttcataaggggtggtagggtggttcgtagcagtctccgggctactagggcgttgtgtgctggtagtaactggttcattgaaaggggcatctccctccccgcgtctgcctgaagcaggggaaggacttcgnccagccaaggcagttgtatgagttttagctgcagcacttcgaganctgcaggagttaattgaggacgtgggagaggaaggaaatcagctcaaagggagaacagaaaaccccctccccaattcccatccanctttcctaactggacaaccctcttccaaaaagcctttagtcgcacaactcaaatcattcactgaaatgcaagtacagtccactttggttcttattttcccaacacaatcccaaagagcgttctccctctaccc

SEQ ID NO: 567337 - DNA, 105 bp, Homo sapiens
  misc_feature (11)..(11): n is a, c, g, or t
tctcagaagcngctgtttcagactcaatcgaagttaccaggtactgggttccttgaatgtcttcatctgcttatgtaatggccttctgtctcttttgatctgttg

SEQ ID NO: 567338 - DNA, 1100 bp, Homo sapiens
gcctgagaaggaaggaacaatgattctccaggatactgcacggggatcggcacaggtgaacattcgccctggcatcactcagctgtgtccggcagcctgaacactattctgtgggtattcgaggagaaaaacaccctttccattcagctctgcgataccagtcagagtcttcgtgagaaccagcagcactatggtgaccttttaaatcactgtgcagtcttggagaagcaggttcaagagctgcaggcggggccactaaatatagatgttgctccaggagctccccaggaaaagaatggagttcacagaaagagtgaccctgaggaactaagggaaccgcagcaaagcttttctgaagctcagcagcagctatgcaacaccagacaggaagtgaatgaattaaggaagctgctggaagaagaacgagaccaaagagtggctgctgagaatgctctctctgtggccgaggagcagatcagacggttagagcacagtgaatgggactcttcccggactcctatcattggctcctgtggcactcaggagcaggcactgttaatagatcttacaagcaacagttgtcgaaggacccggagtggcgttggatggaagcgagtcctgcgttcactctgtcattcacggacccgagtgccacttctagcagccatctactttctaatgattcatgtcctgctcattctgtgttttacgggccatctatagacttagttgttactctttggaccactcccctcaaaacttggaattctctcacctctaacatcagaacatcaattccagtggaacagtcttcccatttacaggtcttctctccaactcttcacggaaagtgcctgcaaaaacagaggtggatacgaggacaggttggagctgcagggactggcgagtctgctttcttctactgccctgagcctgaacgcttctgcttaatctgagaatcacatttggtttgttgagcctaatatttgttgagattttgcaggaccctgatcttttgtggtcctgtaaaagatactgaggaatgtctttcagccaagccaagaggatggtttcaataaacctaataatctgaagttcag

SEQ ID NO: 567339 - DNA, 140 bp, Homo sapiens
atatgcactgggccctgaaccacacttcacttaagaccacgggtggtgttatttcaaagcccccaagggaaaccgtgggcggtacagacattttcaaagtggccagtgttactttaatgggacggccttcgtaattcatg

SEQ ID NO: 567340 - DNA, 151 bp, Homo sapiens
atactacactttattctaatataggaacttcataatataaaatccaacgcacgatgctagagataaaaaaagagggtgggagatgtggagccaggattcaaatcgaaaatcgtaatcggaaactaaaccagcattgcaaccgggccataag

SEQ ID NO: 567341 - DNA, 9754 bp, Homo sapiens
  misc_feature (603)..(603): n is a, c, g, or t
  misc_feature (618)..(618): n is a, c, g, or t
  misc_feature (676)..(676): n is a, c, g, or t
  misc_feature (685)..(685): n is a, c, g, or t
  misc_feature (1078)..(1078): n is a, c, g, or t
  misc_feature (1116)..(1116): n is a, c, g, or t
ttttttttttatagtgcatgcaggaaattgcaattttatttatgtttgtattgatacatatttgtacatatttatggggtgtggtagtttgatatatgcatacaatgtgtaatgatcaaatcagggtgtttaggatatctatcacctcaaacatttatcatttttgtgtttggaacatttctaatctcctagttattttgaaatatataacatattgttaactatagtcaccctactgtgctatcaaacacttgaacttattccttctatctacgtttgtacccattaaccaatctcttccctccctcccccaactccaccttcccagcctctggtacttatctctactccatgagatcaactttttaagctcccacatgagtgagaccatgggatatttgtctttctgtgccagacttatttcacttagaataatgacctccagttccgtaagatgggcagccaggaaaggccttacttagctgatgtttgaattgtgaagttatgtaatcattaagatgagtatacatacaatgggccagctgagtgcacagcaagattcaataaattcaaactaacattactcttattgccaagagagtncctgaaatgacagcncattggaaactggctactttccttccctttccttaggggtttaaggaaagcatgagtnatttcagtnttttgctggagctcctcactgacactcattgcagagcctgagccctcaactctcaatctttgcttaggtcctggcttaggctccactttgtaagaggcaccttcctagtattcactactctctctctcacaatcatgtccttacagacattgctgatcctctttcatactgacaccgggttctagtccgagttccatcactaagtcgctgtttgactttgggcaagttacttctgtggttaattatttttcatcaacaaaatcaaaaggtgaaactagacgaacaactaagaggctccagtattttttcaatctaagagtcccatatcccccactcccttctcacagctcattcaacaatcctaatggcagcgggtgcccgcagtctcaagtntctgccgaagcccaagccgctgtctcggtcagtcacanccgacgaagaggaggaattggaggaagccagcataaccacctcacactgagaacatctgacctttcccagaacgcccgcccactcgacacttcctgtccctccccagatcttgttccggggcacctactcgggtctaatcactcccctcattcactctttagggtccattgctgtttctttgaggaagcggagcatcttctgtcgttgattggtttccgtcattgttgataggttggtaacaaacaaggtgtgcctggtctcctggtaacgtcctgccgatagtcctgattggtcggtgtcttaatcccatcttccgtcccaactgctagtggctgagtccctggcggggcgcggcggtggaaggtgtcgcgtacgggcttcccgagctgacgtggcttgaattgggaggggggcagctggagcctcaggcggcagcgcttctagaaatgctgagccgattatcaggattagcaaatgttgttttgcatgaattatcaggagatgatgacactgatcagaatatgagggctcccctagaccctgaattacaccaagaatctgacatggaatttaataatactacacaagaagatgttcaggagcgcctggcttatgcagagcaattggtggtggagctaaaagatattattagacagaaggatgttcaactgcagcagaaagatgaagctctacaggaagagagaaaagctgctgataacaaaattaaaaaactaaaacttcatgcgaaggccaaattaacttctttgaataaatacatagaagaaatgaaagcacaaggagggactgttctgcctacagaacctcagtcagaggagcaactttccaagcatgacaagagttctacagaggaagagatggaaatagaaaagataaaacataagctccaggagaaggaggaactaatcagcactttgcaagcccagcttactcaggcacaggcagaacaacctgcacagagttctacagagatggaagaatttgtaatgatgaagcaacagctccaggagaaggaagaattcattagcactttacaagcccagctcagccagacacaggcagagcaagctgcacagcaggtggtccgagagaaagatgcccgctttgaaacacaagttcgtcttcatgaagatgagcttcttcagttagtaacccaggcagatgtggaaacagagatgcaacagaaattgagggtgctgcaaaggaagcttgaggaacacgaagaatccttggtgggccgtgctcaggtcgttgacttgctgcaacaggagctgactgctgctgagcagagaaaccagattctctctcagcagttacagcagatggaagctgagcataatactttgaggaacactgtggaaacagaaagagaggagtccaagattctactggaaaagatggaacttgaagtggcagagagaaaattatccttccataatctgcaggaagaaatgcatcatcttttagaacagtttgagcaagcaggccaagcccaggctgaactagagtctcggtatagtgctttggagcagaagcacaaagcagaaatggaagagaagacctctcatattttgagtcttcaaaagactggacaagagctgcagtctgcctgtgatgctctaaaggatcaaaattcaaagcttctccaagataagaatgaacaggcagttcagtcagcccagaccattcagcaactggaagatcagctccagcaaaaatccaaagaaattagccaatttctaaatagactgcccttgcaacaacatgaaacagcatctcagacttctttcccagatgtttataatgagggcacacaggcagtcactgaggagaatattgcttctttgcagaagagagtggtagaactagagaatgaaaagggagccttgctccttagttctatagagctggaggagctgaaagctgagaatgaaaaactgtcttctcagattactctcctagaggctcagaatagaactggggaggcagacagagaagtcagtgagatcagcattgttgatattgccaacaagaggagctcttctgctgaggaaagtggacaagatgttctagaaaacacattttctcagaaacataaagaattatcagttttattgttggaaatgaaagaagctcaagaggaaattgcatttcttaaattacagctccagggaaaaagggctgaggaagcagatcatgaggtccttgaccagaaagaaatgaaacagatggagggtgagggaatagctccaattaaaatgaaagtatttcttgaagatacagggcaagattttcccttaatgccaaatgaagagagcagtcttccagcagttgaaaaagaacaggcgagcactgaacatcaaagtagaacatctgaggaaatatctttaaatgatgctggagtagaattgaaatcaacaaagcaggatggtgataaatccctttctgctgtaccagatattggtcagtgtcatcaggatgagttggaaaggttaaaaagtcaaattttggagctcgagctaaactttcataaagcacaagaaatctatgagaaaaatttagatgagaaagctaaggaaattagcaacctaaaccagttgattgaggagtttaagaaaaatgctgacaacaacagcagtgcattcactgctttgtctgaagaaagagaccagcttctctctcaggtgaaggaacttagcatggtaacagaattgagggctcaggtaaagcaactggaaatgaaccttgcagaagcagaaaggcaaagaagacttgattatgaaagccaaactgcccatgacaacctgctcactgaacagatccatagtctcagcatagaagccaaatctaaagatgtgaaaattgaagttttacagaatgaactggatgatgtgcagcttcagttttctgagcagagtaccctgataagaagcctgcaaagccagctgcaaaataaggaaagtgaagtgcttgagggggcagaacgtgtaaggcatatctcaagtaaagtggaagaactgtcccaggctctttcacagaaggaacttgaaataacaaaaatggatcagctcttactagagaaaaagagagatgtggaaaccctccaacaaaccatcgaggagaaggatcaacaagtgacagaaatcagctttagtatgactgagaaaatggttcagcttaatgaagagaagttttctcttggggttgaaattaagactcttaaagaacagctaaatttattatccagagctgaggaagcaaaaaaagagcaggtggaagaagataatgaagtttcttctggccttaaacaaaattatgatgagatgagcccagcaggacaaataagtaaggaagaacttcagcatgaatttgaccttctgaagaaagaaaatgagcagagaaagagaaagctccaggcagctcttattaacagaaaggagcttctgcaaagagtcagtagattggaagaagaattagccaacttgaaagatgaatctaagaaagaaatcccactcagtgagactgagaggggagaagtggaagaagataaagaaaacaaagaatactcagaaaaatgtgtgacttctaagtgccaagaaatagaaatttatttaaaacagacaatatctgagaaagaagtggaactacagcatataaggaaggatttggaagaaaagctggcagctgaagagcaattccaggctctggtcaaacagatgaatcagaccttgcaagataaaacaaaccaaatagatttgctccaagcagaaatcagtgaaaaccaagcaattatccagaagttaatcacaagtaacacggatgcaagtgatggggactccgtagcacttgtaaaggaaacagtggtgataagtccaccttgtacaggtagtagtgaacactggaaaccagaactagaagaaaagatactggcccttgaaaaagaaaaggagcaacttcaaaagaagctacaggaagccttaacctcccgcaaggcaattcttaaaaaggcacaggagaaagaaagacatctcagggaggagctaaagcaacagaaagatgactataatcgcttgcaagaacagtttgatgagcaaagcaaggaaaatgagaatattggagaccagctaaggcaactccagattcaagtaagggaatccatagacggaaaactcccaagcacagaccagcaggaatcgtgttcttccactccaggtttagaagaacctttattcaaagccacagaacagcatcacactcaacctgttttagagtccaacttgtgcccagactggccttctcattctgaagatgcgagtgctctgcagggcggaacttctgttgcccagattaaggcccagctgaaggaaatagaggctgagaaagtagagttagaattgaaagttagttctacaacaagtgagcttactaaaaaatcagaagaggtatttcagttacaagagcagataaataaacagggtttagaaatcgagagtctaaagacagtatcccatgaagctgaagtccatgccgaaagcctgcagcagaaattggaaagcagccaactacaaattgctggcctagaacatctaagagaattgcaacctaaactggatgaactgcaaaaactcataagcaaaaaggaagaagacgttagctacctttctggacaacttagtgagaaagaagcagctctcactaaaatacagacagagataatagaacaagaagatttaattaaggctctgcatacacagctagaaatgcaagccaaagagcatgatgagaggataaagcagctacaggtggaactttgtgaaatgaagcaaaaaccagaagagattggagaagaaagtagagcaaagcaacaaatacaaaggaaactgcaagctgcccttatttcccgaaaagaagcactaaaagaaaacaaaagtctccaagaggaattgtctttggccagaggtaccattgaacgtctcaccaagtctctggcagatgtggaaagccaagtttctgctcaaaataaagaaaaagatacggtcttaggaaggttagctcttcttcaagaagaaagagacaaactcattacagaaatggacaggtctttattggaaaatcagagtctcagcagctcctgtgaaagtctaaaactagctctagagggtcttactgaagacaaggaaaagttagtgaaggaaattgaatctttgaaatcttctaagattgcagaaagtactgagtggcaagagaaacacaaggagctacaaaaagagtatgaaattcttctgcagtcctatgagaatgttagtaatgaagcagaaaggattcagcatgtggtggaagctgtgaggcaagagaaacaagaactgtatggcaagttaagaagcacagaggcaaacaagaaggagacagaaaagcagttgcaggaagctgagcaagaaatggaggaaatgaaagaaaagatgagaaagtttgctaaatctaaacagcagaaaatcctagagctggaagaagagaatgaccggcttagggcagaggtgcaccctgcaggagatacagctaaagagtgtatggaaacacttctttcttccaatgccagcatgaaggaagaacttgaaagggtcaaaatggagtatgaaaccctttctaagaagtttcagtctttaatgtctgagaaagactctctaagtgaagaggttcaagatttaaagcatcagatagaagataatgtatctaaacaagctaacctagaggccaccgagaaacatgataaccaaacgaatgtcactgaagagggaacacagtctataccaggtgagactgaagagcaagactctctgagtatgagcacaagacctacatgttcagaatcggttccatcagcgaagagtgccaaccctgctgtaagtaaggatttcagctcacatgatgaaattaataactacctacagcagattgatcagctcaaagaaagaattgctggattagaggaggagaagcagaaaaacaaggaatttagccagactttagaaaatgagaaaaataccttactgagtcagatatcaacaaaggatggtgaactaaaaatgcttcaggaggaagtaaccaaaatgaacctgttaaatcagcaaatccaagaagaactctccagagttaccaaactaaaggagacagcagaagaagagaaagatgatttggaagagaggcttatgaatcaattagcagaacttaatggaagcattgggaattactgtcaggatgttacagatgcccaaataaaaaatgagctattggaatctgaaatgaagaaccttaaaaagtgtgtgagtgaattggaagaagaaaagcagcagttagtcaaggaaaaaactaaggtggaatcagaaatacgaaaggaatatttggagaaaatacaaggtgctcagaaagaacccggaaataaaagccatgcaaaggaacttcaggaactgttaaaagaaaaacaacaagaagtaaagcagctacagaaggactgcatcaggtatcaagagaaaattagtgctctggagagaactgttaaagctctagaatttgttcaaactgaatctcaaaaagatttggaaataaccaaagaaaatctggctcaagcagttgaacaccgcaaaaaggcacaagcagaattagctagcttcaaagtcctgctagatgacactcaaagtgaagcagcaagggtcctagcagacaatctcaagttgaaaaaggaacttcagtcaaataaagaatcagttaaaagccagatgaaacaaaaggatgaagatcttgagcgaagactggaacaggcagaagagaagcacctgaaagagaagaagaatatgcaagagaaactggatgctttgcgcagagaaaaagtccacttggaagagacaattggagagattcaggttactttgaacaagaaagacaaggaagttcagcaacttcaggaaaacttggacagtactgtgacccagcttgcagcctttactaagagcatgtcttccctccaggatgatcgtgacagggtgatagatgaagctaagaaatgggagaggaagtttagtgatgcgattcaaagcaaagaagaagaaattagactcaaagaagataattgcagtgttctaaaggatcaacttagacagatgtccatccatatggaagaattaaagattaacatttccaggcttgaacatgacaagcagatttgggagtccaaggcccagacagaggtccagcttcagcagaaggtctgtgatactctacagggggaaaacaaagaacttttgtcccagctagaagagacacgccacctataccacagttctcagaatgaattagctaagttggaatcagaacttaagagtctcaaagaccagttgactgatttaagtaactctttagaaaaatgtaaggaacaaaaaggaaacttggaagggatcataaggcagcaagaggctgatattcaaaattctaagttcagttatgaacaactggagactgatcttcaggcctccagagaactgaccagtaggctgcatgaagaaataaatatgaaagagcaaaagattataagcctgctttctggcaaggaagaggcaatccaagtagctattgctgaactgcgtcagcaacatgataaagaaattaaagagctggaaaacctgctgtcccaggaggaagaggagaatattgttttagaagaggagaacaaaaaggctgttgataaaaccaatcagcttatggaaacactgaaaaccatcaaaaaggaaaacattcagcaaaaggcacagttggattcctttgttaaatccatgtcttctctccaaaatgatcgagaccgcatagtgggtgactatcaacagctggaagagcgacatctctctataatcttggaaaaagaccaactcatccaagaggctgctgcagagaataataagcttaaagaagaaatacgaggcttgagaagtcatatggatgatctcaattctgagaatgccaagctagatgcagaactgatccaatatagagaagacctgaaccaagtgataacaataaaggacagccaacaaaagcagcttcttgaagttcaacttcagcaaaataaggagctggaaaataaatatgctaaattagaagaaaagctgaaggaatctgaggaagcaaatgaggatctgcggaggtcctttaatgccctacaagaagagaaacaagatttatctaaagagattgagagtttgaaagtatctatatcccagctaacaagacaagtaacagccttgcaagaagaaggtactttaggactctatcatgcccagttaaaagtaaaagaacttttgtcccagctagaagagacacgccacctataccacagttctcagaatgaattagctaagttggaatcagaacttaagagtctcaaagaccagttgactgatttaagtaactctttagaaaaatgtaaggaacaaaaaggaaacttggaagggatcataaggcagcaagaggctgatattcaaaattctaagttcagttatgacactggagactgatcttcagcccaagaactgaccagtaggctgcatgaagaaagagtgctggcggtccggc

SEQ ID NO: 567342 - DNA, 8490 bp, Homo sapiens
  misc_feature (603)..(603): n is a, c, g, or t
  misc_feature (618)..(618): n is a, c, g, or t
  misc_feature (676)..(676): n is a, c, g, or t
  misc_feature (685)..(685): n is a, c, g, or t
  misc_feature (1078)..(1078): n is a, c, g, or t
  misc_feature (1116)..(1116): n is a, c, g, or t
ttttttttttatagtgcatgcaggaaattgcaattttatttatgtttgtattgatacatatttgtacatatttatggggtgtggtagtttgatatatgcatacaatgtgtaatgatcaaatcagggtgtttaggatatctatcacctcaaacatttatcatttttgtgtttggaacatttctaatctcctagttattttgaaatatataacatattgttaactatagtcaccctactgtgctatcaaacacttgaacttattccttctatctacgtttgtacccattaaccaatctcttccctccctcccccaactccaccttcccagcctctggtacttatctctactccatgagatcaactttttaagctcccacatgagtgagaccatgggatatttgtctttctgtgccagacttatttcacttagaataatgacctccagttccgtaagatgggcagccaggaaaggccttacttagctgatgtttgaattgtgaagttatgtaatcattaagatgagtatacatacaatgggccagctgagtgcacagcaagattcaataaattcaaactaacattactcttattgccaagagagtncctgaaatgacagcncattggaaactggctactttccttccctttccttaggggtttaaggaaagcatgagtnatttcagtnttttgctggagctcctcactgacactcattgcagagcctgagccctcaactctcaatctttgcttaggtcctggcttaggctccactttgtaagaggcaccttcctagtattcactactctctctctcacaatcatgtccttacagacattgctgatcctctttcatactgacaccgggttctagtccgagttccatcactaagtcgctgtttgactttgggcaagttacttctgtggttaattatttttcatcaacaaaatcaaaaggtgaaactagacgaacaactaagaggctccagtattttttcaatctaagagtcccatatcccccactcccttctcacagctcattcaacaatcctaatggcagcgggtgcccgcagtctcaagtntctgccgaagcccaagccgctgtctcggtcagtcacanccgacgaagaggaggaattggaggaagccagcataaccacctcacactgagaacatctgacctttcccagaacgcccgcccactcgacacttcctgtccctccccagatcttgttccggggcacctactcgggtctaatcactcccctcattcactctttagggtccattgctgtttctttgaggaagcggagcatcttctgtcgttgattggtttccgtcattgttgataggttggtaacaaacaaggtgtgcctggtctcctggtaacgtcctgccgatagtcctgattggtcggtgtcttaatcccatcttccgtcccaactgctagtggctgagtccctggcggggcgcggcggtggaaggtgtcgcgtacgggcttcccgagctgacgtggcttgaattgggaggggggcagctggagcctcaggcggcagcgcttctagaaatgctgagccgattatcaggattagcaaatgttgttttgcatgaattatcaggagatgatgacactgatcagaatatgagggctcccctagaccctgaattacaccaagaatctgacatggaatttaataatactacacaagaagatgttcaggagcgcctggcttatgcagagcaattggtggtggagctaaaagatattattagacagaaggatgttcaactgcagcagaaagatgaagctctacaggaagagagaaaagctgctgataacaaaattaaaaaactaaaacttcatgcgaaggccaaattaacttctttgaataaatacatagaagaaatgaaagcacaaggagggactgttctgcctacagaacctcagtcagaggagcaactttccaagcatgacaagagttctacagaggaagagatggaaatagaaaagataaaacataagctccaggagaaggaggaactaatcagcactttgcaagcccagcttactcaggcacaggcagaacaacctgcacagagttctacagagatggaagaatttgtaatgatgaagcaacagctccaggagaaggaagaattcattagcactttacaagcccagctcagccagacacaggcagagcaagctgcacagcaggtggtccgagagaaagatgcccgctttgaaacacaagttcgtcttcatgaagatgagcttcttcagttagtaacccaggcagatgtggaaacagagatgcaacagaaattgagggtgctgcaaaggaagcttgaggaacacgaagaatccttggtgggccgtgctcaggtcgttgacttgctgcaacaggagctgactgctgctgagcagagaaaccagattctctctcagcagttacagcagatggaagctgagcataatactttgaggaacactgtggaaacagaaagagaggagtccaagattctactggaaaagatggaacttgaagtggcagagagaaaattatccttccataatctgcaggaagaaatgcatcatcttttagaacagtttgagcaagcaggccaagcccaggctgaactagagtctcggtatagtgctttggagcagaagcacaaagcagaaatggaagagaagacctctcatattttgagtcttcaaaagactggacaagagctgcagtctgcctgtgatgctctaaaggatcaaaattcaaagcttctccaagataagaatgaacaggcagttcagtcagcccagaccattcagcaactggaagatcagctccagcaaaaatccaaagaaattagccaatttctaaatagactgcccttgcaacaacatgaaacagcatctcagacttctttcccagatgtttataatgagggcacacaggcagtcactgaggagaatattgcttctttgcagaagagagtggtagaactagagaatgaaaagggagccttgctccttagttctatagagctggaggagctgaaagctgagaatgaaaaactgtcttctcagattactctcctagaggctcagaatagaactggggaggcagacagagaagtcagtgagatcagcattgttgatattgccaacaagaggagctcttctgctgaggaaagtggacaagatgttctagaaaacacattttctcagaaacataaagaattatcagttttattgttggaaatgaaagaagctcaagaggaaattgcatttcttaaattacagctccagggaaaaagggctgaggaagcagatcatgaggtccttgaccagaaagaaatgaaacagatggagggtgagggaatagctccaattaaaatgaaagtatttcttgaagatacagggcaagattttcccttaatgccaaatgaagagagcagtcttccagcagttgaaaaagaacaggcgagcactgaacatcaaagtagaacatctgaggaaatatctttaaatgatgctggagtagaattgaaatcaacaaagcaggatggtgataaatccctttctgctgtaccagatattggtcagtgtcatcaggatgagttggaaaggttaaaaagtcaaattttggagctcgagctaaactttcataaagcacaagaaatctatgagaaaaatttagatgagaaagctaaggaaattagcaacctaaaccagttgattgaggagtttaagaaaaatgctgacaacaacagcagtgcattcactgctttgtctgaagaaagagaccagcttctctctcaggtgaaggaacttagcatggtaacagaattgagggctcaggtaaagcaactggaaatgaaccttgcagaagcagaaaggcaaagaagacttgattatgaaagccaaactgcccatgacaacctgctcactgaacagatccatagtctcagcatagaagccaaatctaaagatgtgaaaattgaagttttacagaatgaactggatgatgtgcagcttcagttttctgagcagagtaccctgataagaagcctgcaaagccagctgcaaaataaggaaagtgaagtgcttgagggggcagaacgtgtaaggcatatctcaagtaaagtggaagaactgtcccaggctctttcacagaaggaacttgaaataacaaaaatggatcagctcttactagagaaaaagagagatgtggaaaccctccaacaaaccatcgaggagaaggatcaacaagtgacagaaatcagctttagtatgactgagaaaatggttcagcttaatgaagagaagttttctcttggggttgaaattaagactcttaaagaacagctaaatttattatccagagctgaggaagcaaaaaaagagcaggtggaagaagataatgaagtttcttctggccttaaacaaaattatgatgagatgagcccagcaggacaaataagtaaggaagaacttcagcatgaatttgaccttctgaagaaagaaaatgagcagagaaagagaaagctccaggcagctcttattaacagaaaggagcttctgcaaagagtcagtagattggaagaagaattagccaacttgaaagatgaatctaagaaagaaatcccactcagtgagactgagaggggagaagtggaagaagataaagaaaacaaagaatactcagaaaaatgtgtgacttctaagtgccaagaaatagaaatttatttaaaacagacaatatctgagaaagaagtggaactacagcatataaggaaggatttggaagaaaagctggcagctgaagagcaattccaggctctggtcaaacagatgaatcagaccttgcaagataaaacaaaccaaatagatttgctccaagcagaaatcagtgaaaaccaagcaattatccagaagttaatcacaagtaacacggatgcaagtgatggggactccgtagcacttgtaaaggaaacagtggtgataagtccaccttgtacaggtagtagtgaacactggaaaccagaactagaagaaaagatactggcccttgaaaaagaaaaggagcaacttcaaaagaagctacaggaagccttaacctcccgcaaggcaattcttaaaaaggcacaggagaaagaaagacatctcagggaggagctaaagcaacagaaagatgactataatcgcttgcaagaacagtttgatgagcaaagcaaggaaaatgagaatattggagaccagctaaggcaactccagattcaagtaagggaatccatagacggaaaactcccaagcacagaccagcaggaatcgtgttcttccactccaggtttagaagaacctttattcaaagccacagaacagcatcacactcaacctgttttagagtccaacttgtgcccagactggccttctcattctgaagatgcgagtgctctgcagggcggaacttctgttgcccagattaaggcccagctgaaggaaatagaggctgagaaagtagagttagaattgaaagttagttctacaacaagtgagcttactaaaaaatcagaagaggtatttcagttacaagagcagataaataaacagggtttagaaatcgagagtctaaagacagtatcccatgaagctgaagtccatgccgaaagcctgcagcagaaattggaaagcagccaactacaaattgctggcctagaacatctaagagaattgcaacctaaactggatgaactgcaaaaactcataagcaaaaaggaagaagacgttagctacctttctggacaacttagtgagaaagaagcagctctcactaaaatacagacagagataatagaacaagaagatttaattaaggctctgcatacacagctagaaatgcaagccaaagagcatgatgagaggataaagcagctacaggtggaactttgtgaaatgaagcaaaaaccagaagagattggagaagaaagtagagcaaagcaacaaatacaaaggaaactgcaagctgcccttatttcccgaaaagaagcactaaaagaaaacaaaagtctccaagaggaattgtctttggccagaggtaccattgaacgtctcaccaagtctctggcagatgtggaaagccaagtttctgctcaaaataaagaaaaagatacggtcttaggaaggttagctcttcttcaagaagaaagagacaaactcattacagaaatggacaggtctttattggaaaatcagagtctcagcagctcctgtgaaagtctaaaactagctctagagggtcttactgaagacaaggaaaagttagtgaaggaaattgaatctttgaaatcttctaagattgcagaaagtactgagtggcaagagaaacacaaggagctacaaaaagagtatgaaattcttctgcagtcctatgagaatgttagtaatgaagcagaaaggattcagcatgtggtggaagctgtgaggcaagagaaacaagaactgtatggcaagttaagaagcacagaggcaaacaagaaggagacagaaaagcagttgcaggaagctgagcaagaaatggaggaaatgaaagaaaagatgagaaagtttgctaaatctaaacagcagaaaatcctagagctggaagaagagaatgaccggcttagggcagaggtgcaccctgcaggagatacagctaaagagtgtatggaaacacttctttcttccaatgccagcatgaaggaagaacttgaaagggtcaaaatggagtatgaaaccctttctaagaagtttcagtctttaatgtctgagaaagactctctaagtgaagaggttcaagatttaaagcatcagatagaagataatgtatctaaacaagctaacctagaggccaccgagaaacatgataaccaaacgaatgtcactgaagagggaacacagtctataccaggtgagactgaagagcaagactctctgagtatgagcacaagacctacatgttcagaatcggttccatcagcgaagagtgccaaccctgctgtaagtaaggatttcagctcacatgatgaaattaataactacctacagcagattgatcagctcaaagaaagaattgctggattagaggaggagaagcagaaaaacaaggaatttagccagactttagaaaatgagaaaaataccttactgagtcagatatcaacaaaggatggtgaactaaaaatgcttcaggaggaagtaaccaaaatgaacctgttaaatcagcaaatccaagaagaactctccagagttaccaaactaaaggagacagcagaagaagagaaagatgatttggaagagaggcttatgaatcaattagcagaacttaatggaagcattgggaattactgtcaggatgttacagatgcccaaataaaaaatgagctattggaatctgaaatgaagaaccttaaaaagtgtgtgagtgaattggaagaagaaaagcagcagttagtcaaggaaaaaactaaggtggaatcagaaatacgaaaggaatatttggagaaaaaaaaaaaaaaaaaaaaaaaaaaaaaaaaaaaaaaaaaaaaaaaaaaaaaaaaaaaaaaaaggaaaaaaaaaaaaatacaaacgaagagagagaaacacaaaaaaaaaaaacacacccgaacgagtcggcggcactcaaggaaggccccccagagcagggcgcaatataagacagaagcgcccccgccgcacacaaaccaccaaccctagcagagatgtaaaacaatacccagagcaaccccgaccaaaacaccacacgactggtagaggaaaccacacagcgacccacctaaatccgaagacaacaacccccacccggggaccacacaaccgacaagagaccccaaccgggcacaccacaccgacacggaaaccacccaaaccaaccggccccacacggaccccaaccccagagaacacactacacacccagaacacccctaacgcccccacccgaaaccaccaccacacacaagcacgcaacctcaacaacacaccgcggcccaccaacacaccagccccaccgccacacacagcacacacacacaacaacccagcaacacagccacccagcaccacccgcaggggacaaccgcgcgggagaggcgaggccaaagagccagccagacgccgacacgaaagcgcacgggcacgcacgcacgacccgcaagccaggcgaagcgcgccacaacagagaggaacaggcacagcaccacaacacacacaccgccgcacgacacaaacagcgggccagagagcgagaacgccgcaacgacaaagcgacgcagagacccagcacgcggcagaccggaccagacggccaacaaaagcgaaagcaaagaagcacaaagcagacgaacacgagagcaggacgagacaaaccgaccaacggaacgcgaacgcaacgcaaaagagacgcatatagacagcaaagcggaaccaacaaca

SEQ ID NO: 567343 - DNA, 109 bp, Homo sapiens
agtctacgagggtagaaccagtgtgttatgacccttctgcaagcagccatcaactatataccctactttaaacaaacatttaacaaagaaataggctcttaaaatgcat

SEQ ID NO: 567344 - DNA, 8188 bp, Homo sapiens
  misc_feature (603)..(603): n is a, c, g, or t
  misc_feature (618)..(618): n is a, c, g, or t
  misc_feature (676)..(676): n is a, c, g, or t
  misc_feature (685)..(685): n is a, c, g, or t
  misc_feature (1078)..(1078): n is a, c, g, or t
  misc_feature (1116)..(1116): n is a, c, g, or t
ttttttttttatagtgcatgcaggaaattgcaattttatttatgtttgtattgatacatatttgtacatatttatggggtgtggtagtttgatatatgcatacaatgtgtaatgatcaaatcagggtgtttaggatatctatcacctcaaacatttatcatttttgtgtttggaacatttctaatctcctagttattttgaaatatataacatattgttaactatagtcaccctactgtgctatcaaacacttgaacttattccttctatctacgtttgtacccattaaccaatctcttccctccctcccccaactccaccttcccagcctctggtacttatctctactccatgagatcaactttttaagctcccacatgagtgagaccatgggatatttgtctttctgtgccagacttatttcacttagaataatgacctccagttccgtaagatgggcagccaggaaaggccttacttagctgatgtttgaattgtgaagttatgtaatcattaagatgagtatacatacaatgggccagctgagtgcacagcaagattcaataaattcaaactaacattactcttattgccaagagagtncctgaaatgacagcncattggaaactggctactttccttccctttccttaggggtttaaggaaagcatgagtnatttcagtnttttgctggagctcctcactgacactcattgcagagcctgagccctcaactctcaatctttgcttaggtcctggcttaggctccactttgtaagaggcaccttcctagtattcactactctctctctcacaatcatgtccttacagacattgctgatcctctttcatactgacaccgggttctagtccgagttccatcactaagtcgctgtttgactttgggcaagttacttctgtggttaattatttttcatcaacaaaatcaaaaggtgaaactagacgaacaactaagaggctccagtattttttcaatctaagagtcccatatcccccactcccttctcacagctcattcaacaatcctaatggcagcgggtgcccgcagtctcaagtntctgccgaagcccaagccgctgtctcggtcagtcacanccgacgaagaggaggaattggaggaagccagcataaccacctcacactgagaacatctgacctttcccagaacgcccgcccactcgacacttcctgtccctccccagatcttgttccggggcacctactcgggtctaatcactcccctcattcactctttagggtccattgctgtttctttgaggaagcggagcatcttctgtcgttgattggtttccgtcattgttgataggttggtaacaaacaaggtgtgcctggtctcctggtaacgtcctgccgatagtcctgattggtcggtgtcttaatcccatcttccgtcccaactgctagtggctgagtccctggcggggcgcggcggtggaaggtgtcgcgtacgggcttcccgagctgacgtggcttgaattgggaggggggcagctggagcctcaggcggcagcgcttctagaaatgctgagccgattatcaggattagcaaatgttgttttgcatgaattatcaggagatgatgacactgatcagaatatgagggctcccctagaccctgaattacaccaagaatctgacatggaatttaataatactacacaagaagatgttcaggagcgcctggcttatgcagagcaattggtggtggagctaaaagatattattagacagaaggatgttcaactgcagcagaaagatgaagctctacaggaagagagaaaagctgctgataacaaaattaaaaaactaaaacttcatgcgaaggccaaattaacttctttgaataaatacatagaagaaatgaaagcacaaggagggactgttctgcctacagaacctcagtcagaggagcaactttccaagcatgacaagagttctacagaggaagagatggaaatagaaaagataaaacataagctccaggagaaggaggaactaatcagcactttgcaagcccagcttactcaggcacaggcagaacaacctgcacagagttctacagagatggaagaatttgtaatgatgaagcaacagctccaggagaaggaagaattcattagcactttacaagcccagctcagccagacacaggcagagcaagctgcacagcaggtggtccgagagaaagatgcccgctttgaaacacaagttcgtcttcatgaagatgagcttcttcagttagtaacccaggcagatgtggaaacagagatgcaacagaaattgagggtgctgcaaaggaagcttgaggaacacgaagaatccttggtgggccgtgctcaggtcgttgacttgctgcaacaggagctgactgctgctgagcagagaaaccagattctctctcagcagttacagcagatggaagctgagcataatactttgaggaacactgtggaaacagaaagagaggagtccaagattctactggaaaagatggaacttgaagtggcagagagaaaattatccttccataatctgcaggaagaaatgcatcatcttttagaacagtttgagcaagcaggccaagcccaggctgaactagagtctcggtatagtgctttggagcagaagcacaaagcagaaatggaagagaagacctctcatattttgagtcttcaaaagactggacaagagctgcagtctgcctgtgatgctctaaaggatcaaaattcaaagcttctccaagataagaatgaacaggcagttcagtcagcccagaccattcagcaactggaagatcagctccagcaaaaatccaaagaaattagccaatttctaaatagactgcccttgcaacaacatgaaacagcatctcagacttctttcccagatgtttataatgagggcacacaggcagtcactgaggagaatattgcttctttgcagaagagagtggtagaactagagaatgaaaagggagccttgctccttagttctatagagctggaggagctgaaagctgagaatgaaaaactgtcttctcagattactctcctagaggctcagaatagaactggggaggcagacagagaagtcagtgagatcagcattgttgatattgccaacaagaggagctcttctgctgaggaaagtggacaagatgttctagaaaacacattttctcagaaacataaagaattatcagttttattgttggaaatgaaagaagctcaagaggaaattgcatttcttaaattacagctccagggaaaaagggctgaggaagcagatcatgaggtccttgaccagaaagaaatgaaacagatggagggtgagggaatagctccaattaaaatgaaagtatttcttgaagatacagggcaagattttcccttaatgccaaatgaagagagcagtcttccagcagttgaaaaagaacaggcgagcactgaacatcaaagtagaacatctgaggaaatatctttaaatgatgctggagtagaattgaaatcaacaaagcaggatggtgataaatccctttctgctgtaccagatattggtcagtgtcatcaggatgagttggaaaggttaaaaagtcaaattttggagctcgagctaaactttcataaagcacaagaaatctatgagaaaaatttagatgagaaagctaaggaaattagcaacctaaaccagttgattgaggagtttaagaaaaatgctgacaacaacagcagtgcattcactgctttgtctgaagaaagagaccagcttctctctcaggtgaaggaacttagcatggtaacagaattgagggctcaggtaaagcaactggaaatgaaccttgcagaagcagaaaggcaaagaagacttgattatgaaagccaaactgcccatgacaacctgctcactgaacagatccatagtctcagcatagaagccaaatctaaagatgtgaaaattgaagttttacagaatgaactggatgatgtgcagcttcagttttctgagcagagtaccctgataagaagcctgcaaagccagctgcaaaataaggaaagtgaagtgcttgagggggcagaacgtgtaaggcatatctcaagtaaagtggaagaactgtcccaggctctttcacagaaggaacttgaaataacaaaaatggatcagctcttactagagaaaaagagagatgtggaaaccctccaacaaaccatcgaggagaaggatcaacaagtgacagaaatcagctttagtatgactgagaaaatggttcagcttaatgaagagaagttttctcttggggttgaaattaagactcttaaagaacagctaaatttattatccagagctgaggaagcaaaaaaagagcaggtggaagaagataatgaagtttcttctggccttaaacaaaattatgatgagatgagcccagcaggacaaataagtaaggaagaacttcagcatgaatttgaccttctgaagaaagaaaatgagcagagaaagagaaagctccaggcagctcttattaacagaaaggagcttctgcaaagagtcagtagattggaagaagaattagccaacttgaaagatgaatctaagaaagaaatcccactcagtgagactgagaggggagaagtggaagaagataaagaaaacaaagaatactcagaaaaatgtgtgacttctaagtgccaagaaatagaaatttatttaaaacagacaatatctgagaaagaagtggaactacagcatataaggaaggatttggaagaaaagctggcagctgaagagcaattccaggctctggtcaaacagatgaatcagaccttgcaagataaaacaaaccaaatagatttgctccaagcagaaatcagtgaaaaccaagcaattatccagaagttaatcacaagtaacacggatgcaagtgatggggactccgtagcacttgtaaaggaaacagtggtgataagtccaccttgtacaggtagtagtgaacactggaaaccagaactagaagaaaagatactggcccttgaaaaagaaaaggagcaacttcaaaagaagctacaggaagccttaacctcccgcaaggcaattcttaaaaaggcacaggagaaagaaagacatctcagggaggagctaaagcaacagaaagatgactataatcgcttgcaagaacagtttgatgagcaaagcaaggaaaatgagaatattggagaccagctaaggcaactccagattcaagtaagggaatccatagacggaaaactcccaagcacagaccagcaggaatcgtgttcttccactccaggtttagaagaacctttattcaaagccacagaacagcatcacactcaacctgttttagagtccaacttgtgcccagactggccttctcattctgaagatgcgagtgctctgcagggcggaacttctgttgcccagattaaggcccagctgaaggaaatagaggctgagaaagtagagttagaattgaaagttagttctacaacaagtgagcttactaaaaaatcagaagaggtatttcagttacaagagcagataaataaacagggtttagaaatcgagagtctaaagacagtatcccatgaagctgaagtccatgccgaaagcctgcagcagaaattggaaagcagccaactacaaattgctggcctagaacatctaagagaattgcaacctaaactggatgaactgcaaaaactcataagcaaaaaggaagaagacgttagctacctttctggacaacttagtgagaaagaagcagctctcactaaaatacagacagagataatagaacaagaagatttaattaaggctctgcatacacagctagaaatgcaagccaaagagcatgatgagaggataaagcagctacaggtggaactttgtgaaatgaagcaaaaaccagaagagattggagaagaaagtagagcaaagcaacaaatacaaaggaaactgcaagctgcccttatttcccgaaaagaagcactaaaagaaaacaaaagtctccaagaggaattgtctttggccagaggtaccattgaacgtctcaccaagtctctggcagatgtggaaagccaagtttctgctcaaaataaagaaaaagatacggtcttaggaaggttagctcttcttcaagaagaaagagacaaactcattacagaaatggacaggtctttattggaaaatcagagtctcagcagctcctgtgaaagtctaaaactagctctagagggtcttactgaagacaaggaaaagttagtgaaggaaattgaatctttgaaatcttctaagattgcagaaagtactgagtggcaagagaaacacaaggagctacaaaaagagtatgaaattcttctgcagtcctatgagaatgttagtaatgaagcagaaaggattcagcatgtggtggaagctgtgaggcaagagaaacaagaactgtatggcaagttaagaagcacagaggcaaacaagaaggagacagaaaagcagttgcaggaagctgagcaagaaatggaggaaatgaaagaaaagatgagaaagtttgctaaatctaaacagcagaaaatcctagagctggaagaagagaatgaccggcttagggcagaggtgcaccctgcaggagatacagctaaagagtgtatggaaacacttctttcttccaatgccagcatgaaggaagaacttgaaagggtcaaaatggagtatgaaaccctttctaagaagtttcagtctttaatgtctgagaaagactctctaagtgaagaggttcaagatttaaagcatcagatagaagataatgtatctaaacaagctaacctagaggccaccgagaaacatgataaccaaacgaatgtcactgaagagggaacacagtctataccaggtgagactgaagagcaagactctctgagtatgagcacaagacctacatgttcagaatcggttccatcagcgaagagtgccaaccctgctgtaagtaaggatttcagctcacatgatgaaattaataactacctacagcagattgatcagctcaaagaaagaattgctggattagaggaggagaagcagaaaaacaaggaatttagccagactttagaaaatgagaaaaataccttactgagtcagatatcaacaaaggatggtgaactaaaaatgcttcaggaggaagtaaccaaaatgaacctgttaaatcagcaaatccaagaagaactctccagagttaccaaactaaaggagacagcagaagaagagaaagatgatttggaagagaggcttatgaatcaattagcagaacttaatggaagcattgggaattactgtcaggatgttacagatgcccaaataaaaaatgagctattggaatctgaaatgaagaaccttaaaaagtgtgtgagtgaattggaagaagaaaagcagcagttagtcaaggaaaaaactaaggtggaatcagaaatacgaaaggaatatttggagaaaaaaaaaaaaaaaaaaaaaaaaaaacaaaaaaaaaaaaaaaaaaaaacaaaaaacaaaaaaaaggggggcccccccttttcccccgcagggggccccaagacagcccgcccaccgcgctgtctgtccatgtcaacacagcggcccccctcgcagacgggcgcataaacaagcaccacagaagacgcggcgccgcgcgctaaacacacgacaacgccgcgagcgaggcaacacggccgcccgggggccccgctcggcgcacgccaccgcactcccccgcggagcgggcgcaaccactggtgacgacacaaccacctccaacagcacgcatacacagcgcctcggggcgaaccaaaaaaccggaaccacagagccataaccggtgggacgaagcacgcgcggccaccatgagcccgccgccgccgagcgaaaaagactgatgcgcccacacggcgcactctcccccgcagacgaaaccaacctctcatcccgcccgcggcccccagcgcacacaccgaccgcgccgacagcccaccacccacgacaactgaccgccgaccacagctcgagacacccagcacgcaccgcagcgcccgccgacgcaccgcacacgcagccacgccgcagcacggcgtggccagcgagggca

SEQ ID NO: 567345 - DNA, 268 bp, Homo sapiens
aaaatttcagggggttttccccctgaaatttcaatgttttccgggcgaaaaaccttaaattccctgcctttgttagggagggggtttttcccccgttaaccccaaaaagcaaatgggtaatgggggcccttttgcctttttgacattttcttggggatttggaagaacccccccttttccttccccccataaggcccttttagggggggtttaaccacccccgaatttttaattaaaagtttgggccaacccccccctggaggtgcca

SEQ ID NO: 567346 - DNA, 565 bp, Homo sapiens
agaggtacacaacatgttttgctatagcataacatacgacggacgcggagcttagttggcttataacaccaacgaccggtgacatgaccaggcgtttactaagtgcatgctggctacatgacggagactgaattacggagatctttgcttaccaaagaataccctgaaaaacacaatgtgttttggactggtactaagtagcccagggctccaatcacatgaaaaatccggaagatgtgtggagagaagcagatccattgaagaggtgcactttgttaccccaggtattgacagggttaaatttattctctgaatataaatcatgagagtcagagggctggatttatgcatgaagactcatacggtggactgtgggtccatgtgggggcaacagggacctgaagaatcaatggtttaagcagtatagcggtttatttattttacatgaccgcgtgaagagttggaaacaaagacttgttgtgtggaacattgagtgagagaccgtcagaggatgccatcttatagttcattatggaaggggatgggccttatcagcaggtccagg

SEQ ID NO: 567347 - DNA, 1678 bp, Homo sapiens
agatggctatagtgggggcaaggagctgaggagaaggaatgtggaagtccagccactgagcagcgaatgagtctaaggctggaagggcgtggaagattagaacctggtggaatttgccaagttgttgactctgaggcaactttcctctcagaatacccctttctacagtggttgggtcagctttgcttaagtgcaagactagtaggagggaaagcaacatagccctatagggtgaaaactctctgactttcacatttttctttcagacccggagtggcgttggatggaagcgagtcctgcgttcactctgtcattcacggacccgagtgccacttctagcagccatctactttctaatgattcatgtcctgctcattctgtgttttacgggccatctatagacttagttgttactctttggaccactcccctcaaaacttggaattctctcacctctaacatcagaacatcaattccagtggaacagtcttcccatttacaggtcttctctccaactcttcacggaaagtgcctgcaaaaacagaggtggatacgaggacaggttggagctgcagggactggcgagtctgctttcttctactgccctgagcctgaacgcttctgcttaatctgagaatcacatttggtttgttgagcctaatatttgttgagattttgcaggaccctgatcttttgtggtcctgtaaaagatactgaggaatgtctttcagccaagccaagaggatggtttcaataaacctaataatctgaagttcagtatcattttgattgataactttctttgccttgtttgcctgtattttctcctgtttcagggggaaggtggctctgcataaacagagttcagggaaatgaacatgtcacctcataggacatctgatttaggtctcttgcagaatagggtggtgaaagctgaaggaactccctaggggttttagctgttagatcacatgggaggacagcatcttcttccctgccaatttcagatataattggagggagaatttcaggtcttagactataaggatagaatccctttgcttttgcccttgatcacatgtatactaaggtattaagtggcccaagtctttcctttcaccaaagggcagggagaagtgtctatggacagcagggttccaattcttgtcattccaggaatatctgaatattcctggaatgtggaccctgagacagtgctcaggggccactgggagccaatattaggcattgactctcagccaggagtctgactggtctaacaccacactgcaactcctgacctcttgaagtactaagctactttgctgttagtgacagttattacagtttctcagccccattgtctctgccctctgtggcaatggaaggagaatatagagaagacaaaattaaatatagatagacctgagaaggacagccaggatagaattccatttgtgcctattccctgcctcccctcccctcccccatcctaccagttggttattttctcattgcatacgtgatgtgttcactgcctagcctctccctaaagaagagagaagacaagtgggctgactgatctgctctaaatctactgtggtgattaaatcttggttacaacatcctgggaagtttcctgaacaactgtaaaataataaaattattttcagaatga

SEQ ID NO: 567348 - DNA, 142 bp, Homo sapiens
gatctagaggatccctctaacctaatcgccagcagtttgaggcagcctggcaacatggtgagacccgtctctacaaaaatgcaaaattatctgggcatgtggcatgcacctgtggtctcagctaatagggaggctgaggtgg

SEQ ID NO: 567349 - DNA, 170 bp, Homo sapiens
gggacgctcttcagcctcttgggcgcacgggcccagccttccttcaaaaatgtctaacttgttcacggaaattcctgtttccaagtctccagctttgggaggggtaatcaatcttacaaccccccaaggtccaatattgggggcctttctaaaggccctttctaaccttt

SEQ ID NO: 567350 - DNA, 338 bp, Homo sapiens
  misc_feature (78)..(78): n is a, c, g, or t
  misc_feature (114)..(114): n is a, c, g, or t
  misc_feature (173)..(173): n is a, c, g, or t
  misc_feature (176)..(176): n is a, c, g, or t
  misc_feature (314)..(314): n is a, c, g, or t
aggtaaattttgccccaatttgtagggtaatggaaagtgtttttgagcatgtttcaaggtaggctaggctaagctatnagtgttcagcaggttggtgtattaaatgtattttcnacttacagtgttatcaacatacaatggctttatcaagatgtaaccctgttgtaagtcanggnacatctatatgaccaaatcatcctcaaggaagattttgcaggggccaggcacagtgactcatgcctgtaattacaacactttgggaggccaaggcaggaggatcacttgagcccaggagtttgagagtagcctgggcnacatagggagacccccatctctac

SEQ ID NO: 567351 - DNA, 275 bp, Homo sapiens
  misc_feature (165)..(165): n is a, c, g, or t
  misc_feature (244)..(244): n is a, c, g, or t
accggggctggggcccctttttggaaagggtttttaagaaaaacattttccttccccctttttggccttccctccagggttggcccaaatttgttagggaaaatcatcaaaggggttggctgtgccttcataggtcatttagggttttataaaggaggaggagcncaatttttttccaaccttttggggagggggggcctttttgtttataaaaaatgtttatatttaaggggggtttttgttnccgtttttaattaacagaatgggccctttta

SEQ ID NO: 567352 - DNA, 341 bp, Homo sapiens
ttttttttggagacggagccgtctctgtagcccaggctggagtgcaaagatgtgatatcaactcactgcaacccctacctcccagattcaagcaattctcccgcctcagcctcccacgtagttgggattacaagcacacaccaccacacctggccaatttttttgcatttttagtagagaaggggcttcaccatgttggccatgctggtctggaactcctgccttcaagtgatccgcccacctcagactcccaaagtgctgggattatagccatgagccactgagcgtggcccagtttgttcctttccatttagttgtctaggtataaaatcatgtcgacg

SEQ ID NO: 567353 - DNA, 793 bp, Homo sapiens
  misc_feature (71)..(71): n is a, c, g, or t
  misc_feature (76)..(76): n is a, c, g, or t
  misc_feature (95)..(95): n is a, c, g, or t
  misc_feature (108)..(108): n is a, c, g, or t
  misc_feature (117)..(117): n is a, c, g, or t
  misc_feature (133)..(133): n is a, c, g, or t
  misc_feature (140)..(140): n is a, c, g, or t
  misc_feature (148)..(148): n is a, c, g, or t
  misc_feature (151)..(151): n is a, c, g, or t
  misc_feature (158)..(158): n is a, c, g, or t
  misc_feature (161)..(161): n is a, c, g, or t
tatgtagggtgaccatgatagctgccactctgcaggcagttattaatgaagtttgtaggcacatacccctnatganggggggtttaaaatacctnctttccttcctanttcaacaantgaagggttattactnaaaattnatccattnttncctaaanaantaaaaaataaaaaaactgaaaaaaaagatgcctaaatgggggaattgggaaattactttcactggggggggggcaatggagaggggtgtaatacagaataatttttacatttggtggcttggtattgatcatacttgaaagtgaactttaacattgagaaatcgtacagggatttcaagaataagagaataaaattttgtgtgtggctgagaaaaaaaaatgcgggctcggtggggctcagggggggagctctggggggcggttccctttagggggggggaattcatggtcctgggtcacgtgagtcgctgcggtacgggcggtccggtgggggaagcggggttagctccctcgaggggggggatagggtgatccacagaatgggggggagaccggagggaggaggtgggagcaaaaggcggcggaagggcgggagccccaaaaaggcgcgggggtggagggtggttgcctgggcttccccgccctgacggggctcacaaggagggggggctaggggagggggggggagtgcgcggggggggtgtagagataccgaggggtgggcccgtggaggccccgggggcgctgggcggggcccgggcttgcgcggagggggggccgggcaccgtttg

SEQ ID NO: 567354 - DNA, 696 bp, Homo sapiens
aaatcaaataattcaagcactggctttattacaatttatactgggtctctattgtaccctcctacgaagcctcagagtacttcgagtctcccttcatccatttccgacggctatctacggctcaacattttgtgtagccacaggcttccacggacttcaccgtcattattggctcaagtttcctcactatctgcttcatccgcaactaatatttcacgtttacagtccaaactatcacttcggcttcgaagccgcgcctgatactggcatttctgtagatgtggtttgactatttctgtatgtctccatcctattgatgagggtcttaaaaaaaaagaaaacggcaaatgatatacatcgacatattttttcggcggaggaagagagcctgtcgggaaagaccatttgcgaagaacgcacttattcggttggggagccgcaggaggagcccaaaagccgcaagcatgcaaaacgcgtgctgccaaccgcgggacgctacgagaataccccgccggactcaggaaccaacgggcatgagaattcaccagccagattatgaacaccccccggggggcaaaccgtgctgtgatgcgaacgacagcccacaaggggccattgagtcaaaccacaacgtggggttcaatcacacagtgggatagcaagcgaacctcctcaccaacattcgccccgcccggg

SEQ ID NO: 567355 - DNA, 848 bp, Homo sapiens
ggcaagccaccgccaattatccagtgaagcactatcacgaaaaaaactctacctctctatagctaatctccctagcaaatgctccttaattatagaacattcacagccacagaactaacttcatattttatatcttcttcgaaaccacgcttatcgcccaccttgggtaatgatcacccgaggaggcaaccaggccagaaagcctgaacgcgaggcacatacttcctattcgtacgagcctagtaggctcccttcccctactgcatcgcactgatgttacactcacaacaccctaggctcactagaagcattgctactactcactcgtcaaccggcccaagaactatcgaaaactcctgagccaacaacttaagtatgactagcgttacacaatagctttgatagtagagatacctctttagcggactccacttatgagtccctaaagcccatgtcgaagcccccagttcgctgggtcaatagtacttgccgaagtactcttaaaactaggcggctatggtataataggcctcacactcattctcaacccctgaaaaaaaatagctaaccccttcctgtgtactatccctatgaggcagtaattataacaggctccatcttgtctactgaaaaaaagacctaaaatcggtcatgaataacttcttcaatcaagcacaattagcctcgtagtaacaggcattctcatcaaacccctgaagttcaccggggcggcattctcataagctctctcaaggattcaatctggtccactaatagtttggtgagttaggaggctcgaactgggtacccattaactaggggaacctgtggggaccgctccggggaat

SEQ ID NO: 567356 - DNA, 147 bp, Homo sapiens
tgaacagctatacatgcactggcgtcgtttcactaacagctataccatcactggccgttcgtatacacaaacagctatgaccagtgcactggtctgtcgtattacacaaacagctataaccatgcagtggccgtcgttcttacacgt

SEQ ID NO: 567357 - DNA, 1219 bp, Homo sapiens
actcccaagcctactggctgagactgtcgtctgactctgacctcatcaatatatggtcctatttacgctagctgcacaaacctaagcaaggacaagcagcttctgacaagggctaatgattccaagctacgcaggctctacgccaagagtgacaatgcacggaacacttgtgaggaacaggcagtccctatatccttcagcgcaattacttccatggcatactacttcttcccgcaactgcggctcttgacgaagaacttatccaacccagagctcttgcgccttactagctctctgactgacaaccttggacgctgcagctgtctgccaaccatatttggcgaatggcaggcgacagggtcgccagttcattttcgcccctgatgaaatcgtacacggacatatccccgtccaactggactcagccccactgctcgggtcccctcctccacgcagcatcgcacacttcgaacggacgcgatcacaccagccaggcgataccccaatccctttccttcccaccagacactacacctccctggggactcccaacccttctgtcacaaccccacaatgtctgccggcataatgcactctccatatactactcaagcggttcccgcctattagagcccctctctacttacggccaggtcacacttccctagataacaaaccgctttctacaacactctccgggtctatgccgaccttcacttggacgcacccgaaacccgccccaccttggacccataagcagcacctctggacagctggccgccacgttggcagcacggccccttaatatcggctggcctattcccccccaacttggggacggacaacggtcccttctaaccaccctgtgttcgctccaaccgggccttggacgcttacgagactttcaagttcaaccgctatctgaagcccaccacccaacaagtattcccctgttaagggaaggcggccccttgggacatttatcgggctacacaggaaacttcagccgccctctgcacacacgccaaccttacaacccctcccttcacaacgcacgtgggaagtggcccttacaagagctttccattgggggctacgaccacttttcacgctctctccgccacttttcgatccaaccacatacgaacgcgaaccctaagatcacgcacaactcctcatttatgaacaccactctatggggagcttctcccctatgtcc

SEQ ID NO: 567358 - DNA, 856 bp, Homo sapiens
  misc_feature (56)..(56): n is a, c, g, or t
  misc_feature (62)..(62): n is a, c, g, or t
  misc_feature (145)..(145): n is a, c, g, or t
  misc_feature (155)..(155): n is a, c, g, or t
  misc_feature (174)..(174): n is a, c, g, or t
  misc_feature (184)..(184): n is a, c, g, or t
  misc_feature (198)..(198): n is a, c, g, or t
  misc_feature (211)..(211): n is a, c, g, or t
  misc_feature (221)..(221): n is a, c, g, or t
  misc_feature (232)..(232): n is a, c, g, or t
  misc_feature (235)..(235): n is a, c, g, or t
  misc_feature (239)..(239): n is a, c, g, or t
  misc_feature (249)..(249): n is a, c, g, or t
  misc_feature (251)..(252): n is a, c, g, or t
  misc_feature (259)..(260): n is a, c, g, or t
  misc_feature (265)..(265): n is a, c, g, or t
  misc_feature (275)..(275): n is a, c, g, or t
  misc_feature (294)..(294): n is a, c, g, or t
  misc_feature (301)..(301): n is a, c, g, or t
  misc_feature (307)..(307): n is a, c, g, or t
  misc_feature (315)..(315): n is a, c, g, or t
  misc_feature (327)..(327): n is a, c, g, or t
  misc_feature (331)..(332): n is a, c, g, or t
  misc_feature (400)..(400): n is a, c, g, or t
  misc_feature (404)..(404): n is a, c, g, or t
  misc_feature (443)..(444): n is a, c, g, or t
  misc_feature (449)..(449): n is a, c, g, or t
  misc_feature (451)..(451): n is a, c, g, or t
  misc_feature (454)..(454): n is a, c, g, or t
  misc_feature (473)..(473): n is a, c, g, or t
  misc_feature (505)..(505): n is a, c, g, or t
cccttgtctttcctactattgctacaatagttggtaaattgatgttcagtagtgtnactctnatttacaaaggacaatcttgggtggattgcgtttgttgccataaaaggagcaatttaaagtttacttcaaacagcagcaaatntttacgacangcacaccgcaaaattctgnattatccagnaacaagaagaagcntaaaactgacttntggttgttgnggcagttctcncancctnatgaatctgntnngttgttnngattncatcattaangcacttgtggagacttgtnataagcnggtgcncctatatnttttaagaaatntaannaagcacttagggcaggggaaatcatctcggtaatcatggaacctaaggatgtgatttgttttcattgnttgnatgtactacttttatggcactcatatgaaccattatctnngcatngnaancctgggttttgttcatatnttccccagacagaaatgcaaagatcaaactgngcaaatattaaaaaaatgcacatgctgttttattcaaatgcctcttttgtacatgttcatgtttagtgttttctcagaatcagcaactcaaggtactatgaggatttttctcactgacataatttgattacatactaaataagaggatatgttaatatgaggaaatgtaaattaaattagttataaataaataaccaaaaatgtatgtaaacattcaaatgattatctgaacaaatgagattttgtggtgttttctttaacccatgtgatgtcctccaaaattttttgggttaaaatttcacggggttcccagatcactttttcaatattaaattttatttacataaaaaa

SEQ ID NO: 567359 - DNA, 126 bp, Homo sapiens
caatgggcaggcggctgcaacatgcccagtgcgcgtggaggcgctgagggctgctgcaggaggcgctagacaaggatagtggctacccggagacgctggtcaacctcatcgtcctgtcccagcacc

SEQ ID NO: 567360 - DNA, 234 bp, Homo sapiens
attgtcttccagaactgtgtacttgtctggtcagctgtgtatgatcagttatcatacctcagagtctattttcttattgtgctgggacagtgttgctggccctcccgtgtttccaccagaccaagatcctcactcagctcacggagctcagggctacagccagttatttcgtttccacagtcattattatcagttacttcaaattttcattgcttgtcatttgcatgcatagca

SEQ ID NO: 567361 - DNA, 240 bp, Homo sapiens
atccggagagatgcgacagatctcggaggacacacgctctgattcgaggctgttccttcatgaagcccatactccccatgatattggctgccttcatctgtcaccttccacgctgtctccgagccagagattttgctgatggcggcctctatctggaaggtccggggctccctggctccatgttatcactcaccatgtacgccatggactcagttcacttactgcagcataaccatcgga

SEQ ID NO: 567362 - DNA, 509 bp, Homo sapiens
  misc_feature (223)..(223): n is a, c, g, or t
  misc_feature (312)..(312): n is a, c, g, or t
cgagttgaaaccagccaacccagccctataccaaaaggctggattaaagaaaagatttacgtgctcctttgtcggcaggcccaacagggtgggaaataattgtgttgaaacccctgggggggttggggtggccttgaaacacaggtgtgtacagggtcctgtagtggaagttttgtatcaaagaaatccggtttcccctttgttaaactcaacccaaaattgnctgttttaaatgaaatgtgaggttttttttcaatgggaaacccccggcacccccttttttttttttttttttttttttttttttaactnaaacatttttaaaagaatttaaaggaaagtttttttttgcccctaaaggtgggtcccagcccttcaactgtttaaatttattttaaaacattcaaaaaaaacccctttttcaaaatggggggggggggggaaaaccagtttacccatgtccccaaaaaaaatttttggtaaaaaaaaaaaaatttccttttgttata

SEQ ID NO: 567363 - DNA, 952 bp, Homo sapiens
gcggggatggcggtcgcagcgacgtacggcctgggccggggtcggctgggcccccggggctggagtgcggcccggcagaagtctggcgctgcgaggagaagaaggtgctgatgcaccgaggagatggagctgtacgagctggtgcaggcggcgggcgggctatcgaccccgagtgtgcaagatcctggtggacctgctgaagctgatacgtggacccgcctcgcgcgtcttccagatgctcgaagtccatgtgtgcccgggcaataggctagcgagctgagccccaggacccatgcggccgtgtctctgcccaccgtcgagcagtgcccgagaccgagggagaaacaaagggagcagctgcctcgtgggagcattggcctgggggaaagcagcagccgcggaggatcgatcccagacggatggatgacgcacagccaggtcgatagcatagcaggcctgcccaggggcaggcgggcctgtcgaagagcacctacacggggcagcacactaggatggggcagagacttgtagcatcttatgtccccagcaaaggctacatgttaccgtccttcaacttgataataaaccatttcgtgagatgcagagcggtccagggtcatcaccacctaaaagcagttttgaccccctctaaaagccccgcagcgagtccatactgactgaagcgaggcgaaacctggcactggcacacggcgcaggttccgccacagtgacacgaacacacaggcgtccgtgtgaacacgaggggagcaacgacgggagtccacagcctagggccgccatacacgcagagcccgcgtagacgcacagcaagagtcccacgcggcgaaggcctccgagaaagaaacaacggacccagagcgcagaaacgctccaccggtccagctcccttgcatgcacccgtcagcacaacgtcagaccacccgaccgcgcc

SEQ ID NO: 567364 - DNA, 931 bp, Homo sapiens
  misc_feature (1)..(1): n is a, c, g, or t
nggctttgggggctctgcgattgctcccctgttgcccaaaagtagccgttgtattggggcaaacacagtgtgtcctggtgtaggaacaccgcttgcgcttttataacccgccgcctcattcatgtattgttgtcggcccacaaactgtgcctatgttggtgcctaagcgccctaaaagtgggcgcctcccggaaggatctgcggaataagttgcttcccgacgaaagatcgttctggccccatcgtacccaggcgccttatccgcatccacataatgatttgggacggggaccgcccttgctttcgactgggaccagcctgaggcttctacgccaaagggtcttgttacctctcctggggcgcccccaacaccaactagcgagcaggcggcaggcgcagaacaccctaaggcacggacgcgacgcctgccaaaacatgagcagctatacccgcggggcgccctcgggccccttttgccattgggacccaggtcaaggcgcaccccccggcccctgggggaggggcgtcccacgccacccaacgcccaccgcgacagcttgggggaaacaacgcccccccccaggagcctcccagcgaagagaccccacaccacgtgttgacacaggaaggaaaggcgtaaagcgggggccccccacgccgcgcccaatggagagtgaacagcggttggcggagccccgagaaccgtgcactcggcacatgtcaccccccttccatgggcgcccgggcccccttcgccccgccagtaaccttgaagcagcggggcggcagctgcgccgcgcgcttcacgcacccggaaggatgagacacaacaggagagggaggggtcgagacccaggagtcggcctaggaagcacccccacgactcgtcccccccggccccggtaaaaaccccgcccgtccaacaaagaca

SEQ ID NO: 567365 - DNA, 129 bp, Homo sapiens
gtctctttccttgcctttggcgtccatggctcgttgtcccgagaagtatctgtagcggcctggcatgtccaaggcattgaatgctgtcatcaatttggcgctggtgttgtcagctcctacttcgcagtc

SEQ ID NO: 567366 - DNA, 131 bp, Homo sapiens
gctcgacaataccaccaaggattaaaggagaagaaggaagttgtggaagaggcagaaaatggaagagacgcccctgctaaacgggaatgctaatgaggaaaatggggagcaggaggctgacaaggtaggct

SEQ ID NO: 567367 - DNA, 1251 bp, Homo sapiens
  misc_feature (1251)..(1251): n is a, c, g, or t
ccacgcgtcgaatcccagcactttagtgaggccgaggcgggtggatcacctgaggtcgggagtttgagaccagcctggccaacatgtgaaaccctgtctctactaaaaatacaaaaattagccagatgtggtggcacacacctgtaatctcagcctcccaagtagctggcgactacaggcgcccaccaccacactcggctaattttttgtattatttacgtacagacggggtttcaccgtgttggccaggatggtctcgactctcctgacctcgtgatctgtccacctcggcttcccaaagtgctgggacttacacggcatgagccaccgcgcccagcctagccatattcctactctgcatatactcacgaatgtttctctcctttgaagctctatcaaccaaacacagcgcaccatcgcttccccataccctacacgtcctcaatctcctcacccctccatcgaccaggtctgctatcccacacttcgatccaatccatcctcacatctcccaccaacactggctccaacaccattctcgctccagctcaccatgctcctcccgtgtgaactggggaacatcggccactacgaacttcgactggttcaacgcatcacatcgcaacgtctgccgtgaccaagcgttcgccacgcccacactgcttctcccgctcaagcatggaccccgcagtctccccaatacttgcccgcgcataatacgccactcacgaccagaccactcaaaacagccaacgacgcgcccggcgcagatcacgactcgcatcgcggcccgcctgagtggcgtcctaccacacccgagggcacgcacagatcagcgcaagatcccgctgccccacccacgcacgcccacaccaccaacgcagcacacgagccgtgcaccagtccagcacaacgaaacacccaatccacacaccccaatcgcacgcgccacaagcgacacaaagcgaccagcgaaccagccaccgctgcgcacccgcgcactccacggcgaggagcgcaacccaaaagctcacccaccccgggagacccagcgaagacccgaccgggactccccaggccccacctcccaagaccccccagaggcaacacccgcaaggaacctccatgacgagaacgccccgaaccccaacccggcgagccacgcaggcacacgacacacgccacgcgaacagcgcggtcgcgcaccgtcgcacgccagccaaacgccgcgagcacgaccaccggcacggn

SEQ ID NO: 567368 - DNA, 304 bp, Homo sapiens
tgctctgacgtgtcagctgcgtgcgaatggagtccgaggtcatgatgagtgactatgagagcggggacgacggcacttcgaagaggtgacgaacccggccctgtgattccagcagcacacggaagtctgactctcaacttcccccaaagtggcttactttagtgaacctagaagtgatttgagtaattcgggctggtctttgcagcagtgcttccaagctttttttggtgagccgaatgggcatggctgcgctggatcctgcgcctctggacgtgctagccatttccagtgtcccagctactca

SEQ ID NO: 567369 - DNA, 307 bp, Homo sapiens
cccggatgacactgcaacactgattggctgaaacttttgagttactgacagctttgtttttttttgagatggagttttgctcttgtcgctcaggctggagtgcggtggcacaatctcagctcactgcaacctccacctcctgggttcaagcgattctcctgcctcagcctcccgaggagctgggattacaggcattacagacgtgtgccaccatgcctggctaatttttttgcatttccagtagaaacggggtttcaccatgttagccaggctggtctctaactcctgacctcaggtgaaccgccca

SEQ ID NO: 567370 - DNA, 272 bp, Homo sapiens
ggcagcttcggtgcttgtggtgccatcgggccaggacggctctcgtgcaaggagcgctgtgggactcgaaggcttgtatgttcaggccagatcagcacggtagagtctgacacgccgttgaggcggtcagaccggtgcgtgcagtttggtaacggctggggtgttcgagcccgtctctgagtacagagcgcacggccaccgtgctggtcttcctgaagcccgaacggttaggcgcgccggcttggccgagcgcgcatgcacaagcaagggat

SEQ ID NO: 567371 - DNA, 1036 bp, Homo sapiens
tctgactccgcagcagagtcaggccgaggcagatcagaagctgagcgtggccacgaggagcggagagggcccagaaggaactgagagtgcccgggacggtgcgagcgtgcaagaaggagctcctgtgaaccatggtccacgcaaatgcgcggtgcgccgacgaagatccatagtctaaaatccaaccaattcagcgagcgcgtgagcagagccagagagatgcaagcgagtaagacgggcagcaacgctcgaccaagggaccggcagattgggacaaccgggggcgggaagccgatcagatgaaggcttggaaatgatgacacgcgtgagagagtaaattcgtagaatcgcagggatgagaggaacgtgcgccccagatggcccgcacgccgttacaggggaggcagggcatgaccatacacggcaaaatgcccctggggcgaagacaagtgacggagaagcgcagtgggaagagaatagttggaagagggggaggccgcaagtggcaactcatacggtacagggcgtcagggagaaggttgcgcgtcgagtccggtggggtgaaggcccggggcaccctagcgacgggagagtcgtgggaccggggaaggttggaacggacaattgcccagagtccaggggtccaaggccaggtagacgttgatgcagctctcggcgggcccttacgtagcaatcgcttggcagggccggaagacgtttcccgcacgagtgctgaccggtgcatgcgggtggaaagcgaggccttcgagtgcggcagctcaccagtggaagccaggggcgagtgaaatagagccatgttcgacggagtgtcgccccgggacaaggagtggctagagatatcaagggaaagcaacgtgcaccgaagggccgggccccagtgcggagagagtctttcagacaacgacaggcgccgcccggataggggagcacgggcactgttcaagagagcgcccacaaaggggtgtcaccccaaaacacgggggcgcggaccaaacagggtttgtgatatatcacg

SEQ ID NO: 567372 - DNA, 734 bp, Homo sapiens
  misc_feature (97)..(97): n is a, c, g, or t
  misc_feature (320)..(320): n is a, c, g, or t
  misc_feature (476)..(476): n is a, c, g, or t
tcgcaattgtcccccaagttgtccccggaagtgactttcctgtttgggggtcagaaggaagaagaggcatcatcaaccctcatacccatcccccgcngccccttcccccgaccctgggcgcttaccttctctaatgggcgtgccctgcaagcctctgcactcaatgcctggcgagggcaccgggacaatgctggggctgccactgagaagttcatcaagcgggctgaggtgaatgggcttcagcccagggcaagtatgaaggcagtgaaaaagatggtggagcaccagcacagtcactttacattgccaaccatgcctantgagtatccactccataccacagcccttggcccagccatttgcacccacttttgcttgtagtcatggccagggccaaatagctatgcagagcagaaatgccttcacctggcaccaacttgttttcctttcttttttcccttcccctctttcattgnggcacctgggaccataggatgggaggatagggagcccctcatgattgagggcaaaaaaaattgttaaaagtcagaacaggatgggtgggtctccccctaccttttccagctcccccaattttcccataatgaggtagcttctccctgggctctcctttttgcctgccctgtttcctgggatcaaagggtagtacaaaagccctgactcatgccttgagtacatcccatccagcaaataaatggtagcaaaccttttta

SEQ ID NO: 567373 - DNA, 1054 bp, Homo sapiens
gactgacatttttacgtttaattttcttgcagttttattcttgctagtaaaggtaattcgttagaaacccttaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagggagcgggcagagagcatggattatagatggaaggggtaggcgcacacactagcagagacgatcacagagtgaataggcacgacgcgaaccgtcgacaacgtagtatctattaatatacctggcaggcgggtgcccacatacacacatcggcggcgacacacggccaacaacgcccacccaccaccaactagggagacaccaccgtactcttgacacgccccacatggctacccagaacaccataaagatgataacacagaggccggagagaaaaatcaacgcccaacagggcctcacagggagcaacaactcagacaaaccgggcgcggtgcacgacaacctccgcccacaagatgatcaccacaccaacaaccttactaataaccgcagcgccaagccacaacaccctaccacaaccacgagcccacaaccacaccccactccacccccagtatgttgtagtgtctatctgctaagagatgtggtgtgtgtgtaggtattgatttttgtgggtactagtgctgcctgtgttcgtggctgtgcgggtgttaggtcggtgttgattgtgtgtgactgactgttcgctcacttgctgcgtgttgttttcgtctgtcttgctgtgagcgcttctcacaccggttctggttggcgtgcgtccgattatgacatgcggatcttattgtctggatggttgggctagctttctatgcagttcgtgctgttatggcgtgttctggttctgcggcgttgtctggattgcgtggttgtcaagctgctcttgcgcgcagtgtgcgtcacctgctacttactttgtgacaaacatacaagacaccaaactacacatacacgggacaacgaatcgaccctcctacgcacagagaaaaca

SEQ ID NO: 567374 - DNA, 437 bp, Homo sapiens
gttgattgtcagttttgtctttcacatactatgcacctattgactctgatccctgatattcattgtatgatgaatgaaggatcatagagcatctacgtagtactacgcatgcgtcatcattagtcgattgaatgcaagtagtgcctctattatagatttaaaggaaatctagtgggtttcgactttggccacaacaaacttaaacctctttttttctttaagtccaggaaaagtaagaaccatttggttcatggcccacaataaagtatgcatgttacgtcaccatctgtcattattcaaatattccaaatacaaacatagagcattaacaaaacaggttaaaaacgcttctcaacattttttttttcaataagacaaaaaaggttaatagttacaatggtttacaaataaagtttagtgattgtgcttttaaaacc

SEQ ID NO: 567375 - DNA, 239 bp, Homo sapiens
  misc_feature (8)..(8): n is a, c, g, or t
  misc_feature (34)..(34): n is a, c, g, or t
  misc_feature (60)..(60): n is a, c, g, or t
  misc_feature (64)..(64): n is a, c, g, or t
  misc_feature (125)..(127): n is a, c, g, or t
  misc_feature (132)..(132): n is a, c, g, or t
  misc_feature (136)..(136): n is a, c, g, or t
  misc_feature (142)..(142): n is a, c, g, or t
  misc_feature (147)..(147): n is a, c, g, or t
  misc_feature (166)..(168): n is a, c, g, or t
  misc_feature (176)..(176): n is a, c, g, or t
  misc_feature (180)..(180): n is a, c, g, or t
  misc_feature (191)..(191): n is a, c, g, or t
  misc_feature (200)..(200): n is a, c, g, or t
  misc_feature (232)..(232): n is a, c, g, or t
taagaggnctaaataactcattaaagtttattanattaaaaccaaatatcacttttaaantgtntttgccatttcggaacaatacaaagtagaggcaaataggaacacttaaaaaaaaagttgcnnncccantccnttcccnaaganccagccctccctcaaaaannncctcccancccnaaaagaacccngtccttaanaaaacacttaaaaaaaacaaaaaaaggaaatnaagaaaa

SEQ ID NO: 567376 - DNA, 183 bp, Homo sapiens
ttgcccgatgagctgatcaaggccgcgatgctggacggcgcgggctatctggaaaatcttctggcgcatcgtgctgccgctgtccacgccgatcctcgtcgtcacgctcatctggcagttcacggcgatctggaacgacttcctctacggcgtcgtgttctccggggccgactccaagccggg

SEQ ID NO: 567377 - DNA, 707 bp, Homo sapiens
  misc_feature (58)..(58): n is a, c, g, or t
  misc_feature (133)..(133): n is a, c, g, or t
  misc_feature (213)..(213): n is a, c, g, or t
  misc_feature (222)..(222): n is a, c, g, or t
  misc_feature (236)..(236): n is a, c, g, or t
  misc_feature (263)..(263): n is a, c, g, or t
  misc_feature (294)..(294): n is a, c, g, or t
  misc_feature (298)..(299): n is a, c, g, or t
  misc_feature (302)..(302): n is a, c, g, or t
  misc_feature (305)..(307): n is a, c, g, or t
  misc_feature (309)..(309): n is a, c, g, or t
  misc_feature (311)..(311): n is a, c, g, or t
  misc_feature (321)..(321): n is a, c, g, or t
  misc_feature (328)..(328): n is a, c, g, or t
  misc_feature (332)..(332): n is a, c, g, or t
  misc_feature (337)..(337): n is a, c, g, or t
  misc_feature (354)..(354): n is a, c, g, or t
  misc_feature (372)..(372): n is a, c, g, or t
  misc_feature (379)..(379): n is a, c, g, or t
  misc_feature (381)..(382): n is a, c, g, or t
  misc_feature (386)..(386): n is a, c, g, or t
  misc_feature (389)..(389): n is a, c, g, or t
  misc_feature (427)..(427): n is a, c, g, or t
  misc_feature (483)..(483): n is a, c, g, or t
  misc_feature (486)..(486): n is a, c, g, or t
  misc_feature (512)..(512): n is a, c, g, or t
  misc_feature (514)..(514): n is a, c, g, or t
  misc_feature (518)..(518): n is a, c, g, or t
  misc_feature (557)..(557): n is a, c, g, or t
  misc_feature (559)..(559): n is a, c, g, or t
  misc_feature (582)..(582): n is a, c, g, or t
  misc_feature (594)..(594): n is a, c, g, or t
  misc_feature (609)..(609): n is a, c, g, or t
  misc_feature (614)..(614): n is a, c, g, or t
  misc_feature (618)..(618): n is a, c, g, or t
  misc_feature (681)..(681): n is a, c, g, or t
catgtaaacacaagctttcaatatctatgaatatttcattgcaaatacaccctaagtnacttcttctctacataaaggcagaaactccaagttctgctctttaggaagacatggagggcaagcaataccttangaacaaccattgctatttctcccctttccttgggtgacctaacattttacagggactaacgacataaagaaatattagantccattgantttaaacacaaatntcccactgagggcattaaatatttgangcttatgagtgtgaataaataaacattaggnatanngcngannncncncccccctgangtatganaacnaattngcatagatacctaacantcagtaaaattaaatttnactactnannatanccnacagccggccggggagaagaaacgcccggagcacgggnggcgagaaccgaggagcagccaagagaacaaacgaaaggcaagaaaagaaaaaccnggnggcgaaccccagggaggggcccaagncnaaanaggaggggggtggttacagaatccggcgaggggggcagnangcaggagggaatagtaagtggcnagaaagaagctntctattggaaaaccnactcncaancgcagagtgcggccagcggaacaacgcgttgctagccggttgttatctcaatagatcaagccnattgtgtcgctccaagacgggagcaa

SEQ ID NO: 567378 - DNA, 343 bp, Homo sapiens
  misc_feature (13)..(13): n is a, c, g, or t
  misc_feature (72)..(72): n is a, c, g, or t
  misc_feature (110)..(110): n is a, c, g, or t
  misc_feature (207)..(207): n is a, c, g, or t
  misc_feature (282)..(282): n is a, c, g, or t
agaacagacattnccctttgagccttagtccttcatctgtatttgggatatgacataaaactctatatgggnccggtgcatggctcagcatttatcccgcatttgggagnccaagacaggtggatcacttgaggtcaggattcaggacgagcctggccatgtggtgaaaactgtctctactaaaatacaaaaattagctgggcgtgntggtgcacacctgtaatctcagctactcgagacgctgaggcaggagaatcgcttgaacccaggaggcagaggttntagtgagctgagatcgtgccactgcaccccagcttgggcaacagagcaaaactctgtcttt

SEQ ID NO: 567379 - DNA, 1707 bp, Homo sapiens
  misc_feature (1456)..(1456): n is a, c, g, or t
  misc_feature (1467)..(1467): n is a, c, g, or t
cgcggccttgtcggctgtggctgctggtcgtctgtggcggcgggtctggtgctgtgctgtgctccgtcgcgctgcttggcgcggtggtgcctcgtcggtgccgacacttgtcgtgcgtgtgtgattgtgggcgtccgccgttccaattttttatatatccccgttagcccgcgtcgttgtagtggtgtattgctcacgattaccaccacgcacatctcccggcgatttatttatagggggggcagccacccgcctgtggtatgtgggaaccctcttccctggatatgggggagtttccccccccccccaggcgtggtgtggggtgaccccacaaaagatgcccactgggccgttttgtgttatataaacccggccccgtggtcccccctggtttacccttttttttgtcacccggggttctccctctttaataaggggttttattcctcggaagcggccccgctcgtgggtgtttgtggcccgagaaatttttcttgggcgcctaccagtgaatgagcgtgtgctgttgttgttgcccccccgcgtagacggtgcttaagagtgtagtcctcttcgtcacaggtctgccgcaagggcccccccccgatcttgcaacaaggacgttgttcctcccccccggggagcccccctttatgcgccgcccccacaccccctcgtgggaggagcgccccccgccccgtctttgtccatttgtcggctccctctcttgtcctacatgtctctccgcgcgggtatccgccgggcggctgttttcctctaggcggcgctgcagcgtcgccctctctggtggtttgtggggggcgcgcgaagagatgatccttatatcccccagaggcgctcctttttttcgtcgaagcgccccgcacataagagggggtgattttttcccggccgcccctctcgcgtgggggcccctcaccatcgagaaaggttgtttctcctcctcccgcgggcccctctctcggagatagagaccacccccttcgagatagctcacgcgcacacttatcacacgtgtggagcacccctcgtagaagagtagcccgcagcccactctgtgtctctcccctcgcgggtcctcgcgtttggaaaagatacacaccatgtaggacaattctcacgcggcacccgcgcgtttgtttggccccaccatgtgttttctgttgagagagagggccctgtgagacacgcgtgtggtgagaagagcacacgcgccccgcagagcttgatatgtctctttgtggggagagagacccacacatgccacaccacagagagtttcacaaagcccacagcgacacaccacatgttcgctggggaagactcttctgcacatttcacgcgttgtgccacgcgagacacactcacattttccatggccacgctgagattcacgctataaaaagtgtgctgtagaaaaagagaaatcacgccnctatatgggtnttatagccctcgtagagagacctgggttgacataccaagtctttgtgcgtccaatgagcctgggtcttattgaaatataagaaggtggaccacccacacgccagtcttcccttccagccccggccgtggtgtgtcccctggacaccaacgtcttccattccccttgacttagaggccaccggattgatccttctttttatagagccatatttgccccattaagcttttgggaacccggga

SEQ ID NO: 567380 - DNA, 476 bp, Homo sapiens
ccaactttgtactaggggtgctgtatctttccctttacgccttcaaatagactgctagcctctgtccttatcagcactttccagttgaaattagaaggcagtaaaggcgaaatgacacaaacaacatggaattagcgtggctgacacacagagatcacagcaggtaatggagacaggtgaggacccagtgaggggcatggggaaggggctgtggagctctgaagtgcatttcccacatttagccttgcactggatgtacaaatgtccacatctctaaaattaaattatgtaccttatggagcaatttgcataaaacaattttgtatctgttgtgtgtttcataacctgcggtacatctgtacatttatagattttaaaaaatagtatatatcctgctttgtaacatgctttttttgttggcacatgcctctttatgtccataaataaatacagacgtcataattgccgatgaaaaa

SEQ ID NO: 567381 - DNA, 83 bp, Homo sapiens
ggatatggtgctgcagtccaactaggctttatagggactcgattcgagctcgaattcgaggctcgaattcgagcaagcttcta

SEQ ID NO: 567382 - DNA, 156 bp, Homo sapiens
gacagaccgtcgttactcatacatctccactggtcacgaatcctgacggtaacgggtcacatgatctcatcggtaccttccacaccagcttggaccagctgctgcaccttctcccacttggagttgatgatttgcggggcagctcgcccctgagtt

SEQ ID NO: 567383 - DNA, 796 bp, Homo sapiens
gaatgtggaaaaagcaccttacctttgtgagagactgcatatcaaagtacactgtcctcacatctgagcaatctgtaaaagatgggaaaacacatagaatcatgtggtgggtttactgccctagagagatacagatgacttcaaccatcagtaagctttagaagtgcggctcggccttcatgacaattcttacattacacttggaaatctaattggagccaccatgttcagaaccaatagaatttgggacacactgtcacaaagctggaagagaaaactatcctgagggaagccaatatgatgcagactctgtactgatagattagagctcaaaaattctctgtaagtagtcgtgtataaacttctggctatcagattttaaatggtggttgtatataaaattcgtagttaaatggtctatacgattggtccacacttaaatactcgatatacctcggaagttttatacgaggtggggatcgacgatcgaaaacgtgtcatttactgtcaaacgtggtcgtgggccatcatgtcaaaagagtttgaggaaaacatcagttcgtaagttattctgggaagggtccgattctctattgcggagattgactttatcacaatatgattcttacatctttataccatttacaatgtgtgttctaagatctacagagttagaaattcgaaaaatattccaggactaattctttatccggcttatttatacccaaaggtccagtaacatttaataagcgcaatatggctggcaatgacttataacgccctctggaaattttac

SEQ ID NO: 567384 - DNA, 217 bp, Homo sapiens
agtagcgtatgatgggcagttgaggggcgatatgcatctaggctataatattcggagtatacgtagcggtaagtaacaacggacctctagaatatagtagcatggcaaattaaagcgtgatatcgatcgcgcgcagatctgtcatgatgatcattgcaattggatccatatatagggcctgggttataattacctcaggtcgacgtcccatggccat

SEQ ID NO: 567385 - DNA, 302 bp, Homo sapiens
ggctgttctgaggtaccggaaggctgagagtaaggaggccagtaccgtagctgtcatgcaggtcgataccaggcgtggccaacattgcgaagccccgttctctactaagaatacagaaactagctgagcatgatggagggcgcctgtggtcccagctgcttgggaggctgaggcgggagtaatcgcttgagcccgagaggcagaggttgccgtgagccgagatcgtgcaggcaaaggttgccagtgagtctgcagattgtgcccatccagcctggggcgcacaaccagcaagcacttcgtct

SEQ ID NO: 567386 - DNA, 460 bp, Homo sapiens
  misc_feature (19)..(19): n is a, c, g, or t
  misc_feature (29)..(29): n is a, c, g, or t
  misc_feature (84)..(84): n is a, c, g, or t
  misc_feature (94)..(94): n is a, c, g, or t
  misc_feature (100)..(100): n is a, c, g, or t
  misc_feature (102)..(102): n is a, c, g, or t
  misc_feature (137)..(137): n is a, c, g, or t
  misc_feature (141)..(141): n is a, c, g, or t
  misc_feature (209)..(209): n is a, c, g, or t
  misc_feature (367)..(367): n is a, c, g, or t
  misc_feature (431)..(431): n is a, c, g, or t
ggaaaaaccaacccactgngtaagtgacncatctaaggaaaaaccaacccatcattcatggagggctgctacctgacccttggngccatgagangctccncngggggtggggtttgtccacagagctgctggagcanaccnaagagccagtcttgaccgggatgaggcccacagacaggttgtcatcagcttgtcccattcaagccacncgcttcaccacagacacagtggagccgcgctcttctccagtgacacgtggacaaatgcggggctcatcagccccccaagagagggtcaggccgaaccccatttctccttcctcttaggtcatttttcagcaaacttgaatatctaagacctctcttcnaatggaaaccctccagtctatttataagtcacatagataatggtgccacgtgttttctgatttnggtgagctcagacttgggtgcttccctct

SEQ ID NO: 567387 - DNA, 116 bp, Homo sapiens
tagctcgcacacaactcctgcggatagctactcccgagcccggagaggacccacgcgtaacccgacgccaagtacttcattacgagatgagtattctagaggatacagcactagcc

SEQ ID NO: 567388 - DNA, 430 bp, Homo sapiens
atacgcctgctccttatatctaccccaaggcaggccgtagacactaaaaatataatctcatctcccccaacctttctatctatggagctggccataaagaaattctctgaccttcctatgtctcattacaggccacaagaccttcatatcagaaggggtcctcccccataccctggaggaaggaaagctacacagagagaccaagaagaatctgaacagacaatccttgcagaattatcacactcagtctattaatattagatcataccctaaaaagtctaatcacataactacataggaagactagtacttaaatcatagactatccaataaagtcttaccataaaagacggacgaggacaggatatgaggagctcccagagagctgaacatgtagagatgtagattaggccacaacacagggctccgc

SEQ ID NO: 567389 - DNA, 405 bp, Homo sapiens
atcttccacacaacaaggagcaagctttatactaatagtagctcaaaagccaataaatcaaatcgctaggtggaatattttactattgaaatggagtgatagtttggttaataatttgagatccactaatcctaaatggggtagacccatttaaaatggcctctgtgtacatatcacagttcattaaatagagtctaggtttgaacaggtcattatagtagttagtatataagtaaatggatagagcaaggataggcaggggatacccatggggacacactaggctgagtctggtggctttcataacactgtcaagctttcttataatagtgagattcatttaaatcaccaactataaatttaggtggtattgcttagtaacctcttttggtatacagtcatact

SEQ ID NO: 567390 - DNA, 273 bp, Homo sapiens
tagagacctgtgcatgtgatgttttggtatatgtttacattatggaatgattaaatcaagctaattaacacatccatcagctcacgtatttctcagtattttgtggtaaaacatttaaaatctgctcatttagcaattttgaaacatacagttcattattatttattatagtcaccattctatgtaataggtcactaacacttatttcttgtaacggaagtttgtaccctttgatcaacatctcacctttctccattgcaacacggtctctca

SEQ ID NO: 567391 - DNA, 702 bp, Homo sapiens
cgccttctccagtccgcggtgccatggcccccgcccgtctgttcgcgctgctgctgctcttcgtatggcggagtcgccgagtcgatccgatggagactgatggtcatcgacccccatggacctcctagaaggccgatacttctccggagtccctacctagacgagtgaggatgtaagtgtgggcccgggcaggaatctgatgactttgagctgtctggctctggagatctggatgacttggaagactccatgatcggccctgaagttgtccatcccttggtgcctctagataaccatatccctgagagggcaggggtctgggagccaaagtccccaccgaagcccaagaaactagaggagaatgaggttatccccaagagaatctcacccgttgaatgagagtgaggatgtgtccaacaacggtgtcaatgtccatgcactgtgccgggcagcaagatctgtgagcagaacggaggtcctggcagcatctgaatcgctgggtggcaatcggcgggctatcctctttgccgtgttcctgatacctagctggtcatgtaccgtatgaagagcgacggatgaaggcagctatggacctgggcaacgaaacccatgctactcagaaatggccccaacaactgagttcttacgcgtgaagcttgctagtgggcgactgggcttggactgaatcgtgggagggaagcc

SEQ ID NO: 567392 - DNA, 825 bp, Homo sapiens
agcggatgatgctcacagggagcctggacaatcgaatgaggcctcccagcattcaggggtatatggaaacagctggtcaggaaatggtgactataaatatcagttcaaaaactcctaatacaagatgcttaggatggatcaattcatgtatccattcatttattccagtaaacatttccagagtgcctcccatgggccatgctcggacctaccatcgaggaacacaggaatgaatgatagatccatacctcctgagcagatggggctcatgtactatagaagttcaggatgcattaccccatatctcagagaaatatttcgtgcctaagtcccagaaaaagacgaagaattccacaagagggatacagagccatcagaaaatagctctgatgattctaactcagctgaggtaccatcaccatcttcccagaatacgcatgggaagaaaagcgagagaagcaaacgtacggatggctgggacttgcaaattacaaccaggaagcagaaatgatacagcttacatttatgtggatgccttcagacaaggccagactgagagatggaggcacacagatgagagaccccgcgaaggaacctggaacagaacaaagaggacaatgagcatgtgcgaggaagtcagagacaacggcgaaccgaccaacaaacgacgagacataaaaagaaagagaacagggaaacgagctagaaccaaaaaaaagggggcaataaaatcacccagaataaaaagtggaaagggaacacaagataataaaaggaaacgcgaagagcccataaacggacagaacaaggaaaagaagaagcaga

SEQ ID NO: 567393 - DNA, 930 bp, Homo sapiens
atttatctattactctccatattcgagcactttataacgcacatgagtcaaattgctaatgaggacaacaggctccccaaatcagcacaccaaactgtcaaagtggtgatccctcttcatttgacatgctcacaaagaggagaataagacaagaaagcaagctaacccagaaacagtgaggtgactgtgcgcctcaaacacaggaaaataaaatgcataactatactgattgtatgctgctcaaatatcactctatcatgccatcgctctcgtacattgtgaactaagttaccaatttctatctctaacttatgatatcctgcaaaactgtaccatcagctcctggctacgctcctaaaaaccaaagaatctagaaatcccttattcaaaaaattataatagaagtactagtggagacattttaggtatataaggaagccaagatactctttgaggatacatgtgggaactaacctaccatgaataccttattgtgactcgcgttaaatatcactataataatcctcctctcttgatcgtaattactatgaaacattatagacagcatcctatcctttttaagagcggtggtattgtcatgaagctccacagaacttaatttgttttaaattggtaaaaatagatatcgcgccttcaccttcatattctctactgcagggcagagcatatcgatcttcctaaccaactaatggtgaattgcctatggaaaacaccatatctgacatactatcgccagcctaatggatctatcatagcaatagaacaagatatgtgtcccgcacacaagttgcttttaacgtcgtccattttgatcttgctaaccaaattcccctgtctacatgcacacataccaaaacaccattcttcattgatgattatctaaattgttgcctcaggagaggtacaaga

SEQ ID NO: 567394 - DNA, 107 bp, Homo sapiens
ccacgggcagatttagatctttgacgttgggaaattctggcagcagtgttccgagtttggaccgggtgaatatccactgtctgtttgctcacttctttcttgcccgt

SEQ ID NO: 567395 - DNA, 878 bp, Homo sapiens
  misc_feature (4)..(5): n is a, c, g, or t
  misc_feature (258)..(258): n is a, c, g, or t
aggnntgtggggtgcaggcgtgaggggcgggggggggggggcgactggccggggggccattgagggttcgccgaagggtgtggacccctcgggttcaggtgtccccgcttggtccgaacggcgtgtggctgttgtcccatatcgaaggccattttgtgtagcgggtttccccgccattggctttttccaccgggcgaaaggtccgggtgtctacagaagccgctggtgccccccaattatatggtgcatccccctgtngtggaatccgctccttaactgtcaacaccaacacaagctggtggtgccggaaacccgtttttttatacgcccggagaactcgtctattaaagatgggtgggaggaaacacatttgcgcgcgctcctggtagaattccccgcctcagtggggaacacccggtttccggggcgagccccagtacacaagtccggtacaagggtgtcgcaccagtgccccccctataggagccttacaaggacctagagttgtgggattactggtgtccccccggctgcttgtcagcgtctggcccccaacaccccagttcagagagggcccctgtgatagtagcttccctcgaggcgcagccagtgttctttcaagaataccacgcgcctctctgttacatcccggcaaaaagttgccctcccggcggctggtaacagtggcggtgcatccggcagtgaaagtccacgcgcttgttgggggtcggtgaggccggacgggaccatctctcgcgggcccggggagctttcaagaccccccttttcggggcactctggcaaatccgctgccattgccgcgtacaccaaaatcatttcataacccgcccccaaaaaatataaacaacccacatgac

SEQ ID NO: 567396 - DNA, 128 bp, Homo sapiens
ctcaaagtcagctccccagaccactgctcgccatggacaccggtgtgattaatggtggattaattgtcactctcaccatccggctactattgcatggaaggaaggttggcagtatcatcggaaggagg

SEQ ID NO: 567397 - DNA, 242 bp, Homo sapiens
agaagattggcccatgcacaagctggaatgttctccatggttgttttgggaaaactgaatcctcggagactgtagactatcagcacggattctcgccaaacagaaatccacccagagagacaccttcggaaaattgttagctgtgaggagtttgattcacatctggatagttagacaatgagagaggtttgattcagagtgccatagctgctctcatcactttactcaggcatctggattcc

SEQ ID NO: 567398 - DNA, 118 bp, Homo sapiens
caacgatggtcctcagctccgcgagagaagtgatggctcttgctctcaggggagctccgaaatgtcgcatttattcacaggatacgtgtgtgagacagcagttggacaaaatcaatgc

SEQ ID NO: 567399 - DNA, 307 bp, Homo sapiens
  misc_feature (16)..(16): n is a, c, g, or t
  misc_feature (35)..(35): n is a, c, g, or t
  misc_feature (123)..(123): n is a, c, g, or t
  misc_feature (128)..(128): n is a, c, g, or t
tcatcgttcccccaanactaattaatcacaaacanctggggctgggtgtggtggctcatgtctgtaatcccagcactttgggaggccaaggtgggcagatcacttgagccccaggagttcaanaccancctgggcaacatggagaaacacagtctccacaaaaaaatacaaaaattagccaggtgtggtggcacgtacctgaggtcctagctccttagaaggctgaggcgaaaggactgcttgaacctgggaggcagaggttgcctcctacactgcactccagactgggtggcagtgagaccttgtc

SEQ ID NO: 567400 - DNA, 207 bp, Homo sapiens
actcagatcctgccggcagaatccactccactatccgccctggactaataggtgaacggattacgagtagagtagaatcccaagcactcactactgactggctatactacccaaatctagtagctggaaaaacaaggctccagctagcaagccctcataggacaaatgagtccaggggccagcccacgcagtgagcgcagtgcacca

SEQ ID NO: 567401 - DNA, 358 bp, Homo sapiens
tatatatatatagtatgtttatgtatatatgtgatgctgataagaatagacggtgctattctgtattctatatgtaaaaacaagacaagaaaaaatagagaattctacatactgagacatctgctctccttccttataatttcaatatcttgttatcgatttattatatttggtgctactgtgtatccgtagtaattgtggggaaaagatattaatgtcacgtctttgtctctaggtgcaggtttttcgagatagttccgctagtacatatattatttataaacaacgagcagagaaagtacagcattatatcttaataaaaaaaagatgcctttggtattaaggaattaatatgctg

SEQ ID NO: 567402 - DNA, 1553 bp, Homo sapiens
  misc_feature (819)..(819): n is a, c, g, or t
  misc_feature (1553)..(1553): n is a, c, g, or t
ggctactccaatcaaaattccttgttagttcctgagtacttcagggcagaatcatgaatgtcattggagaagctatcgatgaaaggagagtcgccactcacaaaacttccgaagacatagttgtgcgtcccgatatcatgcatggaatgctccatgagcttctatgggaagaatgcagtgttgacgctaggcaccaatgctgcgtagacctgattatccaacggttctcgatccgtatgccttgcataagtctccacctaatgcctagatgggttgcgctagatacattcggagcgtatacattggtgagctgcatggaactcgtgttagaagactcgttacatgatatatgtgcagttgacatacaatcataatgtccgacgcaaaatgccccatggatcggttgtaacgtcgtcggctgctgtcgacttcggagtgttcgcgggtggagaaaggcgtgaccgccaggtaagagagcgtgcacagggagtgttagatggacccaatgcgagaatgccacctctgaaatctctgggtttcgatttaattcaaaccttttgaatgacgcatggaacgaacccgtctgattgggggggcctgccatcgcgatagtactagtggtcacacacttgaaactggagaccaccacgcgtgcgttgaccttctggctcgaccgcagcgcgttaagcgttcctgagccttgtgtggctggatgctgttgagctgggacatacctctcaggtaggacaccatagaaagcggttccacacgaagtgctatctttgactaatttgaatcgagtagatccactctcgttgntgcgggctttgcagagcgcctagagcctagggtatcccgaggaagacagttgctccatgtggccactattgatctcgtgcggaccgcgcaaaataccgccttagctggacctagcatggggagccttaaattcgagaaacgctttaggccacctggagagggccaacgttgaacccactgtggccgattacctttaattggcatgtggcacaacaaggaaattaaagcgccaaccctgtgaacccaaaaaggagacgtgggaaatacataatacaaccctcctaggtcaacgaaaggcgtaaatgccgtgatccgtgggaccttggttctcgaattaggaactccggaagacttgaaaaccgcctcagcacccgtgtggggaaacctaaccggttttattggccccggttttttgggacttgggctaacccaactggataaccgtgggttcggacggttttgcaccatttttgcggttggatagcgtaaggggcggcagtacattatttgccaacaggctcggtggggtcgttcccttcggataaagaacacgtccgacaccgtcatacagctaaatatcaaattgggaaatgccccaacacaatgttgatatgggcggaggtcgtgaacagcaaattaaacagcgatatggttctgccccacgttgtggtgttggccaacacacacggactatctttgggagcgacacttaattagatatatgccccgtctan

SEQ ID NO: 567403 - DNA, 125 bp, Homo sapiens
  misc_feature (118)..(118): n is a, c, g, or t
gtttcccaccaaaatccatcgaagaacagagaggccacggttgaattagggaagagaacagagcacagttcagtcaataattcacgcggagcaattggaaatagatagagaggttgangattcat

SEQ ID NO: 567404 - DNA, 149 bp, Homo sapiens
tgtggtggtgccttctgggagaagagctgagatactcatgccatgtacagcatgaggggctgctgaagcctctcaccctgatgatgggagccatcttctcagtccaccgtcccctttgtgggcattgttgctggcctggctgtcctagc

SEQ ID NO: 567405 - DNA, 949 bp, Homo sapiens
gagaagtagccggcaggcggaggcaggcccgagggggcggttgcatgtgtgccagacgttcgtagcccactgagcttcctcacgccggctgtcgcaggcctagccccaccggcggctctcctgcgcttccggggccgtgggagctagtgcgcctgcgtgccggccatccgcgcgccttgcagctgtccttgcgtcggcagctggcagacagttcctgcaggcttaccgactggcctcatctggttccgtggcgcaccggagggcagatgtagacggtgggtgacaaggacgagaacgacggtgggcagctcacaaaaggagaaagactctgatgcaaatgaaagtgaagatcatttggaatctttaatatgtaaagtaggagaaaagagtgctgatctttggagaagaactaaaaagttggaatggatggtaaagataaaggtgatcatatagtcaatacaaagcagacaagaatcgctgaaggggaacatctgccgctacaagaagtggatgcgacctaagtaacatgatgtacagcggaaccgacatacatcgacaacagcggaatgcgacaaattggatgttccagaaattgacaacaagcgagtggacggaatggatacacacccggagtgagagaacaaacaaacaagatgagaggacaacagttacgggagagaggtatggggaccaagaagtggagagggaagcgaggaggagcagacaaaaagggaaagagagagcaaggagggcagcaggcgaagacagcagggacaaatgaggggacaaaggaacaagcggggagcacgaagaggagagagacgagacgacggaaccgcgaacaggcacgaaacaagcgagaagaagaaacaaaaacggagcgcaacagacgcagaagcagcaaaggggaggacggggacaaaaagaagaaagagaaagacagcgctac

SEQ ID NO: 567406 - DNA, 902 bp, Homo sapiens
ataggaatcgggagctcgccaatcctgtgggcatgctggatccagcagagaaggatgaacacagggcatgcctgtgacagctcgatgtggggtagttacgtcctgataagaagctgacgcggtcatatacctcctacgccacaggtaccacatggcaggaacttggatgagattctcagggtagtcatctctctccagctgagagcagaaaagaatgggttgtcaccccagttgattggaaggatggggcatagtgtgagtggtccttccaaccatccctgaagaatgaatgccaagaaaattttcccgaaaggagtcttcacaaagagctcccatctggccaggatttacctccgttagacaccccagcctttaagtctctgtggagaagctggtgctgtgagccaagaggatgtcagctgccaacttgtgtgtcattcctgcagcacattccataagagcacatcctggtgtcatcacagccaaggttgctcaggttgctataccaattggttattaaatgacatgggcactaacaagttgctggagattcttgtatactctctgctttcagccagtcaattccatgccatacattaagcacctctgggtggtactggtgcgcacctatgttctgtatttcagcacgtcaaatcctgtggatctctgcagggttggtgccactgaactccatttggggggcggtggccaacgttgttcctccatcgagagacttcaccgttttttaaatggccaaacgtccctccgtcaccacttggcgtcgggactgtgtccactctcggaatatcacgaaagcgcgatgtaaaacaagcgcacatttcactgtgggccacctataaagagcgttattttcacttgccagggggacgatttccccaaga

SEQ ID NO: 567407 - DNA, 154 bp, Homo sapiens
ggccggtaccgaccagagactcgagacaaagtgggacggatgtcatctgactcttcatttatttctgactgtgatttatttgggagtggagcgcactgtattctaacgcaaaagaacatgtcattgtaggttttcttaccaataaaatgcattt

SEQ ID NO: 567408 - DNA, 174 bp, Homo sapiens
tgagccggtaccggtggaatgacgtagacacacgagcatatttcacctcgctaccataatcatcgctatccccaccggcgttaaaatttttccctgagccgaaacactccacggaagcaatatgaaatgatctgctgcagtgctctgagccctaggattcatctttcttttcac

SEQ ID NO: 567409 - DNA, 100 bp, Homo sapiens
aagtaccacttggtgcgagctgctgtcgatgctgctgtggtgtgtgctgggtgttgtcctgtgtgatatcctcacgtgatgttctgcggcccggttgatc

SEQ ID NO: 567410 - DNA, 217 bp, Homo sapiens
aggtatatcgatcgtataggtagggaaaccatgcaaaggtttgtttcagtgtttccgtgtgtgtgtgtgtatataaatatcaaatccctctcccatcggattttttttcgtgttcccacaattaaaaaatttacctagggtcaagtcgggagagagaaatgtacttgagatgaatatgttctgttactataggtatccaataaattgtgtcaaactc

SEQ ID NO: 567411 - DNA, 338 bp, Homo sapiens
tctgagggggttaattccccatgaattgaggaaatcaggacgttttcatggaggacgtgaattagcaggattcctaatgatgagaccaatgaagttggccatttcaagctgaaggaagcatgcaagcttatttggcaaaggaagttaatctaattgtcaaattctgaatgatttttggtggctgtcttaagtgctgccctgagataaatcttaaaaatgcttccatactaagtcacaatcaattagaagggtctgctctggttacagcatggcaagaggtatctgcaataactgccatagacaaaaaaatttaaagaaaaaaaaaaagggcggccgct

SEQ ID NO: 567412 - DNA, 158 bp, Homo sapiens
cttccgtctgcccactccagcctgggcatagagtgagactccatcttcaaataaaaaaacgttcagttaggctggcgcgcggtggctcacgcctgtgatcccagcactttgggaggccaaggtgggtggatcatctgaagtcagggtcttggctgagg

SEQ ID NO: 567413 - DNA, 215 bp, Homo sapiens
  misc_feature (165)..(165): n is a, c, g, or t
ttgaacctgtgaggcaacatagcaaatcctggtctttactaaaaatacaaaaaaaattagccgggtgtggtggcgcatgcgtgtggtcccagctactcaggaggttgaggtgagaggattgtctgagctcttgcctgagcctgggaggtcgaggctgcgtgagtngagttcgcaccagtgcactcccgcctggacaacagagtgagactgtctca

SEQ ID NO: 567414 - DNA, 433 bp, Homo sapiens
cgactctagagcatcccgtccccgggtagcccagatgcgtagagcctgatgtgtctcagtttgtcctcactgaggggaaccctcgctgggaggaaacacatctgacctacaggattgaaacttacacgccagatttgccaagagcagatggggaccatgccattgagaaagccttccaactctggagaaatgacgcacttctgacattcaccaaggcctctgagggtcaagcagacatcatgatatcttttgccaggggagatcatcgggacaactctcctttagatggacctggaggaaatcttgctcatgcttttcaaccagtcccaggtattggaggggatgctaatttggatgaagatgaagggtgtaccaacaatttcagagagtacaacttacatcgcgttgctggtcatgaactcagccattctct

SEQ ID NO: 567415 - DNA, 153 bp, Homo sapiens
aggagcatgcgtatatccagctactttgggaagccgaagctctggggggactgcttgagccagtgttagggtgcaatgagccgtgatcatgccaccaaactccagcctccacgctccagcccaggcaacagcaggacatcctgtctcaaaaaa

SEQ ID NO: 567416 - DNA, 517 bp, Homo sapiens
  misc_feature (469)..(469): n is a, c, g, or t
  misc_feature (498)..(498): n is a, c, g, or t
gtcacccaggctggagtgcaatgggagtacgatggcgcgatctcagttcactgcaaacctcaacctcccgggttcaagcgattctcctccctcagcctcctgagtagctgggattacaggcacacgccaccacagccggctattttttgtatctttagtagagccggagtttcaccatgttggccaggctggtctcaagctcctgacctcgtgatctgcccgccttggcccccataaagttctgggattacaggcatgagccaccgcacctggctctacataattttaagtattgattaattttcttccagacagattagatttttttttttttttaatgagatggtcttgctctatcgcccaggctgagtggcatgtcttggctcactgcaacctctggctcccaggttcaagctattctcctgcctcagcttccctagtagctgggactacaggcatgcgccaccanacccagcttttttttttgcattttgagtngagatgggttttcacctgt

SEQ ID NO: 567417 - DNA, 567 bp, Homo sapiens
  misc_feature (11)..(11): n is a, c, g, or t
  misc_feature (482)..(482): n is a, c, g, or t
aggatctccgncagaatcacactcaaatcagccggacaaggtggaacacatctgtagtcccagctactgaggacgctgaggtgggtagatggcttgtgcctgggaggcagaggttgcagtgagctgagatcatgtcactgtggtacagtctgggtgacagagggagactgtttcaaaaaaaaaaccagaaagattgaagggcaaaactttaaaattagatttcccatgtgatctaacaatttttatttcgggattattatattccaaaattattggaaaacaaggaaaaagaaaaacagagtctcgatgagatattggtacccagtgttcataacagcgttatccacatttagctaaatggtggaagcaacccaatatatcatggagggatgaatagatagggaaaatgtggtatgtacatataactgaaaattcatccagggtcaggagggacggtactcctgacatatgctacaacatgnatgaaccttgaggataatcatgctaggtgaaataagccagtcatgtaacggacattaccatataattcacttagaccttggagtg

SEQ ID NO: 567418 - DNA, 341 bp, Homo sapiens
  misc_feature (33)..(33): n is a, c, g, or t
  misc_feature (40)..(40): n is a, c, g, or t
  misc_feature (42)..(42): n is a, c, g, or t
  misc_feature (55)..(55): n is a, c, g, or t
ctctacaggagctttaaaaattagcgagatggncgagggntnctcatgcttggtncagctccattagacctcactcaagcaggactaggtctcactctgggctgtcactggcctcagagtgatctcaggaagtgcttcctctccctgcagccaatgtccttgtttgcgaaggaggcagcagaaaaaaaaaaaaatttattggagcttccatggtgtgtcgagtattttcacattcaattccctactatctgtgaggcagctagcatcatctgcatttaacagactaggaagttgaggatcccagaggtgaaggaaccaacccaaggcccgtcggctaattt

SEQ ID NO: 567419 - DNA, 445 bp, Homo sapiens
gtccgaggattctaattttatggtttatcgtagatgtagatacatgtattcataatacataacatagggagaactaaagcaaagattattctgtctcaaatgtagtgtcatattgcaaaaaagaaaggtgtaattagctgatttaacagaaaaatccttggtgatatgacaaatcatataacctcggaaaagcatgggaaagagaatggctataaagactcaactgtagttggtcatcggaaagagattaccgagcacagctgataagacacacaaacttacagaacaatgaagtcaaactttggaggatctgccaaccccagtcctgctccacacttttcacttccataactatcatctttggcctaagacatctacacaaaggccagactaaggagaaggcaatagaaacaggaaaggggtaagggcacaaatcaataaaaga

SEQ ID NO: 567420 - DNA, 103 bp, Homo sapiens
atgccgctgaatagaagtttggcagagcccaaagcccagatctggagtcagtgcattgatggtggtcacttgccggggtcggtctgtctgcaaggaagccacg

SEQ ID NO: 567421 - DNA, 1358 bp, Homo sapiens
atcctgacccaagcacgtggctgacgagatgctgaacgacatgaagaaagacgagagccagagaggaccagcagcagttcaacagcatgtacatgtaccgtacacgagaacgtcagacatcctctttgccgacatcgatgggctttacccagctgtcattctgcctgccggtgcccaggagcttgctgacgcctgctcaccgagactcctattgcccgcctttgaccccctcggccgctccatccccaccagcctgcgcgcttcaccgatcctgcggcgcacctgctcctcactgcctctcgcggcttgcccgcctcaccgcccgcgcacctcgccgtcttgctccactcctccatcggccgctcgcccatcggtcggcccgcccaccctcgctctctcgcgcgccaccacgacaccgcacctcccgctcggccctcgcgctgctccccgctcgcccactccgccgcccccccgccgcctgcccggcggcgctccctggctgccccccccctcccgctgccacccgctctccgcacctgctgcgctccgcactgcattgtcccacccgccccgccccctgcgccacccactggcgcgcgacccctgccgccccacctccccctgcgacaccccccggtcgcctacgcgcctacgctcaccccaccacgacaaacccccaccgctcccccctcgcccttcgaccacccccacggacagcctctcccgcaccgcccgcgacccaccccacgacgcacacatgccggacagcccaagccccagctacgcctgcacccccccccccccacacgccccgcaggagcggccccgccccaccccccccccccccccccagccccgacccacaatcccacccggtcaccctcaccccaaccgccacaccgccacgccctcacaccgcacacccaccccccccgcccccccccccccccgccaccgcgcgcccgccctccacaccgccccactcgccgcacctcgtgacagacaacaccacggaacgccacacacccagcccaacagcacgcacagcaccggcccccaacgcgacccgacccaaccactacgcccaccatacggataaccggacgcggaacagaaacggaaaccgccccacaaccccggcgcgacggccataccccccacaacagacgccaagcacggcacgcgaccccagcgcgctctaggcacaacaaacaagacccacaagcacaacgcaggacacacgcaggcacagcacgccacaccgcccacacgacaccaacaacccgacgaacacatacccacgacacgccccacacaccggcagagcagacagcacacaccaagcacaagaaaaccaa

SEQ ID NO: 567422 - DNA, 205 bp, Homo sapiens
aatccgggcagtgcgtggctggaggaccagatgccaacatgacagaagaaaatgagtatgctcatctaccagcattatggatactacagcagaatataaagcctggaaaggcagactggactccatctagcagagcactctccaactcggacaccgggatgttgagcgcccctgggatggtcccagctgccgcctcctcgcgaga

SEQ ID NO: 567423 - DNA, 129 bp, Homo sapiens
gcttataccaccatggacttacaggtttgcatgggttccaaatactggctttatggtactgtttttcggaactacttgtgggactatagttttggttgtggtatagagtggtatagggtggtatcaggc

SEQ ID NO: 567424 - DNA, 367 bp, Homo sapiens
atgccggtagtactggatagcgcgacttcacggtcaacttcacggacgtctgcacggggctgtgcaagtgcatcacaaagcgccgtggtgctagattggctaagtatggtgcgtattatgagaccaacggtgaaacaagagttgtatgagaatcttgtcgcggacaatgatatatatgattatacagacaatacccacagatgggaatacatgtgtgatggaattgctcattatggcttacgcactgaagactgtctgcgacaggaacattgttggggtaatccactacttcccatacagtgagcataccaagatgatggaggtgcttcattgtgtgcaggcagctagcatgcatgctgtcttcgtg

SEQ ID NO: 567425 - DNA, 513 bp, Homo sapiens
  misc_feature (123)..(124): n is a, c, g, or t
ctatattgataattgaataaaatgtcaactttcagtaagaagaggttggagaaaataaagtcatttttttcatccaagttcatggttccctgggggagaaggtgggccaaggttaagaacccnntaaatgggtgaccctttcctcttaccccacataaacgtgtgtgtgtatacatacatagctatcaaatatatatgtatgtatgtatatatatatacacacacacacacgtacgtatagacacacttcaaatactgttccagaactatctcctataagttcttaacatattagaaaatcttagtatttatggatttgtgaaacaaatttcctttttttttttgccactgaaggaccatgcctcttagagatgggttagagaaaaacagtcactaccacaggggttcctagactgtgtcctcagtagccccaggtttccattagaggtgtttcagaagtacccgcgttgtgtatgtgtagggttaaggggttgatgagaaggtccctgccgc

SEQ ID NO: 567426 - DNA, 1023 bp, Homo sapiens
tagccaggcatagtgttgtgcacctgtactcccagctaatcaggagggtgaggtgggagaatcacttgagcccaggagatcggagatgcagtgagccatgattgcaccactgcactcctgcctggttgacagactgagaccctgtcaaaaaaagaaagagaagaagagaggaggaaatggaaagaagaagagaaacgaaaaaggaaaaaaaaaaaaaaaaaaaaaaaaaaagtgggctgggccgcgcccctgggccacgcgaaaaagccttctaagaacaatgccgctggggagcgccgcggggccccagtgaggatacagtgaacagtgtggccactaggggttacccagggaaaaccggggcccaggacaaaaggggcgggggaattcctcccccaatatcacaaagcccccgcgggggaaaacggaaaggatcgggaaacaaacccgaagcgggcacatagcgagggacaaaaaagcgggaaccatatcaccgggggatcccaagggagagaccaggagtcttaaaaatttagcccccggccgggggggaaaacgaaacagagggaagaaagggacgagccagagaagagcagacatacagagggagaacacagacagaacgaaaaaccagaaagaaggggaacaacacaacaagaaacggaaccgaaaagagagcgaagcggcagcacgtccaggagcgaagggggaggagcggaagggacagggcggcagcggagcagagcgcgagaggcagacgagacgaagcaaaaagtagccgagagcagaggaaacagggagaggacgggagaaaagggcggggagagaaaggaaaaagagagagaggggcggaggcgggagaagggggcaccgcgcacggacagagacagagaaaaggccggagacaccggcagaagagagaagagaaaggaaacgaagcgggggagggacaccaggcaaaacaaacaaggaaaaaaaaagggcaaaggagcaggggcgggaccacagggaaaggaaggaaga

SEQ ID NO: 567427 - DNA, 210 bp, Homo sapiens
acctcctaccccacgagggataacccagccatgagaaaacatctgcgacacccagcggtcccagagtccacgtctggtgcagaatgtggcaaagcttttgtgtgagagttcaaatactaaagacgacaccagactggttcgtgactggagagaagccctttcagatgcacggttcgaacggctgtggtgaaacgcattttcactgtgact

SEQ ID NO: 567428 - DNA, 316 bp, Homo sapiens
cacttgaaggccctcctcttccttccgcgtacaacggactgattcacctgcaagactgtgggcgtggatccggctgccgacggcaagaggtgtcgtggtggtcattaagcggagatccggccagtgtgaagcctgcctcctcctatgtgcggaccaccatcaacaagaatgctcgcgccacgctcagcagcatcatacacttgatccgcaataacaagttaccgaccctacctgcgcatggcagccatccgcagggccagtgccatcctgcgcaggcagaagcctgtgatggtgaagaggaagcggacccgcccca

SEQ ID NO: 567429 - DNA, 292 bp, Homo sapiens
aagattcccccccgggagatgttcttgtctgaacccgacgaatgcttcaaggtcgatgaaaatgtcatcatggtgtgtccacacatgacatggagggcaatgagctcacccaagggcaagccatgaatctgaataagctcttcccggctcaggagaagctctacaaggaatatctgcagatggcccagaatggaagcttccactgagggggcacaggactgactttttaaaccattgtggactagaggctgctgactgcctcaacgacaatgtcccagcgctcctatcatgt

SEQ ID NO: 567430 - DNA, 593 bp, Homo sapiens
tgcggtggcttatgcttgtaatcccagcactttgggaggctgaggcacgtggatcacttgagctcacgagttggagaccagcctgggcaacacagggagactgtctctacaaaacattttttataataataaaattagccagacaccgtggtgtgcgcctgtagtcccagctgcttgggaggctgaggcgggaggatcatttgagcccagagagattgaggctgcagtgagctgtaataaagatactgtagccgggtgctggctcacgcctgcaatcccagcactttgagtggccgaggcaggcggatcacaaggtcaggagttcaagaccagcacggcaagatggtgaaccccctgtctctactaccaacataccgaacaattaggccgggcatggtggcaggcgcctatacatccccaagtctgctcaaggagggctgacgcgccagacgaactgctgtgaaacccggggagggcgcggaggtttgcaggttgatgccaaggatcaacgccaacttgaacttccaagccctggagcacaaaagagccaagtttcccgattctcaaaacaaagaaacatacaaagcataaaa

SEQ ID NO: 567431 - DNA, 1168 bp, Homo sapiens
gtcctgctaaaatagaggagcctccaccggctaaagttcctgaatgcacctaagaaaattgtgcctagaaacagaaagttcctgctccagttcctaaaaaggaaaaggtgaccaacacactaaagtgcctgtaagagccaaagaaaccagttaccagaaataaaaggttcctccaacaagctcattaacgcatggcacagaacctcatcccagccaaagtgccagaggaacccgaagcagagctgtcccagaaagaaacaacgcactagcacacacacacctacacaagagagcgaggcaaccaaccagctaaacagcgacctgacatacacgaaaacaagacaaggccaacaacgaaccacaaacgcaaacccacacgcaacgctccacacaacaccaccaccccacaaaccccacacacacacaatctactactcatacactgcaccctacccacaacaccccaacactatactaccccctacccaactcacccacacccacctacccaacccaacccacccccctaacacacacaactccttcacctgcaaaccaccacaaccacctatatccctacacctcaaaaccaaacacaccagacaacaaaaatatttccaaaccccacacacacatacaaacaacctacaagtacacacaacccacctacacttcaccctcaacacacatcacactcagcacacacataacaacaaaccacaaatcaacccccaccaatgatcccccactataacattcacaacccaccccacggaccaacgacctaaaacccacagaacaaaactacacatgacaccagtgacagaaacccagaattcaacaccaaagaaacacgaatgcgcaccccaacacggacaacaaacagaccgacggcacacggcctgcctctcctataacactaaaaaacaatccaatagcccacacacacaataagaacaacctcacaccctcccaccctcccctcaacaataccatacataaccacactacaccaacactataccacacaccccacctctccatcccaaaaatccaaaaaacactacatcttaccccacatatctccacttattccacacacaccctccatcacaataccagccaacacacaccctacacaatcaaccccttacactacaaaccaact

SEQ ID NO: 567432 - DNA, 869 bp, Homo sapiens
ggcaagcgtaacagaatttcccgtggaattgttcaaatatcacctcctgttttgagactctgatagactacttcattgtactgataggtatgacatgggaaaaaattagaactaataatgtatgtaatgaaaggaattacttgtatgtcatgattttctgaaatcaaagtcactggcattatgttggccaatttttggattttatctcaaagccatatttatgacaatccagtgaagtgagttttattttctccaatttgcagatcagaaaactgagaaaatgtctgctcaggtaattgttccatgaagcttaaatttgaatttaggctgttgactctgaagctttcactcctaaaattatatcagactatactgtctcatctatagcttttatttacaaaacagaaagctccattttattaggagaattttgaatatacaataacaagtagacagagtaattttatgaatcaatatgtactcaacacccagctgcactatcaatacttagccattaatatctcttctatgtttttctctccttatttattttgaaggaaatctcagacatcatttaattttatctataagtaagtacttcagcatgagtatcaaaaaagataagtgcttttaaaaacatcgatgatatcaggccaaaaaaaattaacacaaatcttttatcatcatcagatattcagtcaatgttcaaatttccaatgttccataaatgtttttctttgaaattttaaaatttgaatcatgattcaaataatgtccacacaatgtaattgattggtatatattttaattttattttaatctatatgtttccctctgtttttgataatcaataaacatgtattttcaaa

SEQ ID NO: 567433 - DNA, 111 bp, Homo sapiens
taaataaatcaccaacatgtgtaccatgcaaatcacccccacaactccttttgatctctagatgtctgacctgcattgcatcaatgctttgcactgtgcctgtctgtttta

SEQ ID NO: 567434 - DNA, 298 bp, Homo sapiens
aaatgagatcaaaccttcctgcttagaggagcagtggcctggtctgtctactgactgctgtctctgctcctcgttcttgtcttggcattgctgtagcggactcctgtggggcctgaagcttgtaatcttttctctgctgattcgtggccctgatgaggtcagtgcctgacccttccacccgggccctgctactcctggccttgctgatcctctacgccctgctgagccggctcactggctcccgagcctctggggcccaactcgaggccaaggtgcgagggctggaacgccaggtgaa

SEQ ID NO: 567435 - DNA, 649 bp, Homo sapiens
ataccttgtttatacctaaagcattagatgtgttaaaaactgggattctggccaggcgcggtggctcacgcctgtaatcccaacactttggaaggctgaggcgggcggatcacgaagtcaggagctcgagaccaacctgaccaacatagtgaaaccctgtctctaccaaaaatacaaaaattagccaggcgtggtggtgcacgcctgtaatcccagcaccttgggaggccgaggcgggcagatcacaaggtcaggagatcgaggccatcctggctaaaacggtgaaaccccgtctttattaaaaatacaaaaaattagctgggattacagaatttgcagattgctactacgcaaagattggaggagaaaattcagaaacttcagaaacagctcagtgatttgaaattgtcaaataaaaatatgaaaactcagctgacaagagtaaatgtccttaaagacaaaacaattgaagagctcaggcaatctttagcaaatgttgaaaggatgaaagagaggacattactattgaccttacagaattagaaaggatcatcatgaacaactgtataccaacatacagttttgttatttatgttatttcatgttggataacttatatgaaataaagacaaagggaaacaccggggat

SEQ ID NO: 567436 - DNA, 100 bp, Homo sapiens
tacaccgaacccagcctggtggcaaagctcgaggaactagagatcggtcgcccatcgacgtacgcatcaatcatccgcactatcaccagccgtgactacg

SEQ ID NO: 567437 - DNA, 249 bp, Homo sapiens
atatgtacaacagactaacactgaagttatgggattccaactaacaatagtacaaacactttaacattatttacttcaaatattatcttgaaattattcaaatgtattcgaagtttatagttaactgatgtgtaacaatagaattccagcaccaacattgactcagcgattagactatattacgtgctgtctgcattgtccattcacattgatcacagagatgacagctcccgtttggtaaggaaacat

SEQ ID NO: 567438 - DNA, 766 bp, Homo sapiens
  misc_feature (59)..(59): n is a, c, g, or t
  misc_feature (62)..(62): n is a, c, g, or t
taccgccacctgtgggaatgtgctacacggaggaagaagccaggcgctgctgaggaagntgnaggtccaggatggccctaatgatgatggggagatgttcatgcggccagggcagttgtctgactattttccaaaaccataccctaaccctgaggctgcaagagctgctaacaatggagctttaccccctgacctcagctacatcgttcaaacttaggcatgggtggtaaggactacgtatttttccttgctccctgggttactgtgagcccccccactggggtgtcattgcaaaaaggcctctatttcaacccttactttcccggccaggccattggcatggctcctcccatctacacagaagtcttggagtatgatgatggcaccccagctaccatgtcacaagtagctaaggatgtcgccaccttccttcgctgggcatcagaaccagagcatgaccatcgaaaacgcatgggtctcaagatgttgttgatgatgggcctgctgctgcccctgacctatgccatgaagcggcataagtggtcagtcctgaagagtcgaaagctggcttatcggccacccaagtgaccctgttcagtatctgcttgtcatcttgccagaacaagctctcagcagcccaggaacagtccatggccttctcaggcctggcccttttcatcagatacaagggccaggagaccagactcttgcttctgatcttccttcagccctcagtgtgggaataaattaagtttctcaacataaa

SEQ ID NO: 567439 - DNA, 400 bp, Homo sapiens
ctaatatcgtaccgagcctgaagcttgcgggttgtacacgagaggtgccgagggctactgtaaatgggcccattgagccctatgaaggcctgagcgagtcaaactgctagttcaaagcgcgacagctctgtgtacactatgagctgaccttgggtaccgcttacaaagttcaacacccgtatgaggcctgccggccctagttctgatcgcgtttgagctcaacagccagtacgctatgacctgctgcttggccgctcctcaaagctgtgtccgccagatttcgcgatcggcatctgtccgcatgcttatgcatgacagcgaacatcgagatcagtggcacttccacctagggggagtagagttgcagttcagtggctcagacatggcctacatgcagtgg

SEQ ID NO: 567440 - DNA, 183 bp, Homo sapiens
tcgtgactggcgacttatccttagattggataccacccgctttgggctgcattcccaagcaacccgattctcggcgagtcacgagatgggcatgctctagagctggaaccggacgcataccgtctaggggcttgtcacttcgcttagaaggtactcgtggtgctaaaatcgccggttcacgag

SEQ ID NO: 567441 - DNA, 285 bp, Homo sapiens
gtccaatctactatgtcaaccatcctaagtcaccctctgtattacatgaattactaattagttgatggcatgtcagagtccctaccacttaaagtagagatcatgatgatgctatatcttatcttgtgacctgggcttatttctactctaatcataatgatctacggattcccattcatgttgttgcagattactggatctcactcttttttatgggtgaatcgtacttcatagtgtatatgtaccacggtttctttaaacattcatctgttgatagacagctct

SEQ ID NO: 567442 - DNA, 458 bp, Homo sapiens
gtgcaaatatccacacaatacatattggtaaatcgtacatgtataaactcttacctgtaatatacttccaagttgttatgataagaacttacaatctctttgctctcatcattttgctgggtaagggtcaaaaccatgcgccttactgaagttagaagctgcgaggagcatacttcatccatgtgctcctgagaaaaatcctagtgtggttggaatatatacttacctattgtttgaaaagagagcatcaatccatatcatacaaaatgttaattttgaatgttcttgccgtagatgctcctcaatcttcagatgtctgtgtagaaagtatccattcgtaagaaaagccatactcctactttattcatacgtcttgagaggttgggcaatgtcgacccacgaaagcaggtgatggccagtaaaagaactggctgatccagtacttttcagcactttct

SEQ ID NO: 567443 - DNA, 608 bp, Homo sapiens
ggatatgtctatcacttctgtcacctctattagctatttgcttagcatatagtgcagctctagtgttaggtgcactacatatttacggattctctaggtagattgacccctttatcatagtttaatgttcttttctttcttgctaatttcgtgtgctgaagccttcattatataatattaatatagcctttttgctttctttcaatgaatgtatgcaagatatatccttatacattcttttactttcaacctgccagtattgttatattgtaagtgagtttatagtggacagcacataggtgagtcattatccttccaatctgccaatcttcatcttattaattagtatagttaggttatttatatttaatgttgttaatgatatgtgagagcttcagtctgccattttatatttgatattctagtatttcattagtggtttacttatatcctttctgtgacttacttgaacatttttaagaattttatttaggtttatctgtagtgttttcatttcttgatacagcttaatatcatgattactgtacgtattatattatatacacataacttatcaaagactactggtgtcataatcttaccagttc

SEQ ID NO: 567444 - DNA, 196 bp, Homo sapiens
ccccaaatgggaatccttttggttgtttttattatttgttatacgttgtcgtacaacattgagcgcgatatttgcgaggttcttgagggcgtgtcaagtcgagaagttatattatgacttgcggtgaaacgattcaagcgcagcggcacggtcgccccctgtaggagcgagtttgatcgagacaaaatcgtcaagc

SEQ ID NO: 567445 - DNA, 1139 bp, Homo sapiens
  misc_feature (140)..(140): n is a, c, g, or t
  misc_feature (979)..(979): n is a, c, g, or t
cgccgctatccccgagctacccgcgccggccgtctacgctcaccgcgccgatgtatttcgtaggcgcagatctgctctggacttgtagactatgtgctgtgggtacagcgtcttcagttgctcgccattcgacacgcacnaaactcttctctaatcgacaaaaacgcatcctgctaagtccttgcaatactcgctaatctctacggacttagcatacctagctagcacagagcatccatcggtcatcaccacctgctaccagtggtaccctcgcgccgcccttgaccgacgactgttgtctcgcgcgtccgccgctgcccggcacgcggcgccgccactgcatctccacgtgtgttgtcgtggggcctcgccgcgccgcatgtgggcgctcgctccccgccgcctccgccggtgtaccttccccgcgctcaccccgtccgccacccacgtcgccgtgtcgctgtcggtcccctcgcgttccacgtctcctgtcgcgtccccgccgccccccgccccagtcccgccgcacgcacatcgtgtgactacctctccctacagaatacgtggcccgcatctcacttcactgcccccccccccccgctccggcccggcttatccccccgccgcgcaccggccccgcacccaccccctcccttggcggagtgcccgtgtggagccagcccgccccggctccgccgcgtgcgcagaccccgcgcctcgacgcgggggggctgagcctcgtatatcctcccgcgtctcggcccccgccgtcgccctgccgaccccgtcctccctcatcccgtgccgccgggctccaggtagtccggagtatatgcgcgcgcgccgtgagcaccgcccgacgctatcgccgcgcgccgccgtgcgcgtcgtcccggcgccgcgcgctcccgtccgcctgccacgccatagtgcagctatcccacaggtcacaccgccagcgcatcccgccgcattttgnacgccgaggctctctcgtccacgcgcccgcgctgcgaggcgcgtgttgcccgttggtgccggggccggcgccactgtcggcggttcattgttcctccgtcagattcgtgttcgcgctcgcgcacacaccgggcgcccaactctggcgtatgcgcggccgt

SEQ ID NO: 567446 - DNA, 1114 bp, Homo sapiens
gccaaccttccagcctgcgacctgcggcagaacacaaaaattacttattttctctgccccactacatacctctgaggcgagcaaaaaaacttaaattttaaccactgaggcgaaactcgtgcacactccaggctggctcagctgctggcaaccagcactcggtgccacagcttctggcgacggtgactcacgctgcatgacaccatgcgcatcgacccccccaccgcgccaccctaccaccggccgcgcacccgccgacccctgcccccctgcgcaccgcccactctcctgctgctaccctcacaacctgacaccccaccaggctgcgccccctcctgctccccctcgcctgccactccctgcgcctcgcgcactcctaccaccccccctgcggaccccactcgccacctctgctcccccctccacgctcccctcccgcgccccccccctcctctctaccacccaccaccaaaccctccgctcctccccgcgctcacgccccctgggcgcacccgcctcaccaaaccctcggcgccccccaccccgcgcccaaccctaccacccaccaccgccgcccgccccgcaccccctcgcgccccgcccctctcccttgctctcttctgcgcactcgctgcgcctccccgcgccccaccgcaccgcgcccaccccccacccccctccgcctcgcacccctcggccccctgcccccgccgcccccctctcccacgcccctcgcaccccgcacccctcccccctgccgccgcccgcgcccccgccacccacgcgccctccctgcgccaactcgcgcgccccccatccctccccccccccttccccccccccccactcccccccccccccgcccctccccccctcgccctccgcccctcccctcgcacccccccccccccccccccgcccgccccgccccctcccccccccccccccgcctctgcaccccccgccggccccccacccccctccccccgccccccccccctccccccccccccacccccccccccaccccccccccgcccccgtcccccccccccgcctcgcccccccaaccccccccccccccccctcctccccccgccaccccccccccccc

SEQ ID NO: 567447 - DNA, 1338 bp, Homo sapiens
gacatctatcggagctgaacttcctaaaagacaaagtgtttatctttcaagattcattctccctgaatcttaccaacaaaacactcctgaggcagcaaagcaaaggagcagggcagggcagcagcaaacacagcagcagcagcagcagacaaccaaaacaaccgaccagcagcagcagcaacaaaatgcaattccatcgtcaacatccatctgtaacacaccaatgcgacagcagcagcaggcatgcttcatcttccacaaaatgtttcttatgggaacttgtttgcttggggaatcccccaagtcccttatttttcttcacaggtggcctttgtttttccattcaacccacagagaatggtgcgtagggtgagaaagttttccgagcaattttttctcaaaaacccttggatagatttcgacagaccacaacagtgtatctcaaggcatacccatagaaaaatatacaccaccagagacgaccatctcacgtggtcaataccacaagatatactgcggaactcaagggactgccaaggtcaaaacggaacattggtatggtacccactatggacaacttgggggacactcatcgtttccaggtcccacagcctgtcgtaacattccatttgtccctaactggaaccacacaagtattccctgggggcgattcacagttttaacgaaggaaacgtggcatccacgaccaatgggggggcctacaccctggcgtgggttaatccaacgctcccaccagaggaagggaacgccagggaaatttccccttaattacccttagccagagaaaaaacccctaaacaacatttgaggcaacgcaggatacaaacaaactcttgggaacctcgtgaccaagaacaccacggggttaggtcccacacggggcatcacaatgggccaactgggcaatggagcacgggcaccaacccttgcggagcacacggatcatccggaagactacctggaggacatgcaggggggaaggacccaaccaaagccaaagccgtaaccacaggaagggaaaatggatgcacaagcaaaggaacaaacgaccacggcgccagacccacaaagagacaaacagtggcgacaatgcccgatacccagtgttccaccccagtccactgaccggcgaatcaggcgcaagagggaccagcacacactaaccccgttcgcacaccaaccggggaaaacgtcgcccactaccgaacccagaaagcgacaaacagccacaccgactgctaccacccacagcacacagcaacgacagccttggcacaccaacaacaacggacccccgacacacagacaaacagtggg

SEQ ID NO: 567448 - DNA, 1054 bp, Homo sapiens
  misc_feature (119)..(119): n is a, c, g, or t
  misc_feature (125)..(125): n is a, c, g, or t
  misc_feature (238)..(238): n is a, c, g, or t
gcgtattactcgcatcaggatgtattcatcacctgagctcaccatagtctaatagaaatacaagacgaaaccaaattaattcgaatgacacttgctgtattcacaattttactgggttnctctantttttacccttcctacatagaccttcagaaggtactgtcgaataatctccctttcaccaatttccgacggcagtctacgcgactcgaacactttgtcttgatagaccacaggncattccacgagacttcacagtcacttattggtctcagatctttcctcaactagtctgacttcatccgccaacataattagttgtcacatttacattccaaagcaatcagctgtctgggcgttcggaagcacgccgcactgattactgggcattttcgctagactgttgcgctttagacgtatttactgtatgtctccgatcttattgatgagtggtcttaaacgaaagaatcaatataagaagtaaacataaataacacatagacatcaattgaataaatgacaagaagaaacgtgcggggtgcgtaacatgtttacggggtgcgtcgaacgcaggatggcgctaatgcgtcttgaatatatgcatatgggacaccaacaaatgaccatcaggctaataatttctttagcgagtgtgtattaatcctctcttcaattgtggttcaaagggtctctttggtgaactattcagggcgtggacctttgtcccctgggatatagagcctatagagcggttcctccatctggagtgataggtcggaaaaggggaggcattatacgacaggagagtgtacacatgtgggtcacaccagcaaaacgtttaggttaaaaagctctctctggccccacgtgggtaacggacaggactttgcaccggagggactaaagtccagaggcaccacacaacaaggacgtcacagaccaccggagagacaggcacataaacacacactacagggccctctgcaacacaatgtcacgcagaaggggtacacaaacgcgtgaacaactacaatggctcaaacagccacgccac

SEQ ID NO: 567449 - DNA, 1177 bp, Homo sapiens
gatctctataggttcgctggagcaggctgcagggctctgatcctgtcagctgcaggccatgaaggcttctactccaagttgtccgtgttgttagcctgaacgacagccttggaatcatggcgtgcgatcctgagcgcatggtgcggatgaaacgcatcacagaatcgtcatcttactgggcgtgtggactgccatgagatagtgggaggaaccctggtgaccggtgtgaccacactggttgaccatgtgtgctataggcccaaagtgcgtggtcagcccaggcaagacgcagtggcctcggcgggtgcgaggagtcatgtcgtagcaggaattgactgaggtgcgcgtgccgacgtaggtgcctgatgggacctaacacgtggttggcgagtaccacttgtaggcttgatgtcgcatgggtctcgatactgccggcgtgacccctggggctttgcgtccgaagctgtgcacccctcgacaggcgatcctcgaggtacatgagaggcttcgtcgttctctttgcgcatatcgcgcatctagagtgcccctcaaattgatatgaccttgagcaccagagagagctcgacaggaatcgcgcaccggagccaatttcccgttgcgcccatcgggaggtagcgccccagttgcgtagactttagctttccaacctagtggtggccctcggtgcatgtgcacacgggagggacaagacctttttgcaacggaggccaactttacagcaaagggaaggcagggagccttcgggggtaggttggagctccctttgaccaagccccacgagtttggataatacccgcactgggggaggaattgcgcgacttgcggtaccatccttgggtgaaaacttcctttgcttcccaagggggggaacgctcttgccttgcccatgatgagggcggcaacctttggtgtgcaacacgcgatattactttcaaggaacgggattggcactcccgtggagcgtacggccgccgttggaacggaccttaccatgggttcccccacgttgcattgtccgttactccatggagttgtggttgcgcagcgtggggaccgtcacagtcggaaaccagctttggacttgtcgaaggacctttttcaatgcgttgcggacttcaagacaaccagcggtgtgtccactggtaccccgtgagaa

SEQ ID NO: 567450 - DNA, 251 bp, Homo sapiens
atctataggagtgaggagagatgtgtaccggagcggattgagtgaggagatatgcatgatcagctggtgacagagggatctgttgaaataatatatataatgtatgtttattgcttagtttacatagggaatcaagttatactttgattataaaagttgtttgatttagttcaagaaccagaattttcatataaaggtatgagaggggccagtgtggtgggtcatgcctgtaatcccagcatatggggagg

SEQ ID NO: 567451 - DNA, 312 bp, Homo sapiens
gagaaggagtctcgctctgtcacccaggctggagtgctgtggcgcaatctcagctcactgcaatctctacctcctgggttcaagcgattctcatgcctcagcctcctgagtagctgggactacgggtgtatgccaacatgcccatcgtattatctatcatgctcgtaaagttgtgctctatactgtcgtccaggctggtcacgaactcctggctctcaagtgatctacccgcctcggtctcccaaactgctgggactccaggtgtgagccaccacacccagccgtcgagcggccgcccccggagtagtagta

SEQ ID NO: 567452 - DNA, 100 bp, Homo sapiens
cgccaaggcagtgtcacacactgaacatcagtttaatcagctctaaaatacagactgggctagatcatgggtagctgctctacctactctcaggcctcca

SEQ ID NO: 567453 - DNA, 577 bp, Homo sapiens
  misc_feature (432)..(433): n is a, c, g, or t
gctgcacagttaaatcagccaccgggagagcccagtgcagtttctgcctaaggccaaggtaaagctgagcttattctaatcctggctgcagctcgaacacaacataatgtagatgcagccgcttcactcactgtgcccgagcagtatgtcagcgcgttctccaaactggccaaggactccaacactatcttactgccctccaaccctggcgatgtcaccagcatggtgctcaggccatgtgtgtatatggagccctcaccaaagcccctgtcccagggactccagactcactctcctgtgggagcagcagagatgtccagggtacagatgcaagtcttgatgaggaacttgatcgagtcaagatgagttagtggagctggcttggccaggggggggggggggggggggggccggggaaaaaaaaaaaagggnnttttctccccttttgggtgggggggaaaccaaaagcgcaagcagattttcctgattctggctctagcttccctgccaagattttggtttttatttttttatttgaactttagtcgtgtaataaactcaccagtggcaaaccaaa

SEQ ID NO: 567454 - DNA, 460 bp, Homo sapiens
gtgctatttgtatttctactgtttagttgtaagagttttaatatattataggtacagatgtaacgcaaatgttattaattttagtgaatactattttattttactgtttattgcttgcagtttcatattatatctaaaaaccactgcctaatccaaggtcaaagaaatgtatgtacagtgtataaaataaatataaaaaagataattatgcctatattttcttctaatagctttgtaattttagctcttaaatttatgtatgtaatctattttcagttaatgttttacatgctatgaagtaccattccatatttattaatttgtacatgagtttccatttgccctagcaccatttgttgcaaagactattctttctttcatggaattttcttggcttcattgttgctcaacttactattaacctagagtttggttctggactcagaattctgtttccttg

SEQ ID NO: 567455 - DNA, 643 bp, Homo sapiens
tactggggacggagggtagccgatggggccctgagcaggacgtgcctcttctggacttgaccacagaacccaagcatggttcaagcgattctcctgcttcagcctcctgagtagttgggattacagatgcccgccaccgcacccagtcacagatggactctgagagagaaaatagcacccctgtccaaacatcacatgcctggcggaggaacgcagcctggcctgtgcagccgaatgttggagagtgcaccttcctctcttattttgttttatttccagggaaagggaaaggaagacatgcagtctcattgaagtccttgggtcactttacccctgcccttgggttgatggacgatcagatgtcttccttctcatgctggctgagacatcaaacaccagagtggacttacttggctccagtgctggtgatgggcacttctgggtgaatggaatctggggtgtatgtacactagcaaatttgctggttcttagtgcaggatcatttgaaaatttattattctgccaaattgatcaaatcactttgaacaatttatgcatgtacttcattacacaatagtttccatttctgcacattctaacacctattaatttttgcaaatactatagccataatataacaaaa

SEQ ID NO: 567456 - DNA, 861 bp, Homo sapiens
ccatgagagctgtgtgttactcggacgagggcattcttctggagagtgtccctgaactgctgcccaatgtctgggaagtgccctttctctacttatgtaccacctcatggagacccccgctggctgccgcccccgctggtgagcttattcccctccttacctgctccttgcctgctgggactgctggtgtgcctgccttgcttgggctgcctgcatcacctgcctgtgtgtgctctatctatcatgacttgcttgcacaatgtgtgtgacaatgttgcaatgctgtcctgtgcatggctgtgatgatgaactgttggcctgctgttgcttgatgtggcccattggtgttgctgtgtatcgatcttcactgcctgtgtctgtgttggtgtgcacattatccccttgcttgcttggttgtgccttgctgatgagaacttggtggtgcatcctgttgttgtgttggcacatcactggccagttgatgtgtcatctgtgcctggtctctttgctggctttgacttgctattgtgccctgccttgtcctgtgtgactgtgtgtgtgctgttgtgctgttgcagttgaccatgcatgttgcccttgtggcctacaccaaacactgtgttgacttgctgtgtgacagaattgctcatgatgtgctcatgtccctcaattccttgcttcttgtgggttgtggtgctttgcctgcactactgctttgcagacacctgggtggttgctgctccagtgcttgtctgatcagctctgtccctctttcctgtgccaccctagtactgtttgtagtgtcttgtgctgagtgttgctgacatttgtgcccaccctggtggccggatggttggcgca

SEQ ID NO: 567457 - DNA, 590 bp, Homo sapiens
ttttttcaaagttcaaccagtaatttaatatgaaaacaggaatgttagttattatgtaattaaataccattataaagaattttagtgtgtcaaacaaaatattaaaagtgctgctagaatctattataaaattttaagaattcagatgttttggataattctatttgtgtattaaaattgtttctataattcttattaatgttccaacactaatctgcttcaagaaacacccctttgctttcctttttagtctcattgaagtccttgggtcactttacccctgcccttgggttgatggacgatcagatgtcttccttctcatgctggctgagacatcaaacaccagagtggacttacttggctccagtgctggtgatgggcacttctgggtgaatggaatctggggtgtatgtacactagcaaatttgctggttcttagtgcaggatcatttgaaaatttattattctgccaaattgatcaaatcactttgaacaatttatgcatgtacttcattacacaatagtttccatttctgcacattctaacacctattaatttttgcaaatactatagccataatataacaaaa

SEQ ID NO: 567458 - DNA, 297 bp, Homo sapiens
tgaaggttatatcctcagccaacacgagctgtggttggtgtggtggctggaggttggctgaatatgacaaacccatcttgaagtgctggcctgtgtgtaccacaaatataagtgcaaagaggaactgctggccacgagtacggggtgtaggcatgaatcctgtgcagcatcctttttggaggtggcaaccaccagcacatcggcaagccctccattatccgcagagatgcccctgcttggccgcaaagtgggtctcattgctgcccgccggactggacgtctatcgggtcgttagga

SEQ ID NO: 567459 - DNA, 238 bp, Homo sapiens
aagatacagaatattcatcaccacaaggatacttcaagtcatcctatcatagccacgccttatttccctcccaccctaacctcctacttaacccctagcgaccactcatctattctccatttctaaaatacagttgtttcaaccgaggttatgtagtaaaatagaatcacacagtatgcaaactttagggattttgttttcagtcagcataattttctggagatccatccaggttgtt

SEQ ID NO: 567460 - DNA, 473 bp, Homo sapiens
aggcagcttatgggaagcagggccccatttgtccctcggtccccgtgtggccagagtgggtccgtcgtcccccacactcgggctcgttcagaccctttggcaggaggtttggggcctccccagcaggagggcgtgcaacccgggcaggcggtccccctagacccccagcccctcgggagccccccccctctgggtgtgaggtagctttctctccctcagccggcaagggtccgatttgccatcgaaaaagccaccctctacttttttcttttgtattttgataaaccctgaagcgggagctgttaaatttatcttggggaaccctcagaactggtctatttggggtcggggaccctcttccggctttcaaaacccaattagtaatcaactgttttgtaaacttgttttcagttttcatttcgccaaccaagccctgtaattaaagctattagaataaaattttttaactatta

SEQ ID NO: 567461 - DNA, 356 bp, Homo sapiens
tactggggacggagggtagccgatggggccctgagcaggacgtgcctcttctggacttgaccacagaacccaagcatggttcaagcgattctcctgcttcagcctcctgagtagttgggattacagatgcccgccaccgcacccagtcacagatggactctgagagagaaaatagcacccctgtccaaacatcacatgcctggcggaggaacgcagcctggcctgtgcagccgaatgttggagagtgcaccttcctctcttattttgttttatttccagggaaagggaaaggaagacatgcaggtaatttatcaactaaattacaggctgactgataataaagtccccgccccaca

SEQ ID NO: 567462 - DNA, 514 bp, Homo sapiens
ggatttttcttggatgccagcatttgacatctctatgtgagatctgcttcttccctgatcgtgacattccctccaccagcaggcagccgcatgaggaccagcgcctgctcaccgctgtgtccctcctacgtgcggggcaggcacccagcagcaggtgttcggtgcccactgggagcgtgcctgggcccctgctcctgctcctcagagggaacaaacaactgacctgctgatggaggctgtgaacccacacgggttgtctgcagacgtaacagggcatctcctatgacgcttctggagagggcaaggctccacggctgagggctttctttgggtgacaaccatgtgaaatgccatgaccttgtgccaccctgtggcagatgactctctcagaaggtggtgcgtaccctttcaccattatggtgtggacactcagatgtggggcctctcccacctcttacaactggggcaggctgacaaccacagtagaagggacaccctgcaaccacatcataag

SEQ ID NO: 567463 - DNA, 238 bp, Homo sapiens
aggctccagttccgatattatggaggtcagcacggtgctcacgtgtcgacggaacttgtacagtggaggcatgcaccggagtgggtgaatacacgtctgaccaggctccatctatagcgatatttggaggtcagcacggtgctcacgtatcgacggaacttgtctagggaggcatgcaccgcagtggtgaatacacgtcgagctgtgaggcaatgattgcgagtgctcgggtactgga

SEQ ID NO: 567464 - DNA, 938 bp, Homo sapiens
  misc_feature (37)..(37): n is a, c, g, or t
  misc_feature (73)..(73): n is a, c, g, or t
  misc_feature (96)..(96): n is a, c, g, or t
  misc_feature (126)..(126): n is a, c, g, or t
  misc_feature (141)..(141): n is a, c, g, or t
  misc_feature (189)..(189): n is a, c, g, or t
  misc_feature (205)..(205): n is a, c, g, or t
  misc_feature (209)..(209): n is a, c, g, or t
  misc_feature (218)..(218): n is a, c, g, or t
  misc_feature (221)..(221): n is a, c, g, or t
  misc_feature (224)..(224): n is a, c, g, or t
  misc_feature (242)..(242): n is a, c, g, or t
  misc_feature (245)..(246): n is a, c, g, or t
  misc_feature (250)..(250): n is a, c, g, or t
  misc_feature (252)..(252): n is a, c, g, or t
  misc_feature (274)..(274): n is a, c, g, or t
  misc_feature (283)..(283): n is a, c, g, or t
  misc_feature (307)..(307): n is a, c, g, or t
  misc_feature (312)..(312): n is a, c, g, or t
  misc_feature (314)..(314): n is a, c, g, or t
  misc_feature (320)..(320): n is a, c, g, or t
  misc_feature (325)..(325): n is a, c, g, or t
  misc_feature (346)..(346): n is a, c, g, or t
  misc_feature (367)..(367): n is a, c, g, or t
  misc_feature (374)..(374): n is a, c, g, or t
  misc_feature (396)..(396): n is a, c, g, or t
  misc_feature (399)..(399): n is a, c, g, or t
  misc_feature (446)..(446): n is a, c, g, or t
  misc_feature (448)..(448): n is a, c, g, or t
  misc_feature (453)..(453): n is a, c, g, or t
  misc_feature (457)..(457): n is a, c, g, or t
  misc_feature (460)..(460): n is a, c, g, or t
  misc_feature (462)..(462): n is a, c, g, or t
  misc_feature (464)..(464): n is a, c, g, or t
  misc_feature (470)..(470): n is a, c, g, or t
  misc_feature (505)..(505): n is a, c, g, or t
  misc_feature (587)..(592): n is a, c, g, or t
ctatggcagtttctttctgggattcaaaaccaattcntcagatcgctgcctctgagggatgtacagattggcnggggcgctgagtgctacaataanggaggaagtaccggggaacagtgcagggcnaaggcagggcagagntctgagctgcctggagatcatctggggtgcggagtacaaagctttgcnagggtgtggttttggnatgncgctaaacnggnggnggagagaacagataaagnggnngggngnggcacactgtacactgttaagnagttgagcntttatcttaggggcagcagaaggnttggngncaaggngtganatggtgaggcgtccttcaggnaatgggctccagctgccgtgnggcccgngcaggaagactggcagctgtcnacnctggaacagtccagtgagtatgtgcaggcccgggcttgggcagttangngggcngggngcncncntcactnttctgcggtagaaccttctagacggaagaccaganagagaggtcaacagagttgaaaggagaaaataattgaggatgaggtccaagtttttagtttcagagactaggcatatggttnnnnnnttaggtaggaaattcaggaaaaggagcttgttgggcaggaagggaaggaacggcagcttggggcactctgacatctttaacaagtcttgtaaaggcttactaaatacaacgaagcattgtaccaactataccctaataaaaaataaaaatttacattccagttaactaccttaaaagttaagtccactttcatcccacgcccccatcctttccgtcatccctcacccctttgtcttgagaaaggaggtttagctgcttcttttagttctgcaatttctttttcttgctctattatcttcatctgtagggtgaggttaacatttccagaattttggaaaagtcactc

SEQ ID NO: 567465 - DNA, 338 bp, Homo sapiens
caggctgtacgccttcggttacgggatctcgggtaacccttgtcgctgggccggggcgctggagagtgaccgtgttctgagttgacactggtggcgcgctgctgttggggactgtaggtggtgctctcaaatgccgggtcatccagacgggatggtgcggcgctctgggccgcgctgctggccgcgccgtgtgtcctggctgggcggcgaggctggggctgactcctgcctcaggatgccggggtgaggacgaggagcggtccttcctgtgtggcccgcgaggagctggcgagcgccctgaggagggattccgggcaggcgttttccctggagcagct

SEQ ID NO: 567466 - DNA, 792 bp, Homo sapiens
  misc_feature (124)..(124): n is a, c, g, or t
agcggatcttgcgggagaccgggttgggctgtgacgctgctgctggggtcagaagtgtcatacccaggactatccgccgcaacaggcgtacccacctttcccctgggatatcctacctgcaggntcaggcaggtcatcatttgtcccccattctggctcgagcagtccgtgtatcctaggtggcatattccatccaagtgggagcgaggatgccttacctctactaaggtgaccaagctagctggactagcctagcgagcgtggacggactacgcactgcgcctggcaggattatgccaggtcctccgtggacgtgctaatgcgctgggtgtccgccatcagtcgcatcgggggataggctccatcgctattcctcggagctgtcctccacgggctaaggagtttcggaggtcgctctacctagggctggaagcatcggcatgtcttcgtcgagtgtactccagcatgccgacgctttcagcaagtcgatgatcgagacggatggtcctatagcatcgaagggttccaactaccgtaggtggcttttccaatggaagagacaggactgccgtatcgtcgaagtgaattcccctgggaggggacgaaacctaacgtttacccgcttgaaggtgcaaggtagttcgaaataacaggaagtgccgttggctaccaaatcctcttaattccctggttgtgacctcttcgcgtggattttcccttctgggaatttagttagccagtggaaacccagaccctaggagttggacttccaggattcaccttcctagggaa

SEQ ID NO: 567467 - DNA, 347 bp, Homo sapiens
tcttagggcacttcctcaagatttgacacgtcacggttgagccagtgtatctggtatatgatcacgcaaaaccaaggatgagaagctaactaaagaggaaatatgggagaactggaacatgtttgtaggaagccaagctaccaatgacggggaagatctcacaaaaaatcatgatgcgctttgctcgacactcaccagaatatggcagactgtcataggcattctgtcatggtcttggatttgtcagctaccactggtctaatttaccagcacgttgtgatcccacacaaaaggaagttcatacctcgagattggggtataagaaattggtttttcgctcaaggatt

SEQ ID NO: 567468 - DNA, 242 bp, Homo sapiens
ggctgggcataagaataggagcagagaatgagtcactgacagtgctgaacagtgtcctgggatgggcagataccatgacagcacgtcatgcgagctagggccagcctaaccctatgcaggctcaatcagagtgtagtatcctgcaccatgcagtggcagccggtttttactacacatgcattgctcccctgcactctcgaggagcacttgaggctgccttcactgtcgctgcatacaatagg

SEQ ID NO: 567469 - DNA, 542 bp, Homo sapiens
ataccgtgtaggattactatttgcccacttggcggattctacaaaacagagtttcaaaactcctcaatcaaaagaaaagtttaattctgtgagacgaatgcacacatcataaagaagtttctcagattgcttctttcttctttttatgtgaagatatttcctttccacagtaggccttaaaatgttccaaatatccacttgcagattctacaaaaagacagtttcaaaactgctcactcaaaagaaagttttaactctgtgagaggaatgcacacatcataaagtagtttctcagattgcttctgtctacaatttatgtgaagatgtttccttttctaccgttaggccccaaagcactccaaatgtccacttgcagattctacaaaaagagagtttcaaaactgctcaatcaaaagaaaggttaactctgtgagatgaatgcacacatcactaagaggtttctcagattgcttctgtctagattttatgtgagggtatttcattttctaccgcaggccacaaaactctccaaatattcactt

SEQ ID NO: 567470 - DNA, 1187 bp, Homo sapiens
tacggctctgggttggttgacgccctgcgcctggtgtcagccccgagctgttgcacgacgagttctccacgcaggctctagccaggcagcatctgggccctggaggaggagattcgaagccaccggtcaaccctgtgacgccttgagggaacaggcagcagtcctgccccccacactgagccgcacgcccgaggtgcagtggccgggtgcccaccctggagcggcacatacgaggagctgcaggcccgggcatggcgatgcgagcgcggtgccttgtgaggcagccctggcgctctacaccatgctcagcgaggccggggcctgtggactctgggtggagcgagaaggacgcacgtggctcaacggggctggccctgcctgaaacgccctgtagggaccttggagggtcgtgccatgcagaggttcgaggacccctggagccttgaacattgaacaccccttgctagtcaccaaattcaccgcgtgtgaactgacattgccgagcatgtttactgacaggccaatccccccaggctaaagaccgccattgtcaacacccaggagcagctcaaccacaggtggcagccagttttcggccgtcatggcagacggcaagaaggcagctctcacctcagccctgagcattccagaactaccacttatagtgcacgtagacccaggcctgattgagcgcagacgaccaaagtcatcgagttcaccaggtctaggcaagatctggctgcggtgctggccctgcagcgccaagtctggccggcactgaaccggacctggaggcatcggccgaccccgggtgggcgaagctgacctcgaagactgcaaaatgcgccttgttgcgggcgcaatccccggtcagccagtggccatcacggccgggttacacaggctcagaccgggctggcagcacctcagggccacgcaattcccgacgtcgcacgaccgagaccgctgggccgcacgcagccgcgtgcctcgccaacaatcttttcccgccgcttagagagacgactacagggcgtcggcatagcggccgctacagaacttcgtcgccctcgtcatacaagccgcgagaccacctagctcgtagaaggccagtctgccacaagaggtcacccagcagagcgctagacgggcccgcgagccattatcccgccagaccaaccggacgg

SEQ ID NO: 567471 - DNA, 167 bp, Homo sapiens
cgtaaatgtgtagatccactgcaaacggtagaagagcaagcttcatatatcttcaccaaaaatgtccagttttacgggcttgtacatgcatgcacgaggtctcagcgctgtatccccatccacccaaaaaaaaggaaaaaagtctagatatataggggggaacagga

SEQ ID NO: 567472 - DNA, 626 bp, Homo sapiens
  misc_feature (420)..(420): n is a, c, g, or t
gcggctaagtctcaagagccgagaaggcaccaaggaaggggagagagggagggagggagggagggagagagagagagagagagagagagagagagagagacagagagagacagagagagagagagagagagagagggcgagagcgagagacagagagagagagagagagagagagagagagagagagagagagaacgcgccgcgagggagagcgcgagagcgagagagagacgagagaagacagagagaagaaaaaaaaaaaaaaaaaaaatggtgggggccgccctcccccaaaaattttaacccatggtggggggccgggccccagagaggaagagatagaacggtgtggtgacaaggcgggtccccaaagaagaacaagcgcggcaactagaacgcggtggggtggttcccaccacnaaaataaaaacgcgccgggggcgaacacagcgcagtcgttatgaaaccacaccagggagtgggcgtcgggcacgacaagagggggtgccacagaaaagggggacccaggagggcccgagaatataaataccccccgcctggggtgagaaaaccgagaacagaaatacacataaaacagaggagcaaccaacacacagaaaagacgc

SEQ ID NO: 567473 - DNA, 252 bp, Homo sapiens
cccaataagtattgcaatagattcaacttgacacgatgattcttaaaaaaaattcttttttgttattgagacagggtctcattgctgcccaggccaagtgcagtggcatagtcatggctcactgcagcttcaactgccgaggctcaagcaatcctcccccaacctcagcctctcgagtagctgggaccacaggcgtgcaccaccgtgccctggccaattttggcattttgagtagaggcggggtttcaccat

SEQ ID NO: 567474 - DNA, 116 bp, Homo sapiens
cgactttagaggaacccccacccccgcccaaggagcagagttgtatgagaagagatttggtttttttcagaagaatgcaggcgatgaagctgtgaactttatcatggccatcaaaa

SEQ ID NO: 567475 - DNA, 484 bp, Homo sapiens
tgtcgcagctgcgtacacaacaagtcttgccttgtcacttgatcaggaggcaagatagcatcttctactacagatgaatgtgcagtgggttgacttggtggtagaaggctcaggaagttctctcagtaagttaactaggtgagaatgaggggtgtgtgtgtatgtagtgccagagatgtggggagcagcaataacacaggtgtgagcaaagtcacccttgcataataagatagtaaatatacccaccaaaattggggccgacagtgccaagaaatcacttgagggctctccattcataaacatttatagtaggcacagtcagcagagtccttcgttgaacatctgcatcatgataccatgtcaggcaggtgaccagagcatctgctggaaaccaactggggcataatgacaataggacaggacagaagtgtgggagcatgttccacctggatttatgtacaggcatacataaagatgggcaaaa

SEQ ID NO: 567476 - DNA, 426 bp, Homo sapiens
ggcggggtgtggtgctgggcgcggtaatccaagctactgcgaggtggctaggcaagaagatagcttgaacctgggagagtgaggttgcattgagccaagatagtgccacagcactccagccttggcgacagagtgaggctgtctcaaaaacaaaaacaaaaacaaaaggctgtcccaggttgtaccctaccaacaatgggtgacggtgcctatttcactaaactcaacatcaaacttaccttgtttgcctgttaccttgtagcctgttatatagaagaaaagtatttcattgtatttatctgcatttttctgcaggtgagattttcgtttgcatttcttcgcagattatactcttctgataattggacatttgtgtcgtctgaatggccttttcatgccctttgccaatttctgtgcccatttcaa

SEQ ID NO: 567477 - DNA, 283 bp, Homo sapiens
  misc_feature (201)..(201): n is a, c, g, or t
  misc_feature (208)..(208): n is a, c, g, or t
ccagttttagaagtccccggcagaaatgcaaaagaacagaaattataacaaacagtctctcagaccacagtacaatcaaattagaactcaggattaagaaactcactcaaaaccacacaactacatgaaaactgaacaacctgctcctgaatgactactgggtaaataatgaaatcaaggcagaaataaagatgttctttnggctatngaaacttctaaaactaggcctagttttagaaggttcaatagcaaaaggaaatgttttttcttttttttgggggta

SEQ ID NO: 567478 - DNA, 734 bp, Homo sapiens
  misc_feature (139)..(139): n is a, c, g, or t
cctttaggctcccggctgttattttggggaattttaaccgaatacaattttcacaagggaccagctatgcccttgtttccgcaagctcgaatttacccttcttaaaggaccaaaacttgaagcccccccccggtgccgnccgttctagaatagtgattcccccgggctccaggattccggccgaacctgtgtgaacaaagaagtcggttagccagattatgtcgtagccactctgaatgatgttattgaaactgcacccatctctccaggcacaagcactcaactaactgaactgatagctcttacaagagcactcaaattaagcaagggaaaagtaactaacattggccctgactccaagtatgctttcttagtccttcatgctcatgctgccatctggaaggaaaggcacttctttacagctaatgggctctctataaaataccatcaggggccgggcgcggtggctcacgcctgtaatcctagcactttgggaggccgaggcgggcggatcccgaggtcaggggatcgagaccccggtgaaaccccgtctctactaaaaatacaaaaaattagccgggcgcagtggcgggcgcctgtagtcccagctactcgggaggctgaggcaggagaatggcgtgaacccggaaggcggagcttgcagtgagtggagatcgcgccacagcactcccgcctgggcgacagaacgagactccgtctccaaaaaaaaaaaa

SEQ ID NO: 567479 - DNA, 122 bp, Homo sapiens
acgggcgcagaatgatgcgaacaggcgtgatgatacgcgcctaagcatcgtgtaagcgttcggattagtgggctaattatctgctagggggtggaagcggatgcgtaagaagattcctgcta

SEQ ID NO: 567480 - DNA, 418 bp, Homo sapiens
ttttataatgggacacccgtatagggcccttaccatgaatggagtttgcaggactggaagttgctctgagtgagtcagtgagtgaatgtgaagacctaggacattattgtacgctactgtagaccttgtacacattggacgcttaggcgacattaaatctacaaaagaatatttttctttcccttggcttactatatcttttttattactattttataaactttttgactcttatgtattaacacttagcttacaacacaaacacattgtacagctatacaaaaatattttctttcttggcaaggcatggtggctcacacctgtgatcccagcactttgagaggcagaggcgggaggatcatttgaggtcaggagttcaagaccagcctgaccaacatggtgaaatcccatgtccact

SEQ ID NO: 567481 - DNA, 1559 bp, Homo sapiens
  misc_feature (72)..(72): n is a, c, g, or t
gccacggaggagtctgacctggtccagcagtacggcgtgcgcggatatcccaccatcaagtttcctatcagngaagtggagtacagcggtgttcccccaagtgaactatacatgtctggcagagaggcgtgagtgacggtcgtgatagctggctgaagcaagacgacacggggcccgtgcgtgccaggcaccactgcgctgacggcggccgctagcgtgcgagcagtcctgtggctcggcacgtcctagcgtaggttgggcttgctcgatcggcccttcgttcgacgtggacgttggcagctctgggacctcttgggcaccggccggctctttttcgcgaggggcacgccgacgaggtgccgactacgtagtgcaccagtacgacactgtgttggggcagtccagcgttctcgaatcgagatgcaccgttgtgccgtgccaagaatagccagacgtcgaccacaacgcattcgggcgtcctgctcccgtcgttttagacggaaccgtttctggacatggaccacggcccctgggaaacctagacctctttctgaaagcgggcagcgagcggcgtcaacccgacactgggcactgaaaaccccattgcctttgggaacatatataacgtcgaaatacgaccaaaccgaccaaggctttgacctcccatctgctcaacttccgagtggttttcagccacaggagggccgagaacacagcgggcaccccccgcacaccggacgttctctcctagcggcacgaggttgcacacaacttcacagggaaacatccaaccaacttcatcttaggccttgcgtttccgtatggccccccacaggcaaagggtggactggtcctggagcacttactgcgaccgcggctcgcaacctttgcacaccaaaccgtttccaacaagagcaggccaaggcccaagaatgcaagcctttctccccagtggggcccaacaagaagttcacattgggttcaccttcagtaccaacatcgggacccaaggcgtaactccccacaaacccgcgaccaaaacctccaagaccaggccgatttcccgtcaggaaggtatacctttatgcagcgacccttgaacatgcaacagagacgcagaagattggaccacgggaccggttggccgccccttcaattccagccccctggtggaggggagcagacgccatggaagaccaaatgttcatcaaaagaacccggaaattcgggaacgaacagcctggacggggacaggacaaacgtgatcctcacgacgacaggatcctatgacaacccgtcgctttcccaggggcaagagaccaccaaagaccacgacgccacaccacaccatgggatgtgaaagcccgcagcagctcttgtcctgggcagcgacctgcgtgaaccaaaaagaggacatagtactacaggcgcgctcgtgtgcccgcgcccacatcacacttctggagacacgccgcgcactatccagacgtgaccacactaaccacctaccacatcgactgcgcagacacccacacctcacaagcgaccagccagaccac

SEQ ID NO: 567482 - DNA, 204 bp, Homo sapiens
atatcaacacaaagaccagtaatgtgttgggtggtgacacgttggtcagcgctgtgaagaaaaggaggctacaggataaagcaggggtgctgttttatatattttggggacagtttctctgtaatgtgtccccagtacccctgctttctgtccgtgtcctgaccaggctgtgatccagctagctggaggggggggtcctctaga

SEQ ID NO: 567483 - DNA, 625 bp, Homo sapiens
gaaggtagcgcacggtcggtgtgtacctggtaggtgacttcggtctggttatcgcccttggcaccagcttccagaaaccctccacctgggcgaccgcacgtagccttttgcttcaggcttgtaggtcggcacgccttccagtttgcgcgtgacggtgccgtcagcggctttggtggtggtgacgtggatgtacgagtcgcggtccgtcacggggaacggggccttgaactgggtgtaggtccaggcctcgtcgccttggttgtcgacgagtttctgggatttgcattcatggatccatgcgcaagcaccgaccacatcttcctgcagcgcctggaccttggccaaaggcgccttgatcacggtcacgccgcgataggccttgtacttggaaccggcaatctcgctcagggacaccttgataccgtcttcgtccttggcgacttgccaatcctcagcctgggcagtggccgcaaacaacagcgtaaaaccgcacagcacagccactcgtttcagcgaacccatcgttgtattccttatggttgaagttccgatagtaaagcccatcaagccgccgtcatctgctcccaccagccgatcgactcaggtggtgtgggggatctctaga

SEQ ID NO: 567484 - DNA, 710 bp, Homo sapiens
catcctgataggataaatgttcaacttcataataaagaggctggcatgtggctcatgcctgtaatcccagcacgttgggaggccaaggcaggtggaacacttgagcctaggagttcgagaccagcctgggcaacaaagtgatacccccatctctacaaaaaatataaaagttagcacccggcatggtggcgcgcgcctgtagtcccagttactctgggagactgaggtgggaggatcacctgggtccgggaggcggaggttgcagtgagctgagattgcatcactgcactccagcctgggtgacagggtccagacagggtctcactctgtcacccaggctggagtgcagtggcgcaatctccacacaagaaaaagcaaactgcaacctcttgtgcctcagccacccgagtggctgggactacaggtgcgcaccaccacacctggctaaatttgtatttttagtagagacagcaagaccctgtctcaaaaaaaagaaagaaagaaagaaggaaggaaggagggcaaagacagaaacgaaaacgaaagaaagaaagacacgaaaggacgaaaggacggaaagaaagaaagaaatgagagatagaatatataggaactacatctcagctaaaccagcattaacatcaaaaagactcacatggggccaggcacagggctcactttggaggcactagcaccttggagctgagtgg

SEQ ID NO: 567485 - DNA, 344 bp, Homo sapiens
aaaatacatacaggatcttcgatgctgtatgatgagtcatttaatcttacgagatccattgaggcatctgtgcacagcgcgtatccagctcatacgtatataagtgctgcagtaaaaactcgagttgatctggagcggcggcggtcgcgcgagcgagcaccgccgtcccgcccttgctctggggcccctcgatgctcttactgagtgtccgcgggcccgagcgttactttgaaaaatagagtgtcaagcaggccgagcgcctgataccgagctagaatatggataggacgcggtctatttgttggcgccggatgggtgctggtacgagctcgatcgtatcatgt

SEQ ID NO: 567486 - DNA, 160 bp, Homo sapiens
  misc_feature (51)..(52): n is a, c, g, or t
  misc_feature (67)..(67): n is a, c, g, or t
  misc_feature (76)..(76): n is a, c, g, or t
  misc_feature (94)..(94): n is a, c, g, or t
  misc_feature (99)..(99): n is a, c, g, or t
  misc_feature (141)..(141): n is a, c, g, or t
gcactgagaagagatcgggacatcttaggctggtggcggcgcatcacgaanncttctgattgagcgnttgcatggncggtctccgtgggcaggnttggnccgcatgtggaagggctctgagctgtgtcctccttcattaanagtttttatgtctcgtgtc

SEQ ID NO: 567487 - DNA, 131 bp, Homo sapiens
aggttacttgccatgctgctctctccttgacacgctgtctttggctcgggggctcttctgtcggtgtccctcccatccccatgtgtgctgcactgagttctctccttcttcttcctgctgtcctgccacaa

SEQ ID NO: 567488 - DNA, 120 bp, Homo sapiens
tcttaggatccccgcatccagagccatcatctggcgagaactgagggctcttcggccgttagtgcgaccatgagacgatgaaggcacgctggtgagcctaatccgtaggcataccgagcg

SEQ ID NO: 567489 - DNA, 352 bp, Homo sapiens
tacggtaaaaatgcggatcaacctttatttcggcgaagggatactctcatggtgtactttaggttcagctatttcagggtgaaagccaacgcatttctgccaagctaggcaacgaatgtaccatgccaaggaggctgctttgcgctctgtccgtttggtcgtacgagagtggggatctctcggcctatctccctctcgtggtaaaattaccgtcaagtcgtgatggttgttcgaccgcacttatcactggttttgcgtttgattatcgcagtagtcgattccacaccttcgcgatcctatcctcggaaaacacggtcgctttcatgctggctgcgtgcccaaatgtcgacgc

SEQ ID NO: 567490 - DNA, 405 bp, Homo sapiens
cattgaccttttcaaaggggaacagtttgtggccttggaaggataagtggtcaacaattaattccgccaattcaaggtttttaaataagttttcacaccccaggtgggggtggaattttttttgaattacatgggggtacagccacccaaaattttgccagagggttggaagggccaaatccaagtcctccgggcctaaatcaaggcccaagtgaacaaagggctggggcagctccagggggttgtgggggggcgggtcaaggccagggggggaagggtcagcagcaagttgaattcaattggggggcccttccaggtacctccgggttaaggcaagggcaaggccaagtggcccccaacatttttcccaataaaggtttgggcccgaatggccccatccctgca

SEQ ID NO: 567491 - DNA, 151 bp, Homo sapiens
caagaacaacaacattcaaagatcctcgtaatgggaagccacctgtaactaaaggtggcccacaaatggcttatgaacgcggcttgagggggagctttctcactgcctttattggcgccagtctaatgcacaccgagtcatggaagatcat

SEQ ID NO: 567492 - DNA, 185 bp, Homo sapiens
aactaaacctattgattttttttttttaaaatttttttttccttttgatttaatatactgaaaaaaaaatgggagactttttaatgttaacaaaatcccttttaggagtgtttggggttgtgtattaaaaaaccattcattttggaactcaaggacaggactgtaataaaatggaatggaaccca

SEQ ID NO: 567493 - DNA, 535 bp, Homo sapiens
ctgagtatagattccgagtgccttctcctgctatctgttgcatctgtctccaagatatgctctaattctgatccaatggtaatcccaagaatgctgatctcgctaatatagaaggtatctagtagaatgatcgcatagattgttctatgagaacaagcaaatcgagtgcacctgggatgacaaaaagtcatagtggtgtgacaagtaagttactttggttttctaaagattgctgccattaattgcaaatggggcttattttatcagcttttcatttagggggccattatgtttctgggtacagttttcactccttgctgggtaatcatacatcagtagttagggaagaaatcagtgatgatgatagaagttataacctaggggctgtcattaattcttgcctcagagcaagacatgtgattatgtactctgcctgaccctggtccctctagggtaccctcttttactacatttcacagttacttttcttctgaactactagaactaagtcttgttttctagaacagagtacttg

SEQ ID NO: 567494 - DNA, 150 bp, Homo sapiens
  misc_feature (34)..(34): n is a, c, g, or t
  misc_feature (103)..(103): n is a, c, g, or t
ctcatcctctcctattacatagtgaagcccatgncaaataggaagaagctcagtatcgctcctcccaccataaccccccttaatgcctcctgaaccatagttncctccactatatatccccccatgttcctgctaccccaagttttcact

SEQ ID NO: 567495 - DNA, 305 bp, Homo sapiens
  misc_feature (105)..(105): n is a, c, g, or t
caaagaggggcttgtgaacaagaccggagagggacagtggattgtttatactccagtgtacatagtgtaatgaagcgtgtttacatgtgtagcctatgttgtggnccatcaccccctcaaattcctaggggtttgagatcctgtaggtggtatgtgacacccaagccacctctgtcatttgttgtgatgtcttttcttgcccaaagccttgtgtaaatttgtatattacacatttgtacagaattttgggagattttcagtctagtttcccaatctggctcctttaccaaagaaaaaccttgaaa

SEQ ID NO: 567496 - DNA, 531 bp, Homo sapiens
  misc_feature (531)..(531): n is a, c, g, or t
attctagaggcctagggagccgcacctggtcatgtaccatcaataaagtaccctgtgctcaaccagaaaaaaaaaaaaaaaaaaaaaaaaaaaaaaaaaaaaaaaaaagggaaaaaaaaaaaaaaaaaaaaaaaaaaaaaatttgtggggcgcgcgcgcccggcggagccagaagaaaaaaggttttctcaaaccacactttgggttgggggcgcggcggcgcgcccaaaatgatggattaatggagcaaactcggcgcacaagcagcacgtgacccaaagaggcaaccccggcgcagacgacaagcacggggggcggggtgctctctctcacaaaaaataaaaaaaagcgcgcgccggggggaggccagcagggggggctggttggagaaaacacacactccacaagagggggagcgctcgagggaagcgagccaacaaggggggcgactactaacacaaaggaggggcaccacaagggcgagcgccgaaaattaaatagtagcgcgcgagcgggggggggggaggtagn

SEQ ID NO: 567497 - DNA, 362 bp, Homo sapiens
aacaggatgtgcactgcccctaagtgagaacttgctctacgtggtcaggaaagagcaggagaccaagcagagtctgtgagcaggagtagaatggaaggagaggcggctggagaggacaggtggtggagggccttggcttctgctaagtgagatgggaaccactggagggtttgaacagaggagtgccttgattgatttatattttgcaagggtcattctagctgccatattgtgaaaaactttagtggacaagggcagaaggaagagggaagacctgttaggaagctactgcaatgttccaggcttgggcctgggccacagcaacagcagtggtcaaatatctagatttattttgaaaagag

SEQ ID NO: 567498 - DNA, 145 bp, Homo sapiens
ctgatgatcattacagcatcataaacaactccactgtggaaattcttagtatatgttggctggccgtggtggcatcacacctgcaactcccagcaccgctgtggaggccaatgcagtgcggatcacctagaggatcaggtaattc

SEQ ID NO: 567499 - DNA, 168 bp, Homo sapiens
  misc_feature (131)..(131): n is a, c, g, or t
acggtcttctagaggatccctgggctctgggcctgtccaggggcacaggaaaagggcgatggcctgagctgatgcttcctggccagatctctgctagtccctcccagacatggtcgcaccaggctccccanaccaatgacgttcctgtgcatggaccacgccactgca

SEQ ID NO: 567500 - DNA, 362 bp, Homo sapiens
  misc_feature (87)..(87): n is a, c, g, or t
gtgcagggattacggggcatagagccacgagcatctgggcacaagaacaattctttaaactggatctacaatggtcagggcagctcnaggagagcagcagtttctggaactttcgggctcttaagaagttttcaaatggacctatgtatgggaggacctggggtcaggggaccagagacaactaggggctctggggtgtacgcaggtcgggagaccccagcccatccggcctccttgccccgccacctcccggggcactgggaggacgccggccacgacaggctcctcggcttccagatgactcctgaggactacgaaaagctgggctttcccggtgcccgggaactggccaaaatgttccg

SEQ ID NO: 567501 - DNA, 305 bp, Homo sapiens
tttatcactgggcttgtttacacaggagatggagcaagtcgttacaacttgagcaaaacatatataataaatcattgtcattccttatatcggtacaagcccatcctttgttgatcgcctccacatttatatggcatagtcatagctgttgtctgacttacctatgacattatttttatatcccttcatttgtggatcttaagatgttgcagaaggttcattcctgtaccccaatacagattcacttcctttagctgccttttctagcaccaatatgctttaaaaaaaaatgcgcaaacaacaag

SEQ ID NO: 567502 - DNA, 187 bp, Homo sapiens
gaagtagaggggccaattataggctcatggcaaccttcaactccggggctcaagccatcctctcatctcagactcgggagtagctaggacttcagtggtcacgccaccatgcctagctaatttttttttattttttacggagacaagtctggctatgtcgcctaggcgggtctggaactccgggccg

SEQ ID NO: 567503 - DNA, 158 bp, Homo sapiens
cggcatggggtgggctctgccattttttgaaggctggcagggggacccctcaggaggtacttggggcagtaccatatgctgtggctcctgagtgagagtcagctctgcgccccacaagaccactccctacccagaattcactgtcatcatgtgctggg

SEQ ID NO: 567504 - DNA, 1236 bp, Homo sapiens
cgagttttttgatgccattgggttccagaaggtgtttcttcggccgctcaggatcaggaggaccgcctgaggagttctacgtgctgagcgagaccaccttggcgcagtcccagagccttggagaggcacaaggaacagcgtgctggcttgcgggagcccagtgcgcggccaagcgtggacaggcgagcgccgtcgtactttcctagcccttcgagccctgggctctagaagttcgaactgcctgtgggacttcgttcaagcctcacagcagaggagatcaagcgggagcagaggctcaggtcccgaggcggttggaggcgggcttgacgcgttgcttggggcaccaaggcccgatgccgggaagaagcgagcgagccagccggggcgcttggcgccagtttaccaatttacacgtctgatggcgcggtgcggccattccccggatggtctgccatcctggcagagggaccacttttctaagcggcttcgagggatcccgctcttgccagaggccgtgtgtacacaggagttctcgcaccaggtgaaggcccccttgcataaagccagaattgggcttggcatttgaggaagccttgctatgcccttcggggaggtgcacacaactctgtgccccggatgcaccgacaaatcccttggcctttggaaccggattttgcatcatttggatcgccctttttggccttccgttgggccttttctcggtgggcaacattggctcgctcttgacgccaccactaaagggcctggaggtgcccagatgcggggacccccattcgttagaaaaccaccggagcttcttttggcacgcactgctggagaacgtcttctgggcgaacttacgaaccgtggggtgttgagtcctcaaccctgtgagtgctttctgtgcacaagggtgctcccgtgtgaactccacccccagggcacccctaggtgcttcaagcacccttttgggatatttgggtctccccttgagaccggatggccccaacggtgaaattcgctaatgtgcccctgtggacgcccacccctttggggtgtggaatcccccccgcagtatgggtgtgcccagtattccgcctcattgttgagtggtcacgtgccaacgaattcttcggacgaccctatgtctcacggagctgcaacacgtgccgtggagagtcggtcacagataaattttatgtttttagactcaattctgtgtcgcacgttgtatgg

SEQ ID NO: 567505 - DNA, 350 bp, Homo sapiens
  misc_feature (259)..(259): n is a, c, g, or t
  misc_feature (298)..(298): n is a, c, g, or t
  misc_feature (300)..(300): n is a, c, g, or t
gtgatggcactgatgtcactgtattgttgaaatgcttgtttctgtgctagtccattcctgtaggtggggactccttgaagcagggacagtgatgtagggaaaggagcatgagtttggagccaagttcagatcccagctctgctgatgactgctgtaggacttcaggcaagttactgagctggcccaagcctcagctttctcatctgttaaacagggataataataatcttgactgattgggttgctgagtgatgcgganacaatgtatacagtgtgctcagcaaaatacctggcatananaagcggtcctggccctgggcacagttgacataaccagcggtcacatgagt

SEQ ID NO: 567506 - DNA, 350 bp, Homo sapiens
ttagcaggtatcccctggctagcgctcgggttcacaacgaatgccaagcagcacgggcaggctgaggttcctgccggttcctatggctctgtctccgcacgcgatcccggccgcttttctgcgcaactggaggctgactgctgctgccctttatacatgtagtacgtgaaggtccacgggcgcggagactgcaactagcagcgccgtcggattctagcctgtcagaggcgtctgtccggagggaggaatcatccatggatgtggaccagccatctcccagtgctcaagatactctatcccttgcctccgtatggaacccccaccgtggggcacgcacacggaaaaggaag

SEQ ID NO: 567507 - DNA, 165 bp, Homo sapiens
aaggtctctgtcggagcagcggacgcggtctctgttccggagatgggggtttgttaaagtagtaaggatagggcctcttttaggagataccaggtgaatttaggaggacggaccgagagggtaaaactaattatatttcttcggaaacgcttgggtaataaccgg

SEQ ID NO: 567508 - DNA, 311 bp, Homo sapiens
cagatcaagaatacgatggcactcacagtcgcatcataatcctctctcaaggacttcaaagcgtgctacgccgcacgtaatagctttttggatgacttctagcaagcctcgctaacctcgccttaccccccactattaacctactgggagaactctcagtgctagtaaccacgttctccggatctgatatcctagtctccgttatcggattcatcgtcctagtcatagcccctctcctgtcgtgaacattactcatttacaccaccccagtgagttatgtgcgtactaattatgtgcgtactagttatgtg

SEQ ID NO: 567509 - DNA, 172 bp, Homo sapiens
ggacaagtggtgcacagacttggtattgatgtcttatcgcatttgagtgagatagagaatatttgtgatttgcagaaggcagagatatctactgtataattgcaccagagtacatttgaaaggaaggttttcaatagtgtaatactgcagcgatgtagatgaaatcacaaat

SEQ ID NO: 567510 - DNA, 200 bp, Homo sapiens
  misc_feature (70)..(70): n is a, c, g, or t
acagaatgctttacaccatgaagtaggaggtctaggtatccccatttcacagacaaggaaactgaagctnagtttcccaaaatcacagagagaattttgccaagctgggattcggattcacacagccttgacgtcttgagcccacaccttagtcgccagagtcatccttgtctcgtggacccgaggccactcctgccaat

SEQ ID NO: 567511 - DNA, 367 bp, Homo sapiens
gactgagctgcctcagagagttgtcttacatgtcctacctgagcccgtcgtctggaatcgtcttgcagtggcataatcttgtgggccttcctcctccatcttcagatcctttaacacatctcttggctgagttcttgctggtggctgctaactcgatgccaatttcatctcgatcttgcccctcttctgtaaccgccttcttgagccgctccatcaggacgctcttgttgccgcccgtgtccaggttccgcttcttcagctccgcccgcacatcgatcaccctgcagctcgctgagccgcgctcgtcccagtctccgtaacgccctgggccgcgagaagccgtgccatgggcccgagtcgcccgacc

SEQ ID NO: 567512 - DNA, 251 bp, Homo sapiens
  misc_feature (8)..(8): n is a, c, g, or t
  misc_feature (96)..(96): n is a, c, g, or t
  misc_feature (149)..(149): n is a, c, g, or t
  misc_feature (156)..(156): n is a, c, g, or t
tgggcctntcaagtcctcctgtccttgctgtttctgatgatttggggcttggagccctttgcctcatctgagactgaaatgtggggtccaggatgnctcctcctcttccctcctccctcagcctgcaacctctatcctggacctgcctnccttttncccaactatgcatctgttgtctgctcctcttgcaaaggccagccagcttgggagcagcagagaaataaacagcatttctgatgccaaaaaaaaaa

SEQ ID NO: 567513 - DNA, 717 bp, Homo sapiens
  misc_feature (20)..(20): n is a, c, g, or t
  misc_feature (91)..(91): n is a, c, g, or t
  misc_feature (103)..(103): n is a, c, g, or t
  misc_feature (127)..(127): n is a, c, g, or t
  misc_feature (150)..(150): n is a, c, g, or t
  misc_feature (190)..(191): n is a, c, g, or t
  misc_feature (209)..(209): n is a, c, g, or t
  misc_feature (231)..(231): n is a, c, g, or t
  misc_feature (238)..(238): n is a, c, g, or t
  misc_feature (259)..(259): n is a, c, g, or t
  misc_feature (261)..(261): n is a, c, g, or t
  misc_feature (318)..(318): n is a, c, g, or t
  misc_feature (391)..(391): n is a, c, g, or t
  misc_feature (394)..(394): n is a, c, g, or t
  misc_feature (452)..(453): n is a, c, g, or t
  misc_feature (462)..(462): n is a, c, g, or t
  misc_feature (483)..(483): n is a, c, g, or t
  misc_feature (542)..(542): n is a, c, g, or t
  misc_feature (583)..(583): n is a, c, g, or t
  misc_feature (689)..(689): n is a, c, g, or t
tctccttcaaattaaaaaanaaaatacaaaagctacgtagaaaacgtcagatcagacgactaaactttcccgactcagggccaagttcttnttgagcctgcgntctcgggacgcctgcgagtgggtntccgagtacggggggcgtgtcgngggcgggtagtaggcctcttcctcctcctccttgtggggnntcctcctctcctccgacncctttttcctcacagcctcctncagtagncgcccatcataggggaggtcncnggacctggagccgttgtcccgagggtcccgggtacggtggtggtgggacctggggtnggcaggagggcgctcccgaggagcctgaatgttgtcgtagatgggggtcgcctgtggtagcgtgggaatgtcnctngagttgtcttggtcatagaggtcgtcccggctggggctctgcgggggcatgtagtgcnnggcttctcncaccattattcgtgggagagntgctccctgactcgtgcggtgctcggcggggtgaggtcgtccagtggcgtctatcggancgggcccggggccgcctggcccgccagcccccgcctgcctnctccctggcgggctcctggtcccatcccctgggactccggggggagtggccaccccactcctcatcccggatcggggtgagggcagggccccgggaaggccgagancgccaatcgtcctcgtggagggaggtga

SEQ ID NO: 567514 - DNA, 175 bp, Homo sapiens
cggggtttcgccgttggtccaggcttgtcttgaagtcctggactcaggcagtctgcccaccttgtgtgctcccaaaggtggttgggttacaggcgtgatgcactgtgaccggtccccacactgtctgtgtgcttgcgatgctgctttagagtacttggaaaagctgtgaggggcg

SEQ ID NO: 567515 - DNA, 362 bp, Homo sapiens
cccccccagaacaaactttaaacctctccttaggtccttatattcctaaacgatggggaacctattgtttttggtgggtttataaaaatgggatcttattatacacatttctttataactggttggccttactctacaatctattacagacagccttccaggtaattccatacagacttataccacattctttgagtggcgaaatattccacagtacaggtaaatgacaatttatacttcctactatggagggatattcaggctgtttttagtagcaaatattggaaacattataaaaatatccttacatatacttttatatgtggatactttaattcctacagaacagattcccagaggag

SEQ ID NO: 567516 - DNA, 345 bp, Homo sapiens
atcactcatacactcgcacatgactccccagtatcctcgatccggacggcgatcgatcgaagcccttcaagcccgctcatctggacaccaccaatcccacctgtacacacccccgtgcacaggatacccccactctccccctccctcgctacacggaaaaggggaagaagcatcggacataagaggccccatcccagtggacaacgccatccacatcccgaccgatatcggacctgcgacccatcctggtcccaacccaacatccgctcctactagggcgcttgtaccccgggcatgaagtcccatctgtgggggaaagtaccaacccggaccataccgacacat

SEQ ID NO: 567517 - DNA, 144 bp, Homo sapiens
cacccaccccatgaaaaggaagatctaacagacactaggaggttgaaggcgaaggagacctcgctgggggctgcttgttcgcatgtctaagtgttgggtgtgtgttcccgtgtatgagcttggtggcgctagtcttgggatgtg

SEQ ID NO: 567518 - DNA, 130 bp, Homo sapiens
ggcaagctatccggttcatacatgggaagataactgtataaaactatctgagctgtgaaaagaagtcactggttcggccaggtgcaatgacttaacgcctgtaatcccagcactttggggggctgaggcg

SEQ ID NO: 567519 - DNA, 160 bp, Homo sapiens
acccccccggttttgggattggggggggataccccgggttcgggtggggccaatttttaacccctcttgggaaaaatttttcctccccccccccgggggtttttttttgggtggggttccaacaccccttccattttcgggggttccccccccaccctta

SEQ ID NO: 567520 - DNA, 107 bp, Homo sapiens
tgtcagtcagtgcaccatgaagttgaggcatatatggagacacctcagccccacctctctggaacagtgaaatgatgattggtggagggagcacaggtcagcgtggg

SEQ ID NO: 567521 - DNA, 143 bp, Homo sapiens
caaacatgcataccctactggacgccgagcgggtcggccccgcctatactgaggacggcatgctgctggcgcgccgcaagacgcgcgaagcactcgccgccattgccgcgcgcatccgccccggcatgctggaagaagacgct

SEQ ID NO: 567522 - DNA, 287 bp, Homo sapiens
  misc_feature (55)..(55): n is a, c, g, or t
  misc_feature (250)..(250): n is a, c, g, or t
  misc_feature (253)..(253): n is a, c, g, or t
ggatcgagccgcaccgctctcgtgaactgatgagttggctgtaggtgtgtgggtngaattctgggctttctagtctgttccactgatctctatttctgtctttgtgccagtaccatacggttttgatgattgttgctttgtagtatagtctgaagtccgggagcctggttccttcagctccatttttctttttcaggatgtctttggctattctgggtcttttgtgcttccaaacaactttaaaatattntgntcaagttccgagtctcacgaagcggggccgagct

SEQ ID NO: 567523 - DNA, 172 bp, Homo sapiens
ccataaggataaggtatgcataatcccttctgattcctaagatgaagctgtttttgtgctctttgtcatcattggccctcattccaagcactttacgctgtctgtaatgggatctatttcagcacagcaatatctgagaattgcaaaactagaccaaagtttcacaacagat

SEQ ID NO: 567524 - DNA, 395 bp, Homo sapiens
ttgtttttcccaacaacagagggaaactgcattgcaaggtcattaccaacaccccccaaaccagggatgcttttttttttttggcacgcttatcgacccttcagcaactttaaactccttttaaaactcttctctcctctgtttccttcctaactaaaggctgctccccttggaatatctttgcctggtttctatttctctatcttcttcccttctctatctgatgactacatattggagtgctttgggtaccaccctagacattagttccatgaatttttgtcagaaatagatgctgaataccatgacttgccctaccacaccacagtttgatggcttagcaatagcatagttttattgcaatttctcaaactgcaattgaaattttcctgaac

SEQ ID NO: 567525 - DNA, 591 bp, Homo sapiens
gcaccagcagcattgaagactcagatgatcaggcggtaagatacataaagtgcatggggatacactggtatgtaagcggaacaggtatgcggggtgagaacccaccacatgacggatgcgcacacagttgcactggttgccctacaagcagctactagctccagatgcacggacataccaagttctcactgaacttgatgactgtggaagccacggacacctgggtgcacagtgtgatacaccaaggtctgaagtgtagtcttcggctagagtaaagaagacaacctgacatgctgccaccagacctgaacagcaggcaatgttctccaccttcatcgggaacacatccgtcctaatgcccgaccgatggactacacacgcttctttataaatccagcaacattgggaagaaacagatctgttaaccgaggcagattgtttagagcgaggttatcctttttgccggcagttggtaccatgacaatctatcgccttagtgcggacatgttgaagaagtcgtttcgggtgacagacggtagaccttccgctggtcacttttgtccctgaggattaggtccatattcgtgccaa

SEQ ID NO: 567526 - DNA, 538 bp, Homo sapiens
caaatctaaaaattttaaattaaaggggggtcccccccccaaaaagggccaaatcccgggaaccaaaaaaaaggggccccttcccaaaaaaaaaaaaaaaacttgcccaaaatttgggggttggggcaaaaaaggcaaaaaggtactccctgggaaaaaatggggcccccaaaaaatggtaaagatattttttattttttggccccgggtttaaaccaaaaaccccccttgaatttccaacggggaaaacccggtaaattctttcccggggggactgggaaaaaaaacacccccccgaatttttgcgtttagcccaccacccttcggaataaaaaccaagcaccctctggatattataagggcccccaaaaaaagccggcggaaaaacggaaacaagcgttctcctcggaaaaaggttccccgccacaaatcccaacaaaaatacagccgcgaaaataaaaatgtaaaccctggggggctcaaaaggggggacaacaccaaaaaaaatgggggcccaacataccccgctttaaaaacg

SEQ ID NO: 567527 - DNA, 213 bp, Homo sapiens
tccagggctgggtccgttcagcatagccactaagtagattaggttcgccatgtgccccttcaatcttagtatttttctcctggatgaaatatgatcttattgactctacctggtacatagaaatgtttagagagcacatgtattaatatatcccatgtactctgtggattgtaagataagggctgactattatgcttcattattctttattta

SEQ ID NO: 567528 - DNA, 170 bp, Homo sapiens
gcattaaagtgtaataacgctgcttctctacacgccggtcatacctggaacaattgcgctcactcataccttcggactcaactgtcccgtgacgcttacgtcaacctacggctgtgacctatactctacggccaaggtgccatcacgcgttcagcggttattacggctca

SEQ ID NO: 567529 - DNA, 158 bp, Homo sapiens
ttgggtcgttgcttctgctaatgacagaagatgatggaagctattgtacagtctacagcagaacagctcactttgcctcagcttccacgtcaaagtaatgaaaagcatgctcactagaatctcacaggcacactgtggtacggtatgatgacaggacg

SEQ ID NO: 567530 - DNA, 133 bp, Homo sapiens
aatgtcctatcactctatgcttacagaaaatatagccatgattgaaatcaaatagtaaaggctgttctggctttactatttgatttcaatcatggctatattttcttagctcatcttaaataagcagtacact

SEQ ID NO: 567531 - DNA, 1056 bp, Homo sapiens
  misc_feature (1019)..(1019): n is a, c, g, or t
agacttggtaatggcgacgggctttgtcagagcaccataacatggtgtgggaagtgacaagacaaatctagatgccgtacatgcagtgacagaagagctccgtgttggtgatggacaagagagcctcaggaatgaatgactcattggaggttgcgtgcacgtgtagagtgagacatttgccagtcttcacctggatataactcctgtgatgaacacatggagccttgatgaccttcctgaacttcaggcagttcatcagtgatcctacccaatctggctatgtacctagctgagttcagatgtttcacagtcaaggaatacccaagatcatcttggaaccaaaatagctcagacatagccagaaactacgttaccgtgaaaagtgaggtggactggctaacagaatgggcaaatatcgtgaccagtccacaacagtccactgatgctgtgctcattttacaatacgagtcatctcctgtacacatcatagccgactagcaaaagttgacattcctatggacgccgtccaccaagtgtcctcttcttcgaagagtgaaccagcctttcccttattcacattgggcggcggaacaccagtaagacccgccgggccactcgggagttcgaactggcttttcggcattgtctccccgtccgtgtagataactggggagggggaacacctggcgcttaaagaatgggcccgctgttgaaagcgacgcatgaggtctcctaggggacccaagagcagtgcgcacttttcacattctttcaccaacgagcgtggaaaaagagagactaccaagcggcacgcagcggagttctgcggtcacctgcatgcacaacacggatgattcggtgccatagcacacgcttatctcgcccacaagggttttaaaaagtggcgcacacacaataaaggggcgcacccatcgacagacgcgtcaaaagtaaacagccgacatgaatcgcgtcctttatgcctcctccttctcgactccctcctctaccactacctngccgaaaaaacaagaaagagagagaggaagagagtgt

SEQ ID NO: 567532 - DNA, 445 bp, Homo sapiens
  misc_feature (122)..(122): n is a, c, g, or t
  misc_feature (309)..(310): n is a, c, g, or t
ttttgctattagttttgtgccatatgtaagcattatttaaacattggccacaattaataacaacacatcaatagatgtcataccttttatcctaaatgtcagaagaaattctaatatgaacntaagccagtcacagtttgatgacaccatcatcaggaagcaagatttctaatctacttggaattcttaagtttcacttaagaaaacaatgtaagaaatgctgaatagtaatttgacttaaagagacaagttaagagactgtagagacgaccaaattcttatattaagaaggtagtgattttgattggnnattggtggcacataacatttaatcctggcatttgggaggcagagacaggcagatctctgagttcaagaccagcctggtctgcagaagcaagttccagggtaaccaaggctaaacagatgaacaccctgctcccct

SEQ ID NO: 567533 - DNA, 733 bp, Homo sapiens
aatctgagccctattgtggaggaggggagactgagggggtgctggcatctcctcacttgccagcacctgtacgcattctcgagtatgcaccctgccttggtagctgggcagttccctcctgggagtcgctcactgggctgaagactaaggaattggagaaccagaagcttggttcccagggtggggggaatgtgatacctgggctgagggatgggagttagtcacttcctctacccgacccctagaagccccttgtagtagctgctcctgtgtgagctgtggtgccctctccttctccctttggctcctctcctgctgccttacagtgcccccagatgcctggctaggggcatggacttcacctcctggtcctctcttcctcaggtatggcgttgacgtgtggatgtggccgtgtggccagctgccctgcgggcttccgtatcacatgtggcggcagcggatttccacatcgcccatcagtggtgactactgtggccgactctgcggccactcttccaacggactgctgacctccggaccttggacacataactcagtggccatctaacggggaaagctgcggagcggcattgctgcattgcctgatggcccagtatgcaacgatcccgctatagccccttcgcccccttgcttgctgcagctgtgacctgtctctacatgctacgtctccaggggcataccacatgggtcacagctccttggaagttctggc

SEQ ID NO: 567534 - DNA, 243 bp, Homo sapiens
  misc_feature (101)..(101): n is a, c, g, or t
  misc_feature (142)..(143): n is a, c, g, or t
gacatgggacacggtcagtgctgccctactcggaacgttgctgtctcgatggtgatgggtgctgcatccttgttcctaagcccttctaacgagagtctcanacaagcggaggcgagggccacttcaaccccattctttccanngcgcccgcacatagcaccttgccaccttgagaaccaggaacgcacccttctctgtgggagctctgactggctgtagctggaaaacaaaacagcaactttg

SEQ ID NO: 567535 - DNA, 429 bp, Homo sapiens
caccaggagagagagagatagagctgctgtaccgtgcctgtaggatattccacggctgaggatcccataggcatgaggagcctgtcagtcctgatcttgatgctgaacgcctgcctggcggtgagcgctgaccctgtgccaacgacgcccgacatcattcaagtgcacgataactacaatatatatcggatctatgagaagtggtacaatctggacataggatccacctgcccctgactgaataagatcatggacatgatgacagatagcacgctgatgctgtgagaagacgctacagacgccgagatcagcatgaccagcactcgttgtcggataggagtgcgtaatgagacgtgaggagcttatgagacaacagatactgacggtaagtctctctatcactcccactggatcctaaccatggttctg

SEQ ID NO: 567536 - DNA, 259 bp, Homo sapiens
tagtaaaggctaataaccagctgtataaaagaacaaattagcatatataacagtatgctaacaggatttaagactattcactatagggagttatatttaaaaatccacttttatactgagtcttactacataccaggcactgtactaggccatctaggtaactaagacaacgtaggttaagataggaaagcaccatacatcagtcctttggttaccaaattcaattattaacttacaaacatcctccaagatcaagaaa

SEQ ID NO: 567537 - DNA, 384 bp, Homo sapiens
  misc_feature (22)..(22): n is a, c, g, or t
  misc_feature (37)..(37): n is a, c, g, or t
  misc_feature (242)..(242): n is a, c, g, or t
  misc_feature (271)..(271): n is a, c, g, or t
  misc_feature (325)..(325): n is a, c, g, or t
  misc_feature (365)..(365): n is a, c, g, or t
  misc_feature (382)..(382): n is a, c, g, or t
aagccttatctgaggctgtaancctgctcttttggtncctggaacatcctcccaaagcctcagtgtttacaataggcagcagtgtgtactacaattgtcttgtgaaagtgatgacctggtggtagaatactccttggctttgcttggcaagaacttcattgtgctgtccaccagtgggaccatgggcatactagggtgggtattcacaccctgattttggggggctgctgagaatctctagntcacactgcttcttgccaggagtgaattncctagatttatcaaccactccagttattttaagtaactcctcaggctgaatagntccctatcttgcaatatatctataactcattcattgcatnccaaatgaagtatttcnct

SEQ ID NO: 567538 - DNA, 554 bp, Homo sapiens
tggtttacacattttccttccttttattggaaaaaaatttaaaaaaatgggcagttaataaagggcacaaacaaatcaacggggatatactagtggaaaacacaatataaaactaaaatgccatgggcttcttaaatgggttaaaagcaaaaatgtaacaggcagaaagtctgtttcaaacaatttaaaaagctatgtgtttttaaattcttcccaaattcagatttttacacacccacaaaaatagctggtggtgaaggaaagcgtgctcatacacaagaaagctggtactccgtgaatcctctcagggaaacacatttttgaaactaggaattagagagttcagcaagcagatttaataatttttataaaaattgggagtctctataagagagtgcctacgagtgggccccaagaggcctattaccatattattaagagttacgtggcataggtctccacaagagcaaacagagtctcgtgtcacagcctttttatagccaaaaagcgtgcttttccccagaaaaagagccaaatttaacaattaagtgcac

SEQ ID NO: 567539 - DNA, 321 bp, Homo sapiens
ggttctccactaactctggtagacaaactagtatggaaacctccttgcagccatccataatttcttgctccaagtcgggggtacatttcacttttagtataggactctgggccaggcatagtggctcacgcctgtaatcccaacactttgggaggccaaggcggctggatcacctgaggtcagatcaagaccatcctggctaacacggcgaaaccccatctctactaaaaatacaaaaaattagccaggcgtggtggtgggcgcctgtaatcccagctactcgggaggctgaggcaggagaatggcatgaacccaggaggt

SEQ ID NO: 567540 - DNA, 643 bp, Homo sapiens
aggaatcttatttacccgtggtgcacatttgcgatggcactttcagaaatggagggcccttcgacgaggacgctggcccggtccggcttgggccaaggccatgtccccgccatccatgtcgacgtcatagggatgaggacaccgtaggggcgcctaattcttataggatgcaggcacgtcttcttagggcatgtttcagcagctcagactgcatctccttcttgttgggtcaacgggtgttaaatataatatgtctgactttctgtgcaataataacgtggtgcctttaacaggaatcagatgtgaattagacacctcatttatcaaacctagcatgtcatttctgtagttcctctcatttgacgttttcatgtatgacaacatgtttcatttgttgtacatacccagcttttcaaacatcttttgaattggaacttcattggcatccaccataacacgtttttcatctagcattaagacattcatggaaagccatttggatgacatccagagtggatgatcgtctgggatgattggtgttggaggagtaatgatagtccatcctgctttcttgaaaagatcaatctggtgacatggtcggtcagggttggaaagcacaataacaggtccaatgatgttgaag

SEQ ID NO: 567541 - DNA, 741 bp, Homo sapiens
gcccaggtcctgccctcttcccgcccgccctagggtccagctcccttcacctaggagctgccaaacatctggatcaacctgggaacataaagaggggttgaatctaccattatcgcgcctttgatatttcacacccagacctcctgctcacatccgtaaagcccactgattcttcttacgtacactttttatgagaacacagacatttctaggaagatggtggcagacacaagagaccctgagcttaaacaaatgcccagacaagatgccgaagaggacccaagatgctggcaccaacagccgctcccggtgcagccagccctcaactctctgtgtttctagagggcttacaacatgtccaacagcccatgatgacccacactccagtcgtgagagggccaccacgctgaaccgggggactctcaaaggaaagacccaacgcacaggccaccagcactcaccgaacgcaatcccagtgaaggcgaggacgacataccccaaaaatcggcccacgacgccatgacccgacacgggaaaacaacacaccgcccgggacaggcacacaaaactagacccaacccgtggacctcacgcactccactaacgacatggacaccaagggccacagcggatcgcgcgcacaagggaaacacaggacgacatacccccaagacgcagcacaaaggcccacgcggcaacaggaacaaccaacagaacactggcacgcacaccacagcagcg

SEQ ID NO: 567542 - DNA, 203 bp, Homo sapiens
agaaagcacaaaagagcattcctgttctgaacttaattgtttccaataaagaagagctagttggtgacatagaagtgacaagaaccttatgaggaagggactcatgctagagcttaaaaaaccactggacataattagagatttttagaaaagtaggtatcagaaacatctcagaaaaaaagatataaatccatacctctaaa

SEQ ID NO: 567543 - DNA, 235 bp, Homo sapiens
atcgagcgcttaccgtctgagcagctgggaatgaacaattttatgaaggaaaggtggatgaaattgttgcaacttaaaaggggcaacttagacgcccccctcaagacgcaggaccaagtgcagagaggactcttatctggatgtcgtagtcagacagggtgcgtccatcttccagctgttgcccagccaagatcaacctctgctgatcaggagggatgccttccgttatcttgga

SEQ ID NO: 567544 - DNA, 215 bp, Homo sapiens
gaagctggagctggggcagtgccatgcagccgctggttctcgctcggtggccaatcagtgggatccgaggtggctcggccatcatgcccaggatctgagcccacatctggcaccagatctagcaagggcctgttgggcccacacaagcttgcttgtacctagtcaggctggtaccggcacctccttgcaatgggtcacccgtccggttcctgctc

SEQ ID NO: 567545 - DNA, 174 bp, Homo sapiens
  misc_feature (37)..(37): n is a, c, g, or t
  misc_feature (47)..(47): n is a, c, g, or t
  misc_feature (53)..(53): n is a, c, g, or t
  misc_feature (131)..(131): n is a, c, g, or t
  misc_feature (133)..(133): n is a, c, g, or t
tgggatgtgatccaatgcatggtgcttaagagcgatngccagtggtngcctantacccagtggcatggctgttttatacttccttttgtttgcaggtgtgctctatagtgggggtgggatatttttttccntnaccagatcttctcctgggccctgggggagtctcctgcaatc

SEQ ID NO: 567546 - DNA, 316 bp, Homo sapiens
actggccccgttatatcctataggcttgttctgttgccattaagttatggcaggacgctgtcaccagaaaccagtggaaaaaggaagaagagaagaacaaatgaaccagtagttcttacattgattatcaagtttagacacaaggtgacataacaaatagaaaacgaggatgttctttacttagaaaataagtcgacgacattgtaaggtcctgataaccgcacgtgctactccttaccagctagatgcaacaacgagcaggaagttctatagagccagaaaatcaaacgagatggcagagcatagaagacttttt

SEQ ID NO: 567547 - DNA, 235 bp, Homo sapiens
acctcacacgcactgggtgggtgtgggtatatactaagtggatgatatatttacgggggaagggcttgtgaataggcttattctcttgtcctttcatacagggaggaactttgaagtagatagaaacgactggattactccggtctgaactcagatcacgtaggactttaatcgttgaacaaacgaacctttaatagcggctgcacatcgggatgtctgatccacatcgaggtcg

SEQ ID NO: 567548 - DNA, 399 bp, Homo sapiens
  misc_feature (39)..(39): n is a, c, g, or t
  misc_feature (64)..(64): n is a, c, g, or t
  misc_feature (139)..(139): n is a, c, g, or t
  misc_feature (225)..(225): n is a, c, g, or t
aaggttattaaaaaagtattttgggccctccatatatcnggaaaaatataaccaaatttgaaanctttggatgtcagaaaagtataataaatcctgtagccccccttacagaaaccttatataaaaaataatgatttantcttttgttaaaaattatttagtactggctgggcatgatagctcatgcctgtagtcccagagctttaggaggctgaggcattaggntcacttgaagcccaggaattcaagaccagcctgggcaacatagtgagaccctgtctctacaaaaaaaattaataaattagccagacatggtggtacacacctgtagacccagctacttgagaggctaaggtgggaggatcacttgagcctaggagttcaaggttacacacacgc

SEQ ID NO: 567549 - DNA, 490 bp, Homo sapiens
atgaaatgaaaggctcaccacttcataggctttaaggaaattctggccaggtgtggtgcctcactcatgtaatcccagtgctttaagaggccaagatgggaggatgtttgagccagctgtttgagaccagcctgggcaacgtcatgagaccccatctccacaaaaaaaaaaaaaaagaaaatgggggggtgcgggggctcatgtctgtaatcccagcaatttgggaggctgaggcggggggatcacttgaggtcaggagttggagaccagccgggccaacagggtgaaaccccgtcactactaaaaatacaaaaattagccaggcgtggcggcaggtgcctgtaatcccagctactggcgaggctgaggaagaatggcgtgaacctaggaggtggaggttgcagtgagccaagatcatggctggctggcactccagcctggggcaacagagtggagactccatctcaaaaatattaaaaataatttaaac

SEQ ID NO: 567550 - DNA, 427 bp, Homo sapiens
  misc_feature (207)..(207): n is a, c, g, or t
  misc_feature (213)..(213): n is a, c, g, or t
  misc_feature (304)..(304): n is a, c, g, or t
  misc_feature (315)..(315): n is a, c, g, or t
  misc_feature (336)..(336): n is a, c, g, or t
  misc_feature (354)..(354): n is a, c, g, or t
  misc_feature (379)..(379): n is a, c, g, or t
ttgagatagagtttcactcttgtcacccaggctgcagtgcaatggcgtgatcttggctcgctgcaacccacctcccaggttcaagcgattctcctgcctcagcctcccaaagtgccaagattacaggcgtgacaactggcacctggccctgaaattttttttttttaacaacaaaaaaaacaataaagagcaaacagaccagcagantaaatntaggacaaacctgggccttgagtcatggctctaccacttaattaaacatagtagtcttaatacttcgtaggaatctcaggaccttgttgtncataggggctnttgggaggaccaatgagagcnttttatttaaggcctttntttattcaaagttttggcccattgnttttaaaaacgggcagcaattatttttgggagaataataattattttc

SEQ ID NO: 567551 - DNA, 450 bp, Homo sapiens
tctagaggactcccccccgtcacgttacctcaaacaatcagaggtattaaccttcacctaaatccatctaatactagagtttcatggaacccgactttcaacttgaaagaaaatagtcacaccggccaggcgcagtggctccatctaatattttgtattttcatagagacggggtttcaccatgttgcccagactggtctcaaactcctgactttaggtgatctgcccaccttggcctcccaaagtgctgggattacaggcgtgagtcaccacgcctggcttctatttattattattattttttgcagacagagtctcgctctgtcgcccaggctggagtgcaatggcatgatctcagcttactgcaacctctgcctcccaggttcaagcgattctcctgcctcagcctccagagtagctgggattacaggcatgcaacaccatatgcag

SEQ ID NO: 567552 - DNA, 894 bp, Homo sapiens
ggtgacatctacttcaataacgtgtgcgtgccaccgccgaggtcgttgtgcttgcttgccaggatgccagccgatgcccaccgcagtgagatctcgaatgtcgcaggtgccatacgggcactggacttcatggctgcaacaaccaagctatggcatcgtgggtcatatgcccgtatcaccccagacttcgcagcactcgacgcgtttcagtcgtcaagtcaggaaccatgagtggtgcgtgctcaagcagcaggctattccctggttggcctgcgccgatctccgtctcacttcggcagtgctgacatgggtagtttacctagcactaaatccgtgttatgaacctacaggccatcatggccgactcatggcgtcctggcagtcctctgctctgatggccacaagtaggtgcgagcacatgcaccacacatggggtttccccaggattctttccagtcatgtgacgttgcgcacaccacatgacgctgtgtcttgtgcattggggctacatcccattgatgcgctgtcttagcgccgacacagttggacccaggcaagggcactggaagttattggttggggaatgggcccaattgttacgccgggccctgtgtgggcaatcacgaaagggacactagaagcgacagacggaggcgaatcccacatgaaacaggaataccgacccccagtagtcgacgttggaacccttggtttgcggaccccaaagggtaaccgacattcatatgggtcaacggcaaggtattgagatgctgaatgagcaattaccatatttatatgcaagaccacgaaattacgatatatcctggtatacttgggtaaagaccgtacagcgggaaagaagctcagctaggcacttaggcaacgcccacgcaa

SEQ ID NO: 567553 - DNA, 125 bp, Homo sapiens
  misc_feature (83)..(83): n is a, c, g, or t
agacacactgctgcatgagtaaggtggcttgactggtgtacagtatttcaaaggactagtattaaacttgtgattttcgtttngtttttaaggaatacaaaaaataaacatttactaaaaacgtt

SEQ ID NO: 567554 - DNA, 1551 bp, Homo sapiens
catggctgcaggttgctcagaggcgccgcggccagctggccgccttctgatgggctctctggatagggcaggctggcgtcctgcttggcataagagtggccagacttatgccgcatgattgtgcgctggtgaacagtcggctactcatgcctggtggccggagcccgcaccaaagggcacaatcggcgctgctcgccccagataacctttaacagggaaagcgcaccggggcaatttccgacgacacaggcctcggcgtgccgaacagctccctttccgccatacttccgtgagacacgccatattagaggtgtggtcccctttattgggccaatagtgcactacacattcaaaacgttgttttggccaacgacgcctgtgtgcgacagaattcatttacacactaggaatgtgaaattcaagcggggacccacaatttcacaactacttaaacacactattgtgcgacgccgccccggaactatgcgtgtgctatatttcatctcggtggcacccctgtgcaaccccagagtgggcacacactgaacggcgacatttactgtgggcggacatacttacgctaccaaactaacagcgggttgcgtctcatctctttaacccccacacttatgttggggcagctgtggcatataaatggacataccaatcgtgggcgatatggtatctcacaaagtgtgccccttcccaacattctcccgataaacaccctgttggcagcccaggttgtggcacaagtggttgtactctgtggttgggcaaaaccgcaggtgggaagatttcacactggtgggggctggcttgacaccactagacaattttgtggaacaggtacttctaccgggatgagaaggaacctccaagcaatagcgtgggcggggaaaggataattgctgtggcatctcccgcggcgcaacaccacaccatcactgattacttctcaccgcgacgtttataaccagcttagcagacgcgcgccgtagtgaaaagttttcgttgtgcaagcgaagtggtctcaccaagcaacaatgggtgtgcccgtggcgtcgcaatctctgtgcctaaaacgacacactctctaagacgcaacgtcagcaccacacgcgacgcggcacacggaaccccgacggaagaacccatatttgcaacggggcacagcggggtgtaccccccaacgacgtagccgacaattcatgcagacgagatcaaccccatagggtagaagtacagccgcgggcaagcataccacaaaccggggaggagcaaccaggtaggcgagagccacaccagaaacacatagtcaacagaactcacctagcagattatgacgcacgcacgttttcacaacggtagcacagatgacaacagtccacacagaccaaagaccagcaagaggcggacggcctacccgttgtgctgaaaagaaaaaaaaggctcgcggcgacagcaggccaggagcgtacgagtagccagcctaactcagcaccgctcacgctaggtcactagctgcccgcaagcgactgccgacagctg

SEQ ID NO: 567555 - DNA, 169 bp, Homo sapiens
accacccgaatatcaacagattaatagcaaaacgtggtatatacactcaatggtatattacttcaaccttgaaaaaggaaggtaattctgatacatatctacaacatgaactgaacagccatttaaaaattcaatgggtgagaacttcttgggtgtgtgctttcagggt

SEQ ID NO: 567556 - DNA, 336 bp, Homo sapiens
  misc_feature (81)..(81): n is a, c, g, or t
  misc_feature (131)..(131): n is a, c, g, or t
  misc_feature (298)..(298): n is a, c, g, or t
ccagcgagccgtcagcctgataaccgcgatcggcaaacacttcctcgcgcgttgtcagaccatattgcttgcctgcacgantcagctcgcttcccgccagcccgacgagaatcaatgctggatcgcaagcntataccgctctggcgatggcgtctgccagttgtgcttctttcgccgcctggttgtacaacatgccgtgcggtttgacatgacgcattacgccgccttgcgcacgggcaatcgttgccagcgcgccaatttgatacagcgtctgggcgtaaacggtttctggcggcantgcatggcgctgcgaccaaaattttccctgtcgggaaa

SEQ ID NO: 567557 - DNA, 129 bp, Homo sapiens
tccaactaattctgacaaaatcttactttgaagttatagtcgtttagaccttacagttacacaaacacaagtatttctatctcaggcaagtatttaatttcttaaaagctcagtccagaacaccaaaag

SEQ ID NO: 567558 - DNA, 106 bp, Homo sapiens
cacttctcccccatttcatcctctacccgtagtgctacatgtttccattcatttacaccattttgtcccgagtgtaactgtaagcagccacgttctaaaaagacaa

SEQ ID NO: 567559 - DNA, 145 bp, Homo sapiens
aaaaagactttatgaacagttattctatcttatttaaaggtttaaacctgcccagaaattaccttggtatctgaagtttcctctgtctcctcctctaattagcttgttatttgtcatgcaccagacttggagataataaatttct

SEQ ID NO: 567560 - DNA, 554 bp, Homo sapiens
ctaagttggatcgtttctactgtagagtttagagaattctttgtacatttaaaattctagtcttgaccaggtgcagtggctcacacctgtaatcccagcactttgggaggcttaggtgggtgagttgtttgagactagcttgggcaacatggcgaaaccctatctctacaaaaaaagaaaaaaattggctggatgtggtggtgtgcacctgtagattcagctatctgagagactgagatgggaggatcagctgaggccaggaaggttgaggctgcagtgagctgtgatcactccagcctgggcgacagtgagactctatctcaatacaataaaataaaattctagtcctatgttggatatgtggttttacagatattttcttcccagtctgtagcttgtcttttcatcctcttcacatgggctttcacagggcaggcatttggaactttgatgcggtccatttctcaatcatgcttttggactttcctctcttattgtggatcatgcttttggtatctaggactctgtccatcatagatccaaatatttcttct

SEQ ID NO: 567561 - DNA, 866 bp, Homo sapiens
cccagcattgggtataacattcctctaactcacactttaatggccccttgcactcacgcgcgcaatcacgatcaccccacgcgaaaacggtgcctaacgcccctcatacactccgcgtcctgcgcttcccaagagagaaggacctcctcgtcatctctcactcgaaagatcctttcctacgctcccataatctctacttccgcccccctcacccacagtgcacttagctctgtcttaaaacgaacttttcctttgcccgcgacccacacgtgtacccttaattttggatgccccgcccatggccgagactccgcgccgcgccttctctgtaaccaatctcgctcgcccttttgtaaggaggaactctctcctatctactatgttggggtaatttccccgacacccacatcgtatgtctctatcgtctctcacacaattactaatatccctctctctcgctcggctcacacgcgtcacgtccactcactatacacagttttgtctctccccccccaacggtaaaatctctcgtctctctctctcacatattgtgttctactcacgcacacacacatcgcacactgcaggttgctgtgcactctctctctcacgctcgcacccctagtgctcacacacatgtacacctccacttcctctcccccactgagtaccacaccacactctctgtgcttatctcacgccctcctcacgccactacgtctctctctactcgctcctctccccctctccaccccgcctcctcgctcttgcgctctgctctgtctattctgtctcttgatttgaataaaccaaaagaataacaaataaaataaaaaataataagaaaaaaaacccaacaataatca

SEQ ID NO: 567562 - DNA, 314 bp, Homo sapiens
attcttgaagaagtggatctaagcgtaaagatgaactcttttcagatcttgggaactgaaaccatttgaaatttattactaaggtaaagatgtgaaaatttgctaagtcagcccaccttgtcctgcctttttgcagatagatattcatatggacagctataactactagtgttttttatattatttataatctttaccataaatcaattacaagaaaagagtttcagtcctagtatttagccccaaaatgaacatttaaacatttttatggtaattattatattttatgtctttttaaaaatattaaattctgg

SEQ ID NO: 567563 - DNA, 1007 bp, Homo sapiens
  misc_feature (66)..(66): n is a, c, g, or t
  misc_feature (148)..(148): n is a, c, g, or t
  misc_feature (169)..(169): n is a, c, g, or t
  misc_feature (176)..(176): n is a, c, g, or t
  misc_feature (179)..(179): n is a, c, g, or t
  misc_feature (195)..(195): n is a, c, g, or t
  misc_feature (224)..(224): n is a, c, g, or t
  misc_feature (241)..(241): n is a, c, g, or t
  misc_feature (243)..(243): n is a, c, g, or t
  misc_feature (245)..(246): n is a, c, g, or t
  misc_feature (260)..(260): n is a, c, g, or t
  misc_feature (271)..(271): n is a, c, g, or t
  misc_feature (291)..(291): n is a, c, g, or t
  misc_feature (299)..(299): n is a, c, g, or t
  misc_feature (322)..(322): n is a, c, g, or t
  misc_feature (325)..(325): n is a, c, g, or t
  misc_feature (331)..(331): n is a, c, g, or t
  misc_feature (334)..(334): n is a, c, g, or t
  misc_feature (349)..(349): n is a, c, g, or t
  misc_feature (352)..(352): n is a, c, g, or t
  misc_feature (354)..(354): n is a, c, g, or t
  misc_feature (367)..(367): n is a, c, g, or t
  misc_feature (372)..(372): n is a, c, g, or t
  misc_feature (382)..(382): n is a, c, g, or t
  misc_feature (390)..(390): n is a, c, g, or t
  misc_feature (393)..(393): n is a, c, g, or t
  misc_feature (396)..(396): n is a, c, g, or t
  misc_feature (406)..(406): n is a, c, g, or t
  misc_feature (415)..(415): n is a, c, g, or t
  misc_feature (419)..(419): n is a, c, g, or t
  misc_feature (449)..(449): n is a, c, g, or t
  misc_feature (453)..(453): n is a, c, g, or t
  misc_feature (468)..(468): n is a, c, g, or t
  misc_feature (489)..(489): n is a, c, g, or t
  misc_feature (508)..(508): n is a, c, g, or t
  misc_feature (517)..(517): n is a, c, g, or t
  misc_feature (519)..(519): n is a, c, g, or t
  misc_feature (537)..(537): n is a, c, g, or t
  misc_feature (588)..(588): n is a, c, g, or t
  misc_feature (612)..(612): n is a, c, g, or t
  misc_feature (919)..(919): n is a, c, g, or t
  misc_feature (933)..(933): n is a, c, g, or t
  misc_feature (975)..(975): n is a, c, g, or t
cctgctgcaggcatgtgacagagggagtatactttatgtacaaagttatttatttatagaaatttnggtacagtgtacattgaaaaccatgtaaaatattgcagtgtctaacaaatggcattgaagtgtctttaataaaggctcattnataaatgtcagtatcgttggnggctccntcntttacaaacgccgtcnttctgcctttaattatcttcccccaaaanagaaaaaaaaaatgggngnanngggaatcacatacngtttgtttgcncccgggcagacaacactgcnagattccngacattttgttttgaatttttcnacncccggngcntgtcagtcaaggtcnaananccccaagtgtggngaccnttccctttcnccccgccnttnccnagccggcccnggccccccnttcngtctgacatgagactggcgagagtggctcncccnccgtgcccccccgcncgaagccagccgggcccaccnagtcacttgagttgcagcngccttctcncncacaccacagggggcgcnggacacatctctgtgaaataatacaattgtgcgtttttatgggtgaaatcngagggtaattaaaaccagcagccnagttacccagaaagagtgcctgccatgcacctgtagttcaatctttctttctttttcaacaaagcctacccttacacaacaggaattaactagggggagaaacacccacatacacaactcttccccaagtctccttttcccaaacaaacaaacaaacaagctattcttttagaattataaccatcttgccttctgctgaatccaccatcaggtggcaggaaatgaaagatcagatacagatcaaatgaaagctctaaaaggcctggcctcagcattaccaaacttatttatttagaggttctgaggnaattgttcagagtnccgccacagaccccgttttcttctcttagctctctggcatanaggccaatgacttcataccagccagcctatac

SEQ ID NO: 567564 - DNA, 976 bp, Homo sapiens
  misc_feature (849)..(850): n is a, c, g, or t
cccccgcagaactggctgctgcgtgtgaactgaacagacggagaatgatgtgctagtggagaatctgtctccacatgtcacccatttcatggctcgctgcgcaaagaagacgtgagactgacatatgccattatctctttaccagtattaaacactcatatgcttatggcttggagaaatggcttagattgggtgaattagaggttaatccgagaattagcatggatataccgggacctcatgcgacttggcagatatctgagaaatggttgaattcatgctcaggagctgtgtgactgttccatcccttccggactcccgtacgcctcagattacaaggggtctctctcctgcttgcgcttaggggtccgtagatggggttgtgaagcgatggaggtcctcactggaatcggctctctcctctcctccccccaggaggaactggaaaggagggtaaacagaactaataatgagggggaacagagtttcacgggtacacattaggggactgttcaccaaatattcattaaaagaactattagtacagtgcccctgtcgtctcggcaatggatgaccaaaagtaattaagaatgcacaattggttccggtatcgggaccaaggtatcttacagaaggtggtcgctagggatactaggatgagagaataacggaccgccagggcgggaccgcctcacggtgtcgattgcattaggttccggctcgagaatgtgctctttagtccacactgcctgaaaggcaacattgattcgaccatggatgatcggaaaaacagtcagcctggggacacgggcaaggagggctgtcttgtctctgtgcatacgttgtttnnccgaccaacgaatgcacgcacaatattacaaagagcacatcaagtacacgaacgcgcaagagaagtgcagcatgcaaagacaatctacacgaacaccgcatcagaacaacatcctcagacacgtgg

SEQ ID NO: 567565 - DNA, 396 bp, Homo sapiens
ttattacttctctctgataacatgatgaaaaaatcgcgcaacgtgtctattactactcagtatctcaaaatgttcatttcaaaaagattcttccttttgccacagactgtttacactttaatgaaaaattaatgaaataaagttgccctaaaatttggaggaaaaaatcagtatcactggagtcagttcctcccttgtgctggtgactattttaaaaaaaccacatgagtgacttagaacttggcaggcatagttgttcttcaaactgaaatgactaagaagctatagctacagtagtgcctatccaacactgtacatagaacgatgtgctaagatgacaggaagaaacagtattcttctaggaaggcaaaggaaggtaaaacaatcaggacacct

SEQ ID NO: 567566 - DNA, 649 bp, Homo sapiens
  misc_feature (247)..(247): n is a, c, g, or t
atttaaatactacgttagggggccaccataattacccccatactccttacactattcctcatcacccaactaaaactcttaaacacaaactaccacctacctccctcgccaaagcccataaaaataaaaaattataacaaaccctgcgaaccaaaatgaacttatctcggggtgggtcattcattgcccgcacacttctagagcctaccccccgcggttctgatcattctatctccccctctattgntccccacttccaaattttttatcttcatccggctaatcaccacccttctttgccttttccatctaacctcttatcatttttttggtcttccacaccactaaaggccgaaccggatcttcttatactcggtgtcctttatcattttcattgccctcaacttttctttctttgactcctcgctccctccttcccccccccccccctctctctattcccctagtcttgtcattcctttttgtgccgccctgcttttctaggcctctcctctttgtttttttttgcttcttcctcttttttcccctggtatttttccccgtcttcccccttcctccgtcctctcggttccctcgcccctgtcgttctcccggcggcctttcccggttatataaattaaaacaaaaa

SEQ ID NO: 567567 - DNA, 905 bp, Homo sapiens
  misc_feature (131)..(131): n is a, c, g, or t
  misc_feature (227)..(228): n is a, c, g, or t
  misc_feature (245)..(246): n is a, c, g, or t
  misc_feature (314)..(314): n is a, c, g, or t
  misc_feature (321)..(321): n is a, c, g, or t
  misc_feature (774)..(774): n is a, c, g, or t
  misc_feature (796)..(796): n is a, c, g, or t
  misc_feature (818)..(818): n is a, c, g, or t
  misc_feature (826)..(826): n is a, c, g, or t
  misc_feature (875)..(875): n is a, c, g, or t
gcgcggcgcgtggaggctgctcccagccgcgcgcgagtcagactcgggtgggggtcccggcggcggtagcggcggcggcggtgcgagcatgtcgtggctcttcggcattaacaagggccccaagggtgaangacgctggggccgccgccgcctttgccgcccgcgcagcccggggccgagtggcggcggggacctgcggcttgggatgacctggcctggctgcccannggacaaattggagcaannttctgaccccacctggccttggatgctgctgcctgcaatggctggcgctgcgatgctggatgcactcngctgttnatgccaatggacgccctgaatctggcacagatgcaggatgcagacgctgcagttggatgcaacatgtccaatgctcaaaagagtatgagtgcctgcctgtggatgcagctcaatgagcgagcagatcctgggcgcaggctgaggagaggaggaagaaccctgagcgaggagaccctggcagcaccaggccagggcccagtatccaagacaagctggcccggcagcgctacgaggaccaactgaagcagcagcaacttctcaatgaggagaatttacggaagcaggaggagtccgtgcagaagcaggaagccatgcggcgagccaccgtggagcgggagatggagctgcggcacaagaatgagatgctgcgagtggaggccgaggcccgggcgcgcgccaaggccgagcgggagaatgcagacatcatccgcgagcagatccgcctgaaggcgnccgagcaccgtcagaccgtctnggagtacatcaggacggctggnaccttgtntggggaaggattccgtgcctttgtgacagactgggacaaagtgacagcnacggtggctgggctgacgctgctggctgtt

SEQ ID NO: 567568 - DNA, 882 bp, Homo sapiens
ccagatcaaggtatcggcagatttggtttcttctgaggcctctctccttggcttgcagatagacttctatcggctagaagacttgtcttctcacggtggtgtcctcacatggtctttcctctgtgcatgcacatgtctgtgtgctaatctccttataaagaccaatgagaaacttgcagtttgcatggtccgagtgttctccctattgccatagtccctctcctcctattgtaataatcattttgaatcaagtctctccttacccaaatccacatttgtttttatttgccatttccgtcctgcttaccatgtgtttagctgtggcagcctagtgggaattgagcaaatacatagccaactacaacctaggaaggtatgtattgtgcagggcctgttacatcattttcatgtaagatgaaaatgctgaatgccttattcaaaagacaaaggcaaaagtgcccctgaagtactaaaatatgtttttgcttttcttctatagtctctctcaacttgttacggtgtctcttttaatttagtgtaattgtaaataaataaaaattaaattttttatttagagaacagaaaagaagaacacaaaaacaagcaaaagaaacacacaaacacacacacaaaagacaaacaaaacaaaaaacaaagagggggggcgcggccctataaagaaattcccccgagagggggccacccattttggcgaccccccgggttttctgtaacaggagggggccccctaaaagagaccgcgttataaacgacgcaaacgctgggcgccgtgtgataaacaacgcgccgtgagggagaaaacgtggtcgtggagacactctggaggagcccactcgcgcggcggcaactggggcacaactc

SEQ ID NO: 567569 - DNA, 888 bp, Homo sapiens
  misc_feature (131)..(131): n is a, c, g, or t
  misc_feature (207)..(207): n is a, c, g, or t
  misc_feature (210)..(210): n is a, c, g, or t
  misc_feature (217)..(218): n is a, c, g, or t
  misc_feature (232)..(232): n is a, c, g, or t
  misc_feature (262)..(262): n is a, c, g, or t
  misc_feature (269)..(269): n is a, c, g, or t
  misc_feature (284)..(284): n is a, c, g, or t
  misc_feature (297)..(297): n is a, c, g, or t
  misc_feature (304)..(304): n is a, c, g, or t
  misc_feature (757)..(757): n is a, c, g, or t
  misc_feature (779)..(779): n is a, c, g, or t
  misc_feature (801)..(801): n is a, c, g, or t
  misc_feature (809)..(809): n is a, c, g, or t
  misc_feature (858)..(858): n is a, c, g, or t
gcgcggcgcgtggaggctgctcccagccgcgcgcgagtcagactcgggtgggggtcccggcggcggtagcggcggcggcggtgcgagcatgtcgtggctcttcggcattaacaagggccccaagggtgaangacgctggggccgccgccgcctttgccgcccgcgcagcccggggccgagtggcggcggggacctgcggcttggganacnggccganncccaaggacaaatnaagcaacttcgaccccaccggcctggaacncgccgcnaaggcggccaaaagnctatgagcactcngctgttnatgccaatggacgccctgaatctggcacagatgcaggatgcagacgctgcagttggatgcaacatgtccaatgctcaaaagagtatgagtgcctgcctgtggatgcagctcaatgagcgagcagatcctgggcgcaggctgaggagaggaggaagaaccctgagcgaggagaccctggcagcaccaggccagggcccagtatccaagacaagctggcccggcagcgctacgaggaccaactgaagcagcagcaacttctcaatgaggagaatttacggaagcaggaggagtccgtgcagaagcaggaagccatgcggcgagccaccgtggagcgggagatggagctgcggcacaagaatgagatgctgcgagtggaggccgaggcccgggcgcgcgccaaggccgagcgggagaatgcagacatcatccgcgagcagatccgcctgaaggcgnccgagcaccgtcagaccgtctnggagtacatcaggacggctggnaccttgtntggggaaggattccgtgcctttgtgacagactgggacaaagtgacagcnacggtggctgggctgacgctgctggctgtt

SEQ ID NO: 567570 - DNA, 358 bp, Homo sapiens
ttttttctgagacggatcgtgctctgttgcccaggctggagtgcagtggcgcggtctcggctcactgcaagctccacctcccaggttcatgccattctcccgcctcagcctcctgagtagctgtgactacaggcgcccgcaccacgcccagctaattttttgtatttttagtagagacagggtttcactgtgttagccaggacggtctcgatctcctgacctcatgatccacctgcctcggcctcccaaagtgctgggattacaggcgtaacgaccgcgcccggcctaaaatctatctcttaatgcatggggtatcattctagctaaatagttgagaagtacccttcctgtcgacgcg

SEQ ID NO: 567571 - DNA, 1828 bp, Homo sapiens
  misc_feature (672)..(672): n is a, c, g, or t
  misc_feature (1029)..(1029): n is a, c, g, or t
  misc_feature (1142)..(1142): n is a, c, g, or t
ggagtatatctttcggccgccggctcccgccgacacgcgtcgtccgtgcgcccgtcgagccggctagccatcagcagaggctgtgcagtagcaaggctgcacgggtgcgtcgccagttctgaccagcgccgagtcgaggcatggtgtgtgtcgaaaccaggacaggctgcagaggggccctgtggccccggcaatggtgcccggagaagcctgggtataggcagtctgcgtcctcgggggagtcgcgagagggaggcgccaggacggtacgcaagtgaaccgaggttataaccggatctagatacaactaggctgcatggtccctggggctgtgctgccggagacagcgctagcctgggacggtggcattgcacagtcgggacggcgagcatgccaccgagggaaaaggtaggtcgcccgctggaaatgcttccttgctactgcagcgagctgcgcgaaagcgccgcccgggcccaggggcagggctgagcatccaaatcgaacgtcaggcgcaagggaccatttgcctagcgccggggcaccgcccgccactgtactctgggctgcgtaggaccaagtccgacctcgcggactcggtcgatcactttgaggcagacactaattgtcgagcgcaagtggggcctagacggtcgagccttggagtcatgcccnttcgacttcgaataccaattggggtagactcgccaatttgagaaaaacgggcctagggcgttgtaatgcatagtagtccacacgcagttggctatcgagacactttttacagcgtggcacgctttacgcctcgcagttccaagatcccacattggcaggacagctatccacagtacgctactagagcaaaggtctaggaacaaagcaattgcagaactagaaacacaaaagacgaccttcttcactatcttagtccgcgatttgaaaaaccctcccactttatggggcgactgttcgcaatctcaggcaccccgaacgatgctcatgcacacagagtttacgatagcgactttgccnacagcaccgcaacagcccggctatatctcttctctgtttcgacgggtgggcatgcacgaacgacaaacgcagacgggaacaatgggaaatacggcgtttgtgggcacgagccntctcggccgcaacacacagcgattccgtttcacagtctgggtgcctgcacacatagtttcctcaacatacgacctgtatcactgcaggcgagaccagtgcacaaaatttcagtccccagccgcgatgaggcgattatgtgcacaagtgaacaaaagatgcgtgacttaggcgatgtcaccgccttctagagtctggaggactgacaccccaacagagggcacaaggacacacgccgtcgatgcgtagatagtcgtgacattcagttcacacatttattagtacagcgataccacacaactcaaaatatcctacagctatggcaatttccttcagatcggcactgtcagcgacatttacattggaccacagcgccgttcggaaagccatgcacaacacaaggaagtcaacaagcgagccattataccatttttctcaacagcagtgcagcatctgtgacataacaccacagtcgagtggcaaaaacgcaaaggacatacgaataacacttcacggacagaggcgcacagaccactatgcagttagggcccaacaggcatctgtcacgcacctccatcacccacaactagtgtagacgatcacagcgaaataatcagcataggagctattagcaaagacgaacatcgacagaataatcataacaacaacacataatcgcacatacaca

SEQ ID NO: 567572 - DNA, 1228 bp, Homo sapiens
ctttgtcatctcaacagtagcactctgttgtgcggtcctgtgtgtatcgacatgcgaacgtcttcattgcatcatgtttgtagtttccaccgctacgatacgtcgtctgtacaactctgcggtggttgtttcctcagaggaatctacctggtgcttcgagtgtatcggcaacatagtgtaatccccttccttttcggcggtatcaacttccgctagaatcaatctccccattgcggtaattgcataagggtaacaattatgtttatctagtcgggtttttccctataaatcccctgtctggttgtatttgagctagtcctcccgagtggttgttaccctgtgttctagatcctatggtcaatatgttctgtgatatgctccgtgttgtcccattgctggctgacggttgggcacaaacttataaatgttatttccatggttggtctagaactgggtgacccaacacgctatgacaacgaaagttcacgctgatttgaagtctgaactttgagcttttatctcttaagaatgagctgtcgtccttgcctctacgtcaggtcaatttctcccccattttccatccatttaccccttagccatttgagactaataggaaatagggaataaatcagacattacggtcatctctaggtcacgggtctaggaaacatttgggcagcctgctcccttggcagagctgtggtctcctctgcaaagcattcttaattaaaaaacctcaatacaagatggccctgcccagcgctgtgaccttgtgtctatcggggcattcgatagagtcgctgaaaggatgtgttgctttgaaaaggtgtggccttacgacactatggagatgatgggtagaagctccttcgagaaacctagcagtggccatagagaagtagactgggtatggggaacctaagtcatagttgtaacctacagctcgattcggtaagaagctatgggccagacactttaactctctcaatgctatgaaatagtccattctcatttatctaccttaggttatgggctcttctattagattggatattcacactgttatctcttcagtgttaactgggtatcagttatgagtctactactgtataatggcatccaaaagaattttaaagtacctcggtttatagggactttacaattcacgtagaaacttgttattacatgtgaaacagtgaacataatatactcaaccgaggtggagtaa

SEQ ID NO: 567573 - DNA, 586 bp, Homo sapiens
  misc_feature (83)..(83): n is a, c, g, or t
  misc_feature (90)..(90): n is a, c, g, or t
  misc_feature (97)..(97): n is a, c, g, or t
  misc_feature (147)..(148): n is a, c, g, or t
  misc_feature (163)..(163): n is a, c, g, or t
  misc_feature (176)..(176): n is a, c, g, or t
  misc_feature (334)..(334): n is a, c, g, or t
  misc_feature (348)..(348): n is a, c, g, or t
  misc_feature (361)..(361): n is a, c, g, or t
  misc_feature (393)..(393): n is a, c, g, or t
  misc_feature (397)..(397): n is a, c, g, or t
  misc_feature (409)..(409): n is a, c, g, or t
  misc_feature (415)..(415): n is a, c, g, or t
  misc_feature (436)..(436): n is a, c, g, or t
  misc_feature (454)..(454): n is a, c, g, or t
  misc_feature (459)..(459): n is a, c, g, or t
  misc_feature (467)..(468): n is a, c, g, or t
  misc_feature (503)..(503): n is a, c, g, or t
  misc_feature (518)..(518): n is a, c, g, or t
  misc_feature (547)..(547): n is a, c, g, or t
  misc_feature (556)..(556): n is a, c, g, or t
  misc_feature (563)..(563): n is a, c, g, or t
tataaataaaaatattaataaaaaaaaaaaactattcagcatctccattcttgcatcaatttaaatcaaaaaaatctgaattnaaaaatntccaggntccaataacaattctgttaagaacagacagccagtatcatcctgagcacnnaggtatgctttccanggccgagacccanccctactcattgcgatggtctggatgttcactacttgaagagccatctggagggtgtcaggatggaattctccccgccaaagcaacacttgctgatgaagcaactattaaggctaagccaagttttctcaaaataatcagcagtaaagctggcgattngtgactagcatganggctccagaatcngggagttcttgtaccctctccttgttctcttnaagnatcaagggtccngatgcngcaaatgatgaaaattaaggnaactctgggacacaaagntctgnacccctgnncaatttagaagaatagttgcccaattggctttacnatacactgacaccantgtgttgaagtctgagcgcccagctattnacagatctntctgccngatcctccaaaagtccaagagta

SEQ ID NO: 567574 - DNA, 752 bp, Homo sapiens
  misc_feature (41)..(41): n is a, c, g, or t
tcattgtcttccctggacactcagtacttagattcttgcanccgccactaggacgagctatgttcgtattttagtacatacaaggtctgattatgttgcacaggctggtctctaactcttaacttcaagtgatccaccggcctcggcctcccaacgtattgggactatagacatgacccatcgtgcttggcattcttgattcttaatacggggttttgaggtgaaagcatttcatgacaacttaggttcatacacaagagcatcatgaatcttctaagaaaggtatctgtgctttttttgtgcgcacaaaatattacttcttatggaatgtttacactaggtgaggaaaagttcattaattacctttaaaccgctccctatcttttttacagattttaaattgtactttggcttctgccttcagtatcccttctggttgctatggtttgaattaagttcctattatgctgcagcacatatcaaccttccctaagtaaccatttcctggaatgttaagcatcggtaccattatcagaccatatgcagaaatgtcgtggactcagcaattcttttttgtgcactgtataaggctggttgtgactcagatcagcatagctttttatattatgtaatttcactagcagctacagtccaaatgattctctctttgaacaatagaaaattattttaattttattttttccctcacatttctaattcgagtgtaaatgtttatcaataaaaaattactt

SEQ ID NO: 567575 - DNA, 286 bp, Homo sapiens
aatctaacaccaaacatgcgtaggccgaccatacgaagataatcagtcaccacataaggacaacagacacaggaggaacaacagagagagtgatcagccaggggtggtggctcacaaatgagatcccagctcctagggaggctgaggcagaagacttgcctgaacctgggaggtggaggttgcagtaagccaagatagcgccactgcactccagcctcggggacagagggagactccgactcaaaaaaaaagagagtggacacccaacccatgtgatatcccagcc

SEQ ID NO: 567576 - DNA, 128 bp, Homo sapiens
cctgatttgtcttctattataattagtgagttacccgtagtctacctattatgattctgtgcagcagactcgtgggtagtaatgctaagattagcatcacagttatgtgccatctccccacccgatcg

SEQ ID NO: 567577 - DNA, 169 bp, Homo sapiens
cccccaggcttttgtttggcggctgtaatttttaagtatttgagtttgaacagattagctttggggggagggggtttccccaatgtgagggggaaccaagaaaattttaaatacagggtattttccagcttcctgtttttaccccaaaataaagtattgacccaagaga

SEQ ID NO: 567578 - DNA, 291 bp, Homo sapiens
ttcaaactgctcccgcatctgctcctcctgctcccccacctgctcctcctgcttccgcatctgctcctcctgcttccgcatctgctcctcctgcttcagcatctgctcctcctgctcccccatctgctcctcctgcttccgcatctgctcctcctgctcccccatctgctcctcctgctcccccatctgctcctcctgcttccgcatctgctcctcctgcttccgcatctgctcctcctgctcccccatctgctcctccgtcgacgcggccgcgaatttagtagtagtagg

SEQ ID NO: 567579 - DNA, 230 bp, Homo sapiens
ttcgatggcgggcacttattgacattgtcaatatattagcaacagaaatgagaacagaaatgtacacttcagtaatatttttcaaacggtatgctttgatcctattaacatttttttttttttttttggaaaaagtctcgctcttctcccccaagctggagtgcaatgccaagatctgggcatcaccgaaaccttctgcccccgggatcaagcagatccccgtgctaagc

SEQ ID NO: 567580 - DNA, 595 bp, Homo sapiens
  misc_feature (506)..(506): n is a, c, g, or t
  misc_feature (518)..(518): n is a, c, g, or t
  misc_feature (581)..(581): n is a, c, g, or t
  misc_feature (593)..(593): n is a, c, g, or t
catgagaccacaacctgctaaaaatgagctttcctagtaacttgggactacctacctgtctaggaataaactgtcagcgcgagagatccgatgaaacctgagacgaaagattcattttcttctaaaatgctttctcaaaagtttttaaaaagaaaaggggggaaatgtgaaagaaaataaatcttggggcccccaaaaatcactaagctaaagggaaaagtcaagctgagaactgtttagggcaaacctgcctctcattctattcaaagtcactgagataaatgcatatctgactgcctcctctggagaggctaatcagaaactcaaaagaaaacaaccatttgtctctcacctacctgtgacctgaaagcctcctccctgctttgagctggcctgcctttccagacagaaccagtgtacatcttacgtatattaattgatgtctcacgactccctaaaatgtataaaaccaacctctggccaggcgtggtggctcacgcctgtantcctctatggtnttgggcatcatgagctaagttccatcttgctttgggtagtggttaataaaattcactctgagntcatgtcatacntt

SEQ ID NO: 567581 - DNA, 421 bp, Homo sapiens
gagtgtccacaagcctttgcctcctggtcacctatagcaaccttctcaacaagatacactacttcacagggcaaagaggtagtctgacataacagcactaccagccaaacccctcttgtacagtgtgtgtctacaagtttacaccctcatattaagctgtaaagacataaacaccaatattaacagtgtaatggatccatttttatgttttactcaaatccaaaaaggatacaaatgattatcaaacagccattttgacatcaaggccaatatcatgattgggtcatcctgcgatagagttaactagcgaatctcggagaaactaaagataccaaagtcaaaaattcccaaccttacccctagagacacaatatgttttatatatagatagagatataacctaccaataaatatagatccc

SEQ ID NO: 567582 - DNA, 490 bp, Homo sapiens
  misc_feature (401)..(401): n is a, c, g, or t
  misc_feature (413)..(413): n is a, c, g, or t
  misc_feature (476)..(476): n is a, c, g, or t
  misc_feature (488)..(488): n is a, c, g, or t
atcgatacagtaccgtgtctgtaagcttagctcggtagttatactccgaaatatgggtaggtgtgagatgcatttggtgtggggctgccaatggtgcctacgctacgcgtacgtgtcgagcggggacctgtacagggctcgccgggctctcatggtattgtgggtcgcggagacttatgcatatctgactgcctcctctggagaggctaatcagaaactcaaaagaaaacaaccatttgtctctcacctacctgtgacctgaaagcctcctccctgctttgagctggcctgcctttccagacagaaccagtgtacatcttacgtatattaattgatgtctcacgactccctaaaatgtataaaaccaacctctggccaggcgtggtggctcacgcctgtantcctctatggtnttgggcatcatgagctaagttccatcttgctttgggtagtggttaataaaattcactctgagntcatgtcatacntt

SEQ ID NO: 567583 - DNA, 1236 bp, Homo sapiens
  misc_feature (130)..(130): n is a, c, g, or t
  misc_feature (196)..(196): n is a, c, g, or t
  misc_feature (662)..(662): n is a, c, g, or t
  misc_feature (870)..(870): n is a, c, g, or t
  misc_feature (878)..(878): n is a, c, g, or t
  misc_feature (1197)..(1197): n is a, c, g, or t
gagctgaatcgcactggcctatttgccgcttgtatctggttgtgcacttaaggtactcttcttgagagcgccatcgttagcaacccatgttactccaagtatgcacccggaaccggaacacattcgcttntcccgtgatcgtacagtgctgaaggacgttcgtacgtataaatctagcagtctgagaaagactgtntacaatgttccctggaagccatgtgtgtgtggtgtcttgtctggccatggtgctgtgacttctagaatatgtagtatctaattgcaagcaaggcattctgtctagagtgtatgatgcaacacttgttgagaaagcccactctgcgagtaatcacgcaccttacatataccgcggcattgtgattctacatcgatttcccctcctaggacggaaaacaggccactaacataggtcgctgtttgtactcccacagataccacacgtgtaggcaagtaacgcaagagaagggtgatgatttggttcgacagagagttattcgtcctagaaagacagaggccattacgcagttaacacgactgattagttttcattgctcatcttgatcttccattgcgaaaggcagtagaaacgttgagagacctcctttcaacatgcgtacgaacaacagatattggctccaacctantgtcgtaccggtaactgtggacattcagacaaacagaaccccttgtagtcacagccggacacatgtgagcgaggtcttggccagaagtaacgcgcccctggacttcgtgcgttttctagcctagttgcaggcgcgacgcctcccgatttttagaccgcacgaccttgggaaaacgctcagcagtatgagcagcgtcagaagactgtgntccgcaancacacaatttgcgcagtggagatttgcttcgttagactagtacaatagcacttacttcgcgctcatagcgagtgaacttaggtcgcaagtcttcgtggctcaaaaggcgaatgtgcatagctcgcctccctttgggtcatgcttgtcgatatgacagcaggacatcaacacttcttatgagatgcgttggatgtcagcttacgactgcgcaaatgattgacgtttgacttcccgtttgagggagcgaagatccctggtgtaagaactccacgccatttgaaggccttcggtatttgcgccaaaactggatcgatccatnggcgcgtgtgactttactaaccgtggaggagagaaatcc

SEQ ID NO: 567584 - DNA, 821 bp, Homo sapiens
tctggctaccgggactaaaagggaagcgttttgggggtcgcggtccggacttggggcggggggtccggccccaggacagtttataccgcattccgtccactcccgattccttcagggatccggcgtctgcacttatacagaggtccaatcacgcggacccagaaaccccagggggaccgggacctcagccctcggggtaaagtcccgagggcggaggggtgattggccgcaaacatgcggggactcctagccggcccctgggctcgtatccgcaacatctctcgcataaggcgagtcaacaacagtaccaggcggggtgcctcgggcgactacgctgattcccagtattggaagcaagtcctcggccacatggtgatcgaagaggagctctcggggaaagggacacagctataagtccaaaagctattcctacacgggctgacccgggccatgtaaagccggcgcctctaaagatagaaccctcttgggtgaccaccacgggcaccgagagggcatacacaacagggaaagaaccacccccggatattgggcacaggcggggggaaccccaaaaaagccccctgccggggcccggggtcataggcgcccataccgtgccacaccccgtcggcacacatcttggcaaaccaccgtgcaaaccaaccagggccccgcacaaaaacaaccgcacggagtgcacaccagaagacccgttacacggtcaacccctcctcccaaggggtgctaaacacctacacacaaacggcacacaccctagcgcaaccaacccaaccaccaaacagcatacatcaaacaagcaa

SEQ ID NO: 567585 - DNA, 107 bp, Homo sapiens
  misc_feature (30)..(30): n is a, c, g, or t
  misc_feature (75)..(75): n is a, c, g, or t
  misc_feature (106)..(106): n is a, c, g, or t
gaggctcatcagaacagagtaatgacatgngtttggtgtaataaaaaaggtcttttggctacaagtggcaatganggcaccatccgcgtatggaatgttaccaagnt

SEQ ID NO: 567586 - DNA, 287 bp, Homo sapiens
  misc_feature (133)..(133): n is a, c, g, or t
gatccatgctctgagtagaaaagttaactacattcatgtcttgtctgtgtactcggcctgggtgtctacatttacttcaccccagtctgctgccatccagttgcgaagcatgattttcctaagaatccagggncatgggagatacaattccaagttctcgcttcctcctttgggcatctcttctgcctcccaatcaaggaagctccatgctcaggctctcagctctcgggccagtgctctgctctgtccagggtaggtaatactgggagactcctgtcttttaccct

SEQ ID NO: 567587 - DNA, 891 bp, Homo sapiens
ggagagaactagtctcgaggtttttttcttttttttctccaaaacaaggatattgtttttaatcaaattaactgcacaatatggaaaccaaagagggagccccaggttgggccaaatcattgggctgcacccctcccgcaaagagaacggggggagtgcaggtggtgcccctaaaaccctattgtaggcgtcgatgcgcggccccgtggctccactcttggtgcagcaatcactaagcgtggcagggccccaatgttccctgggaactggcggtaactctgcgtgacccagagctcgtgccaatgtgcccccagagcccccttcttttccaccaacaaaagaaaggtatcttgaggggcgaaggagcgaactctgagtgggtcccacgacagcccgagagtgtccatgtgatacgactagaaactaagtccgtaactgctgttgatgttgcccaagggatagctacaataggatgggcagtttgtttccagaaacagaaaccgcaagcaccaactcccgaaaaacaaaggagaacaaccaccatgccatagagttggtcccccaaacaagagaggtaacgacccatgggccgatagatcaaaacgaagatagcgaccacgtggcaaccccaaagaacaccactccagagagcgagcgataaccggacgaaagaaagcacctgcgaagaaaccgcgagaagccatggaaaagagcccgccggcaacagggctagagaaacagacgggaagcaaaacaacaaacgcatgagacccacgacaatatatcaaacgacaggccagaaataagcagatgacagcgaagagggaaagaagcaacaacagaaccaaggaagggcaccggcgagcacaccacaccaccacaccacaacat

SEQ ID NO: 567588 - DNA, 212 bp, Homo sapiens
  misc_feature (89)..(89): n is a, c, g, or t
agaatataagaattcacatcctcccaccttcttctttccgaagaaggtgggaggatgtgaattgttagatgctgagtgtataccgaganataacgatagaagtatgcgatggagttcgaagaatatcaaggagaatgcggacggatacagaatgaattgtaaaaagagtcataagtgatacaaaatagggaaatggacatagtgaaaaaacg

SEQ ID NO: 567589 - DNA, 622 bp, Homo sapiens
  misc_feature (533)..(533): n is a, c, g, or t
tgaacatcaagaaccgtattgacgcaagtgtcttgctggctgaagcctcgctggcacggaagcagcggaaaacacatactacctttattccactgatgctgaatgagatgccacagattggggacctggagggactggatgctgagttagtcacccttaatgaggatgaagcagagttacgctgtgatggtaccaagtctaccattaaaccatgccagatgtcagtagccaggattacctgtgttcggagccagagacccaatgagggtatcccctgcattgatgactacatctatacccacgagcaggtggtggattacttgactcaatactcgggtatagagcctggtgacctcgatgcctttactacatgcacctaacaactctcaagtgtacctactgagagcttcatattctcattgacattggagtccagcatgtgggacatggcctgcagaaggacttgccggatatcaaccggatggtgcccaaggaccaatggcttgacactgactacctgttccatatgcccngtcaacgggggaacccctgaacagggttgaaggaagccctgacaaacccttcagcttgaccgggttgtggagctcagccgggaggggtc

SEQ ID NO: 567590 - DNA, 120 bp, Homo sapiens
ataacacgtaatacaagctcagtgtgtgctgacacagtgttaggatacacggtgcatcacagaggtctcctgcagtgtgcactggagagacgtggcccagaagcaggcaaggtgggctgg

SEQ ID NO: 567591 - DNA, 163 bp, Homo sapiens
gtggtgatggggtctcataagggtccaagctgtgtccagagaagatcccggctgtcctagattctagagcagggaagctcagctgcttgcctgacctggaggggcacggaggggccctgcaactgggccaagggacagcaggaagtggagtggccatttacgg

SEQ ID NO: 567592 - DNA, 108 bp, Homo sapiens
ctatcaccttgaaacgattattgatttccacaaggatcaagctactggctgcatcgaggtgaggggtgaagtggtctgtgctagatcaaaaggcacggggtggtatag

SEQ ID NO: 567593 - DNA, 134 bp, Homo sapiens
tccagaggatacccgtcagtagggtgtgcccaggacgtggatggtgcagtgagccgagatcacaccatagcactccagcccgagtgacagtgcgaggctctgtctcaaaaaaaaacaaaaacagggcacaatat

SEQ ID NO: 567594 - DNA, 603 bp, Homo sapiens
gttcaaagcttgaaggagtcgcgctttgtcgtgtggttactgcgagacggaattgtgtgtcgcccgcggtgcgccgatcatcatgtgagaatatgtgagtcgggggtgtgggctgccccacggcggcagtagtttcttataacagtagatacaacaattgtgttaccacattggggtcctcctattgcggtataacacccggggtgcggtttagtgtctgtgcgagcactatccgctccccttttcggagaagatagaggtgcgccagcagccgttgttgcggggtcggccaagggcgcggtgcgtcgtggcctgattggctcgacactcgctgtcgttttctacggcgttatcgccgcctgcggtgtgctaggattctcccgcttctctcccggccgtgtacctgccgatgactctcccgcgacggagatctcttggtgttgatccgtgtgattttgagcgtacaacatatagtgcgtcttgcctagacctcagcgcgaaacagatacacgagccaacacgatctctctgaggcgaaggagttcgacacgcaaaaacatatacaatactacgcatacagtgtacacaccaagataaatcaaa

SEQ ID NO: 567595 - DNA, 578 bp, Homo sapiens
  misc_feature (485)..(485): n is a, c, g, or t
  misc_feature (574)..(574): n is a, c, g, or t
ggaccccgaggccaatgctgactggttcacagttcagccccctgctcagaaaaccatttgtccagctaaggagaggaggaggcaccttgaggcttccgtagtcgaggctctccagggttccccagcccatcaatcattttctgcaccccctgcctgggaggcagctccctggggggtgggaatgggtgactagaggggatttcagtgtgggacccagggtctgttcttcacagtaggaggtggaagggatgactaagttctttatcacagacctacaaaaaatgagataattagatattactctcactagtttgggcttcttttttctttttctttttacaaaacagcagctggaaagagaaatgtaggtggcagacgagccaggcacaaggtttcagattggaagggaccaagatgaggaccaaggtgtggctgcctgactaggaacgctgtgggctggcccaggctctcgccacacatcctgngagaactgccataggccctagaaggagggatgaaaggcgtatgggagggaagacagcggtccccgaaccagtcagcattaaccacgggnaccg

SEQ ID NO: 567596 - DNA, 175 bp, Homo sapiens
  misc_feature (160)..(161): n is a, c, g, or t
tcgtatagtctaaactgtcagcagacattaattcggtcgcaggtgaagtcccaccgcctagagatgaactctgcctccgatggatgttttccacttcagtggcactcgtctcgcagattactggggtcattacatatcattcgcatgcacattcagtganncagtagaaacgagc

SEQ ID NO: 567597 - DNA, 633 bp, Homo sapiens
tacgggaacgcgacccgcgccggtcccgcggcggtaagaagaaggggagacgacggcggaggctggggaacatcgggcagcgagagcggctgcgggcctcctgcgcactcacggctgcggctcggcctgccggggctggggtcctaccgcgaaccggcggcactgcgcaccagcccgccgtacgagctcgccgcagagcttcctaggcaaaatcaagaagaaagaagttcccatccacgaagtagccaagatgaacttaatgaaatcaatcagttcttgggacccgtggaaaaattcttcactgaagaggtggactcccgaaaaattgaccaggaagggaaaatcccagatgaaactttggagaaattgaagagcctagggctttttgggctgcaagtcccagaagaatatggtggcctgggcttttcatccaaacaacccatggtactcacgactaggggagatcatcagcatggattgggtccatcactgtgaccctggtcagcgcaccagggctattggcctcaaagggggatcattctttgtgccttggcaacctgagtgagcaggaaagccaaatacttgcctaaactggcgtccggggagcacattgcagccttctgcctcacggga

SEQ ID NO: 567598 - DNA, 612 bp, Homo sapiens
attcggccattatggccggggcacttttggcgagagtcgtttcttggataccaagcgcttgtgtttggcaaagctggtgtgagacgagacattcttgcccggccgccggaataatcaagagtttgggccgaacctttgagcatacaccgagagagtgaggagccagacgacaggcacacactatggcgctgaaacggattaatagggaacttagggattgggcccgggaccttccagaacaaggttctgcaggtccagttggggatgataggtttaattggcaggccacatttatgggacctaaggacagcccatatcagggcggggaattcttttggacaattaattttcctacagattaccctttcaaaccacttagggttgaatttacaccaggaatttatcatccaaatattaccagtattggcagcattggcctggatattctaggatcacagtggccgcctgctttaccaattcttaaggttctttaatccattggttaatgttatgtgatccaaacccagatgaccccttagtgccagagattgcacggatctattccggcggagttaggtccaacggaatatctcggattggacctaggtttgc

SEQ ID NO: 567599 - DNA, 848 bp, Homo sapiens
  misc_feature (32)..(32): n is a, c, g, or t
  misc_feature (88)..(88): n is a, c, g, or t
  misc_feature (119)..(119): n is a, c, g, or t
  misc_feature (134)..(134): n is a, c, g, or t
  misc_feature (159)..(159): n is a, c, g, or t
  misc_feature (199)..(199): n is a, c, g, or t
  misc_feature (204)..(204): n is a, c, g, or t
  misc_feature (243)..(243): n is a, c, g, or t
  misc_feature (273)..(273): n is a, c, g, or t
  misc_feature (312)..(313): n is a, c, g, or t
  misc_feature (353)..(353): n is a, c, g, or t
  misc_feature (384)..(384): n is a, c, g, or t
  misc_feature (440)..(440): n is a, c, g, or t
  misc_feature (493)..(493): n is a, c, g, or t
  misc_feature (585)..(585): n is a, c, g, or t
  misc_feature (588)..(588): n is a, c, g, or t
  misc_feature (592)..(592): n is a, c, g, or t
  misc_feature (597)..(597): n is a, c, g, or t
  misc_feature (618)..(618): n is a, c, g, or t
  misc_feature (627)..(627): n is a, c, g, or t
  misc_feature (648)..(648): n is a, c, g, or t
  misc_feature (651)..(651): n is a, c, g, or t
  misc_feature (711)..(711): n is a, c, g, or t
  misc_feature (740)..(740): n is a, c, g, or t
  misc_feature (745)..(745): n is a, c, g, or t
  misc_feature (767)..(767): n is a, c, g, or t
  misc_feature (770)..(770): n is a, c, g, or t
  misc_feature (786)..(786): n is a, c, g, or t
  misc_feature (788)..(788): n is a, c, g, or t
  misc_feature (840)..(840): n is a, c, g, or t
gggtggcggctggcccagccgggcccccgctnccctctgccctgggcgcttggtcggagcgggctgggcaaagcgggtacagggcgancgcggcggcccgggggctcggaggcgaaaanggcgtccggcaagcncgccccgccaaccgggcttctgganctgcgcgccggggcgggctcgggggccggcggcgaacganggcancgggtgctgctgaatctggcggaagacgtgctgaccgtnaaccccgccgacggcaaccctggtcccgancccggcgctccgcgggaacaagaacccgcgcactcaacnncgccgcggaaccgggcgccgggccccctcaactgccaaangcgctactgctccaacggcgccgcgttacgntgcgcaaagccgacgccggtgggctgggcatcaacatcaaaagcggccgggaaaanaaaattcctattctcatttccaaaatcttcaaaggattagcaactaaccaaanaaaagccctttttgtgggggatgccatcctgtctgttatatggggaatacttatcctctgctacccatgatgaagcgttgcaggtcctcaanaanacangcaangaggtggtgctggaggtcaantatatgaangacgtctcaccgtatttcaanaantctactggtgggacctcggtcggctgggactcacctcctgcctcaccccttcagcggcancttcctcccctggccccacaccccggaanttcancgaggccaaacacatgtccttnaanatggcatatgtctcgnanaggtgcacccccaatgacccggagcccaggtatctggagatctgctcggcanatggtcaa

SEQ ID NO: 567600 - DNA, 741 bp, Homo sapiens
  misc_feature (168)..(168): n is a, c, g, or t
agcgggagactgaagtgagagcccagccctacgctggggttcttaccataatagaggagacggattcagaagggctactgaccacatgtgtgttgcgaaaccagacttattatgatcgtctaaaggattaggcgatctccgaactagggtcgcgaggtatttatactnccattgccgcaaagagaacaagggagcttcctcgtgttctgccgcatcttcctaagcaaggctagtggggtgataatcgaagcagtgatggagtgtgagagaggcagaatatacacgggagaacgaagtacagacctccagcagctagacagctgcaacggggctgtgagtgaaagtgaaggatgtcgcactgatgactcgatcgatgcagttcatctgagactgtgttctgattcgtgagtgatgcatgagtgcaagagcatggagcccctcatgaggaatggggccttatgacccatgcgggacgtatgagcatggggccagatcactgcgtagaaagtgcaagggaactctttgccaagtagcgatcaggtagtgtacatcacctctcgaggttgattggatccctggagacacacacatctgagaggctcattgcaggttcccttggaatttacatccgcacggcgtgggtgcgggtgatagatcgagtggccagtttctctcacaagggttccctagcgctcgcatgggaatggaaggagtcctgtagaatgcattcggggcatattg

SEQ ID NO: 567601 - DNA, 163 bp, Homo sapiens
aagcaggattttcccatttgaaaattcatttgaaggggggtcctgccccctgctaaaagcagttccaactaaattttttggatcaagtccctgaatggaagtatgacgttgggtccctctgaagtttaattttgagttctccttaaaaaaaatttgctttcca

SEQ ID NO: 567602 - DNA, 292 bp, Homo sapiens
aaagcagataatcatcagaactataaacatgaaaagagtgtatgagactagaggatctatactgtgaaaggatcgtaggggatccctatgatgatatacaggaccaatgcttcagaactacaaagactaaagacactagtcaagacagaagaagaggagtgtgcaatgggtggattcatagtagacactgaagtgtgaagccaaggaatccttaagtatgcaagaagcaaagcatgtcctgaggactaacatgaaagaaatggcaggagctgattgtcactaaggggatcct

SEQ ID NO: 567603 - DNA, 473 bp, Homo sapiens
  misc_feature (32)..(32): n is a, c, g, or t
  misc_feature (47)..(47): n is a, c, g, or t
  misc_feature (61)..(61): n is a, c, g, or t
  misc_feature (144)..(144): n is a, c, g, or t
  misc_feature (200)..(200): n is a, c, g, or t
  misc_feature (205)..(205): n is a, c, g, or t
  misc_feature (230)..(230): n is a, c, g, or t
  misc_feature (252)..(252): n is a, c, g, or t
  misc_feature (431)..(431): n is a, c, g, or t
  misc_feature (433)..(433): n is a, c, g, or t
  misc_feature (436)..(436): n is a, c, g, or t
  misc_feature (438)..(438): n is a, c, g, or t
  misc_feature (460)..(460): n is a, c, g, or t
aataatacctcagttttattttctgtggtaanaaacatttaagaacnagagaaaacaaggnacccctgagcacacaaaggcagtacaggccgaccataaggcctcccgggaaagtagcaactgtggaaattacctgccctaggnaggatggatgcactgcctaggagaagacgcaaggttagacttcgccccattttccnaggcnaggcttagcgggaaactgggggccnaaagtgctgcagggtccgcacnaccagagaaagatggtcgagaaagttgataagggaaattcggagcaggcgacagtcttcagctttccagcggacggcccaggatcctgccgctcactgtgagatccttcccaaccaccctttggtggggttcggcatctggagcccagggacccatgggcaatttcccacctctaaggntnttngnaaaggcacgctgagggtgaatnatgtgcggtacca

SEQ ID NO: 567604 - DNA, 108 bp, Homo sapiens
gcggccgcctactactactactactgctcgaattcaagcttctaacgatgtacggggacatgagtttcccaattaaaaaaaaaatgacttcttgtccagtgcaaaaaa

SEQ ID NO: 567605 - DNA, 802 bp, Homo sapiens
gcaattctcccacctcagcctcctgagtagctgggactacaagtgtgcaccaccatgcctggctaatttttgaattttgtagtgatgggatctcgctctgttgcccagggtggtctcgaactcctggcctcaagcgatcctcccactttgggaggccgaggtgggcggatcatgaggtcaggagatcgagaccatcctggctaacacgatgaaacgccgtctctactaaaaatacaaaaaattagccaggcgtggtggtgggcacctgtggtctcagctacttgggaggctgaggcaggagaatggcatgaacccgggaggcagaagttgcagtgagccgagattgcgccactgcactccagcctgggcgacagagtgagactctgtctcaaaaaaaaaaagggtttgggggagatgaggtctgggggctgggtggcgttgcccgggctgtctggaactccggggcttaagcgcatcctcccacctcagcctcccagtgttggatttacagggcttgagccacgtgcgcggctgtcttgtgttaatatgaggtcctctctcccttaacatgagaagctttaaaggtgtggcccaagaatccctcggtcaaggaagcctctgtgggagtggccttacttttcatgatgtccatgatgtggcggctggtggatgtcgccagtgggatccttcatcatcactggcgaaagcatctatgaggctctgggttgaggggatgctcacctgaacctaatgaattaaacctaattctagccatttgatgggctgctcctattatcggtag

SEQ ID NO: 567606 - DNA, 475 bp, Homo sapiens
  misc_feature (218)..(218): n is a, c, g, or t
cacgcagagtagatgcacgagaatttcatgtgagtgatagtgtgcacgagacacatgtgggagagtagcatatgagttgtgagagaaagaggaagagcgcacagcgcggagaaagacacactcgtgagagaccacacacaacacgaggacacgagaatagcgtcgtgatagtgcgagacgcgtctctctgagacaaccactatacgacagacggcgcngcagagagcatcgtgctctccacatatcacacgcggcacaagagacagtgtagcgtgtgacacatatacacacactgttgtcacatagcgtatcacgcgcacatatgatatgcgatatctcgcgctcatacttttgtgagaggacacgagctatacacatctccccgtgtgctctgagatttctctcttttgtgcaggcgcacatcgctgtgtttcacactgtttaaggaagcgggaggattctgagtgcggctctt

SEQ ID NO: 567607 - DNA, 897 bp, Homo sapiens
  misc_feature (96)..(97): n is a, c, g, or t
  misc_feature (128)..(128): n is a, c, g, or t
  misc_feature (135)..(135): n is a, c, g, or t
  misc_feature (157)..(157): n is a, c, g, or t
  misc_feature (160)..(160): n is a, c, g, or t
  misc_feature (164)..(164): n is a, c, g, or t
  misc_feature (188)..(188): n is a, c, g, or t
  misc_feature (195)..(195): n is a, c, g, or t
  misc_feature (520)..(520): n is a, c, g, or t
gcaggaattcggcacgaggagagagactagttctctctcgtttcagtggcttctggtgctctagggtgagctctgcccggctgcagggatggcggnnaggggtaagctcatcgcagtgatcggagacnaggacanggtgactggtttcctgctgggnggnatangggagcttaacaagaaccgccatnccaattntctggtggtgtcaggaaggatacacacactatgcaagtgaggatcgaagagcactttgcggactacatatgtctaaaaccgggatgacatgtggcatcatcctcgatcaaaacagtactagtcgcagaacgtatggtgtcgggaatgcgctggaccgcccacaacagtcagatcgcatcccgcgcatggtccgtggtagagtcccctccaaggagcgatccagtatgacgccggcggggcactccaatggcctcgcggtccagtggtcgaggggcgatgtacacatgcacgtaagcagctgcagccttaggggactacctgcatnagcctctcgagtcattccctacgtatttcccaaggtcctctcgccaggcttggcattgcagcctttctagattgttggagcctctgatgatccgattccctggttctgttctcaactcctattgaagtaggttaggtgaggggtactagggtatggtgggggatctgaaggttgaaggaacaggatgcctgagcattttgcctcgaagtaactcttgcggtggtgctgtttgaccagtgtcaatgtcgatgttcaattgaaaggtcatattcttggtgctgaggaaaaaaaaggggggaaaaagacactttaaaaaaagattttggggggggcgccaaaaagaatttggcaccggggggggggggcccactaagaaa

SEQ ID NO: 567608 - DNA, 892 bp, Homo sapiens
cattgtgtggcacctgagacccgactcccggggtctcgaagacgcgtacggcgccgtgcccgtcgccatgaaccgcattcagaggtgtccaagttccggcacaccgagggtcggacgccccgtccgcgagtcctggatcagtgacgattcgagtcaggaaccgccccttcatgcatggaaccacagtcaaatcaagtctgcagcttgatcgccttcaatctccgaccggtcctggtgtactgggcattgtgcctctgcaaggccaaggagaggacaagcgacgcgtggccagctgggctgcattcagacctagtcaccgaggttggacttctcgcccttgatgacttcctcctggccagaggctcggctgacaggacgggaaaactctggcgacgtgccagggcctggggcagggccctgaccctcaggcagacctgggggtggtgctgggccccgatggacctacccagtggaaggtactgcgagtgccagcccaaactctgatcgggcatgtctggtgagcgcgatgtaggcaccagtgtgaacggtcttgggacgcatccaagacagcaagctcctgacagagctggcgcccatgcgggacctgggtgcccgagcgccgcatggagccgacgatggacgcccgtgggtgagagcacggcggagcataggacaatggcgaggaggcaggaatcgctgagccccaagaaccaacgcggtgggccatcgaccagagcactgcaaggccatgaggcaacggcaaggaaagcgggctggggaagaaaggaccatggggaaagctgaggtaactgggtacaccagacgggtaccgcacacgggaaacagggggagccacgtatcagcagcggctgggcccacgttgggacctgtg

SEQ ID NO: 567609 - DNA, 708 bp, Homo sapiens
  misc_feature (96)..(97): n is a, c, g, or t
  misc_feature (128)..(128): n is a, c, g, or t
  misc_feature (135)..(135): n is a, c, g, or t
  misc_feature (157)..(157): n is a, c, g, or t
  misc_feature (160)..(160): n is a, c, g, or t
  misc_feature (164)..(164): n is a, c, g, or t
  misc_feature (188)..(188): n is a, c, g, or t
  misc_feature (195)..(195): n is a, c, g, or t
gcaggaattcggcacgaggagagagactagttctctctcgtttcagtggcttctggtgctctagggtgagctctgcccggctgcagggatggcggnnaggggtaagctcatcgcagtgatcggagacnaggacanggtgactggtttcctgctgggnggnatangggagcttaacaagaaccgccatnccaattntctggtggtggaaaaagattccacccttaattagaaccaagacccttttcggtaatttctaaaccgggatgacattggcattattcttattaaccagtacattgcaaagatggtgccgcatgccctggacgcccaccagcagtccattcccgctggcctggagaacccttcaaggagcacccatatgacgccgccaaggacttcattctgcgcaaggccagggcatgttcactgtctaagacctgcgctaggggacttcttatagcccttagccctttcctcggttccaggcctcttcccaggctttgccattagccttttttactttttgagcctctgaattctcatttccctgctcctttccacttcatttagaggcttaggtaggcgcttctagggtgctgggggctctgctggtaaggaacacgaagcctgaccattttcttcacaccttttcctgtgctgtacaccatgtcattgttgaggtaaattgtcctatcttggtttttttct

SEQ ID NO: 567610 - DNA, 1013 bp, Homo sapiens
  misc_feature (784)..(784): n is a, c, g, or t
atgtagtacaggaggctcttatgtctccactccagctcgtcctctccgccgtagcgccaggcgtgtcgctcgcctaaccgggttgttgcgccacaattgggcacgattcattcgaaaacttctatcaaacagaacacactacgcatcagtcatcacacgaccaatcgataggccactcatcaccccttccgttaaccatcctacttctaccgtacggcctatatcttacgtccaccgtcaattcacactagctctcccactatctaacgatagcgtaaaaatataaactgccaggtttgaaccagtacaaaatcccacccgcattactccccatgagatcattctgccgcttaccacgctaatccttacctaatcttcccccttttattagctacagtaatcttatttgaaattaagaagaaactttgcccaaaatactttcttcaccaatctcatcgcaggagagggaacatgctgagaaagctgctgacgctgcagaaaccaactaatgttggccggaatcttccgtttgcagggatatcccaggtgaactaaagatcctaggggtgtcgtacttcatccatctgggcagtgtcggggtattccgagagtcccttaaatagaaatgcccttgtaaagtgatgattacgcttggcacccggcttggtgctgggtaggcttgcatctaacactaagtgaggccacgtagtaatgtcccttttggcccccgccggcgtgttacgcatgctggttggggactccaggtgtgggtcacagtcttacncttccgtcgccacccccatgttcgctgtgcacgtgctgtatgcaggcgttggtcacttggccaacgctggtcgccctgggcgcccacgtgcctggaacgagcccttggtatcctggcacttcgtcagggggacccctcgtgtgaccaccatcgacggccaccgtggagttttcagccgcctgaggcggcctggagtcgtcctgtctgcgccgggaacgcgtcggtgctt

SEQ ID NO: 567611 - DNA, 197 bp, Homo sapiens
tagtatcagctcggtaccagtgctactccacaaacaggtatcagaatgtttattgaatacttacaacgaattctcctctgaagaatttcacaatgaccctgataaagtatatattaaattttaatgctttggaaatggatcctattaattcattttctttctttccttctttttttttttttttttttttttggaaa

SEQ ID NO: 567612 - DNA, 371 bp, Homo sapiens
  misc_feature (131)..(131): n is a, c, g, or t
  misc_feature (134)..(134): n is a, c, g, or t
  misc_feature (138)..(138): n is a, c, g, or t
  misc_feature (149)..(149): n is a, c, g, or t
  misc_feature (168)..(168): n is a, c, g, or t
gagggggggccgcggcagctgcgcccccatgaggaggggaggaagatgccggctgagctgctgctgctgctgattgttgccttcgccagccccagctgccaggagctctcttttctgcgcagggttgcaanccnggangaacagacagngttttttttttgcgagcgnctggccttggccttggcccgggagcagatcaccgccatcatcgaggtcccagccaaggcccgagtggaagtagacatctttgagctgcagcgggacagccagtacgagaccacggacaccattgccatggctagaagaatggagttctgtgactccccaaggcctgcatcaggtgccagtccctcctgtgaaccctggactga

SEQ ID NO: 567613 - DNA, 409 bp, Homo sapiens
aagcagttcatacagactcagaactcggggccgggtgtggtggctcacacctgtaatcccagcactttggaggctgaggtgggcggatcacttgcggtcaggagttcaagaccagcctagccaacatggtgaacccccatctccactaaaattacaaaaactagcagggcattgtggtgggcgcctgtaatcccagctgctcaggaggtggaggcaggagaactgcttgaacccagaggcggagaggttgcagtgagccgaaatttgttccactgcactacagcctgggcaacagcgaaactctatatatagtgtgtgtgtgtatgtgtgtagtgtaatgtgtagtgtatgtatgtgtaaacactgtgtgtgtatatatgacagtgtgcctagtgtatgtgtgtgtgta

SEQ ID NO: 567614 - DNA, 193 bp, Homo sapiens
  misc_feature (18)..(18): n is a, c, g, or t
  misc_feature (45)..(45): n is a, c, g, or t
  misc_feature (84)..(84): n is a, c, g, or t
  misc_feature (93)..(93): n is a, c, g, or t
  misc_feature (150)..(150): n is a, c, g, or t
  misc_feature (159)..(159): n is a, c, g, or t
gccggacggacgctcgtnttcgcccgccatggccgagagcgactnggacacggtgacggtgctgcgcaagaagggccctacggncgcccaggncaaatccaagcaggctatcttagcggcacagagacgaggagaagatgtggagacttncaagaaatnggctgctggccagaacaaacaacatttctattac

SEQ ID NO: 567615 - DNA, 107 bp, Homo sapiens
tctatgaggatccacccgtggcgagttcatgcatgtgctgcgcatgagtgtgtgtgctgtgtgagcatgtgtgtgctgtgtgtctgtgggggctgtgtgcatgagtg

SEQ ID NO: 567616 - DNA, 599 bp, Homo sapiens
atggcggtgcggatggtgctgggaaacgatctcgttgcgcatgggtggtagtaggcattgaccgtctgcgggaacatgagccactcgtcgggatccatggggcccgagagtttctcaatggtgcggtcgagttggaatgaattgcaggctagaacggcgtcgaccaggcttccgtcaggtaaccggagtcccgagaaatcgcgccaatgttccgggtagccgatcttcgggcggaaggccgagagcttgtcaagggcttcagctcgggtcgactcgctcatccatgtcagtgtcgagatggactgacgatatgccgccagcaggttggcgacgaggtcgtccattcgctctttggctgctggagggaagtgcctagcggcataaagtttgccgacggcctcggcccatggccgattcaacgaaggagacgccgcgcttccatcgagccttgagcgcaggggtgccgttgaggacacgaccgtaaaagtcgaagttctcatcgacgaaggctgagctgagataggaggccagggaaagatatggcgtgccagcgttgccacgacttccactggtcaaggcgttcgtcgacgagcattccc

SEQ ID NO: 567617 - DNA, 1941 bp, Homo sapiens
atgtaagggagcataaatgaattcctgattactctgtaagctaagaatttaaacatatgttcaggattgtatttttataaaaatttttattgcaaattattaatatagattcacagatgaataaaaaatgatgtggtcctatttatgtaaagcaaaacaaatatttgataggtggtgtagaatgatgtttacacctgccttatggatgatttatgttggaactgctaggcctacgagtcagaatatctacttaccagaaaatcatagaaaaatatgcaagtttatatcactcacactgtggagaaaaccagtcagtaacaaactgttaagtcttaacagtgattataatattgaaaagaacaatatcaacagtagaacaaccatatcaagacagtggatcatgaagcaatgactataggattccctcctaaatttcgttcattgtaacacccacactgtgttctgtctctgtgcacagcacaacaaactcacttcaaagccaaatgaggacttggcatactcaggaaattctagtaatgagatgctcttagttttactgttacagtatgtagcacttcatcttaggcaaatatgacagtctgtggaatcctgtgtcattcatttgaaagaactgacaaaagaacatgtttttagatcaacttgcatttgcaggaacacacatgggttgccaaaaatatccatttagagtgtttaaaagaggcacacgcctggattggcctcggtgaccaataatgtctggtggtaatgcgtgttttttggagtagtctttaattactaaacaaggtggtgacatacataaagccagtgggttttttttccaccggaagatgggtgctaaagaaactgagcgattttatttttttcatcatataatatttctgatggtcttgcctccttcaagtctcaacatgtgtctctttaaagagaatatttcacctttcaaaatgaagtctcctaatgactcacttaaatgtttattgttttcttgccgtaaggaactttgtgacttgtaaatatgaatttatgtatgcatttttgtatgaataaatacatttataaaattgatatttaaaaagagctagcacttaagttaggccagacgtttttctaagcactttacagatgctaattttctaatcctttcaacagccctgaaaagtgactttcatatttaggattgaatataaactcattctaagattgtctataacctatttctgtgttgcttagcatagttctatttaagagaactaagacaaacatatagaaatatgatgatgacaatgatgatattatattactttcccaagtgtctggcactatgcgtatttcaccaagcatttgtagagaagcggcagaatatgatgattatgagcctcaattctggaatgagactaacctggttttaaatcctggctgtgcttcttacaggttgtgtgatttgtggtaagttacttaaattgtctgtgcttcagtttcttcatttgttaaatgtgtatgacacctatttcatagaattgttatacagattacgttaattactaaaaaattatttcgagctcttagaatagggactggcacatattcaatacaaaataagtaataaaatacagaggtatgtatttgaatattcaagacttcttggaaggaaaatacttaatgctgttgaggaaaattttaagcaattagaatggcaactagaagagattttgtaacaaactatagtggattatctcacatatttatccctcattcaggcaactacacatctgagttctctgcttgttactagagctcatggttgctggctccgaatgagaactgaatatgaaaattttcagtttgtgaaaaacatctggagcttttagttgactacaagcttaatatgagccaactgtatgttgcaactgcttaaaagag

SEQ ID NO: 567618 - DNA, 184 bp, Homo sapiens
  misc_feature (15)..(15): n is a, c, g, or t
  misc_feature (18)..(18): n is a, c, g, or t
ctcttcaaggctcantantctcggctggtgaatttcatggaaaattccactttgatcccgttcatctcaatcacgtccgtgctgccagttcttggtctccacggtttgtgggtccagctgtgatctgtcctttgcccatgatcttgtccacgatctcattgttgtccttgttgaccttggtctt

SEQ ID NO: 567619 - DNA, 332 bp, Homo sapiens
catcccctgcactgaaccgtgtcctcaatctggtggttagtcttggcacctgaagctgataggcaggtcaggctgtgctcggggggtgttgagctcgatgtcataggcggcttcttcagttcgtaatctctctgtgccttgcgcatctcgatctcactcaggtactgagcaagacaccttttcctgcttggctttagcttcccggatcccagcatctctcttgggctctgcttctccaatccgtgcatctttttggacttgagccgttcgagccttccccaaagagtgcaaatagtcctggtcatcgtggggggatggagcacccatgggta

SEQ ID NO: 567620 - DNA, 1208 bp, Homo sapiens
tcagtgggggaccagagagcaccgacccgggaggaaggggcggacaggcccgtaaagccgaacatccccctcccagaccacgagagctcgtgcggggcaaagtgaaccgagccgctgggcggatgcaaggtggaacgcccaatgcccgttctcccggccaaagtgaactttaatcagggagtggttggatgcaggagacggggcggcagagacctgctacgaagctggccgcaagatgaatccccagcaacaacgcatggccgctatagggaccgaccaaggagctgagcgacctactggacttcagtgcgactagttttccccagctgttacatagtgggaccaactagaccaagctacactgggaagcagtcaatacagtggatcaggtacttgatgaaagaggaggtacaacatctagggggaacaagtggtcaaccaagtccgttcctatgaattcatcatagaaggtaatacacgacatgccctcattacagtgatcacttgactgacagtccgattaggacggcccatgaagggctggtcccccaaaacactatgcatgaaactcaacattctgcactgggcacacaccattcagaagcagcaggctcaataagcgcctgctacagcaagcagaatactgggaattaccaaggagctggccaaacataacatctaccgtgagaccaagagaactatggggggcataggagaaggcccaggcagcacaggagtatgagtactatcaaggcacacaatcttgggaacaccgaatatacatatgtaccatatatccgcgcataagcaagattccaaggacgcgagaccccaaccaatgcacacattagcaagaagcaaagaagccaatgtgcaagacaaagaaaggaactaaaggggacgcaaaccaggagaaagcgcaaaaaccataacatgctagaagagtgacggacaacaacacaaaaaaactaaagcatatagatctaaaaaacgcgagaagattgtccctacgaaacaaacgcagccagaaaaaccaacaacaacaagaatgatgaaacgcacaaacccaaaacaaagtggcgcggagacgggagaaccaccaaagtaagagcaaaaactaaacaaaaagagaaaaaaacacacacgaaaagacgaaacacgtagagacaaaaagacgaagatgaaacacgagagaacacaaccaaaag

SEQ ID NO: 567621 - DNA, 111 bp, Homo sapiens
tacacatgaggctcttacacatgaggctctacacatgaggctccaataggtttggtcctagcctttctattagctcttagtaagattacacatgtaggctccccgttccag

SEQ ID NO: 567622 - DNA, 113 bp, Homo sapiens
gcctgcggaggagttcctgaaccagagctcgcccttctacttctggtttaatggtgaccgcatcgactccctgctggggaacgacctgcagcagacgcacatgctggatgtca

SEQ ID NO: 567623 - DNA, 176 bp, Homo sapiens
tgtgtccatatggcccttattttacttaataatggcttccaaatgtaagactagtgatgctggcatttccagatatacccaagagaagcttcctttaagtgaaaaggtgacaggtctagatttactagggcaggcaaaaaaatagttgctagatctatggttagaatgaatcttct

SEQ ID NO: 567624 - DNA, 261 bp, Homo sapiens
ggctcactaaacattctactactcaccctcactgcccaagaactatcaaactcctgagtccaacaacttaatatgactagtcttacacaatagcttttatagtaaacatacctctataccgactccacttattactccctaaaacccatgtcgaaacccccatcgctgggtcaatagtacttgccgcagtactcttgtatactacgcggctatggtataatacgcctcacactcattctcaaccccgctgcaaaccaatac

SEQ ID NO: 567625 - DNA, 300 bp, Homo sapiens
  misc_feature (10)..(10): n is a, c, g, or t
  misc_feature (138)..(138): n is a, c, g, or t
  misc_feature (286)..(286): n is a, c, g, or t
cataaatgtntccctgtttttttatggcttatgcagtttgccatccatgacggaacgataccgtatccgcctgtttaggtgtgggcgattgtaacagcacgtcaactgatgtccagacgccctgatttgctgatttgntcatagcctggtaatcgccgccctgtaggctacttgattctatagaaacagaaaaaggcaaacgcagccttttctacattttcagagtaactcccgtcagttgcgagcaaaaaagccgctacgctttagctatacgtgctaatttcangagaagagaccatg

SEQ ID NO: 567626 - DNA, 149 bp, Homo sapiens
tggcaaaaacccaaaaatttttttccgggcccctggggaattttaagggtgatgggaaaaaaagaaccctgagtggaaagaacaaagtttccaatttaccacctgccaattaggggccaaaaaaaagcaaaagattggccggcttttta

SEQ ID NO: 567627 - DNA, 599 bp, Homo sapiens
gctgacctgtgaggaccagaggcccccggtaggagcactgaatgcgagcaagatctgccattggtgtctccattgcccagctcctgcccacactcccgcctgttgccctgtaccagagtcatcatgcctcttgagcagagtgagtcagcacttgcaaggcctgaagaaaggccttgtagtgccctgagtgagaggccctgggcctgtgtgggtgcgcaggcgtcctgctactgaggagcatggagggctgcctcctcctcttctactctatgttgaagtcaccctgtggggaggtgcctgctgcctgagtcaccgagatcctccccagagtcctctagtggagcctccagcctccccactaccatgaactaccctctctggagccaatcctatgagtgactccagcaaccaagaagaggatggggccaatgcaccttccctgacctgtgagtcctgagttccaagcagcactcagtaggaaggtggccgagttggttcattttctgctcctcatgtatcgagccaggtagccggtccctaaggccgaagtgctggggagtgtcgtcggccattggcagtatttctttcctgtgatcttc

SEQ ID NO: 567628 - DNA, 226 bp, Homo sapiens
cgtgactggggaaatccctagctgggagttcaagaccagcccggacaacatggtaaaaccccgtccttactgaaaatacaaaacttagctgggcgcattggcttgcgcctgtagtacttggggggcttagggtaataaaactcagaatgcaatagccaagatttactcatcgaccacgatttactcatcgaccaagatttactcctcggccaagatttactcatcg

SEQ ID NO: 567629 - DNA, 901 bp, Homo sapiens
  misc_feature (225)..(225): n is a, c, g, or t
catgatgcattcgacttttcaatcaccatgggacgtatcctgtaggtagaagttactctaggagttgctaggaccctcgtgcatacgtagctatgctcaccagtggcatcctagatcatctgcggcatatgcaccgtgtgtattactcgcctgctcagcggagagaagttgaaatagtgtgtggacatcctcccactcgtgtctggactactcgagacttggtgntgcgcccgtgcgcgtgctgctttgttgttcgcgagtcctcatgattcgcgccgtcctgctaagcataccaaaccttcgtgatgcgtcgatatgcatttgctgtcgaagcttcgctcaattccagccttgcgcttactttgatggcacagaagcggtagtgggccctgacttccgcgttcctacggagtgtatacttaacaagcccaatgggatgtagtgtgttgggatggcgactatgatctctctcggggcctcctctccctatgcacgttgttattctctcccttgtctccatttcggcctgatctctgtggcactcctggcgtatcgcagctgtgccgtgggcatacgagtcttggagggacgagatggggagcatgtgcttccatgtctcgtctgttgctcccttttggaggtttgtgtggcccttctgtgtggtgtgcggcatatccagaggcataggctcggtaacgttgggaaaggccctacgtctggggatggtctcgtacgtataccacttcctatcgacatctacacgctcaagatctctctcatccacaaggtgctctcaatcgttatgcctcggtccattttctataccccaggagggtcccaactctggcgactcttggggcagccttccaaggctccctaggtgtgttcttggggaagagac

SEQ ID NO: 567630 - DNA, 595 bp, Homo sapiens
cagtgaacccatatcacgaaaaaagatctacctctctatactaatctccctacaaatctccttaattataacattcacagccacagaactaatcatatttaatatcttcttcgaaaccacatttatccccaccttgttatcaatcacccgattgaggcaaccaagccagaacgcctgaacgcaggcacatacttcctaattctacaccctaagtaggctcccttcccctaatcatcgcactgatttacattcacaaaacctaaggctcaataaacattctactactcatctcgatgcccaagaactatcaaatcctgagccaacaattaatatggactagcttacacaatagctttatagtaaagatacctctttagggactccattatgatccctaaagcccatgtcgaagcccccatcgtgggtcaatagtactgtgccgcagtactcttaaaaataggcggctatggtataatagcctcaactcattctcaaccccctgaaaaacaatagcctacccttccttgtactatccctatgaggcataattataacaagctccactgctaagaaaaaagacctaaatcgtcattga

SEQ ID NO: 567631 - DNA, 237 bp, Homo sapiens
  misc_feature (216)..(216): n is a, c, g, or t
attatgttgagctatgatatcttctatgctcagtttacgagggtttgtatcgaggaaaggttgaattgatcaaatgcttttcagcatcaatagaaatgatcatataacttttgtctttcattctgttgatctgatgtacacattgattaatttgagaatgttcaaccatcattgcatccctggtgataaattccactttggtcatagatgaatgantctttttaagtgcgacagtta

SEQ ID NO: 567632 - DNA, 100 bp, Homo sapiens
aattctgatgaacacaaggacattcagagttgtacagtagaagttcattttcaaaagataattgataaggaaggggatgattatgaagtcattcctaaca

SEQ ID NO: 567633 - DNA, 1280 bp, Homo sapiens
gctccccttcaacatgcggacgacggagagatgcagtagaacggtagagtcacactgctgactgtcgtattatgcaagcttctgcctggctgaatttcgctcgtcattcttgtcttagtctcgcctcgccctcctgttttgaattattattacatgcaccgccttgtttttgcatcggcgcatcacacattcgctggtatgcttgcctctcttctggctcctcgtttgattgaattcatctctctcgtgttgtgggttgtatttcctctttctgccgcgcccccctttgtgtgtttggacacctccctgcctaggaaccgtcctggggcgttcttggggcaccgtgtgttcccggggtaagacttttggctctgttgtgggagacgcaacacttttttggtcatctgggtaagtgtttgttccgctgatggtattgtgccttttctgggttactcggcgatatgatcagcttatgggacacagtgggccttggtggaactggccaaatggatgtccccctattgccacccctggttggaagtaactctcctctggtttgtacgtggttattaaaggcgctcgtgtagttatagacctattcccgatagtgttaaatataagatgtcttgtttcccctaatatagacctatggaatatatttaggtaatagatgtattacttggaaacttctgcctttgaccaactgcccaagtctcaatgagcacatgtatccccgtgacccgtaaatccatggaacatccccatgaagaggataaggatgcttaaaatggaaatcattctccaacgatatcccaattggacttgttcacactgctggatatatgctacccataaccccagcccccacttgaaattcttaccattcaagctcctaagagttcttgaatttataactaattttaaaagagaagtttcttcttctggttttaatttgggaatcatccattccattcaaataaatggtacttgtgcgtttatgcgaacagacccacctggcattaccgttggcctttccttcgacggtgggccaccagcctgggccagattgtggccacagtggtggcccatgtaagtcccatccggacgtagtcatgcctcctgcactttcgctaccccgagtttagtaaccacgtgcagactctccaccgtttctgtgttccgatacctctgagaagtgcctgatgttgatgtaccttaccagaccacccagagaccatctttgctataattgtataaagccataaatgtacataaattta

SEQ ID NO: 567634 - DNA, 248 bp, Homo sapiens
gcagcgcgtctgcacaatccttgtcataacatatggtatatcacaatcaatccaaggtgagaacatttcttctaaatagtacatatcacatgttcatactcactgagttgtcccaaaggtgagtgcctataaacttcccagctgtaacatatactgtcaacatctttcttcttgagttcaaactttcttaagcttatatgtttctcgttggatataccagtccaagcctctttgggaaggcacctgca

SEQ ID NO: 567635 - DNA, 158 bp, Homo sapiens
cgcgtaactgccggtacagtttcggttacgccacctgtccgaacctcgaatatcgagacaaggtggtgaaattactcgatccgacgaggatacagtgtacaactgtcagaggagttcaagcttcatcctggccagtacaccgacgccttcgtcgtcca

SEQ ID NO: 567636 - DNA, 160 bp, Homo sapiens
actcatgtacaaggcataactcaataagtcgggcaagttcgttggaatatcacccatgtgcgggaaggcaaatatcaaaccagacaaaataatgttggcccaccaccaactgtgacggaaaaaatatttaaccactaacccacgatgacaatttcttcaa

SEQ ID NO: 567637 - DNA, 92 bp, Homo sapiens
gggtcgacacggccgtgtattactgtgggagtgagaatggcttctcactctttgactactggggccagggaaccctggtcaccgtctcctca

SEQ ID NO: 567638 - DNA, 857 bp, Homo sapiens
aaaaaaatttttgttctttggtagagatggagtctccctctgttgcccagactggtctcgaagctcctgagctcaggtgatcctcctgccgttagcttcccaaagtgtgggattacaggcatgagccattgcagtgggtccagagatgggtatgatgagagcagttgaatgctctcaaaagtgcaaagtgacggtatgtcggtaaatgtctcatactccagaagcacatccagtttacatgttctgtcacattgtagtggggaaggctgaggtaacacatcacgaggaaactcaggagcgatagcaacaggagaccccatgtgagggatcctagtgacatcctacttggaagggctgtccggggagctggggcttgtccagagagccggagccagtccgtagcagctcagaagcatgcgagcctgaggttcttcctctggactcaattactgtgtcactgaaatactttcagtatctcaccagttggacacatttagcggtatgtagtgtgcaagaaatataggccaccaaattatagagagaatctcagatggggttgaaagttcctgcataaaatgccttattaagaaccacacgagcttgtacgaatttccagatgagatttaacaggcactagctacacaatgttgcggcggtctggtgtgtcccatggcttttctgttaaacactccagatgggctgtgaaccctattgaacccccgaaaaagcagtataagaccccatggtgtaggactaccctttgtacaaacttttacaaacaaaaggcacacccttaaacagggctcgtgaaacccctcgtttttatacgccacaaggggataacccagcccatcggg

SEQ ID NO: 567639 - DNA, 327 bp, Homo sapiens
tttatacaggtctgcagatgtagtggagaggatgtgtccacctggatgtccatctgaactgcacctctaatgtcaagtctaacggcaagatacatatcgacagcaagctccatgtgaccctctacaactgctcctttggccgcagagactgcagcctgtgcctgttcctgctaaccccgactacaggtgtgcgtggtgctgtggtgccagagcaggtgcagtagtaatgaggccctgtgcaacaccacctccgagtgcccagccgaccgtcatcaacaggatcttggcctgtgccggatcttggcctcgatgccgagtaccgagctc

SEQ ID NO: 567640 - DNA, 244 bp, Homo sapiens
  misc_feature (86)..(87): n is a, c, g, or t
  misc_feature (92)..(92): n is a, c, g, or t
  misc_feature (112)..(112): n is a, c, g, or t
  misc_feature (118)..(118): n is a, c, g, or t
  misc_feature (132)..(132): n is a, c, g, or t
  misc_feature (148)..(148): n is a, c, g, or t
  misc_feature (150)..(150): n is a, c, g, or t
gacactcacacagatgagaatacttcctgagacgccttgtatgatgcagagctgtcccagatgcagacccacatctcagacacacnngtggntgctatccatggacaacaancgcaanctggactggacagnatcatcgctgaggtcnanggcccaatacgaggagattgctcagaggagccgggctgaaggctgatatccagataccagaccaatttataggagctgtaggtcacagcagtgc

SEQ ID NO: 567641 - DNA, 199 bp, Homo sapiens
ctaagaaattaaaaaaaaaaaggctgtccttcatccccttcccccctaaagactgaattttatttgttttaaaaatgaacttctccccctacccaaaagtaacaaatatggtagtcagttttgtatttaaaaatgtattgggaccagggatgttttcataattttcaaagattatgcatttttcatgaaaacttttgta

SEQ ID NO: 567642 - DNA, 1008 bp, Homo sapiens
gctctagcgcggcggtgcggctcttttccctcgtgactcgtgttgctcctggcgccgcgacggggcctcacggtccgcagtcccgacgaacccctgccggtggtgcgcatcccagtggctctacagctggcagttggaacagctggcagagcaggctggctggaacctccctgaggcctggtgcttggttctgaccctggacctgctagctcggtttctgtgctgctggctggcctggaggtttgaaccgagtctggctgcgccttcacacgtgggcctgtttgggagctgctgctgccctgctaagcctcttcaaggctgggaaggagtctgacgctgcgctgtcggggaccacattctccagtcgagcgctgcgcaacatggaggcgcacagcgtgtgcgaaaggcctctcgtcctaaggggccagctttgccttgacccttgggccatggaagccccggtgtgctggcacgcacttacaggaggctgccgcctgacagtcgttcaggccacaaactgtgcagtctagcaccatccccttcactacttcgcggccgcatgtacgtcatgcgccggagaaacctggccagtggcaaagactctcagttatctcctgctgctgcttcaaccggttcttgcggccagccaagcctggactcccttcctatcccctgcgcccgaggctggtcctttgttctttcgcgaggaattgggccaccaggtgcgggctgtgggccaaccttgtgccgctccttggggcctgtggtgcgggacttggggggaggccacggactgcgtaggatcaggcttgcatgctgtcacgacaggcttcacgcgattgtgcttgtgcgcactccaagggctctgtggcagggcctgaaaagtcaatggatcgcctggagcactctccttcctgggtgtgcatgcaggcagaacactggtgatgaaagtactgggattgtgtgaacgtcttaaagagccaatgcaaggccgttattgagaccctc

SEQ ID NO: 567643 - DNA, 313 bp, Homo sapiens
  misc_feature (12)..(12): n is a, c, g, or t
  misc_feature (56)..(56): n is a, c, g, or t
agggaaacccangataacatacactcaccctgataaagaattaagccttcaagcgnctgcctggtggcccacgtctgtaatcccaccactttgggaagccaaggtgggtggatcacttggggtcaggagttcgagaccagcctggtcaacatgatgaaaccccgtctctactaaaacacacacaaaaaaattagctgggcatcatggcgggtgcctgtggtcccagctactcgggaggctgaggcgggaggatcgcttgaacctaggaggtggaggttgcagtgagttgagattgtgccactgcactccagcc

SEQ ID NO: 567644 - DNA, 891 bp, Homo sapiens
gagactcgcgtcggtggggatcccggacgtaggtagttgtgggccgggttctgaggccttgttctctttacttttcccactctaggccacgatgccgagtaccagacctggaggagttcagccgcgctgccgagaaagctttacctcgcttgaaccctatgaaggcacgtgtggttctcacatataggcatcctgatgggaacttgttgtgtcaaggagtaccaagatgattacgtggtgggtgtataaaacagaccaagctcacgatgtacacgaagattggagaaattccacaagtcaaatattgcgacttatggtagccaaggaagcccgcaatgttaccatggaacactggagtgaactggttgtgaactgaggacttgtgtcggtgtacttagggaaggtaaatatctttggaatagagaatgtgtggggacgagaaggtactttattgtaactaaggtgggcttgtacagaagctaagaggtcatttgtgtaatttcattgaataactttagaggagctagggatggaattgtttcaagtatagaacagcttttatttactttgtgaagtggaacaagaaatggatctggtcttaggaaacgtgggcgatattgggatgtaggtaaacacatgtactggtctcctggcaattgtactcaggacttcgcacatgggtatcaggacaaccacttgttctaaaatcacgtcactttcttaaagacactcaatgtaccttgtgccggctcagtcttgggataaagcttcgggggggccaaaaattaaatggactggatacgccaccatgtcctgtgcatcgggacaatttacggggccattgtgaatgggaacggtggttccaaaccgagagggtgtaggacaatacag

SEQ ID NO: 567645 - DNA, 246 bp, Homo sapiens
tccatgctccatgcattactgatcaatctttacactgctgcagcggatgtaaatggcgttatgcaagaaagtgttaatgtttccattttctgccccattcagaatccaggtggaaagttaacctttctaccacaaaaaaaactcaataaaaaagaacaaaatttttttaaattccccttttttttcaacgcggggctcaaaaaaaaagggtagaaatcagatttgttgggtgttttgctctctttc

SEQ ID NO: 567646 - DNA, 609 bp, Homo sapiens
  misc_feature (176)..(176): n is a, c, g, or t
  misc_feature (223)..(223): n is a, c, g, or t
  misc_feature (236)..(236): n is a, c, g, or t
  misc_feature (257)..(257): n is a, c, g, or t
atcgtttcagggacaatagggctttctagcattcctgactagaactagcagaacggtgtcccagcttatcctgaggtccagtatgtgcattgtgctagatcaccgggaggaccccaggactctctacataggataactcaattcaaatgtgtgcgcctaaagctctggaactggtnttccaaccagctgaccgaactcactgaccagtacaggcatggttatntcaacattaatancatgtcaactggactcctatntgtaaatgttatccatcgcagcaacccagctcatcaggtcattagtcagtttatttctgaaacaagtcaagtcatgcaaaaagtggcggcttaatgcagagagaatccccaggggcccgcacccgtaggatgtaaagtccggcagagggtttccataagcgacaagcagaggcctcggtcttgagagatgtccccggacaacaagaggcggcgtgtcagatcacagggcggaaggccagagatagttttcccattgtcatttgaggcctatggaaagtgagtatttcaaagccttcaagtttacgcgagttgtaattaaaaataaccaacattttcaaagttggtaaattta

SEQ ID NO: 567647 - DNA, 153 bp, Homo sapiens
cagcacctccgcatccgcaccaagcgcctgacccctggggggacggcaaccacactctgttctacaatagccacgttaaccctctgtccacgggttacgaacacccctgaggtcccggacgaccccggacacaataaaggtgtgaggcttcga

SEQ ID NO: 567648 - DNA, 291 bp, Homo sapiens
gtggagaggagacctgggggtagctgctggtgagggtaggtgagcctgcatgttagccgcagtcagcttggacagagagtgggcaagttcgcgtgaagaggctttgctaaccatctcagttaaatagcagtcggcatttcataatcataaagaggtcaattatctaagaagacagagcaatacttaatgtgcatgcacctaacaacaaagcatcataacacgtgaggccaaaaacgatagacccgtgaagagatgcatccactactgtagtaggagacttaaaatccctca

SEQ ID NO: 567649 - DNA, 164 bp, Homo sapiens
  misc_feature (1)..(1): n is a, c, g, or t
ntcagtttctacacggagggctgaggcatagcagtgtagcaggacgagccgcaggcaaaactcttcagtcaccaagttaaagaaggaaggagaaggaagaagaaagtaagaagaaggagaagacggtgacgaaggaagaagaacaactaaggagaaggaagaag

SEQ ID NO: 567650 - DNA, 212 bp, Homo sapiens
tgatacggaatgaacgcgaccaccatcatcgcgccgaacaggatgttggcgccgcgcacccgccatagcgacagggcgtaaccggtgagcgagccgaccaggatggagataacgacagacggcaccaggatgcgcagcgaattgagaaagccgaccttgatgccctggcaggtcagcccagtgcaggccgaggtccaggccttgacccatgc

SEQ ID NO: 567651 - DNA, 357 bp, Homo sapiens
  misc_feature (176)..(176): n is a, c, g, or t
  misc_feature (223)..(223): n is a, c, g, or t
  misc_feature (236)..(236): n is a, c, g, or t
  misc_feature (257)..(257): n is a, c, g, or t
atcgtttcagggacaatagggctttctagcattcctgactagaactagcagaacggtgtcccagcttatcctgaggtccagtatgtgcattgtgctagatcaccgggaggaccccaggactctctacataggataactcaattcaaatgtgtgcgcctaaagctctggaactggtnttccaaccagctgaccgaactcactgaccagtacaggcatggttatntcaacattaatancatgtcaactggactcctatntgttacacgtaatcaatctaagcattcctagcctcagtcagtatataatgtggtttctgtcgaagagactcccagggttttcccactctgaagattatat

SEQ ID NO: 567652 - DNA, 450 bp, Homo sapiens
cacggacgacgagtccttgtgcaagtgtgtgtgccatgtgtagtgctatttacatataagcgctactttagaagtttatcaaagtcatgacttttacaacccgtgtcgaatgctcttctgcattatatgcagcattgcaaatctgcaaagtagtaaaactataaagcacctttaggtttgcaccagttattacagaaatggggatttgtgaaaaggatgtaatttgatgtagaagggcaaagtcctttaatgactggcattcaagaggattacttaaaacaatttgtaagttcatgctaacctcttccctatatttatactactgggacctggggaaggatccatgacatggaagtatcttgagtgtgccttttaaatttgagcattactgctaagaatgttctgtaaaggtgcatagttaagcagctatcccttaactcttggagaaat

SEQ ID NO: 567653 - DNA, 977 bp, Homo sapiens
  misc_feature (41)..(41): n is a, c, g, or t
  misc_feature (48)..(48): n is a, c, g, or t
  misc_feature (51)..(51): n is a, c, g, or t
  misc_feature (64)..(64): n is a, c, g, or t
  misc_feature (121)..(121): n is a, c, g, or t
  misc_feature (156)..(156): n is a, c, g, or t
  misc_feature (171)..(171): n is a, c, g, or t
  misc_feature (337)..(337): n is a, c, g, or t
  misc_feature (339)..(339): n is a, c, g, or t
  misc_feature (392)..(392): n is a, c, g, or t
  misc_feature (396)..(396): n is a, c, g, or t
  misc_feature (399)..(399): n is a, c, g, or t
cacgaggcggcacgaggaaaaacagcaaattccttaatttnggtaatnttnattcttggtcttnttgttcttggaatcgccagcatactctattactatttttcaatggaagcagcaagtntaagtctctccaatctttggtttggattcttgctnggcctcctatgtttncttgataattcatcctttaaaaatgatgtaaaagaagaatcaaccaaatatttgcttctaacatccatagtgttaaggatattgtgctctctggtggagagaatttctggttatgtccgtcatcggcccactttactaaccacagttgaatttctggagcttgttngntttgccattgccagcacaactatgttggtggagaagtctctgagtgtcatttngctngtngtagctctggctatgctgattatgatctgagaatgaaatctattcttagctattccaaacttagtaatttaagcagttctgtcataatataacctcatggaaatcccaaaaatccgatgcttagcgtgtaaaaattgctgataactgatcctaatccctagacacattataaaagaggactttcagtaactgcacaagagggaaaccataaaagaccgggaagcaatgcacgcaaaactacagaacgaacaagatggatgatcgaagcaaacatgagaaatacatcgcataaactaaagaacaacacacggaaaaagcaacaccagaattccaaaggaatacggagactcgcacaacgcaaacacccggaaacaacacaaaaaagaaaaaatacaaagaacaaaccaaaatacacaaaagaaaaagacaagagggaaaagaagaagaaagaaaaaaaaaaacaggacagaacaaaaaggcaaccgaacgtaacgcaacaacacaagaacaaaaaaagagaactaaaaaaagcacgaacaacgaagaagaagagagaggaaagaaaagcgaaaaaaaaa

SEQ ID NO: 567654 - DNA, 491 bp, Homo sapiens
acaggatctattttgcgggcctttccgtccaatatagtaatgatagcaaagcataaccaccgtatgctgacatggagaaagttttagtggtatgaatggaaggataaagcagccacagcattcccttagtccaaatcctaattaagagcaagatctcaaaactcttcggttctatgaaggctgagacaggtgaggaagatacagaagaaaagctggaagctagtagaggttagctcatgagatttaacaaaagaaaccatcgctataacatagaagtacagggtgaagcagcaaatgctgatgtagaagctgcagtaagttatccagaatatctacctacaataattgatgaagatggctactctaaacagattgtcaatggagacaaaacagtcttatgttggcagaagatgacatctaggactttcacagctagagaggaggagtcgatgcctgacttcaaggcttgaagagacagtctgactcttctg

SEQ ID NO: 567655 - DNA, 612 bp, Homo sapiens
  misc_feature (61)..(61): n is a, c, g, or t
tccgtttctcgccccatgaccaaccgtgtaagtttgggcacaataagcttacacaattggntttggtgataacccaattgatttctcacaaaattccccaactatgccatttctaagacggtatccccatgaataagggttaatgaatgttaagaaaattacctggttcaagcttttccattttttcactccccaaatgatttccacctttttcttaaaaggtccattaaaggccttaaaaccttgaatcacggtcattacagtggaccttaagtgtttttctcgggttttggctggcacagttttcatgtcattaaaggaaaattttataaatgcttgaggagaatgagatacatcttgtataggggagagtacaaaaggtatggtggcaagagagaactccttaaaggggcactataatatgtaagtgttaacctaattgccagctttctctatgccatcctggacacagcgatcatattgtgtttcaaataatttatacacattcattaaaacttgagtcatttgtgataaaatggtgtgtgtaaaagtaatgaatctaaaattggtgtggggtgttaaaaggtgtaaaattttcctcatctatatcat

SEQ ID NO: 567656 - DNA, 228 bp, Homo sapiens
  misc_feature (8)..(8): n is a, c, g, or t
  misc_feature (41)..(41): n is a, c, g, or t
ccggccgngcgactacggctgcgagagacgacagaagggtnaccaagaaagagaaatcctctctactaaaaatacaaaagtagtcaggcgtggtggcacatgcctgtaatcccagctactcgggaggctgagggcaggagaatcgcgaacccaggaggtgggggctgtggtgagctgagatcatgccattgcactccagcctgggcaacaaaagtgaaactccatccc

SEQ ID NO: 567657 - DNA, 285 bp, Homo sapiens
catggcagaatatcttatatccctgagctgctttccactaaatgtcagtggtgaccccgatccaattattatgacaactgaacatgcttatgcttccctcatgcctttattttacatggggggaaatcttaacagctacagtatgcgcggatatacatgtgcatacttggtcctgcaattcaaatttctgggaagccaaaagagtctccttggctcagattacgtgattgggactagagcttctcacttcagattctgtcataagattagtggtaaccctaaggg

SEQ ID NO: 567658 - DNA, 316 bp, Homo sapiens
ggggtggaggagggtcctgagagcgaagagggacttaagactcaccggccgtacgccatgatgggccctgtgggtgctgagtgcctctgctgcgtcctgctgaccttcgggttcggtcagagctgacgatgaattaaaagtggatggtacagtagaagaggatctgggtaacaagtagagaaggatcaaggacggatgatgaagtagtacagagagaggaagaagctattcagttggatggattaaatgcatcacaaataagagaacttagagagaagtcggaaaagtttgccttccaagccgcgtagtcagatcg

SEQ ID NO: 567659 - DNA, 342 bp, Homo sapiens
tcctttgggatgatgggccctgctatccccagtttttgccagttggttttttttggagggttgtgggctttttttaaaaaaaaaaagtcctccaatccggaagaaacctccaaggctttgtcctagtggagggggttatcctaaccccccggctggcccccagctggcccctgcctttattccagactgccctcgtcccagctttttgtcccactgttgattattgggttttttttgaaacgccccttttccaaagcccgggggtttccattttcgctttggcccgccccttttgttttttaagctttttgggccccattaaataggacgggctgtttgcca

SEQ ID NO: 567660 - DNA, 301 bp, Homo sapiens
acgctctctctgtggggtactggaggtaggactttaaagatctttttttggccaggcgcagtggcttacgcctgtaatcccagcacttcgggaggccgaggtgggcagatcacgaggtcaagagattgagaccattctggtccacagtgttgaaaccccgtctctactaaaagtacaaaaattagctgggcgtggtggtgcacgcctgtactcccagctactcgggaggctgaggcgggcggatcatgaggtcaggagatcaagaccaccctggctaacacggtgaaaccccatctctact

SEQ ID NO: 567661 - DNA, 106 bp, Homo sapiens
atggctagatgctagcatacaggcaagtcgggggagctacgtcaacctgtccctcaagtcgggggctgtctggcttggtcatcaacctcaggctcaggtgccttcg

SEQ ID NO: 567662 - DNA, 1269 bp, Homo sapiens
cctgcgtcctcgcttcgttcctcgtgcgtttcttgctcgcctgttcttccctctttctgtctgtgttccttatgggctatgtgcctgttgttctctgcttctcctcttccctccgttctcttctatgcttcgtgttgtgccctcttcttgtgctttccttcctctttcttggtgtttctgtcgcgttttcctcctgcttcctgtggccccctccttttcccccttgcttcggcgtcccccccttacagcgtttttgcctcctgttcctctctcgtttcttcttctcttgtttcgttgtttccctttgggtattctcctttctggcctttctttcctgttgtcattctgtgcgcgctttcggtctttgtgtcattgactgggtcttcgtttgtgtcctgcgttgccccctgtcatccttcttcggctcccctttctctttgctcatttcgtcctctccccttgtccctttctttctgtgcgcccttctgtgtcagtaccgtcgctttccccctcttcctctgtttccccgcttgcgtcctactcactcggcgtatcgtgcgtctcggctcaggttatgttcctctggggtcttagggtcgtggagtgatgtcccctggggttctcatccctcgggcacatctcgctggccatcgccggcgtccatttcttctgtcttgtgcatcgctaaggagatacgtcatcagtagcccagggccttctgtcagctcgtttgtagccttctgcggctggccttgtgggcgggatctggggatgctgggtctctaccatccctcccattagtagctttatccagtccccgtttttgctgcttctcagggcctctgctcttcaaggcccccatggggctgtccatccatgtgctctgcctacggaaggggcttaatgcatgcgcctgcccctccctccagctgtttttaatgcaactgactagaatagactctgatcccggcaggactgtgatagccagagcctgagcctgcccagcctagcacccaagatctcaggagctttagggagaagacttggtggtgggctggagcacaccgtgggcactcagtggtgttctgtgctcctctgtggtgccacagtgcttctgggcagtgcaggcgggctgccaggcccagccctgacttccacatctggcgtcagcaacactggttatttatgtggggccgtgcaggcatgggcaccactgcactgtccatcctgtttctcttatttattgaaactcaccaggcacctatacct

SEQ ID NO: 567663 - DNA, 181 bp, Homo sapiens
aggactcatatatgctgtctcactatgttgcccaggctggtctccaactcctgggcttaagcaatcctcccacagtggtctcccaaagtgctgggattacagacgcgagccaccatgcccagcctttattattattattattattttgaaacaaggcctcgctctgtcttccaggctggaa

SEQ ID NO: 567664 - DNA, 442 bp, Homo sapiens
ctaaaaacaccgcaactccaaacttttttttcaagataggttattctatctccatatgcaataaggatcatgtatccaatttctgcaaagaagtcagctggaatattgatagggataatgttgaatctgtagatcaatttgggactaagtgtcatattaacaaatattacatcttctgattcattaccatgggatatctttctgtatatgtaggtcttttaaaacttctctacaggaatgtataatcactgtcagaggataagttttgcacttattaaaaacacgtaagctaagttagccattccccaaaattatatgagcatggtaactcccgaaatactgtggcataacaagattaatttcccttaatggcacagcatatactgggccccgacatactttagaatcaagtctagaattcacgagaatacaggctgcagca

SEQ ID NO: 567665 - DNA, 740 bp, Homo sapiens
gagttcatggcagtagcttgtaagagttcttctatatataagatcatgttgtctgcaagcgggaacagcttaacttcctccttcccgattggatgcccttatatttctgtgtctgtcgctaatagcttggctcaggctgaggacttccagtactagtgttcagtaggagtggtgatagtaggcatccttgagtgttccagcatcttagaggaaaagctttaagagatgtcccccatgtgcatctaattaaactgaaagagcttctgcacagctagaagaaacgtaccatcagagtgaacaggcaacctacagaatgggagaacaattttgcaatctgaccgatctgacaaagggctaattatccaggaatctacaaagaacttaaacaaatttacaaggacaaacacatttcatacagcccatggacatactctgccatcactcacagtttgctcgcgaggcctcagtcgcacccgggaagaaggggcggcccgaaggaacgaaggtatggatgcgcccggggccccccagtggcatcagtgacccctccggtcaaaccggttggccggtcccagaggaacgatcgtggcacaggcaaacaacgccgcgagacacacacccggggatgcaaagcgcccccggcgcaccacgccacggtgtcttcaaagacctcgaggcgggactcaccgccacccgcgggcaccttaccagagcagcgcccagcacactgcggacatccg

SEQ ID NO: 567666 - DNA, 888 bp, Homo sapiens
  misc_feature (3)..(3): n is a, c, g, or t
  misc_feature (5)..(5): n is a, c, g, or t
cantnccacataaggagaaagcatggcgcaggaggcagcgagacaaaagggaacgcgacacaagacagagtcgagccttcctccggaaacaccccctaaagcaggccctcttgagcccccatttctcggcccccagggcaccctggaaatcacggcaactgtcgaaattcgggaacgcaaatgggggggccaaaacctaaagggggctccaatacagccgaatgctggcccccgaccaagaaggccaattcctgggcaaaaacgattagtggccaggtctgcgcagaaccaccaagaaaggtgctcccgtcgtcatgaacaagcccgttatgtttacgtggcttttccgcgcaaagtgtttgcgccccgtgatgacgcgatcgagtctcttaaccccgtttgcctggtaacctaaggctcaggaaataacatggcagagggttcaactacgagaaaaaatatgaccccgtcttgccaaatcggaacacacagggaggcttgcgtctaaatatagggaaacaacttgtgcgtggagagcgcctcttttaaaatagcgttttttttatggagacgactccagcaaaggtctgttgaaacaggagcgatcacaatctgcgtcgagaatggcgcgccctcgccaatatgcgttctataagattccgctctcggcagaacgggggtcatgatcccgagtccctggtcgaacactaatagttcctatcaccatgttccggcaccacgagaacacatttctttctatgagtatccttgcgatctgcaaatcagtcaagaccgcccataaaaatgcctcgctagggcgcaccagttgctcccgcaagccaccccaaaggaaaaatttgttcccacaaaaaaatccaattttcaaat

SEQ ID NO: 567667 - DNA, 112 bp, Homo sapiens
gtgtgacagatgctactgagaccaccatcaccattagctggagaacgcaagactgagacgatcactggcttccaagttgatgccggtccagccaatggccagactccaatcc

SEQ ID NO: 567668 - DNA, 114 bp, Homo sapiens
  misc_feature (3)..(3): n is a, c, g, or t
agnagaccatcctcctgaaccacaccttcaacgagacgcagattgattgtttctcgcgctggcagtgccctcaacagaatgaaggagctgcaacagtgagggcagtgcctcccc

SEQ ID NO: 567669 - DNA, 177 bp, Homo sapiens
  misc_feature (29)..(29): n is a, c, g, or t
  misc_feature (31)..(31): n is a, c, g, or t
tgtcaacaaaactagttcctggtgcttgnanagccagtgctgcaggtgtgagcggaagatcccaactgaaggtaatgagagactgcagctctaaagccctttcttaaggagatcgggttggaaagctaactcagctgtatttattgtttaaatagaaataaacccagtgttgcttgc

SEQ ID NO: 567670 - DNA, 316 bp, Homo sapiens
cccttgaggtcagccggggcttgcgttggatgaaagcgggtgactgatctagccgctgaatcttctccgagatcgaactcctgcatggtctctctgccctcctccacctggtacttggcagttggagagaatcagtggagtcaggtcccgctccacttcataactgatgacatgcagttcagtgacctcgggggcatccacggaatagctgttgttttccttggagagtttttccacggcgtagaacaatttcatggtgtaggcgaatcaagtagctgacgagaacggtagcaacagatggcccaggcacccggtc

SEQ ID NO: 567671 - DNA, 526 bp, Homo sapiens
tggatcattcctttggtgccattctcacaatagtaagtttcatgagagctggttatctacaagtgcgtagcatttcccccctgcccttgcacttaccatgtgatgtgcaagcaccggatttatttttcaccttgattgtcagttgtcagaggcttcaccagaagcagaagccagtgctatgctttctgtacagcctgtagaaccataagccaatgaaacctatttcctttataaattaactagtcaccgattatttttacagcaatgtgagaatggcctaatatatccatcaaaaaactattagaagtaataacttgagtaaatttgcataagacaaaatcaacatgtacaaatcagtaggatttctatatgccaacagtcaacaaactggaaaagaattcaaaaaagtaatcctatttgcaatagccacgaataaaacaaaatgtgtgggaatttaccaaagaaataaaagttctcaacaattaaaaatgtaaaacactgataaaagaaagagaagacaaaaaag

SEQ ID NO: 567672 - DNA, 169 bp, Homo sapiens
aattccctacagtcgatctactgagtcaaagtacggctagccctctggccctggttcatgcctttgaattcaactaactgtggatcaaaaatatttggaaaaaaaattccagtaagttccttgtgccccagcaactatttatatagcatttacattgtattaggtcttg

SEQ ID NO: 567673 - DNA, 355 bp, Homo sapiens
actacatacttccggggggccggggctgccgtgggagagttcggttgctgcggcggggccggcacgttgacggtgggaaactcggataacaagctcacatcttcctgtgggaaaccttctagcaagaggaggagtctgcaggggactgcagtcgccaccttcctctatgcgggggtctttgtcgtgttgcttctctgcattcccttcatatctcctaagagatggcagaagatgttcaagtcccggctggtggagtagtgagtgtcctatggcgagatcttctttgtggttctcatggtcatcgctgtgcagttggtcatcgatgccgtgcgcgaaatacggaagtatgtagtcg

SEQ ID NO: 567674 - DNA, 145 bp, Homo sapiens
ggggggggggggggggaaaaggcccaatttgggggggggggggtttcccccccccccccggggggggggggggggggggaattcttttttccccctttggggggcgcggggtttggggaattaaaaaaaaccgggggccccttta

SEQ ID NO: 567675 - DNA, 884 bp, Homo sapiens
  misc_feature (44)..(44): n is a, c, g, or t
  misc_feature (73)..(73): n is a, c, g, or t
  misc_feature (77)..(77): n is a, c, g, or t
  misc_feature (130)..(130): n is a, c, g, or t
  misc_feature (250)..(250): n is a, c, g, or t
  misc_feature (262)..(262): n is a, c, g, or t
  misc_feature (266)..(266): n is a, c, g, or t
  misc_feature (281)..(282): n is a, c, g, or t
  misc_feature (284)..(284): n is a, c, g, or t
  misc_feature (318)..(318): n is a, c, g, or t
  misc_feature (479)..(479): n is a, c, g, or t
  misc_feature (603)..(605): n is a, c, g, or t
  misc_feature (620)..(620): n is a, c, g, or t
  misc_feature (640)..(640): n is a, c, g, or t
  misc_feature (642)..(642): n is a, c, g, or t
  misc_feature (644)..(645): n is a, c, g, or t
  misc_feature (671)..(671): n is a, c, g, or t
  misc_feature (673)..(673): n is a, c, g, or t
  misc_feature (690)..(690): n is a, c, g, or t
  misc_feature (702)..(702): n is a, c, g, or t
  misc_feature (759)..(759): n is a, c, g, or t
  misc_feature (781)..(781): n is a, c, g, or t
  misc_feature (794)..(794): n is a, c, g, or t
  misc_feature (823)..(823): n is a, c, g, or t
  misc_feature (841)..(841): n is a, c, g, or t
aaacttccacattcaaaagaaagactaaaccatgcacaaatganccctttctgtttcctttaacatacaaganagtnatttcatgaaatttattataactgttatttctggccaggcgcagtggctcacncctgtaatcccagcactttgggaggccaaggcacacagatcacgagatcaggagttccaagaccagcctggccaacatagtgaaaccccatctctactaaaaatacaaaaaaaaaaattngccaggcgtgcnggcnggcttgctggcaggnncntgcaatcccagctactcgggaggctgcggcaggngaatcacttgaacctgggaggtggaagttgcagtgagcagagatcgcgccattgcactccagcctaggtgacagagcaagactctgtcccaaaaaaaaaaaaaaactgttatttctgtccaattccaagcaaccaaagtacttcatgtcattaaatatgtntgtgtaacacacatacacatacatatatacatatagatattcaccaaaccattattcaactatctggccacttcattctactcaaaatgcagatccttagcaaaatttttgacagaaaaaaatnnnttctggggtggtggngttggcttgttgggtgttantngnngttttccacagttaaggggacatctnanttcttaattaaatcccntctactcttacntttccccaaattcaaactataatatcatttttcaatataatatcaatttaaaatcancaaataaattttcaatcaaaantcaaattttcacntacaaaaacaataaaaaataatacaaacntacctacaacaaataatntttaattaacaaaatcacacatttttacccataaacataattc

SEQ ID NO: 567676 - DNA, 234 bp, Homo sapiens
gtacgctctaacccaacatattggaacgaatcccagaacttaaagattggttctctaaaataagacagacaaaaataaaaaagaataaaacggaaggaagaaaacctccaataagtatggggttatatatagaggccaattctacaaatcactggcatccctgaaaggagggtggagatatcaatgcattgggttagagcatgctcatttagctctgtcaaatttgttataccc

SEQ ID NO: 567677 - DNA, 147 bp, Homo sapiens
aaaacgcttaagctaagcacaaccccacgggaaacagcagtgattaacctttaacaattaacgaaagtttaactaagctataataaacccagggttggtccatttcgtggcaggcaacggggtcacacgattaacccaagttcatag

SEQ ID NO: 567678 - DNA, 350 bp, Homo sapiens
  misc_feature (165)..(165): n is a, c, g, or t
  misc_feature (248)..(248): n is a, c, g, or t
ttaatggtattcaatgtaacatttttagaaagttatcttagcccagtgcaataggaatattttttggttacatacataaggggattaagactcaggctataaggcctgggtatggtggctcatgcctataatcccagcactttgggaggctgagacaagagaatngcttgagcccaggagtttgagaccagcctgggcaacatagtgagaccccgtctctaacaaaactaaaattagctggtcatgtnggtgcacatctgtagttccagttactcaggaggctgaggtgggaggatttcttgagtccaggagatcaaggctgtagtgagctgtgattgccccaggcaaca

SEQ ID NO: 567679 - DNA, 607 bp, Homo sapiens
gagcggggaggccgcgctcttgagatggccgtcgggctcctgctccccgctggcgccccggctgagtggcccgccagccgggcacctggctgccaccgctgcgttcctggcactagcacgggacacggtcagggagcggcgggccgcggccttgcgcgcgccgtctctcggggctgggcaccgtggccccttccgggggactgggccccggcgcccgcgtcggcctgtgctgtgcccggcccctcccctgctcggggcggggcgctgcggccggtgtccccgcccgtcaggtccggcccggctcggctgtgccgcaggaacagggccctgggcggccggcacatgagagctttacgcccggaggcggtcgggcgctgccagcttggacccgcgaccggggaacgggggctgaaaagggcggcgggaacccattgttcttccctcaagcccgggccagaagccaggcattcaagggtcctagcgtccgtggcagccggcgccagacgtgacgaatcacggatcagcctccggaaccgggcgataagaagatggaggccaggccttgacggccggagacaagggcgaaaatgaggcgccggggggacgg

SEQ ID NO: 567680 - DNA, 172 bp, Homo sapiens
gcgcacctatgcaggccggtgtagcctggctgctctagacactcctctggctcgatgacaccctctcttcggactgcctgcgttaggaagggagaacctgccagttctctcagaagaaaatgtagctctattataagataggcaagacagtcaagtagttacgggaggtagg

SEQ ID NO: 567681 - DNA, 527 bp, Homo sapiens
  misc_feature (38)..(38): n is a, c, g, or t
  misc_feature (520)..(520): n is a, c, g, or t
tgaaagaagttagtgactagtgaagttcacagagctanagagttgtaggactgaacaagaatctaagacgagattcctagcagaggtcttttatgagagcacattgcctctcagaataatggagctggagaagtgcacagggttgccgcctctgtatcctgccctctccatagaccagacacaccccagagcatatctgggcggttaggctttgaagtgagtcttgtgagtcctctctgctgataatagctgtctacttggaccttaataagccagttcataagatgtactgcaggccacttcatcgtttcctaagccatatctgtagtatcatgtgcttttccattcagacctgtttgtctccagatatctttaaccactgcattagaacaaactttggagcgtgtatccataatatatgtatttgttaataaattatattcatgcactaatatgtatttatattatgtattttatgaagcatagaaaaagttgaaataaaaaggcatttgataaaaanaaatata

SEQ ID NO: 567682 - DNA, 367 bp, Homo sapiens
  misc_feature (13)..(13): n is a, c, g, or t
gcaggaggggaanagcatctctcccaacccccattcccctccacacctttcaaacagccattctgtcactgcctctgtggggaacccgacagccggtgcctgcctcggtcactggtccgggtgggcatcataagactttgctaacccccttgtcttgggctggacgctccaagggctgaacttggttctgccctagtcagtcgggaatgttccttgaatggctaccaccaggagttccttcagggactatttatctcttggacctaaccccactgcaatccaagacttttgttagccgccaccctcactcagaggggatgaagcaagggctgagaccacttaagccctaggtgcctggaggccagcc

SEQ ID NO: 567683 - DNA, 461 bp, Homo sapiens
  misc_feature (16)..(16): n is a, c, g, or t
  misc_feature (58)..(58): n is a, c, g, or t
  misc_feature (75)..(75): n is a, c, g, or t
  misc_feature (81)..(81): n is a, c, g, or t
  misc_feature (259)..(259): n is a, c, g, or t
  misc_feature (294)..(294): n is a, c, g, or t
  misc_feature (371)..(371): n is a, c, g, or t
  misc_feature (379)..(379): n is a, c, g, or t
  misc_feature (413)..(414): n is a, c, g, or t
  misc_feature (443)..(443): n is a, c, g, or t
ccccttttcctcatgncattaacgagaaagagatgaaaataaagatgacagctccagngacaagctacgtggagnctggtncaggtccttttagtgagtctaccattaccatttccctgtatattccctctgaacagcaatttgatccacccaggcctttagagtcagatgtcttcattgaagatagagccgaaatgactgtgtttgtacggtctttcgatggattttctagtgcccaaaagaatcaagaacaactttngacattagcaagcattttaggggaaagatggaaangttttcgaatgagaagggtttactacaactgcaggctacaacagccctgtcaaattgctttaattagaaatactgangtggtggnagggattccaaaaaaattgaaccccacccaaagnnaaacgaattgagaaaaatgaaaggaagtnctgcttgtccagaggcaa

SEQ ID NO: 567684 - DNA, 1739 bp, Homo sapiens
  misc_feature (1056)..(1056): n is a, c, g, or t
ccttccgtggtgaaggctgctttttgagtgtggtgagaaggcctttcgttcttgtcgcctctcgtggggggcaccacatacactttggtggggcgctcactttctgacatacagtggtcgtcacaatgctgatgattgtggtgttcgtcctctatgttagacatacggggagaaattcagtgttgagctgattttgctgctggggggctacattactgtgattttagcccttgtggtggggatctacgacgtctgcctaattatgatttggggtagcgtctccatccttcctacatctggggcgaaaacttagctagcagtcctttggggtgcactgtttcttctacgtctggtggcgctcttctcaatacggcgtgtatgaattctatattgtctccgtccgtggtggtgagccacaactgtgcatcattagggggtcctcccactacatgtgttaatagtgacgcgtgcctacgagcggggcctataaatattggcctgcccccgccttggtgttgatattgtcggtggaaagtattgtgtgcgatgcatcatcgcagcgcgaggggctgcattgcaagagactaatgttgtgggtactagactttggccaagcaagcaggcttattgtgtccccttgggaaggagcctccttctaataagtgtgcgagaataataataggtacgtcgtttgggaagtgttgtcgccccgccggctttgttatctgtggcggcttatgaataaacataagtcccgtgggggaaaaaaagaatattggggtcccccgcgtgtcataggaattgtgttttctgtctgggaataaaaggttatctttcgtgtggctgcaggatatcaatggtgccgatctggtggcaccacatatgttggggggtgtaggaacgatgaatatatgggggtgttctcctgtgggggcaacataagcggcccaacagtggggtgggttggtgttctggagtagagagcggttgttgtgtgctactaggagctttattgatcgtccagcccgcggctgttgtgtggagtttcttcagcgnctttgttaggcgcgtggtgtttttctcggcgtcgacgatactatcgtagaggatgctgatagaagacctacctagtgttgttcgcctcggcgttgtggtggtggtgtgtgtcatctcgtctagatagaggacaactagtgtgtggaaccacagcagatgaaaagtggtccttgtggtacttcttgggagtagtctttggggggcacatggtggtgtcacgcacacaagttgtcttgtgtcacgcctacagagaaaagagtcgtttctacagaagagaggtcttatatactgtgagatagatgtgaagtgtctccctgagatgagacctcgcgacactccgccacacttcttatataacacagtgtggtggggataagaacacggtgtcttcacagagagctcgttgttgtgtgtgtcacacttggcgcccacttgtaaagtgtgttaagttaagtataaaagagactggtgtaaatgatagacacaatgcactcgtgaaaaccttcacgaaaggaaaaggaggaaatgtttctgtgggagccacctcttggtctttcttttttgcgctggtggcacgctctgtaacgttaattagttttctaaaatcagtactttttaatggaaacaacttggcccttaatttgtcacagaattttgagacccctttaaaaagttaaaagaga

SEQ ID NO: 567685 - DNA, 148 bp, Homo sapiens
  misc_feature (103)..(103): n is a, c, g, or t
cggctgaccgtgattatttctagcttcttagaaacggaatatcttgtggtgctgctgataaaactccttgacctgacgactgtctaagtcctaactgcatatntatattcccatagtaagagtgttgggagatagtgtttgagctttt

SEQ ID NO: 567686 - DNA, 176 bp, Homo sapiens
ttttgggggggggggggggggggttttgggggccttcccccccccccccccccccccttttggggggggcccggggggcccttttttttgggggccccccccccccccccccccgtttttccccggggggggggccccccttttttttttttttttttttttaaaaaaggggggga

SEQ ID NO: 567687 - DNA, 697 bp, Homo sapiens
  misc_feature (39)..(39): n is a, c, g, or t
agcggaggtctgcctggaatagcctggctactacccctncacctgttcccctgcatgtccccaggcgctctctggcctgaatctgcctctctctgccatcttgtctcctgtccctccgaggagtctcgtctgccgtcaagcgactctctctgcccgttcatctctctgagctggtgtgtctggtcctgaccctcgtgtttggggagctgtctgggtctgttccccacctcttggccagcctgtgtctcctgtctatgactgagccgcaattgcctgttgcctattctgcaggtgtttgccgacgagccgtatccgcgtacccgacctgtgggtcttctgagtctgtctgtgtgtccctttctccctgtctctgactgtcttccataggctcccctagcatcccctcctcccggccatctgtctttgctgtcccgttctgtggtctgtctgttccgtgtgctggtgctcatgcctgctttctttgtaacttcagttctcctactgctctctctgtgctcctctctgcgaccgtttttctgccatgccatcccatacctgctgtccgtctgctctgctgagtccatcccctcagtctgctgtcagtcgtctcatagctgtgggtctacaccctcaatctttcaggccatttgccccaacatcaacgcagaaaccaaaccgctgtctccctccaagaggc

SEQ ID NO: 567688 - DNA, 226 bp, Homo sapiens
tatggggttaggaagggggctttggtatgtctaatatttaaccaagtcactagagatgatgacccaggctagaaagtcctgattggggggcagatggccaaatgagtatatcccctctccgtggaatctccagggcacctccttgaatctccggagcatgggaaatataccatccggccctcaggattgtgtatgggagccccttgaggggaagataccgttattt

SEQ ID NO: 567689 - DNA, 213 bp, Homo sapiens
ctgggtctgtgttaatcatgttattaaatgctaatagagcaaaatctagcagcccactggaatacattctattaaactctcatctgcgtgggacactgggtgatatttgacagtgactgttccaccttgcgggtttgttcggtttctttattaaagtgtacacgtattaaaaaataaaacatagctttagttaaaacactaagctgaattagt

SEQ ID NO: 567690 - DNA, 599 bp, Homo sapiens
atcaagtatctttatcaattattggaaaatcaatagaagtgggttagcaaatggaaataaatgaatggcaactaggtatctggttaaacaggtatgtttgcttcatatcagttgaggcacttaagtatagtacatgatataatcatattaataaacaataattagactggaatattataaattatttgcacttgtaagcattccccaaatttgcaaatttttatacacatgcagtgctctgatagcaaactcagtagcatgaaggaaagagatagagactgtattttctatgtatttacatttctaatgcctcttggctgaaattatcttgtgacttcctatgaggaaggccctgcaaatgacatccctaattttttttgagacccttttctccttgaattctgtgacgctactctctgctagttttccccctgcctctcttccttcactttctgccttttgaacattactgttcttctgagggctgttctcatcccaatttttatctgttctgttctttttggttccacagctttcattgtgatttaagtgtcacccacccgagtccagacccttctcccaagccctaaatcatgagt

SEQ ID NO: 567691 - DNA, 454 bp, Homo sapiens
  misc_feature (1)..(1): n is a, c, g, or t
  misc_feature (117)..(117): n is a, c, g, or t
ntccggaactcctgtcagtcagatgttgggccttttggatagattcctgtgagtccttcttttctaccttttgcttgtagataagattttccttgaatccaaacacacacactctcnctgctttttaaaaaattagttttggggctggatgtagtggcttacacctgtagtcccaggcactttgggaggccgaggcaggcagatcacttgaggtcaggagttccagaccagcctggccaacatggtgaaaccccgtctctactaaaaatacaaaaagtagctgaatgtggtggtgtgcacctgtggtcccggctgctcaggaggctgaggcaggagactggcttgaacccgggtggcggaggttgcagtgagccgagatcacaccactgtactccagcctggtgacagagccagactgttttaaaataaataaaaataaaaaattggttttgga

SEQ ID NO: 567692 - DNA, 166 bp, Homo sapiens
ccagaccttttacaagttaactctttcaagccttcatgggatataattctgacactactctcactttgtcaaagaataagaaagaggaataacttctgaactatctttacacaatcagtataatactgataggaaactgactagttcagcaaaggaaacgagtaga

SEQ ID NO: 567693 - DNA, 239 bp, Homo sapiens
  misc_feature (29)..(29): n is a, c, g, or t
  misc_feature (202)..(202): n is a, c, g, or t
  misc_feature (227)..(227): n is a, c, g, or t
tggcatttgtggaaactacctaaagaagntagaaccatgtttactgggggcaggagggtgcacatgctccagttgaatatctgtgtatacttaaaattgtaatcaagttgagagggcaaagcagagctattgcccctcgaccctaagtgacctctctttgaaggatagggccaaagaagacaaagcctttaccactgtttgntgccctcttttgcttataaaggggnaggcattatata

SEQ ID NO: 567694 - DNA, 1049 bp, Homo sapiens
tttttttttttaacttgaggagggtgacgggcggggtgtacgcgcttcagggcccggtttcaacttaagcacttcttacttcttcagttttacgtgcttaaactccacctttcgaccctttaagttttcataagggcatatcgatagttattcgtggggttagaaaagtgtagccacatttcttgccaccttcagtgggcctaacaccttggacctaagcggtcttatacggtgggtactgtggcgcttacttgtggtagcccttacatcagggattgtggctgaagaatgggcggtattttagggcgtgagccaagaagggtggctgaaggtgtgactcggggatttatcgaattacaggaacaggcctccttctagaaggggatttgaagccaccgccagggtccttgtgagcttttaagcctgggggcctcgataggtgctcctgggagaggcagtttgggtgggattataactggttgaggttatagggactaagcataggggggtatctaatcccagttgggggtcttagcatatgggtggtgttccggactttgttaaaagccactttcgtagtctattggggtggtcaatgggagttttttaacaactcagggtgagttttagcttaatgggggaggggggtgatcttaaaaactcttttacgccggcttctatggactgggggtaactcggtgttgacgcgggtgggtgtgcgaaatttggccaaaccggggggtaagtaaaggtaagtttaaactttggttatgggtaagggtaatcactggcggttccagagggggtgtggtaaggtataggtttgaacatgattgcgggtgctgaaagcttgtcccttgggacgggggggataacaggggtgaacaaatgggaacgggaaattgtgacttgttagggtaatcagagagttaagaaggaggaagtaatagatgagaagagggattaaatttctcggggccactttgtaatcccgttttgtaaagggtcatgaaggagttattaaagaaggggcttaaagtcgggaatcg

SEQ ID NO: 567695 - DNA, 330 bp, Homo sapiens
atggcacctgtacatttgtggcgctatgagcaacgtggagcccccgtggagctggcaagcgcgaagaaccagttcgagtagtggactacattgtgagctgtgatgaatcgtgcctgataatttgaattccctcccgaattctagtgatcatgacatggctctggtgtggatggatgaaggagtgcgtgccatggcacgtaacgctccatgcgagtaccagttgattgactgtgcccagtactacctggacaagatcgacgtgatcaagcaggctgactatgtgccgagcgatcaggtcctgcttcgctgccgtgtcctgacttctggaat

SEQ ID NO: 567696 - DNA, 241 bp, Homo sapiens
tgaggatcctcgtctgcgtcagactcccgagggggtgggactgcagcttccggccaccgcgcctggctaatgtttatatttttagtacagatgaggtttcaccagtgtggccaggctgatctcgaactcctgacctcaagcgatccacctgcctgggcctcccaaccctgagggttttggtttttgttttggttttgagacagagtcttgctctgtcgcccaggctggagggggccgcgcg

SEQ ID NO: 567697 - DNA, 1017 bp, Homo sapiens
ggtccaacattgcggtgcccatcggagggtgtaacggagtcagcgcgagcttgtggtgccgcgctgtctcctagtgggccgtggactctaagtgctcgtgcgcgtaggcggtgtccgatcccacggactggtggacgtatgtacgtgtcgtgcccggacggacgtcgtgcattccttctcccataacgtgggccctgagtgacaaaatatactgtgtatgttctacttacgactctcctcaaagtgtagggaccgaattgaggctaatggaagagtatgcatgtcgtgcgcgtgaccgatcggaagacccagcagaccatttcacacttgatgccaactcttgggaggccccaagccgtgaatgtcctcatctgtactcttcgaccacaagttcaaggcaagtcggtgcagagcgcctgagcattgcatgtacgccatgagctacctcgtaatgcctgatcttgaatgggcactgtgatgtccctcttaaaatttgagggaactattgaatgtcgacccacaacaggcatttggctcgacaggtgcccggggagcatcaaaggctaaaactgtccaacgcatggatgagttgtggtcacatggcgatctggcactgatctgtgaccagcatgccatgcttgtgggtggcaccttctgcatctccggtgaatgcctaaggggtctgttttccctgacagggccagcacatcactggttgtctaggcagggactcttgagtctgtctagctgggactgacgtttgccttgtgccggagaggcttgcatgtgtgtgaatgcctggggcagagaaccagagggtccctggcctcctgagtcccaaaaggttcagtcccacttctgcttaggctcttctggatcaggatcgcaaatccgcgccaagcggtggcactgggtctcctctgggaaaaactgtcccgacttcaaaaattaaaaccggaaggttccttgtccgggccctcaaaaggggagaaagtcttaaaaagagaaaaaggtttg

SEQ ID NO: 567698 - DNA, 629 bp, Homo sapiens
gaatttttataaccagtgatggccacagtaatgatcactcttaagatcgtacctattggcaaatctggcacctttttactagaaaggttctacgctataagtctcatgttaccatgggtcctagatgcagacatcaccttcaagctgagttctcagcttgatctcactcactatctcaaatcttcgtacagatcatgctcctccagttgtccagtagagtcaatgaatcatgccctagtggttgcaccgtatcgcttggctgtaggtcatagtaaggccagtgtcatggatgtctctgatctcatcctaacctccttaaattctcctctagaattccgtagtgaacaaggctacgtcagtgatcaaagtcttttatatcagcgcagagtaatcccaacacaagtgaaggatccaggtgtagcatgttcattcgctgtatggcctgcagtcaatgaaaagtctggtcattctcagttccattctagtcagtgtcaacataggtctggagtgtatgagggtccaaaaagttcagctagtctcctgaattgtagtacatatacttaactctcaaagaatcaccgatcctggcgccatgtacatagttcacagaaggcactctgggtctactt

SEQ ID NO: 567699 - DNA, 1918 bp, Homo sapiens
  misc_feature (931)..(931): n is a, c, g, or t
gccctgagggatgagatgcgagccttggcgaggcaaccccaaggccacccctcaccccagaacagaaccgtgtctctgataaaggttttggaagtgaataagagttttagaatactaataaaacaagaacaaaaaataatagagaaaaaataagaaataaacaaaaaagaaaagagaagataataagaaaaaaaaaagataaacataggacaaaataataacacacacaaaataaaaacaaaaaagatcaaatagaaaaaataatacacgaagaagaaagaacgcgaggcgggggcgcgactccaaccatacactccccactccgcgcagcggccacaccgaagcaaccagccacaccacccgcatgctagtgcaataagtagagacgcggcccactcgctcaatagagctcaacagagtccggctaaatccctagaaccagctaggcatccgatgccgtcggcaattccatgatacatcacgaaagagaccccaacaacactgggctctgtgtacacccaaaagactactttcgtcacccgtggagtgaccaagattacaaagtcgtctgtgtgacataggcaaaatggacaacaccatggccatcaagagcatatcgctgggcgaagtccaaactataatatacccccgatgatgcgagccattataccatacaaacatatatggtttggcattaggaatacagatatcgaggaatctcatctggcatccttttcgaccacaattatccagcaaaactttacaggaataagacagcaattactggtcaaacgcaagtgcgacccaagattacacacttaggaaactacctataaagatctgaacattatcagcgcggttgaggagcttagtatactccaaataagtcaacgacgcgaatagtagcagctatacacgccgaaggtacagngtaatcaatactacttggagttttcctacgtcaccgagcactaataatagaacacaagtaagtttaaaacaacgcacccacaaaagcatatataggtcgtcacacaccgatcaaaacaagcaagagaaaacagcagcaggtctggccccataggacattcttgcaacaccaagaactgatgtcaaccaaaggacagacacggagagcttaagtctcacttcacaatacaatccaagcctgtagctagggaacgcgcggtgtaaacacaactaaaaacataacattccaacagatcccacggaccttataacaagaagacaaggggcatcccaacaaataaactcatggcacccgaacagcaacgaaataacactggaacagcaacacaatgcaaacaaagaagccaccacaaaccacagcctctaccagacaacaaccaacacacggcaacaagaagacaacccaaataccaaaatgagcaaacacacaacgagacacgcgaaacagcgacgacatactaaaacacacacaaagacagcaaggcagtaacccacacccaacacaaagacacacagcgcgcaagccacacaaacgagccgaaaaacaagccacacacaaacccaggagtggtcgaaaccacaaccagagacaaaccacaccgaaactaaacacagccggccccaccacgcacacaacacaagatgaaatccctaagcaacaccctactgctagacaaccatcggccatacgtgagacactatgacgcacaaagccttcatgcgatcaatgacgcactatcaaccaaacaagagatacaataatagcaaacaacaacaccgacagaaaaaaaacaacaaataaagcaacacaacgcaagcaaaacgaaagtaaagcaaacaaagaacagaacaagagcacacaatcacaacactaaccacgaaagcataccacaccatgcacgaaaccagcaaagaagaacagaacaaa

SEQ ID NO: 567700 - DNA, 356 bp, Homo sapiens
  misc_feature (157)..(157): n is a, c, g, or t
  misc_feature (355)..(355): n is a, c, g, or t
agaggtgtatatccccccttttctgccggcgcttatccccgcggacacacatcatatatgcccccgcgcgaaaatattctgcgtcccccactttccgcccgcgcggggtacacacacattgtgtgggagaatatatagggcgcgcgcccccccgggnatttgtgggtgtatgagaggagagtttgtgtgggagacgcacccctctcttggcgacacagagtggggcgcacaccctgtgccccctctccacacggtgtgtgttacacacacagaatctcccccacctctggaaagagtccctctggcgcgccacaaataaacaccacaaaggtcgcacgctttctccacaaaaaana

SEQ ID NO: 567701 - DNA, 298 bp, Homo sapiens
gctatactagaggatccccccttgaccgtgctgacttaaagtagattatattggtgagatattaagaggaggggcagcacatttggaagccctcatgagtgcagggcccgccacattgtccagagtggccacgactggggactgtacttgaccccacagccatctgggatgagcctgcttttcagccaccagtgtcttcaaatttcatcatgctttgaaccttggtgaatgccccaacttcttttgagcatgtggatcttcctggcggccatggaacacttgaccttggtgccctgcc

SEQ ID NO: 567702 - DNA, 420 bp, Homo sapiens
ttttgatctcatttgctttttctgcaagctcagcagcagaatgcccagagtcttccctggttagagtgccggttccatagactgacgttctcctgcatatgctcgctggtattctgcaatagcaggccatgtctctccttgagcctggatgctttggagccaagctttcgtcccatgcaagggaacccaccacttctgggatttccgctgcattctgctccggggtctgcagcaacctcgtcagctcttgcctggagtggctcagcctgggcctgcagggccacctggagaattgcagcgcgtgtatggcgagcgtcctcatgggctcgggtcacagatcctctagcttggccgggtgaccagagagggcagactgcaatcctctgtcccaggtcttctattgcaaggagcagcccatgt

SEQ ID NO: 567703 - DNA, 129 bp, Homo sapiens
caggatccccagtagagagacgagatgtcaccacctgcttgcggaccctgcatattgcgctggctgatcagtcacgctgagcgtggatgaatggatcttggcccagccctccgcttggagacctgggtc

SEQ ID NO: 567704 - DNA, 307 bp, Homo sapiens
tgctaataggagggtcccaggtggggagagcccaagtgagaacaataatgaacaatgtatgtatgaacaattgttagagacagctaatcacaaacaacctgcgggcacaatgacctcattccacacgtagcacccttcagcaggaccctataaaactttcctccagcccttgcctctttgcaggtagccccttctctgctgagctgcccactgcaacatattttcacaatttctctaataaatctgcccttctttacctacaactatcttggtaaatggctttaccacctgcaaaactgaccctagg

SEQ ID NO: 567705 - DNA, 1137 bp, Homo sapiens
ggacgcgtgggtcgacccacgcgtacgcgccggggcgctcgcgtctgcgtggagaccggtctggccgcgcgcgggaagccgcggcaactgcgccggaaagtcccccggactcttggggccccggtgacccagagtaagccgtccaagaaggaggaggaggagagaaaggcggctcttcccagtgccccgtaccagcaggcattcggtggagcccaccattgtgaactccgcgggcaggccccatcaagtggaactggcgtcccaacagcgggggggcgtccccagactcgtgggggccgagagaccagacgctgaccgctggggacgtcgcacgcgacaggcgccgtgggttccccaagggcagaggagaatacgcctggctgtgaatgctccttcctttccagtagaacccgagagactggacagtctgtgggattctcaagaagcctatggtggatcaggccttgcaacagagcatgcttgcaggcagttggtgcaaatggatctacgtacgacgcaaccatggcataccgcaggacggccgtatatggctgttgcccgacctggttacattgggcaacaggccagccctggctcttggcatatgtgggaacatgccttggattttcaaggggtaagacaaggaagatccgcgttggcagttggagattgttttggacaatggttgggacattcacagacgagtttccaaatatcacgaggatggttagaacttggccgacggcacaggtaccatggcatggagagcccacagaaccaaagccaagaagcaacgtgtgcacttggtaggtccatccttgtgcgaatccagtgcacagtacgaccggggccactcaccacacggcgaccgttcacaccagcaaatgtcactccttggaaccgccgcatggcgcttcaacaccagggaacacaaccgggttggaaacgaatcgacacgcgtggaccggggatcccggttaccagggacctgggtgccaccctaaaggggggggtgcaacacaccgtcgagacgggcacactgtagcacccctgagcccgcagcagacaccgagcacaaccagcagaaccacagggcctccaagagacacaccacggcacacacgaagggcagcgcga

SEQ ID NO: 567706 - DNA, 971 bp, Homo sapiens
ggtaactccagtgactattgtccatgaaatgaccatgagagccctctgtatgcccttgaccgcaaggcagtggccaaagataatttcgagattctggtgagcatttatttatactggtgattccactgggacatcccaccagtccagaagttcctacatccccagagaaattctctggggccacaggttgcatgagtgtattggaagtgaagagaagtactacaaggtgaactgcgttgcaggtttgactggaagcgtggaagtctacgcccccttttgcagtgccaaacaactggactgggaaggaccaacaagtcaacaacttggagaaaacgtcccctgcccgaggatcctgcaatttctgacaggcaacaccaggaggcggtccttcagcgcagtttgctgtggtgacgcagctgtgagaacccagaggagaccgtccgtgtccccacaagatgaactgtaaggagatgccctatcagaaagccctcctgatcttgtaaataggatctccatggaatcccagatgtagccctcctctctgaccttatctaaggggccagaagctgtaagcatgatttttaacaaaatgttagtgctgtgattggggcaggaatagaaagcagagcaggttaagctttggtgaattattatctaaaaaaatccgcgattttacaatattaaaatttgggcttggcagtagagtgtattcgggaagtgattagaagctaattgatacagttatctaatatgctatacctggtttctctgaagtgaattttcggtgggggcataggcggtaatataagttgaaaacgatagtaattggtttactagtttttgtggaaaaaaaaaggggggctaataccggggcgagaaaggacgtttaaagccaaagagtaaaaaggggcaaaggaagagtgtgactggagaaacataatttgtggtttttcatactttctctctcttgt

SEQ ID NO: 567707 - DNA, 381 bp, Homo sapiens
ctacaataaacaggggatggattccaaacgtcaatcagctactgaccatatactctaagactatatatcctcattcgtcatgcctgctgagcatcctattcagtactccacagcctcagctaaaatgccctttccgcaaggacgccttctctgctacctgtctggactactcacagattgcaagtctcttcttctggtactgtgatgctggaactgtatatgtctggctctgtttctcccagactgaaggctcctaggggattccagcaacaccaattggatgggacgacaggttattaaacagtctcacggatactgcactgagcattcaatgcctcacaaggacagcggtccaagtaagtcagattcaagccgggctct

SEQ ID NO: 567708 - DNA, 112 bp, Homo sapiens
gctcaggtgatcctccttagcagcatgggaacttctaaatcctctctacccacccctcccactttaaccggaattctcctttccattccagcggcctccaagagggggtacc

SEQ ID NO: 567709 - DNA, 402 bp, Homo sapiens
ctctcctgggtcatgattccatcactctcttccgtgatttggcggacctgttggtgctgagcactcgaggtcttccgtatcgtgattgttgcgctttgtttagtacaagctacacataacagacgaggctcgtaaccatcggtagtcttgtacctcctcgtgagtcttctatcattgtctgccattttttgaccgtggaacacattttgtctacggtgtaatatccatgccatgtaagttagtcaggctgttttaaccctgaagatcttcagtaatcagcttgaattttctaaatgcaacttctatcattctgcaaatcagcaagtactcacttcaaacacacgagccttgagaccatcagatgcaattttggttccttgggtcctggtgacgagcgtcttt

SEQ ID NO: 567710 - DNA, 134 bp, Homo sapiens
cccgaatctcgacgagtggtgcatcatgatataactgccgcatcaaatgaagagttggatagtaggtcttttttcatttctttcactaatggagccttaatcttcttttaattataggaggctggacactgtga

SEQ ID NO: 567711 - DNA, 244 bp, Homo sapiens
ctgatctttctggctgtcactggagaacatcctttgtgcagtgcgctgctctgtgcttgacagttcccaatctacgtctctgtcccaacttcttaagcacaattggtcttcttccatctccaggtattcttgcattcttaaacaatgctgctcttccaacagggtgtgaatcagacctactcccctaaggtcaccactctgggcactgctacagatgccccaaccttcactgagtactctggat

SEQ ID NO: 567712 - DNA, 419 bp, Homo sapiens
  misc_feature (159)..(159): n is a, c, g, or t
  misc_feature (185)..(185): n is a, c, g, or t
  misc_feature (332)..(332): n is a, c, g, or t
  misc_feature (390)..(390): n is a, c, g, or t
  misc_feature (404)..(404): n is a, c, g, or t
tagagtcgatatcttgctctgtcacacagtctggagtgcagtggcatgattagctttgaattcctgttcaggtgatcctcccacctcagtctccagagtggctagggctacgggcagtgctgccacacctggataatttttaaattgtttatagagttngggtcttgctatgttgcccaggcttntctcggactcctggccttaagtgatcctcctgcctctgtcttctgagtcgctggattacaggtatgagccaccatgctcagcagaaaaattaaatttttttttaacaagtcattagttcctggggaattctatttcacttccaaatncacctcattttggcagtggccctgttcttagtagtccgggttttgggaagagttcgtntttttcacatgatncaaggttggccaaca

SEQ ID NO: 567713 - DNA, 218 bp, Homo sapiens
gagattgactctagagtatcccgtagccatttcttgcactcatgtgctacaccttgaactaacgtctttacgtgggtacttgcgcttactttgtagccttcatcagtgtttgcttgaaagatggccgggaataatagggctggagcaaagaaggtgggtgagcgtttgatccgggggtttatccgatttacagaaacaggctccctctaagaggggat

SEQ ID NO: 567714 - DNA, 380 bp, Homo sapiens
  misc_feature (102)..(102): n is a, c, g, or t
  misc_feature (245)..(245): n is a, c, g, or t
caagctatccggttcaatcatggactaaacgggctccaggagctacaggctgcagcagcagcttctcctctacgtccttcactgcctcaaactgttgttgantttgaaagcttctttcagtctagttttatcaacagagctagtatttcgtgaggttctactacataccaggttccagaaagctaaatgccttttgtttgttattattctctaaatacaaatcacaactcctcattactcacacnacaaaatttagctgcgggagattgagtgactttcccagggtcacatagctactaagagcagagtcgtgtttagattcatgtgggaatattaacacagagttgaaccgatagctgctaatcctcggagtcgacccc

SEQ ID NO: 567715 - DNA, 405 bp, Homo sapiens
tgcccctggaccgtgaggaacaagataacaagggtttctaaaacatgacggaggttgagatgaagcttcttcatggagtaaaaaattgtatttaaaaagaaaattgacgagaaaggactaacaagagcccccgaattaatacccaatacgcacgggcaactgctataagatcaacacatgcacgggtgacttaaaacagcttacagtcatagtccaacaacgtcgtcaggtgactttccaagatacctttggcaagcgccgatccttcttaacaacaggacgattacaacccgacacgggtgacttaacccaggaccctggaaaattcccatggacggcagggcaacatcggccgtcatttaaaggcctaagttaaaccgcttttcactaagacgcagacgaaac

SEQ ID NO: 567716 - DNA, 847 bp, Homo sapiens
  misc_feature (22)..(22): n is a, c, g, or t
  misc_feature (130)..(130): n is a, c, g, or t
  misc_feature (153)..(153): n is a, c, g, or t
  misc_feature (211)..(211): n is a, c, g, or t
  misc_feature (221)..(221): n is a, c, g, or t
  misc_feature (242)..(242): n is a, c, g, or t
  misc_feature (244)..(244): n is a, c, g, or t
  misc_feature (248)..(248): n is a, c, g, or t
  misc_feature (264)..(264): n is a, c, g, or t
  misc_feature (289)..(289): n is a, c, g, or t
  misc_feature (298)..(298): n is a, c, g, or t
  misc_feature (357)..(357): n is a, c, g, or t
  misc_feature (370)..(370): n is a, c, g, or t
  misc_feature (479)..(479): n is a, c, g, or t
  misc_feature (482)..(482): n is a, c, g, or t
  misc_feature (504)..(505): n is a, c, g, or t
  misc_feature (514)..(515): n is a, c, g, or t
  misc_feature (520)..(520): n is a, c, g, or t
  misc_feature (533)..(533): n is a, c, g, or t
  misc_feature (535)..(535): n is a, c, g, or t
  misc_feature (575)..(575): n is a, c, g, or t
  misc_feature (578)..(578): n is a, c, g, or t
  misc_feature (582)..(582): n is a, c, g, or t
  misc_feature (627)..(627): n is a, c, g, or t
  misc_feature (823)..(823): n is a, c, g, or t
tttaatatttaaagattgtggnagtatagtcaaaacacataaatattataatatacatttagaaattaaatataaagtcaacacaacactccttaaaaactcatatgtacacttccaataagtctcaggnttgaacattcaagctcatcaganttccccatgggaatgggtgaatcttgcagggagattgtccacaggatacacggtgggnctggttttcnttgtaggaggtccatttagangnggcnagtcacaatgcctggncagctccactgtaaatattttgggnggaattttngcgaattctttgcctacacagctcctaaggcctcctccaaatgggatggggctgagccngggtgcgtcctcngggtgaggcagcatgaatcggtcagggttaaattcttccttgttggtgaagatctctgccacatcatgggtatcacagatactgtagataacattccagcccttggggntcngggatccatttgattcagaagnnttcggagcnncccgnaaccctcctgggncnggggggttcagtcgaggggtctccttaataacacacccgnggnattngagttgttccaaaatttccatgtccaacttgttgtcttgattgcncttgcaaagtaaacccttactcttcagctcttctcgcgctttctggggagcgtgtgggtggagccccaggtaagtgatcagagatgtggctgcactggccgtggtttcgtgtcctccaaagaggagttcggttgaagattgctttagtgcctgcatgtccagccgctctcccctctcccacgagtgctcgatcaanagctgcagcgcgtctttgcagccc

SEQ ID NO: 567717 - DNA, 1270 bp, Homo sapiens
agtcgtttcggagagagagtattggttagccatcgttcggtggtgagtagccagctggtgatcgaaggtcagcgttgggtcaaccagtattgtcagtttcccgtggggaattattgcggtcccccttatatctgtgaattaataattggttttgttagagtaagtctatgaatgtatgagaattctgccctatgaggagaaccgggttagagcttgtttccagcactggcattttctggggtgaattgtttgtcttaatttgtaattgtggttttagtttgggggcgaacttttaatttgagcagtttcttgcccaaatccggggtgttagaagtatactttagaaggctccccaggtgtacaagagaggtttgtagatttgattttttcaaggcttatcttggaggggccatagggctttgggggagttttttcgttttttgaaaaaaggaatatgtctgaatatatgagccgcctgttgaacatagagttttttcagaccactgttgtgccgggtagccccttggcaagtcttgtttaatgttttcgccatacaggtgttaacccccgctgggtattgtaatatttgtatggtgaggggtattaaaaatgtatacccctccattttctttgtttttgaccacccactcataatctcacagggacacatggcccttgtgggtgccttaaaaatagtgagatttcgatatatatatgtctgttgggccccaaaggtaattatctttggttcccaccacaactctccacttttgttttttgatgggggtgcccactttaatttgatatatttataaataaatgtttttggtaataaacttgtgtgttaatattgtctttgtgaaaaccccagatatgcaataggtgtgcacacaaagatgtttatggatgggttcttggtgaatgttctaattctaataatagattgttaagatgatttgttaattgtgttgttccctccttggggggaaacaccactttaagtataatagtggttaagaaatataagcttccactgacactgttcataataaggttataataacttgttccataacatgaaacatggaaattgtggttggtgaggaaatttctgttaaagcccaacactagtttaatttaggagcttgcaatttaatttgtgtgccttgaatctatttttatgtggccccttaaaaaatatcccaaaaaaccccttgctaatatagccaatccccactactcttgggtactgaccaaaagaaaaaagaaa

SEQ ID NO: 567718 - DNA, 813 bp, Homo sapiens
ggaggcggaggttgcagtgagccgagatcgcaccattgcactccagtctgggcaacagagtgagattccgtctcaaaaaaaaaaggaaaggaaaaaaaatagcattatacctcttccttgtctcaaccggccatgaaattttctgaacactccaaattcagtggaataatccaaaacaaaatttataagtatacaaatactttttacttcttatagtaatagtatactttaaaaagcctcagggtatattatcttctaaacagctacaattcagtgcagctactttaaccaactatgtctctagttgagaacaattaggcctattttcactgctgtgtagcctcagtgcctaacattggggtgccaaattaaatatcgtagactttacacctggatttgtaaaacccattcgttttgtgtttacaattgtgccaaaattctcaaaaggctctgtatttatgtcaatccttggaaattatatttacttggattctcagtaatgactgctgggtgtgccttagtacataagtctcaatattataaaaacctcaaataatggactggattttacacaagatccttcccttttcctacaagttacatttcttcacacaatcattggcggtatctcctaaataaggtaatcatttaatggttccaagaaccatgtttcaaatatatgtgccttatccgaatacttggtttaaatatttccacaacaattttataatttcaaagaccacttcttgctgagaatttgcgggacaggacttcacacttgtgctttcacactccgtgcgcgtgcgcccggat

SEQ ID NO: 567719 - DNA, 434 bp, Homo sapiens
atcatcatcatacatctgaattttttgaccgataatgccctgttctttggctaccgtttgtgcactaaagtaaggtgtttgcacaaaatcaagcaaatgcgcaagggctggcaaaacgttttgcgtcgttgaaaacagataactcgtttgatacgggttcgtaaacgcgttggctccgaacctaattcaccaaatcgcgtaaaggcatccccatcagccttctcaaacagtttgtgttccagaaagtgggctgtccagctggaatggtaatcggtgattcatcattgatttggattggcgcgcaatgacccaatggagtcgttaatacagcaaacgttttatgatatttggctttggtacatgacacagtaagccgtgagtaactcggtcgttaaacagttccttttattttggatatgtctttctatcatgca

SEQ ID NO: 567720 - DNA, 891 bp, Homo sapiens
gaaaaattggacagaggggtaaggcctcattgtccgtggggcaaaaaatacttgctcttcagagatctgatctgaatgctgtgaacatggactagtgaactccatgagaacttcctttatataaggatggtgcggtgtgtactaaaggttgaagcaattgggtggaggaggagaatatagatagatgcatgatgatgtggagtgttaagtagatctcctatgagagataagtatctaggattgcgattcccagagaaggagagtggggcataataccgaagctggggtgggaacaccaggatagtggaagaataatcggagagtagacaagactgtcaaaagtgtggaagtggggcccttgtaagagctgtgttcgagaagaagatgttctaatatatatggaatgtgttgaagaggtcttgcagtctgcaggatgaaattaaatctctagaggaggcagatagtaatggctatgagctaattcatccaatgggcaaccggaaagtaataagagcttggaaaaaatgtgtgggttcaggcagagagctatatcggggggaagcgttactggaacgaccatgagaatctgtttaggaacaggtttggagtggagctgctgaatttaagtaggatatgggtaagaaagtgaaatttctttaactgaattgtgggttcgggtggatgttgtccaaggtaaaggtcccgtttctaatatgtttactgttcactggttttacaatggagcttcagaataaccgaggtctatagtaacatgcggagtagggaacaatttacaattgaaagtcttaacacatttgtgcaaaaacaagggcatatgggagttgggaaaaaattaaattggtggaaatttggcgccaagaattttaaaaa

SEQ ID NO: 567721 - DNA, 1054 bp, Homo sapiens
gagagatgtctcgcacgttatgacgtcggtattgatgttgggagtagaccaccgagctgctcatcgagatcagaagaaggagtgagcaggaagatgagacaaggacatatgactcttgatccttggtcgggagatccctgtactatttgtgcgctcccctcaatagttagcccagcgtttctcggagatcctggaatggtgtcgtgtcccagaagactggccatgttccttccggggatacgctgtgttgatagtctatggagcgttccttagatcttacgtggcacatcgataagtattggctgattcctgtggttcatggtgccctagttaatcaccaccgttcagtggatatactgataaccccaacatgggagtaggcgcccttgttcccttgcgttcacgtgagaggtgagaccgtggagcgtttcccgtaaatcctgagacgaacagcatttggaggaaccctgttcttatcttcgattctcggtggtgtggcccatggacttccactcagaggagcggtgacgtaatcgacagttcttgcgtagcgtggtgtctattcggaaccgtgtcttatcgcatggactgttagaagacagggtgcttactctctttccctgcgtcctccccaggagaggggtcgttccctacaggaggcgaggtgaacgagaactctgagggtgtcgtccatccaggaggccgggcatttgttgctgtgctcatccattcctgcccagtgtcatgtgtccattggtcctgtcttcgcagtagcagaaggtctttcagggcctgcttgggagcgtgggaggggtgggtgcacaggtcaagtgagcaaagagagctaggagtacaatgcgtggaagggtcttcgggtgggtgcgtggttgaaggcacagggtgcgttgccacttgatcctccaaggtcaccccgggctggggttgagagactccttggccttctgtgtgggctgtttcaatggtatcgagcttaccttttttttgtggaccccgtgccacggagagaaaagcggagaggggcacaaagactgca

SEQ ID NO: 567722 - DNA, 752 bp, Homo sapiens
ctcttctcctgttttccgggaagaacctggcctgtgggaacctggctcagcacttcaggaggaatcaacagccggggttcgcatcccagcaattgcttccatcggcctgtgaccttgggggagggactcccccgcctgacctgggtgtccccgtctgtagacttccgatcataattggacccaccatggagcccaggtgagggcacgccgccgtgcggacgcgtggttagagccctgccctggtggttggaactgccccactgtggggaggttgtctttctgcccctgtgaatggactgtgtgacccctcacatggcaccttccctctcccaggctccagtttctctgctggaacctggagtcattcctgggctactgccggaattaagtgtaggcgagttacccgtttacacaggacttggtccatagcatgagctgctttgtagaaatggttcatgaccccgcgtggtagctcacacctataatccccgaactttgggagaccccggccggaggatggcttgagcctgggagctgaagactagcccggaccacatagccagactccatctctaccaaaaaatttaaaatcagctgtgtgtggtggtgcactcctgtggtcccagctactcaggagcctgaggtgggaggatttgcttgaaccccggccgttgaggctcccgtgagccttgattacacccctgcacttcagcctgggtaaccgagccaggcctgtctccaaaaaaaaaaaa

SEQ ID NO: 567723 - DNA, 776 bp, Homo sapiens
  misc_feature (147)..(147): n is a, c, g, or t
cagcagacggcagtcagcctggagcatcctgcagcctggttgccctacttgcctagaacatagggatcgcgcttcaaggttcactggtctcgagatagcgcaggatattgagtggttatgtgggcgcagcctgttggatagagcatntcgcctaattgagtgaactctggtctaaaacgctggattactacgtacaccagtcgttctcgatgcgccagtacaatggcatggtcaatgatcatcatcgagtctgtacgcgtggtacacgacagtactagagttccggagcatccacagagagatgagttatcacacgtagataggacgcgtttcgatagggacgtgcaatgatgcagcgcaatatgctatgacgcaactacccattggcaaaatagtcgggcagaatcgatggcgagtacaataacgctaggggaacgtacacgagaaagtcacacataccccacagtcagaccagaagcgttcgctggaaaaacatgtctagaggcagactagggaacctataaagggcttcgccatggccagcgattcccagcgttgaagttggaaactttgcccaccgcaagcaccgcagttgagacgacatatagaggtcagagtgtggcgcacgcattcaaccgcttccattagaggaggaaaggaagacgccgaccacacaaagttaggcgtccaacgtggctaacacttatggcgtagagcgacaaacaacattgcgatgaagcctggcaattggagcgcgcccctacgaagagcgaaag

SEQ ID NO: 567724 - DNA, 276 bp, Homo sapiens
  misc_feature (96)..(96): n is a, c, g, or t
ctgtgtgctgtatccagcatcgaggctaggcagtagaattgcttaccaggaggcggggttgtgcatatcgagcattgcactccggctggcgacagntagagatccgtctcaaaaaaaaaaagaaaagaaaaaggttcctcttccaaacctcaattttcttatttttgcaatggtaggaatgtgggtttataataacctgtgtgtatgctcatcatacataacccctaagggcttaggactcgagacattttatgagctctccccagccatagcact

SEQ ID NO: 567725 - DNA, 89 bp, Homo sapiens
  misc_feature (4)..(4): n is a, c, g, or t
  misc_feature (48)..(48): n is a, c, g, or t
gcgnccgcctactactactactactactactgctcgaattcaagcttntaacgatgtacggggacatgttcaataaaaagctgaactct

SEQ ID NO: 567726 - DNA, 322 bp, Homo sapiens
ccagtttccggcttcttgaaggcacttcactatgcttagcatatttcgtctggaattcccagattcctcttttgatctgtaggacatattgactagtttgttatattaggatcattataaaagaacatccagtaatagaatctcatccagatattgcattagagtatctacgactagattagccatttcctgaactgagagaacattttcagtcctatgatctggatcatatggcataaaaggtaccacagtcttactccatggattgtgatcatcgctgaatctttagcacagtgttatagtgaaacaaattgactaatac

SEQ ID NO: 567727 - DNA, 103 bp, Homo sapiens
gtacgacaaaacgttacctggctatagaaggatggtctgtgccactccccttccaccctcagctccacccagttcgcgagttgtgtggccagagtgcaagttg

SEQ ID NO: 567728 - DNA, 109 bp, Homo sapiens
ttagtggctgccaggcatcttcagtgtgcagcacaaatcagtaagggacggttcatggatgatacatggccttccttaagaaataagaatccctgaagatttgttggtg

SEQ ID NO: 567729 - DNA, 237 bp, Homo sapiens
gagcttcaacagatttgtttgtccaaactgctcgccacaacacttcgatccaccgtcttattactcagtggagctggcgattctttatttctcgccataggagcctgctgtgtgatgttgtcctccacaaaaagctcaccacctcttgctcagcctatataccgccatcttcagcaaaccctgatgaaggctacaaagtaagcgcaagtacccacgtaaagacgttaggtctacctg

SEQ ID NO: 567730 - DNA, 388 bp, Homo sapiens
gaagtctgatctgctgcaggttaatagctgtgtgacctggtcgagttcctcaggctcacccagggtcgtgtcctcatttataaaaaagaatagtaagtaccttataaggttttttttttaaacagagtccggctatgtggcccaagcgggtcttaaactccgggcctcaagcaatccttcggcctgggccccccaaagggcggggatggtgggcatgagcggcggggcccagcctccaggttttaatatcaactctcactccggaattcagtggcttggcccaagataggagttctcggatgcagaaattatggggctcttttagggtaagaagttggtgtcttggtcgggccacatctggactaggtatggtctactctggaaggtg

SEQ ID NO: 567731 - DNA, 1295 bp, Homo sapiens
aaaggactaggtacgaggaccgcgtgttttgagcgcggggtgtgtggcgaccggatacgctgacctgttatccgcggggcagcttcatatataccacggaccagcgacgctgctcgtcactaacacgctgggctgctgcgcgcgctcatggcggacggtgatggcgtgcgccagtcctggcgagatcctgagcccgtgcccgagccacggttttacgacccacggagctccgcgacgcatgtttgcaggtgggcatgcagcattgaggtcccttcctgcactacatggtacttgtacgctggacctgcctattccctgcgtctggcctccgaggcttcccaaatgtcctcaagaaggtcctcgtggatcagctggtagcctctccattgctgggcgtctggtacttctatgggccttggctgcctggagcggtcacgacacgctgggctgcgacgctgccaggagctgcgggacgaagtctctgggaccttctacaagcgcagactggtgccgtagtggccatgccattagcagcgagttcgtcgacactctcactctctcgtagccccacccaaatccacagagtacaccatcacattccaacgagaactgcacgcctgcgcgcctgaggcaccacggtacacacctgatccataactatggaacgtcaccgcgcagccccacgtacactctgcaccaccaccaaagggactgctgatacagcccatggcaaccaccccgacgcagcacttgcaccttgtcatgcttccctggcgaaccccacgaatatcgcgccgaccatggacatacccttgcgccgcgacacaacgaacccccttcgtgaaccaacacaagggggacattgggacattcatgactcagccacagcctccgcgccacattggacgcccaacggtaccctacgatcaccacttccacgccttccctcagacccccacatttggccgccccacaaacaccagtacacattatcccactagtacctaccaactatcctgtgtaaaccattaaacctcttaccacttcgaaagacacgcgggaacacaaccgccccgcatgtgaaccgcactcggacctggccatcaacccccacccatagagccccatgtctccacacaagggggaaacccaatactactgcaacactggctacaacccaccgaccgtgtgccccattacttcacggcacaggcgagccgcccgctccggagagacaacgggacaaccacagacacaacgcaccataccgaaggagagacccgcacacgcggggc

SEQ ID NO: 567732 - DNA, 171 bp, Homo sapiens
ctacccttggtagactaacccaggtagcctactttaaaataaagacaagggtggagtgcagtgctgtgatctcttagctcgcctggctaatttctgtatttttagtagagatggggttttgccatgttggccaagccggtgttgaacccctggcctcaggtgatccaccca

SEQ ID NO: 567733 - DNA, 128 bp, Homo sapiens
tcgtacttatgatctgtcgtctgagagcaggttaacggcaacttcgaattgacgggtccgctcgaattgacgtgtccgcgataagttaacttgatatataattgatagctaggtccactgtgtgatta

SEQ ID NO: 567734 - DNA, 1134 bp, Homo sapiens
gctgctaacgcggtccccggcacgcaccatctgtatgccatcccggacggccgaggccattgcagattttggaagatggcaaatgttcatgacaccctgtgatccaggacaaaccctcaggctggtggtccctgtgctggttcccgagcagtttcgggctatgccctaccagaccgttcagcaaaggagatcggctaggaaaggttgcagactggacaggagccacataccaagatcagaggtacacaaatacgtactcctctcagtttggtggtggcagtccaatatgcttctttccatgaggaggatgaaagtagcttccagcatggtggatacagagacgcacacagaagacggcctaccagcggaatcgaatgagatatgaccacgaggacactacgaagagacaacaagatcagatcggaacatgatacgcagatacaacctgcacaatccatgcctaagagctgcaaccagacaacgagagagaacgcatacgcactgcaccacaacaagtccaaaaaaccaaaaaggaggtaaaggccagaacatggacatccgacactcccagcaaaccccgaagaatcaaacagacagaaagaacggacgtgattagggcaagtgaacagagagcaaaggcgaacaaccataaagaagaagcaacacggagagaaaatagaaaagaaaacagaagacacaacgacaacatgaaaagaagaagaagacacctaccagcaccacaacacaaagacacgaaccacctaccacacaaagaagaagcaaacagacaaagggacgaccacacaaagaagcacagcaaacaaacaagaaacacaccccacatgcagaaacccggtcaacacggagcaagaagggacaagaaaaaccctcacacgacaacggagaccaggccaaccaccacagacaccacatcggagccgacacgacagaagaagagtacaccggataccagagaatcaaagcaagcagaagaagcgacagagaacacagcgacaccaaccacgaaacagcgaacatgacagcaacacagagacaagacagcagaacaagaagaaatgagacttgcacaagaaacacaccatgcacgtaacgagaaaaacgagcaacacgcag

SEQ ID NO: 567735 - DNA, 93 bp, Homo sapiens
ttccccggccttttttcattttgcccatttcggtttttttgcaacggcaaaatacccctttaccctctttaacccagatggcggcccccccca

SEQ ID NO: 567736 - DNA, 212 bp, Homo sapiens
gaatgtcgaggctgcaatgagccatggtcatgccattgcactcccaactgggcaagagaacgagagcctgtctcaaaaaaaaagagagaaaaaaaaaaggaaaaaatactccatttgagatgactgcaagtccaggatgtgtagcagggataaggtgtgatggctagtgaaagctaatatgggcttgagtgctggagggaggattagcttgt

SEQ ID NO: 567737 - DNA, 546 bp, Homo sapiens
gccccctctataggtcccgcctccaaatatctcatcaacaagccgacataatcaacacccaacaatgactaatcaaactaacctcacacacacagaccgtcacacaccacacacacagacctcacacagacaccacacacagacctcacattgacactacacacagacctcacacaccacacacacatccacacccacgcactcacacacaccacacacagaccacagacacaccacaaacacacatacagacctcacacaccacacacacagacctcacacacacaccacacagagaccacacactcagagacctcacacacagacctcacacacacagaccatcacacaccacacacacagacctcacacagaccccacacacagacctcacatagacactacacacagacctcacacaccacacacacatccacaccctacactatcaaagtttaccacaaccaccaccccatcatactctatcacccacagcaccaatcctaccaccatcgctaaccccaccctaccgtacggagtcgcgat

SEQ ID NO: 567738 - DNA, 617 bp, Homo sapiens
aactaagttgtcaggaaactgacaaattataatgaaaagaaaggaatgaaattaccacaaagtcaaacagaagttttctctaactgaggggaggaaatggtgagaacacttatcagagaaatgcccatgtggcacttttgggatgcaggctagattaaactttgtatgtgtctacacacatatgtatacatgtatgtatatgtccataagtatggatattttatttatatactttctatatgtgtattatgttacacaataaaagaccaataataacaaagaaccaactggattctgtacaaatgaagctcaaattaagttacctcaatagtgctccttttttttaattgctgtgagtattcttgtgtttgacaatttattcattctactgttgatggatatttgggttattcagatttttttttacatgaagacactgtgtctttaataaaaccacctaatcaagcagctctgatccatgttcagtgctcattgctcacagaattttactgtgaagtaatattgctgacgttagtttgtggcttgcttatagatcacccttgtctaacactctccagtgtcctttcacagatattatcttgtcgggggggatctct

SEQ ID NO: 567739 - DNA, 1018 bp, Homo sapiens
gacactacaaatatgtatacttgttatgtttatattgttttagagacagggtcgtcactctgtcacccaggctggagggcgagtggcgcttcacagctcactgcatcctcaatcgcattgggggctcacgcagtcctcccgactcagtcctcccaagtagctgggcatgtcgccgaacaagtccagctaatgtttgtatctttagtagagatggggtttcgccatgttgcccaggttggtgtggaattcctgggctccagttatatgcccacctcagactcccaaagtgctgggattacagacgtgatccaacgcgacctggtgcaaatatgtattctttttgaacatttcctctgatacgtatagagctttgtgcatttatctgaagcagtatacagtgcctttggttatcagcaattttaacagtttggatatacttatcagctatctgtattccaaagctacatcgtacttcttccagtatagaatctggtgcttcctgacgaaaaagatgagaagacataatgttggacaatatatgatgctttccattgagaatggagtgaaaacattggttctatatgtattcttttaaaataattttcttatgaaaaacttgtgtctttattatacttaagcttgtttatggcatattcagtagtatgttataagatgtggtctataaattatgtaattgtaggatacgggaatgcattggtccagtgaccttcataaggagggcctaatggtggtatccttttgtaacttcttattggtatagaaactattagaaatgtatggacttacagagggtcactttgggaattgacgttttttcaagacaggtttattaccgttgctggtgggttgcgcaagtgcacaactggtgaactgcatgtgtgtattctggagtaatgtgtttgacagtttgagaatcacgggggagagatagtagacacattgtgtgtgggtgtacccaagggtatttcagtacaaattgtgtgaacgtccgtgggaa

SEQ ID NO: 567740 - DNA, 524 bp, Homo sapiens
ctcacttatttctaggttatttaatattgttcagttagatgaaagtgtgattgtagatttgaaatacaaaataaaacttggatactgtgatttttttaacatggccagactgtcatgtattataatgacatatacttttgtccataaaatgaaattaagtttcactgaaaaatttacatactttcccctggggattctgttgcttcagattaaagtttataaagtatcattagtgtcttccacagggtcattttacacaaacacagttttagtgagatgtcaactggcttttgttggttgttggattgactgtgatttaaaatgttaaagatgatataatgcatcttgttctgcttctaggctgaaaggtcactgaggcagagctgtttgtaccttgtatcccctggaattttgcctaaacatttgtgtactcatagggtggtaggagatagtccgcagatggtctaaagaatgccatgtgatactgtgagatgccaataatataaataaaactttgttattat

SEQ ID NO: 567741 - DNA, 263 bp, Homo sapiens
gtgattgcaggcagagagctcacagagctacctggagtaatgtcctcacgtgtcatgttagcttggacatctgcaacatcgacccatcctgtggctgtggcagttgtcggccttccttcagagacaggcagagcggcagggagcgatgtggacctcgagatggcttgcatcttagacagcgctgagaccaccaacctgttccagttcaatgagatgaagaagtacatagcgtaccctagtcagacaacttggacatgagcccc

SEQ ID NO: 567742 - DNA, 379 bp, Homo sapiens
  misc_feature (3)..(3): n is a, c, g, or t
gcnattttcatccttttcctcctcctccttccccccctctttccttaggccttttgcattgaaaatgccccaggggagggtagtgagggggaagtccttttaaggagaaccaaactatgaagtttttttgtattattgttgggggggggtgtgggaggaaagggggcgaaaacaaccaacaaagcttaatgcatttggagagcctctcagagctgttccgtttgaggagcccaaagaaaaatccaaatgaactttcagttcagaaaggcagtttatagggagaatctctccccccccccatcgggggtattggggttttgggctgaatttacttgattattggaaaacctgccataaaaaattttaggggcggtgtgga

SEQ ID NO: 567743 - DNA, 684 bp, Homo sapiens
gtcagccggggccgcatattggaaaggcgccgcgccgctccgccttgtgagctcggggtgtatcggggactgcgggcacaggctggaaggcgctcctctcctgccccgccgacgcccgtgcagcccgcttcgccctgacctgtttcctcatgactgcccccgtgccctgctggcgacggacgtcgccccggcgtccggatttaacacggataacccggatcgtgaggccgctcggtggaggatggagggcgactccgtgtcggtcctgcgaccctctcggcccggctcggtgcctcggtgggagtcctatgaccttcgctgacccagtctcagctccggcctggtgcagcggcgcaccgaggtctcctcgtcaacgcctaccgacaaggagctgggcggcgggtcggcggcgccggcagctagcgaggacgactgcgcagagccgccgctgacgagcatggacgacgacgaccaagggcgacgtccaaggaaacgcggttgagcctgatggaggaagtgctcctgcttgggcctcgaggaccggagggttacagatcatttcggaatgagtgtatatcatctggattacgtggctgtatgttacttgaattagcatcgagaggaaggttacaacctagaggcttgtggaatgagacgtagaagtcgtattaactaagaaatggt

SEQ ID NO: 567744 - DNA, 321 bp, Homo sapiens
ctttgggggtctttgctcagtttgtcaaggcaacccaggaccagatgcataaagtgatagaacaatctaattgtatcacaaatgtataaaacaaccacagcgatggggtggatgaaactgttgtgggcctaagtgattttggaaatagagcctataaaatttaaggcaaaagatactgcatataagtactgcactctagttgaaaaggtgtttcctgagggatatgtgttaacaattatgatactgctgtacaggtatgctggggctgaactaataaatgcaacgatggtggctgtgggccgccagcttttacactttttg

SEQ ID NO: 567745 - DNA, 678 bp, Homo sapiens
gccttgagaggctctggctcttgctgcttagggcggccgaggacgccatgggcgagtgcccgacactcggggaggctatgtcacacgaacacaccgtgatcgcctgtgggtctgggagaaagttcgtgtatatggacgagaagcagtatgcctggatgtccttaaccatcgagataaaggataggttacagttacagggtgctcttgtcgtggggaagacgtcgtcctggggcaggcctatgagcccagacccagataggcccatgagccgtgtctgcggtatcatgtggcaagctctacccttgatgggacgataccgatcctcagactccagtttctggcgcttagtgctaccagcgagtcgaagcattgacggcggtgcgtagggactactgcgttctcggagcctgtctgcgcagatgactgatttgtctggtcttggcgaggacggctgttctcctttcaccccagggcctgaagcctggggccagcctacacatggggactgttgtgtttctgttctagcttcgtctccatctagtagcgctagtgtcgttgctccgaccatgctggggtctgggcaggaatggcacagaggagatggcatgagctctagccaggtgctgcgaggacctgcgtgtagcgccagtctggtcgccttagtaactaccacatctg

SEQ ID NO: 567746 - DNA, 1405 bp, Homo sapiens
  misc_feature (1405)..(1405): n is a, c, g, or t
gtatatcgtcaatgttgagtcggtagactatgtagtcaatgccaagttgtggtttcgcaatccccatgaacttttcttacatatgttattctgaactactaagatggattccccatagcacctggtgatttgtgagtggatgttctacttgcagtattctgcctatacttgtccgactgacgctgtatggctgccatagacattggtactccatcccgaggctagctgcacagtgggctgcatatttggggagagaaagagtgctaaacatcctcgtagtgcgctagcagtcgtacgctgcgtgtcgaccgtgtcgtgatgtcggtgactgcttctggcgaatccgtagtccgggcactgtgaggaacctaggaccatgtcggagtcgatgccctgatatcggacgacgtggtaggtgctgtccaagaaatgtgttcatgagaggtcgctttcattaatagcaagatgctgtcacaagggtaccggcaggggaatagttgcaaggcattgtgcgtactttgcgtatttgactttgcttcgctagctactttactgagcacattttgcaatggcttgggtagattgagtgccccatccactaaggaatgcgagtacccaaagtgggtagagacaggactcgtggtgatagagtggggagagtgcaccttgccggcacgtaagtcggcacaagtgccaacacgttctccgcgctgcgacggaagcttcaaccattgggtagtccgctgcaaagtgggcacccgttggtaccttcaattccccacgaacggatgtatgtctcagaggaccacgcaattagtgcatacacctagcgacagtgcagtcgagacgtccagggcccccacgtttccctacagttgccacattggtgggccaccgttcctaacccctaaagggtgacacagaccccatgtgtctaacatttcgcgaaggcgcatgccttcccgggacctttttgccgcacaagtagcagtgggaacacgtctggtcatggaacattaggcctacccaacattcctgctggaaaaacagcttcgaaaccacaaatggctttggaaatgaacccccatagcgcaatgcgcccctttctcatagggagaggggccacaacaacagattagccaactaaatcgagctttctgaacaattcccccctttgggcaactccaaggaatcacgaaaacgatgatgacaaagggctgtccaattatgagtagggcccctgaaagacccaaatatccccattgggtaccactcatggttcaatggtagtttgagacattcgctgcttggtcacatcggctttagagaactcctttggcctatgacacctttgtgcacgttagaacctttctctatgcctccgtggtggtagaagagcaacacn

SEQ ID NO: 567747 - DNA, 202 bp, Homo sapiens
gctgggagggtggaggtgaaggatggggcctagagccgtgtggtgaaggtcacagtgtcctgagctagaaccacctgtggtatatggtctcacatcagaggcctgtctgatgcctcccactcaaccgctctcagagagtttgcaactccagagaaggagagtggggcacttagtgggcacaggctgggcatccaagatgggc

SEQ ID NO: 567748 - DNA, 269 bp, Homo sapiens
  misc_feature (38)..(38): n is a, c, g, or t
  misc_feature (46)..(46): n is a, c, g, or t
  misc_feature (77)..(77): n is a, c, g, or t
  misc_feature (98)..(98): n is a, c, g, or t
  misc_feature (125)..(125): n is a, c, g, or t
  misc_feature (133)..(133): n is a, c, g, or t
  misc_feature (200)..(200): n is a, c, g, or t
  misc_feature (246)..(246): n is a, c, g, or t
attcggcacagctcaatcatagcaaaataaaccttctntttaagtntacatagaacatttaccaagatagaccatantctggtccataaaatgtaaanggattcaacttatacaaaattatacanaatatgtnctctggccgtaatggaaatcaaaaacataatgattaacgataacttgacaatccccaaatatttggncaccaaataacttatactccactagtcaaagaagataccaaaggtnaaattagaaagtagtataacctg

SEQ ID NO: 567749 - DNA, 684 bp, Homo sapiens
gttggccagcgagacgcagggagatgctgtctctgagactagctctgtcaggcgtggtctgcggccggtcccttagctggacccgtctccatccccagaaggctattcacatgatcgattctgatctttgcttactcgccgatttcccacgacacgatgtccctttctacagctgctggaggactggactgctactactagtcctggctgtgggcagtgagagaatcctggcagacagaagacaaacttgcgacttggtaggagaaaagggtaaagagtcagaggaaagagttggctctacgtgaagagtgctgaataccactgtttaataataagctatgagagcactgtgtgcgccagggctccagacacatacatctacatcttcagggtgtgccgggaagctggcaaccacacttctggggcatggcctgggttgcaagggtcaggcacaaagtcatgggaaggaggacagatggtagggacgactcaatgagcactcacatcttcaacggaagttattggatcatgctgcatctataaagggggtgatgaatatgtacagccactgtggcaatggagtcagcgtcgtgcaaggtggtgatgatctcctgcaatcgacacaacccgtagacggacaaattttaaacccttgatgtctgaggagcgtgggcaaagttccaa

SEQ ID NO: 567750 - DNA, 449 bp, Homo sapiens
gagctcgctaccgttacaggttgtgctgctcaccaagacctgactctccctcggttcctgtctctcctccctcaccttgacctctccctcgtgttcctgtctctcctcctctgaccctgacctctccctcgtgtcctgtctctcctccactgaccttgacctctccctcggttcctgtctctcctcctctgaccctgacctctccctcggttcctgtttctccccactgaccttgacctctcactcggttccatctctccccactgagcttgacctctcactcggttcctgtctctcctcactgaccttgacctctccctcggttcctgtctctcctcactgaccttgaactctccctcggttcctgtctctcctcctctgaccctgacccctccctcggttcccgtctctcctcactgaccctgacctctccctcggttcccgtctct

SEQ ID NO: 567751 - DNA, 324 bp, Homo sapiens
attcgcggccgcgtcgactttttttttttcctccaaaattgtatttatttacatgaaaacaccattttattcaaattgaagacacatcctaaaagaagggtttgtccaggcatgccttcctaatccccttatatagtcactatcattttcatattgtttagtgtcataaatgaaacttcttactggttatagaaaattgaattggtctcttctacccacccaaaactactttaattatttaatgtgtgtagtcatccttcaaagaaaagtcgacgcggccgccaatttagtagtatgtatgtccacccggggacttcggaccgg

SEQ ID NO: 567752 - DNA, 102 bp, Homo sapiens
cgtctgcaatgacggacacacagctccaatagtggagaagtacacattacgtatgtagtctcccgccgaccaaaaatacatactgcaaaatgcagtatactc

SEQ ID NO: 567753 - DNA, 236 bp, Homo sapiens
cagtcggcaaagctgcgtttctggccgcccagtgttcgtcttcagcaggtggctgtagaccattgtcgcccggggctgaggcccaggagcccttctccggacccctagctggggaagagccgattgccttactgaggtggctctgcttaaggccatgcctgcaggccggatggtgacagtaagaggtgggctatccgtgaatcagcaacgtgagcacaggggggctccctgtaaac

SEQ ID NO: 567754 - DNA, 150 bp, Homo sapiens
gcagggctggcaaaagctgtcattggtgttggaccttgcttgacaggaagtcgcagagaggctttgaatcttgacctcgtcctatatcaacaaggaaaggtgcacctgcctgccattcctgtgtgaagacatccctaagacctagggtac

SEQ ID NO: 567755 - DNA, 535 bp, Homo sapiens
tctcaaagatggggagacgggggtctcaccaggtgggccaggatggtctcgatctcttgacctcatgatccacccgcctcgacctcccaaagtgctgtgattacagggtgtgagccactgcacccggcctgaaatttttggaaggtgaaaaggtttggacaagttccttttacagaataggtttgggagcagaactctttcagttggtaagacccaagttggctttggtttagcttcacagcatagctgaaagtggccaaacggtacttggtgcaataaagtagaattctatatggataagcaaactatttccaaactaggagggtgatagataggggtgtgataaatcaaatgatatgatcagagtaaagaatttggccatttggatccttttagttggtttaagccacctatagggtaaccaaccatctttatcctggtgggcggggataataatgaactaatggagggttccaagataattgaaggatactatctttccaaagtgtgttagatttgaaaggtattatggacc

SEQ ID NO: 567756 - DNA, 466 bp, Homo sapiens
acagatattgaagggaccaatgggaagtgacacaagatgccgcgtcaattgacaattttagatttacccaggtaacggcaacgtacagactaggggggcggtggattaggaagaaggggcattacggatgaggggacgagagagagggtatgaagggaccaggcggggggggcggacaatacgaagaaaactgagagagcggaaggaaaacgagataggggggggtattgtatggaagaaaaattaacgggcagcagagaaaaaagtaataggtttggagtgctgcacggggattgcatgaaatgctagggtggagtacaccgtatcagggagacgcaatcgatgagggattataggcatacggccaagggggggggggattgcaggtgcgtgtgagggggggagtgtgggcaccgaaaaggcgggattgacaaatactacgtagtgtgtgtgcgggagagagata

SEQ ID NO: 567757 - DNA, 600 bp, Homo sapiens
gctccagtctacagctcccagtgtgagcgacgcagaagacgggtgatttctgcatttccaactgagctttggaagagagtagtggttctcccagcacagagtttgagatctgagaacggacagactgcctcctcaagtgggtccctgacccctgagtagcctaactgggaagcaccccccagtaggggcagactgacacctcacacggccgggtacccctctgagatgaagcttccagaggaatgatcacgcagcaacatttgctgttcagcaatattcgctgttctgcagcctatgctgctgatacccaagcaaacaaggtctggaatggacctccagcaaactccaacagacctgcagctgagggtcttgactgttagaaggaaaactaacaaacagaaaggatatccacaccaaaacccatctatacatcaccatcatcaaagaccaaaggtagataaaaccacaaagatggggcaaacacgagcgaaagtgaaatctaaatcgagcacctcacccctcaaagaatgcagtcttgcacaatggacagtggtggcagtgcttgcatggagacagtcaggtacttccgtaaggagtgcc

SEQ ID NO: 567758 - DNA, 144 bp, Homo sapiens
tgagattgtgccactgtgctccagcctgggcgacagaatgagactccatctccaaagaaacaaacaaacaaacaaagcactaactagctcagaggacaatgctaacatttccaaagggtcctagaagttggttcccagaaaaga

SEQ ID NO: 567759 - DNA, 1054 bp, Homo sapiens
  misc_feature (262)..(262): n is a, c, g, or t
cacgcgtcgcagaagacctgcccgagctctgcacccgagaggaggacccagaaggacgtcaggggaggctactgggacgctggaaggcgctgttgatccccccttccagccccatgccaggtccctagggggcaaggccttgaacactgccgggcacatgcatcgtgccctgtcagcccaaattttgccctcacatcctgcagtctcccgccagcacaggaagtgacaacatgacagaggggtgcgtgctaggcagtccagngtgacgagttcgctgacagtgggcttcctgtggaagataccatatggatggctctgagcggccagcaccaggctcactctcctcgccgtactcgctgggcacacgagatcttcacatcgatgggtccaggagtaggaatcccgtaggtgcctcaagtagccctctccctggctaggcatcttgtcccctctattcctctagggagcactgtgcccactctttctgggttttccaagggaatgggcttgcagagatggagtgtctgttaaaatcgaacaggaaatacaaacgtgtgtatgagcccaggcaagtgaagctagacatcataacgtagccaccacacaaagggggaagctcacctaagatgtaccgcgcctggagggcccgccgactgtttacactgttacctggtgcttacgttgaacgatagcggggcgcccctttacggctgcgcattcccccgggctgccgtaggtcccgtgcgacgattctagaggccagactgaagactggcaaagattcccgtcgcacccccggagttacccttacgtagacgcgacacgccctgcaaccaacgcccgcgtgctgacaccacaacggggcacactgacgccccccgtagcgcagcacttacacacgcgccttgaagcgcaacgcttcccacactccacgaacgcggctaaccacggggctctacacgcacagacgaccgttctcgccacgcccagcgctcgacaaaccttgggacactgacgcgcggcactcaattcctgcaccacttttctcttccag

SEQ ID NO: 567760 - DNA, 359 bp, Homo sapiens
ggcagcttctgagagcaggttgctccgttccgtgctccgactcgccagttgacttcctacacgctatcgccagtcgtcggccacgtcggtccttcggaggcctgggcggcggctccgtgcgtttggtggccgggggtcgcttttcgcgcgtcccagcatttcacggggggctccggtggtcgaggagtaatccgtgtcctccgcccgctttgtgtcctcgtcctcctcggggggctacggcggcgggtacggggcgtcctgagcgcgtccgaggggctgctggcggtgaatcgagaagctaatccatgcagaacctcaacgagacggctgtgtctcctacctgggacaaggtgcgcgcc

SEQ ID NO: 567761 - DNA, 380 bp, Homo sapiens
gggcctgggcccctgactttttaaagatctagaagctgaaataccatttgacccagcaatccaattataaatcattctattagaaagatacatgcatgtttatgttcattgcagcactattcacaatagcaaagacagaatcaacccacatgtccatcagtgatggactggataaagaaaatgtggtacctatacaccatggaatactatgcagccataaaaaggaacaatatcatgtcctttccaggaacacgaatggagctggaagctgttgtccttagcaaactaactcagaaacagagaaccaaacaccgcacgtcctcacttacaagtgggagctgaacgatgagaacagagggacgcgtgaaagagggaaggat

SEQ ID NO: 567762 - DNA, 412 bp, Homo sapiens
gtagtttgagaccagcctggctaacatggtacaactccatctctactaaaaatacaaaaattagcccggtgtggtagcaggcgcctgtagtcccagctacactggaggctgaggcaggagaactgcttgagcctgggaggcggaggttgcagtgagtcgagatcacaccagtgcactccagcctgggcaacagagcaagactcactctgaaaattaaaaaaaaataaaattaaaaaaacgtgataaactaatgactaagtctttttcttttctttttttaagagatggggtctctaccgggcacagtagctcacacctttaatcccagtatttaggaggccaaggtgggcagattgcttgtgcccagaagtttgattccagcgtgggcagcaatgtgaaaccccaactctac

SEQ ID NO: 567763 - DNA, 692 bp, Homo sapiens
  misc_feature (82)..(82): n is a, c, g, or t
  misc_feature (125)..(125): n is a, c, g, or t
  misc_feature (133)..(133): n is a, c, g, or t
  misc_feature (169)..(169): n is a, c, g, or t
  misc_feature (179)..(179): n is a, c, g, or t
  misc_feature (236)..(237): n is a, c, g, or t
  misc_feature (240)..(240): n is a, c, g, or t
  misc_feature (256)..(256): n is a, c, g, or t
  misc_feature (261)..(261): n is a, c, g, or t
  misc_feature (268)..(269): n is a, c, g, or t
  misc_feature (283)..(283): n is a, c, g, or t
  misc_feature (290)..(290): n is a, c, g, or t
  misc_feature (293)..(293): n is a, c, g, or t
  misc_feature (305)..(305): n is a, c, g, or t
  misc_feature (317)..(317): n is a, c, g, or t
gcacgaccacagcagccgtggtttggccttgtgtgtctggagctgtacaaggttgttgcaggggcaccgacagctttgactnctacaagaatggtttcctcaacttggccctgcctttctttggnttctctgnaccccttgccgcaccacgtcaccagtactattaccnagagtggacnttgtgggatcgctttgaggtacaagggctcagcctaatggtgaggagatgaccctcnnacngttctcgactattttnagacngagcacnnattagagatcaccntgctgtnccngggcgtgtccanactctattcctncttcatgcccgctgcccagctcaaggaacggttggatcaccgatgacacgagattgtgaccctgtgtcgaagcgaaagctgggccgccacgtgcgggcgctggtgcttgagctgtgctcgttacgacgagacggcgaggattcgaggttccctatgtccgatacaccactccgctgaccccctctgctcctttaggctggccccttgtccacccctctccacaccccttcagcccagggttcccatttggcttttggcaatggcccaactacccagtctggtgttccctcatcatccccctacctggacccctcttgcccctgccttctaccttgtttggaacctgaatcctaataaagcattaattactcccca

SEQ ID NO: 567764 - DNA, 986 bp, Homo sapiens
  misc_feature (303)..(303): n is a, c, g, or t
  misc_feature (440)..(440): n is a, c, g, or t
  misc_feature (456)..(456): n is a, c, g, or t
  misc_feature (674)..(674): n is a, c, g, or t
  misc_feature (684)..(684): n is a, c, g, or t
  misc_feature (732)..(732): n is a, c, g, or t
  misc_feature (743)..(743): n is a, c, g, or t
  misc_feature (765)..(765): n is a, c, g, or t
  misc_feature (767)..(767): n is a, c, g, or t
  misc_feature (812)..(812): n is a, c, g, or t
  misc_feature (836)..(836): n is a, c, g, or t
  misc_feature (899)..(899): n is a, c, g, or t
  misc_feature (908)..(909): n is a, c, g, or t
  misc_feature (914)..(914): n is a, c, g, or t
  misc_feature (916)..(916): n is a, c, g, or t
  misc_feature (935)..(935): n is a, c, g, or t
gaattacttcaggccttctccataatatctgttagatagaaattgccagtgagcaagtgagaatttttatttctcaatacctgcttcacttgatgaatcatattataattttttatcatgattattgactatatttttggagtcccattgtttcagtgggcattaacagaatgctttaaaaacttctaagacaagaatctatagcattagtatacactggcacataattttttaaaaagttttaagaaaagatttcatttggaattttattcacagtataaaatttcctcacctgaagtaacnttgtttgccaaaaaagttgttttaataaactataatttttgaaaacttccttttttattagtttagaaagccccttatttttcaacaaaggggatttgtacacataacatgggttatttagtttaactctggcaaanaaaaaaaaaaaaattntggtatgtcggatgttggtataccggttcagtataaaagtgtcctaagcatattagccaatcttttcacagtagagcatacttaaggctgctgggtactggagtatacttaaatataactccagaaatccagggactgggtgttaaaacaggattagagcatgtaaaggtacatctagattcatatttgaatcttaaactgtatttttctcttagtantggctaatgnagtaaagaaaagtctcataaggtagccaaatgaaaaagattgaagggnaaagtgaaaanttagaggggccaaaagatgggntntgtgaacagaagaattctagtttgagggtgactcatattcacgantaggatacaacgtgtgattgtgtnggacaacatgtcccaaatttctaaaattctgcttctctgccaaaagcaagtgtcttcttggtngatatcggnnttcanangggtcaatctttcaatttngatcttgagaggggagcctagaagaatcagcgggtctaatcccccagtaga

SEQ ID NO: 567765 - DNA, 859 bp, Homo sapiens
caagaggggttatgtctataaccttgagttggaccgtgtgtactggcctgaattcccaccgtaccgaaagtgtgtcgcagagaatgtagaagggaattttctaaaggggctccctcgggcaaaggtttctaccaagaagcaagttgtaaatgttggtttgctggggcgccacaacatatgtaccccgctttgccccgggccgccttttttattataaagccccccgtattgctcgcccacccgcccggcctcttgtccagaagacgtcgccgcagttttttacaccaagcgcgcaaatggttcccattattatataaccgttcggttagtagttctttccacgcggtgcgccctttttaaaatggtgatgcgacccaagggttttggtgggttctgaaaatttaagtgttataatgttatggccccccgggctgccggggaaatccacccccatatgcgctaagatgtttgtaagcaccacgaaatttaatattgggttcgcccctgctgtggttataagtgagaagcgaaacacgctagaagttgtgaaaaagttgtgtttagattacaccaacacctggggaattctcagagaactataaagtgttttgtgtaagccgaccccaaagaaagatattatagagatatttatctcatctcccagaccttttccaaggaataggatccataattctttaatggggatttacgccgcgtgttctttatccctaatagtgttctctccccctttttaccacaatgcctgctgccccacaccctccttgggtaaataaaataagccttggaacaaggaaattaaaccaacccttggaaaaaaatttttttaaaccccaaaaaa

SEQ ID NO: 567766 - DNA, 233 bp, Homo sapiens
tctgaggatcccaagcttacgaggcagcattgttaaaaagtctaacctaaaagcccaaatgtccattgagagatgaatgaatgaatacacacacacaaacacaatggaatactacccagccatatgaaaaaatgaaataatgccatttgcagcatcagggatggatctacagagtatcacactaagtgaagtaagtcagaaaaagacaaataccatatgatagtaccctcgtt

SEQ ID NO: 567767 - DNA, 1109 bp, Homo sapiens
  misc_feature (426)..(426): n is a, c, g, or t
  misc_feature (563)..(563): n is a, c, g, or t
  misc_feature (579)..(579): n is a, c, g, or t
  misc_feature (797)..(797): n is a, c, g, or t
  misc_feature (807)..(807): n is a, c, g, or t
  misc_feature (855)..(855): n is a, c, g, or t
  misc_feature (866)..(866): n is a, c, g, or t
  misc_feature (888)..(888): n is a, c, g, or t
  misc_feature (890)..(890): n is a, c, g, or t
  misc_feature (935)..(935): n is a, c, g, or t
  misc_feature (959)..(959): n is a, c, g, or t
  misc_feature (1022)..(1022): n is a, c, g, or t
  misc_feature (1031)..(1032): n is a, c, g, or t
  misc_feature (1037)..(1037): n is a, c, g, or t
  misc_feature (1039)..(1039): n is a, c, g, or t
  misc_feature (1058)..(1058): n is a, c, g, or t
gaattacttcaggccttctccataatatctgttagatagaaattgccagtgagcaagtgagaatttttatttctcaatacctgcttcacttgatgaatcatattataattttttatcatgattattgactatatttttggagtcccattgtttcagtgggcattaacagaatgctttaaaaacttctaagacaagaatctatagcattagtatacactggcacataattttttaaaaagttttaagaaaagattcatttggaattttattcacagtataaaattccaaatgaatcttttcttaaaacttctaagacaagaatctatagcattagtatacactggcacataattttttaaaaagttttaagaaaagattcatttggaattttattcacagtataaaatttcctcacctgaagtaacnttgtttgccaaaaaagttgttttaataaactataatttttgaaaacttccttttttattagtttagaaagccccttatttttcaacaaaggggatttgtacacataacatgggttatttagtttaactctggcaaanaaaaaaaaaaaaattntggtatgtcggatgttggtataccggttcagtataaaagtgtcctaagcatattagccaatcttttcacagtagagcatacttaaggctgctgggtactggagtatacttaaatataactccagaaatccagggactgggtgttaaaacaggattagagcatgtaaaggtacatctagattcatatttgaatcttaaactgtatttttctcttagtantggctaatgnagtaaagaaaagtctcataaggtagccaaatgaaaaagattgaagggnaaagtgaaaanttagaggggccaaaagatgggntntgtgaacagaagaattctagtttgagggtgactcatattcacgantaggatacaacgtgtgattgtgtnggacaacatgtcccaaatttctaaaattctgcttctctgccaaaagcaagtgtcttcttggtngatatcggnnttcanangggtcaatctttcaatttngatcttgagaggggagcctagaagaatcagcgggtctaatcccccagtaga

SEQ ID NO: 567768 - DNA, 128 bp, Homo sapiens
tcgtacctgcatatggcaggccaaggcacaactcctaggtagctttctatttcgtacgtggttcatcttcctagatatcctgcactagtccgctgccttacacaactccttggccttgccatatgcaa

SEQ ID NO: 567769 - DNA, 698 bp, Homo sapiens
acaataaaattagccaggaatggtagcttgcagctgtagtcccacctactcgggaggttgaggtgggaagatcacttgggcccaggaggttaaggctgcagtgagccatgagcgtgccgctgcactctagtctgggtgacagagtgagactctgtcccaaaaaacaaacaatagtcctcaaagtccaagccatggttttctctaccatgctgtaaggtatagaatttttatatttttatttgttacagggtctgtctctgatgcccaggctggggtgcagtggggcaatcatagctcactgcagcccccaactcctgggctcaagcaatcttttgccttagccttccgagtagctaggactagaggcacaggccaccacacgtgcagaatttttaacattctgtgttgacgatgggggcttcactatgttgcccaggcgggtctcgaactcctggcctcaatccatcctccctcttcagcttcccaaagtgctgggattacaggtgtgagccacgaacctgtcaagtacaaaatgtcgaggctgtagttgagaactttatttgctcaatacaatagatctaaacctactattgcaagtatggctggggtgcggggggctcacgcctgtaatcccagtactttgggaggccaaggaagcgtggatcccaatactttgggaggcctaggaattcacgacc

SEQ ID NO: 567770 - DNA, 296 bp, Homo sapiens
  misc_feature (119)..(119): n is a, c, g, or t
ctcttagaggatcccctctctgcccccagatcacacaacattataagatgcataactttatgtaccactaaacaaggaaaagcgctaccaatgtaaatattacaatgccatatgattgntacaatgcagtcctgagtttcacgagatcttcaaaatataaaaaagtatcagtactgtaatcagtgaaatgtggtatatttattcattgattgaagattgaggtaaatggatttcaaaagtcatttccagtataatcactgctaattatattgtattatacatgttctcagtcatta

SEQ ID NO: 567771 - DNA, 279 bp, Homo sapiens
atgtcttacggtgttctacggctaaatctgatttaacgccttttgtctcttccttcctcgatcagaaaagagcctcaccttttcctggtagatctctcagtaggacatattgacagagagagcccatggtcggccctcagcaccctcctcccttgtgagctgcaggaggtccatgaaagcgcgggggatcaccccaggcttgctctggtgccgtaagcacataactcgcggtggtaccgacgctcgaacttcgataagtctctggctcatagtctattt

SEQ ID NO: 567772 - DNA, 167 bp, Homo sapiens
  misc_feature (131)..(131): n is a, c, g, or t
caaaatcactctctctcgaaataggtggaccaaaattcttttaatctcacctccaaagtctagaaaactatgtccgtcctaaccagcacatattctcttaattacactgacacgcatatcgaattcctganacacattgactaactgctttatgactgtacattaaa

SEQ ID NO: 567773 - DNA, 737 bp, Homo sapiens
  misc_feature (737)..(737): n is a, c, g, or t
tactgtatttcttccttcctttcaatttcgtcgccccaaacaataaactacctaatttaaatgggttaccatttcccatcagcacccctctcctgtcctaggtgtatattcctaacaaagaaacgggcaaggaaagtaagacaacatgcgcacctgttctaaaaccactgggtgtctgctcacatgtccctcctcaaaataaaactgactttcacaagagatcacgggactttgactcacacaaaactaaatccaaatcccatctctactctctccgcccaattaccctttcggaaacccatttatcttcctaacaatttacctttttatctaggagatcaaaagaaccctatgtttccttccctaagaaactcccttcccacaaccacaaaacctgcgcagctttactggcttctccaaccatcaaacacatttctactctttatccttaacactaaacaacatcgcctctttgcctcccctcgcaactttcccacccctcctttacccaggcgtactcgtcacccccttactaatcccttcctccggcccctggttcgccaacccccccctcccccccagccttctccggtttcccctatccccggtaccccccctacacctctcccccttccctctcctgccgtgcccctgaccgccccatcccgcccttctctacctcgctccctacccattacatacatgctctcgtcgcggtgcggaccccaccgcctcan

SEQ ID NO: 567774 - DNA, 709 bp, Homo sapiens
  misc_feature (7)..(7): n is a, c, g, or t
  misc_feature (31)..(31): n is a, c, g, or t
  misc_feature (78)..(78): n is a, c, g, or t
  misc_feature (108)..(108): n is a, c, g, or t
  misc_feature (144)..(144): n is a, c, g, or t
  misc_feature (148)..(148): n is a, c, g, or t
  misc_feature (259)..(259): n is a, c, g, or t
  misc_feature (291)..(291): n is a, c, g, or t
  misc_feature (304)..(304): n is a, c, g, or t
tgtcgtnccggctggacgcaacatcaggttntcgccggtgaatctgccggaatcccgggtgatgcgcctcaagaggtngtatcccggatcggtggtcaagcaaacagngggtttggtgctggtgcctaaacccatgactgcaangatngggggccagccattgggcggtgccgacttgttgaagtggagtgccgacctcgtgacgaacgtcctggctgttgacaccccgatcggcgcgggccggcccactgagccatanaattgtgccgttggcggcataagatgaccagntgtaccctttttncgtggcaggagatgtgatgacgatgcgacgacgactcggtgccgctgcggtggctgttgctctggtgagtgtggcttccgggtgtgcgagttccccgagcaacgcggccacggtgggaaatacgacggtgaccatgaagtccgtttgacgatgccgtcgagcattgctcgaagttcatcaacccgtcctcggaactcaccccggcccagatcatcgccttcgaggttattcgtggagccgttgcgcaagaggtcctggacaaacgcggagcggaagctctctgacgccgaacggtgacccagatgtgtcgctcgaacatggttattggtgcttagattccgatccaggtctgtccacaccgagggggttccgtagctccgcgggttgtgttcccatcttttcgac

SEQ ID NO: 567775 - DNA, 212 bp, Homo sapiens
ctggactactgggctgtagcttccatgccttcctgagtgtacagacacagaatggggacttgaatcatggcaaaacaggtatgggagggggagaagatgaggtctggttagcacaggtggtcttggttagaaagtttacagatatgcagtgctcaggagagaatagagttgatgaatagcttttcgggacctttaaacgatgtcttgactct

SEQ ID NO: 567776 - DNA, 92 bp, Homo sapiens
caacaaacgtttcgccttttgttagatactccattccattgcagtcgggttgattccattccattccattccattccggaagattccattcc

SEQ ID NO: 567777 - DNA, 468 bp, Homo sapiens
gggccggcctggggctgcggggtgcctggctcaggtaagaccggagggtgggagcagttctagaggggtcaccaggggccgcgtactctcgttgcggcgcccgagctgctcccgtgccgagccgagggccttcggtgcgagcgctctagtggcaggacgcggcccgtggcggtgccctctgcatgctgctctggtccctatgcacatctcgtgtggtcactcaggcatcgtaggtgcggtcacccgctcgggcgcatgataggtcccaggtgattgcgcagcgacaaggacatgagcacgccgtggggtcgtcacacgacaagaagggcatccacatgtgcgcatggcttcacatacagaaagggtctccgttgtgtgaagaggtaggacaaaggactatctgacacacgaagggttagtgtcctaatttcacgtagaaggcatgcccagtcgaaatagattcgccag

SEQ ID NO: 567778 - DNA, 104 bp, Homo sapiens
gcaaacctcaaggagatggaggaccctttgaaacacagatttggctcaagtccgattgccatattaagcggattccatgcgttcagacgttgctgcagtctttg

SEQ ID NO: 567779 - DNA, 264 bp, Homo sapiens
cttgtcctctcttggctttttgggattccacagaacgcacatacagaaacacattgtgaacatatttcttcatcttcctctcttcactaatagctcaacttctagtccagttttatgtgtgacattttgtacctgagttcttcagtgaaattttacattgatctcaatatcacaatttccctgacggtttaccgctttcatcttcttgaaggaagaatatatggtcacaaaataaacttgttaataaagtgactgtgttggttt

SEQ ID NO: 567780 - DNA, 934 bp, Homo sapiens
aaagatcatgtgacattcggactgtactatattagccagtgtctgcctgacttagctaaatacataactatctccaagatggggctaaaaactgctatgattctacagctacacatagactcagggatatctactattgtattcactactagaagggctccatagtatgtcggggtactgtaggcagtaaacactgtccttgtggttatcatgtgtattaaattaggaaccaatgaacgatcaataatggattcgctgcagtagttatactttgtactggttgagcaactatggtgtgcttagtaggtgtagtgttgggtgaagaactcatccgtttattgtcttgtaatatgaagttagagtgcctttttatatttgtatattctgaaaatgttctgtggaatgttttgtatatcatttgagtgtatcagagcaatatgataccagtgagttttcatttcaacttttctttgaatgtataaagtgtcttttttgcctatttccccttgtacttgcattgaaatgaatatgaaaatgcttaagttttctataggaatagttgattttgcagtgctaaaatgctttcgtcttacgaaagtataaacataggtcagtattataggggaaaaagcatttagatagtgaaatctgagtgtgtataaaagtaattctagggacgatacctactgtgacctaaaaaatttcaggaacatatcttaaataggaagtttgctacataatttatgtccaagctggccacatactttgcaagccgagaacaactgggccgtgcatattgcgtacactggcagcacactgcgcggacagggaaggaagaggccgaccgcgtacaaccagaaaacaggcaggaaaacaggagaaacaagaaaacagacaccacagacaaagaacaaacagaagaaaaaaaaggcac

SEQ ID NO: 567781 - DNA, 807 bp, Homo sapiens
cagcctgggtgacagagcgagactctgtctccaaaaaaaaaaaacaaaacgagaaataagagttcccacatgacagcaagaatcactggaaaatggctgggacccactggtcaatggctggtattggttggcaaacgaaaatggtttatcttggcctaagctttaaatgtcacacatgccgtgggaacttccaactatgaacacagtctggcaaagcagacaccctctccctgcagcctcgtggaaaatgacctcctttacatttcctcatggagaatctgcccagtgaggactgtggcagaagagagtcagggagaattttctagctgataagggttagaaaatgaagacgagggctctctggtaatcagcaggaagctatgatagaaaagaatgccttttaaattgtgaagtgcaaaacctagaacaattcgaaaattacttaggggggttcgactatgaagtttcggaattcttttcaagacctgggtgtctgaagttaagattttaaataatggtcggaaggtcacagtctatactgatgggtcaggatatgctaacccaaaatatggcaccttggtgttcgagaaaatgcgggaagcacggaaggtcatttctcagcgatccaccgtcccttttccccctccgtgaagcaagttctacatttggaaagggccccctcccctggtaccacgaaggacagggaaccctgcttacctttggaagtcaacagggttcacagcagcaagaatcctgaaacagggacttccctaatccttccagttggtcaccattgcgctaatacca

SEQ ID NO: 567782 - DNA, 610 bp, Homo sapiens
  misc_feature (216)..(216): n is a, c, g, or t
taacacaatagtggcacgatccactaggtaggaggtgacaaagctaccgagtcgtggtgatagctgagtcggccacagagtagaagtcgctagtgtactaactcttacaatttagcccacgagaaggccgtctaaaatcacccgttgtttagaatcttaatctcgttatgtccgataacgttgggagtcagtctcttgtgagtactactcagagangagaagatccattgtagaagcagagtaatcaacatttacagcacccgatagtgaggcctaaaagcagccaaccaatttacgaaagcgttcaaggctcaacacccactacctaaaaaatcccaaacatataactgaactcctcacacccaacttggaccaatctatcaccctatagaagaactaatgttagtataagtaacatgaaaacattctcctccgcataagcctgcgtcagatttacaacactgaactgacaattaacagcccaagtatctacaatcaatcaagcaagtcattattaccctcactgtcaagtccaacacaggcatgctcataaggaaaggttaaaaacagtaaccaggaactcggcacaatcttaccccgcctgtttacc

SEQ ID NO: 567783 - DNA, 112 bp, Homo sapiens
gtccatttattacattaaaatgtttatccctctatattagtattcactttatcttaatctgttgctgtgtctggaaaattttagagctaggtatagtgaccgtgaactttct

SEQ ID NO: 567784 - DNA, 105 bp, Homo sapiens
atccacgctatccagaggctgagatctgagatcgaccacgtcaagaagcagtgcgccaacctgcaggccgccattgctgatagctgagcagcgtagccagaagga

SEQ ID NO: 567785 - DNA, 488 bp, Homo sapiens
  misc_feature (253)..(254): n is a, c, g, or t
  misc_feature (256)..(256): n is a, c, g, or t
atcagtcgcgtcgatacccctattgcttcatatcgactctagcaataagtattgcgcttgttctcccttagcggtaccttggttccgttgttcaccgttattgtatcaatgcagtctagtacttcagctctatattggtgatatcttttcatgtcccgctcttaggttgggttctgctccgatgtcgtcccgacctcgatttcttatgcatgttcgttactttatgatctgtgtgattgtttctcctatatgnntnaataaattacagctccatagggtcttctcgtcttgctgtgtcatgcccgcctcttcacgggcaggtcaatttcactggttaaaagtaaagagacagctgaaccctcgtggagccattcatacaggtccctaattaaggaacaagtgattatgctacctttgcacggttagggtaccgcggccgttaaacatgtgtcactgggcaggcggtgcctctaatactggtgatgcta

SEQ ID NO: 567786 - DNA, 340 bp, Homo sapiens
cggcctcttatacccattgtcgggcctccgggtggcgcgtgcgtgtcgttctagctcatctcacgaagagtgcctcgtggcgtactcggttgtcctcgtggagtcgaacgtgttaggcgtgcccgctattgcgtcggatcgtcgtccaacctggtcgagacagggaaactcttgtctcaaaaaaaaaagggtgaagagtattcaggaagatctctaggatacaaggcaaaaaaatatattttttatctcacccttttaaaatgtctattgggtaatgtgcctggcacattacatatttgcaaatacttatgtacttaaatacttatactaccacgacaca

SEQ ID NO: 567787 - DNA, 659 bp, Homo sapiens
cgggtctaaatacagtacagtcaggaaggaccctctatgctaactcaataaatagtgcattgagtacagagtacatataggagattacggcagataataggacaaagaagaaattcagtgtggcgctaacaataataaagtagcaccagagaataaccacaggaaacaaacactaatctccgactactagcatttgaggggtcgctatacacgtcgacagtgagttaactcggagggattaaccagtgggttacaaaccaacctctgaaagatactaaaactattagtaacagaagtctatctaatggagcaccgtagaattctgttggccagttttttacttactctacactgattagtcttaaatagcaacatgtactgatcccgaatctcgataaacataggtgtcgtacgagaatgatgaatggcatttgaactacaacagatgggcacgaagttaaccaagacgatgggatcaggagtattccagaatggcgaggtttgataactagagaagggacaggattcagattggaagcagattcagttttaaaaccctgctctgtgttacatgagtatatagtaagcgctactaagcgcaaaaagaaattccggggaaaacttccaaaacttgagtggtggtcacccaattgttaacc

SEQ ID NO: 567788 - DNA, 346 bp, Homo sapiens
  misc_feature (65)..(65): n is a, c, g, or t
  misc_feature (104)..(104): n is a, c, g, or t
aagcttttctgtctccgatttcctgaacggtttaaggaccaggaagaaacaggctcctgccagcnccgacagcaacgaaaatgttcccccggagatcaggatgnctttcttaagctcagtggaggttaaaaaggggcccgggaagtgtacagaatgttcttcctacgcccaacccaaacgtcagttaatgttccatccatgctgcttaaagagcattcctgtcctagtaaaatgggcaagtccctttacccccccccctcccctggtatgcttacattaatagctaaagtcaatcctgtaatgaaataaagcaagtggtagctgtttggtagcctccccttctgca

SEQ ID NO: 567789 - DNA, 485 bp, Homo sapiens
gctcgacttccattccattccattccattctattccattccattgcaatcgatttgaacccattgcatttcattccattctattccattccattccattccggaagattccattccattgcattccattccattccattcccctgcactcgcgttgattccattccattccattccattccattccattccgttccgttccattccattacattccattccattctattcgggttaattccattccattccattcgattgcaatcgagttgattccattccattccattccattccattccattctattccattcctttccattccattacggatgattccattccattgcattccattccattccattcccctgtactcgggttgattccattccattccatttcaatccatgccattccactcgtgttgattccattctttacattccattcaagttgaatccattccattgcattccattcc

SEQ ID NO: 567790 - DNA, 1344 bp, Homo sapiens
  misc_feature (613)..(613): n is a, c, g, or t
  misc_feature (621)..(621): n is a, c, g, or t
gcggctgtgctggctctgtcagacaagcctacagcatgtgaggctgagttcgagtactcgcatgcgttgcattcgagcatagtagccgcatctgactccaatggccgacaagcctcacgaaccagggagctatacgcattccgggagagagcgtcaagcagcattcatgagcgcataatatctgacgtatagccaccatgcctgcgtacccaaggagagacatctgtgaagcattgcggcacgtaccaacgctgatggactccgcagagtcagtgcgtggggcgtagcggtggtagcgtgtgttgagccggtcaagcccgctcagaaagccgcagacccttggctgggaatgtggggcgagaatcctatatggtacgaactgtgcgcctataatctgagattgggagaggagaaggccaatcctagtccatagaaacgcatggtgcccaggggcctgggcagtgcgtccgcaagatggacttcaggagcagccaattacggacacgctttcatgcttgcgggccatttgccctgaagtcgcgcaggcaaacccgaggacaagagcgccaagaagtggcccagtgcgcattgaaacgcgcatacctgagaggcntctagtgntccgttagccgtgaattgtgtccccggatgggaaaaccggaggcacgatgcgattccgaggtgctgtgattgggtgtggcttgagggcagcgagagtatgagtccgaaagggtgccgggaagaaggcactgtgcatgttcatcgcggttgagcattgcaccgccgcgttgtggacccgttcaggtcgatcgcccaaggggggattataggcgatggcgggttgtggtagacgtgaggattaggagggataccctggacaagaactacctgtgtccccccaaggtttcctcgtaccttaagcaaagggggggggcactttgggacgtgtgcccaattcttgcactggggcaatttcacggggccgctggtggcaaggaatatacaatttggcaataggccccccatgtctaggaattgaggaggcaccttacaggtaggtggggttacacaacgttactcgcaactaggctttgagtggcggctcaccttgagacattagcgtgttcccctcaccttggcctctcccaaaagggaaattgcaaccggaactttgtttccccgctttatttacagaacaccttacttgtatccagcaggttttcgtgggcccaactgcggggtaataccactttaccccaaattgtctttcatatgatggattccccatgtatatccctatacatttatcgcaagggttggcccccgctattgttattagaactc

SEQ ID NO: 567791 - DNA, 1045 bp, Homo sapiens
cgttgctcgcttgttctctctttgggttgcgtctgtgtacgttcccgtctggtcctcgtctttctctctcttcgtccttgtctgccgcgtctctgctgcgcgtgctcgttctcctgttccgcgtcctgcccagttgcgctactgctctgtctccgtctctcgttctgctcctgcctcctcgagccggtgcttgcgccttgctcgggcccttgcttcgttcccccccaccgcacgggcggagcgtgggactgctgtggggagcggcgcctctccctcgtttgatccttgttggtcattgagcgtctcgcctttggggggatcgccctactcttgggtctcccccgttctgttgtgttagtggtgcccgctgtgtgtatctcctgcggcctactcgtcccctcttctctctatgtagggcgcccgtgaattgctgtcccccgctttgttggcgcgccgttcgcgcgggcgtctcgactgcgacttttaagcccgttcccgcaacttgcggggttaccctttctggccctttattaaagtggttcacgccgtagaggtctgcttaagttgggggttcccccctcaagtgtgccagcggtcccctgctttcaggtcctgtgccgctaacacaacgtgggcccgcggagagcgtccacctaatgagatgggggcaactccatcagccgctttgtcgccaaggagatacaatacagggaatcccccgctttcgttcgacagactggttatcctgaagactgatacctcccaggctactcttcaagtattatgtgcttccaacgggcagccccgccggcgattcgctgtaagacacataggggaccgcttcttaatcttttgtgctttaatctggatttctcccatttttcacaggaaccaaaccttttaaccatctgtttccccaaataataaatattcgggaacacacccccacattctgagcagcaattctccccatcactgcttatttctccgcccacatttgcgcaccctatatataaaagattcctttcacaaaatcatagtacaa

SEQ ID NO: 567792 - DNA, 106 bp, Homo sapiens
agtctggttagtttcttttcctcgctgactaatatgcttaaattcagcgggccctcgagtgtcgcgccatatcattggtctgtggttgtagtccgtgcgagcccct

SEQ ID NO: 567793 - DNA, 847 bp, Homo sapiens
gagtctagttagtatcggcctgttatctcctttggcgcgagcacggtctcagctgtgtccgcctgaggcgagcgagcgctggccgccaacgaggtatacgtactgggagcctcgccgtcagtctcgtctccggcgcggtacctgccccgttttccctgtgagttgatctgctccgggcgggggcctggcattggtggggggcgtccgaccgcggtctgcgggcaggcgttggtcggcccgctcggattcagggaagaccagtactggctgggctgtgagtgaagttcctgcgcgcgtctggggcggcgtcgtgcgggtggtgacccctgggacccgggcaaaagaggggctcgccgtacggagtgtgccgtggacggtgggctgacctggtgggtcgggggcagaacgtgatggactgcgctgctacttgggggctcgataggaggtctggtacaaactgcttgggaggtacctggaaagcccatgctgatttgggctcggtgccaggattggagccccctcacgaggacgatacttccttcttgcggactgccaggctgaggagacgcttctgtacagcatcaagggggctggggaggaacgaatttgctgccccagagtggtgcatttgcgcaccatcaagggtggaggggggcacctcggtgctctccaacgaatggggggacctggccaggtcacttcaggactgggcacaccggggcaacgagctcgatgggaatgcccaataaactctttgagaaggccgggagaaatgggaggaggggccacagatcaaaacagggtggagcctcaaggggccggtagaaattcaacaagcggcaaaatg

SEQ ID NO: 567794 - DNA, 654 bp, Homo sapiens
  misc_feature (14)..(14): n is a, c, g, or t
  misc_feature (49)..(49): n is a, c, g, or t
  misc_feature (64)..(64): n is a, c, g, or t
  misc_feature (319)..(320): n is a, c, g, or t
gtctgctttgtcangtagggtatcagactgactcaggataaagcatggnagtaaagccactggnatggggtttggtggtttttgtttttggggaaaggttttaaccgggtttcaaaattaggaaattttaaaaaaaatttcttgggccggttttaaagggtttgcccctttaatccccgcctttttgggggggccgggggggggaataccgggggggggagtttggagccttttttgttttaaaaggaaaacccatttttttattaaaaaaaaaaaaaaattttgcaaagggggggggcctttggcccccttttttttnnatattgggggggaggagggggggttccccccccgggggagctcttttggggggggaaataccccccccctctttctcccgcgggggggggggggggcgtcttgcttttttaaaaaaaaaaaaaaaaaaaaaaaaaaaaagtgggggggggggggggcgcgcccccccccccctccttttgggggggggggggggaataataaaaaagggggggggtgtttttataaaaaaggggggggagaaaaacaaaacaccccccccaccaataaatttttgtgggggggagacgccccttctttcctttttgggaaaagaaaaaaaatcgcgcgcccccc

SEQ ID NO: 567795 - DNA, 2049 bp, Homo sapiens
cggccactacctaccacatacaaacgccacctaacgcccacaacacctctacacgtctgcgcacttcaacttctcgtgcgctacacacctgccctctactgcctctacgcaaccactaacgcacccaaaacccccccaagaccacagcaactcaaacaccacgcccacggcctcactaaccatacacgcaacgtacttacaactctacgcgcctcgaaccgctacgcgggcacccttcctcccccgtaccacccaacacgcaacttaacccccctaacccccccctccacagctcacaccacccacaccctcctaacctgcttacaactccggaagaccacacccccaacaccccggcaacctcttggcccccaattcatcatacttctatcctgggcgccttctcccgaaacgaagttaccctctacacccccgcaacaccttaacagacactctaccctcctggccccgccttggccttgtaaccgaccttcccctacgggcaccgacaccccttggcgcccaacaaccacaatccccttcaacatccaccccccttcgctcccaaccttggccaacaacccttatcgggcgccccgacccccgccgcctttcccaaacgccgcaaaacccttcactccctaacactccctgccccccccctttctctcggcacacacacgcgcgcaaacgtcttcccccattcactccgctctccagaccccccacggtatcgcgctacacacttgcacgcgccccctcctccttcgctctccgtcccccccgcccctcacctggcgcccgcgccccgctcgcccgcctccgccacgagccccgcccccccgccgtccgtttgggcgtcccctccccccccccctcccccctgccccgcctccgggcgcgcccccctcgcgtggcccgcccccagcgaccccacttggcccccccacctcgaaaccgaaacgcaacaccaccctgccgcgccgcacaactacaacccgccccccacccgctccacggcggaacgcgcaccccacgacaccaacaaccccacaccgcctggccaccgcccacgccacgcaaaccagcgtcccacagccacggacgcacccaccccgatctaccccccgcacaccaagcagcagcgcgcctcccctacaaacaaaacacaccccagcccgccgaccgcgaaacgccactcctgctcccccgacgacgacaccacgacacagaggcgggggcgccacctcccgtcctctcaccacagcaagacggccgacccgccccgccgaccaccccgcccccccgcccccgcgtcgcgcgcacgacacctaaccaccacgcaccccaccccgcctacggccagcacgaccggcaaccccacgccactttcccccctccaccaacaggaccaaccacctcgggcggacccaccacaaaaacgtatcgatgcgtagacatcacgccgcccccccccacccacacacttgtccgcaccgcatatatcaccctactcttagaacttacgcccgccgccccccctcctcacatcatcgactcccgctctcatcttctcccaacaaatccacgcagcagttacttcgcactaaatcgacaatggtgtaggcgcacatcaccaactacacatcttacacaccctatctatcactacctctctcagctaatcataatcactatatcgctaactatgtcaacacctagatcaatccactaactctacatatattgtgccgcaaccgaacgcagcacgaacgacgcagcccctcactcaaccccaccaccagacccggcgcacacacaccgcgcagcggcgaggcggcgcgacgaaatccacaactcccagcacccccgcgccgagacgctcaaccgcgaccgcaaagcatccagtcacaggccgccgcaccccccacccacacaccgcgggcgtcccgcccgcacgcgcgaacaccatctctccttaacgcccgacctccgccagcgccacacagccatcacccccgtcgcctatctctcccacgccacgagccc

SEQ ID NO: 567796 - DNA, 170 bp, Homo sapiens
gccacagagcacaagggtgacggtccttcccatggtgtgcaaagccaccgtggcagttttatcaccgcaacagcacatatgacaagctcacgttttcaagagtttccatgcgtccagtgatgaccggaattaatcatgtatggtgtttaataaaacacacagcgtaagca

SEQ ID NO: 567797 - DNA, 344 bp, Homo sapiens
cgatcccgttgacggggtctcagaaggctccacggtgggtgataatggataaaaggttgtgacagccgggcacggtggctcacgcctgtaatcccagcactttgggaggccaaggcgggtggatcacctaaggtcaggagtttgagaccagcctggctaacatgatgaaatcctgtctctactaaaaataccaaaaaatcagctgggtgtggtggtgggcacctgtaatcccagctacttgggaggctgaggcaggagaatcgcttgaactggggaggtggtttcagtgagctgggatcatgccattgcactacatcctgggcaatagagcgaaactccgtctc

SEQ ID NO: 567798 - DNA, 333 bp, Homo sapiens
taagggcaggtagttggctgactttgaactatgaagaaaagccagaaacaaaatggcagaatggtatgactctgggtgggcttagggacgctggtgccagaggacttggcttgaacccgctccaacacttacaacctgagtgaccgtgagaaagaactgtaactcctctaaacttcaagttcctcacttctcaaataagaacgtgaatagtacctccctcctagagttgtgaggattgagttagaaaatgctagcaattgttatgccctaaggaacagcacaagatacaataacacgtgataatgtgtgtcgaaggtgcagaaaaaaaaaaaa

SEQ ID NO: 567799 - DNA, 570 bp, Homo sapiens
  misc_feature (32)..(32): n is a, c, g, or t
  misc_feature (41)..(41): n is a, c, g, or t
  misc_feature (292)..(292): n is a, c, g, or t
  misc_feature (296)..(296): n is a, c, g, or t
  misc_feature (447)..(447): n is a, c, g, or t
  misc_feature (449)..(449): n is a, c, g, or t
  misc_feature (484)..(484): n is a, c, g, or t
  misc_feature (493)..(493): n is a, c, g, or t
  misc_feature (498)..(498): n is a, c, g, or t
  misc_feature (515)..(515): n is a, c, g, or t
acctattttcacaggggacgtttacacctggnaaactgacntttcattcaccgcagcccgccgggcgtgccggcacttcacttttcaccccctctgactcctctttctttgaagctaagagagatgattttcatttccagcaacgttcatgaggctttctgggcactcgcccgcctcggcctcccaagatgctgggattacaggcgtgagccactgcaccgggctcttctcacccactttaagctttcttccatccctaaactcctctgtgtatcctcttccaacttcatgntacngcttaggggtgcatttgcctctcaaaggccttttcttacaaacagtgcatttccagactttcaggagtccgcaggtgtctaggacagccgaagacccaacactggtctttaaaatttccatacgtattgttttccacgccactgacgcagncntggacagctcctttgtggactgattgtcaggtcanccctgtganctgcntgtatacatctagatgngctggagcaaatgaaggacacagaagatgacatctacatcgtgatctgttcctgt

SEQ ID NO: 567800 - DNA, 207 bp, Homo sapiens
cacgaggataacaacctgtagagcccgttttaaattgttgtttatagacccatacctgtagcacccatatttctagtaagaattgagttttcaattacagatagattagaaacatgctactgggtgcaatcttagatcacattttcaatatgcctcattccacatatgattgagcatatgtcattaactcacaaatgcactttctga

SEQ ID NO: 567801 - DNA, 453 bp, Homo sapiens
  misc_feature (25)..(25): n is a, c, g, or t
  misc_feature (33)..(33): n is a, c, g, or t
  misc_feature (97)..(97): n is a, c, g, or t
tgctttataggagaccagttgatcntgggaaancagcagtcgtgtgagctgcagggctttgtgcagtcccagcacccagttagaacagcctctgtgntgggccgggaaggtttctgagggcacaggagtctcagtggatgagaactgagattgtctgaactcagaaacttatcagggaacccgtgacctgtctttcttagagctgcccctttcatcttgcttaaaaaataaattctcagctcatgtgtcagtctgtttaacccttgagaggatgttcccagtgtcacgaggcattcaggagcgactagtgagctgtgcctgtcctgatctttcttaagttccttcattcacactaactctgagacagatgagcctgtatcagcaaataaccacaggagcaaatctaatctcatagtgaaaaagtacaaatggcattaaatcattttcaatgca

SEQ ID NO: 567802 - DNA, 196 bp, Homo sapiens
  misc_feature (46)..(46): n is a, c, g, or t
  misc_feature (64)..(64): n is a, c, g, or t
  misc_feature (111)..(111): n is a, c, g, or t
atggcgagactatagccaaggattgactgagctgtctgagcgctgngcccagtacaagaagganggagctgacttcgccaagtggggttgtgtgctgaagattggggaaanaccccctcagccctcgcaatcatggaaaatgccaatgttctggcccgttatgccagtatctggcagcagaatgggattgtgccca

SEQ ID NO: 567803 - DNA, 369 bp, Homo sapiens
ctttaggagtcaggatggctgaagacatcaagactataatcaagaactacaaaactgccccctttgacagccgcttccccaaccagaaccagactaagaactgttggcagaactacctgtacttccaccgctgtgataaggcaatgacggccaatgggggtgatgtctccgtgtgtgagtggtaccggcgtgtgtacaagtccctctgtcccgtgtcatgtgtctcagcctgggatgaacgcatagctgaaggcacatttcctgggaagatctgacctcgccgcccacctctcctctgttctttgtctttctcccctgatagaaaagggggacctcagcatatgatggtccttaccctgggaccctgaa

SEQ ID NO: 567804 - DNA, 506 bp, Homo sapiens
  misc_feature (40)..(40): n is a, c, g, or t
cccaaaaacccatagtgagacccagtctctttaagaaaanaataaaaaagaaaaatcctaaccaagaattccatatcctgccaaactaagctacatgagcaaagaagaaataaaatctttcccagacaagcaactgctaaaagaatttgttatcaccagactggccctacaagagagtcttgagagttctaaacatggaaatgaaagaatggtgacacctgctaccacaaaaatacacataagcacatagcccacagaccctgtaaagcaactacacaatccaaactacagagcaaccagctaatgacaccatgttaggaataaagcctcatgtctcaatattaaccttgaatgtaaacaacctaaacaccccacctaaaagacttggagtggcaaattggattaaaaacaagacccagccttctgctgtcttcaagagacctctctcacatgtaacaggactcataggttcaaagtaaagggatagggaaaaaaatctatcacac

SEQ ID NO: 567805 - DNA, 850 bp, Homo sapiens
cccgtctctactagggatgcaaaaaaattagctgggggggccaaattctggctaatttttgcatttttagtagagacggggtttcgccatgttgcccaggctggtctcgaactcctgaactcaagcgatccacctgccttggcctcccagagtgctgagattgcaggcgtgagccaccgcacccagcccaatgttgttcactttaaataagcaggaaggaatgcaaggaatgtggtagtttctagaagctagaaaagtaaaggaagtagattcccctgtagagcctccaaaaaaaaaaaaaagataagacttttcctctaaaaagtaacgcagaacctgcccacacctgattttagcccaggtgagacccatttgggaatttctgaccttcaaaactgtccaataacaaattggtggctttaagccactaaattgcggggtaattggttacagcagcaataggacatttaacacagtatattatactaagtggatttccagatgttaaagtaaccttgcatttcctatgataaatctcagtgggccagtggtatgtaatcctttcttctagtggctggattgggtgtgctggtgtcggttgagcattttgaagtctacattactaaaagatccttgtctgcagttccttttcatgtgatgtcttggacgggcttgggtatcagggtaccacgggcctcacagaaagagttggaacagtgtttccccctttcttcttatagccaacccagcttggtcatggttggccatttaacatggtatgtctttgtccattcttttactttcaacataatctggacctatcttagatggagattcccctacattaaca

SEQ ID NO: 567806 - DNA, 398 bp, Homo sapiens
  misc_feature (191)..(191): n is a, c, g, or t
cagcccaatttttgtatattttgtagagacacagtcttgttatgttgtccagactggtctcgaactcctgggctcaagggatcttcttgcattggcctcccggagcacttatttacaggaatgactgcatgtgctgttgtgccaaactttctggaaatacgtggttaggaattaatgagttggcccgggcncggtggctcacgcctgtagtcccagcactctgggatgccgaggcgggtggatcacctgaggtcaggggttcgggaccagcctggtcaacgtggtgagaccctgtctctactaataatactaaaatcagaggttgcttgcagtgagccgagatcataccattgcactgcagcctgggcaacggagcgagactatgtctccacacaaaa

SEQ ID NO: 567807 - DNA, 163 bp, Homo sapiens
acacttggtgacacgaactactacttgactaactgtccgtgacacaccacgcagacatgacacacggacggccacgacttacctcacaacggacgttcttctgtactactttttactacgactgcacttacccttttaaccttactgttacattacactgtta

SEQ ID NO: 567808 - DNA, 1475 bp, Homo sapiens
cggagcggcggcgggcgcagctagcgggtcggccgcggagccggaaggtgcagctcggcttccccaggacacccgtacacccgagaaacgacaatggcatcaaaaaagcacgatggaaaagatacgaaatgtcctcaagcggggtagagacacagccaacatccgctcagggaccccatgcgcgtacagacgaagacgccgaccacagaagaagggcctagagagacggatgcagggcacacaccaagagacaagggcggctgacgtgcacgaagacgaaggcaaatcaaggagaccgtcgccaaatagacaccaccgggcaggctaaaggcaccaaacgcatccacaaaacgaggccagaccaacacagcagaacgcgtcaggagaccgaacaacgaccataaccaatagaccacaacaagccaacacgacatatggagaaaagcaggatgacacaggagacaacacgtactatagcacaaagagagaagctaagcagagaccataaaagaaccagggacaccacaaccgaggcacccgaggcgccgcaaaagtggacccacacggggacacaacaaggggcaccaaacgggaacttcacggaacgcactcaacccagccacaccagagacgaacatagacgcacgaccaccccgaagaggaagatacacacgagcacatccaacacaccctaacaaacgtggccacacacgcacgacagagaggacaccaccccaatacgggcccccgcccgtacacgcaaaagagaaaggcgacgaaccgagacaccgctaaccgacactacactacctccgacacacgcgcgcaccacacaactaggacaagacgaccccaccgcgcacaacgaaccccacggcgcacgctcgcagacaccaacagacagagacaagccacagactaggcacaacacacaaacagagagcgcgaacaaaccccgagccgatcaaagcagccaaaaaggagcacagcgagcaccagaggagaggagagcacaccacacaccacaacggacagcaaccagaaaccaagcccatcgctgtcacacacgacacgacagcaagccacaccaccgcaagcgccgccagaagcacggacacaaagacaggcagcaaacagcaggcagcacagagaacaccaaaatcagcgacagcaccgcacggggcaagaaccacacgacagagcgcgggcagcgcgcagaagaagggctgacgagagagccggcggccgaagaagacgaggaaacaccgacccggcagagacggagcgcgagcaggcgagcacgagcggcggccgcggcgcgaacggcaggcgacacgcacgagaggggacgcagagaagcggcagggagcagaggcgggcacggcggcgagcaggcggcgacgcgcacgacagcaccgacaagcaacaaagacgcggccagagagaaggacacgcgacccaggcgagcgcacaac

SEQ ID NO: 567809 - DNA, 440 bp, Homo sapiens
  misc_feature (429)..(429): n is a, c, g, or t
tacaattaagtggtacattctgtcttctgtaaattatacctcaataagggcgatttaaataataaaaactgtgacaaatggttcattaatcagccatcatcagcaacaactgcttatattcagcctctgccttgaaaaaaggagctgtggctatcactggatatttaagattgtctgaggaagtgatgtgatgagggctttgctcaggacaggaaagatgctgagcaaggtcttggctggatagagctgaaaaaaaggactatcaaaatagaggaagaggtgtgctgagagaaggcaattcatcaactataattttgcttaagataacacattacctttgaatacatagaactgtatgtatatgtgtatttaggaaatttatgaaaatatcagaacaattccatacctctcaataaatcttactgttgnaacattttaaa

SEQ ID NO: 567810 - DNA, 1162 bp, Homo sapiens
ggcggagcacaagcggattgcagggtcagctcatgtcatctgagcctcccccagccaccacagtctccccacccatcatgcttcagtcggtgctgcatggacgaccactctcgagagcctgtgatgcgcttcaccatcacctcgtctgcgcggtgcctaacggtggtcccatatgcccatctgatcacagcgtcgaccggatcgagtgacctgtcattcggacagacgggtgcaggagcttacactagggactccctgtcgtacagaaggagatctgtcaaatggcttctgacccggctcctgatgggtccatggccttcatttactctcctaggcatgtatggtcaggtccccccgaaacattctttccgtgtccactaatcatctgaagttgtgagcaaggtggagcatggtagtgtccacagtgggcacatgcgctggactgcaggtcctccctaatacaatgttgtgctcgcatcctcaagcctatacgaatagagaatgcatgccaggtccggtgtgatgagtctgtctactccacgtgcagcccttgtgtctatcacatgggtcataccatgcactagaggactctgggtcttggaacattgttcatcaggctcgctaaggcagattgggtgggaagcgaccccatttgtcgctgttgcattggtggcgaagacgtttcgcgcgggacggagcgcagccagaacacttggtatgagtgacaattcgttccacaccgagacgggggcttcaagccgggcattggtcccatctcaaagtatctcctggaggacggggtatggggggcccggggatgtggggttgtggggtgttcccgggccatcaggcacagccgtatgaccatttggcaaaggaaccgtctcaccattctgaagagcatttacaagcatttaccaaagcgaaaaaaacagaacaccacacacacacacagcacatcccaagggcacatcaaattgccgggagatgccggcacacacgcagcgcgtgcggcaaacaggcgcccatgtggccatacgcgcggtgttccctgggacccagcagggtttctggggcgccacaggggcggtacaaacacggccgcgcacccccatatatgtgaggccgatactatcacttccagataaggccagggttaacg

SEQ ID NO: 567811 - DNA, 468 bp, Homo sapiens
  misc_feature (245)..(245): n is a, c, g, or t
  misc_feature (354)..(354): n is a, c, g, or t
  misc_feature (468)..(468): n is a, c, g, or t
tttctttttttgtactgttgtgatgattaaaacatttttttcccattcattcgccccggggagaccttaagaggtttcttttgaaaaaaaaaatttccggccctttaacttttcccaccttttcaccgggaaggtttttgtgggggggggggtttccgggggggggggtttttgaatttttgggagaaggggggggctcccccctttagagggggggggctagggcccaaagggggggctgggcngttaacccattttaaaaccccgggggagggccccttcggggggggaaactttctttccggctttttcccctacccacgggaaagggtggccccctgttaaggcccagtnccgggcggttagggccccagtttcccccttggggtgggaaaggggggggggggaagtgccccccggggttccacggctttttttttcccctccgggggggggctttttgtgttn

SEQ ID NO: 567812 - DNA, 231 bp, Homo sapiens
cgatagaaaaggcaatacgaatatgactgttgggctttcaatttatcttatatggaattacaaaatctgattaaaaaagatgcgtttgaaaatatcaaattatgcactaaaaaccactatttaataattttaggaaattttcaatatcattttgttgtgtttctagagttgttgttcctgaagaagaagtattgagagttttatttaatgaatctaaaaaactatttacat

SEQ ID NO: 567813 - DNA, 975 bp, Homo sapiens
ccgtgtcaggagcaacgcggggcggggtggttaagaaaaacacaaaagggcgtccaaacgcccctccactggggcccgggcgaggaaaacactctgtttggtgcccgcgggaccgcccgactaccctggctgcacggtgggatatccaacgaccggtgtcttcgcgtgcaagggacaaaagccgcctgttccgcgagagggcgcgccccactccttctcccacgcgcgcgcgagtgttggcttcaaaacgccgggggcgcggcgctccctcgcccagagacaaattgtgttgtattgaacagtgggcgggcgcgctcggtctcttttgcataaagatcccggggaagccttcttcttagtcgttgacctgaagacaacttcacaacctgagggcgggtcaatttcattttagcctccctctctacagtggtcgttgtcatgtcagcactcctgtgttgagatatatactcgaaccacttcgtgcgacatattggactgttccaccgtttgtatatacttcccggtgccgcgaccagacaacagtagctgtcttgtcaaaagaaaccatgctgctggagcagcgaataggggagagcgactctggagtgatgtcgcgccttggcggcggctgaatatagaagggggggtgcacaacacaagagagaggagtaaaaaggcccgcgtagtgcactcgaggtcagttttactagagaggtcacgtcgatactccgcagaggggcaataaagccttctctctcgtagccacacgtcacgagagacaacactgtggccaccccgcccgacggaatgtactaaaagtggccactcactggtgacgacgccaccacaaatgatcaggtcatgcacttcctcacctcacgcgggggcagaccacctccacgaccccaagaaatcgaccacaagtcggcgctcccttttccccttttaaaaagaaggaagaacacaaaaaaaaca

SEQ ID NO: 567814 - DNA, 160 bp, Homo sapiens
ccaccgcaggtttggccaccttgagaagctgcgaagatgggcggagttaaggcgtgccgcttgttaaaccttgcctcttgggcccgggggcgagcagccccgggaaggccgcagttcattcttttggacccctcccaggagaaggaaaaaaaattattct

SEQ ID NO: 567815 - DNA, 160 bp, Homo sapiens
  misc_feature (12)..(12): n is a, c, g, or t
  misc_feature (150)..(150): n is a, c, g, or t
gaagtgacaggnaagctacaggtgtataacaaatttgtaaactaaccaagcacaatgtggcagggcctagctgctacaaagaagacaatttaacaaatactcaacgcatgacaaaaaactcaggactgcatttgcactaatcgataacgngtcatttaat

SEQ ID NO: 567816 - DNA, 200 bp, Homo sapiens
gcccaaataaagtataggcgatagaaattgaaaccttgcgcaatagatatagtaccccaagggaaagatggaaaattaacaaggctaatttaggcagggcttacccctattacctctggaatatgtgattaactctggaatatactcttgcacaggagagaccccaagcgctagagcccccccgaaccccagcagcggcg

SEQ ID NO: 567817 - DNA, 178 bp, Homo sapiens
  misc_feature (60)..(60): n is a, c, g, or t
atgttcagagcatgggtatttgtatgatactataatggtggatatatgtcattataaatntgtccaaaatcacataatgtacaacttcaagagtgcatcctatgtaaactatggactttgggtgattatgatatgccaatgtagattataacaaaagcactactctaatggggtggat

SEQ ID NO: 567818 - DNA, 336 bp, Homo sapiens
  misc_feature (29)..(29): n is a, c, g, or t
cccataccaacacacaccccccaaacgantcctccacattaccagccaccctggttagaagaaaactccttgggaactcgggccgtgagaagcatccttcctgatcatcggggggtggaaacatccttatcgcaccctcccgggcaaaggcccaacagcctgactgcaggaacatccttgccatatcctgccgggcagcaagctctaccgcccacacccctccttcccagtcccatgatcaccccagcctgggagaggcagttggagctgggggtgagctggattcctcctctgcagggtttagctagtaataaaggagttgctgttgaagccgtc

SEQ ID NO: 567819 - DNA, 327 bp, Homo sapiens
agcggatgaacggattggcaggagattatagctctgtatgagaaggacaacacctacttagtggaagtctctagcctcctggtttcgataatgtcagctatgagatcccctcactggagaggaagcagattgccaagtgccagcaggctgcagtcaagaatacgagatcgcaagggaggaggagtgtgcaggccgggtgctgccgagatgcgggagtcagttctacctagttcctgcaagcacgtatggctatcacggcgcgaaaatgtccgaggagaactggtggccctggtgaaggacctgcactgagtcagctggctgagattg

SEQ ID NO: 567820 - DNA, 1422 bp, Homo sapiens
ggctagccgatgaggaggccgcggaggggaacccggcccccgtggccccgagaccgactgagggagacgacctgcgcgagggccctggggcagtcatggtctcctagtcgacccaatctccatgcttctgagtcctgctctctgctcagagctcccctgctcgggtgtctggcctgctgctgatccctccagtacagccctgctgtattgcgtgcgcccagcaaaatggggggaccggcctgtttggcgtgaggccccagtgtcaggtcctgtgcaaggactgcagtcggctacttggaactaggcgaagaagccctggtggagctgcttgccactagtgctggggccaaaaactccgcagcaacggttgcagtcgcatcaccatttaactcggaagggctgcattcagattcgtcctggaggatcaccttcattgggagtctgcgggtcatcggtgcccactccctgtggtaggcagggctcagcaacttggcaaggcacttaggagatccaggcttctaatcaaatccggaagaattggtcccgtcaccttgtgcaccatttctacgaacccaattccatcggatggttctcgtggtcagaccatttgtccagcttccttaccttgggggcttttacccagtctgcaattgggtctctcccctgaggttgttgttggcccgcctgggtcacacgcagggaggcgcaatgtgcgtcacgagccatccccgtacgctggagacgtcccaacctttcctcgccttttggccaggcccgccggttatccttcccgaaggagtatggggccgaaagggggttttggggaaaagcacatggctagttaaaaggcctagagcacccccgcgtatagaccttgaccgcggaaaatcaccactcggcggaagtgcaaatccttgaatcacagcgaaaacccatagtgctccaggaaaatgctcacagggggccccacacggggacacatgatagcttccccccaccacagggatggaataagaggtagtcctacccccatggtgagcccatgtagcaccccttgctggtcccggtgcacacccaggctgtgagacggaataaacccccagagagtttcttcgtggtgaaagcacccactttgtcgtgcagcactattcccctgggggggtggctccactacgaaaaaagtcaatcgacttactgactgaggccaacggtgggtagctccacaaaaaacgttgctgctcgtccaccccactgttagggaaggagtgtaaagataatatatccccccgtgtcagccaatcgcaataatcccccctgcatgaaagaaaacatggctcgtatcacacgccgctatgatataccctcgtgccaaacaaaacaagatacttgtcatacaacacaaagaggtggcttagaccacat

SEQ ID NO: 567821 - DNA, 1292 bp, Homo sapiens
ggctacctgagctccatcctcagggttctttgtcaagatccctgtgccgaacaagaactccgactggcattggcatacagtgcgacttacgtcatcattcgcccctcggtttcatcagccgcatgtggaccgaaactacttggcggtcagtcgacagtaaatacagtagttccttcctggattctggttggagagatctgttcagtcgcttcggagccaaccagatggtcagagctcaacgtggacgatgcgctgagggtcgaggtgatgcagattacgtccaacggggcagccacgaacaacaccagcttcccgtctgtgccagaagccaatgctgacgttgccggcataacgttccctgatgaaacgactcctatcagcaagtttattgcccgttcattggtcgtggctgaatggtgggtctggttgaacgagtctcgcctccagaggctagtgcgactgcgggcacggactatcatccctgtcgggtactagccctatacgtggtagcaccgttccaagagtcatccatgccatcctagtcgtcgcggcccttgagcactaaggaaggcctacgggcaaagccctcgcttcctccctatactatagagtcagctgcaccccttggcccaatcccgtggggaggatgccccattaataaggcgcaattattgggcgaccgttgattggggccacccatgggtggaactaaattgagatgggggctaccccccgaggggaggcgggacggaaactaaggggcaatactgaacggaacaacccagtctccaaaggaaaggatcgatcagaggaaactggaccaagccgaccaccaaaagcaccaggagggtccggaacagtccccaagaaagtgcggcgagggcaggacgggatccccggggggccatgggggaccaagaggcagtggggagacagcagagaaaaaagacaacaaaaaagattgccacacgagataccggaaaacaaacacccccaaggaaaacagagggtagtatacaaaaacgccagggaggagaggaacaagtcacacaccaagagaaccaccaaagcacgcaaaataaaaaacataaaaaaggagaagcggacacagacgaacaagggcacacaactatcacacgacggtaaaaacaaagaagaaaaagaacaagacaaaagagaccaaaaaaagacgagagaaaaaaagacgagggaagaaacaacaaaagaaaaaagagaagaaaacgcaacaagagaaagcaacaaaaagaaaaaagacgacactagaacaagag

SEQ ID NO: 567822 - DNA, 173 bp, Homo sapiens
cttagtctcacatgcaagcatgtagtcttcaccatggagaatgtgggtttgccatttctcaaagcttatttcttattacattaagaaaaagaactgatttatcagtctagtgtttcattttaaaaacatattatagggtgggtaacttgcataataaggtatttggagaccgg

SEQ ID NO: 567823 - DNA, 310 bp, Homo sapiens
atagtagaatattagaatatgtgggctttacatctaacccacagaaagcccaccgaaaatgtactgtgtatcagatatccactcatgtgtactatgaaagttccatttatgccccattaagtcaaaagtaaattatagtaagctaaagaactgcatatttacatatggatgaatgtccagtatatctaaataggcaaataaatggcgcatcctcatctacctatataaaaaaaatagcacatatctttccagcattttgccatactcctcaactgtcaagaagcaggtatgccaggtttcaaggtttcac

SEQ ID NO: 567824 - DNA, 954 bp, Homo sapiens
  misc_feature (217)..(218): n is a, c, g, or t
tggtggtaagggcccaaactggctgcaaacagaaggggtgatagcgcctaaccttagtgttaaagttgggattagggggctatttcctgctagggggtggaagccggatttgagttaaaaaaattcccgtgcttacaactatattatggtgcttgagtgtggagtatagcggctgtgaaactgtggggtgtgggcgccttctatatgtggcttgagnnggagagctccaggggtgtggtaacaccctaaattggggggcctagaattgtgcccgtgcgtggcgtcgcatagagagggagagcgtcctctaagtaatagtgtgagggcgtgtggagcgctgtgtggaaatatagacagttatatagaaaaggggctctcaatatgtgagtgtaggatggagcgtcctccagtgagagagtgtggcagtgtgtgtacggaatctcaatcaaccaatccttttccttacaagggaaaagggaccggaccctacaattgtacaattcgcaacggcgtgggaggcacgttgaagattagctgagttcaacaacatataatataatatgaagtgagctgtactgtgatcatgatgagaagcgaatcataatagaaacattatgagatccgaatcaacaaccaatcaataacgacgagaaaaagaggagacagccataatgtacaaaaaatatatcttcgtattgatagatagcgttgacatacaacttcggatagttggtgatgtgcaacacacaaaaaatcaatccccacacgccccacggactaaattttaaaatatttattttaatatccttttgtcccgacgcgcgctatcctgtagcaccccgataaaacaaaaattcattaacttattttcacgggcccacagggggggacgggagtgtatcagagcacctatgaattagtagggggatgtgcgattatatacaaattgacatt

SEQ ID NO: 567825 - DNA, 172 bp, Homo sapiens
tatccccagtaggtactgggaaccaaggggcattgaaaacaccatttggagcagttaccccaggagaaaaccagctcccgcttcctctaacagacccagtcaattcgaatgtcaagaccttgctgttccttctacgtgagacaccatgtcacaaacacacactccccgtggg

SEQ ID NO: 567826 - DNA, 240 bp, Homo sapiens
tcgaaggccgcgaaaagaccagagtgccccgcccctcatccccgaagtctccaaacccctcgtcggaagaggtgagcaagccttcacgatggcggtggcggagctctgggagacgctgaagcaggcgatcttagcgtacacggggctgtccccgacggccttcttcaccgccgtggcggtcgccgccgcgctgtaccacgtcgtgtcggggatctttgcgccgccgccgcctccccggca

SEQ ID NO: 567827 - DNA, 113 bp, Homo sapiens
cggagcgttctccaggagcccttagagaccgagtcccggcggcgacggcggggcagcgcaccggcaggcggattcattccacttaaaacctgaaaacattggaccacacagag

SEQ ID NO: 567828 - DNA, 489 bp, Homo sapiens
  misc_feature (114)..(114): n is a, c, g, or t
  misc_feature (118)..(119): n is a, c, g, or t
  misc_feature (131)..(131): n is a, c, g, or t
  misc_feature (135)..(135): n is a, c, g, or t
  misc_feature (146)..(146): n is a, c, g, or t
cctcataaagtgaacctaattgcttagccccaagaattttgttctctaatgagcctagtgtgggtaaggctgcacctggtgaaggggcagggcaaaactcccgggccccctttngggnncctggggggggnaaanggatttctttntccagcaaggaaaagtctcctgggacctgaaaggcacttaacctcacccagactgccgctaaagaacaatgaacttaggagtcttcgctgtgctcctcttaagtttgtaagagactgtaataagtctcttactctctccgggcctcagtttcctcatctataaattgaagaatctagaccagataagaggtctccagcctggcttgactagtggaggaccccttttaccatgtatactcttgccaacaccttggaagtattttatcatgcaataatttgtgtatgatgtgtaatagagaagggattgttaaataaaacttattttagatccatgtataacctt

SEQ ID NO: 567829 - DNA, 1534 bp, Homo sapiens
  misc_feature (252)..(252): n is a, c, g, or t
tttaagaacccttcatcaatagatgggagacatacagaaatagtcaaaccacattctacaaaaggccgagtatcaggcgggggttctcgaagccaaagggagtgttgggatgtgttaaaggtgaaatatattataggtgggcgggatgtgaacgcagaaataggtgagggaaagtgtgacgccaattaatgtgcacgggtgaagctccgggggaacgcctgtggtggcttacacaaaaagtgtgtgagcccnggaagaagtgccgcgggcggaaagagtgggtgaagaggggagacacctcgaagagttcacctcgtggaggcttgggagagaggagggtataaaaaatagagagcgcctccgagaataaaaagtgtggataagtggagacaaggtgtctctgtgaaactataatgtgtgcggttctcaggagtgtggaatgtctctctcaatatagacactctcagtgcggtgagagactctcagaggtgtgacagtgtgcgcgatcactctcctgtgagagctgcgagagatatacaatcagcgggagagtgtgtgtgtctatgaggcgaaacggtgggagacctctcctctataagggggggatattaacacgggcgggggggagagaaagtcgccgtgtgtgtgtgggagtgcggccaaagtgtggcgcactctctctatacaacgtgtgggcgagggcggaaacaaggggcgcacattaggcggcgtcgtgagccacgtggtgggataacacaggggtgcgccctccgaaaaaaaaagaataacttcccgtgggcgacaacagacaaaacacaaaaaacaccttctccggtgagaagggggcataaaacattaaaacaagttgacggagggaatatataatctctccgcggggataaatatcggaaaggagggggccccacatatattgtggggtggcacccgacgatggggtggtgggccggtgttggagtgcgtgggtggcgagccccactggtgcgagaaaaagttggggtagccacaaattcacccccacaggaagtggtcattacacccaatctcgcggggggcccccaaaaccccaaggtgtgggggcgaaacaataaatgtgggggagtaaacaagaagggggagacaacgagagggaccaacaagaaaaaggggccccacaaagctacacatgaacagaggacaagcacgcgtacaaagaggcagcaacctgtggcacaaaacgtgtgataaaccaccccccaacacaggtgggccatagaggcccccgcaggaagaggtacccaaacaacacagggaaagcgggggcgcccaaataatggcgcgaaacgggggggacaccacgataactaggaaaacactattcccgaaaacaacgtgcggggagggacaaccaattaatcatctaaccccaccgggaggaaattctcccccccaggaagaaaagaggaccaggggaaaaaaacaaccacgagcccacacccaacaagaagacacaaaaccgctgtcgtgagaaacaact

SEQ ID NO: 567830 - DNA, 444 bp, Homo sapiens
cccacgccgttcccggcaagttaaaaacgggggcttaccctttccccccaattccccaacttaaaggttttccaaacaaggtgggtaacttggaaaccccttgccttccccccaaaccaaggcggccccaaggaacttttggttggggggttcttggcaccaaggtggcccttggcccttaaaccctttttgggcccctgggggaatttaattgccttaaagtggcccacccaaagaaagggggacctggcgattcaatggaacttttccaataaatggcctcaataacccccaaatttccccaaaggccttttgggggaagaaggaaaagccttgggggaaaggccttgttttgggggaacaaggccttgccttggtaaaattttgggctttgttggaaggtggaatggttcaatttttttctttgggcccaaacccaacaaa

SEQ ID NO: 567831 - DNA, 875 bp, Homo sapiens
cgcacagtggtcggtgcagctgtcgccgcgtgttcgtatgggctgttccgcaaggttggccctcagcggtgcccgctttggagaagcacacatgggactggccccacagtcccagcttttttgccccccaggaaattgcgggggaccatatacaaggcgggttcctaaaccacgactatggggcccttaataacctttttcggcggaaccctgggacccgctttccggaagacccctgttggggttgcgccccgtgtcccccagcctgagttgccccttcaaccaaaacaagggggctttgtttaatagcaggtgccccactgggacaaagtgagtatatcatgtacacctgggaccaaagcggtgagcccccaacgcgagggtgaaaaaaatatgcgggtggcaattgcgcacgtagcaatatcggcgtttttatacatagcatttttctaaagctccaaaggggtcttattttgttactcggttgtgaaaaaaacaggacaccccgccttgtttggtcctgttgaatctataaaagctatgggggtgcacccccttctacacgctaacgttgctgtccccactagtgcaaatctcctaactgccttttttcctatttcaccaaccactggtgtcccccccatgttgtccaaatcgacacacaggggctgtgttaaatggcccgctcctcgtcataaaccaccgtcaacagttgtgccccgaaatcattatcgtctctagtagacagagacttggtatacttgggtcagaggacatactccccggggagaggttgttgaagtatgtacctcccccccctgggggggggtgtttttttgcccaaaaaaaatgaactctaacagtcccacataaca

SEQ ID NO: 567832 - DNA, 369 bp, Homo sapiens
  misc_feature (15)..(15): n is a, c, g, or t
  misc_feature (28)..(28): n is a, c, g, or t
  misc_feature (43)..(43): n is a, c, g, or t
  misc_feature (98)..(98): n is a, c, g, or t
  misc_feature (140)..(140): n is a, c, g, or t
  misc_feature (286)..(286): n is a, c, g, or t
  misc_feature (294)..(294): n is a, c, g, or t
  misc_feature (328)..(328): n is a, c, g, or t
  misc_feature (331)..(331): n is a, c, g, or t
tgtggtggaaaagcncctgtagtttgantggggtgattaccanaaatatacatgtgaaatgttagaagtatttatagcctgaaacatattagtatggnggtatatacatatttctgactaattaatttcgcccatgtttncccaggctggtctcgaactcctaagctcaagtgatgtgcccgcctcaacttcccaagtgctgagattacagccgtgagcccccatgtccggcctgtttttccctatgcatgcataattacgatcaagtttaatttgtaattgggcncattaagngattaacaatagctaacaaaatggaacaattacnacnatatattgtaataaaagttatgcaaatgtgaaaaatat

SEQ ID NO: 567833 - DNA, 130 bp, Homo sapiens
  misc_feature (109)..(109): n is a, c, g, or t
agtgacatgtgtgcttccccaggacactgtgacgttgggacaacagcattatttgtggagtgcaagcctgctaaagcttaaggcatcatctacgctgaaactcacaacncccatggacggattcaccatc

SEQ ID NO: 567834 - DNA, 245 bp, Homo sapiens
gctgcagttgtcgtgaggttgtttccggggattagtttgtaagtctgagtggactgagtggggaagatctgccttcaatgttggtgggtaccatccaacaggcgggggccagagagaacaaatacagaaggcaaattggtctctaagaggtaggatagatttttcttcttttttaagattgagttttgctcttgtggcccaggctggagtgcaatggctccatctcagctcacgacaactgcagc

SEQ ID NO: 567835 - DNA, 204 bp, Homo sapiens
  misc_feature (149)..(149): n is a, c, g, or t
tcagtgtgatctagagatccccggtacgagcggtctgaggtgataccctttcccgagccttatatcttggtatatgccaacgatgctgccatttctgagccagagagtgtggtagccagcttacaaggacacaggaatttccctgctgnagctatgcccaaactggatcgccaccttagggctgccctttctacagaaaggcgg

SEQ ID NO: 567836 - DNA, 749 bp, Homo sapiens
cggacgcgtgggtcgacccacgcgtccggttctagatcgcgagcggccgcctttaattatgtttatttattttaatttatttttttagagtgtacctttaaaaaagttgtaaaaagatttggaaaagaatagggggatttaaaaaacccctcaattaaaaaagttgggtaaacctgagtaaaagttggtgggttaaaaaaattgtgagtgagatccccagagccaaataaaagtgggtttaagaaaagattttataatagtgggtgacacaatctcgtggaattcaggggatttagatggaaaactcctttagagaggagtattagagcagcagttattttaatacaggttatatcaggttatcaaaactttaccgggtggtttaccgtacttaaaaattaaaaatagcatagtttgttcgcggggaataataaaagagattcttggaaaatgaaattgtgccgctttatttggagaaatacttgttgcccaataaagtatacaaggttgtgaaagattggtatttcacaaaaatatgtggggaacggaggaataaatgtggtaaggacaaagatttttatatattgctattctcaaaagtgggaataggggtcccacaaaaagttatatttggttgacagacacaaaatacatctgtgggaaataaatagcgtcgccccttgttgttcacagagtataagtaagacgacatttgtttcctttgcggattatcacttcagtaattgtat

SEQ ID NO: 567837 - DNA, 858 bp, Homo sapiens
  misc_feature (858)..(858): n is a, c, g, or t
cgcagtggtcacacctataatcccagcaccccgggaggctgaggcaggtggatcacgaggtaggagctcaagaccatcctggccaacatagtgaaaacccatctttactaaaaatacaaaaatcagctgatgtggtgacaggcacctgtaatcccagctatgtgggaggctgaggcaagagaattgtgtgaacccaggagtcggcagtttgcagtgagcgagatcgcgccagtgcactccagccttggttgcaatcatgggctcactgcaggctcaacttcctgagctgaaaggatcctcccgcctcagccttctgagtagctgggaccagaggctctgacaacacatacttggccttttttttgacgagaggggggattggatataggcgaggggtactggtatcgtacccaggttgtctcaataattaaggcctcaagtgatcctcctgatgggacctcaaaatggctggataacaggcgtgagcaacaaattcagcatatttgcgtacgggagggaaggaaagaaggtggtaataagtagttcacaaaaggagggacgaaaggcgcaccaccaggctagcgacacaggggaggaacacctggagcaagggaaaccctgcgcccaaaggtaaaaaggaagtcacccgcaagaaccgaacgaggacacgggtggggccccaccggagaatagtgtcaggaaacacggtccaggtggcagtgtagacaagaccggccaaaaacaaaaacagcgggcccagcagaaacaaaacggagcacaagagaagagcgcagcagaatggtcacaacggacgcaaggcgacgaacagaacggggaagaggggagccgtgcgcgccn

SEQ ID NO: 567838 - DNA, 504 bp, Homo sapiens
agcggggtctggaagccggagcgggccgagccgccaccgcggccggagctgtcccttagccagacccggcgagacacgagcggcgggagggaggcggtggctgcgcccgtgtcccgcacgcccgcacaagcgtcggactgcggaccggtgccgagccatgtatgcctgagccagtggaggactgtgtgcagagcactctcgccgacctgatatccaccctttgaggtaaacagcacacacaacctgattcgaggcccagagtgatcacaaggacagcgcggacgaagcgactatacatcgcgcgagcgaacgcaaccataggaacaggtaaccaccagccagggaaacgtccgacaagccataacccgaagcacaaaaagcaaaccgtgacacagcagccaaaaacgagcacccagcagagcgaacagccactcggcgaccagaacgatacacgaacgcaacatacagacaccaacaccaaagaacaacggtgacacacagaaa

SEQ ID NO: 567839 - DNA, 241 bp, Homo sapiens
ttggtgatctctaaagaattcccagagtactcaggcctgacacgttgataccctgctcagatcagagggtgctggtgtcacagactcaccaagtccagagacttgtcttccacaagcacgttcttaccttagccacgaagtgatcaagcctagacttactatcaggttgaactcgaagatatgtacagggtattaaacaaattccacggcgaacagttcatttcaatacaaggtcagaatc

SEQ ID NO: 567840 - DNA, 227 bp, Homo sapiens
  misc_feature (18)..(19): n is a, c, g, or t
  misc_feature (21)..(21): n is a, c, g, or t
  misc_feature (24)..(24): n is a, c, g, or t
  misc_feature (28)..(30): n is a, c, g, or t
  misc_feature (34)..(34): n is a, c, g, or t
  misc_feature (39)..(39): n is a, c, g, or t
  misc_feature (56)..(56): n is a, c, g, or t
  misc_feature (70)..(70): n is a, c, g, or t
  misc_feature (73)..(73): n is a, c, g, or t
  misc_feature (76)..(77): n is a, c, g, or t
  misc_feature (89)..(89): n is a, c, g, or t
  misc_feature (103)..(103): n is a, c, g, or t
  misc_feature (106)..(106): n is a, c, g, or t
  misc_feature (153)..(154): n is a, c, g, or t
  misc_feature (157)..(157): n is a, c, g, or t
  misc_feature (163)..(163): n is a, c, g, or t
  misc_feature (169)..(169): n is a, c, g, or t
tcggggtctccgggaagnngnggngccnnngganggggnggatgcggccgtgagcnggggggggaggggnggnggnngcctgccactgnactcagacccaggnagnacaggattgtccatcctccagcagctcagtgcaacggttgtgaactnngtntgtttnagagcntccacaccatgagttggaagaaggtggtgaagtcggtggctggctgtgctgatgacgc

SEQ ID NO: 567841 - DNA, 379 bp, Homo sapiens
gaatggctaaattcaaaagggctgaaactaagtgttaacatgatgtcggagaaattggaaccttattctgctcttgggaatgtaaaatggtacagccactttggcattctagcagtgtctcagatagttgagcctagagttgacatgtgacctagcagttctatccgtaagtacgtatacctaagataaattataacataactgcacatgactccttgtacatgaatgattatagcaacattattcttaattgctatacggtggatacagaccaactgtacatcaagtgctgccagatcttatgatatccatatgatgcaatattattctgccataataaggaatacggtactgatacatgctacaacatagtgccttg

SEQ ID NO: 567842 - DNA, 159 bp, Homo sapiens
gcgtcgttctagaggatccctgtctgcttaggactagctattcttttttctttactttcttttttcagccagagacttgctctgtcaccaggctggagtacgagtggcgcgatcttggtcactgcaaactctgcctcctgggttcaagcgattctcctg

SEQ ID NO: 567843 - DNA, 145 bp, Homo sapiens
aatgtgagcgtaatgcgcggaatggtgaggagactcgagtactctgaggctgaggaggtaaacagagacccgtaaattgtaatagcagtgttgaattatttggttcggtgtttctatagactatgtgagctcaggtgttgtactc

SEQ ID NO: 567844 - DNA, 330 bp, Homo sapiens
gtgtcggtcatttcctaggaagagtcttcatgttggacagtctcagggacaccatgtagagaatttcgctctcgcttcagagaagagaaagagccagtggtcgttgatacagtagaacagaagaaggaacctatcctagtgtgtccacctttacgaagcctgagcatacacacacacctgaagatctccagagtcgtatggaatcttacgttaaagaagtttttggttcatctcttcctagtaattggcaagacatctccctggaagatagtcgtctaaagttcaatcttctggctcatttagctgatgacttgggtcatgtagtcccta

SEQ ID NO: 567845 - DNA, 563 bp, Homo sapiens
  misc_feature (535)..(535): n is a, c, g, or t
gctgcaaaaaagtgtgcagcttgatgaattttcaagaggatatattttttatagatgggggtctcactctgtcacccactgcactccagcctgggcgacagagcaagaccctgtctcagaaaaaaaaaaaaaaaaaaagaagtccattttactggtcatagggcttaaaacaaatgaaacactctcctagccctctggggatgtaatgggctaccatcggcacaaactcttcattatggcacaagaatatcaatatacttaagggctactgaagggtgttaaagtgggccgagggggtgaaggtaagcggtatttaaccacaattaaagataagagggagggaaaaggaagtgtactttacaaccaaaaaatgtacgctggatgtgcaaaaaggtggtggcagtggatgaatttggcgagcgataccgttcgcaaaattcacgggaaattaaaacagttcacatagaaagggagaaaaaggtcaaaagaaaacaaagaaagggaattcgggtccacagcatctgaattactttgnactctcttgctggtcctggacggggctg

SEQ ID NO: 567846 - DNA, 576 bp, Homo sapiens
  misc_feature (462)..(462): n is a, c, g, or t
  misc_feature (541)..(541): n is a, c, g, or t
gaccttccccacctcacctccttcccatcccgccgagcgtcccagacactaactcttcccagatgatgacaatgaaattagtgcctgttttcttgcaaatttagcactggggacacttaaagtctctgctgtctatggagttgatttggaaataccttcctggccccgccctaccccttctttttggttttgacatcacccatttccaactggggatctctggtgccaagccagaaagaacgaggcatgtatacacctcttcttcatgatatataatctatatttttttaggaaaacagaaattgaaaaatttatcccattggggcatttaaagctactcttctttcttcttcctctcttgaccacatcctagacccagttccatatacacttcttcatcccaatacacaggaaacatggataaggaagttggcagaagtccaactgtttcccaatcagtcnaaggcagcaagcagacagacgccaggtatttgaaaggtcttctacacagaggatatacaactgtatgtctgggtcaganagtctgtctatgtgtgcatgtcagagggagagaag

SEQ ID NO: 567847 - DNA, 356 bp, Homo sapiens
  misc_feature (65)..(65): n is a, c, g, or t
  misc_feature (81)..(82): n is a, c, g, or t
  misc_feature (163)..(163): n is a, c, g, or t
cgcggtcagtaaggggactgagcgattcttctggtccgcacgctcctgctcctgtactcaccggnctgttcgctcctctannccgagtgaacgagagttcggtccaggaagccctgcgcgctaatagccatggcttttaaggataccgtgaaaaacgacccgnttggagcccggacggtggtgcgaattgcagcccgaacttgcgaagtcgacccctaacaatgccgcaacgtaaaatccttggaagcggtgtgtggctgactttgatcacagaggcgcgaagaagcaacaagcaagatctcgagaagctgacagggggacctaggttcgcaatggcctttaccaagacttgtgga

SEQ ID NO: 567848 - DNA, 111 bp, Homo sapiens
  misc_feature (72)..(73): n is a, c, g, or t
  misc_feature (102)..(103): n is a, c, g, or t
ggggtctccgggggccacagcttggggtgagttgaagacctcaggggatgtggaggggtctgcggggccctnnacaggatggccttcaggaaggtggtcttnnggcatggt

SEQ ID NO: 567849 - DNA, 208 bp, Homo sapiens
aggtaaagcactccagctcttagtcgggggtattaactccagcagtcttcaagatctggacatcagggcaggttgtcggggccaactctagctccccattcacctcgaatgtgcttcagcccattggtatgttgcggctgcagggtcacatgtacacctatacacataaacctccacgattgcgaccccgggctgatgtgggagtacc

SEQ ID NO: 567850 - DNA, 300 bp, Homo sapiens
ctattttagaagtttcatagcacaagacgggggatgtgggaatcccgatttatagctatgtcagacagaaggacaggtcacaagttgagggcagtcttggggactgagccaacaacctgtgtgatctgatgctgtctccaggtagggagtgtcagaactgagttgaattggaggacagttcacccagggggtgtccatgcagaactacttgcttggttggtgtgtggggaagccccctccccacatttgctcacagaagacttctgtgttgattgttgtgttgtgagagcagaggaaaag

SEQ ID NO: 567851 - DNA, 404 bp, Homo sapiens
gatggaaaagggaatagaggtgctaaataattttgaaaaagaaccaagagttgcaccagttcacaattacctggtttgaagaactgcatataaagctatcgtaaaggtgccacgcacagtggctcatgcctgtaatcccagcactttcagaggccaaggcaggcagaccacctgaggtcgagaggagttcgagaccagcctggccaacatggcaaagcctcgtctccattaaaaatacaaaaaattagcagggactggtagtgtgcgcacctgcagtcccagctactcaggaggctgatgaaggacaatcgcttgaatccgggaggtagtggttatagtgagccgagactgcaccactgaactccagccagggagactgagtgagactccgtctaaaaaaaaaa

SEQ ID NO: 567852 - DNA, 400 bp, Homo sapiens
aggcttggtggaaaatgatctccaggaaaagttacttgctaatactctcttcccttaagcaatgcaggtccttaggctacaataacttctggcagggcctccccagcaggaaggcatgtgctccccacattggggcatagctcaaacatctaccagtctgttctacttacagaaggagggaggcagtggtatagagctccgacgggggttaggcctctagaaacaggctgttcccaataagccttggatctcactttgattatttagaacttatttaccttgatttacaccatgttatgtgtaacatgtgtacctgttacacatgttatgtgtaccgtgtaaatcttacacatgttatttaccttgttacacatgttatacaatctctctgaaccagttt

SEQ ID NO: 567853 - DNA, 351 bp, Homo sapiens
aggcccccggggccctttttccccccccggtttttaatttcccccacccttctggcccgaagaggaagggacccccgaaaaattaacccgccccgaatggtttggggtccggggcctattttttgggtattatcccgaaacccgattaaaagggattttccagaaaggttttttttgccccctggaaattttttttttttgggaaaaggccgccaaaaaatttgggttggctaaaagggaaggggcctggatttttaaaatttttagaatttttttattttataaaatttttataactatattgggtttttttccccttattttttttaatttaaaacccccgaaaatgga

SEQ ID NO: 567854 - DNA, 152 bp, Homo sapiens
gcagtggtcaggccatctatcgggttatcttcggccgaaccttctggatgagcctggtgatcaccgccatctgcctggtgctggcttacccgctggcctacctgctggccaacctgccgacgcggcagggcaacctgctgatgattctggtg

SEQ ID NO: 567855 - DNA, 985 bp, Homo sapiens
  misc_feature (150)..(150): n is a, c, g, or t
aatcttttttttccacagggtgctcgttgttgtgtctcctttgcgcccttctttgggggaggacctccttctgttgaaaccagctggtgttggttccctcatcaaaacgaagcgggggtgtttcccttggctcccgtcgatattttttcncgcgcgagtattttttctctgtcgcacacactcacgtcgtctctcgcgctgcccacaagtatgtggtgtgctcgctctctctctcctaactatgattcctatcagaaaagtttttttctcctcccacaaaaaaatgctttttttctcccccctcccccccctgataaatggctatttcctcccctacgaagaatatatatatatagaatgggctccccctctgcataaatatataagaaggtgtatgtttatatatatactgcgatttcttttctccacaaaagatgagatacactctcaccaccccccgcctctctctatatttctccatagagaagaaaatcaccctcctcctcataataataaatagatgaccccccgtccagagagaaatcttttatacacacacctattccccacacacacacctctctcttttatataaagaagcatctctcttcctcccaaaaagagaggggagacacaccctctctgtgggggagaatatagaggcccccctatgtgggagaatatatctcacctcctctctcgcgtgcgccacagaagacacacccacaggagagaaatatatatttacaccacactcctctaaataattttttttaacacttttttttaaccccccttcgttttgtgtgaaaaatcaccgcgcgcccccctatagatattttgtgtgttttgtgtggaaaaaaatatattttttggtggggaaaaattatttgggggggggggtagtataatcggggggttttttttttttttttttttacatttgtgtgccccccccccaaaaaaaaacccccctctctatata

SEQ ID NO: 567856 - DNA, 359 bp, Homo sapiens
tgcattttctgggatttgagctactcccttgtggtacattgctgaggtcagtttcaacccagatgctttcaaccttctctacacttaaaatgactgcacgggagtacattgaatcctttgctaatggtcagcctcattcttggattccacataagggggaaatttaaaccaaatgggatatagaatttggaacacaccccttttggtcccgtggctgtaaaatccaaaaaccacctcggagaagggcctcatgtaacgtccccacctttatttaccccaaagttgagcaagaaatcttttattactatggggcgggcaattagaagtcaaggggcatcctccgttctctcccaaacaaa

SEQ ID NO: 567857 - DNA, 291 bp, Homo sapiens
caattattgaatccatcttgcagttactttctgtatatcgtaagggtacagtatccttcttttgcacacagcactccaagtttcccagcactattcattgcatagggtatcctttccccagtatatacttttgccaactttgtcaaagatcagttggtacacagtatggggcttaatgtctggactctctattccactccattgatttatatatctacttttataccggtactgggctgctttcatttactataaccttgtcgtatcattctacatcaggtaatgtgattc

SEQ ID NO: 567858 - DNA, 558 bp, Homo sapiens
  misc_feature (46)..(46): n is a, c, g, or t
  misc_feature (51)..(51): n is a, c, g, or t
  misc_feature (85)..(85): n is a, c, g, or t
  misc_feature (110)..(110): n is a, c, g, or t
  misc_feature (149)..(149): n is a, c, g, or t
  misc_feature (161)..(161): n is a, c, g, or t
  misc_feature (471)..(471): n is a, c, g, or t
cttttagttaaaaaaaaaagttggcccctttttccccacccaaaancccanccccaaattgtaaccccccaaaacccccccatgngtcaagggccaggacccaagtggangtaattggatccatgggggtggttcgcccatgctgttcncatgatagtgantgagttattgatggtttatataatggtctggcatttcccctgcttggcaactcattccgtcctgctgccctgggaagaaggtgcctgtttctcctttgcttctgccatgattgtaattttcctgaggcctcccagcaatgcggaactgtgagtcaattaaacctctttcctttataaattactcagtcttgggtatttcttcatagcactgtgagaatagactaatccagatggatttaaagctatgagactgcatgagattaccaagggactgagtgaagacagaggatggtataaaggccaggcatgngtgtcacgcctgtaaaatcagcactttgggaggctgaggcagaattgcttcagcctaagggtttgagaccagcctggccatctcctc

SEQ ID NO: 567859 - DNA, 114 bp, Homo sapiens
gggggggaagggggggagggggagggggggttggggagaagaggtgggggaggaggtgagagggagtggcaccattgcacttcagcctgagtggcagagcaagactctgtctca

SEQ ID NO: 567860 - DNA, 162 bp, Homo sapiens
gctgcattattttaaacaaagctctctgtgttcgaatctattgaacttgaggggatatattccatcatcctacttgaattctgttcctgagctagacctcatcagacatgatttcttttaggcaggctgcttctgacattcagataaaaggggcttgcctgg

SEQ ID NO: 567861 - DNA, 217 bp, Homo sapiens
tgacacaaatgtcatcatcatccccactgagcatctccaccgccttgattttcctgtctttggaggcccataataccaccacgacagagattctcaaaggcctcaagtctaacctcacggaaacttctgagacaaaaatataccagagcttccaacatctaccgtgcaccttaaataaatacaacggtgagctgtagctgagcctggaaaatgacat

SEQ ID NO: 567862 - DNA, 921 bp, Homo sapiens
cggacggtatggtactgatcccctacaaaccacaacctgtccctgatgctggcggcttattgacaaaccagtgccaggcccaggagaatgattcgcggtttcccatggatggagtgcactcgggttgaggtacactgaactcacgagtgaacttacattctcagtcgaacagatgaggtaacctgcaagttgctggacgtagatgaacctgtattcacattgatgcctaggcatacgcggggagaactctgttatgcggacaaaggctgatgtcggacgatatagcctggtagcaagtatgggatctgaagtgtgcttgggtcatagggggctctcgtgcataacacgaaatgtctcgatatgaagagcaaacagtggtttcgccttagtcagttggtgaccctatgcctgcgttgtatcttgtcaaacaagtatcgtggtttgcactagagtgtcctgggtctgtggtagccccttgtggtgtcctatgaaaactggcttgccttcttgtttgtaccttccctgctgagtcggatgggctgattgctcgagaggcgagcgttgaggtaggttgcttaccagtcgccccgtgggtgcagttcctcatattcctaaggggctatagtacgtaggagtgcttgatcctcgtgcgacgggtgtggcccatccaggtcagcgagggtgccctccgcaacattctcatgcgtggccgggttaggtgcctggggatgctcagaggaagttgcgtaggcgcactaccatccttgcacggctccccaggaattcccgtggccggagacccacggagggggggggccgggccccagggaccccccccttgtggtgtggcaggcatatacatttgtcccccaatgtgtatccccccgtattttgtgttccccggtcacccgcaattccaag

SEQ ID NO: 567863 - DNA, 132 bp, Homo sapiens
tacagcacttagactgaacatgcaatgtcaaatcagaaaggagagggacagggagagatgacggaaaggtgaaccagcagcagactggagcgcttggtctacgcagcaggggtggctcacaggagtccacct

SEQ ID NO: 567864 - DNA, 151 bp, Homo sapiens
  misc_feature (33)..(33): n is a, c, g, or t
agagagcttacctggtatacccaccctaggctngctgtaacagacatctctatgctgtgcctcggggttagagccccagaaagtgatgggcaagtgtactaagcccacaatcctaccctaacctgtgggggctagcctcgcataatcacct

SEQ ID NO: 567865 - DNA, 228 bp, Homo sapiens
tcaatgttgaatgatctgacctttccagttctgtagatactaacaaattaattttatgtttgcatgtgctcgtgtaatatttatagcatttcaaaccgtagtattatggtagaaaatcattatcacagaacattgttgtcagatgtattttgacataaaaatgtaagttgaccagctaattcacattttcaggtttttaaaattaaagttatactccaagtaagttat

SEQ ID NO: 567866 - DNA, 364 bp, Homo sapiens
tttgtgttttcattttagcccattctggtggatggcagagaccacttctttgtggttataatttgcatttccctgacaagtaattaacttgaacactttttctataggttaatgggtaattggccgttcttcttggtaaaaagctttgaagaggaacttttccaatatccaaaagaaaaccttttatttttctaataacattcccaacaattatgatgacgctattctaaggaccatactttgagtagtgaggctttattgtagaagagctaagtgaaatgatatttgaaagaacctgcagaatttgattgtggcgtagcttttggcagtcttagagggtttgaggtgagtagcagaaatctca

SEQ ID NO: 567867 - DNA, 182 bp, Homo sapiens
atcatcttccctgatgactgtgagttcaagcgggtgctgagtgccccagcggcagggtctacgtgctagaagttcaaggcaggctccaagcggcttttctatctggatgcaggaacccaaagacagaccaggatgacggagccttgccgggaacagtcaacgagctatctgacacaaccccc

SEQ ID NO: 567868 - DNA, 195 bp, Homo sapiens
ggattgaaacttgctctgggtgaataacgtgacctgacagtgcgacgcctaggacatgactgtacaccactatagacttacaaacactgtacacttacgtacactcaaatttattatgcttcttctttttgagacaggggtctcactatatagtctagactgaacttgaactcccaggctcaagcgatcctcctg

SEQ ID NO: 567869 - DNA, 340 bp, Homo sapiens
gcggccgcctactactactaaattcgcggccgcgtcgacttttgacaggttctcactctgttcccaggctggaatacagtggcatgatcatagctcactgcagcctcaactcaccgagcccaagagatcctttcacctcagccccccaagtagccggcaccacaggcatgcaccaccacgcctggctaattcttttgtatttttagtagagatggggctccaccatgctgcccaggctggtctcgatctcctggactcaagcgagatcggccttccaaagtgttggaattacaggcataagccaccatgcctggcccacttatataactttttgattcaa

SEQ ID NO: 567870 - DNA, 241 bp, Homo sapiens
ggctgctcgtggggcagcggctgctgctttgggctggccaggtccatggtgggcttgatgaactcaggagtcaggtggtcgcttgccaggtggtcacggggtcccggactcggtgctggtgtcccatattgggcttggatacagggcatctctggagagagaggagaccccaggcagggaaaggagagtcagtgggacaagcctatagccttgtctcaaagtatttgggcccccgagcaga

SEQ ID NO: 567871 - DNA, 732 bp, Homo sapiens
ggggctgttttttattcgaatgggggagtgggagggttttttgatttgtaattctaacgctcactctaaaaacaactccttgtacttaatttctttggacaaaactgtgatttaggtcaaattgattcaactatggattttgtggatacgggatatgactatcttagcttagacgtggatttatagggaggtataactattttaacgaaaccttcttagaattataataaaggacacttctatgtggggtaaaatgtggtcacaaattaattctttttacgagtggatctttctactcgctaacaatcatttagtgagtaggttcggggtaaacacctaggggtgatgtgtcctacgaacgaggacagtttctagaagcatatgcacaaccgagtcatgagctccatcggtctttgcaaaattgcaaagctctcattttcccattgtttaattcctaagcggaaggtggcagtaaccttacccctgacagagctgatggttaatggtaaaacgcctgcccgtcaaaaatcagtgaacaagaacaaaagctaattaggtcggccctttaaagcataaaggcttttcaacatgatcaatggtgggtttgcccctaaggctcccgttaagtggaacaaaccggtttgaaatgtttaggatttttctggaagagagcttttttcacttttccttgggatacaagccgggagacaccatttttgcccgcctgggggg

SEQ ID NO: 567872 - DNA, 135 bp, Homo sapiens
gctcctgttttggcctcccaaagctctgggattataggcatgagccagccgcacccagctccattgatttttttaaatattgagattgtatcctgcaactttgctgaactcatttattggttctaataatttttt

SEQ ID NO: 567873 - DNA, 101 bp, Homo sapiens
gcctgtgtcgccatgggccgcccgccccgccccgtttgttaccggtatttgtaaggaaccaagccgtaacccaaggtgttcgcttctgccgaggtgtccct

SEQ ID NO: 567874 - DNA, 169 bp, Homo sapiens
gtgggagagggggtctcacattgggtatactactacactgggaagaaatagggaggtttctagatgtccggcttggagaactattaacataagttggaatttaagttggtatgggtatgctggttccccacgtgtcattacagccaatcttactgtgacttatggagta

SEQ ID NO: 567875 - DNA, 1706 bp, Homo sapiens
ctcgacgacgtacggtacttgatgcgctgtccgttgatacactgtgcactgcctagagagtctaggactcttcctctcgtctgatgaccttcctttgactgagcatggcgtggccatggcatccaagttccgcacgtcatgctgatggacgctgtaggggaatcccctgcgaaggctctaccccctctcacgaaggttacagggcacctaggaggtagggagagtgcatagaaactctgggggcggcaagggccgcgtacgttggatggtggtggcatgggcgtcacgcttgacgtgtcccttgcttgcacttccacaacgtcctggccgactaacttgttccgagggctgccggcaggtgtagcgttggctgtgtctgcctagattcttctgtgagctgtggtggcaggcggcgtagatttgcccctgtgggccatgccaccgtccattactgccggtgcagacgcgacgtggacgtgtgggtccacggactaacctggacggtctgctgcggtagctcgctaggactgggcatactgggccgtgtgtgcactcatcgcggaccgtaggtcgcatagtagagaccgagctcgatccgctctagggcgctatctaggcgaccagagtccatgatctctagctccaaggtccgttgctacaatctctcgctaaaggtccagcggaacagggaaagatctaggtgagcgggcgaacaaacatcgacagagcccgtcggtgctatgttgggagcgaccgcgacaaaggtagcagcgctttggtatagcccattacgtgtgctcgaagtcgctcgcggagtaaacttcaatttcggaattgacgtagacaacaagttgtttagcaagggtaatggtgggtctgaaccttggtgtgcaccaactgacacaccttggtggcctccaccaaggtaacctccggagagttcgggagagggcaagcctttggccgagagagaaaaaggcacctgaaccacggggggcaaaggcaaaagggggaaggcccgagggaaacccatattttaccggggaggaacggaacaaaggaggcgacgaggaggaacttagcgcctttggtttgagcacccacaaaggacaagacgtttgaagagcccccaaggttagggccacaggttttggatttaggcaaaagactttggggttgagagaaacagggagaaaagacagggccgtacaagcttatgggaaacaagaacgttacaccaacatatactttaggatgttatgtgtatagagagaatatgtgagtggaggagaaacaattttcaagatgagaagagcaccaactatggagtaagagaccccaagactatggtggtgtaagcagagcccacagaaggggaggcacaacaatatagaaggacaaggggagatataaaagatcacaaggagggggagcccctttagggagaccaacatcttggcgagagaaatggtcgagacgaagaaaatatacgaacaacgaatatgggcgaagcacaaagtagtatgttaatagcagacaaaaatatagagaaagagataggaagaccaaaattatagaagaaccgaacgagataatataagatcacaaagccagcatcaaagagaaatagataaagccatcaatatacaagagaaaaacacaaagaaaagtacgaaagtagataaagattaggtagcagaataagt

SEQ ID NO: 567876 - DNA, 133 bp, Homo sapiens
  misc_feature (9)..(9): n is a, c, g, or t
  misc_feature (70)..(70): n is a, c, g, or t
  misc_feature (96)..(96): n is a, c, g, or t
agcaaaaantacgtatgtcagagagactgttaaaaggaagaggggaaatggggaatatgtgttgggttcncagaataatttacattcgcacaatgnacaaatgcaataaaatgtcttaacagtgaaaaaaaaa

SEQ ID NO: 567877 - DNA, 593 bp, Homo sapiens
gaatgataaataatgtcattaagcctagtctgtcttaagtatgttcagcagctaaataatgcgcacgtaggtacacttctacattgataaaactattcatgtgaatactgactatcaggggaaagtcataaacagtgttagaaaggctcttgggaaggtgtaggggttccttgtgttgttcatttttaaaattgaaactgtgtcatacagtgtttcacgtctctgaaattgggattataatagcactattttgatgtagctctaccgatactatgtggtaatgctatttgttttactaacaagctctggaatatttagcagtcattttcactggcacaagagccttttgtatgttattcaatttaaacttttaaaccaagaaattttatggtccagtgtctttggcaaaaagatgctggagggaatgtaacatacaattaatatgtggttatatatatatataaaaagacacaaattgccatggttatggttctgccttgaaacagcacaatgaagtgtatcagtatattctgtgattatgaaattatatgttgtgttgttgtgtcttctgttgcctgtcctttgggccagat

SEQ ID NO: 567878 - DNA, 343 bp, Homo sapiens
gcaccgcgggttcaaatgcaggcgattcatgaggacgccatccctaggagagtggcgatgaggacgaagacgaccgtgtggagggcgcatctcgatctgctcctctgacaaacgaattgcctgtgaggaagagttctccgattctgaagaggagggagaggggggcccgcaaggaactcttccaagttcaaaaaagccaagagagtcaaaacagaggatgaaaaagagaaagacccagaggagaagaaagaagtcaccgaagaggagaaaaccaaggaggagaagccagaagccaaaggggtcaaggaggaggtcaagttggcctgaatggacctctccagct

SEQ ID NO: 567879 - DNA, 629 bp, Homo sapiens
  misc_feature (619)..(619): n is a, c, g, or t
ctgcctgcaggtggagcaggcacaagaaccgccgcatgcgccctccatgtccaggttgtgaccttgagcgatgtccaggatggtttcgccctcacagacttcgtacgtcttctgggagccatccttcagaataaaagttatcttcagttcttcgcctggtttcggttttttcaaatggccatggtttaagaacgaagacgtagagaagggcagaaatcttgtggttgtggtggtgcgtgtgagcagagatggagaggtgcgtaaaagatgtgctgcgatgttcgatattctagctgtgtgtccagcccgagtaacaattttcagcattgggggcgggttgagtatagatacgagaagcgcctatttcgtatgagggtttttttttctattattatgtatattaggcatatatatacatatatatattttgcatacatattcatttttaaaaaaatgcaactgctacacgctttgaaagattcaatcaaaagtttttccgacgaccagaattggctagcaaaaaaacgaaaatgtaatggagtcatgcaaacatgactaatagtaacaaaaaaaaaagatatagtagaattgagtaagtaagttctatgtatattggtgntattttctct

SEQ ID NO: 567880 - DNA, 1377 bp, Homo sapiens
atacggccatattgttacaaacctcggacgaaaaatgtgggaagactagatacacaagattggcactatgtaataatatgggttcaagagagttttctataatagcataactggctaatcataaggcttaaggagcaaagtatctggaagaaagtatgtagtaaggattaggtcttactacgtataaagccccaaaaagttcgcgaattacaatatgcaccttgcaattactggacggatatctaatgggtaacccagttacgtttaaaaggcccatcaactgaaatgttctcggtggtgcaaaaagctagcaaggttaaagcttgatcaagattgaagggtgtttacgtaggatctagaatccaatttagaaagcaataccttgaagctagataggggatagttggttaaataatcaacatctattagctactataaggactggtgtaatgtttaaagaatactaaggcagaaggcttttggaagagcttagtagaatttggaaggccttaaatatagtagacttagtgtgaaaaaatgtgaaggactttcgtaacaggaagtaattcatagagtcaagagtaattacctacttaaagtttttgcaattggactttgagcttaagattattgctttcaatcctgaggactagcatttaattgacagctcgacccaggtgctacactagaagtggattcagtgaatcttaggaagacagcagcagacaggattccaggaaccagtgtttgatgaagctaggactgtaggagcaagtcgagcatagcagcagttcgtggtgaagataggaatagagtccatggtaggcacctagtgccgatctgtggtgaaaggaagactaggaacgaaggaaggagcgctaacgatttggtggtgaagctaggataaaaggattacaggaaggagcgagtgcaatttggtgatgtaaggtagcaggcggcttggcttggcaaccacacggaggaggcgagcaggcgttgtgcgtagaggatcctagaccagcatgccagtgtgccaaggccacagggaaagcgagtggttggtaaaaatccgtgaggtcggcaatatgttgtttttctggaacttacttatgggaaccctttatttattttctaaaaaaaagggggagtttcgtactgaggtgtaaaaggatttatatggggacgtaggcccatttcccggtgttgtaggtttctctttttcaggcttaaactcatgaatcttgtctgaagccttttagggcagactgccaagtcccggagaaatagtaaatggcaagttcgtgggttattttttttttacacgaatttgagcaaaacccaaaagagcaaagaccccaaaagggaaaccgagctcga

SEQ ID NO: 567881 - DNA, 799 bp, Homo sapiens
ttgcgtagaaggtggggggcggatggggggcggtgccaagcattactgcctgagctcagtttcctgttagatcagccatggcattagattctcaaaggagctcgaatcctgctgtgacaccgcatgtgcaagacgatctaggttgcatgctccttatgagaatctaatgataacatgtacatgtaccttgacttcatcctgaaaccattccccctaaaccccccagtcccgtggacacaattttcttccagcaaaagcccgtccctaatgccaaaacagtgggagatcgctccactagagaacagataacggcttacttcctttaacgtgccattacaatttcactgctcagcagctaggttctttacggtagggcaaccatcaattcacccatgacaatggcaattgtcatctatatatcatctatttaaaaatcccatctattcagggatcctacccaaaaagcaaatttaactttacattatcacaacataacacttatcttctcatgtgtcacgtgtcctgacattggccactcacaggggctctctagattcctcattagagaaatccttatgcttttcatcttgggagaaccagagcagaatggaatctttgctcaaaagctctaatgatgggtaaacatattccataataaagtaataaatcaaacttggtaacgagttgcattatattattgggcatcctaatggatataatataaataaattggaaaaaggctgaaataaagttgaattatataaggaataagatttaaatgaactgtaacttctacacg

SEQ ID NO: 567882 - DNA, 102 bp, Homo sapiens
ttcaagtgagagcactactagataggtgccctttcccattttacagatgatcaaattgaggcaaagaaagagtaagaaacgtgtactaccctcgttaagctt

SEQ ID NO: 567883 - DNA, 729 bp, Homo sapiens
ctctggccagcgccttcccgagagggacctttatgccgacatgtactccgcctggcaggccctgtcgcaccagggttcggcatcatcccggtcagcatctatcctgtacgggcagagcatctggcacggtgtctcccccgtggacctggcctcgcgctacgagtgttccccggtggttctgcactcgccgctcacctcgggcatgcgcgtcgccttccccgacccccaggtagaccttctgcttcgacgccttcccttacctcgagaaggtgtcccagatcacgtttcccgtgctcatcatccccggcccggaggacgaggtgatcgacttttcgcccgggctggcgctttacgagccctgcccccaggccggtggaccccctgtgggtggagggccccgggcaccacacgactctcgaggctttacacgcccgtacctggagcgcctgcgtcgcgttcatcttcccaggagctgcccagaccagcgcgcctatcggcggcccccaaccggccggaccctcagccaataaggcggcccccggaccctcaccccgcgccggcccccaaccacggggctgcatgtggaccccccgggcggcccacaggggaccccgccccgaacccacggggctgtggacgatgtacaggccacagagctacgcactcctttccttttggaagcccagaagaaaatacgtgaaaacggaaattaaagattttaaattttta

SEQ ID NO: 567884 - DNA, 342 bp, Homo sapiens
ctgcctcccattctattcaaagtcacccctgtgctcactgagatagatgcatatctgattgcctcctttggaaaggctaacagaatctcaaaagaatgtaaccatttgtgtatcacctatctgtgacctggaagcctcctccccacttcaagtcttcctgcctttccagactgaaccaatgtacttcttacatatattgattgatgtctcatgcctccctaaaatgtataaaactaagctgtaccccaaccaccttgggcacaggtcttcaggacttcctgaggctgtcacggacacatgtccccaaccttggcaaaataaacaattaactgaaaaaaaaaa

SEQ ID NO: 567885 - DNA, 164 bp, Homo sapiens
ctcaacgctttatacttcatcatctaacattccagaacaatggaaagtactctacttgtacatgcaaagttaaagtcatgtggtatgtgctcggtagtaacagcaaagaagagccttgtataacaaggttccaaggtaaaattatacacaggtcgttaacgttc

SEQ ID NO: 567886 - DNA, 998 bp, Homo sapiens
gccactccttttctgagtggggggcagtcaccactgctgggcgtggcatccgcctgggcctttctccgaccttctggtgtggccgccctgggggccaggccctcgccatcctccccatccttgttcctcagcaaatggcattagcttctgatgacagctgctaatgccatttgctgaggaacaaggatggggagggagccacagatttgggaaacgacctggacacactattgggaaggagatgtggacgggctgtctcctcctgcagggcccacccataggacatgtattcagcaacacatgaacctacgtatacgatcactcgataacacacaaccaccacccacaaaaacccgcgggcccatcaagagcacgcgggggcggaacaaggcggcaccgtgacagtggcacccgtgcgcccaatagcagcgaacccaggaccacaacccacaacccgcgggccaccaacgggagcacaatcaggaccagcgcacccccaaacagcgcacacccgcaccaccacctcccgcaaaagcccacagcgcacaccccgcgcagcctccacggaccccccccgccaacacccgcacgaacacaccaccacacccaacccgcgccacccccgaagcccaccaacccgccccacaaacgcagcacgcacaacgcacccccccacaccaacaccagcccaaaaagaacgagggagggaagcggcgcgacgcgaggacggacaagacaaaggaagcgagacgcgaaggagcgcaacaaggaggggcggagacacaccccgcggcgggcggcgaaacgccagaccagagcacaacacggcgcaacggacgacgcagggacaggagagaggagcgggggagaaggggtggatgagacgacaggagcgaggagacggaacccagacgggggaggcgaggaagaaggaaacgaagcgaagaggcaggaggagaggcggggagaaaggaagagagcaagagagagaagggagc

SEQ ID NO: 567887 - DNA, 286 bp, Homo sapiens
gaaagctgtacccaacgtgtcccactccatccatcccccagtcaccattattctgtccgcatgaatttgattattctaggtatctcatgtaagtggaatcatacagtatttgactttttgtgattggcttatttcacttagcttaatgtcctcatttttacccacgttgtggcatgtcagaacttatttcctttttaaaggctgaacaatattccactgtacatataatacctcattttgtttatccattcatcgttgatgaacacttgggtactacgctttggca

SEQ ID NO: 567888 - DNA, 456 bp, Homo sapiens
cacaagacttctcagcttcaggagatccagctgaggctagttaatggtttgttgaggccaccttaaacctgtagagggcaccctctaaaagtttgttcagggcattgcaagcatcaatccacctgtctcaggtagactcctagatttggctccactgagagaagtatgttctggtgtggtttttaactcctttgaaaagggcaaaagggattttggagccactgagcgtgcatgctgctggctgtgggaaagacattttctatcaaggaggccctcctcctgtgctcacatcacacattcccagacatgcatcccagtgtggtcagctcccagctgattgatcactggcagcccttgcttagtggtgctgcttacctaaacaccctggccactcctagggtgcttgtccatttctccttcttcaatatatgcaaatatatgcatgaaaactttttt

SEQ ID NO: 567889 - DNA, 1040 bp, Homo sapiens
gggcggatgacgccggtgcagcggtgggggcccggggtgccctggtggccctgggatggggaaccgcggtggcttccgctggaggtttctggcagtggcatcctggtggcctggtggtctgctggcctgtggactggtggccggggcctgaggcctgcggagctcgctggagtgcaatggcctgaggataacggagtggatgccctgtcacccaagttgggcctgcttggtcacatgacatgacagatcaaggtctcctggacggacgatctactcgtcttcgtcccgttgcccagttaacgggacatcacgaggattcagttgcacttgtcgttccttgggtgtgcccttcttcttcaatgggattcgacgggttttttggaaccgacttattggccaggttgccaggaatcgcatgacgcctgtagcctgtgcccagctgcagccagggtttcaactggcacttctggtctgcttatccgggcgacttaccaactggccccacgttcgggctcatagggcgtggcttaatgttagcatacgcagatgggcaccgtgctgggacaacactgacacaattccctgatagtgcgagcccccaattcgagttcccttggggctccaaatggcttcttcccaagtacagtaccccactggttgcctggccatgcaaccgcgccttaaccttgggtcgggtgcacaacctgacacgcaattcctgcggcgcaagaagggccacacgctagccgaacttgcttacccccctattgctccacatcgggctttggaaccacacggggccccaggcgattagacatcgagtggcccttccaatttgggatagggccagtttcggagcgttacatccgcggacgccgcttatacacaaattctcacccaccactatatgggcacaaattgcgtccgcacaagaggtgggggcgggcgcacaaacccctttggggcgccacatatcaggggtaccgtatccccatggcgagagcccacaattaggtataggccgctttacaaggggaaag

SEQ ID NO: 567890 - DNA, 275 bp, Homo sapiens
  misc_feature (31)..(31): n is a, c, g, or t
  misc_feature (100)..(100): n is a, c, g, or t
ctaaatattgcacatccattttaaaactatntgagatgcactttttgactcaggaggccaaggcaggaggattgcttgagcccaggagtttgagaccagncctgggcaacacagcgagcaccttgtctcttaaaaaaaaaaaaaaaaaaaaatgagagaaatcggctgggcatggtttctcatgcctgtaatcccagaactttgggaggctgaggcaggtggatcaccggaggttaggaattcaagactgaaaccttgtctctactgaaaataca

SEQ ID NO: 567891 - DNA, 242 bp, Homo sapiens
  misc_feature (42)..(42): n is a, c, g, or t
  misc_feature (201)..(201): n is a, c, g, or t
acctagaggatcccgtacgtggtgtaccgtcctagtcggatngttaccactgagccacgaccggaactcccataaagtattttaacctaaaggtcaatttcatgtgagtccacttaacatgttggataaagaccttattggcaggtcagtatcttaataatatttgtatcctgaatatctaatagattgtgaggactcacnggtaacaccccacagtgggtaccgggagctcgaacttcgta

SEQ ID NO: 567892 - DNA, 309 bp, Homo sapiens
cagctactcaggaggctgagtcagtagaataacttcaacctgggaggcggaggttgcagtgagccaagatcgtgccattgcactccagcctgggcaacaagagtgaaactctgtcttaaaaaacaaacaaaaaaaaacaaaaacttgtaccctctgctaaaaatattcccgaccgactgcaaaaagaaggtttcggccatgttaaccctttaaatgtttacagtcattttgaaaataagcaagcaaagatttttcttttttaaaaaagatctgtaggataaaaagtggaagtaaggatattcacgtcca

SEQ ID NO: 567893 - DNA, 200 bp, Homo sapiens
  misc_feature (23)..(23): n is a, c, g, or t
  misc_feature (34)..(34): n is a, c, g, or t
  misc_feature (39)..(39): n is a, c, g, or t
  misc_feature (57)..(57): n is a, c, g, or t
  misc_feature (105)..(105): n is a, c, g, or t
  misc_feature (107)..(107): n is a, c, g, or t
  misc_feature (110)..(110): n is a, c, g, or t
  misc_feature (129)..(129): n is a, c, g, or t
  misc_feature (146)..(147): n is a, c, g, or t
  misc_feature (177)..(177): n is a, c, g, or t
cattataccactgccgttaatgngcctttacgcnctttnccgtgttcgtcatacccntccttcactcattcccatatcgttctcacgccgtattagtatacgcgncnctnccccgatccttttgccacnttatttcgtgccggccnncacgcgattagttcggctggcgttcccttngcacggcgttatcgtgtataccc

SEQ ID NO: 567894 - DNA, 157 bp, Homo sapiens
ctaaggctctactgatctgaaatgctgcacacgtattatctcatgatcttgtcatctgttggaactatgtctcagcattgctgcgagacaggcatttttaccatgttccccatatcatgcaaggggcaactgcgaacccgctgccctacagcacatg

SEQ ID NO: 567895 - DNA, 660 bp, Homo sapiens
  misc_feature (490)..(490): n is a, c, g, or t
ggtcatgtggacgcatgtgtacagtgcacgcggaggcagagcgggtccggaagttctctccattttcccatagagaaaccctgactggccgtgtggggacaactgacgacacaggccctcacgccctggcgagcccagtgagggtcactatcatatgacaaaggcttgccggcagttcatcttcctccctgtgtactttccatttgccttcctggaatcctgtgcatcacagaagctggaaagttctgatgtccactgaaaatcacaatggaaagtcttgattgactgtcacagtaatgaaaaggcagtaactagaaataaggatcattcagcagaaggacgaaggggtgtggaaaacgaccaaaaggaaagtgtcttcaggggcatccatttgctagcaaagaaacttctgtgatttttcagaagaggaagaagaggaagacgaagaggaggatactgatcaaggttcacttctttggggccgatgggnctagagcaagatgttggtgaaactgaccgattgattgaatcaccagagcaagcgagcccggagaccaatgaatgctttctttatttgtgcaaaacgcaatcgctctcttgtaacgtcagggaacaccccaggttgataaccgggctgcttccaaaataataagtgattgg

SEQ ID NO: 567896 - DNA, 962 bp, Homo sapiens
gccaggtacagtcgcctctgtgcggagcttgtgactggttacttggtcctccagtggcggtccgaggcttcgttcgagtaacaacatgtgatatcggctgctttgccaaggctcacgcaactacactactgtctaggtagcgatcggaggctcagacaacttctacagtgtgttcgagggcgaggctctccgatagccatccccggtggctgcacgcgtctatcgccggctgctcgcatcatcagggtcgcactgtgtgtggggtaacagggcactggatctcctgggtaccctagaacacagtaccagccggacccaggagtcgtgcaagcacattcgcaagagtgctcccagacacagggcagattaggcgggtggaggatgcggttctcatacttgggcaatgtctgcacctgcaaattgactacgttgggctcttcggtccctactctcagacattggaacgacgggaagacagaagaaattgctgggcgcgatgtgctcatgggtgggtaatgtcgtctccatcaacagatcagtcgcgtcgaccacgtgtgctagtaggaaggctactgtgtcttcagggaatcgaggtgcagggctgctgcatcaccaatgacttcgattgtgagcgagcaatggatgagtttgtgctctgcttcttcgagtccccgcttgtgggggttgactgttgctcccgtggccgcggggtgatcgtcggcgcgtggtggtggctgatttgcgtgcatgtgcactatctgtcgtgcggtgctaccatcttcctcctttctcgtgtggtcggactgcttggcctgtggtggggctgtgtcacccccttggcgcagttgggattcagcctggggtgtctgtcagtgctgcctgttcggccgcgggggggtgcacttgcggcgctgatgctccgtgggaggctctgtttaaggggggccacctccggtgcgggc

SEQ ID NO: 567897 - DNA, 688 bp, Homo sapiens
  misc_feature (15)..(15): n is a, c, g, or t
ctggcagctaccatngttcgcgggctacagctggcggggagtggacgacaccggctggtccaggcggtggcattgcgggacgtacgtgcctgtctgacggtcctatgcacccgagggcctctcgcagattaccccaggttcgtggagtctgtggatgaatatcagtttgtggaggcgcctggttacctggctatcagggatccgcagatcccccaagagcatgaacattatcgctagccctagttgagctggcaggctcccaagagaccccccaaccaagctgaccttacttggtactgatagctcctcggtaatgctacaaacatgctcccgttgctatcaacggactatcagcgcatggtaatcggcagatgactgtgatccgcgaaagtgtgaacggggacatctgggccctgcagaaggacgtggcagattttctgagcccgctgctggggaagacacctgtcacgccaggtcaattgaggtgactaggtaccctacgcgatcaagggctagctttgagccaggagcttagagctcgtggctctgtggtagaaatggcgttctgaggctcgtagactgagctagccctgtttgtcatgcatgcacctgtggatctgagtctagggggcctcaggaggagggaggtgggtgtaggagttcctgtggatagggggatacgagaaga

SEQ ID NO: 567898 - DNA, 318 bp, Homo sapiens
tccttgtagccctgccgactagaaaggatgatctcagctaaacgcaacctctgcctcccaggtacaagtgattctcccacctcggccacccaaagtgctgggattacagacatgagccactcactgcgcccagtaaaaaaaaagaaattattaataagaatatatatatagacattatgcagctcatatgttttaagtgactagtatacatatattcaattgtataggataatacctataatattacctaaatctagtccactatctagagagacacagttacggagtgtatagcacatattgtagtaatacggtagt

SEQ ID NO: 567899 - DNA, 218 bp, Homo sapiens
aggcacattggctgcattcctgttacccacctggtagggatgagggaggagatagcatgaaagggtggagcgcatgaaggaaaagagaacgaatcagctagatcaaaggaggcaggggtggcgtgcaattggattcctttcagccgtccagggcctggcttcctgtccaccagcacacggaaattccccagagtaaccttctcgaacaggactgggaa

SEQ ID NO: 567900 - DNA, 438 bp, Homo sapiens
  misc_feature (337)..(337): n is a, c, g, or t
  misc_feature (343)..(343): n is a, c, g, or t
  misc_feature (354)..(354): n is a, c, g, or t
  misc_feature (393)..(393): n is a, c, g, or t
  misc_feature (420)..(420): n is a, c, g, or t
cttactgccgccccctcgcttcaatcaaactgtggctgccctttgtccacgaggcgggatcggatcgaaacttgcgaccacggtagatcagtcgaacttcaccagatccttaaagatcagttgaccccagcgatttccgcgcgcgtgcacaagcagtccaccttccgaaagcccgccaagtttgatcggcgagaaaccgagattttccgcaagcgcgccaatctccgctgcggcaccgtcatcgtcgctcgccaggaacacgactctcctgccaccatgtacggccggatcctgttcaaggacggcagcgcccaaatgattgaaaccttaaccagtntgccgncagtgaaggcntccgcgaaggcccaggaagaaggtttttcccccagtttntgaggaaggatttcttagggatttgtnaaattgaagatgattttt

SEQ ID NO: 567901 - DNA, 147 bp, Homo sapiens
acttcacaggcatcctgttcatcgacgagatcataccatcattggcgccggtgcagcttccggtggggtgatggacgcttccaacctgctcaagccactgctgtcctcgggtgatatcctgttgcattggcttgagcaggttggaag

SEQ ID NO: 567902 - DNA, 120 bp, Homo sapiens
taaaccaaaggaaacagggcttcaacattaaggattaaccaggaaactggatccatttaagtttttccaaatatggatttcatttaaaagcaagaatttttctttccgccttctgctatg

SEQ ID NO: 567903 - DNA, 349 bp, Homo sapiens
ctcagggcgcagatgagaaaaggatacacggtagcgtgctgagcaaatgggatctatgaccacagactgtgtactaaggaggagtcaatgatatacataaagcactgagcacaaagcaaaaatgcaggaaacatttgtttcgcttcagctgggacctgaaaattccccagggcccataacagctctttctttcccattcagtttcatatctacctccttagcatctagatatgcaagacctccagaccaggaatcagtaagctttcagatccatcaaaaacctaagctcgtcactgctgcaggaacagagttgctctgagtgtcatgctacctcccggcgaacctatga

SEQ ID NO: 567904 - DNA, 210 bp, Homo sapiens
caagtttattagaaaaaaaaagttagtgggggctgtggcatgtactgtaccggtagctctggctacctgggaggctgaggtgggaggatctcttgagcccaggagtttgagaccagcctgggcaacattgcaagaccctcatctacaaaaaaaaaaaataaagggtatgaacattgggctcaaagcaaagcagtgtgactaccccgtgat

SEQ ID NO: 567905 - DNA, 1096 bp, Homo sapiens
  misc_feature (147)..(147): n is a, c, g, or t
  misc_feature (607)..(607): n is a, c, g, or t
agcggctactagtacagcgccgccgtacgccaccgccaccgccaccgccactaaccaccgtactagagtactagcagtacccgagagagatacacagccatacatagtaccataagacgaagatactaggagcccgaggagactccnagagacatcccgcggagaacccccacaggaggacggaggacactgctatacgtattcaataaatataatggctaattctattaagaacccaagagaatcttgctgcatttatatagataagatgggcctaatagctaatgatacatggagcgatatgatggatactaaatgggcaaaaaaatatctggatatagaatattgccactagacaatttatcctattgaggcactgctggcgctcgacaatgatcgacaatatacacgacttataaagattgattcatagattaatgcgaatattatcctaataaatggaaattgtgcacacagtactgaatactatagcaggaccgaagtatttaataatttgaaaaggcaaccaagtgaaattatcagttataccattattaaagattacagatatatgatcaagacaggtgtctgttcctcattattatgnctttgatataacggcattctaaacgctgaatagattacatgactggtagtctaacgcattaatgaaactctacagatcggaacactaacgtgaaactactcatagctggacagatgaatgcatatcaaatcaaatcgcatgggacccgccctggattatgcaatagatctaatataatatgcgttttatgtatgaagatgagctcagaaattcggatctcacgattctatacatcgatgctgggttaaggcggtaggatatagcatgctatggaatagatggatttatattcattggggccttaaattttttgtaaattgaggaaactgttattactggaggaaaatatgcgtactgcggggtctttcattctttggattaaaataaattaacggggaatatgagcgaggtggattaatgttagataatgaaaactatttcatggatttatcctatatcttttccaaacattttgttgattgtaatgga

SEQ ID NO: 567906 - DNA, 106 bp, Homo sapiens
ttcgacacatcgagcttgctggtgcagacgaagtcggcgggctctggagaagattgacctttagttcagtagacacgcacctccgagtttgggcacttacaacgcc

SEQ ID NO: 567907 - DNA, 753 bp, Homo sapiens
gcgggctactacggacgacgtgtgctgcctggacgcacgcccccgctaacatgcgggggctgatgtggcagagcgcgagtgcacgagcctgctgaacaatctacggtctcgtcggggcgacaggccatcgctacctgaacacaaccgtgaccaatggcacaggcccgcatcccatgaatgccgtgtgggtccatcatcgtccgaggctcgtgctcggtgatctccttgtggagttgactgatgggggcagtacacgctcgcttgtaagtcgtacacccactcattgagggactgaatcgtgagaatcttgagggcgatggggacctccgtgaagggcggatcgcgtgctgggccgattgccggaaaccgtcattccccgtcgtttcacccgcgggaaagaggggggggttgcctgtccataatacgggacctacagtaatgtcatttgagcaatggggccggggataaatcagcgcgtctatcggttccagaaattggctatgaggctactgagtatgccaggagcccaggggaagctgcagcagcagggtctgaaacccctccagacacacgagcccagagggacagccaaggtccacgagcccgaaaacatgtcaaacaggaaatggacagccccggtccctgagaagcggccctgaaatacagcatttccgcatgagtgatgatgtcactcactgggaaaggtgacctcagatctggcaaataggaggaagctgaactccaggaagtggc

SEQ ID NO: 567908 - DNA, 238 bp, Homo sapiens
cagtaataaattagccaaaactgtctattattagcactttttgtaaacgtataccaattttttcttattccttttttttcaaaaaaaatctaatttcttcttcctagcgtaattatctttagaagctttatctctagttacatatttatggttgtttacgtgagatctaagagctatcagaataacctacattttctggatatggaaaaatacttttcctactttgtttcatgtggtg

SEQ ID NO: 567909 - DNA, 909 bp, Homo sapiens
taatgcccaaatgtttgtgcaatgagtaatgtgtgtgtatacactacatatattctctgaaatagacataccatcagagacatcattcagcaagtgactgatgtattggcatctcattcatatttctcgctgtgtgaggtatatggtactagttatcttgacttgatgtttgccaaatcctgaatagaagtgcattggtacgaaattactgaatgtaaagaaaatgttttcggcgtgaaaaattaacatattttatgacgtaccacagtataactctgtcccaaaccagcagcctatctatctttcctgttctttacatccctgttccccatccctacttcctcattttggtataacacagttctttgtagcatcattataattgcagttctatggcaattggacagtgtatagcatggaagacagactggtataagtagtacagtagtcaccagtgtgccacatttgcattagtaatgcaaaatatacattttataaaaggagcaaactatggtaatgtagatggcattacatcgtataatattgtaagactatgtatgtcctaatttgcatataatgttttcctacgtaaaggcataaatatagcaactctgtattaaccggtagcttaattagaattgcactatgtcaaataaaaaattgtccacagtgggactcccatggccaatggatattgaaggatggatttacccccatgtacattctttttaaccattacccaatttctctaggaacagacaatagtgggtcggacctggcacatgtgtcttatgcgggcggatcacagtacaatcgtgccctaacattgggaaagagccccgatggaatacctagtgatggcacacacaccaccacgccctagtatttcacagagcccatcatgaggaa

SEQ ID NO: 567910 - DNA, 343 bp, Homo sapiens
gatgtattcagaaacagtagagttcatcagagtatgctatgcgactaaaaacccactcaggccccaatgccacctccggaagacaaccaactggctgcactatgttgctgatgcctggccctcctgtactggcggatgtgtcgactcaaaagggacctcgctgtaaagtatgcaaaagccataatcgactatctcaagaactcatttaaagccgcccaagccccataaccgtgggggaccagtggaaactccgtggggtctcagggcagcctaaccaacgccagcgccctgtcaccgtcgaccatcgtcagcatcccacagcgcaaccaccagtgggcggcgg

SEQ ID NO: 567911 - DNA, 217 bp, Homo sapiens
caattttaaaaaccccccccccctgttatagttaatttgccaaaaaggtccccaaagaggactttattttatttaaagcattggtttaattcaccctttaaaaattttgcaaagaaggggagggggggattttaaaaaagcctgccccgaatttaaatgtttttagctttaggatttaactttttggaacaaaaaacccttttttaaaacaagttta

SEQ ID NO: 567912 - DNA, 461 bp, Homo sapiens
aagtacacgttccgccagccattgaccgaggatcgacggccatcagtcttggatgaccggcgaccggcggcatccaggccgtaggcggcggccgcatccagggagtcgaaggtcagatggttccgatcggacagcgcctccaaccgaatgtcggggaggatgatcagctcgtgaggggtcggggttccggatcggttcagcttgccgatcttggtctccccggagattccgacgtacagagagtcaccgaccttgatcgggtcaccgtggctgatcatggcgatgaagtgccaatgaccccggcgaccggtgggctccttcttggactccggtggcagcggtatgtcaccgaacaggtcgaaatcttcgggtcccatcatctcacctcagaactccgatccatcgggcacggagttgaggaccaccttcgccatctggagggcgagctgcttcatcatgta

SEQ ID NO: 567913 - DNA, 174 bp, Homo sapiens
gactgaggatagtgggtgctgaaatttgcgatgagcctgtgggtcttgatccccatcattctgaacctaaacacatatcgtgaacggtgtgaagtgtgctgatagtgtctgtcaccatctcaaataaacagggacttgctcctcattagtggttatgcctgcaaagctttgaaa

SEQ ID NO: 567914 - DNA, 119 bp, Homo sapiens
tagtcatgcagcattcggatgacagatgcacctttgctgatatgatgatagcatcaaatatctctatctaaactcagatagtggtagggccccaaattgatttcaataaggataggctg

SEQ ID NO: 567915 - DNA, 869 bp, Homo sapiens
gtcatcgatcaacccctctttttgatgggatttaattgtggttttttttttttaaccagctgtaagttgggagtaatgcatgtacatgtaaatacagttcacagggcaactccggatgttctaaatactgtgtaacattggcttatttggaacaactatggtatgagtacgtgtgaagtgatttttaaacatgtctcattttttcatgtccccattttattaaaaggagggatgcgacctatttgggtggacagctaagttgtaatttccgtctctaagaggtttctttccttttaagactaaaggcggcttaccagacagaaaacactttactcttcctcactggctaacttcaaagggctaattttttccctagatggctaagttggactattggatcccatcgtatcaacgctgtgaattcccttcatttcctggtcggaggttccattattacactttggtcaaaaataacggggctcatcaactctctgaaagtgtcctaaatgctatgtattttttggccagattggacatcctgattggcaccatgtgcctggaaccctggttatttaccaaggttaattaagtcccggtatttctcacctaggctccgaccacttacgggctgtcgtgacactgacagggctgtctactccagaaaacgattcctatgcccttcagttatggaggtgagcttgtaaggtattggccgtggcggctgacggatttttctggcagacttgtcactctgctggtgggaattctcgatcattccatatgcgcttttggacgggacccccctctccttaatgtcgttgttacccttttgggccccgtcgctctcacaactgcggtgttgcgccctt

SEQ ID NO: 567916 - DNA, 270 bp, Homo sapiens
taaaattggaatgcacttgagtttttctggcaaaagaagttaatttgtatatatatatatatatatatatatatatatatatatatatatatattatatatatatttggaaataaaatggaatattcaagaatttggtgaggccgggcatggtgtcttacacctgtaatcctggcactttgggaggccaaggcaggcaaattgcatgagctcaggattttgagaccagcgtggtcaacatggcaatatcccatctctaccaaaaaaaaaa

SEQ ID NO: 567917 - DNA, 419 bp, Homo sapiens
  misc_feature (413)..(413): n is a, c, g, or t
  misc_feature (415)..(415): n is a, c, g, or t
  misc_feature (417)..(417): n is a, c, g, or t
cgtagcatttccctcaacccatcatgaccccctgttcggccttttttgccaaatttaattttaattttttggttcagcctttaaaattggaaactttcctggcctgcgtgtgttggctcacccccaaagtgctgtaattgcagcactttgggaggctgaagtgagcagatcacttgagcccagggttccagatcagcctgggcaacatggtgaaaccccatctctacaggaaatataaaaattagctgggcatggtggcacacacctctagtcccagcacctcctcaggagtctgaggtgggagggattatctgagcccaggaggtccaggctgcagttagctctgatggttccactgcattccagcctgggcgacagagcatgacactgtctctaaaaaaattaattgaatntntnaa

SEQ ID NO: 567918 - DNA, 114 bp, Homo sapiens
  misc_feature (5)..(5): n is a, c, g, or t
cgtantctcagtgggaagaggggcatgggagattaaatttagggattcatcagtctagtagatagctactgaaggccatgtagcctagcaagcagcatcactctagggcaataa

SEQ ID NO: 567919 - DNA, 195 bp, Homo sapiens
agatgagcatcggcatcaagatgcgccacaggcgtggatgggcccagcagaggcatgacaatgacatcgacatcatcaagaaagaaaacgataccttcacacgtcaagtacacgccaccaggggcgggccgcatacaacatcatggtgctgtaagccaaacaggagatccccgccagcccattccacatcaaggt

SEQ ID NO: 567920 - DNA, 170 bp, Homo sapiens
gccagcaccgagatgacgagctttctgctgccacccacaagcagagggactcggagatcacgcagcagaagcagaaaaaggcaaacaagaagaaggaggaacccaagcagctttgcggcttcacgcccaaccctctcgcccttcacctgtgagcctggagccagtcccac

SEQ ID NO: 567921 - DNA, 141 bp, Homo sapiens
caaatgtaaaaatgcagtattgggtcataactgactaaaattaactgtgatactttactactataataattttgatgctacctcgtgctccatttgtggtgggctgaagtgttgtgatcatgtttaaaataccttgtgatg

SEQ ID NO: 567922 - DNA, 864 bp, Homo sapiens
  misc_feature (71)..(71): n is a, c, g, or t
agcggggccgctcgaggccgtgcgtcgcgggggcggggccgcgcaggcgtaccgggtgccccggctctggngcataaacaagagcggggacgggatgaggcggcggttgatcccagggtggcgagtggcggcgaccgaggcggcgagcggggcccggcgccgaccctgagtgcagcctgacccgccctcgcgcgcgcgccctccccggccgggcccactcgccgcgcgcccagccatgaacctggcgagccagagcggggaggccggcgccggccagctgctcttcgccaacttcaaccaggacaacacgtccctagctgttggtagtaagtccggttataaattttttctccctttcttctgtggataagctggaacagatctatgaatgcaccgatacggaagatgtgtgcattgtagagagattgttctccagcagcctagtggccatcgtgagccttaaagcaccaaggaagctaaaggttggccactttaagaagggaacctgagatctgcaactacagctactccaacacgattctggctgtgaagctcaacaggcagaggctgatagtatgcctggaggagtccctgtacatccacaacattcgggacatgaaggtgctgcattacgatcagggagacgcctccaaaccctgcaggcctgtgttgcgctgtcaatcaacaacgacaactgctacttggcgtacccagggagcgcgaccatcggagaggtgcaggtcttcgataccattaatttgagagctgcaaacatgattccagctcacgacagtcctttagcggcactggcctttgacgcaagtggaactaaacttgccacggcttcggacaacggggaccgca

SEQ ID NO: 567923 - DNA, 404 bp, Homo sapiens
tggattactgtagttgcagatctcagttcccttcttaaagtggcaacctttacttccttggtgctttaaggctcacgattctggctgtgaagctcaacaggcagaggctgatagtatgcctggaggagtccctgtacatccacaacattcgggacatgaaggtgctgcattacgatcagggagacgcctccaaaccctgcaggcctgtgttgcgctgtcaatcaacaacgacaactgctacttggcgtacccagggagcgcgaccatcggagaggtgcaggtcttcgataccattaatttgagagctgcaaacatgattccagctcacgacagtcctttagcggcactggcctttgacgcaagtggaactaaacttgccacggcttcggacaacggggaccgca

SEQ ID NO: 567924 - DNA, 851 bp, Homo sapiens
gtacaacccagccccatgacccctaacaggaggcctctcagcccttcctaatgacctccgggctagccatgtgatcacacgttccaggtccataacgctcctcatagtaggcctactaaccaacacactaaccatataccaatgatggagcgatgtagcacgagatggcacagtatccaagggggcaccgacatcaccagctggtccacaaaaggccttcgatacggggataatccatagtttgattacgcatcagaaggttctggtgtctgcgcgaggaattgaatctgagccttttaccgctccagacctaggccgatactcgcccgcaaagtaggagggcactggccccgcaagactaggcattcgatgccacggctaaattctcgcctagtaagtaccacctcctaatacggtcatccgtatgtagcatcagacagtctagtgagatgtcaagtgcaccgtgtagcttcacgcagtagttctacggtagagagagacaacacgaagagcaaagtaattcaccgccactgcttattacacatttctactggggtctcgtatttcagccctcctatcaagtcctcagagtacttcgaagtctcccgtcaccagtttccgaaggcatctacggctcaaccatttgtgtgagccacacggcgtgtcacgggacttcacgtcgagtgatggatgaactgtccttaagtatgtgttcatccgcaactaatatgtagtttatatcaaaccatagttggttcgaggacggcgctgatactggcatttgacgatgtggtgactactcctgtatgtctccgtcaatgatgagggtctgtacgccccaccaaacacaa

SEQ ID NO: 567925 - DNA, 438 bp, Homo sapiens
  misc_feature (1)..(1): n is a, c, g, or t
  misc_feature (165)..(165): n is a, c, g, or t
  misc_feature (255)..(255): n is a, c, g, or t
  misc_feature (267)..(267): n is a, c, g, or t
  misc_feature (303)..(303): n is a, c, g, or t
  misc_feature (313)..(313): n is a, c, g, or t
  misc_feature (315)..(315): n is a, c, g, or t
  misc_feature (317)..(317): n is a, c, g, or t
  misc_feature (321)..(321): n is a, c, g, or t
  misc_feature (323)..(324): n is a, c, g, or t
  misc_feature (329)..(329): n is a, c, g, or t
  misc_feature (331)..(332): n is a, c, g, or t
  misc_feature (358)..(358): n is a, c, g, or t
  misc_feature (367)..(367): n is a, c, g, or t
  misc_feature (370)..(370): n is a, c, g, or t
  misc_feature (377)..(377): n is a, c, g, or t
  misc_feature (424)..(424): n is a, c, g, or t
naacttcttgctcttaatcctcatcttttagttgaagaataaggcttaagagagagaaaggaaaaaccataatggctaaacttagcagcaccaacacggttctttcatcaaaaagtactcatcatttctccaaactgacatgctacagaaatgtcttccaaaaancgttaagttttcacagagtggggactatgatttccatgctcaaatagtgtaggaaatggtagattacgttagttttgtttactgtaacangtaatctcaggngtccttagacactctaatgtgggttgatctccaganggagaaaggnantnaganannatttncnngcttttataaagaaaacactccattnatcataggnacnacaaaanaaaccagtttggagtatgctggtaaatagtgttattggggacagganagtcacgacacaca

SEQ ID NO: 567926 - DNA, 1063 bp, Homo sapiens
tttttgacagagtttcgctctgttgcccaggctggagtgcagtgacaggatcccagctcactgcaacctccaccctctgggcccaagggattctcccgccttagcctcctgagtagctgggactacaggcgtgtaccgctacgcccggctaatttttatatttttagtagagacagggcttcgcatgccggccagctgggtctcgaactcctgacctcaagtgattcatctgcctcagcctcccaaagtgctggaggatcacttgagcccacgagtttaagagcggggacgggatgaggcggcggttgatcccagggtggcgagtggcggcgaccgaggcggcgagcggggcccggcgccgaccctgagtgcagcctgacccgccctcgcgcgcgcgccctccccggccgggcccactcgccgcgcgcccagccatgaacctggcgagccagagcggggaggccggcgccggccagctgctcttcgccaacttcaaccaggacaacacgtccctagctgttggtagtaagtccggttataaattttttctccctttcttctgtggataagctggaacagatctatgaatgcaccgatacggaagatgtgtgcattgtagagagattgttctccagcagcctagtggccatcgtgagccttaaagcaccaaggaagctaaaggttggccactttaagaagggaacctgagatctgcaactacagctactccaacacgattctggctgtgaagctcaacaggcagaggctgatagtatgcctggaggagtccctgtacatccacaacattcgggacatgaaggtgctgcattacgatcagggagacgcctccaaaccctgcaggcctgtgttgcgctgtcaatcaacaacgacaactgctacttggcgtacccagggagcgcgaccatcggagaggtgcaggtcttcgataccattaatttgagagctgcaaacatgattccagctcacgacagtcctttagcggcactggcctttgacgcaagtggaactaaacttgccacggcttcggacaacggggaccgca

SEQ ID NO: 567927 - DNA, 266 bp, Homo sapiens
ctcaatctgtcattccttacgaacatgccccaagccaggaactaagaaaaagctggattttggctgggcgcggtgactcacgcctgtaatcccagcactttgggaggccaaggcagtggatcacctgaggtcaggaattcgagaccaatctggccaacatggtgaaaccccgtctctaccaaaaatacaaaaactagctgggcacggtggcaggcgtctgtaatcccagctagttgggaggctgaggcaggagaatcgcttgaacc

SEQ ID NO: 567928 - DNA, 384 bp, Homo sapiens
caacgatgtgtcctcagctaccctccaggtgaggtagggatgactgcattaagcccagtgaggttgcgtgtgcgtgtagctctgattgtgtcagtgggctccaggctgggttgagaaaactagatcctgactcaaaagtgaaaatttgctactgcgttgaagattaaaatgtcagaggactccctttatcctgcgtccgcgatctgactttcagcttgcatcttccattaggagctacagattagagacaggatactaggaaacatgctagtgagtctgacgatgtttgcctggctgctatcttagctcagcagtgttgacgggtcataggaggttcttgtccccggtgtcatgtgcgttcttggtcagagaaaatccctacag

SEQ ID NO: 567929 - DNA, 1001 bp, Homo sapiens
tttttgacagagtttcgctctgttgcccaggctggagtgcagtgacaggatcccagctcactgcaacctccaccctctgggcccaagggattctcccgccttagcctcctgagtagctgggactacaggcgtgtaccgctacgcccggctaatttttatatttttagtagagacagggcttcgcatgccggccagctgggtctcgaactcctgacctcaagtgattcatctgcctcagcctcccaaagtgctggaggatcacttgagcccacgagtttaagagcggggacgggatgaggcggcggttgatcccagggtggcgagtggcggcgaccgaggcggcgagcggggcccggcgccgaccctgagtgcagcctgacccgccctcgcgcgcgcgccctccccggccgggcccactcgccgcgcgcccagccatgaacctggcgagccagagcggggaggccggcgccggccagctgctcttcgccaacttcaaccaggacaacacctggaacagatctatgaatgcaccgatacggaagatgtgtgcattgtagagagattgttctccagcagcctagtggccatcgtgagccttaaagcaccaaggaagctaaaggttggccactttaagaagggaacctgagatctgcaactacagctactccaacacgattctggctgtgaagctcaacaggcagaggctgatagtatgcctggaggagtccctgtacatccacaacattcgggacatgaaggtgctgcattacgatcagggagacgcctccaaaccctgcaggcctgtgttgcgctgtcaatcaacaacgacaactgctacttggcgtacccagggagcgcgaccatcggagaggtgcaggtcttcgataccattaatttgagagctgcaaacatgattccagctcacgacagtcctttagcggcactggcctttgacgcaagtggaactaaacttgccacggcttcggacaacggggaccgca

SEQ ID NO: 567930 - DNA, 861 bp, Homo sapiens
ccacacgtcgcccacgcgatcgggcgagggtcggggccaccgacgcggcgacctcgggtccggagcgaccgcagggcagccccgggcgccggccccggatgcgcgtctccatgtgcgcgccccatccgcgcgcggacccgtatgctggacatgacgcgaggcaccgctcccagcctagcctgcagccccgtccgtgcaccgccaagctccatgtcagcacgtggacggactccggacatcgcgacgctgccgccgatctcccagacggctcctgagggacctgtggccgccgacgagggagtcagcgcgtcggggggcagcaccggggacgaacccaggcaggagcgccggcggcacgacgcgcgttcccgggccatgacatccgccgacgaccagagatcagcaggtagactacaaaagggctacagacatgcgacgtctgctgaccacatgcacggtgccgcgagcgcgcggcgtgcggcagacgactcgaaagcccaagaccgcatgctgacagcgcgccaatgacacgccattccatcggtagtgaggcagcagagcaggcgccgcccgcacagctgtgccgaaccagtaacgccggacctgcaaccaaggcccgacgctcagccaagacggctgaggccaagctgatggccgcttgcatgagcgagcagcgagcaagcggcccattcgtaggcaggaaggcagaaccgccacaacggacacatgcaagcaacaaggaaaggaagcaccacacgaattacgaaagtaaccaagacacaggcgcaaggaccgaagcgcacaacaagccgggccaacaagcggactcacgactccgggcagcggaagctgcggaccccc

SEQ ID NO: 567931 - DNA, 1118 bp, Homo sapiens
tttttgacagagtttcgctctgttgcccaggctggagtgcagtgacaggatcccagctcactgcaacctccaccctctgggcccaagggattctcccgccttagcctcctgagtagctgggactacaggcgtgtaccgctacgcccggctaatttttatatttttagtagagacagggcttcgcatgccggccagctgggtctcgaactcctgacctcaagtgattcatctgcctcagcctcccaaagtgctggaggatcacttgagcccacgagtttaagagcggggacgggatgaggcggcggttgatcccagggtggcgagtggcggcgaccgaggcggcgagcggggcccggcgccgaccctgagtgcagcctgacccgccctcgcgcgcgcgccctccccggccgggcccactcgccgcgcgcccagccatgaacctggcgagccagagcggggaggccggcgccggccagctgctcttcgccaacttcaaccaggacaacacagaagtgaacggggcatcaacgagcagctggtcttggccgtcgcgctgtcgtctggtccctagctgttggtagtaagtccggttataaattttttctccctttcttctgtggataagctggaacagatctatgaatgcaccgatacggaagatgtgtgcattgtagagagattgttctccagcagcctagtggccatcgtgagccttaaagcaccaaggaagctaaaggttggccactttaagaagggaacctgagatctgcaactacagctactccaacacgattctggctgtgaagctcaacaggcagaggctgatagtatgcctggaggagtccctgtacatccacaacattcgggacatgaaggtgctgcattacgatcagggagacgcctccaaaccctgcaggcctgtgttgcgctgtcaatcaacaacgacaactgctacttggcgtacccagggagcgcgaccatcggagaggtgcaggtcttcgataccattaatttgagagctgcaaacatgattccagctcacgacagtcctttagcggcactggcctttgacgcaagtggaactaaacttgccacggcttcggacaacggggaccgca

SEQ ID NO: 567932 - DNA, 750 bp, Homo sapiens
aagagcacagccatgcaggtcggtcccgtgttatcgtccgtggctcgcgttagcggacgcttctcccgatgctacgtctacacacatggatgggactatggaaatatacatgtgacttttaaacctgaacagtagctgttggtgatagattggtggtcatccaacatgcatgaaatgaatgagcagtgaaaatgcagcattagtccgatgcggtcatgagacatgtaagctgcgtttgaagagcttccacatccctctactcctaggacagaatcattgtacattaaactggaggataagcacgcgaccagatgataccatgaagcagaagtttacaggccctctattgccaactgttaaggtttcctgctgatcttggcactgatcctgaagcgctggcatttgccatccaggaaccatctcccagtggaactctcttcagtgtcctcccttcaggcacttcccccgggaaccatggtgacaggagccccacagctctaccagacatacttctgtggtgatgctgacccccaatcccgatggacccccctcagaggctgcagctcccatggctaacactcgactccccgtgcttgaggggcaccctcctaagcgcaccatctccagccatctgctgcgactagtacctggccccccattctgataagctccctgtccacacgggcccgcgtccagcaggcctggcgacctcgttcctccaagcctgaagggcgcctcgaggggcggttg

SEQ ID NO: 567933 - DNA, 276 bp, Homo sapiens
gtggtaatgagttgaagcacagcatagtggaacctctagggcagagaacaaaagaatttcccagtgtcttcatcatcatgcactgctaacccaagaaacgtccggtcgcataagtgggaattttggcatgaggtgcttagagaaatctttggtcttttccatgcgcaggctcgacagactctcttttaagtgatgtatggcaatgagaatcatctttattctttagaaaagaactttatgttaatggccaatatttttcgtccgccaccgccacta

SEQ ID NO: 567934 - DNA, 308 bp, Homo sapiens
cacgctcacactgaatatttgctttaatgaaccgaccagcccctgaggagatcttctatgagaacatgcgtttaatgataccgacaactttaccaatgctactctcaacacgttcacagaggaacttaagaagtatggagtgacgactttggatcaattttgtgaggctacgtgggaggaagctccattggaaaaagaaggaatccacgttctagatcggccattggatgatggagctcctcccaataatcagatactacatgattggttaaacctgttaaaaccaaatttcttgagagagggaagat

SEQ ID NO: 567935 - DNA, 251 bp, Homo sapiens
gcgtggtcgcggcgaggtaccatctatgtatttgcattgaaaagttggttatttattccagtcttctttgtctggcttgctttggttcttattggatatgtctccttaggcagtctttatactttattagattattctctttttgtcccccaggttgctgcctccttttcaacactaaatgacaccttctgcccaggtttgcctcaattctagtaagcaatcaccacccatcccatatgggagagatccca

SEQ ID NO: 567936 - DNA, 341 bp, Homo sapiens
cacgaggcgcaccatgggaacacgcttgacctcagttctgcaaacctgctgatgcttcacaggtcgcatcgcaaccaccgtcttggacatctatcatgtgatgatcatcgtcttgttattcatctggcacccggtaaaggtggcccacagaatggcgtcatgcaagatcgcccagatgggccacatcacgatcggtgaccggatctccagcttccggctcatcacgatgctcttcatcatcatccctaacgctactggttagagttttcaaaaaacgggagaactagaagccgcccttcatgtccctgcaaatcattgactatttcctgtgcctgtccacc

SEQ ID NO: 567937 - DNA, 317 bp, Homo sapiens
ttacaggcgtgagccacggtgccagaccctaaattaagactgattgggttgagcaccgtggctcacgcctgtaatcctagcactttgggaggccaaggcaggtggattgcctgagctcaggagttcgatactagcctgggcaacagagcaaaaccccggctctactaaaaatacaaaaattagctgggtgtggtggcaggcacctgtcatcccagctactcgggaggctgaaagcaggagaatcgcttgaacccgggaggcgaggttgcagtgagccgagattgtgccactgcactccaccctggtgggtaccgagc

SEQ ID NO: 567938 - DNA, 322 bp, Homo sapiens
gcgtatcgcctttaccgctgacaacttatctgcacggcgcgggctattggttgaatgagtagcgctgatggtttcgataaagaactagttaatggggataaagggtgtaggcctatacccctatacacttactgcacggccaccctagcgcaactgcaccctaattggagcgcccccctagccaaatccacccttaaccttccctttacaattatcattttcaccaatttaattttactggctatccttggaattctgtcgcctttatcccagcctacttttcacaattttagtaagcctttacccgcccgcccaacacata

SEQ ID NO: 567939 - DNA, 321 bp, Homo sapiens
  misc_feature (197)..(197): n is a, c, g, or t
  misc_feature (228)..(228): n is a, c, g, or t
  misc_feature (252)..(252): n is a, c, g, or t
  misc_feature (310)..(310): n is a, c, g, or t
atggcaggcgagtctacatctccattatataataggatctggtatttctaaagcaggatggggtaaaaatgaggggtgtggaacaagcccagtccccagcccttccctagttcaaggacctacccctcagtgaaattcaaggtggccaatgctagaataacacgaaaccaggagaattttcatagattttctaacgnacttactagcatgtccagatattctactaanatgttttatcctgtgaagggtagnatatcatatatatatccccacttttacgagctggagaaccgtgaggctccatatttanagaaatttgcc

SEQ ID NO: 567940 - DNA, 255 bp, Homo sapiens
gggtcggtaccggacgagcgcccaagtccctagactgatgaaagcactaaatagtagaaagaaatagatttggccggtggctcaggctgggcgcggtggctcatgcctgtaatcccagcactttgggaggccgaggtgggaggatcatttgaggccagaagttcaagaccagcctcgccaacatggtgaaacctcacctctactaaaaatacaaaaattagccaggtgtggtggcaggcgcctgtagtcccagct

SEQ ID NO: 567941 - DNA, 136 bp, Homo sapiens
aaagtgggtgtgggtgagtcgggctgcgtggaggttgtgatagctcacaaaggtgatgtggtagtaggaggtgcaggcatagtgtcctttgagcttgcgcagctctggaaggtggtagattctccctgacgtgttg

SEQ ID NO: 567942 - DNA, 604 bp, Homo sapiens
acatttatgctcgctcccttggtggaatgcctccccttaaggcccccagggcgaaggtcccgaagcccagtaatccctggtgtcgatattgtcatgtaccctcccccgcagggaaccagtttccccaaagaagcctcccagaagttcctcaaagatttcatggaatccatccaaggggaacttgaagaaccgaggcccgaaagagttaacccttttttggcagggggtgcagaaccaatcaagcccctccttgcttatttccaaaactccccgtttttttttggggaaaacctgaatcccaatggcatgggtgcttttttgggcccccgtgaggatggggtgcccccctatatgattttctttaaggatgggttaaaaatgggaaaatgtttcccaaaggggccaatttttttgggtctttcccccgtcctcataactgggttttgcttgtcctcccccccccccccgggctttagaccaatggggctgatgtccttttgggcttttccttttttttggctgtgatttttttggggggggggccttgtttttaaaaaaaacctgtcctgtgggttgttttaaaataaaatgccttttaacccca

SEQ ID NO: 567943 - DNA, 112 bp, Homo sapiens
tcatacagctcctatgaaaaaacttctaccactcaccctagcattacttatattagtatgtctccagtacccattacaagtctccagcattcccccttgggcccttatcgag

SEQ ID NO: 567944 - DNA, 216 bp, Homo sapiens
aagaggtgatgattacggagttatatgtggtgttaccgtccctagatggttaatgagcgagtctcacagtgagacactacctcccaactcccatcccactgcatcccagtcttgccaccagatgagcctttctaaaacactgctgttttctcagagctcttcatttcaaaaccctcagctgattccctaaagcaaagaccccaaatacatcacagt

SEQ ID NO: 567945 - DNA, 357 bp, Homo sapiens
  misc_feature (87)..(87): n is a, c, g, or t
gggaacccatggaaaccgagtccggcgacacaagtttcgagggcccggcccaggtttacctgcccggccgggggccgccgctacccnaaggggaggagctggtcatggacaaggaggcctatgtgctttaccaccgagcgcagactggcgccccctgtttcagctttgacatagtccgggatcacctgggagacaaccggacaaagcttccttttacactttacttgtgtgctgggacccaggctgagagggcccaaagcaacagactgatgatgctttggatgcacaatttgcatgggacaaagcccccaccctcaaagggcagtaataaagggccaggaagaggaaaaaaaaaaa

SEQ ID NO: 567946 - DNA, 375 bp, Homo sapiens
  misc_feature (375)..(375): n is a, c, g, or t
gatttgatacgtttgtcaaagctgctgtgatgacttaatgccaggcttctccttggctgtgagtgtggcatgaagggctggcagcagtggttctcctggatgctagcacagtgggacgaaatgctgagtgctgtcttcttccttcagagtgtgaagaacctaaggagaccagcactgctgagtgtgggcctgacgcgagctgaactagcctggtatttgattctattatgtacatagtttttcattctgaacttggaggtgcttttcagaagatattaactatttgtaaattgtgttttaattaagctttgggacagttccttttaatgttccaaagattggccttgtattaggaaataaagctgaacctggggn

SEQ ID NO: 567947 - DNA, 231 bp, Homo sapiens
ctgaactcaaaattatagaaagctacctaagtaaaaaggaactgacttttatacaaaacaacctggatgatctcgctcgagggcgttgtgctgaatgaaaggagccagtctcaaaagactgcatgttgtaggactgggctggaaaaagccgagccgcagagttgagcagacatgtgcagctgccgggaggtccctgtgtggctgggtgaatggaaagggggaccatggagg

SEQ ID NO: 567948 - DNA, 118 bp, Homo sapiens
tgtgggcgaggactttgatcgcacattgttgttttttttaatagtcattccaaatatgagatgcattgttacaggaagtcccttgccatcctaaaagccaccccaccccaccagatcg

SEQ ID NO: 567949 - DNA, 331 bp, Homo sapiens
ggtacctggatccatcatcgccaatgtaccaggtccaagcaccataatcccccatcgggattatttgaataaatgagccatagcttgttgcttccaccgaaaatttctaaacgattatagccagggctagatcctttttcgtgctgaagactcttcagtagtcaaaggtctcccaatcccttataaagaccaacgggatgtgtcttcctgttaccctgctgatatcatctcgtttctaagtcttttcttcattctgttgaagtcacagctctacttattccagagaacatgctttggatgttatcacctcagaacatttatacgttaacta

SEQ ID NO: 567950 - DNA, 274 bp, Homo sapiens
gggctacacagttactagccaatatttatctcatgcctttcctcgctcatggttcgatatactggtgtcctaggcagtagaggaaccacaccaatccatcccgaattaggtggttaaactctactgcggtgcacgatcctgtaggggaggtcctgcggctgaaatagctcgatgccgagaatgataaaaagcttaacacctcttcatttgcacttttacactattttgaacataagcaaaaagatccaaatctaaaatgcatagaaaatatctg

SEQ ID NO: 567951 - DNA, 209 bp, Homo sapiens
cgggtgacgctagaggccccagttgagtgctgctaaaaaagtggcctcctgagcactgcaggtccacccacagggcagggcggtgcacctttaacctgggcctggacacagctgacacccacacatcccgagcttggacacgcacactagggagctggtggatgggcctcggcctcctgagtgctcaccaccctctctccccacagtat

SEQ ID NO: 567952 - DNA, 650 bp, Homo sapiens
  misc_feature (449)..(449): n is a, c, g, or t
  misc_feature (456)..(456): n is a, c, g, or t
ctctctccacactggactaagaatgacgtacttatagccaactactttccccctaatgtgactgaagggattcataatgatcacaattagcattacggttaagtattttagggttgacgtctaagctcacacttgaaaggtatttatctaatggccactggctcaccagcttcccaccctagcattcattgctagcttaccaatcttaaggctaataattttatcgcacattcaacttcaaaacacaccagtgtttaccattaccactaatcactgaatgccatgaagccatggcactgaaccaggagctttcaccttttatgtgaatttaaaatggtactgtggaggctgaggccattttcttcaggctaacccagattttctaaagcccaacttaaaaagtctacacctgccaaacttgttaaacgcagccacttgaaaataaccancagagcnttgccatcactccgataagctgcaggtttcatcacatgcaccagacaaatctacagggctagtttcagttctctcctgttctagagaatttaatcaagccgtgttataccacccagtatgttttatacactgacagtacgactcccgtaatatagactcaagcgaagactataaagtattatcgttattagacc

SEQ ID NO: 567953 - DNA, 221 bp, Homo sapiens
acagtgaagtgtatggcataatactgtagattatattgttaagtttttctgcttttatttaaaaaacaaaacaaaacaaaaaaaaacaggctgggcgcggtggctcacgccgtgtaatcccagcacttggggaggccgaggcaggcggatcacaaggtcaggagatcgagaccatcctagctaacactgtgaaaccccgtctctaatcattctatggttgt

SEQ ID NO: 567954 - DNA, 226 bp, Homo sapiens
ttagctttagtaagcggttggagcaattcacttccttaatggggtaggtcccaaagagggtattctggccgtgtgggagggctggctaggggtttgtgcccaagagatctgtggaatgaacctcctacagcatgctgctgctgaacagccacactgagtttaaacaagatctacatgtagggcttagaggataaagctcttatatatcttttttttttttttatta

SEQ ID NO: 567955 - DNA, 168 bp, Homo sapiens
ctgctcccaaaacctaagctttacatcatgacttagcactaagatattccttatctcagaacatacaatgtcaggttaaaaaaggtggcacctcttgtgatttcctgttgctactttagcaaatcatcacaaattgctgtataaaagaacacaaatcaagatgtcatc

SEQ ID NO: 567956 - DNA, 405 bp, Homo sapiens
  misc_feature (268)..(268): n is a, c, g, or t
  misc_feature (277)..(278): n is a, c, g, or t
ctctttgacaagaaaatgatagaaagggaaaacagacgaggttaaagcacatgcgtttgtctgaataacaatctctcctgctgttctgcacgttctttgcgtataatgtatgaattacacatagtggtgggtttcacaaaggcatttacataccagtacatcacgtcctatggccgtctttccacacatgtgcatcatatacaccgattctttacaggcatgcatgccatatacactgactacatttgcacacacataccttcccctntctctcccnncaccctcctgcaggtctcttttattcacctgggcagttttgtttctattttaatggtttgtacacatgaatgattttattgcacattattattcttacatggattaaaaagaaaactactttaatat

SEQ ID NO: 567957 - DNA, 581 bp, Homo sapiens
  misc_feature (537)..(537): n is a, c, g, or t
caattctcaagatgtcatacattcttagatctctaaggaacaatcaatacaagatacaagattgatggaatacatcgtcatggcagggaccaaaccaaataaaaatgctcaatggcacatcattcgctaacttcaaagaataatgtaaaagcccatgtaaaggcagcaacaattaccatatgcagagcagctgtcactaagcccaaactactggcttcccaacttaccatcttccttttcctttctgcaatctgctcctctgattccatttctacttcattactaataggagttttttcttctatatcatcaataaaatctggttcctgattatttgatactgatagtctcagtggagaaagctttcttggtttagtttctgggctcttcatttagttggtcgttccttcacaatccaaagtaatattctgattttgtgtatctttttcttttgaaatatctttgtctttttatttccttttttccgtctggtctcataaccactatggatattttccatggattcagaactacgtnttagaacagggcaactgggttaagtaagcggggacctctagagt

SEQ ID NO: 567958 - DNA, 136 bp, Homo sapiens
acacaatgcatcagctcaaccacaggcagcagtatataccccccaacagcacatcactcaccagtctcagcggttcagaacccttgcaccagtgccacctcactcagtctcagcacctcgtggcacctttcagcac

SEQ ID NO: 567959 - DNA, 103 bp, Homo sapiens
agcttgcgtgagactacgcgatggacgcacatatgtgatgtcatctccacctcagcacgacgggcgcctggttgttcgtaaacatgccccacgtggtgccttg

SEQ ID NO: 567960 - DNA, 170 bp, Homo sapiens
cacgaggttgctatccgcggttcctcccactctaagggtaatcggattcagatgcatcttgtcataaattaccgccagttttaactggcagtgctttcatttgtaaaacaagtgttgtcatcttataccacaggtgagtggatccttaggaaagcctgtaaaatttacaa

SEQ ID NO: 567961 - DNA, 256 bp, Homo sapiens
gttctagcctgccagtgggcgtgttagctttttcctgcaatggatggtccactcacgttcgctgtcaccctctggaatcacgtatacaaaaatccaaatattagttgggcatagtggcaagcacctgtagtctcagccacgtgggaggttgagatgggaggatcgcttcagcctggaaggttgaggctgcagtcagctgtgatagcactactacactccagccttggacaacagagggagaccctgtagtcccatt

SEQ ID NO: 567962 - DNA, 467 bp, Homo sapiens
  misc_feature (43)..(43): n is a, c, g, or t
  misc_feature (51)..(51): n is a, c, g, or t
  misc_feature (59)..(59): n is a, c, g, or t
  misc_feature (113)..(113): n is a, c, g, or t
  misc_feature (135)..(135): n is a, c, g, or t
  misc_feature (143)..(143): n is a, c, g, or t
  misc_feature (156)..(156): n is a, c, g, or t
agctcccctggtgacccaaactggtcccttcattagtgacgtnatttcaanttttccanatcagtttagagagttcggcatgcttacaggcagttatgttctaggtgtagccntttttctgggtgtcggagcagncccccccnttttttccccttnaagccggcaacatggcccggttgcccttgcgatcaaagagaagagggctgggcgctccatgatttagcctgaggctcttcaaacatccattctgcttccacgcatggcttctgccattggttctcttcccccagcaccctgaaacgacagaaacaagcaatccgattccagaaaattcggaggcaaatggaggcgcctggtgccccgcccaggaccctgacgtgggaagccatggagcagatacggtatttacatgaggaatttccagagtcctggtcagttcccaggttggctgaaggctttgatgtcca

SEQ ID NO: 567963 - DNA, 343 bp, Homo sapiens
  misc_feature (11)..(11): n is a, c, g, or t
  misc_feature (41)..(41): n is a, c, g, or t
  misc_feature (243)..(243): n is a, c, g, or t
  misc_feature (270)..(270): n is a, c, g, or t
  misc_feature (316)..(316): n is a, c, g, or t
cagagtctcgnctctgttgcccaggctggagtgcagtggcngttcccggctcactgcaacttccgcctcccaggttcaagcgatcctcccgcctcagccccgctagtagctgggattacaggtatgtgccaccatgcccggctaatttttgtattttcagtagagttggggtttcaccatgttgggccaggctggtctctaactcctgacccgcctcggcctctcaaagtagtccagtacttntactactactcctaatagaccaagganagttatttattagtacttattcatctatcctctgcctgggtcccanatatgggccagcagtagctatttattt

SEQ ID NO: 567964 - DNA, 378 bp, Homo sapiens
  misc_feature (13)..(13): n is a, c, g, or t
  misc_feature (42)..(42): n is a, c, g, or t
  misc_feature (76)..(76): n is a, c, g, or t
  misc_feature (98)..(98): n is a, c, g, or t
  misc_feature (178)..(178): n is a, c, g, or t
  misc_feature (285)..(285): n is a, c, g, or t
  misc_feature (309)..(309): n is a, c, g, or t
  misc_feature (324)..(324): n is a, c, g, or t
  misc_feature (338)..(338): n is a, c, g, or t
  misc_feature (355)..(355): n is a, c, g, or t
caagatctcacancccgtcaactcatcttgaagtacgtcaancctctaagcgggagagtcccctttaatcatgagntctcgggagcctatctctgtgnactgtctcccgtctcaggacagacaagttcaagacagatttttatgatcaatcaacgacgtgggctcatgcctacctcgnaccatcaccaaaacgtcaacaccataaccagtttgtaacaagttaatgctctcgaccgacaagcatcgcaggaaatcgcggctctttttctatgagggtcttaaggnttatggcaggggtaggaactatcnaaagggagggactanacttccttgagagnaaccgctgtcattaatnaaagggagcagccctgagcacaa

SEQ ID NO: 567965 - DNA, 455 bp, Homo sapiens
  misc_feature (291)..(291): n is a, c, g, or t
tgcactgtagaatctggaacagacacctgaacgttctttaggtgacttttagggatgttttagctcccctgccacctggggcccacagggagacacccagggacgagatctctctgagccttgaagacatttgcagcccagccctccctgctccttcctgcttgtctaaaacttcgcaattctgtgagatcatagacaaattgcatctcttctgtgaaggctgctctcaccttactaaacccccccccaaattaaaaataaaaacccccccaaaaaaaaaaattttttttnaattccccttccccttttttttaacttttctcaattcaaataacgttattgtcggtaccactcatttggcccttagtaaatgctgtcaatttttattgattgattgatcgagattgcaccactacactccagtctggcgacagagtgagactcgatctcaaaaa

SEQ ID NO: 567966 - DNA, 245 bp, Homo sapiens
taattatttcatggtgataatatgtccagttaaaaaatttggattcaaaatatgtcttcctatggggagttgccatgtgatgcaagttaaataagtggataatgttgggtggagagtcccctaaagctcattcaaaggaataaagacttatagttagttatacagttctgtacccctaaaaaaattgtcaaaggtagatattattttatgtattttggccataataaaaaaggaacaaaaactga

SEQ ID NO: 567967 - DNA, 360 bp, Homo sapiens
ccagttgagacgccggacgcaaatcccgccacgatcaggagtaaaagctcgaccatttttggcatccccatagcttgtacgccgcaagtggcctaaaaggcattggtctgcaaattggtctgcaaggaatggtgcatcatgcgggtagcggctgtcgacagtgcattgaaggagctgctcgagcggtgcgctccggacatcggtgatcgcctcccagctgaacgggacatcgcagctcagatggggtgtagccgtcagaccatacgcattgcatttaccaagatggagcatgcaggcctgatctggcgtcatgtcgggaagggtacgtttcgcgggcctgcgccccttgatgttccttta

SEQ ID NO: 567968 - DNA, 393 bp, Homo sapiens
tccactagtgtaggccattcccagaatccagcctgggtgagaagagcgagactccatctcaaaaaaaagaaaaaaagagagagagaaattagaattcttcttcctcagggcaagttatagaaaccagctatattactctaaccttcccctgccttctgtgtaggagctggccttaagaaattctctgacctacctttctgatagtaggtcataagaccctccttctagagggcttctgtcctataccaggaggaagaagtgctgcatagagaggccaaaaagaatctgaacagacaggccttgctgggttaactctgtctcccccagtctattaccattagatcatacccatttttccaatcacatttccacatggccgcctacactagtgga

SEQ ID NO: 567969 - DNA, 479 bp, Homo sapiens
  misc_feature (379)..(379): n is a, c, g, or t
  misc_feature (388)..(388): n is a, c, g, or t
ctttctttccttctttctcctactctttccttctctctctttctgagacagggtcttgttctgtcacccaggttggagtgcaatggcacaatcatggctcattgcagcctcaatctcctgggctcaaaggatcttccctcctcagcctccttagtagcagggactactggtgcgcaaccccacaactggctaattattgtatttttttggtaggatctccctatattgccaaggttggtcttgaactcctggactcaagtgatcctcccaccttggcctcccaaagtgctgggattacaggtgtgagccactgtgccgggcccacattcttattactaattaacaatttctcttcttctgtgaattgggctgggcattntcacaatgnccatgaatttactttttaaacagttaccttttaccacagaaagaaggtgttggataatggcagtcagaatagctgggatgatggtttttgt

SEQ ID NO: 567970 - DNA, 176 bp, Homo sapiens
agacaggatatggggtaggcaggctcatacactgcaactttgttaacatgagacatcaggcatcacattaacctcccctcctctcttcagaaccctacgttcataaacactgttatatgaaaaagttgccggatttccagctgagcgccggtcgtaccataaccagttggtctggt

SEQ ID NO: 567971 - DNA, 318 bp, Homo sapiens
ctctggagtcgtcgtcgaacctccgacttctgcgttctagattaatggaatacaccagtgcttgggataggctttgggtctaggattaaaaatgccctagcgcaattcttagcataaggcacacctagatcccgttatccccatatcgtagtgatgtagtcgaaaccatcaggctactcattcaagcaatagcgcgggacgtacgccgtaatcgctaagattactgcaggccagctactcatgcacgtaatgggaagcgccgacctagcagatatcaacattaaccttccctcttacatttatcatcttcagaattct

SEQ ID NO: 567972 - DNA, 408 bp, Homo sapiens
agtcggtcgcccttgttttctccacttagtaagtagttgctgttacactactaatctactagctacctgccatgtgttgcttacaatgttttatcctagtagtacaaattcaattcacaatggccagagaattaaaatggctaaggtacttgagagactacttgccactcttaattcagagactgttgtctcactttgaacgtttgtttcaatatccctagttattccttttttttgttacctaaaagtagggactatttataagaactttcatttggcctgcttcggtgtaatattttgacggggagcaatactgaggcacttatttacagaactatcataatgagacttatcagtcagtgagagccctaaattccactcgattcatcaagctccaatggtccctac

SEQ ID NO: 567973 - DNA, 125 bp, Homo sapiens
  misc_feature (47)..(47): n is a, c, g, or t
gaaggcgcacgatggcgcgtccgggtacggatctccagggtcccctngatgacagagtaggccaggacagcactgtggtgactggcagcacccgcttgatgctggacttactctccaggtgacca

SEQ ID NO: 567974 - DNA, 162 bp, Homo sapiens
attataaataatgctaagaattggaaggcgacaatggcttgtcctgatccttgacagcagagctcgaacaaccaatctgtctgtctcttcttcgccaggctcactgtgagttcacagttgtcctccatccctttactttcataatgtccatctttggctttt

SEQ ID NO: 567975 - DNA, 873 bp, Homo sapiens
  misc_feature (10)..(10): n is a, c, g, or t
  misc_feature (26)..(26): n is a, c, g, or t
  misc_feature (30)..(30): n is a, c, g, or t
  misc_feature (69)..(69): n is a, c, g, or t
  misc_feature (89)..(89): n is a, c, g, or t
  misc_feature (94)..(94): n is a, c, g, or t
  misc_feature (102)..(102): n is a, c, g, or t
  misc_feature (104)..(104): n is a, c, g, or t
  misc_feature (109)..(109): n is a, c, g, or t
  misc_feature (115)..(115): n is a, c, g, or t
  misc_feature (117)..(117): n is a, c, g, or t
  misc_feature (127)..(127): n is a, c, g, or t
  misc_feature (133)..(135): n is a, c, g, or t
  misc_feature (142)..(142): n is a, c, g, or t
  misc_feature (164)..(164): n is a, c, g, or t
  misc_feature (196)..(196): n is a, c, g, or t
  misc_feature (199)..(199): n is a, c, g, or t
  misc_feature (220)..(220): n is a, c, g, or t
  misc_feature (222)..(222): n is a, c, g, or t
  misc_feature (224)..(224): n is a, c, g, or t
  misc_feature (226)..(226): n is a, c, g, or t
  misc_feature (228)..(228): n is a, c, g, or t
  misc_feature (237)..(237): n is a, c, g, or t
  misc_feature (244)..(244): n is a, c, g, or t
  misc_feature (253)..(253): n is a, c, g, or t
  misc_feature (262)..(262): n is a, c, g, or t
  misc_feature (274)..(274): n is a, c, g, or t
  misc_feature (277)..(277): n is a, c, g, or t
  misc_feature (281)..(281): n is a, c, g, or t
  misc_feature (286)..(286): n is a, c, g, or t
  misc_feature (288)..(288): n is a, c, g, or t
  misc_feature (290)..(290): n is a, c, g, or t
  misc_feature (303)..(303): n is a, c, g, or t
  misc_feature (306)..(306): n is a, c, g, or t
  misc_feature (312)..(312): n is a, c, g, or t
  misc_feature (315)..(315): n is a, c, g, or t
  misc_feature (327)..(327): n is a, c, g, or t
  misc_feature (329)..(329): n is a, c, g, or t
  misc_feature (333)..(333): n is a, c, g, or t
  misc_feature (348)..(348): n is a, c, g, or t
  misc_feature (351)..(352): n is a, c, g, or t
  misc_feature (359)..(359): n is a, c, g, or t
  misc_feature (361)..(361): n is a, c, g, or t
  misc_feature (369)..(369): n is a, c, g, or t
  misc_feature (373)..(373): n is a, c, g, or t
  misc_feature (376)..(376): n is a, c, g, or t
  misc_feature (382)..(382): n is a, c, g, or t
  misc_feature (384)..(384): n is a, c, g, or t
  misc_feature (386)..(387): n is a, c, g, or t
  misc_feature (397)..(397): n is a, c, g, or t
  misc_feature (406)..(406): n is a, c, g, or t
  misc_feature (410)..(410): n is a, c, g, or t
  misc_feature (419)..(419): n is a, c, g, or t
  misc_feature (421)..(421): n is a, c, g, or t
  misc_feature (434)..(434): n is a, c, g, or t
  misc_feature (439)..(439): n is a, c, g, or t
  misc_feature (465)..(465): n is a, c, g, or t
  misc_feature (480)..(480): n is a, c, g, or t
  misc_feature (528)..(528): n is a, c, g, or t
  misc_feature (557)..(557): n is a, c, g, or t
  misc_feature (559)..(559): n is a, c, g, or t
  misc_feature (858)..(858): n is a, c, g, or t
gaggcgggcnccgccgcgatgctgcnaggnggacggcgcgggcagcttggctggcacagctgggctgcngggccgggcagcctgctggnttggntgatactngnatctnctggcncngcaccctgcnccgatnnntgctgcncccactgctcctcgggactgcnatgcacccgggatggggccctggatagcttcnacnacctgctcggcgcagagaacntnantnanctctacatngagaacnagcagcatnttcagcatnttgagctccgtnatnttangggcntngnggagctgagaaanctnaccatngtnaagagtggtctncntttngtggcgccagatgcnttnnattttantnctcggctnattngcntgaatntntnntttaacgctntggagtttntttnctggaaaantnttcagggcctctncttanaggaactggtcctgttggggaacctntgcactgttcttgtnccctgcgctggctacagcgtgggaggaggagggactgggcggagtgcntgaacagaagctgcagtgtcatgggcaangnctcctggccacatgctcaatgccagctgtggtgtgcccacgctgaaggtccaggtgcccaatgcctcggtggatgtgggggacgacgtgctgctgcggtgccaggtggaggggcggggcctggagcaggccggctggatcctcacagagctggagcagtcagccacggtgatgaaatctggggggtctgccatccctggggctgaccctggccaatgtcaccagtgacctcaacaggaagaacgtgacgtgctgggcagagaacgatgtgggccgggcagaggtctctgttcaggtcanctctccttcccggca

SEQ ID NO: 567976 - DNA, 342 bp, Homo sapiens
ggtttttcttttcccccccatcctttgggggttggggccttcccaaaaggcttttgtttttttgattcctttgggggggaagcagcccaatttccccccgggccccccagttgtgggggggcggggtttttttttaaaacatccccctttccccccggggtcctcccccttcccagggggccaatttttacccgcaatggggattttggggttgtttgttttgtttggggtataaaggggaggttgggggggtgccccccccctgggcgggggggttcttttcccttttccccgggtcgggggtttttttggggggggggccggtgggggccctttgtttta

SEQ ID NO: 567977 - DNA, 1010 bp, Homo sapiens
tcgcctgctgggatgctcgacgccctccccgccttcccccccgaataggcgcccttgtggagccacccctttgctgggcgttcgtcacttgttctcgtcaggattgatccgacgacacccagcggggggttcttccccgcccttcaggccgccccctgcctggggggtggtgattgactgtgccccgcaccttcatccgtgcgacaggtgcgcgcagtttttgctgggcgaccgcgcgggtctgttcctttttgtggtgagcacacacagagaggtggtttggcgagtccgccacgctctcctctcttgatcaagaggaggagcgattctggggtggtttggtctttctccccccgcaccccgcatattgctgcacgaacgatcgggctggttctttcatgggactcgccgcgagcgcaactcgtgcttgtttttgattagcctcgctctgtcttctccgctccatccatctcgctttcctctctttcagaagcccacccaattgttcgccacgcggctcgtgtttgaaccacattgttcctctcgcggtccgcacatagttgtgttttgtcccgctccttccttgctccctccggccgctctcccgcgccgtgtgtcccttcttctcggtgccccctcgggaacacacgagttacttctgtctccggccccgcacggatcgtgtgagggagccggtgggtgggctctgtctggtccgcccgtccgctcccgctccaccgcacgccgcgctcggagatctgtcttcctcacccgagacgcacccccggccttcgggcggtgggtggagaagagcgcggccgcgcgtcatattgtcttctctcgccgtcggccccccgcggtcggggtgtgagaggagtttctcttccttctctgcgctgtttttgcgggagggggtggaaaaggggggggtttccccccccctgggggggccaaaagggccccaaaaaagggggacccccgtgtgaaaaaacccaccctttttattatta

SEQ ID NO: 567978 - DNA, 225 bp, Homo sapiens
gctatacacctgtgaagagagaaagatacgttgttcttctgttttgaccgtttatgaaccgatatatgtttctggtgaaattatgtgtataaacaggtgaacacattgtatacgattatacatatatgtgcatacaacgtatatacaagatttacggaacagcatgtgcatggctgtgtgctgtgtgtgctgtgctgtgctgctgactaccaacccacactggac

SEQ ID NO: 567979 - DNA, 424 bp, Homo sapiens
tggcacacatctgggcaggctccatctcgtgtgctgctggaacccactagaaaccaaatgagccctgcagcaggcctaatcactctgatgtgagatggacctactaactggaagagttatgcctcatattattccaacactaaagagagtggggagaccacttttacctgaagatgaaagggtgctttgcgagattctttgactagcagatggattgttagagtgactttgtgcaggggacttggtcgcttgagtaccgttggaaccaacgaatgggaatattgaccaggagcagggagagggtgcttaggtttggcgtggggtggggttttataggttgtaagagaagggttggcggagagccgcgatggtggtgttagtgtatgtgcgctttggtgtctagaggcagcatagtattacgcat

SEQ ID NO: 567980 - DNA, 475 bp, Homo sapiens
gagatggcgccactgcagtccggcgtgggtgaaagagcgagactccgtctcaaaaaaataaaaatccaaatacaaaaaaaaaaacacaaaaaaccatagctgggattacgggcatgtgtcaccacacccagctcatttttgtatttttagtaaagactgggtttcaccattttggccaggctggtttcaaactcctgacctaaggcgatccaccagcctcagcctcccaaaatgctgggattacaggcatgagccactgcacccggcctgaatttatttttttaagagatagggtcttgctctctggcccaggtgggagtgtagtggcatgatcatggctcactgcaatctcaacctcctgggctcaagcgatcctcctgcctcagcctcttgagtagctgacgctacaggcatgcactaccacacctggctaatttagtctttctatgaaacctaaaaagaatgattggtaaca

SEQ ID NO: 567981 - DNA, 101 bp, Homo sapiens
  misc_feature (30)..(30): n is a, c, g, or t
tcaggtctaaagtgtttaattatcacagcnatatttcacaggaaaaggaatgtagcaaatgggtcaaggtggtataaaaaaaaaatccaggtttgtacatg

SEQ ID NO: 567982 - DNA, 357 bp, Homo sapiens
tgcagataggcacatgatgtttctgatgaacacttccccctgcccttttttttttttccaaagggagcctcgctttgtcacccaggcgggagtgcaggggcacaatctcggttcatggcaacctcggccccccagtttcaagcgattctctggtctcagcctccggagtagctagaataacgggtgcacgccaccgggcggggttaatttgggtattttaagtagagatggggtgtttacaccatggtgggtcagggcgggtctcaaactcttgacttcgtgatctggcttggcttacagcttcccaaagtgtgggaatcacgggctgtgagccacaatgctgtggcacttcaggaa

SEQ ID NO: 567983 - DNA, 298 bp, Homo sapiens
  misc_feature (159)..(159): n is a, c, g, or t
  misc_feature (205)..(206): n is a, c, g, or t
cgtcgacgggaagtataatgacagtagatggtagaccagggtaatataatgacagtagatggtagaccagagtaatataatgacagtagattgtagaccagggtaatataatgacagtagatggtagaccagggtaatatagggacagtagaaggtagnccaggttaatagattgacagtagatggtagaccagggaagtataannacagtagatggtagaccagggtaatataatgacagtagagaccagggtgatataatgacagtagagggtaggtcgacgcggccgcgaattta

SEQ ID NO: 567984 - DNA, 297 bp, Homo sapiens
  misc_feature (6)..(6): n is a, c, g, or t
cgacanctcttgagctatgctgcttagatgtacattccaccagatacatactaaatcatcacccccaagttcatagattcacagatctccagtgacaaggtcacatgtgcagacctctgattgggcaaatcaacatgtagctattggctccatattcacacggaaattacgtgatttttactccgacgaacttataagatctggcacttcacatgaccatcgcttctgtacagccttttgatcacacagtatataacaagatctctacacggggtccacagcattatgctcatcatt

SEQ ID NO: 567985 - DNA, 120 bp, Homo sapiens
atcaccttccggataaggcaggagagtcacggagcgcggacggacgcttcaagcacgggcctctctgggcgaaccattcaggcgcctgccttaaaagaaagagaatctcccgggtgcgta

SEQ ID NO: 567986 - DNA, 202 bp, Homo sapiens
gcgtcgactctcaaaaaaaaaagtaaataagtaaataagttaacatcaacattaagccatgaggatggtgtgcacccttcctacgatgggatgagaagggcactttacctctgtggtcataagaaaaatatcagacaaattcaactgaggggcattctacagaatacctgattagtattcctcaaaactgtcaaggtcattt

SEQ ID NO: 567987 - DNA, 1120 bp, Homo sapiens
gcaataagagcgagactccatctaaaaaaaaaaaaaaaaaaaaatccctattttggtgtcacagggggtttaggacacttgctgaaaatgggccctgttgcccagaaaggcctgctgtgggcccagaaactggccagagattgcgatagggaaatttatcttatcccaaattctagtatggggcccatttgcccctatacaaaccatgtcttcaagggtgagcctttgggcaatcataaagactgatgtctgggatttcctaccgtgtttatcctgtggggacataatggaccatattggggtccagaatcctagacaaaagaaacagggcgttctcacagtttggggtgcccgtcaaaattctagcaatccagtattacttgtgacccagaaattgggtctgcgaacattcaggggggcacatggtggagaccaaaattaaccaggggactccgtggcgtggggccagggtactagtggcacttgaggacctggggaattcaagaaggccaggttggcgcatttttaaaccccttgagaaattcctccgagaagaatatattccggggggtaaatacaagaactccacgtctttacacatgggtgcccgtggggcattttgaacctatttttgaacctgagagcaagcaccgtttaagcccaagaaaacctaattcccgttgagatacacagacgaatttgccactcttgcatgatggggtcacgtgaaagtgtttttgaaaagattcttttcaaatggggcggggcagcgtaaagaggaggatacaaggaaagaggggggaggaagaagagggaacggatgcgcgcagaacgggggttcttaacgtgtgtcaccacgggtgtgtaaattgacagcgagtggttgacaacataagcttacaggaattccacccttcaaagtccgtggggcacagggccacactttagaaaggggcgtgggttatgagagcgacaaaagccccaatttataaacgggggggcctggagggcaaattgtgtccattagggccttcgcccacctttaaggaacacctaacggtcctcttattacaaatacgtggtgtgcaaccaagggggcttaacattagcaccaaacact

SEQ ID NO: 567988 - DNA, 559 bp, Homo sapiens
aagaaagatacggattgttacagtgaaataagatggggaagatggctggaaattgaattttttcagtggtcattgttttctttgtaataagaaggtgtggttgtatgatcacccaaatggatgtaggaatggcatttgacaaaattcagatcttttcatgacaaaaacacttaacaaactaggagtagaagggaatttcctcaatctgatgaagtacatctatgaaagacttacagctgacatcatacttaacagtgaaagattgaatgctttccccctaagattggaaacaagacaggctgtccattcttgccaattatatttaatattatgctgcagattctagccagagcaattggaagaaaaagaaataaaggcatccaattggaaaagcagaagtaaaagcatctttactcacagatgacataatcttgtatgtagaaaattctaaggaatccacaaaaattattagaactaataaatgagtttaggaagcttttaggatacaagatcaatacacaaaattcaactgtattctatacactagcaatgaacaatc

SEQ ID NO: 567989 - DNA, 377 bp, Homo sapiens
aagcgtattgccaatccaagatggcaggtgcggtggctcacacttatagtcccagcactttgggaggctgagatggggggactgcttgaacccaggaatttgaaaccagcctgggatatatgttgcaaccttctgtctacaaaaaaatacaaaaattgctggccaggcatggtggtgcatgcctgaaatcccagctctttgggaagctgagaagggtggatcatttgagatcaggggttccagcccagcctaggtaacatgcctaaacttcatctctacaaaaaatacaaaaattagtcagacttggtggtggcgggcgcctgtagtcccagttactcgggaagctgaggcaggagaatggcatgaacccaggaggt

SEQ ID NO: 567990 - DNA, 148 bp, Homo sapiens
tgactccagcctaggtgcgactctgtctcaaaaataaataaaaaataagtaaatgaatcgtttgtcccttggttattgagttgtgagagtactatatacgtgtatcccggatgcaggacttctcagctgagccgatttgccgatgatt

SEQ ID NO: 567991 - DNA, 253 bp, Homo sapiens
  misc_feature (253)..(253): n is a, c, g, or t
ccaccggcagggagtcctggataaatttctagtatttagattaaaaataactttatattgaattgtatactttaaaatggcaaatggttaattttatgttatgtgaattttagcccaattaaaagaaaggacttcaaaaaggattgcaggctggtggctaacgcctgtaatgccagcactttgggaggccaaggtgggcggatcacccgaggtcaggagttcaagaccagcctggtaaacatggcgaaactcn

SEQ ID NO: 567992 - DNA, 513 bp, Homo sapiens
atctgatggagtcttcaaaaaaggctactagaataaatgagtatagcaagattgtaggataaaagatcaatatataaaaactatatggaccgtactactattttgaactaaatttttgaaaaattgtaaatttaaattttaaaaaaatatcatttgcaacatcaaaaatatgatacgcttagagataaatctgacagaagatatgaaagacatgttgataattacaaaacattgctgagagaaagaaaacatacataaatggaaaacaaacatacatatactttgttcatggttcagaagacttgaaattattcagttctccctcaaatttatctataaattcaatgcaatcccactcaaaatcccagcaggaatttgtgtagaaattcgtaagctgattttagaatttgtatggaaatgtaaagtaattaagtaagcaaaacagcctttaaaaaggacacaaactggagggctaacaccactcagtttcaacaataaagctacagtaaaaaa

SEQ ID NO: 567993 - DNA, 337 bp, Homo sapiens
ggggttcccccggccccgggggagggggggggctgttagtcccccccctcccggcctttgggggtgggacttggggggccccaaactttggggggtttttaaaaaaatttcctgggggggtttttgttttttggttaattccccgcctttgtcgcctgccccgcttgggagggttttaggtgaactgtggggggtgggcccacccccccgggtgggttccccccaggggtgaaccgaaccgggtaggaagcctttttcccccgggccgggggttcagggggttttccctttgcccgtttggccctgggtttaataaaaaaaagggggtttgggttta

SEQ ID NO: 567994 - DNA, 156 bp, Homo sapiens
ttttttttttttccccccccccaaaggggccgttttttccccccctggggggtttttttgggggatttcctttccccgggggggtccaaaccccttttgttttttttccccccccccccccccccctgggggggcggggggggcccccttttccca

SEQ ID NO: 567995 - DNA, 903 bp, Homo sapiens
catgaatggtgagacttacttatctgatctacaaggacacataaataggagtaaaaggaccagtgtagtaacataagttcaaggggaactttgggaccagaaaccactgtgatgtacaaaaaacatggccgaaattcaataaactcacatagaacaataattttaaattaagcttatgataaatgttatattgtcatacaaatagattgcttagaatggttctcaagacattagtaagagaaatgaactcacagtcacaaagaattttataattactatactctgtgtagtcgtgtgggggctgggaaatgtatcttgacattgtagccaatcattttatatttgtcaatgtaaatcttatgggtcttagagtttaatctctctcgatgtcagatttccataagtcttattgaataaagtccatttagattagaagagagatgagaacacatcaatacaagaaaaacaagaatgtgaaatgaaacttggatataggaatatgaaaagaaccttacagaaaagaaagaaaaagaaatgtgtgtggggggaaagcaaaaaacagataatatgcgagggtggagcgataaaaagccaataggagacccccaagaaaaataagaaacaacctacaaacagaaagctgactaaactgcaatcctggaagacacgatcatacaagagaggaaacaacacaaggagaaatagaaagaagagacccggagaatagatcagagggagacacacccgaagaggggggggagaaacaccaagaaggacaggcagaaagcaacgaacacgccagagaccacgaaaaacgaagaaagacgcgttaatgcagtgacacacacggcacacctcagcaccagacaagcccaaacaagagaaaaaaaagaaaaaacaacg

SEQ ID NO: 567996 - DNA, 349 bp, Homo sapiens
tccgtccgtagatcgagcgaggaggataagtgtgatggatagggcactgcctgaggagtcgggagtctggtcattccggggatcacgcatgagcttccgggcatcatgggcctggccctgtgctggtttgcggtttgagagctcgtgtgacagccagtccaaaccatcgtacagacctgtgccttgagtggcacaggtggcctggacttaccaggtgcggctgcgttagagtgctgtaacctcagcttgtcagtcagctcgctcacgggcatggcgttgggcatgtcctgcttgttggcaaataccatgtgcagtgcatcccgcagttcgtcctcctcggtcgatctta

SEQ ID NO: 567997 - DNA, 347 bp, Homo sapiens
aaccccctttaggttcaaaaaaaaatggggggctttgcccccttggacccagcgggtttatcctaaacagttgtcaaggcccccaaaaaaccccctcttgttccctgcagcaaaacccccgaaagtgattcatgcttttggggggccttccgcaagtttagggattgttttgggaatgtttccctgccccccgcaccccggggttgcggccccagaaaaaagataagtgtaactatgcaaaggtgtttggattttttcctgggccgggtccaagtcgggggccctaaaaaacccatttgggggggtttgtttttcaaaaaaaaaaaaaacccccttttttttggcca

SEQ ID NO: 567998 - DNA, 112 bp, Homo sapiens
agagaaaagaccaataccaataaacatgccagtggaccatataacatggatcatctataatgaagtaatcttgttggaggtgacccctactgaagtcatcatcatccatagt

SEQ ID NO: 567999 - DNA, 230 bp, Homo sapiens
agattgcccctgccaggctggctgttgccgaccttcagcgctcaagttctgagacctgatgctggccctgccgccagagcgtggcaggccgatcatcaacggcctgcgccgggctgctgccatgagctcactctgctctacagactgatcctggacgatgcaggatcgacgcagccgtgaagtgaaagtagctctgcctcaccatggaagtaacgaacccctggacacga

SEQ ID NO: 568000 - DNA, 211 bp, Homo sapiens
aaagaacccaaaacaggggcccgtccccccggggtgttttctccccgcccccccggggttttttaacgggtttttggggcccaggtttcccctcagggccccggcgggcccggttttgggtttcccccccggtttggcccccgggggggcccccgggttttggggccccccctttggttttttttttaaagggccaagctggtttttccca

SEQ ID NO: 568001 - DNA, 621 bp, Homo sapiens
ggacggctgtgaagtgggggggttccatgctgcgggatgagaacgtagacgccagtggctcactcgctcctggcaccttccctttcaggctccagatggaccctgggaaggacaaagagggggtgacccagccctcagggccgcagcaaggaagaaatttgtgataccacctcgacgaggatgaggtccctcctggattggcaagcccttattaccagatctacaacagaagaccttcccacatgtggaacaacctcggcaccaggcggacccatcagaactacgccgaatatgcacatctcacagacctctggaaggggcatggggccaaagtgccacacacaaggggtcagagcccgcagggaagagaagaagacggacacaaaacagagacagactgaaaaacgcgggggacaaaaaaacaaaaacaagacaatcaataaaagaacgaaacaacagagacatgaagggggaaacatagaccagatacgaaagcaaggtaacagatgccgaccacacgcgacacatgaagaaatcaagggaagaacgaacaagaacacggagataatgatcgagagaagagcagaaagacaagacgcagggaacacaagaaaagaaaca

SEQ ID NO: 568002 - DNA, 954 bp, Homo sapiens
  misc_feature (740)..(740): n is a, c, g, or t
ccacgcgtcgaaatattatactagcatttagcatctcacttctaggaatactagtatatcgctcacaccggtcatatcctccctactatgcctagaaggaataatactatcgctgttcattatagctactctcataaccctcaacacccactccctcttagccaatatgtgcctatgccatactagtcttgccgcctgcgaagcagcggtgggcctagccctactagtctcaagtctccaacagatatggcctagactacggtacataacctaaacctactccaatgcgtaagaacggtaatcgtcccaaccaattatatgtactaccacgtgacatgactttccagagaaaacacataatttgaatcaacagcaacaacccgacagccgtaagttattagcatcatccctctactattttttaaccaaatgcaagcaacaagcctatttagctgttgccccaagggcttttcgctccgaccccctaacaaggcccgcctcctaatacgtaagctaggctgactcctacccctcacaattgcatggcaagccaacgccacttatccagtgaagcactatcacgaaaaaaactctacctctcgtatactaagtctccctacaaatctccttaattataacattcacagcacagaactaatcatattttatatctgtcttcgaagacacacttatcccgcagctggggttatcatcacccgatgaaggtaacagccagaaangctgaaacgcaggcacatacttcctattcttacagccctaggtaggtgccttccctaatcatcgcctaatttacaatcagaaaaccctagggtcactaaaattctatattcatcttcacggccaagaaatttaaattctgagccacaacgtttatttgagatgttcacaaagctttaggaaaaaaccctttggggcccttagagcccaaaccgg

SEQ ID NO: 568003 - DNA, 153 bp, Homo sapiens
gattgggtgggattttttccccttttatgtgggaaaaagtagttacttgtggcaagaataattttggaataatttctattaaaatcaactctgaagccaattggactaatctgagattgtgtttgttcataataaaagtgaagtggatctgga

SEQ ID NO: 568004 - DNA, 351 bp, Homo sapiens
caatagatttctgaatgcctccagcactgttctttgtgacactctaaacacatgcatgcttctcctcctggggatatgatgatgggtcagccagatgccctgggccttctgttcccaaccccttgatgcccagccctgttcccaatggctgcacacatacaattccagccccaatggacatggttggggctggggggaatggcagatgatgtagatggggacacatgtgaacttgcccctatggaagtggagtgcccctgatggtccatgagatggggaacaaccttcatgtgcctggctcaattggagattgttgtccatgcctacaggagggatgcatggaatcaatgg

SEQ ID NO: 568005 - DNA, 252 bp, Homo sapiens
tgttcggactgggacaacctggcgtctattctacagatctcctctcctcccatgcagtaagctcacttcctccttcgaggattcaagtaactccctgccctctttgataaaaaatcccaaattcagtcttagcagaagtgcttccctccaaccagcatccttactccccgtatcctctgcccttcctactcatacttccactgatatcctggaccacgtacaggcacatttcccagagatttcataccgggt

SEQ ID NO: 568006 - DNA, 183 bp, Homo sapiens
cattgtgtgtggctgtgcatctgcgacaggaggaaaagcagaggatgctggtgcccgtgtgggggtcgctggatacagcgctgacagcatgagtgagttctcttgccatgacacggaacctgcttttttggtgaagcaggatgcgagaagctgtgctgcgtgaagacaaaagcgtggaccacc

SEQ ID NO: 568007 - DNA, 723 bp, Homo sapiens
  misc_feature (57)..(57): n is a, c, g, or t
  misc_feature (284)..(284): n is a, c, g, or t
  misc_feature (381)..(381): n is a, c, g, or t
  misc_feature (435)..(435): n is a, c, g, or t
  misc_feature (446)..(447): n is a, c, g, or t
  misc_feature (462)..(462): n is a, c, g, or t
  misc_feature (488)..(488): n is a, c, g, or t
  misc_feature (658)..(658): n is a, c, g, or t
  misc_feature (670)..(670): n is a, c, g, or t
  misc_feature (707)..(707): n is a, c, g, or t
  misc_feature (712)..(712): n is a, c, g, or t
  misc_feature (723)..(723): n is a, c, g, or t
ggccctcccgagcaaagggaagtgcattctcgcttccgtagcgtgtctccgacggtngggggaaagtaattccggctgttgcaccatggcgtccatggggaccctcgccttcgatgaatatgggcgccctttcctcatcatcaaggatcaggaccgcaagtcccgtcttatgggacttgaggccctcaagtctcatataatggcagcaaaggctgtagcaaatacaatgagaacatcacttggaccaaatgggcttgataagatgatggtggataaggatggcngatgtgactgtaactaatgatggggccaccatcttaagcatgatggatgttgatcatcagattgccaagctgatggtggaactgtccaagtctcaangatgatgaatttggagatggaaccacaggagtgggttgtcctggctggtgcctntgttagaaganncggagcaattgctanaccgaggcttcacccaatcagaatanccgatggctatgagcaaggctgctcccgtttgcctaattgaacacctggacaaagattaagcgataacgtcccttgttgacataaaagggcaccgaaacccctgattcaagacaagcaaaaaaccacgctggggctccaaagtgggtcaacaatttgtcaacccgacaanattggcttgaanaattgcctgttgaaattgcccgtcctcaactggtttncaaanattattgggan

SEQ ID NO: 568008 - DNA, 603 bp, Homo sapiens
  misc_feature (326)..(326): n is a, c, g, or t
  misc_feature (405)..(406): n is a, c, g, or t
  misc_feature (460)..(460): n is a, c, g, or t
ccttgctcgcggagcagatcccccccacaccaagacagtcttgcttcttgtcacccatggctggagtgcctgtgtcacgatcttgtgctcactgcaacctctgcctcccaggttcaagcgattctcctgcctcaacctcccgagtaggtgggattacgggcacccgccaccacacccggctaatttttgtatttttagtagagatgaggtttcaccatgctggccaggctggtctccaactcttgacctcaagtgatccgcccgcctcagcctcccagagtgctgggattacaggtgtgagctaccacacccagccatgatttttngtatttttagagatggggtttcaccatgttggccaggctggtctcaaactcctggcctcaagtgatccacccgacttgnnctcccaaaatgctgggattataggcgtgagccaccatgcctggccaaaaaagcntattttaacaaaagtactgggacatgaagttaagggcagaacaccagtttatctcttttggaaaaagtgccagccctcacctacctgtcttctgtctaggttttccgtgtgtatctgccccgcgagccggtcagacgctcgac

SEQ ID NO: 568009 - DNA, 489 bp, Homo sapiens
  misc_feature (57)..(57): n is a, c, g, or t
  misc_feature (284)..(284): n is a, c, g, or t
  misc_feature (381)..(381): n is a, c, g, or t
ggccctcccgagcaaagggaagtgcattctcgcttccgtagcgtgtctccgacggtngggggaaagtaattccggctgttgcaccatggcgtccatggggaccctcgccttcgatgaatatgggcgccctttcctcatcatcaaggatcaggaccgcaagtcccgtcttatgggacttgaggccctcaagtctcatataatggcagcaaaggctgtagcaaatacaatgagaacatcacttggaccaaatgggcttgataagatgatggtggataaggatggcngatgtgactgtaactaatgatggggccaccatcttaagcatgatggatgttgatcatcagattgccaagctgatggtggaactgtccaagtctcaangatgatgaatttggagatggaaccacaggagtgggttgtcctggcgtggttatgccaacaccccccttttggggggggcccgcgcctcttaccaggcccccaccatct

SEQ ID NO: 568010 - DNA, 1004 bp, Homo sapiens
agcgggcttccgcgccatcaggcccgcgatagcggcgaggtgcgcttacagagtatggtcttccctgccaaacggtgctgcatggtgccatccatggagggtcgtgcgctgggtcttctgtcctgtcgggcactgtggctcgccgagccgagccggaatggcatgctgggtctagtgcggactcgcatacagccctgaagagtcaagaaaggcagcgcgattggcacaagctacgatcctcttgccacgggtacgcgttatggccagccaatggctggtcggtctgtggatgatgagagggcaaattagtgtgcgagaagaaaattgcatgtatcctccttggaaatcaatgatggcgagctcggcgaagagaaaggtgccatgagaggcaaaacccagatactatggcgaaatggtacttcagtcggaatcctttatcgccgaagtttcgagagcttgtaaaacgattctctcattcatacgggagactaatgcacggtgcgtatgtcatagtctgaatcgctgtagctgcagagtgtcgggaaattgataatgagatgacagactagtttgcacaggtgcggggttcaattccagaaattcgtttctctattatgacagagaaagtctaaccaacaagagaatggggaacaatcagaagcttgtagaggactgagtggacttgccggctgagattatgttcataggaagttgcgccaccttgaaggaagagattcattcgagccagtgtgtgttggactagggattggaatgcggacgggctggacaatctgatctatttccaggtaggactgggatttgggcccagcttaaatagaaaggccgggtattcctgatgggagggacaaaggaagggcttccgaaaaccaagtttaggcccttgttgcgcgggcttacgaaccgtggcttgcatctgagtcacgtatgaggtccaatccgagtgatcagtgcatagagggagccgccctacacaacactgggag

SEQ ID NO: 568011 - DNA, 669 bp, Homo sapiens
  misc_feature (555)..(555): n is a, c, g, or t
  misc_feature (569)..(569): n is a, c, g, or t
  misc_feature (575)..(575): n is a, c, g, or t
  misc_feature (589)..(589): n is a, c, g, or t
ggctatagatcttggccttcttccctgaatgctttgtttttttgggcccccaagaaaagtcccttttatagcactttagcacaggcaaggctacgggaacaaagtttcaatgctgctgagagtgaaagaaaggaggaaagtctgccactctaccctgagctgggcagtagggcactggagtaccctaggcaagaagtcagagctatggtatacaataggaccttgctctgggattggctggagctaggatccctaattctggatgtcaagagatttaggtttaatcgtggcatagaagctatcacattgggttcttacctctctgagggagaaccaatcttccagaaacagtttgggagggggctcttctaaagcctttcaaattgggcaagtaactttattcaactagagttgacatacaagaagggcaaaaataatctcacagagctgggaactgctgatagcccttactgagggcaaaagatggctatatggtaagctatactcctaccaaagcaagcaaggagataggattatagataatttcacggacantgggaaataacatnggtgantatacagacaagantaactcacttcaagctgtctgttttaataaattttcaacgtaatgatctatttttaccctcccatctggaacagaatact

SEQ ID NO: 568012 - DNA, 1474 bp, Homo sapiens
aagttggccaaatgagcaagagcgagagtgtatactgtctgttccatcccgacccggggaccacggatacatgggccctgtattcccacactacctcggacccccgtagaagccagggctccagccttctgcagggttacccagagcaccccgactaccagggaccgagagctgacaccgaaatacgctggtcgcattcatgcgagaacattccaaacaggctggacacacgatcggacagggcacgatacgagcagctcgatgatacaaagcccagacacaccgttgacgggacgacggctggctggcgccttaacgaaacatccgcactggacactgcagacctgagcgcgatgatgcccagcctatctgcacatccgagaagatcatcatcatgactctaacggacgcattaacccaataccgtaactactctgctccacagacatggcctggcaactgctccacatacacacaacaccaccgacaccaccatcaaacaccatcttaaccatgggataaccactgcacaaatatatcgtgcacaccccacacggaatcatccaacggcaacactctcctcttggggcactgcccccgtcactggcacaaacacaaccaacgacatggagaccaacattaacacacaataccaatgacacacacacgaatccaaaatcaagaacgacaggacacaacctccgatgcgtaaccccacgaacactgaacagtcaccaaagacggcacacccatcaacacaaaaacaacaagggcaccaagactacctacacaacaggagagacccacacaatcaccaacacacacgcaacggcacacactgcttactacaaacacccaccagtacaaaaaggaaaacgtccctgggccgatgatcagtagacaaaacaaaaacatgcgaaaacagggaagcgacccacacattagcagccggcacatatacgaggcaaggaacgacgagcaggcgcaacatcaggcccccaaggacaacaaaataaaaggaccacaccacaccccaccggaccattccgagacaacccgaacaacgccaccaccacaagagcggagccacggcgactcgccaccccccccagacggcacaacaaacagacaaaccacacaccatgacaacacacacacaccaccacgcaggcgagcgccagacgccccaagactcaatacacagtccacaccaaaccaacgtggcgacaccccaacaccaaggccaacagacacagcggggccacagcaacaacaagcaaacagcaacaagaagcaaaagacagacgcacacacgataccccgagagacacaaccaaaaatacacacacaggaacaccacacatgacaggtgaaacacacgccaaccacagcaccgcaccacaccaggaaacacaagcaggagaacaaaacaaaagaagaaacacccccaacagccaacaccacagaacaaacg

SEQ ID NO: 568013 - DNA, 855 bp, Homo sapiens
  misc_feature (36)..(36): n is a, c, g, or t
  misc_feature (44)..(44): n is a, c, g, or t
  misc_feature (124)..(124): n is a, c, g, or t
  misc_feature (145)..(145): n is a, c, g, or t
  misc_feature (149)..(149): n is a, c, g, or t
  misc_feature (172)..(172): n is a, c, g, or t
  misc_feature (175)..(176): n is a, c, g, or t
  misc_feature (180)..(180): n is a, c, g, or t
  misc_feature (187)..(187): n is a, c, g, or t
  misc_feature (191)..(191): n is a, c, g, or t
  misc_feature (223)..(223): n is a, c, g, or t
  misc_feature (228)..(228): n is a, c, g, or t
  misc_feature (243)..(244): n is a, c, g, or t
  misc_feature (253)..(253): n is a, c, g, or t
  misc_feature (260)..(260): n is a, c, g, or t
  misc_feature (276)..(276): n is a, c, g, or t
  misc_feature (285)..(285): n is a, c, g, or t
  misc_feature (352)..(352): n is a, c, g, or t
  misc_feature (358)..(358): n is a, c, g, or t
  misc_feature (360)..(360): n is a, c, g, or t
  misc_feature (420)..(420): n is a, c, g, or t
  misc_feature (494)..(494): n is a, c, g, or t
  misc_feature (498)..(498): n is a, c, g, or t
  misc_feature (596)..(596): n is a, c, g, or t
  misc_feature (707)..(707): n is a, c, g, or t
  misc_feature (719)..(719): n is a, c, g, or t
  misc_feature (746)..(746): n is a, c, g, or t
  misc_feature (764)..(764): n is a, c, g, or t
  misc_feature (774)..(774): n is a, c, g, or t
  misc_feature (816)..(816): n is a, c, g, or t
gccgccgcgccccagctgcatgatcctgcaggagcngggcaggncccctgcctctctctggtgtgacccccccaccccttgggtccccaggacaccccgggtgggtgtgtggttgcaggaaggnaggttttttaaggcacaaggnagcnaagttgtggtcggggcgcccacntgnnggcnccacgcncganaaaggctccaccaagggatggccccgagggtntggcnccgggtgtggagggnngggaactcncgctgcnacagttaccaagagcntgagctgtncctgttaccgcaggtgagcaaggtgaactagatttaatttttttaaaaacaggtaaactgatttttntttaananaataaaatctttggtctgctaaggttactttagctgtttttaaagtggcttttctctggnatgatggaagttgttgctagggggctcggccgtgggggcctgtgctcctagatggtggacttggagaaggaganccgnagtggtggttcttcccgaggtcgtggttgtgcaggttaatgagggcctggaccgcctcctccacggagcccatctggatcagtgctatcttgcggtcnttctggaagaacttgaatcctttgacgacgcccccattgctggaaaacaggaccttgagatcctcctcggagactgagggcgggatgttggagaggtgcagcgtggccganggcgggaatatnttttttttttttttttttttttttttnttgaagcggtgcaggggngagtagccgnagtccttggtcaggccctggtcctcctggccctcgcgggganctgcacgttctggtgcttcgagagcgtgatgcggatggg

SEQ ID NO: 568014 - DNA, 442 bp, Homo sapiens
  misc_feature (29)..(29): n is a, c, g, or t
  misc_feature (34)..(34): n is a, c, g, or t
  misc_feature (369)..(369): n is a, c, g, or t
ataatggactaaacaccctttgggcgaanacagnaggcatggttcagctctctctggccgagtaaataggaagaaacacagacaccatgcaagtcccagactcatctgagaccttctgggacacggaagctgacattttgagatggggtttcaccacattacccaggctggtcttgaactctgggactcaagcaacctgcccacctcagcctcccaaagtgctgagattacaggacacagtgagaagatggccctctatgaaccaggaagggggccctcacagacaccagatctgccagtgctttgatcttggacttctcagccttcgaaactatgagaaataaatttctgttgtttataaggcacacntcaaaaacactaaataactacccaaaagaatattatcttattactagttaaaccacaatataatatatcacgg

SEQ ID NO: 568015 - DNA, 198 bp, Homo sapiens
catgataaaactctgtctctactgaaaatacaaaaactatctgggcatggtggcgcgcctgtagtcccggctacttgggaggctgaggcgggatagtctcttgaacccaggagacaggttacagtcagccgaaatcacattactgcactccacactccagcctgggcgacatagcaagtctcttttcccaaaaaaaaa

SEQ ID NO: 568016 - DNA, 254 bp, Homo sapiens
ggtcttaccttgaccttctggcatacctagaccttcagagcatacctcgaccttctggcatacctagaccttctggcataccttgaccttctggcatacctagaccttctggtcatacctagacctgtctggcatacctagacctgtctggcatatcctgaccttctggcataccttgaccttctggcataccgtcgaccttctggcatatcctgaccttgctggacataccttgacgcttctggtcatacctt

SEQ ID NO: 568017 - DNA, 463 bp, Homo sapiens
  misc_feature (42)..(42): n is a, c, g, or t
  misc_feature (47)..(49): n is a, c, g, or t
  misc_feature (52)..(52): n is a, c, g, or t
  misc_feature (84)..(84): n is a, c, g, or t
  misc_feature (88)..(88): n is a, c, g, or t
  misc_feature (135)..(135): n is a, c, g, or t
ctgggattacagctgcctgccaccgtgcccagctaatttttntattnnnagnggagaggggtttcaccatgttggccagtctgntctngaactcctgacgtcaggtgatccgcccaccttggcctcccaaagtgntggaattagaggcctgaccccctgctcctggcctgaaatctttaaagccgttttttccctaaaaaacgggaaataataacacctcagaaggtttttgtgaagatcaaagaagctaaatatatgtggcatgatttgtaaagtgttatgcatatgtatgttattcttcctactgtcttctaaccttcccttgcctgctatgacttatctgagagccatgttcccatttatctttttgccaactatgttactgttgtcacacctgaaatggctttgtttttatcaataaatacttgttgattgcggtaaacagcaacagaaaaaaaaaaaa

SEQ ID NO: 568018 - DNA, 1335 bp, Homo sapiens
cagaaaaaggagtgatgggaattctgaggctctccccggccttgtgaaaaccctggaagcggctgcacctccctcctgcctgcacggatttgagcgcggccccgacgtcctggcgtcctgatctggcctgcggagtcccccgctgggctgctgcacttccagcctgctgacccctgcccctgcaagcccctgtggtcatgatcctgcctgagtattgaatgctgctctgtggcttttcctttctgtcgtgatgtgatgcaccgcatctgacgcgccctggaccattggggctgccatgtgtgtggcagcgaatggtggcggaaaacgtgggtcaggtcgagcgtacccaggtccctgacgtaagcgcccctgtcacccgccgagaccctgacacagggctgccctgacggggaaggcccctggggacagggacgaacgggcctggggaaaacaggcgcgtggggccaataggacgaagcggggggccccgtttcccgcctttatttaaagcgcctcccaaagaggaagacccaccaaagtggcccgtgagacacgctggcgcagaacacaggcggtattccaagtcggccgatacccggggattcccatgagcccatgatcgctgcaggattaggtttaggtagcgcatttaccaccccccctgtgggatatcccacctgtaggtcatgcgggcggcgaaaacccatgtttccagccgccccatgagagaatgagagcccagtttcacaaaactgtttattaaacccgcctgcgtgacgagcgtttcggcggggcggccccccgtgagagtttggcattttagggcgatttaaactgagccgaccccgaagaagaaccggcggatttttttctcccgagaaaagacgatgggcgccccatatttacccgagtttacccggccatgccgcaggttttacccaacccatgtggggagctgctgctgcgacaaaacaaaacgggttttttggcgggccagccgcatattttttgggtcggccgactgcctcgtggggaccacttggggatggttcataccccactgcgtatgctggtgaaccaccaccggtgcaggcgctccacaaacaagcagcagctctttaaaaacacccggtgcgaggtgggtagcacgcgattttgattcccctgattatgatgatcccgacagaggtgaccgtgggcgaacaacgcccgcaagaaggtttttgtcttgccccaaagatgtgcgagccccctagtagactagagcaagaggcggtgcccccacgacggtgacggatccgtggcggctggccacagcacaagctgcgtgggtca

SEQ ID NO: 568019 - DNA, 468 bp, Homo sapiens
  misc_feature (36)..(36): n is a, c, g, or t
aaggcattctaaacccaatgtgtgcaaaacccagcncagggtcttccctcattcccacactcagacttgttaggaataacattcaaaatcctaaggaaattgaacactcgaacaaaggagtcttagcaaagcaattttacttctgcgcagaggggtgcctccttggccagtcgccatgagagcacacctgaacaaaggggcacgagagcctttattcctgacacaagtcctgcccctgtaccctttccacattggctggggttgggtcgtacaatctaaatgaatcccggttggctaaacatttgatttttttagataaggtgggcatgtaaaagaaagcagagaagaaaggggaaggggtgtctgtaatgagctagaaagttagtcctctttccgaataaggagaggaacgtgagctggtattggtaatgcctggtactgtggcgtgcctgtgtatctaacaaaggc

SEQ ID NO: 568020 - DNA, 1107 bp, Homo sapiens
tgttttgttgtgtgcttcgtttctgttctgtgtgttgtggggtcgtagttttgtgtgtttgtgtgtctggtcgctgattgtcttgtgtgtgtttgtcgtctgctgtcttcgttgtttgtattgattgttgccctgattatgtgtagcgtgtgacatcagagaacgaagtagaatcaatcaatatccctttcaacgtctccgcctcattgttttagggccgtggcttacccgggggtttccaccctttccgttctggcttcgcctttttacgagccttgggacttcctaccctgggcgttttctctatctcgccgttggcccccttggggctcccggatttgcacccactctccgggtaaccctgggaaaagcgaaagggttaccccattcggcagaattttttgaagccccatgtacctgttccgtgcacacgcgggatccacccgtcctagacttcggagaagatgcgtggggaatccacttgaaaatccgcacagtggaatcggatttgccacacatccaagattctgcgagacccaccagctggacaaccgcatggagtcgttcttcctgccgagactgtgaatacctctacctcctgtttgaccccacccacttcatccaccaccatgggtcccccttcgacccggtgatcacccccttatggggagtgcatcctgggggctggggggtacatcttcaacaccagaagctcacccctatcgaccctgccgccctgcactgctgcccgaggctgaaggaagacgccagtgggaggtggaggacttgatgagggaattcttacatctctccaacggagccaggtcgaaatttcagaaaaacactgttagttcggggccctgggaacctcccagcaaggcccaggaacacatcttctcacccaggaaacccatgacccaggcaagggagaggaagcctgcccaaaccagaaggtccccacttttccagctgcccccagtcagcccttcacctcccagattggccttactgggaccggttttcctagactcctcataacccctggataatttttttatttttatttttttgaggctaaactataataaattgcttttggctatcata

SEQ ID NO: 568021 - DNA, 771 bp, Homo sapiens
gcagaggatcattacagcgactgtagcaattacagtacaggcaggaatgttactgatttcctaaacttcatgatgccatagttgaagtggtgacttgtcttcttcgtagaaggtagcctgttacaaatgaaatggtccataacttagtggcaattgaactgggcgttatatcaacacaaaatgatccagacgtttgctgatgcattgatgggcttaatgaatcaataatatatgaggaacaacggagaaacaggctagccagagaataaccttcaggcttgtatcacgagacaagttaagttcaggacaagtagacaagagaaactaaaaatgttgcatcctggaggttggtggggtgggagatggtcgttcatgaaccaaccacaggccaactggagcaggaatgctggatacaacttcataatacgctgaagagttatctcagccagcatagaaacaatctaacacccattcacagattatgccagccagtcacactacaaaaggtccatgccagttgaacctgcatagatgtggcccagttcctcgttggcacgaccacacgtactctgctcgggaacagccggagattgtgaggttcattgaaccgactcagttcaaactcaatattgtctcatctgtcacgaccagactattcccgcacagtgtgccaaaggcaggtaactgcctgcttctgctcaacttcatgtgaaagacactctttccagaggtgagctacttaagccagctggataaatcaatcctccatgc

SEQ ID NO: 568022 - DNA, 138 bp, Homo sapiens
aatccacggccaggggggtttgggacccccaaaaagggagggggaaagcaggccccccccccccccccccttgttttgttcagaggtttcaaggccccatgaaacaaaaaaccccccaaaattttttttcccgtttta

SEQ ID NO: 568023 - DNA, 184 bp, Homo sapiens
  misc_feature (2)..(2): n is a, c, g, or t
  misc_feature (98)..(98): n is a, c, g, or t
  misc_feature (106)..(106): n is a, c, g, or t
  misc_feature (146)..(146): n is a, c, g, or t
  misc_feature (161)..(161): n is a, c, g, or t
gngccatggactctcaattacatccaaacagtggaggcttacgccctgggacaccctcactgcacccttacagatcacagcccctatacctacccccnggcccagnccctccctcagcactgctctctggggtagctctcaagggncagtttctggatttntccacaatgcaagctacagagct

SEQ ID NO: 568024 - DNA, 262 bp, Homo sapiens
  misc_feature (258)..(258): n is a, c, g, or t
ataaataccaagtaagaccatgaggatagtatgaccaagggtccagagatcctcctttccaaccttttagttccaatgttgcctaaaatattaggtggaagaaagacaacagtaaagacaaagttggagggagagtaacagcccacatcgtgaaacaccttctgtattgtcatcagcataaatttactaacaaactatcaaaacctctactgtttggcattttcgcctccagaagcaaacaagaagaatgaggcaagnaaag

SEQ ID NO: 568025 - DNA, 594 bp, Homo sapiens
ctcgacgtgtatgcctgtcgcgaagtggagtccgaggtcatgatgagtgactaaagagcggggcacgatcgagccacttcaaagaggtgatcgatcccgcctctggcattcccagcaggcacacggaagtctgactctcaactcccgccaaagtgcctgagctttaggtgaacctacaggtcatgtgagtaatccgcgctgttcttagtcagcagtgcttcactaaccttttattggtgagccgaatgaggcatagatgtgctgagatccagcgacctctagacggtgctggccatctccagtgtcccaactacgtgctctatgttatgtctcggatcggctgggccatttcccaacgtcttttgggatttacatctgtccgtgttaaaataatcaaacgaaaaatcagtcctgtgttgtcagcatgattcatgtatttatatagatttgattattttaattttcctgtctcttttttttgtaaattttatgtacagatttgatttttcatagttttaaactagatttccaagatattttgtgcatttgcttcaactgaattttggtggtggtagtgccattatctagcaccct

SEQ ID NO: 568026 - DNA, 995 bp, Homo sapiens
cagcaacacatggtccacggtgcgagttcccctgcgttatttaagatcggtcactaggtacctgatgcagtacatcacgtggcctcgctgaccaatataatgtaggtgcgtcgatctaccgttgctctgtcagcaattgaagtatctcttaccctatcatgctgctatctgcacaaatacagattgcgagagcaaattactgtagaagcagataaggaatctgactatgaatccaagatgcccatttccagaagaatatatgtcatgctggaaatcagacattccaatggtcagggagtgatccaagtgatcacaccaagaataccctgtgtagcgtagggtgcgttacgaacgagaagaagcaggccgttgagagcaaccttgtctaaattgctatacggagaaagccatatgtctcgtgactagctagagctgtgccgtacggttgaacaaccagagaaaagtacacactgggctacaaaggaatttggagatagccaaggaacaggatttcccctagcaagctaccttctgttcaaatcatgaaaaaacgactatttccccttagaatagggaagcttgctatttttaaacgctcttgtagtgcttttcttttaacgcggagatgtagtaaaacgggaaaatgtagctcttagtttacacttcaaacgatgtgggggtctttcagagaactaagaataacagtttatgtgccgacgagagtttgccagatctgaagcatatacctcatttgactaagggtgttactttgggataggttgcagtaccagaccacagccagcagatagaacgcaaaagacacacataaaactcgcttctgagcgtccacttctgcactctctggctcctgctgttactcagcccctggagtctagatcatttctgcacaacttctctgtgccctgaaagatacgtcttccatgggccaaccggtcctccgcaggcctgggacttcgaagtgacccatcccaaac

SEQ ID NO: 568027 - DNA, 793 bp, Homo sapiens
  misc_feature (195)..(195): n is a, c, g, or t
  misc_feature (230)..(230): n is a, c, g, or t
  misc_feature (381)..(381): n is a, c, g, or t
  misc_feature (527)..(527): n is a, c, g, or t
  misc_feature (591)..(591): n is a, c, g, or t
ggggcggggctcacgcgaggcgctgaacagtccgggagattctcgctctgctgctttagcttcggagtgtttggcgacggggcagcgcgagatgtggaggctcatgtcgaggtttaatgcattcaaaaggactaattaccatactgcaccatttgagaatgtccaagcacacagatgcagcagaagaggtgctanttggcacaacaccaaggttgcgcgggagtcataancactaaacagaccaaagttcctcaatgcactgactcttaatatgattcggcagatttatccacagctaaagaagtgggaacaagatcctgaaactttcctgatcattataaagggagcaggaggaaaggctttctgtgccgggggtgatantcagagtgatctcggaagctgaaaaggcaaaacagaagatagctccagttttcttcagagaagaatatatgctgaataatgcgtgtggttcttgccagaaaccttatgttgcacttattcatggaattacaatgggtgggggagtnggtctctcagtccatgggcaatttcgagtggctacagaaagtgtcttttggctatgccagaaantgaataggactgtccctgatgtggtggaggtattcttgcagactccaggaaaaactgggtacttcttgcttacaggattcagactaaaaggaagagatgtgttacagagcacgaattcgctaacaacttttgtagattcttggaaaagtcggccatgtagagggagcattggttagccttggaatctcccttagaggaaact

SEQ ID NO: 568028 - DNA, 589 bp, Homo sapiens
cacgccgcaccggggtcaaattaacactattaatcttccagatatcacttatgtgtcaaactcaagagttatgaagggaccttagcatactgtaactttctgactgagctcctctctactctgaatgcaggagaccctcataggtaggctgaactatcgcccctattcagccggacgaagtcatagacggatggatcttcgtccctctgcaaacccttggactcaagggtctcttataaaagggaagagggaaaatgtaggaggcgtgtgaaccagagctccatctttaacaggagcagggtaaaatgaggctgagacctaccatgcagcattcccagagaggaattctatgtcacaagatgagatgggaggtaagcacaagatacaggtcataaagatctggccgttaaaacagtgtttgcggtgaaggagctggctaaaactcgccaaaaccaagatggtgacgagagtgacctctggtcgactatactgctacgctctcatcagcgccatgacagtttgcaaatgccatggcactgtcaggaagtgaccctatatggtctaaaaggggtaggcatgactattccac

SEQ ID NO: 568029 - DNA, 284 bp, Homo sapiens
caggcactgtgttctgagtgggaaaggctgtatacaccagtggctcccaagggtggtccatggaccagcggcatcagcatcatttgggaacttgttacaaatggaaattcctgggccctaccctcgacatactgaatgagaaactctgtgtttcttagtcagtgtttcagcaatcctcccactcaagtagtccggatgtacccgaggtttgagaaccgctgctgtgcacctggcaggttgctgtgttttagcaatcctcctcccgaccgaagatccaaaattct

SEQ ID NO: 568030 - DNA, 125 bp, Homo sapiens
aatttggtaacaaggaccttattctaaacttcctgtgtcttaaggaatcgagaccgcgcaaaccccggatccggttagagacaaattaaaacacttctaaggaaaaaatttctaacaattaacct

SEQ ID NO: 568031 - DNA, 882 bp, Homo sapiens
cggggagaatgtagtgaataaatataaagaagaaaaggggcttgatggcgaccgcgcatacgatgtagcagctcgaacctcacctgcatgagagaagaatgaagagattcagagtggacgaagaattccaaaccccctttgcgagtcaaagtcgaggatattttttattcaggccagggaatggaataaagataataggggtaattaagaatggatgccaggtaatggacgacgagaagagaggtatgagaaacaactagtgctgtaatggggtttattttatgagagaagacgtgaatagaaggtccttgtgtgtatgaaagcggggagtgataaggcaagcagggtgtggcagaggggagggaggtaagagagagtggtagctataaatagtcatgcgtaagagggtgagtaaaggtgaccccggggagacgatcttgtggtaagtgtggtggtaagtagaaggataagtattgtttaagcgtgaaggatgggcgaatattttatttatgtccgcgtaggttgatgagttcaatggtgcgagatggacatagcgatataagtatctgtttgatgttaacggctagatatagattgaaaccgacaaaagaagttagttcggatgcagtaagagatgggttggggggagtggaaagaagagggaggcgttgagctgcgcgagtgcatttttatcgcgaataggatttatatgagttgataagctatgatgtgattgcgtatcagatagaatacggtgacgaatgcgggagagagtgggatgagtggatggggagaatattatgatgttgcgcggtatgctggagataatgtgcgtgtaatttgcgtcgcagtgatatatttgatataatgataagaagaagg

SEQ ID NO: 568032 - DNA, 86 bp, Homo sapiens
ggatttgctggtgcagtacaactaggcttaatagggacatgtccctattaagcctctcgaattcgagcctcgaattcaagttctaa

SEQ ID NO: 568033 - DNA, 778 bp, Homo sapiens
cttcgttcttcgaccccgccggtaccgaggagaccccattctataccaaacacctattctgatttttcggtcaccctgaaagtttatatccttattcctaccaggcttcgtgaggtaatctcccatatttgtaacttactactccgagaaaagaaggaaccatttggatacataggtatggtctgagctatgatatcaatccggcttcctagggttgatctgtgtgagcacaccatatagtttatcagtaggaatagacgtagacacatctgagcatattttcacctccgctaccataatcatcgctatccccaccggcgtcaaagtatttagctgactcgccaggacatccacggaatgcacactagtgaaatgatctgctgcaggtgctctgagccctaggattcggtgctttctttgcacccgtaggtggcctgactggcattgtagttagcaaactcatcactagagcatcgtactacgagctgacacgtactagcgttgtagctcacttccactatgtcctatcaagtaggagctgtattgccatcataggatggcttcattcactgatttcccctattgtcacggctacatcctagacaaactacgccaaaatccatttcactatcatattcatcggcgtaaatctactttcttcccacaaactttctcggctatccggaatgccccgacgtttctcggactaccccgatggtaccacacatgaacatcctatcatctgtaggctcattcattgcttctacgcgaatattaa

SEQ ID NO: 568034 - DNA, 726 bp, Homo sapiens
ggtggtgttgtacacctgtaatcccagctgtgtcaggaggctgaggcacaagaatcgcttggacccgggaggcagaggctgcaggtgagctgagatcgcaccactgcactccagcctaggtaacagagtgagactcttaaaaaaaaaaaaaaaaaaagggaatttaaattccgggtttcttcccaaaattcttgtgaaattcttgtgaactctgtgaatatttaattgccgataaaatttaatccctttgggtgactttaaccttggaaattttttataagttatttccagcagttttaccccatgggcattttaagtcactactagaaaggggtagttcaaaaatttttttcaaagttcaatattgggcaaattcgaaataatcgtggcaaaccctttttgccttgcatttacagaatggaaaacagccgaaaaaggggttcctggaatgccttgggcaaaacacttaacagcaatggggaaacgcaggtaccagttgacaatggcggcaaccttgtgcttgaacacctgggggcatgtctgcacaaaaccttaaaacagtcatgctgaggcctgggattaccaccgtcaggccactgggtgtagatcccttcagaacgctatccacctaactcggctatggggatattatccacaggtctgatgggccaacttttcgaaattgctgtggcactacttccacacaagcccttggccttagcgaga

SEQ ID NO: 568035 - DNA, 177 bp, Homo sapiens
tgcatatgggtcaataggagctgtatttgccatcgtagggaggcttcattgactgatttcccttattctcagggtacaacctagcatgcaaacctacgcgcacaatccatttcaatatcatattcatcggcgtatatctaactttcttcccaaaacactttgttggccttatcgagg

SEQ ID NO: 568036 - DNA, 239 bp, Homo sapiens
ccctttttgggccctttttttggccattttcccaaaatgccggggaccttataaaatttttttaaagaaataggtttggaaaaatttaaaattcccctaatttggttttgaattggaaaaggccaggattctggttttgggggttttttgtttttttaaaccttggttaaaagggccaattggccctttttagaatggttttttggggtaattttatgggccggaaataaaaattttta

SEQ ID NO: 568037 - DNA, 599 bp, Homo sapiens
tcaaccagtaccactcaagtagctggtgcctcataggctcgcagcatcaggtcgcatgcccagcgagggcaccgtctcgtcatcataggtgtgggtcttgataaagttgatggattgtctacgtcatagcagctggaagcattgtactgcatcccggggagctagcgcaacacccgtgtcggagtcgaagcacctgatcctccggcaccggcgtccagatggactcgggggacttctgctctcggaagcggccttcatacacagctgccacctgtgtcaggtcaaaggcgcagacagccgagccaggtatgctgttgctgggcgtggaaaaaacggccaggaccacgggccggcccccgaggctgaccacgcccgtgacagcctgcagcacgttgaagtagaaatgggagtctccgggtacagagcagttgagccgtgccttcaggaaggacgtccactgcttctccagcacgcggggggagcctcccacgtcgttcttgcacactcgggccacgcgggacaccaccaccttctccaggtagttaaactccatcgcaatctcccggaagaagaagtagacatggctgccccactccagc

SEQ ID NO: 568038 - DNA, 131 bp, Homo sapiens
acaaagggcgcttgtgatacattgagatcgaacttatggtccagggcgggcccaggcctccgcaagggccgggggtgttgctcagcattgcacacggcccgctgcaccttggccaggtctcccccggggac

SEQ ID NO: 568039 - DNA, 211 bp, Homo sapiens
caagcaccaggctctacagccctggttacctgcaggacaggtgggtcacgtgtagcgccaggggcagccccacgcgcagtcaaatgagagatccagttcctctcatattcttccccaaacactttggtgtttggcccaaaacctgcaccaattgtggcaagccccttgcccatttccgcgagacggctaggtccaccggttgaatccattc

SEQ ID NO: 568040 - DNA, 510 bp, Homo sapiens
atgcaaggccatcgctcaccttcctcatcacacgcccgacaggatatgcattacaggtttctgactacccttgttgcatatcttgtgagagaaagtctaatgggaaactcctcaagaaaggccgttatgactgtgaacagcgcgtcaggacgatatccatcgtactgcctactcctctgtgtaattttattccctgataccagccagtgccaccttgtttaatacatgggaactcactgaaattcattctgtatattgcccgcaaagtcttaaagatttcatccacagtcaggaattaaacttataccaatgagagcctcacacattcgaggatgtactaagcactacaggcctcacagaaacagagatcccatcttggagttttcagtcccacatgggagataaagggttttgaacattaaatgacaaaaacaacagccagaagaaaattctcgtcctttttcattactatcagacttcaataaatgtcttggccttgccatatgcgat

SEQ ID NO: 568041 - DNA, 122 bp, Homo sapiens
aagaaatcgcggtcgctttctccaagcctacgttttcacacttcttgtaatgcctctacctgcactacaacacataatgacccaccagtcacatgcctatatatatgtaaaacccagcccat

SEQ ID NO: 568042 - DNA, 149 bp, Homo sapiens
cgctcataatactccccgatgccacgttccggcgatccaggatctcaggtgagctcctcagtagtgacaaagccatccccatcattgtcgattcgatcaacaatcttccctagcctctccttgctctcgtccggggagtgatgctttga

SEQ ID NO: 568043 - DNA, 952 bp, Homo sapiens
tttttatgctttttctctctgtttcattgggtcgggtatctgttttgtgtctttgttgttttcgctcttttttcctgtgtgtttatttcccgcgggtggttccttttttttccttctcttggtatgcctgtatccgtctggtttctgtttagttccttgcgggtgcgttttcttgtgttcccttgttttcttctgtttggactgttgttcctggttttttggcgctctggtttccttgctggacgctttgtcctcgcatgtgcttcttggttgctgggtacgctcagcatgtcgcctgcaggtcccgagcctgccacacgggaaggcagctaaggcccggcgaggaatcgagcgcagcgccgcgtgggctggcacttctggggacccagcacaccctcagcagccgctggccacgggtgctaagcccctcattgcccggagccggcagggccaccgccagctgccatccgagtgcggggcccaccaagcccacgcccacccggaactccagctggcccgcaagcgccccgcgcagccccggttcccgctcgcgcctctccctccacacctccctgcaagctgagggagcgggctccaggccttggccagctcagaaaggggctcccacagtgcagcggtgggctgaagggctcctcaagtgccagccaaagtgggagcccaggcagaggaggcgccgagagcgagcgagggctgcgaggactgccagcacgcatgtcacctctcaccagcactttgggaggctgaggcggagtggatcaacgaggtcaggagatcgagaccatcctggctaacacggcgaaaccccgtctccactcaaaacactacaaaaagaaagttcgagcgtgggccgcctagtgcccgcagtcccagcaaatcaggaggcctgacgcaagagaagcggcgtgactaagccaataaacccgagagagca

SEQ ID NO: 568044 - DNA, 105 bp, Homo sapiens
ccatcagcacattactatgataaatcacactacatctactcacacaaaacctgcatctgctgctgtgcagaactgataattacttttcagcatgtaacacgaaac

SEQ ID NO: 568045 - DNA, 261 bp, Homo sapiens
gctcagtggtttcaccacagtctcgtgtgcgcctgagctctcagcgtgccgtggcgcgccgcgtggagagagcggcgcggtgagatccctcatcgctgccagaggtgcgggtgagcaagagcagccaaccctgtctaggaccattcggggtccccggcgcaacccggagggcagggagtgcccggacgcgacaggacagcgggttggtggtgaggggcagcacgcgcaagtggctgcaagaattgcgccgtcccggggcgt

SEQ ID NO: 568046 - DNA, 246 bp, Homo sapiens
gtcaggtaaccgaaggaaaaaacgccgcgcgccgctgccaatattggcgttggcgtctgaagctgatactcggcctggacaatatccggccgccgttgcagcatggtccgaggtcaacccggccggctcgcgcgccaccaggtcggcggacagcggttgtgccggctgagaatccggcaccgggccacccaccaggaacgccaggctgttgaggtcctgggccaccgagtctgaaggcagtctgga

SEQ ID NO: 568047 - DNA, 903 bp, Homo sapiens
  misc_feature (83)..(83): n is a, c, g, or t
  misc_feature (316)..(316): n is a, c, g, or t
  misc_feature (354)..(354): n is a, c, g, or t
  misc_feature (402)..(402): n is a, c, g, or t
  misc_feature (497)..(498): n is a, c, g, or t
  misc_feature (502)..(502): n is a, c, g, or t
  misc_feature (520)..(520): n is a, c, g, or t
  misc_feature (543)..(543): n is a, c, g, or t
  misc_feature (566)..(566): n is a, c, g, or t
  misc_feature (570)..(570): n is a, c, g, or t
  misc_feature (651)..(651): n is a, c, g, or t
  misc_feature (659)..(659): n is a, c, g, or t
  misc_feature (665)..(665): n is a, c, g, or t
  misc_feature (681)..(681): n is a, c, g, or t
  misc_feature (694)..(694): n is a, c, g, or t
  misc_feature (698)..(698): n is a, c, g, or t
acagtcctcggcccaggccaagcaagcttctatctgcacctgctctcaatcctgctctcaccatgagcctccgcctgcagagntcctctgccagctatggaggtggtttcgggggtggctcttgccagctgggaggaggccgtggtgtctctacctgttcaactcggtttgtgtctgggggatcagctgggggctatggaggcggcgtgagctgtggttttggtggaggggctggtagtggctttggaggtggctatggaggtggccttggaggtggctatggaggtggccttggaggtggctttggtgggggttntgctggtggctttgttgactttggtgcttgtgatggcnggctcctcactggcaatgagaagatcaccatgcagaacctcaatgacngctggcttcctacctggagaaggtgcgcgccctggaggaggccaacgctgacctggaggtgaagatccgtgactggcacctgaagcagagcccanntagncctgagcgggactacagnccctactacaagaccattggagnagctccgggacaagatcctgacngcancattgaaaacaaccgggtcatcctggagattgacaatgccaggctggctgttggacgacttcaggcgtcaagtatgagaantgagctgngcctgngccagagcgtggaggncgacatcaacggnctgngccgggtgctggatgaggtccacctctggtcttgagaaatgacctgggagaatgcagagacggagagacctgaatgaagagctaagcctacatttaagaaagaaccatgagagggaatggagggcgttagcaccagtggtcgggccgggtcactgtgaattcgtgccccccggatatacctaaccgggctgccaatacgggcgac

SEQ ID NO: 568048 - DNA, 835 bp, Homo sapiens
  misc_feature (18)..(18): n is a, c, g, or t
  misc_feature (31)..(31): n is a, c, g, or t
  misc_feature (33)..(33): n is a, c, g, or t
  misc_feature (55)..(55): n is a, c, g, or t
  misc_feature (59)..(59): n is a, c, g, or t
  misc_feature (74)..(74): n is a, c, g, or t
  misc_feature (93)..(94): n is a, c, g, or t
  misc_feature (159)..(159): n is a, c, g, or t
  misc_feature (239)..(239): n is a, c, g, or t
  misc_feature (241)..(243): n is a, c, g, or t
  misc_feature (247)..(247): n is a, c, g, or t
  misc_feature (252)..(252): n is a, c, g, or t
  misc_feature (258)..(259): n is a, c, g, or t
  misc_feature (266)..(267): n is a, c, g, or t
  misc_feature (271)..(271): n is a, c, g, or t
  misc_feature (335)..(335): n is a, c, g, or t
  misc_feature (337)..(337): n is a, c, g, or t
  misc_feature (351)..(351): n is a, c, g, or t
  misc_feature (355)..(355): n is a, c, g, or t
  misc_feature (357)..(359): n is a, c, g, or t
  misc_feature (378)..(378): n is a, c, g, or t
  misc_feature (381)..(381): n is a, c, g, or t
  misc_feature (383)..(383): n is a, c, g, or t
  misc_feature (389)..(390): n is a, c, g, or t
  misc_feature (394)..(394): n is a, c, g, or t
  misc_feature (399)..(400): n is a, c, g, or t
  misc_feature (402)..(402): n is a, c, g, or t
  misc_feature (405)..(405): n is a, c, g, or t
  misc_feature (408)..(408): n is a, c, g, or t
  misc_feature (420)..(420): n is a, c, g, or t
  misc_feature (428)..(429): n is a, c, g, or t
  misc_feature (437)..(437): n is a, c, g, or t
  misc_feature (439)..(439): n is a, c, g, or t
  misc_feature (473)..(475): n is a, c, g, or t
  misc_feature (488)..(488): n is a, c, g, or t
  misc_feature (497)..(497): n is a, c, g, or t
  misc_feature (505)..(505): n is a, c, g, or t
  misc_feature (524)..(524): n is a, c, g, or t
  misc_feature (541)..(541): n is a, c, g, or t
  misc_feature (548)..(548): n is a, c, g, or t
  misc_feature (579)..(579): n is a, c, g, or t
  misc_feature (583)..(583): n is a, c, g, or t
  misc_feature (643)..(643): n is a, c, g, or t
  misc_feature (653)..(653): n is a, c, g, or t
  misc_feature (662)..(662): n is a, c, g, or t
  misc_feature (664)..(664): n is a, c, g, or t
  misc_feature (668)..(668): n is a, c, g, or t
  misc_feature (671)..(671): n is a, c, g, or t
  misc_feature (696)..(696): n is a, c, g, or t
  misc_feature (698)..(698): n is a, c, g, or t
  misc_feature (708)..(708): n is a, c, g, or t
atgttttgcaatcttaanacagacatgcttncnaaaaagattaatacagaaccancctnccgttttggataacnctatccagctgtggaaagnncaacctgtggtttctctgcactggtgtttaatggggaagaatatgaacagctttaaagagctgtncattgtggttactactattaaaaaataagatctgcacgagtctcactggcctttgggtggcctttgtggacgcctcgtancnnnaaantgttnatctgnnttccctnncatncttttaagttaaaaagttaacatcgggacatgggtttgatcttttgttgtacctgatgacagtncngagatccccccccncccncnnnccgcgcgcccaagcccctnacngnccctgnnccgnccccnntnccnaancctaatatttcngctgtgcnnttaatacncnaaatattaggggatggggtgttgaagctttcccnnnttggcttttaacnatttatagnatttaacngatggactggctttcatgnggccccccatttaaagntatgagnacatacccatggtttacaacttttactatanaccnttccttggcccccaagtattttaaaagtgtgcccccttttaacctttactttttttaagntgaaggtganactttttcnanatangangaaactcatgtcaactgaagtgagngnaatctcaganatcaacattattatattttaaaaacccgctatggaaaaatcacctgaattctgtcatttgtcagaattacaggacctttttttctttaacctttagcattaaataaaaataaaattgggagccccga

SEQ ID NO: 568049 - DNA, 1048 bp, Homo sapiens
  misc_feature (83)..(83): n is a, c, g, or t
  misc_feature (461)..(461): n is a, c, g, or t
  misc_feature (499)..(499): n is a, c, g, or t
  misc_feature (547)..(547): n is a, c, g, or t
  misc_feature (642)..(643): n is a, c, g, or t
  misc_feature (647)..(647): n is a, c, g, or t
  misc_feature (665)..(665): n is a, c, g, or t
  misc_feature (688)..(688): n is a, c, g, or t
  misc_feature (711)..(711): n is a, c, g, or t
  misc_feature (715)..(715): n is a, c, g, or t
  misc_feature (796)..(796): n is a, c, g, or t
  misc_feature (804)..(804): n is a, c, g, or t
  misc_feature (810)..(810): n is a, c, g, or t
  misc_feature (826)..(826): n is a, c, g, or t
  misc_feature (839)..(839): n is a, c, g, or t
  misc_feature (843)..(843): n is a, c, g, or t
acagtcctcggcccaggccaagcaagcttctatctgcacctgctctcaatcctgctctcaccatgagcctccgcctgcagagntcctctgccagctatggaggtggtttcgggggtggctcttgccagctgggaggaggccgtggtgtctctacctgttcaactcggtttgtgtctgggggatcagctgggggctatggaggcggcgtgagctgtggttttggtggaggggctggtagtggctttggaggtggctatggaggtggccttggaggtggctatggaggtggccaggtcaacgtggagatggatgccaccccaggcattgacctgacccgcgtgctggcagagatgagggagcagtacgaggcctacatgaagaagaaccatgaagaggagatgaaggaatttagcaaccaggtgtcggccagtcaacgttggaggtggctttggtgggggttntgctggtggctttgttgactttggtgcttgtgatggcnggctcctcactggcaatgagaagatcaccatgcagaacctcaatgacngctggcttcctacctggagaaggtgcgcgccctggaggaggccaacgctgacctggaggtgaagatccgtgactggcacctgaagcagagcccanntagncctgagcgggactacagnccctactacaagaccattggagnagctccgggacaagatcctgacngcancattgaaaacaaccgggtcatcctggagattgacaatgccaggctggctgttggacgacttcaggcgtcaagtatgagaantgagctgngcctgngccagagcgtggaggncgacatcaacggnctgngccgggtgctggatgaggtccacctctggtcttgagaaatgacctgggagaatgcagagacggagagacctgaatgaagagctaagcctacatttaagaaagaaccatgagagggaatggagggcgttagcaccagtggtcgggccgggtcactgtgaattcgtgccccccggatatacctaaccgggctgccaatacgggcgac

SEQ ID NO: 568050 - DNA, 608 bp, Homo sapiens
cttttttttgattttgaacatatctgataataactttggaactgaagtaaggttctgttaaaatatactttgaagaccctttaaagcagtgaatctgaaacaatttcgacacccttaagtggttgatacgtacctatttcaggtattttgaggtatttaccataaactaaatttagaaatttttcagacttcactctgcacagctaaacattacaaacattggcatacggctggggctttaccttctagattctacttgagcacgcaaggtgacgtacaaagcaactttgcagcttgtctggtaactgacacagaattacgtggcgcaagctgtgaactcccaaaacgagctcatacgctcttctacaagttctccacaaaccactttggataacacttcactcgcatgcagctctctatcctctcatggatgctggccccataattagtcacagaccagtggcgtcttcttgccccacttccacactggtgcagaacagtttcaagtggcccgtctctccacagccaattcgtctaccgcgttaatggcaccacacacttccccagtacaaaactttgtacttgggacttggggcagatgccactcg

SEQ ID NO: 568051 - DNA, 228 bp, Homo sapiens
tgaacataacgcctagaacatttagactatgaacatccccactgttagtatactaccagtgtagactacccttcagttaaagacctctagaagtacacctgtcatagagcaggttggatttattgctcattgcagcaaagaacacagaccgcagtggaaccatggggatgtcctagtaacagggtgttataatgtattataggatttgggcttaggataatattgggg

SEQ ID NO: 568052 - DNA, 405 bp, Homo sapiens
gaaaggcaatttattgaaacaaaggctacaataactattgggaaatctggatgtattctgaaggtatagtcaggctgaactgatttctggactcagacgtttccctagatgctggctgccatgtgagatgcacgcacagcgttcccctgtctggtccatctgcccgccaccctctccgtttcccaccaaagtcattcattcagcgcttcattcagttattcattatttcattcggcactcagatagcagcagacttggaattgattcgctttggtggaaaatggcaataccatccagaaaactggacacagaatctctgctccatgtccggcagctactgttgttttctgctgaatgctgactaggcccaggactgcaggctaggttatgggcattgggagagac

SEQ ID NO: 568053 - DNA, 219 bp, Homo sapiens
  misc_feature (25)..(25): n is a, c, g, or t
  misc_feature (71)..(71): n is a, c, g, or t
  misc_feature (130)..(130): n is a, c, g, or t
  misc_feature (152)..(152): n is a, c, g, or t
  misc_feature (190)..(191): n is a, c, g, or t
tactttctggcactacaagatgctncctggcactgcacgtatattttgtgccctactcctagaattaggcntttgtccaaggagctgtggttccttttattggagaatgagattagaaaccaagacctgnacactagatgtgcttgctgttnctgggctgtcactgctttgaggccatctcagagcaacnnaatatgtgtgtatatactaacctatgta

SEQ ID NO: 568054 - DNA, 445 bp, Homo sapiens
tcgtacacacaagatagcctagcacaatactcagaatcactctggggttgtgctagctctgagctgaggcacttcaccctgtctaatcttcagcaagcactttgggtggccaagatccagcctgactgcaggtgactgtggttgctaacacgggcaaactcccaggaaagagtaccttggtccagccagtgagggctgctcccagagctgacttcccttccctccattcgtggttttaccccactcgggctttgtgtccctgaggagcgcatcttccccaatgtgcatgcgcatcaaagcgttcctactctgcactcgttccagctctacaacatctccagattcggaggatcaaacttgtaccccatagtctcagagcaactgaatctcggcatgaacaaagggaattagagaatgctttcccttaaaaacaaaatccctattg

SEQ ID NO: 568055 - DNA, 797 bp, Homo sapiens
ggacgaagcgcttacagcggcgggagcggtgcgggcatgaggggttggacccaggtctgaggcaggctcccccctccctcccgcctcagtggatcatgcccagggcggcagcggcggcggtgtgcgggggcggagagtgactggtgcggtgccgcgtcgccggcaggacgatgccgtttccacgttacaacacagggagtcacaaggaatgacacgaccgccacagaagcactatggcattacttctcctatcagcttaggcagcccccaaggagactgactgcgtacttactacagaaactaattgagacattgaaaccctttggggttttagaagaggaaggaggaactgcagctgcactgatttctaatttctgggaaaactataataacctggtaagagagagtggtataggagtaaatcgagtgaaagcaagaatcttccacaatctgtgattgacaaatgtgtggaggcatagaaattcttacatttggatctctacagagttacggagtgcatacaaaaggtgctgatattgatgcgtcgtgtgtagcagccaggacgatgtggatcgaagtgacttcttgcagcctcatgctatgataggttgaaattactggaagaagtaaagattgacgagctgtagaagaggcattcgtaccagttactcaaactctgtctagcatgggactagagattgatatgtcagtgtgcaagattagcagctgcagacaattgcctgaacgattcggatctacgagatgacagtctgctacagacaattagatatacgatg

SEQ ID NO: 568056 - DNA, 344 bp, Homo sapiens
  misc_feature (187)..(187): n is a, c, g, or t
  misc_feature (191)..(192): n is a, c, g, or t
  misc_feature (306)..(306): n is a, c, g, or t
  misc_feature (336)..(336): n is a, c, g, or t
taaggagttatgccgggcaggccgaacagccggggtgggtgaagacttgccctatcaggaatattcaagaggtataacaaatgcaagctattccgatgaccttacgcggcgctgaaaaattacgcgaagagctggattttctgaaatctgtgcgccgtcctgaaatcattgctgctatcgcggaagncgtnnagcatggcgacctgaaagaaaacgccgaataccacgcagctcgtgaacagcagggtttctgcgaaggccgtattaaagacatcgaagccaagctgtcgaacgcgcaggtgattnatgtcaccaaaatgcccaacaatggggggngttatttt

SEQ ID NO: 568057 - DNA, 381 bp, Homo sapiens
  misc_feature (60)..(60): n is a, c, g, or t
  misc_feature (136)..(136): n is a, c, g, or t
  misc_feature (155)..(155): n is a, c, g, or t
  misc_feature (174)..(175): n is a, c, g, or t
  misc_feature (194)..(194): n is a, c, g, or t
  misc_feature (331)..(331): n is a, c, g, or t
cccgacatcaatgcaagcttccaataagaaaaacaaattccccctcctaagccatggcanctcagttatacagaaataccactttgggaaacagtctccaggagagcctagatgagcccatacagtctcaacagancaccccccaacttgccctncaagttctacttcagtttnntaaggctataaatgcagcnctggctcagagggtcaggaacagagtcaatttcaggggctctcttaaatacgtacagcattctgcgataatgtgtggacttttgtactgaatgatgttggaatttcagagaggtgacagaactttattaaaagtggnattaaagtggaaaattgtagcctgtggatgggttaaaaatactgggttcc

SEQ ID NO: 568058 - DNA, 998 bp, Homo sapiens
  misc_feature (670)..(670): n is a, c, g, or t
  misc_feature (888)..(888): n is a, c, g, or t
gtacagttatgtctagtgattgtatatttacagagttgaacgcactattgtgtgttgctaatcattgacctgtagttccccacatataagcctagttgatgatgtcatgcacctatgtaacagaagagtacatataatataaaagtacattttataaatccatgtagtatggatcttgtaacaatagcatacccatatatcaagggacgaggtgaatttactaccttctctaacagttcctattgatactctccctgtatcactgtaaacatgtagctagtgatacctatatccccacgatatgtgcattgtgacatatttgtctatggatgtctggaattgtgtaacagtatgctactgcgatttcttcaagagttgtctccactagtatgatcaggtgctcatgggaccatctcttcgcctcaacatgatcaatgcttcctctggtgtttcgttggttattatgaccagattaatagtgccacgagttctttgataactaatcctaacatctctaaattccatcccatgatagggacgggcgcctcaaaaaaattatcggccctaatgtgaccccaagagtctttccctcgcccaaatgtatctctggtctccaagttggagccatttatagccgagaccgcatccaaaaaacaagggtttgttccgntcgtttttacaaccgtcgctgacctggcggaaaaacctgctaaccttggggggaagccttggtggaaaaggaaccctttccttctggggggggcggtaaacctttattgcgcccacctttccttatcgaaaaattgaacggccctcaaggccaactctcaacacttccacgagggccctacgctgcttttaacacaacacgcttatgtcttggcagcnactgacaacgttttggcttccctgggaatgagactcttcaccattttgttcacgggacaataccaaaacacaccattatactcccagtaaaaacaataagtatatagttg

SEQ ID NO: 568059 - DNA, 408 bp, Homo sapiens
tgaggtcccagctccctgatcctatgctctgtttgaaagatagcctttggccttagactccgttagcgcctatttcgtgccttcagacagacaggaaacttctgcggtcaggaaggctgctgtaccctgcttctttgccgaggccctgtcctgccggcaggcgaccccatcccgcacctgaagtgaggcgatcctggagctgcaggggactagtgacccgtgacttcggctgggtcctaagtcctctgaggagtgggtgactgctgttgccaagacctcagagtgcagggagagggaggaggccagcattgtgactgtaccactaggggcagttggatgtgggtgggaggagaaggtgacttggtatagaggattgaagctagatttgatactgaaagaaaaaaaaaa

SEQ ID NO: 568060 - DNA, 339 bp, Homo sapiens
cgatcatatagtgtggaaaacactgcaactcttctacttctagtctatgctgaaatatacaataaagtaataactataattaccctactgtattatcaaatgctacaactcattcacctaatctaactgtatttttgtacccattaagcaagttctctccattccccctccttgccttacccttctctgcctactacctccattccactctctgcctccatgagatccacttatttttggctcccatttaagaatgacaatatgtgatgtttgtttgtcttacagttcctggctcatttcacctaatataatgacctccagttccatccatgttgctgc

SEQ ID NO: 568061 - DNA, 158 bp, Homo sapiens
ggattcccaccaggacttcccacgggaaacagcagtgattaacctttacaataaacgaaagtttaactaagctatactaaccccaggtaggtcaatatcgtgccgagccaccgcgtgtcacagcgattaaccgcaagtcacatagaagaccggcgtac

SEQ ID NO: 568062 - DNA, 470 bp, Homo sapiens
atctaccccctcattgagagttgcatcactggagctttcttaccaggagagaggatatggaggcagaattagggtgagaactgttacactcgtaatctgagggcctgaatgggaatgtgctgagaaagaaaaacataacgagaaagacattagaaagaaatgaagatagccagacaggtatagaaggaacatgactccctttaaatagagaaacaggcacacgatactctcaaggtaatgctggtttgttattggtcccttattttggaccattgtggtacctgtccaaataggcctgatttccagggccagccctgccttgataaatgggactcacatagtaacaacaggtttcctaccacatcgatcttgttgatgttggagcaaattaaagcagatgttcctgtcaactgtgaatctcttcccaaagagcacatcagcatcctcaacctcttcaagccacacaaaag

SEQ ID NO: 568063 - DNA, 85 bp, Homo sapiens
gcacgagtggtattggtcatatgttacagtatctttgttcagctggattatgggttggttttggtcatatgttagactccataca

SEQ ID NO: 568064 - DNA, 129 bp, Homo sapiens
  misc_feature (90)..(90): n is a, c, g, or t
tggtcacaccaacaacctgcgtcccaagaagaaggtcaaataaggttgttctttccttgaagggcagcctcctgcccaggcccaaaagcnacgaagcctcaataaagtgtcccttactttatctggaaa

SEQ ID NO: 568065 - DNA, 120 bp, Homo sapiens
gacgtcacttctggctgacgtacctttactactgtggctttaacgacttctctcttggtcgttgacactacgttggggggactcctctacgacgtcgaccctgcacggcactgcaacgct

SEQ ID NO: 568066 - DNA, 410 bp, Homo sapiens
  misc_feature (405)..(405): n is a, c, g, or t
gctgctgagtagtctttcctaaatgctgctgagaacacctgtcggtgtcacttagtaacccgtcctcctactggcattcctgctcctcatctcttatcctccttactcctctgcaggacgtggatgctgcctacctgaacaaggtggagttggaggccaaggtggacagtcttaatgacgagatcaacttcctgaaggtcctctatgatgcggtgagggctccatcctcccctccatccagggaaagggaatcccccatctgtgacgctgctggttgggattcacagttttttgaaaggactccagctcccttattttagggcagtgggttctcatcaaggtcatgcatagaaaggtttgaagtgggaaattcaactgggagattcttagaaccagatgtgggtngacgc

SEQ ID NO: 568067 - DNA, 1282 bp, Homo sapiens
  misc_feature (1220)..(1220): n is a, c, g, or t
ggaccattactacctctcagaatcttagccaaaccatttacccaatataaagtataggcgatataaattgaaatctggctgcaatagatatagtaccgcaagggaaagatgaagacaactgctaaccgaagcataatatagcgagaggacgtaaccccatataccatatctgcataatgaattaactagaaataacgtttgcaaggagagccgagagagcgtaaggacccccgaaaaccacgacgagctacctaagaacagctaagaacgagcacagcccggtctatgtacgcaaacatagtgggaacgatttactacggtagacggcgacagaacctaccgacgcctggtgactacgctggttgtccaagactacgacatcttagattacaagcttgaaaattatgcccacagaaccctctaaatccccttgtaaactttaactgttagtccaaagaggaacagctactttggacactaggaaaaaaccttgtcacagagcagtaccaacactttaacacccatagtaggcctacaagcagccaccaattaagcaaagcgttcaagctcaacaccactacctaaaaaatcccaaacatataactgaactcctcacacccaattggaccaaatctatcaccactatagcaagaactacatgttagtcataagtacaccatgacaaacaattctcctacgaatcagacatgcgtcacgattaacacccctgaactgcacaatctaacagtccaaaaaatcgtaacaatcaaccagacaagtcattattaaccctacactggtacagccacaaacaagggccatgtcacatatcaggacagagttaaaaacagtacacaggaactccggaaaatctctactccgcgctgtaactaaagactacatacgaaaaatagccaagaattaaaggaccgctcaccaagtaaacgtgttaaagcacacgacaaccatcacgggaataagggttgcataaaccacactgagcttaaataaggcacaggcaatgaaagcgcaccaagagaaacaaactgataacctacaacagacatgcatgtcgcagagcggcgatcaaccacaagacatagacaattatcacgagacctcaaccagctatctatcttcctgtttgttgttgctttttcaatcgcgagatatcaaagactatggacggcgggactcatcacttagtcgaccgatacttncatataacgaaatgaatcaggcaccatgagaccatatgacaacaaacgatcgattaatcaca

SEQ ID NO: 568068 - DNA, 192 bp, Homo sapiens
ttttgctcatttccctgtctgattttctagcaaggattatagtaagtggttagtcacgacttgctttcttgtatgacccactcaggatcatcaagatttcttctattttcgtaaaaagccatagcaagaaagaaagcaagcaagaaaggaagaaagaaagaaagaaagaaagaaagaaggaaagaaggaaag

SEQ ID NO: 568069 - DNA, 198 bp, Homo sapiens
  misc_feature (2)..(2): n is a, c, g, or t
  misc_feature (69)..(69): n is a, c, g, or t
  misc_feature (110)..(110): n is a, c, g, or t
  misc_feature (157)..(157): n is a, c, g, or t
  misc_feature (168)..(168): n is a, c, g, or t
  misc_feature (173)..(173): n is a, c, g, or t
  misc_feature (187)..(187): n is a, c, g, or t
cnctgaatcgcggtctcagctcgcgcctgtcagcagaatcgagagttgtgtacctgtccatatacaagncgcaggaagagtgaggagatggaagagacacttatctcaanggaggagatgagaggaaatctctgcaatgagtcttggagttggcagntacaaggcaanatgtnggacccaattgaanaggcacagatc

SEQ ID NO: 568070 - DNA, 245 bp, Homo sapiens
ttcgggaaactgagacacgaatcaggatcaccccatgcgccaccgcaccattcccccaccggttccaacgccagggcgcccctagaccggggggggggttatgaggtggacttcctgcgcctcgtggcaacttcccaccaacaccactaaacgggcacagagacaccaccgctgtcccagaggcagtcggataccggtcaccgatcccgagatccgacagagcgaaagagggccgccagcggccg

SEQ ID NO: 568071 - DNA, 429 bp, Homo sapiens
  misc_feature (9)..(9): n is a, c, g, or t
  misc_feature (293)..(293): n is a, c, g, or t
  misc_feature (361)..(361): n is a, c, g, or t
  misc_feature (413)..(413): n is a, c, g, or t
  misc_feature (424)..(424): n is a, c, g, or t
cactctgcngatgtgatgaatagttttttactctggcttcacctattgtaaagctgatcaaagacattgagggtcttacccttgcagtgagccaatcagggcagaaccagaaccgatcctgttaattcagcaatgagttggtttgccgaatcgcccttccatggtaagccattaggatggaggccaatgatggttgtacacgcatgcactcacacgtgcactcttcacatgcctcctgaccaaaactggataaacagaggaaagcaaacaaacaaacccaaagccagaccgtntttttgaagggctccagtttcccattaattaaggcacatggggtaggctttttcacaggcacagggtnggcttaattcagtttgtgggttcaaaacggagccttttgtttattccaaacnggatttaaaancagtt

SEQ ID NO: 568072 - DNA, 497 bp, Homo sapiens
gtctccctattaatgcatatggaatgcacacgtgtgtgctgatcaaatgaatgttctcactcgcaagcacagattgtgttgtgccagtaggagacacatgtccaagtccttcttaacattgaatccagtttctcgtaaaatttacactgcaatcaagtctcttaggataagctagtccatgttagtccaaaccttccattgtgcaagtaagttaatgaattgctggtagctcttctgcaggttgaatatagtagcgcccgctctgtttagctccaagataggcaatgtgtaggcaatctttcccagtaatatcatggatttgcacgtgtgtcttggcaaggttccagtccctgtgcttcgcgttgggtgacgttctcttgcaggttctcaactctttactactttgaactacagatgtccggccaattccgaatactcgagtcatgtgctcgtgccgaattcttgcagcccgtggcatccactagttctagagcgcc

SEQ ID NO: 568073 - DNA, 190 bp, Homo sapiens
cgtgtgacatgtgactgagctgtgttgagctgggctaggctaagctaggctgggcggagctgagctgggttgggctgatgctgaactgggctggactgggctggactgggctgggctgtgctgggctgggctgagctgagctgagctgtactgagctgtgcctgtgccaggctgagctgggctgcgctga

SEQ ID NO: 568074 - DNA, 189 bp, Homo sapiens
tcgatatgcgcctgtctgcattattttccccatttgagttagttttcatatattgtgttatgtaaaagtcaacttcatttctttggcatgtggatatccagttttcccagcaacatttgttaaaaacctgtccttttcccattgaatggtcttggctcccccttcccaaaaatccctttgaccataaag

SEQ ID NO: 568075 - DNA, 624 bp, Homo sapiens
gtggagatacagagtggaccccatctcaggaaataagaaattacaaaaaggatgtcatcagtcaggtttaagggatagacgggtggaacattccagaaaacttgatacattcttcaaggatatagaacacacaatcctaaaattcatatgggaaccataaaagacttagaatagtcagctatcctgagcaaaaggaatcaaactggaggaatcatattacctgacttccatttattcaccagagctacagtacccaaaacagcatgatcctggcataagaacagaaacataagaacagtatagacaacccagaaacaaatacatacatctatggtgaccacttttgacaaaaggagtgaagaacatacactgggggaaaagataatgtctttaataaatggtgctgggaaaactgaatatccatatgcagaagaatgaaactagacccccatctcttagcatatacaaaaatcaaaattaattaacaagttaaatctaagacctcaaattaatgaaacagctaaaagacaccatcggggaatctctccaggacattggagtgggcaaagatttcttgtgtaatacctgacaaacaggcaaccaaagcaaaagtgcaccaatggg

SEQ ID NO: 568076 - DNA, 326 bp, Homo sapiens
acagtatggatttggaatcaactggaatcaggttgtctacatgggttttagctataagactttgaccttcaatttcttagaaaatgaggacagtagttcagcaggctgtattctgtatgaggaaactgttctgggtaatcgatttagagtcctttgaagggagcacagaaagctagggaatgtttggagttctcgttgtgacgcagtggttaacgaatctgactaggaaccatgaggttgcgggttcgatccctggcctggctcagtgggttaaggatccagcgttgccgtgagctgtggtgtaggttgcagactcggccgtaccg

SEQ ID NO: 568077 - DNA, 112 bp, Homo sapiens
gcagcctctcgtctgatgtgcaatcgttcttcaggtggagctgaagcattgaagcaatatgtgtcatactgggaggtgttgcatgtgaggatgtacaccccgttttagtttg

SEQ ID NO: 568078 - DNA, 101 bp, Homo sapiens
gagggctttgcatacctgtggtcaggagcccgtgccagctatggggtcagaaggggccgtgtatgcttcgagatgaagatcaatgaggaaatctccgtgaa

SEQ ID NO: 568079 - DNA, 773 bp, Homo sapiens
ggcctggtgtgattcctgtcctgcagctggttgtatctcatggatgcagctgtctctttatatctccagtcctgcgcttctactcctacctaagtgctgtgcctgccacccagatggaagcattcagcatggcacattggacatgcagccccgctgaggccccatgaactatcttttctgtgtttgtgaactaacatgtgcctgacaacagcattcatccactttcacaggttggctcacatgctgcacaacatggagcacccagttcatcctttacagcacacggctccagtcttcagcgggtctgtgtgccacaagtgcatgcaggttggcaccatatggttcggcaagccaggagcgccacatgcacattcactgcacaagtggcaagttccccacagtctcacacagctcacacccaccgtggaccacaaccctataatgcaacacacactaggttcataggataacgatggcaccaccactgcggttttgctcccatttgctgcgccgggcctcctcctgaacacactcataccaccagacccaaggtggggttcttctaaatagcggcttttggacaccggatgggtcgtcgctactcccagggtggtgcgatccagcggttggcccactaattaaacgctctgtcgaccccacgtcactcctttagccgcaacgactaggttggagaacgggacaccgaactggcaatcgaatgttccatccacgacgcaccttgcacactggaacgtgatagatcgactgtggac

SEQ ID NO: 568080 - DNA, 387 bp, Homo sapiens
gtgaatcccatgtcttaactcatttaccatgtgaataacgtctaaggggcactacaaggggctagttctaatattgatactagatgtaacagctacaatctcccatagtgcttggattaccggtatgattcaccgtacactctcttccatgacagactaacttacttactacttactagaacatgactttcgtacagtcttaactaccaattacatactgaactactatatcacagtacacctacgctaccatatacggagccatggaatcacttactatgtcactgtaatctagtggtcgaactactatcggaggagacataccttatctgatactacttgacgatgcattcagtaccatacctgtttacatgcctaccagatatt

SEQ ID NO: 568081 - DNA, 368 bp, Homo sapiens
  misc_feature (70)..(70): n is a, c, g, or t
  misc_feature (111)..(111): n is a, c, g, or t
  misc_feature (213)..(213): n is a, c, g, or t
  misc_feature (239)..(239): n is a, c, g, or t
  misc_feature (262)..(262): n is a, c, g, or t
  misc_feature (266)..(268): n is a, c, g, or t
  misc_feature (271)..(271): n is a, c, g, or t
  misc_feature (277)..(277): n is a, c, g, or t
  misc_feature (286)..(286): n is a, c, g, or t
  misc_feature (297)..(297): n is a, c, g, or t
  misc_feature (303)..(303): n is a, c, g, or t
cgtcgacatcatcatcgaatggaatctaatggaataatagaatgaactcgaatggaaacatcgaatgganttgaatggaatcatcatcgaatgagatcgaatggaatcatngaataacatcgaatggaatcatcgtcgaatggagtctaatggaatcatcaaatggactcgaacggaatcgtcatggaatgtaattgaatagaatcttctaanggactcaagtggaatcatcatcgaangcaagcgaatggaatcatcatcnaatnnnatngaatgnaatcatcanatggaatcgantggaancattgagtgggctcaaaagaaatgtcgacgcggccgcgaatttagtagtagtagtaggcggccgc

SEQ ID NO: 568082 - DNA, 241 bp, Homo sapiens
gagtctagactgtcttaaaaatgcctcatgtacagtagtttattttttgagacagtctcactctgtcacccaggctgaagcgcagtggcgcgacttcagctcactgcaacctctgcctcctgggttcaagcgattctcctgcctcaacctccccagtggccgggattacagtcgcccgccaccacgcccaggtaattcttgtatttttagtagagatggagtttcacatgggtaccgagct

SEQ ID NO: 568083 - DNA, 972 bp, Homo sapiens
gacagacaatgctgtgaagaatcactggaactctaccatcacaaggaaggtggacctgcgttaatgtgtctgaccaagaatcgtgcactaccggccctcgtcattatgagctggagcacgtgatacaaggaggacaactagaatgcccagaccaaacaggtcaaaaggaaaaactttcacacacccataacacagatggacactcacagaagaaacagaagaaaaaagaagaagacgagacaaaggccagggataataaaaaacaaagagacaaaaagagaaagcaaaaaaaagaagaaagaagaagaaagaaggaaaagaaagaggaaaacaacgaagagaaagcacacgaagacacaacaaaagacacaggaaaaaagagaaaccgaaaaatacacagaacacaagaacaaagaaaagacacaaaaaaaaaacaaaaaaagagaaaaacaaacaaaaaaaaaaaggaacaacatgatacaagaaagaccacagacaaaaacacaaaataaaaaagaccgcaaaaaaaagaccgagacacaacaaaaacgaaaaaagacgaaagaagaccacacgacaaaaacagaaaaagaagaaaaaccaaaaggagaaaaaaggaaaacaaaaaagaaaaacaagagagaaacaaaaaaaacaaaaaaaccggacaagacaaaaaagccaaaaaaaaacaagaaagagaaaaagaacgaaacacagaaaaaaaggacaagagcagacacgcacaggacaagagaagaagataaaaacgagaggcaacacagaacaagagaaataataacaggagcgaccaggaacagaaaaagacgaaagaagcagaaagaaggaaaaaagaagagaggaagaaaaagccagagaaacagacaacagaaacagagaacaacgagagaaaaagcaaagaagcagacaagacaagaagagacacgagacgaagagacgaagaaaagaagt

SEQ ID NO: 568084 - DNA, 99 bp, Homo sapiens
cctccccccgcaggtgcagtacaactagaaaaaatagggcatggggtggctgtagtaaccacctaccatcatcgtccatctattttagccactagcaaa

SEQ ID NO: 568085 - DNA, 281 bp, Homo sapiens
attcgcggccgcgtcgactgcagccataaaaaatgatgagttcatgtcctttgtagggccatggatgaaactggaaaccatcattctcagcaaactatcgcaaggacaaaaaaccaaacactgcaggttctcactcataggtgggaattgaacaatgagaacacatggacacaggaaggggaacatcacacaccggggcctgttgtggggtgggggcaggggggagagatactattctgacatggacctcctggcacacgatgagccactggccgtaagcc

SEQ ID NO: 568086 - DNA, 324 bp, Homo sapiens
  misc_feature (16)..(16): n is a, c, g, or t
  misc_feature (210)..(211): n is a, c, g, or t
  misc_feature (271)..(271): n is a, c, g, or t
  misc_feature (293)..(293): n is a, c, g, or t
tactcataattaatgnttatcttatactaattatcttattgttggattatactgcctttaacatgattcatggtacatttaaagcggtacaaatcaggcacagtgactcatgcctttaatcccagcactttgggaggccaaggcaggcggatcacttgaggccaggagttcaagaccagcctgggcaaccccatctctactaaaaatacnntttttagtagcatggtggcacacacctgtaatcccagctacttgggttgagacaggaganttttttgcccaggaggcagagnttgcagtgagccgagccgagatagcaccacg

SEQ ID NO: 568087 - DNA, 370 bp, Homo sapiens
  misc_feature (228)..(228): n is a, c, g, or t
  misc_feature (330)..(330): n is a, c, g, or t
ctgggtatcaggtgcctatgtgaacagctcccaataaacccttgggcactgagttgctagtgagctcctctggtacagaacacgtcacactggttcagtgttgcggctggtttaggggagaattaagtccgtcctgtccgtcttccctggtgaggactccagaagctcctgcctggggccctccggacagcccagacacctcttcgcgtggctgatctcgctctggtnccttttgctgaatgtagcttagctctgagggtggctctgtgctggacccagttgactcttcctgggggaatcatcaaacctggggggccccaaagcagccgnagccacagcttccacatccttttccggcaggcattcccgt

SEQ ID NO: 568088 - DNA, 902 bp, Homo sapiens
  misc_feature (21)..(21): n is a, c, g, or t
  misc_feature (102)..(102): n is a, c, g, or t
  misc_feature (219)..(219): n is a, c, g, or t
  misc_feature (326)..(326): n is a, c, g, or t
  misc_feature (342)..(342): n is a, c, g, or t
  misc_feature (345)..(345): n is a, c, g, or t
  misc_feature (370)..(370): n is a, c, g, or t
  misc_feature (412)..(412): n is a, c, g, or t
  misc_feature (423)..(423): n is a, c, g, or t
  misc_feature (452)..(452): n is a, c, g, or t
  misc_feature (495)..(495): n is a, c, g, or t
  misc_feature (502)..(502): n is a, c, g, or t
  misc_feature (505)..(505): n is a, c, g, or t
  misc_feature (520)..(520): n is a, c, g, or t
  misc_feature (524)..(524): n is a, c, g, or t
  misc_feature (530)..(530): n is a, c, g, or t
  misc_feature (537)..(537): n is a, c, g, or t
  misc_feature (541)..(541): n is a, c, g, or t
  misc_feature (545)..(546): n is a, c, g, or t
  misc_feature (575)..(575): n is a, c, g, or t
  misc_feature (577)..(577): n is a, c, g, or t
  misc_feature (581)..(582): n is a, c, g, or t
  misc_feature (600)..(600): n is a, c, g, or t
  misc_feature (611)..(611): n is a, c, g, or t
  misc_feature (628)..(628): n is a, c, g, or t
  misc_feature (705)..(705): n is a, c, g, or t
  misc_feature (719)..(719): n is a, c, g, or t
  misc_feature (825)..(825): n is a, c, g, or t
tcctggatgctagatccatcnaccaagctttcattgtactaacgtcgacagtctatatttctgctcttcagtctgtccttaggatagaagctctaactgaantgaaatactgtcttccttttgggctctgtgcaactacagctacagtggaaaaaagcaaactgctcttgatcccaggttggtatgtgcatgagcaccatgtaggggccttgggggtangggagtggggcatcatagcagaatctgagatctctactgattatatatccagctctctaccagctttaccacatgatctgtactgcctctcgtccttccatttaaanactggaaattgtaggnatnggcagagcaggctaaagttgaagangtaaaaaacgttaaactaagtctgtgaatcagcaaacacaanccttaacaccngtgtctgggtgctagcccgccaacgaagnattgtgtccctaaactcttcatctaaaaagaactggaataganacgaagnaanccagagccctaagcntcanttttancctttancccnaggnnctacctaagcctcagcagaacttgtaaancnaaannaaagagcctcacccgganaagcaggcatnccttaaccttaagcaanccaattccacgccctggatcagtgaataaccccagctgcaccatgagccgcgttcgggatgctggctgtgtagcggnggggatagtgatangggctggtgcctggtactgtgtctacaaatacaccagggggagagaccagaccaagaagagaatggccaagcccaaaaaccgggctgtggctgggactggagccanggctagagctgggctaagagccggattcacaatcgaccttgggtcaggattcagtcccccaaccccagtccgtgctg

SEQ ID NO: 568089 - DNA, 137 bp, Homo sapiens
gcgccttcctcaagaatgccttggacaaggagccagttctggtcgtgtccttcgtcgtcgggggcctccctgataattcttccccatttaggccctacttcaaggacttcgcatgatcaacaaggccacgccttaac

SEQ ID NO: 568090 - DNA, 102 bp, Homo sapiens
  misc_feature (2)..(2): n is a, c, g, or t
gngtacccctatcccatcaaaacaaaaggcttatccttattataactttggcaacagctagaagggccaaggagaagtgactaagtatttgttcaaacaaaa

SEQ ID NO: 568091 - DNA, 708 bp, Homo sapiens
ggatcgtcaccaactgcgacgacatggagagagatctggcaccacagccttctacgacgagctgcggcgtgggccccggcaggagcacccagatgctgctgaccgaggtgccccctgaaccccaagggccaacagagagatgatgactcagattatgtttgagaccttcatcaccccggccgtgtacgtggccatccatgtcgtgctgtccctctacgcctctgtggctgcaactacctggcattgtcatggatctctggagacaggcgtcatccacacacggtgctcgcatctaccgagagcgctatcgctcctcccgccattgccatcctgcgtctgtgacctggctggcccggggacctgacagagatacctcatgaagatcctcacctgagcgaggctacacgtgttcaccaccacggccgaccgggaaatcgtgcggccgaacttctaggagaagctgtgctacgctcgcccctggacttctgagacaggagatgggcaccgcccgcatcctccttcgttctctggaggaagagcctacgagactgcccgatgcgcctctggtcatcccctagtcgtcaatgagcggttccggtgtccggaggccgctgtgccaacgcttccttcctggagtatggaatctttgcggaatcctaggagaccaccttcaactccatcatggaagtgtgacgtgcgacatccgca

SEQ ID NO: 568092 - DNA, 154 bp, Homo sapiens
accccccgcattggggtctgtagcagtaccaagacgagcagatgcacatcgctagcactcattcagcggcgagagcggctgcacatgttccgcgtggggggccttgtgttccacgccatcagacagctgctgcctcaccagatggctgactttc

SEQ ID NO: 568093 - DNA, 116 bp, Homo sapiens
acgaaaacgaggatcaacagacactcgaggatctaagagcgaaggccgctgaggcaaggggcccttggcaacaggtggaattaagaaatctggcacaaagtaagctgtaccttgtg

SEQ ID NO: 568094 - DNA, 508 bp, Homo sapiens
gtgggcctgacacacaggcgtccacaaacacggcactgccgagaggtgcccctttggagaaagcccacacagggcaccttgtggcacacagggtgtcaccacattgcgccacacagttattcaatgtgccaatccgcaccccaagctgcaggacacaacaggaggcaatgtgatttgagggccctgccgacacagggcacacaagtgtcaaaggttttccttggccgcccacgagaggagtgccaccacttcttcacaaagaaatgttggggcttctacccacaagtgtcaaatgcgtgagtgaaattttgagagacacactgtgtgtgtctgtagaaaagcgcgtcttcacttccacacgaatgggctcgttggggttccaaagtacacttccccacgttcgtggcaccttctggaacaagtggcgggccctgcaactcatgagggcttccaatgtgctgccccccttttaatactcacccataaattctacttcctgtccacctta

SEQ ID NO: 568095 - DNA, 165 bp, Homo sapiens
ttttttctgagcacgcacttctccccatcggtcatctgacttcagagtatgacagatgactgaaactcgttatcagtgacgaggacaccgcaggagggccagtcaagttacatgctacagtctgaagaactccgggcctccctcctgttcaggaaccccataatg

SEQ ID NO: 568096 - DNA, 100 bp, Homo sapiens
agctacgcagtcctcaccacccagcccagggtgctcacactcaccactcctgtggctgaggaaggatagctaggctcatcctcgtgaaaacagacccaca

SEQ ID NO: 568097 - DNA, 168 bp, Homo sapiens
  misc_feature (8)..(8): n is a, c, g, or t
  misc_feature (40)..(40): n is a, c, g, or t
tcgggttnaagggccatacttttctttgagcaagaatcancctttatagcataggcctgatatgaaacagctaattagaaacacagctgagatttgaacccaggcattcagacctcaggtgcttaaccttatgtaacagcccatttgccctccaccaccaacagtgtc

SEQ ID NO: 568098 - DNA, 354 bp, Homo sapiens
tgtgatcggtactatggtagattctgtgtctttgctaattcgaagctgcggtgaacatacgagtgcatgtgtctttttttatgtagaactatttattttctttcgggtatatacccagttgtgggatttctgggtcaaatggtagttctgttttatgttctttgagaaatttccacagttttctgcagtgactgcttttctccacaatctcttcaggtttttattttttttttactttttagtaatagccatttggacaggtgtcagctggtatctgtgtggatttgatttgcatttctctgatgcttagtgacgatgaacttttttcatatatttgtgggccacatatatgtc

SEQ ID NO: 568099 - DNA, 196 bp, Homo sapiens
gtggcaggagtcccagattacatggtgaaccctgtctactggaaattaaaatagccgggcatggtggcacacactgtagtcccagctactcaggaggctgaggcagaagaatcgcttggacctgggaggcagaggttgcagtgagccgagatggtgccactgcacttactctgggcaacagagcgagattctgtct

SEQ ID NO: 568100 - DNA, 133 bp, Homo sapiens
cagcccccgcaagacgccttccccgaggcgcccggctccgagcccgcctgctgtccgctggccttcagtgctggacccgttcaccgactacggctcctcgctcaccgtcacgctgcccgtcttgcggggtctg

SEQ ID NO: 568101 - DNA, 334 bp, Homo sapiens
ctcctcacagtccgtctgcctgttgtcattattgatggtcctctcccttgcatcctcacagtccgtctgcctgttgtcattattaatagtactcacccttgcattctcaaaatgtactagtttgtgttgataaattatatggtcaccctacttagaaggtacaaagaaagaataaaagaagaaagttcttcaccccatctcagaataaccaagatctttatctttgcatggtactaccccaaggcaattttttttggataccattttttaaccttgacatagtggatacatcatatattcatccatatatatttttcactccattaaaaaaaaa

SEQ ID NO: 568102 - DNA, 81 bp, Homo sapiens
ccttttttttccccccccccgggggggctttttttttcggccccctttgttttttcccccaaaaaacctctttggggttta

SEQ ID NO: 568103 - DNA, 476 bp, Homo sapiens
tgaggtgtgccccctccctagattctcacagcaagcttggctgcaggtggggacggcctgatttttctcccattatgtacgtaagaaaataggctctagggtgggacctccccagtctcccagatggaatgtggtgagtccaggttcaggctcagtcagggctctcctgagaccaggacccacaggatgaacagatatggagacagttacaaggattctggaggctcagaagccccaagatctgctgtctgcaagctggagacccaggagagccagtggtgcaagttccagtccaagggaagaccaatgtcccacctcaacaggccagtgtcaggtatggtggctcgcgcctgtaatccgagtgctttgggaggctgaggtgggaggatcgcttgaggctgagttggagaccagcccgggcaacatagatgaggccttgcctcttcaaaaagtaaaagtgtggtggcaaacgaaaa

SEQ ID NO: 568104 - DNA, 1149 bp, Homo sapiens
tgggaaaaagtcatggaggccagggggtgggcttgaaaccagcttggggtccaggaatggcaagaaccagcaaaaaaatcaccattgtgcgtgacgtggtggacaacttcgaatataagttgtgacgtgtggtgtttaattcttaaccaccagaatcatttccttcgtgatagcctcaggagaagcaccccttccaccgccatttgtgcctcgacagatatctccttaaaattcttgtgggtgctctcttcgctgtggcagttctccctttgtggggtttcccagtgttttctccttgtgttctccctctcccatgtgcctatagccgtggtttgtggcagaagtttataaagtttatagtgcattatattgaaaacacaacaaaaaacaaaagagggggggcggcgcgcgcctctcctataagagatattatctccgcgcgcgagaggggggcgcaccctaggagctcttttatcagcgcggcgatataccccacgagagtaatttcttgtgtgtatacacacagaggggggggctctcccactatatataggcgtgagacggtctgcgcatatttatataatagacgccaaatagagcacaagtgtgagcgcgccgtgcgcgatgtatataccacaaacgcgctgtgcgcgatgaaacgtggtggggacaacacaccacgctgcgccgtataacccttgtggggggaacaccttctactgtgtggcgaccagacggcgaacccccctatttaactctctcgggagggggcggaggtgtgcggcaccatatacatgtgggggcgaacaaaactttattcccctataaaaaaacacataattttcaaaagagggctcctctataaggggggaataaaataattatgtacaacaccattttttatcaaaaagggggagggttaaaacaacgcgtgggggtgcgtatacaacccctttataacgtgtggtgcaaatattaatttgaactagagagagcaggcgtacttgtagagacaacaagatcttatgagggggatataaaaccgagggaacagatactatatcgactattttagcagaggaaaaaacacatagtcattttcaatttacgcaaggcggaagtagtatgtaagagagagaaaacaaaggc

SEQ ID NO: 568105 - DNA, 219 bp, Homo sapiens
cagcctcccaaggtagctctcttaggttcaagcgacaccttctgcctcagcctacccaaagatgctgggattataggcatgagaacaacagcctgcatgtattcttgacaagggctcgaagattaacatgaggattgcaaatatagtctccctctctatggttggccttatttccctcttagtggtgtctattgattcgttctacatataaatcacttc

SEQ ID NO: 568106 - DNA, 664 bp, Homo sapiens
attactaacccaaaaaacacctgggttgtcttaccaagacactttccggaatgccaggaatttatcacttttcgcagacaaaaattacgcccccacctttttttgaatgaaaacccaaccttgaccacagcccggggccaaaggcctcactctgcgaatcccagtgggaccaagcctcataaaaaattggcctcaacaacaactagggtttactggtgataattacagtttagaaccagggaggccacagagcccagctcccatgttctcgtccctatgtcctgaccaatatggcatgtctcgtcattcggctgcattcggagtcagaccaagcggtcatgctagtttacgagccagtagttccagaacgtagatatatttcataaaaccaatgatcaagataaggaacacgcatcaattctcagtatatgtaagacacagcaagaatttacttatctcacataaaaagagcgttcgcatcgtagtaaaacaatagattgattttgagtttagaccccccatgccagatccctggtctagcagtatttaatcttactctggcatggtgtaaatgcgtgtaatgacacctctttgaaagattagtgtcttaggaacacttgagaccagatgttctattccagcatggacggcacccctagacccc

SEQ ID NO: 568107 - DNA, 167 bp, Homo sapiens
cacatggtgaaactcatctctactaaaatacaaaagaattagcctgtgtggtggcaggtgcctgtagtcccagctatcgtgccaattatcccaacttactcggtgaggctgcaggcaaggagaatcgcttgaacccgggaggcgagatgttgcaggtgtgcttcgcg

SEQ ID NO: 568108 - DNA, 1108 bp, Homo sapiens
gggcgcggtggctcacgcttgtaatcccagcactttgggaggccgaggcgggcggatcacgaggtcatgagatcgagaccatcctggctaacacggtgaaaccccgtctctactaaaaaaaatacaaaaaaaaattagccgggcgtgatggcgggcgcctgtagtcccagctactcaggaggctgaggcaggagaatggcgtgaacccgggaggcggaggttgccagtgagccgagatcgcaccattgcactccagtctgggcaacagagtgagattccgtctcaaaaaaaaccaagacacagggaaaaaaattagctttatacctcttccttgttctcaaccgccagtgaaaatttctgaacactccaaattcccgttgacttactccaaaaccaaacttttactacagttattacacatactttcacttcttcatagtaactagtactacctttaacaaagcctcagggtatatcatcttctaaacagctacaattcagtgcacgctactttaacccaactatgtcctctagtggagaaccacttaggccctatttcactgctgtgtacccctcagtgcctaacatgggtgccaacttaaatattccgtacgaattaccccctgaattgtacaaaccacattcgttctggttcaacatttggccaaaaattcctcaagtggcccctgtattcatgccacttcctttcgacatcattattcgatctaggcttcccacggctattggacgggccttgctcgtgcactctaaacacactatagatcccctacacacttcatagaagaaagcccttataagcttcaagtctgaaccactgacattgttacacaccccaacatcgtcctattcccatttctcctatacaagcggttcgtaccttcctcgtccaacaactcccatccgggggcgtcattatccccaacaacagcggcggtataacacacagtcgcggcgcctcagccaagaaccacagggttatcagaccactactgatgccacacttcccgcaacaatacatcggtgaaaactatatattcccgcacaagctattgaccaataaatttgatacaacaacatactcgctcga

SEQ ID NO: 568109 - DNA, 443 bp, Homo sapiens
cagagtccaattcaggaacacagagcagcgcttcctggctgtaaatcctagacttgaaagtgtaccagtattagaacaacttcaaagctgaagtatttttattcactaatgtatttaaatgttctaatcagcatcagaacagctgaaatgccctcctacaatgtcagctgtatgtcacacgagtagctccaacactttgagcatttcaagggagctggcctcatgatcactagagacaaagtctttaaagaactagttctaaaattgggcttgtgatttccatttctgatgtctccagataaggcaccccttctctagattcaatgcctcacgagatttgccaggggcatccaaggcaaacaatacccaatctttctatatcaaactgtattcaagcaaacatcaaataaatttctgggatatgtaaataagaaaaaaaccat

SEQ ID NO: 568110 - DNA, 114 bp, Homo sapiens
aacagtaattggaaatgatgaaaatgagtagtttacatatatttctatgatcatctcctaattcttacaatgcaaaatcttgaacaatcatggataggcgcaagctaagagttt

SEQ ID NO: 568111 - DNA, 360 bp, Homo sapiens
tgtattttgtgtttcttgtatctgagacaggttctggagtgcagtggcacaatcatggctcactgcagcctggacctccagggctcaagcaatcctcccgcctcaagcctcccaagtagctggatcacaggtgcgtgtcaacagacccggctagtttttaaaattttttgtagaaattgggggtctcaccaagttgcccaggctggtcttgaactcctaggctcagtgatcctcttgccttggacttccaaagtacttggattacaggtgtgagccaccacgcccaggctgccatgtgtattttttttttccaagacggagtctcgctctgtctaccaggctggagtgcagtggcgcaat

SEQ ID NO: 568112 - DNA, 467 bp, Homo sapiens
atagcctgccgcatggcagcacactcttaaaggcttaaacacatacgacctttcttcccataaaatctcaagtgagtgtaacttaaaattaccatgcaggcctccataaaaaggaggggctgatatatagcttgtgtgctccacacctctgatgtaggcatctcacaagggacacctgtaataggttaaatatatgctgggttctggggctcatgtgcatgctacaacagcgacaggagacacagcctttacctctgcttgtgtgaatgggcgatatgggtgttgcggatgttttacttcacgcaggggctgatttagaacatgtatctctagggtggtagaagacctttgttgaaagctgggagagctggtcctttgtgcgctgtgcagtttcttcttagcgcaggttgccctgtttacaggggtacagccactaatgatcatacaggagtgttgctgccactgcg

SEQ ID NO: 568113 - DNA, 341 bp, Homo sapiens
  misc_feature (74)..(74): n is a, c, g, or t
gagacggtgtcttgctctgtgccccaggctggagtacaatggcgcgatctcggctcaacacaacctccgcctcncaggttcaagcaattcttctggctcagcctcccgagtagctgggattacaggcgcatgccaccatgcccagctaatttttgtatttttagtagaggcggggtttcaccatgttggccaggctggtctcgaactcctgacctcaggtgatccgccggcctcagcctcccaaagtgctgggattacaggcatgagccaccgcgcctggccaacaaaatatttttaaacgcatagctgggcagaaagctagaaagggcaatcgtcgacgc

SEQ ID NO: 568114 - DNA, 252 bp, Homo sapiens
ttctaaaattgtgcatgactaaatcaaaattcaggttccttaaaaaagaaagatattattttccatctactaatatactaatggatagatatatacagatatattgattctttggaaaaaaggaatcactaacaaaattaaacagaatgcccgtcttcacaaaaatagatgtattctgcacaatattacagtaggtaaggaaagaaatctggaagaaatactggatcacctgagtcctctgtctcccacctc

SEQ ID NO: 568115 - DNA, 252 bp, Homo sapiens
  misc_feature (187)..(187): n is a, c, g, or t
tggacagtctcgagctcactgcaatcttcacctcctgggttcaagcaattctcctgactcaacctcctgagtagctgggattacaggtgcccaccaccacgcctggttaattttttgtatttctagtagagatggggtttctgttattatggaccagcaaatagaagcttcttcaaagcctatttcnacaaacttctacgcctactatcattaggataccttttttttttggagagacagagtatctagctc

SEQ ID NO: 568116 - DNA, 184 bp, Homo sapiens
gcagatcgaatcgagccggtaccccgtagtttagaagtctcactagcagacatctgtttcaccacttctttggcttggtctgcaggcccagacggagctgcttcgctggcgttatcgcctggggtttcctagacacgggcctggtgctggtggatatccttctcatgggctggtttgatgatgg

SEQ ID NO: 568117 - DNA, 504 bp, Homo sapiens
ttcagaggatccgaaaagtgagatagaggcaggtagttctcctcgagacagaaaattaccagatggaagtccatggcatggatggctcacgcctagcaatcccaggcatcttggagaggccgaggtgggcggaccacctgaggtcagggtcttggaagagattaatgtcaaagaagggcctgaagtttcaagtctgttaccttcaaggtaagatctctttccagtcatggttcccaaatcaattattgcttgttcacttgacttacaggtcacacacatatatctatgagattgaacaatagtcataaaaatctatgaagtgagaaagttgataatcagcatcttaatcaacaaacatgaaaatcaaattccaggaaaaaaaagtagggattcacacggcattggctatagtggtacccagagaagtagctgagtgcaggggctgagatatgaactcgggagtcaaggtgcctgggttcaaatctcaggtttactagttaccag

SEQ ID NO: 568118 - DNA, 233 bp, Homo sapiens
agtattggactttttatcaaattgtatcaagcaactttcataacagagcactaaagcaactttgatacaggatattgaaaatccctcaggcggggcacagatcgctcacacctgtaagtctcagcactttggaagggccgatggcgggcaagatcaccttgaatgttagggagtatcgagaccacgcctcggcccgcgttggcgataaccccatctactactcaaaaataaca

SEQ ID NO: 568119 - DNA, 227 bp, Homo sapiens
cctagttctgctccgatgagactcatcccaatctttcttctttccctgctgtctgttccttcagtctccaccccaagctctgagtcctttgaatccttattttctatggactcatctgacctctccccttctccctgggctgctcctcgccaggccgagcccggtcccaattcttcctcagcctctgctcccccaccctataatctttctatcacctcctctcctca

SEQ ID NO: 568120 - DNA, 147 bp, Homo sapiens
ctgtctagaggatcccggtagcacagagtctcgatgccataatcagaacacactttttttccctttccccctttattttcctccttttctttctggaaagtttccttttatgtccataaaatacaaatatatggttcggggtaccgg

SEQ ID NO: 568121 - DNA, 306 bp, Homo sapiens
ccatccagcttgctgctgtaacagaagacaagtacgaaatactgcaatctgtcgacgatgctgcgattgtgataaaaaacacaaaagagccttcattgttcctgaacattcaacttacaatccctgttgttagaggaaggaattggggaaggtttagatctgggaaaacgctctatagagtacaagcgcccccccgacgcgtttctggcacagcacaggatatctcttctctgctcctgcgcgcccctcccgacacgacaatgtggtcacaggacagagccaacgggtgctggagtctggtgatca

SEQ ID NO: 568122 - DNA, 232 bp, Homo sapiens
cgacggtctttaccttgatcacatcggcttcgagcatgacctcctctatctcgatcctgaccaggctgatattggcgcctggacggcctagaatttccgaactcagcgaactttcggccagctcggcagcagataggtataggaggtttcgctgatctccttgtgcatattttttgcaaggctgacgtagtaggcactttggtgggcgtatacgggtagaacatgacgcttc

SEQ ID NO: 568123 - DNA, 437 bp, Homo sapiens
  misc_feature (62)..(62): n is a, c, g, or t
agaagaccttatacagcttgccaggaaatactcctcccaaatcttgattcattctttgattntattaattgtaaattacaacttattttcatagttttcatgtttttaagataaagggccaaacaccttttccttattaaaattggaaccttcttttaagggaattcactttgtttcctttttggtaaccaatgggcaatttttggacacaattatattaataatgacatatacaaaggggcttgataacccaatctaaaattttccttctgcaggtccatccttaagtgattgtaaaggtttcaccttttcaattaatggtaatgggttaattgaaccattattttaattgaaaccaggattaattaagtaggatccttcaccttgacttattaatatttccatttttaatcttgaatgtttttgtctcccaggcc

SEQ ID NO: 568124 - DNA, 837 bp, Homo sapiens
  misc_feature (582)..(582): n is a, c, g, or t
  misc_feature (589)..(589): n is a, c, g, or t
  misc_feature (608)..(608): n is a, c, g, or t
  misc_feature (610)..(610): n is a, c, g, or t
  misc_feature (613)..(614): n is a, c, g, or t
  misc_feature (630)..(630): n is a, c, g, or t
  misc_feature (645)..(645): n is a, c, g, or t
  misc_feature (666)..(666): n is a, c, g, or t
  misc_feature (672)..(672): n is a, c, g, or t
agcggaggaccagcaccggctgtaccagcagatcaaagccggcgcctatgatttcccatgcgtccggaatgggacactgtcagccccggaagccaaggatctgatcaataagatgctgaccattaagcgccatccaaagcgcatcacagctgccgaagcccttaagcacccctggatctcgcaccgatccaccgtggcatcctgcagtgcacagacaggagaccgtggagctgctgaagaagttcaatgccaggaggaaactgaagggagccattctcaccacgatgctggccaccaggaacttctccggagggaagagtgggggaaacaagaagagcgatggtgtgaaggaatcctcagagagcaccaacaccaccatcgaggatgaagacaccaaagtgcggaaacaggaaattataaaagtgacagagcagcgtgattgaagccataagcaactggaggatgtacgagtcctacacgaagatgtgcgaacctggcatgacagccttcgaacctgaggccctggggaacctgggttgagggcctggactgtccatcggatctatttgtgaaaacctgtgntcccggnacagcaagcccgtgcaacnancanncctgaatccccaaatncacctgatgggcgangagtcagcctggattgcatanatccgnatcacgcaagataaccatgagagccgccaggacgggcatccccacagcgaacgcacacaagtcggacgggagaccccgggtcatttgccagccgccgagcgaacgcgtgaaatgggcagaactcggtgccaacttaacagaacagaacaggagagaacacaccaa

SEQ ID NO: 568125 - DNA, 870 bp, Homo sapiens
  misc_feature (615)..(615): n is a, c, g, or t
  misc_feature (622)..(622): n is a, c, g, or t
  misc_feature (641)..(641): n is a, c, g, or t
  misc_feature (643)..(643): n is a, c, g, or t
  misc_feature (646)..(647): n is a, c, g, or t
  misc_feature (663)..(663): n is a, c, g, or t
  misc_feature (678)..(678): n is a, c, g, or t
  misc_feature (699)..(699): n is a, c, g, or t
  misc_feature (705)..(705): n is a, c, g, or t
agcggaggaccagcaccggctgtaccagcagatcaaagccggcgcctatgatttcccatgcgtccggaatgggacactgtcagccccggaagccaaggatctgatcaataagatgctgaccattaagcgccatccaaagcgcatcacagctgccgaagcccttaagcacccctggatctcgcaccgatccaccgtggcatcctgcagtgcacagacaggagaccgtggagctgctgaagaagttcaatgccaggaggaaactgaagggagccattctcaccacgatgctggccaccaggaacttctccggagggaagagtgggggaaacaagaagagcgatggtgtgaagaaaagaaagtccagttccagcgttcagttaatggaatcctcagagagcaccaacaccaccatcgaggatgaagacaccaaagtgcggaaacaggaaattataaaagtgacagagcagcgtgattgaagccataagcaactggaggatgtacgagtcctacacgaagatgtgcgaacctggcatgacagccttcgaacctgaggccctggggaacctgggttgagggcctggactgtccatcggatctatttgtgaaaacctgtgntcccggnacagcaagcccgtgcaacnancanncctgaatccccaaatncacctgatgggcgangagtcagcctggattgcatanatccgnatcacgcaagataaccatgagagccgccaggacgggcatccccacagcgaacgcacacaagtcggacgggagaccccgggtcatttgccagccgccgagcgaacgcgtgaaatgggcagaactcggtgccaacttaacagaacagaacaggagagaacacaccaa

SEQ ID NO: 568126 - DNA, 203 bp, Homo sapiens
cagaccgtctttcccctgactactaaggtactgggacgtcagcgtcttcaaggtctatcctctaatgaacctgtatcgttaatggggaggtttagcccgtggtggaggaagtcccgcgtactctggtataatttaagataaatgataaacaattaaataaaaaggcagtcaatacattttatttgtatgagaagaaggagggg

SEQ ID NO: 568127 - DNA, 162 bp, Homo sapiens
gcttctctccatactcctaagggactttgcagacacccaagccactgggacccctgctaacacatgcaggtcttctttttctgccaactaacggtgctcggctgccctccccagcacgttgagagcttcagttttcagataaacacggaagcgacacataga

SEQ ID NO: 568128 - DNA, 402 bp, Homo sapiens
  misc_feature (187)..(187): n is a, c, g, or t
  misc_feature (386)..(386): n is a, c, g, or t
gaactggagcctggttttctccatccatcctttcttctctgggggccactggtggtggtggtgtcaaaagaccctttgcagctgccttaaaattctttagcatgtcagctatatttacagtgcaggaatatatctgtactgccagaaggttactgcattttagctttagatccaataggctgaaatnactgcgttccagagtccctgatgtagcacaaatatataattaaaattgcttgaaaggaaacatgaaagaaacaacaaaccttccattcttgcagtaataaaattaaaaacaggaaaagtctgcacagacacttaacatttgtctgcagtgaaaggcttttgttattgcttttcccctaagggtttcgcgtttccagagnaactggccgcggattg

SEQ ID NO: 568129 - DNA, 374 bp, Homo sapiens
tactgtggtgtaccgtctttcctttccaatagttcttcatgggtgctctttccactactgtaccgtgttcgaaaccaataatgacgtctgcagctctgaccgtggataggcgatgcgcaacggaaatgattgtgtgcccatgttggatctgtaagcatgtacagggcaccattaagagaggctgtaagagtagacgatgacatttggcaggctcagaatccaaaagtaaggcaaaccctcagtccctaggaacatcctttaatggactgtgcagaaatgccagcctacttagaaaatgccagcagcctttcctgtggctaaaattcaccatcacacgttggtcctatgctgctatcaatcaacagctaaagacc

SEQ ID NO: 568130 - DNA, 248 bp, Homo sapiens
agctcggaaatggcgggatttggtgctatggagaaatttttggtagaatataagagtgcagtggagaagaaactggcagagtacaaatgtaacaccaacacagcaattgacctaaaattagttcgttttcctgaagatcttgaaaatgacattagactttctttcctgagtatacccatcaactctttggggatgatgaactgcttttggtacaagggtctaagatctgtatactatattgctgtagc

SEQ ID NO: 568131 - DNA, 371 bp, Homo sapiens
  misc_feature (153)..(153): n is a, c, g, or t
agggtcttttgggtgcaacaggtgccccggcgccccttgcccctttctcaaagatttccaaacccaatttaaacctgggaactgggccgtgtaatgggaacagttacaaccctttttcaggcccttaattgccatgcaaaggccctcaagtgnccctagggaaaaagcaaaaaactttggggctgcaccctcaggattaggcaaaaggaagggtaagggaaaggatggggcccccaaggaaaaaccaggttctgctcaccaaaggatatgggtgggagcgaaagttgtaacaagtgggggtggggggtgcgggcccccccccctgctcctttactttcccgtttcctaataaaacctggttccccctttca

SEQ ID NO: 568132 - DNA, 119 bp, Homo sapiens
ccagatcaataggtgggtggacacatgagttggaagtctataaagagaacaggaagatatgacgcaaaggtgagagatgtggaggaaaggtgttgaaagtttgaggggaaaagaccctg

SEQ ID NO: 568133 - DNA, 865 bp, Homo sapiens
  misc_feature (509)..(509): n is a, c, g, or t
  misc_feature (711)..(711): n is a, c, g, or t
  misc_feature (776)..(776): n is a, c, g, or t
  misc_feature (799)..(799): n is a, c, g, or t
  misc_feature (855)..(855): n is a, c, g, or t
ctaacccaccaaaagggcctacagcccatcgtaaacaagctctgctcatgcagtcttcttagaccaacacactctccatataacacccctatcctccctgttaaaaagtctgatggctcataccgactcgttcacaacctccaagccatcagtcaagctgtcctccctattcatcccatagtccataacccctatccacttctctctctcgtcgctaccaacaccaccctctacactgcaattgacctgaaggatgccttctttaccatttccctacaccctgattcccaaaacctatttgctttcacctggactgaccctgacaccctccagtcacaacaactcacatggactgtcctccctcagggcttcagggatagccctcatttctttggacaagctctagcccgaaacctcacttccttaaacctgtctcccagtcatcttcaatatgtggacgaccttcttctttgcagcccctctctaaaagactctcaaactcacacggncactgctctcttaaactttctcgctatcaaagggtatagggtctccccctccaaggcccaactctccatctccatgatgacttacttaggaattcaactttcccctggggcccaggctatgactccagccagggcagcattaatagaaaatctacccccacccttcttcaaaagcgaaatcctttccttccaaggctagcangcttctttagaatatggatttccactttggccttctagctcatccctctatgaagtgggccaaangcccttccaatgaacccctaaancccttacataacatactcccaactttcacaaacttccaaactggtcttggcactgngtaagttcgg

SEQ ID NO: 568134 - DNA, 146 bp, Homo sapiens
aggatcacccggaggcggatgtagtgcagatagtctcggggatgacaatggtcctctgcatcttcatctggtcacacggcagagaggatcgcgccgtcgtaatggagacattaccagtgaaggggcatttctggtcaatgtaggtg

SEQ ID NO: 568135 - DNA, 905 bp, Homo sapiens
  misc_feature (630)..(630): n is a, c, g, or t
ggccgccgccgccgccctctcggccatcgctgcctccgccgctgctccacctcgagggacgcgagcgggcggcggggctggccgtgagagagacaggagaggaaggagggcaggggcggagttgcccgccttagcccccgccccgggcgggcccgggccctgcccggcggcctgccggcccaccgagccctgtgtggagtgtctggcggccgtggggcccccgcagcagcaggtgcaggatggccatcagaaggtctgggcggcgctcgaagtggcgctccgcgagtgcacatgctttacatcatcgacgccatcttcaaatcctacccggattccagccaaagccggttctgcatcgtgctccagatcttcctccaggctctttggtgtatttgcatccagtattgttcgtgatcttgtcagcaaacgatcacattttcaagtttttacaagcagtacagctcagcctttctgttaggctgcaaacttcagatgttggtgaattattatgcttctttgcacaattgagttctatggtgcctacaacacgtcagggttttggaattgagctgcttcctcggaaaaggtccctcgctgtggatggcacttatcgtatctacagataacatntggaattggatacgttaagagtaatcagaattcacttacaatctattcacaaaataattaattaagtatctagtgagttctgtactaggcttatcaaagagattacattacaaaatagagaaaattattgttatttttcttatttcgactaagtcagtgttggcttgcaagaagtgaggggtaatagtcacacagaatgtcacttttggtgaggaatttcagatttgggtcggatgaagagaatgaagcgaaacttgaataacgatatggaagga

SEQ ID NO: 568136 - DNA, 183 bp, Homo sapiens
gacagcacacctgtacctgacagtggtacgagtaccactatgcgctgcccctgggcctgcaagaagggagccaagctgacacctagacgaagaagagatatttacacaaaaaatgatctaaaaaaattcagaagaaatatgatgaaaggaaaaagaatgacaaaatcagcagtctcctggagc

SEQ ID NO: 568137 - DNA, 1453 bp, Homo sapiens
tgggtacttttttggtaaaggcggggttcgccccgttgtgcccaggcgtggttctggaacctccgtgagctcaagcatatccatccaccgtgcctcggccttcccattaggtgcgtgggactccaggcgggagcacagcacctagcccctttcctttccgtggtgtcctcgtggtgaaagtggaggtttgggaacgccgaagacaccacgtgaacagttcatcagaatcaatgtgcgaaaagagcgcctcgtggtgtgtgcctcccggagaaagtggaacacaggtgtgtttgcagacaggggtgtaagaaacccccaagcttctgtggggacaacccgaaagtctccacgtgtgagcttcactttaactttaagccaagacaacttattcgacacttttgaagccaacacacgtgtgagacacccgtggggacagtgagagagaaagtgtatcgtaggtgagggcctctctctcggcgtggtccgtgagtgtgacccactctctgtggggggaggagagagacaccccttttatacatccactcccagtgtagaatcactcagtgggtgagcactaaagttggcctctccagcttccccccagtgtggggacccccaagtgtgaaacacccctttctaaagagagccgtgtctcgaggggcacccgtggggtacacacacccaagcttttgaaggggcaactcacatgtggcgcaccatacaagagtgcccttctctcaagaaacctttcccacagagaaagggtcgtggtttcccccacaacaaggaggcgttgggacaattgcccgtgaaagtgggaccaccgggctgatgctacagcatcggggggaccctacaattttcccgaagtttgcaaccgattttcccaaaccagggatttcgtgatttgcccctccacaggggggcacgaataatccaactcccacgggaaactacacgccgggcaggcgcaaaacgagcagactttatgcccactatatgagcaggcacccgtggaccctcacagaagccaaaaccccagggaggggccctcccccattgaaacaagaaaaagagggcgcggcgaaaacacatctcagcgaaacgcaataccacgctggggggcccaagggagtaaaccaaatgcacccaagaaacacaagggggtgttcccacaggacggatatcccctgtacgaaccaccgagacacacaacagcacaaagaagcacccccaacctgcggaatgaggaaaagtacacagcggagctgcaaagacccaagacacagacagagaagcaaggagcacaacccaccagagacccacgacaaggagtacccgcatgagagaggagcacaacaaggccacaaacaccgggggcaaaaccacacaccgcagcaccagcaaagagaagaacccactatcgacaaacacagcaacacctacagaagcc

SEQ ID NO: 568138 - DNA, 840 bp, Homo sapiens
tccctctcagcccttggtctaggccggtgattctcgtcctggcctttttcgggaagaagtcatagccctgtgccggtgcgatgccgagtccgtgtatcgggacggggcggggtcgggccgtgagaggaagggtaaacggggacccccttactttgaggaccccaagtagattgttgaccctctgggacgtttgccacaggaccctcgggtcttacccgacgggagttgatcaagcccatccatgaaaagtttgctgggtcttctggctgggaaggcaccgaatcgctgtagaacccgaagcccaaaccatctgggagatttctttggcatgtcccacagttatgcagagtgctaccccgccccgatggatgacatggctgtggatagtgatgaggaggtggattatagccaaatggacccgggtgaccagaaggggcccttaggcccttgggactttgataccccggaagataacacgcgagtatatgaccaccaagaagctttgccccaggctgcacttcccgtatggtatccaaatgtctgaagggcggagaaacccggcgcttcaaggagaacccatgaccaagcacgagcttgagtcgcccgtggaagaagattagtgccatccttgagaagacggaagaagatggaagctgatggggttgaagtccaaagaccccaatactaatcactagttaccacccgagatgctccccacaggatatgctcccccctgttttctttctaccatttcccaaggttgccagatgtttttttgtggatgaatataaaattttattgtgtaattacttggttcccttaaaattggttaacttgcca

SEQ ID NO: 568139 - DNA, 328 bp, Homo sapiens
aaaaagcctttggggttttttggccccgcccgccaaaggggtttggccccttttaaaaaaaaggggggccccttttttagggggggttttattgggttttttttaaccccattttggggcccgttttgtttgggggggtttcccccccccgccccccacccccgggggttgtttttttttgggtaacccccccccggggcctaagggtgggggtttgctttgttttttggggggccccccccccctttcccggggccccggcccttttttaccttttttttttcaagggctttttggtttttttttttttttacccaggtttggggga

SEQ ID NO: 568140 - DNA, 898 bp, Homo sapiens
  misc_feature (89)..(89): n is a, c, g, or t
  misc_feature (203)..(204): n is a, c, g, or t
  misc_feature (207)..(208): n is a, c, g, or t
  misc_feature (378)..(378): n is a, c, g, or t
  misc_feature (391)..(391): n is a, c, g, or t
  misc_feature (416)..(416): n is a, c, g, or t
  misc_feature (422)..(422): n is a, c, g, or t
  misc_feature (457)..(457): n is a, c, g, or t
  misc_feature (491)..(491): n is a, c, g, or t
  misc_feature (508)..(508): n is a, c, g, or t
  misc_feature (511)..(511): n is a, c, g, or t
  misc_feature (515)..(515): n is a, c, g, or t
  misc_feature (524)..(524): n is a, c, g, or t
cgcccacgcgtcgtggatataccgggactcatgcagcttggtagatatctgagaaatggtttaattcatgctcaggagctgtgtgcctntccatcccttccggctccctacccctcacttccaagggttctctctcctattgcgcttagtgtcctacatggggttgtgaagcgatggagctcctcactgcactcgcctctctnntcnnccccccccaggaggaacttgaaaggagggtaaaaagactaaaatgagggggaacagagttcactgtacaaatttgacaactgtcaccaaaattcataaaaaacaatagtactgtgcctctttcttctcaaacaatggatgacacaaaactatgagagtgacaaaatggtnacaggtagctggnacctaggctatcttaccatgaaggntgtttngcttattgtatatttgtgtatgtagtgtaactatnttgtacaatagaggactgtaactactatttaggntgtacagattgaaattnagncgcnccattggcngtctgaggaggtgtggactgttatatatagatctacataaaaactgctacatgacaaaaaccacacctaaagaaattttaagaatttggcacagttactcactttgtgtaatcctgaaatctagctgctgaatacgctgaagtaaatccttgttcactgaagtctttcaattgagctggttgaatactttgaaaaatgctcagttctaactaatgaaatggatttcccagtaggggtttctgcatatcacctgtatagtagttatatgcatatgtttctgtgcatgttctctacacaattgtaaggtgtcactgtatttaactgttgcacttgtcaactttcaataaagcatataaatgttgaaaaaaaaaaaa

SEQ ID NO: 568141 - DNA, 871 bp, Homo sapiens
ggggtccagagcagactcattcaacacaggtatacgggatactgatcgcgatgcgatacgccgatgcgagccgcatgcgcacgatcggtcgggcgcatcgcgcgcgcgattaacgatatcggggccgtatgcggcgcgcgagcggcgcggctatttttatttttattatattactgatagcgtagcgatcggcgcgattcgcggtatataatattcgcgcgcgatatctctctctgtgttgtatagaatctctccgcttatccgcgtcttatacggcgatctatcggtgtcttcgcgttcatctagctatcgttatgtagttagattcggctatcgatcgagctactgatcgatctcgatgcgatgtatgctatctagcgcgatcgcgcattcagcgatgcgtagcgctacgacgcgcgctgtgcgtcttctcgtgctcatattcgcgatgcgtgcgatgcacgtagcatgatctagcgacggatagtaggacgcagagtaggagcatggggtatagcgtagcggcggagggcgcgattcgggcgcgctaataagcgatatcgggcgctagcgataccgcgcgcggcgcattatatacgggctatgtacgtagcgatcgatcgcattattaatttacgggctagcggcattattagcgtctagcgcgcgctagattatggcgcgagcggcattagcgcggatcggatcgtacgatcgctagcgtttagcatgatgcggggcatctatggattagcgggttatatcggggagctatcgatgcgatttaggcggctatgcgcgcgtagcgagctgcggagcatgcgcatgctaggatcgcggcgcgcgagggaaaaacgtctcgtcaaaaaaa

SEQ ID NO: 568142 - DNA, 294 bp, Homo sapiens
ggctttacattctgcagaactgaccctaggttgttgctacccgatatggttgggctgcgtccccacccaaatttggatcgttgaagtgtagttcccataatccccatgtgtcgtgggagggacccggtaggaggtaatcgaatcatgggggcaggtttttcccatactgttctcgtgatagtgaatacatctcactaaatctgatggttttataagagggcagtttccctgcacgtgctctcttgcctgctgccatggaagacataccttttagctccttctttgccttccacc

SEQ ID NO: 568143 - DNA, 838 bp, Homo sapiens
  misc_feature (8)..(8): n is a, c, g, or t
  misc_feature (76)..(76): n is a, c, g, or t
  misc_feature (78)..(79): n is a, c, g, or t
  misc_feature (81)..(81): n is a, c, g, or t
  misc_feature (143)..(144): n is a, c, g, or t
  misc_feature (147)..(148): n is a, c, g, or t
  misc_feature (318)..(318): n is a, c, g, or t
  misc_feature (331)..(331): n is a, c, g, or t
  misc_feature (356)..(356): n is a, c, g, or t
  misc_feature (362)..(362): n is a, c, g, or t
  misc_feature (397)..(397): n is a, c, g, or t
  misc_feature (431)..(431): n is a, c, g, or t
  misc_feature (448)..(448): n is a, c, g, or t
  misc_feature (451)..(451): n is a, c, g, or t
  misc_feature (455)..(455): n is a, c, g, or t
  misc_feature (464)..(464): n is a, c, g, or t
taattaangataaggagatgtgtgaatttaaataaattaaggataaataaaaataaattaaaagggttatatatananntngagattagtgtcctacatggggttgtgaagcgatggagctcctcactgcactcgcctctctnntcnnccccccccaggaggaacttgaaaggagggtaaaaagactaaaatgagggggaacagagttcactgtacaaatttgacaactgtcaccaaaattcataaaaaacaatagtactgtgcctctttcttctcaaacaatggatgacacaaaactatgagagtgacaaaatggtnacaggtagctggnacctaggctatcttaccatgaaggntgtttngcttattgtatatttgtgtatgtagtgtaactatnttgtacaatagaggactgtaactactatttaggntgtacagattgaaattnagncgcnccattggcngtctgaggaggtgtggactgttatatatagatctacataaaaactgctacatgacaaaaaccacacctaaagaaattttaagaatttggcacagttactcactttgtgtaatcctgaaatctagctgctgaatacgctgaagtaaatccttgttcactgaagtctttcaattgagctggttgaatactttgaaaaatgctcagttctaactaatgaaatggatttcccagtaggggtttctgcatatcacctgtatagtagttatatgcatatgtttctgtgcatgttctctacacaattgtaaggtgtcactgtatttaactgttgcacttgtcaactttcaataaagcatataaatgttgaaaaaaaaaaaa

SEQ ID NO: 568144 - DNA, 1068 bp, Homo sapiens
caggacccacctggtggtcgtctgccgggtttcatgaggggcccgagcagaagcaggatagttgctccggctctgctggaaaatttccccagacctgagctcccctccgaccacatctgttgcaccattgctctcattcatggcctcgtaagtgatagcgttgactgtccatacgaatcggcgcgctctcatagtctgtattgatgggctctctcacctacagcaatcgggaggcgaaggtcctaattattacaggatcactctcgcctacctggggaacagcctgtagaagcggtggcgtggttaatgccatcctggcctgtgtcaaaatagtaggcaggcaggcgcatgacaataggggtaggatcgcgtccgcggtggagggcctaacattaatttacttctgtacgcggggtcacaggaatattccagatagcttttagctatccggcagtcccaataacttggggaccggatcgtaggttctcatgaatcattggggacgtgttgatctagccatcaaagtccgcttgcgcatcgacaacagatgaacgtattacacgtattcgagcatatcgagtccatatgccccttccatgttatatggataggcccttaggcagcgaagccaccgttccctgatatcttttggcactgaaaatggagatcggaggataatccctttagggagtcaacggcccgatcccgataaccatcgacccttccaaccccgttacatacaacaatcaagaacgacggccgtcggtttagattcttattaccctgctctccttaagtgacatttaccaagtagtcttcacccagaactctgagggcgaaccagacaaatgatagcctgagggcaaagccctgtaaacagcgcttcccaaattgagccgaactgaattgcctatacggctacacgaatcatgcgattcggcctaacgaataggaggcgtgttgtcctttagtatcagccggatcgagaagaaccatactcaatttggacacgagggtaataggccaaaaggcgacatatgaacaggggaacccttaaggaaggggcgc

SEQ ID NO: 568145 - DNA, 158 bp, Homo sapiens
cgtgtgatcaccaccatagagtagcacctcatcgacagtactcccagattcactttcttcgattgccaccacgtgagaccacctcacacactcctcccagcttcacttctttgatcactaccaccgagaacccctcacacagtaacggcgtaaggctg

SEQ ID NO: 568146 - DNA, 324 bp, Homo sapiens
gcctcccggcgcagtcaccggtgcggtctatggctggacttctctaatgtctgctttggtgcccggtgctgcagccgcgcacagtgctcccttcgccttcgccctttccacctcgcggcagttcggaatcaacagtgagacaattatgaaagcagcttcaatttcagaggacgaatggtggattcaatcaataaactgaataactgctgataatgtagatggtctcctgtgttcagtggcctcttccagagcatatggctgagagaaggatctggaaatgctgttctccagtacaaggcctgtcgatggcttccactgtcctcc

SEQ ID NO: 568147 - DNA, 1525 bp, Homo sapiens
  misc_feature (206)..(206): n is a, c, g, or t
  misc_feature (1219)..(1219): n is a, c, g, or t
tttttcccacaacccattttttttacccagggggtgtgggctgtgggctgtgtgatgtgttgggaaaacctttgggggttgggggcttgcaggaatgtgcagttagagcctctctctcctgtggcctcgtggtcgtgcgtggctcatagcgccagggtgtgggcgctgactcaagggcgcagaaagcgcctcaatctcttgtgggngagaacagaggagaacagaagaggcgaacagagagagaggcgcgcataaacaccttctttttctgcggccgagccggctgtggtgtagaaccaggagaccccggttccgccatgtggcgccgggtgtgtagatctccgggtgaaccagagagagaagaggggccgcccgcggtgtactcgtgtgtgttctcgccgcgcgcgcgcccagcgtttgttagagcccacgcgtataaaagagggcgcgccgtggcgcgcgccctgtggggcgccgccgcgggggggaaatttcgcgcctgtaaagcgcggggccccagcggggttatcaccattctcaagggggggcatctctgtcttccagaggggacccatctactatctcccacgagaaaccccggcgggccgcgggggggggcgcggcccccctttttcgcccacaggggggttgtctcttctcgcggagaatctcgcgaaatattcggggtttatagaacacgagcgcgaaaagcggggaagtcttgtggttatcccatttgtgcccgcgcccacgagaggggggcactttttttccacccgaggcgggggccccccagtcttttgtggggtcgtctcatgtgcgcgcggcacaatagaaagaggggcccccacaagtttctcccacacccctttgtgggcccaatgtggtggtggcctccccccgtgttgggtggggcgcccacccctatgttgccctaggtgaacggggggcctcccacactctcggggtgtgtgtgtcctttgcccctgtgagagcgagaaaaaaaacgccctgttggggaacaacaccctcgcgggtgggtcacacagtgtctttggcgcccccccgggggggcacactctccgacggggggcagaaacactttattgtgcccccaccccggggggtgtatacttcctttcccccccgaacaaaaaccacctcttgttgtaagacaacccctagctgaaagaggaacctcgctggttgtgttctttgnacaggcgtggtggtccccatctcaggggggctcccccagaggaggaagggagcggtaatcatccgtccctcattcaagggaccaaacgaaggagacgccgtgggtggtattagcagtatctgatctgtctgagcccttgataagcgtattgtgccccatcatatttttgatcaaaaacccccctttttttttggaagggcggggtgggccgccggggggctctccccccaaaattttctttcgtgcggcacacagagagaaatcctgtcgtggtgcccccaaattataatgggtggtggtgtggcc

SEQ ID NO: 568148 - DNA, 199 bp, Homo sapiens
atgcaggctgaactgaccctgggtgatactgctctctgcagccctttctcacccctggtcccacggccctggtctctcccctctgctagaatctcgctgagggattggtggggaggggtgtgatcacgcacgtgggtggagatctaggcgcccccgtggaggcctggacagagaagggccacgggcgggacaacggtct

SEQ ID NO: 568149 - DNA, 396 bp, Homo sapiens
cactccagcctgggggacaagagtgaaactccatctcaaaaaaaaaaaaaaaaaaaaagcacatctgactcagtgggctctgtgctctaacaagctcccagggaacgcgaggctgctggcccagggacccactgagaggtcctgggaagtacatggcagagcaaggacatgaacctgggccaaggctgtccagctccaaggcccacgttcttgctgctccacagccaagaatttcttccagattctctaaggcttttggcaagagaggctcacaccctggtattcccttcctctgtggctggaataacttgactgttctctgccttccctggataaaggtgtatcatgtttaaaaacaaaacaaaatacaacttaagcacatacttgcttgcagga

SEQ ID NO: 568150 - DNA, 569 bp, Homo sapiens
attttaaagatgatcgtaggtagaaggcattttataccgtgcagaattgaatcctaattttgacgttggtatacaacaaagattagtagcaggctgtagcgtgatcttagtgctgtacatgatgacaactggctccctctactgaactgccatgaggaaacgtgcgcagtgtcacccttctgattacagccacctttgggtttcatttaattttggtagtgttaatgtctattaatgtgatttttggttgtgttttaagcctttctcccaataggtggatgacaacaagaaagctaggagaatgggtaggccttggtaaaattgacagagaggggaaaccccgtaaaggggtgggttgcagtcgtgtagtacttaaggtaagtcaccgttgatcctagggatgaaggtctagtgctgggtaatcatataaaagcctgggattggaaataagttgaggatcttataaaggggaaaagaactgagttcagacaggtttaaagcattttctggagtttcaggaaaaaaataaagagctgtaatttacaagccagccaatgaatcggcttacc

SEQ ID NO: 568151 - DNA, 375 bp, Homo sapiens
agccccgatcagtcaggaaactgacatgagcatggtgcttgaatccactcacatttcatactaacgctacattttcttccagtcattgccatctggtacacgatactatgcaacttttgaactgtgcaaataaagaagaaaacagagaatataaacagatctcccaacatccttcccaggtaggattttattttgatgttttgcagtgatccagtggtgtttgcactacactctgctttgccttgcagctccccatgactgcaggccattcctgttgctcagtaggccccatatcagtctaactgctctgcatttgcaccttggactccagaacgttcctctttaggttcccatctccctgcacaggccctgggt

SEQ ID NO: 568152 - DNA, 810 bp, Homo sapiens
tctcccgtgtctgccatggcggagaagcagagagatgctagcgtaagagtgagtcccggtcaacaatctacagatgagtctgaggaagaacagagcgagagtaggaactccaccgctgagagtatggataggctttccagtggggtaagtgaactacttcagacggatgcgccctagctcgatggagagtcctctgactagttttgtgcttagggagcgagcatctgttagtggcgagagggtgttcatgttaactgtgtagtgtctcgagggtgaactatctaggtcgaagataggtgtggcatgtgagcgtgccgtgtgtaagtagtaagatctaggatataagctctcggagtgaccagatgggacgtagacatcactgtgggatggttgtggttgcaagtagcgactggatagaatgtgaaagggtgatttaggcactgtaattctaggtagcaatgaatttctaggtagactgttcagagctggttcgcctactatgaacaagtgtgatgttggctggtggcaactccaacgagttgtcggtagtacaatgcctagctctcgtcgagagacacgcttttcgtggatcccggatgggggacacgcataaactagacgtacctgtgttcgtaaacgcgatcgttgggactgtatgcagggatggcacagtctagtcctagaatctcggactgcaaagcgggacagggactcataagcgaagtgtgaagctgaaagacggaccactctgagtctgactgtggggcccaactaaataatgccggtgtgaataaactttctgtgaaccct

SEQ ID NO: 568153 - DNA, 883 bp, Homo sapiens
gtgaagatctggcacaagatagaatggtaaaaaaaaaaacaattttaaagtgacagtgccatagttgggcacagtcccttctcaatgataaatttaaatagcctgtgagtccaagtaaatgatcacttatattggctagggagggaagtcctaggggggttcagtttctcccagaatacctaaatttttacatcaatcctttaaaagaaaatctggtatttcaaagaatctttctctgcaagtaaatctcgcaggggattttgactataacacttgaaagtggttatgtgtaccctttttcgggcagcttttaaataggaaagttaaccgtttaaaacatggtacgtactgaaattttacaagagtttacctagcattaaactatgtctaaattgtaccttaaagacaaatagtaagcatgacctggggaaatggtcagaccctggaatggttgtttggccttgaaagtagcaggtggccagaatttgtcatggcaacaaggtttaaaacagagacccttaaaaatgaactgtctcaaatgttggggttagaaccagcagctctctggtacatgggctaggctggagttttctaagactgagtcaactcttatttttaagaaaagggaggtctggtttgtaattccttgtactaactggtaaaagttttttccaaacaacattatgtgtgaattggtagcattctcatggaatatagactgtgaattgggaagtcacgtattgttgggaagtgcaacattaattgggaaaaatttcttaaaaaggttttggctaaaacaaaaaaaaaattggggccaagtaaatgatgggcgaaaagaagtaaagagagggatcaaacgggattagttagtctatcagtgaaa

SEQ ID NO: 568154 - DNA, 185 bp, Homo sapiens
aacgcgcagtatgctggtcacagacgaagtgtggtggtgccctggctggctcctgccgggatgcccaagtcaggtactatcatcgatggggcagactccatgatgaccccatgcagccagacgaaccagcacatccttgagggctgaagccacgtgccaggacacgtcagcgtcaccagcatcgt

SEQ ID NO: 568155 - DNA, 189 bp, Homo sapiens
gcgtatcacattatacatcatattaacaagtagctcagaatacatattctggcatagtgtaaatatagactttttaaaataaaactgttacattgttttttgaaatgtatcaagtggtatgtaaataccgttaatgaagtgagtaataaccacacccaggtaaatctttggattatgagttatttatca

SEQ ID NO: 568156 - DNA, 127 bp, Homo sapiens
caggtgattggataggtagtggtggtctggaaggatgttgcagtcctgtctcttccacaggtcctatgactgcaacgaggcttccagaccaccactacctatccaacaccatgactctctcagacca

SEQ ID NO: 568157 - DNA, 142 bp, Homo sapiens
cattatcatcaacagttggtatgatggcctcaactgcactacccagcgggatagtaggtgtatctgcagataaggtctacatgctgtacttaaatagcctccaggtgaaagccagagttggtcgggctatttctggcttcct

SEQ ID NO: 568158 - DNA, 119 bp, Homo sapiens
tccctccatttattgaaaacttacaataaagttagaaaactcataagagattgactcatgtctgtgtgctgggaaataaaccacaggatccatgtgtatgttagatgcctgggggtgca

SEQ ID NO: 568159 - DNA, 185 bp, Homo sapiens
tgacacagaatctcactctgtagcccaaggtggagtgcagtggtgcgatctcggctcactgcaacctccacctcccgggctcaagcaattctcatgcctcagcctcccaagtagctgggattacaggcatttcactgaaagcagaagctgtctcagtccagaaagaattcgaagatccttattac

SEQ ID NO: 568160 - DNA, 344 bp, Homo sapiens
aacccaccaattttctagggattctacttatacatagctcttttttgtatagagccgtcaactaaagggggtctatttgacaccataattttaacaaagcataggataggtgttttgcatttgaaagagtcaagacttaacttgctcaagtgggatgaaaatagttcctgtgtcaatttgctgttgccttctatttaagtactgtatttacaaaaaaatcaaaaaatctaatacaatgtaaaattagaaaagaaactttaaaaatgcttatgatatagcaactgaaataaaaatctcaaaagaatgtcttcatactgtaaaatgcctggtccttcacgaatgaa

SEQ ID NO: 568161 - DNA, 470 bp, Homo sapiens
  misc_feature (356)..(356): n is a, c, g, or t
ggccttccaggccaagaatttagcatgagggggaggctgaggcaggagaattgcttgaacccaggaggtagaagttgcagtgagcaaatattgtgtcactgcactccagcctgggcaacagagtgagactcccatctcaaaaacaaacaaagaaaaagagaaaagcaccaggagacccaatgcagtggctcacaccagtaatcccagcactttaggaggctgaggcaggtggatcgtttgaggtcaggagttcaagaccagttgggccaacatggtgaaacgctatctttactaaagatacaaaaaaagtagctgggcgtggtggcagtgcctgtaatcccagctactcgggaggntgaggcaggagaatcgcttgaacccaggaggtagaagttgcagtgagcaaatattgtgtcactgcactccagcctgggcaacagagtgagactcccatctcaaaaacaaacaaa

SEQ ID NO: 568162 - DNA, 502 bp, Homo sapiens
  misc_feature (381)..(381): n is a, c, g, or t
gtctgaaaagatagaatccctacccctgatttggttgccccgtttgccttttttgtcagtttaaggtcactgtagttcaaattgtgccccgagggatgaagtggtcccggcacgggtggcatttctttcatgaatgaatggtccccttgtgtatgcaggtttcgcgtgcagctaggcagcatctccgcaggtccaggtagtgtaagccctcacctccacgtcccctgggacctcggcataggctgcctttctggccagatccaatcaccctcccgcgaaggtggctttcgcatgcgcttctgctccccagcgatctgaggagtgaacaggaccccacggacgaggtatctgccggggtgtgggccctgctctgatcaccanccgtggcgctccccagggccggagccggggcacccagcactgggggcgggctcgttaggggcggccgttgcgatgtatgtggcaaggtgttcagccagacgcagcaatcctgctgaggcac

SEQ ID NO: 568163 - DNA, 594 bp, Homo sapiens
tggtaaacagggcttggttgctggtggtccgggttaattgtttcccaaaatgttaatgttgcccttgccccatcaaaacaagggcagggcttcagtgtgtggtttgggcccccctggtttaaaggttgggatccactcaagcctccccttgtggggcctggggaaacctggccaaggttaaaaaaattgtggggtttgtagaacaccccaacccttttttgggggtggggtcgcctgggccccaaattttcccttatttttcaccagggggcccttttttcctgggacgggggggaggggaagggggaaggggggtttttaaaggccccgtaaaaaatggccgccccttaaaaggatttttaggggggtggggtggattttttttaaagaaaggggggggaaaaagggaggggaaattaattttcccttccttttgggcccgcaggaggttttggtccccaaattttaggtttcggtttatttgccaacggttaaactttttgggttgattgttttcccctgggggtcatgttttttccctgggggcccggaaattttttcccccctttttccaaggaaaggcctttaccccca

SEQ ID NO: 568164 - DNA, 359 bp, Homo sapiens
  misc_feature (171)..(171): n is a, c, g, or t
  misc_feature (198)..(198): n is a, c, g, or t
  misc_feature (214)..(214): n is a, c, g, or t
  misc_feature (332)..(332): n is a, c, g, or t
taaaatagcatagtatttgcatataacctacgcacttcctccctatagactttaaaccatctctaggttacttatagtattgaatacaatgtaaatggtatgtaataatttttatactgtgtttttttatttgtattctttttaaccattatattgttagtgttgtttctnttcttttcttttctttttttttttttnttttttttttgaggancttcacttggaggtattaaacagattccagttcttcgactgcatctgtgcgtgggtccctaacccagtgggcaccactgaggcctcatctcggtcctgaatcacaactttctggggtnaggtccagggccacctcgggctagaga

SEQ ID NO: 568165 - DNA, 190 bp, Homo sapiens
gcctgcatagacgagaacctggaggtggtgcgcttcctggtggagcagggtgctactgtgaaccaggcggacaacgagggctggacgccgctgcatgtggcagcctcctgtgggtacttggacattgccaggtacctcctgagccatggtgccaacatcgccgccgtcaacagtgatggagacctgtctt

SEQ ID NO: 568166 - DNA, 390 bp, Homo sapiens
cacccactcgctggcgtgccaccgggagcagagggcggctcggccgccctccactcagtctcagaccttggggcttcagaggcgtctaggctctcggaggaggcgcgggtcttcttttccgagagcaaatttctcggagatgctggcaggatgaccgcggccccggagaggacgggacagctctgatcgccgctgcgtgccccgcactgcccatggccaggaggccccaggaacggacagcccgactcttaggcgccgggacctcaggctcagatcagtggccgaggccccagagtttgcaactcagctctggagttcagcagcacagcagcaggaaaagcctgtcccttgtggggggcctggtgcctcgagagagacggccaagggtct

SEQ ID NO: 568167 - DNA, 939 bp, Homo sapiens
ggtttctctgacagtataatgatagctatgtgatgttagtttcaatgtcgatgctgggaactgatctatgaggtgcgtcataagccagcaaccgagcaccgaggaacacgccacgttgcagtacgtattagttatggaaccatttgcattcggtcagtttctaaagctttactctggtccttgtgcgatccggagcgaagtaatatagtgcttcgattgatgagttgaatgtgattgatggtccaataatgtgaggctgaggttatagaccttttggtcacacaagtttgctctgggaactgtctatttgttagagttatgaaacacataggatctaacatgaaagggtataatggtaggtggtgtacataatcttcaggtttgaaagtggacagaagttgtcattacagtttgtaaccttgttacagaggattgttcactatgtgcgctagcgtaggtgtcctagttcagttaaaattgcaaatggaacttagggggcctgaatcttaatctctcagatacagtgtatgtgtgtagcatgattgtttcagacttcttatgttgagcaagactcggatcttggacttgcgtagcccccctgttgcgcaagtttttcttcgaggctcatttgagtggcgactggatccaagaggaaggaagctagttttggtgaagatgtgggggctgttgagggactggactggggaaatactgggtcggtgcatttgtggccagaaaaagcgaacttcaccttattaccaagttaaaaccatgttcgggatcgcgagcttggtctccggaaagaaacctttagctaacccatggcttttgggggaaggaagggccctacctgtggatgggcaccagcttattcaaaagtgtcgagacgaaggaattcccgggaaataacctggcggtgacctgttccctatataaaag

SEQ ID NO: 568168 - DNA, 255 bp, Homo sapiens
cccctgcaacgtgtatccactttgggtctctacactctctgatagttacaacagagacccacagggatacagcaggaattagacaggtgatgggagagagggcacaaaggcttgtgccaggtgagcgactagcatactcaccggctacgtggtaagactaatcttgaggcatgagaagaacctggaacgcagtccactactgacctggacggaggacggaactaccacactggtaccgactgacggctggcgtgc

SEQ ID NO: 568169 - DNA, 621 bp, Homo sapiens
tgcaacgaacagggggtagttcaacggttccttgtgtgtgctcccccgaccggcaggtcctcggtcttgaatgttaagaccctctcattttttcggccttcccccccagactgtgcagggtaagaccagtttgggcagagtatgcttcacatcccagagtatgttgggaaatgtcactttctggttttacagcaattttttttctccctattgcttgacataatttctcagaggctcggaactaaactttaattctctcaaaagaattttttgaaacagtcttgctctgttgccctagttggtgagcactggtgcagtctcacctcagtgcaaccgcagcgttacacgtagctgggatttcaggtgagatccaccatgtcgccctaatttttgtatttttagtagatatggggtttcgtcacattggccaggctgatcttgaactcatgacttcaggtgatccacctgcctcggccttttaagagcgctgggattacaggtgtgagcccctgcactcagcctacttctttttcattaggatagactgatttctctctctagccgccagctcaatgggcaccgatgtgaatgctcctggtggggtgcggtgttgggtgttat

SEQ ID NO: 568170 - DNA, 196 bp, Homo sapiens
agaagatgccatagtttacgttactggatgtcaggagtagatactggtcagtgattggtggaatggagaacacacgtgtagatgcatctgggtagcactggtttgcataagtttatgtttccatgccagagtatgtgtgggcgggcgcatgtgaaacacagagtgcacacgaggggacattaagtacaggatacat

SEQ ID NO: 568171 - DNA, 830 bp, Homo sapiens
gggccgggcgcagtggctcacgcctgtaatcccagcacttgggaggccgaggcgggcggatcacagggtcaggagatcgagaccatcctggctaacacggtgaaaccccgtctctactaaaaatacaaaaaattagccgggcatggtggtgagcacctgtaatcccagctattcaggaggctgaggcaggagaatcacttgaacccgggaggcggaggttgcagtgagccgagatcgcaccattgcactccagtctgggcaacagagtgagattccgtctcaaaaaaaaaacgacaggaaaaaaaatatagcattatacctcttcctgtgtctcaaccggccatgaaaattctggaacactccaaattcacgttggaatattccaaaacaaatttatagtttaaaatattttacttcttatagtaataggtatattttaaaaaggcctcaggtatactatcttctaaacagttacaattccagggcaggttacatttaaccaattatgtcctctagtgagaacaaataggctatttcacgtgtgtgtagcctcagtgcctaaaaagtgggtggccaaataaatattcggtagaattaccctagaatgtgtaaaaccccattcgtttgtgtttaccaattggcaaaaattttcaaaggttctggtatttatgtaatttttggacatattatttatttgggtgcaggaaagagagggggggggactagtaatagtctcattttataaactctatatggtgtgtttaacaatcttccttttaaggaattttcaaccttgggttccaaaaggtttttggttgaacagtcaattg

SEQ ID NO: 568172 - DNA, 898 bp, Homo sapiens
ggggaaatgctggcgcgcgcgggcggggcactggggccttttgctgaggggctctctactggcttctggccgcgctcgggggccggcctcctctgggatggcccgcgaaaaccaccgggtggtactggttccgtgcagcagacagagagcgctcggggtgttgttggaacgcagaatgggggccggatttcccaccgggagattccgtggaaaccctgtggtttgggacacaattctcttacatccctcggtgttgttaacgacccgggatcccggaatttatgggtgggcccaaggaggctccctccacgggcaaacagttgggttccactccaccggggtggcccttgaacgacagaggtgcgggctgtggtgagacacctccttgcgcaccaatgtgggttatcatcttccgtgggacaaaacacgcgagaggggcgaaggtttcccttttgaaaaccgctgtggggcgcactatttcatggggaaccctcttttacaccacagggggaccaaacacggcccttaaacgcggggtggttgggaaacggggaccccccgctgtggtaagtttttagtggcacgcggattcacaacccaccaaagattagtgaaggacttacaaaaaaaagaaaagccctatgtgggaaaggaactccaagggaaggctgtgcggggcaaaaacagactcttcgttctgtccggttgcgcaccccaacacacggcttccttcccgcggggcgaaacgccggcggagaacgttttccccccgtgtgaaagatgttggccccagaggacatattgtgggtgcggcgatgtttgccccctattttcaacagccccaaaagtggcctgttgtctttgacaacctggggcacgggagcagagaataacatcg

SEQ ID NO: 568173 - DNA, 158 bp, Homo sapiens
tataaacctatatagccattaaggtgaagcccagtttaccaggttcaagggtacaaacttttcaaattttaaaacattttaggtaaaggtgtaatatacttaaactgcacctaaaatatcttttgcacctctttgtaagaaagtcctgattcctgtta

SEQ ID NO: 568174 - DNA, 595 bp, Homo sapiens
  misc_feature (209)..(209): n is a, c, g, or t
  misc_feature (239)..(239): n is a, c, g, or t
gcacttgtcgaggcttgcaacatcacatgttggttatttgtaaagtattggcttactaaggttgacagattttcctgatattaatacttttcatcattatttttaaaaaatcatatttgttacaaaaaaatcatatttgttaataccaccactgatctcatcagaaagttctttaaatgttgagttttcaagcccacagtggcaggtgnaagttttccagagttctaatttttgctcanaaaaattatgattatgagaaaagctcagattttattggtcacaaatagtgccaaattgccttgaagtgacggactcattttgttcattttggaaaatatctgacaaatatccaagtccaaataaccatagtttggcccatcagtcactttttgaagtaaaattgacatttcacaggtgaagggccattcatctcacaatgcacagtgagattcctcgaggcggactcttcctggggcgtgccggagaaataaatgctctgtgtatacttcccacttcgtcacgcagaatattcagaagacttgtgctcaggggttgagatttatgcaaaataattattttattgcatcaaggacac

SEQ ID NO: 568175 - DNA, 244 bp, Homo sapiens
  misc_feature (125)..(125): n is a, c, g, or t
  misc_feature (162)..(163): n is a, c, g, or t
  misc_feature (231)..(231): n is a, c, g, or t
cccaaatgtagagccatggtctagacaccccactttccacaccgtgtatacaccctgaccaacaggcttataaatggatccggaaactgctagaataatgtaatacctgattcttagaaccattntagtccgtcatatgacgaaattttattgttcatgaannctccatgtgtcgtgacatgcacactgtgcacacgactgtggttaacgtaacgcagtggtacctgagcnttcgaattcgtaa

SEQ ID NO: 568176 - DNA, 418 bp, Homo sapiens
cgcggtggctcacacctgtaatcctagcactttgggaggctgaggtgggtggattgcctgagctcaggaggttcgagaccagcctgggcaatacggtgaaaccccatctctattaaaatgcaaaaaattagctgggtgtggcagcggatgcctgtagtctcagctactggggaggctgaggcaggagaatcgattgaacccgggaggcagaggttgcagtgagccaagatggtgccaccgcactccagtctgggcgacagagcaagactccatctcaaaacaacaacaaaaacaaaatagttgtgggccaggtgtaatggctcacgcctgtaatcccagccaaaagtatgtaattccacaatttagtcagactccccattctcatatctactcatcttactgtctctattaataatat

SEQ ID NO: 568177 - DNA, 186 bp, Homo sapiens
gagggaactggctcgatcacagcccctccctctggtgaaacagtaggcggccaggaagaaggatgctgtggaagtctatcgccatggaaacacgttagcccatccgaggcagccgctgggcaccaagcacgaagctggtcagtggaggtggggcaggacgtgttccggtcatgcatggaccgagct

SEQ ID NO: 568178 - DNA, 98 bp, Homo sapiens
gttccgcgttcgggagtattcaaggccgttaccgtgtattattgtccgagtggccggaacggagccaacatggcagcggggtcgggcgatcttcattg

SEQ ID NO: 568179 - DNA, 238 bp, Homo sapiens
taatctcagcaggaccctggcgcggctctcgtactgggcatcatgtcagcagggcacaggcagcctttttctgggctacggttccaatacttttgggagggggtgccagcccctccaggcatcccacccccaaatcatcatctttagtactaacagggggtctggtcttcgaagcctcccttcagatcccagctgagccgggtgacggccgggccttgatgtgggctgcagccttctg

SEQ ID NO: 568180 - DNA, 240 bp, Homo sapiens
gcagaccagaatgcctgattgctgaagcagttgagcgtgttgctggtatccctgaagagcaattagcaatcttgagcctcctgaaacagccgtgtggaatcgcatcattgagcctgtggctgccatgagattttttgtgccatgctgcgactcttccctgagtatctgaagggcgaggagctctttgggctgacggagcatgccgtgctacgcatagctgaatcactgcccggggtggag

SEQ ID NO: 568181 - DNA, 380 bp, Homo sapiens
gtaaacagacagatgattgtatgcagctctctagaggtcatcatagacgagacatgatctgaacataccagatggcaagatcactacgccaagtagacaatatcagttttatagaactggctgattctgtaacatctgtctttgaggttacagttttcaaactatagatcaccccaaagaagttgcaactatgacatgtatcaccatcacacaaacggagtccagctgtagttcaaattagtcctgctttgtttcacatcatttaaatatttctagcataggacatgatacgaaccaaaactcaaagtagccataaaaatattattctgccgttgaataaaagcaacaatgtattagactgttagacttttaaagcttca

SEQ ID NO: 568182 - DNA, 672 bp, Homo sapiens
  misc_feature (465)..(465): n is a, c, g, or t
gacaaagactgaattataaatgctacgtggcacatcaaggatgaagtacaggtatcttataagacttgggcaatagccatcatggacatgataaaagctcataatcgcccagagttgtgcgaagacaacctgcgttcgagggctacccagagccaagctaactaccagacgttaccagacttggcgctgggttttcccacgacaggcatcaaacgtgtttgcggagatgagggcctaataaatcccagacaacaacgattatgcggcgcctgcaagattcagtttgtacataatgccatcgcgtgctgttgggccatataatgactcacgaagaggggatctttacacgaagcagcttctatatgcgagtctggaagtccaacatgcacttgcagttggaggcagcggtgcctggacagcttgatcaagaatatgacacaggtctttctacgcactaagttctgnagaggcgggagtggtgtgttactaccttccaggacatttgaggagttgttgaaaactgagtcctggtagtgaacggcgaagataatcagagattcttattcttgcacgcccggggcagagtaattgctatggccatggcgaaacacaagcgtgccgaagactgccagaaactaaaagggatcatgcgcgtcttcctggccatttacg

SEQ ID NO: 568183 - DNA, 134 bp, Homo sapiens
cttggcgcaggtcagctttaagttcgcctcgattcatgccgaaccgctgacaatggacgccgcgtggctgatacgcgtgtttggtgcgccctggatctacggggcattcgttggctacatcggtgcatttttta

SEQ ID NO: 568184 - DNA, 333 bp, Homo sapiens
aagagtgtgcagtcaatagtgtaagtacattcacgtgtcgtgtagcttttggtgtttctttcacctagcataatgcttttgagcttcaccaacattgttgagtatatcagtagttggttccttttttactactgagtagtattccattatgtagatctactacaacttgcttatccattcaccagctgatgggcatttgaggtgtttccagtttgggggtattatgaataatgctgctatgaacatttgtgtacaagtctttgtggacatatgctttcatttctcgtctgtaaatacctaggagtggagatactgggtcatacggctatctat

SEQ ID NO: 568185 - DNA, 107 bp, Homo sapiens
  misc_feature (55)..(55): n is a, c, g, or t
  misc_feature (65)..(65): n is a, c, g, or t
  misc_feature (87)..(87): n is a, c, g, or t
tttgagggttccttacccaaaataatacccctgcctgcgtgatattctaccattnattttaattnctttgggtcttgcacgtttttnaggaggccttgatttaaatg

SEQ ID NO: 568186 - DNA, 526 bp, Homo sapiens
gctctttccggtgtggagtctggagacgacgtgcgaaaatggcaccaaaaaaaaaaaaaaaaaaaaacaaaaaacaactgtgttgcgcgcgcgcgcccgcgggcccctctcggagaaacatttccttaaaacccatattgcgttgtgggcgcgccgcgggcgccccacaggaggtaaagacgacaacgtgtggccccataagggtggtttccccaagggaaacaccggggttcgagagggaaatatagcaagggtgcgggggatatcttccaccacaatacataaaaaaaacagcgcgcgcggagggggagcaacaaagcgcggagcggcttttcttctgtacaaacaaaatctctccaaatgaagtggtggagccgtttctctgcgaggagcacccacatacccgggggggatcatctccattcatcctaacaccgaggggagctctcccaccaagagacgaagacctgctctcgactagatctatcaaactcttttcgacgcgccccagcgagcctggcggggt

SEQ ID NO: 568187 - DNA, 213 bp, Homo sapiens
gtgattgggatgaaagacaaaatccagatcagaagctgtcagccagatgactgggatgaagattgccctgctaggattccagatgaagaggccacaaaacccgaaggcgggttagatgatgagcctgaggtacgtaacctgatccagacgcagagaaaactgaggattgggatgacagactggctggcgaatgggaggctcctcagattggca

SEQ ID NO: 568188 - DNA, 897 bp, Homo sapiens
ggtgcgctgagctccgggctccggagcggtccgtccccttcccgccgccgccatgaagtgatgtcaaggaggaccacctccgctgaacacagatgcgtggatctccgcgaagattcgagcgaacatatcccgacagggtcccggtgcttggtggaaccaaggtctcaggctctcaagaatgtgttgacatcggacccaaacggaccattcacttgtggtcccatctgatatcacttgtgcgctccagttcatgttggctcatcaggaaacagggactccagcttcccttcctgaaagggagacattctccctgtcgtgcataaggacagtccccaacaggtccatgcctaacctaatggcgaacagccttcacgagacagggcacaaccgacctcaacgccatggcttccttcatattgctgcctacaggcgggcgagcaaccacttctgggctttctgagggccattgcctgggcttaggtgccaccggaaccgtgcctgtggtactccttgtaaattagcccagccatttttcaggtattataccagaacctccttcacattacgcccttattcgtgcctttggtaccctgcattctattcctctcactatctcgaccggctctcgtctccccttaagactagtaacctactcataccgacgccactccgacgtcaccctccggcctgcaccatggccgtcttctccagggaacttggcctccggaacccctcttgacgcatcccacccccaccacgccgcgcgaatacacggaacgacgagcgccaaaaccgggacgcaacgccatggcacttactacaccgtacctcccccaaccgtccaatccccccatcgggcactgcttcccacgcataacctctgaacaaaacgtgccg

SEQ ID NO: 568189 - DNA, 189 bp, Homo sapiens
gatgacagctgacgctaagagtgaagctttcgtcacgcaggacatcattctatacaactggtgatgaaacaccttccctgggcgacctaagctcgtgctgctgggcgccggtacgaaggaactagagcgcatcccactcagtgaaatgaccgcgaagagatcaatgcgctaagtcagagctcgggtttc

SEQ ID NO: 568190 - DNA, 313 bp, Homo sapiens
cgggtctagcagatttattcccttatttgtcccctcccatgttccgttttgccctatcagagtgccctttttttcaatcctccctgtgatgtctacttttagaatcctgctgatgggtgcattttacagagtgctgattggtgcgttttacagagtgctgatgggtgcattttacaaacctattgctagctacagagcgctgattggtgtgttttacagagcactgatgggtgcattttacaatcctcttgtaagacagaaaagttctccaaggccccactcgacccaggaagtccagctggctagacccagg

SEQ ID NO: 568191 - DNA, 1452 bp, Homo sapiens
  misc_feature (549)..(549): n is a, c, g, or t
  misc_feature (794)..(794): n is a, c, g, or t
tctgtgtgtcgctgttgtttgttcttttcttttttgttctgtttgtttctttttcggttttgtcgttctgttgtctggtttttctgagttttgttcgttgtgttttgctgcttgtttgtattcttttcttgtatttgttgttatctatgtctcttgctcttgatttcttgtgattgttgctgtcgttctgctgtctgtgtctgtttgctccttttcattatcgtacgatgactcagcatcgaagcgaaggatgtatactgtgtgttggtatgttggttagtagtgatggagaatattttttaattaattaaagtgttatgtttttgatcgcgatattgtgtggtgtggagtgagtgtatggataggttgtcttattcttatgtgtttagtttgcttggttatcgtttgtgattattctactgtatgtatgtattgttttgcttgtagtttgttgtgttctcctgcctcattatgtgacacaccctcgcaaataaaccaaccccttaggtcgccagacccaccgcgagtttggcgcccaccctttggacnctcggagaggaccccccccagggtgtggtcccacgaaacaccacggcctttttttaacccgctgcgtctcctctaccttattatcccggtcctttaaaggtataccgagcgcctctgtggtgaccgaaacttccgcgcaaccaaggggggcccctttgcacccccgcacgaggagttgttgagtgccctttaagtataacccccgggggtggccacatttattgaagcttccctttattataagngaaggggagattcactgggtgcgcccacagaagaggagttgtccacccacatgcgcgtaaggcacctcccgaggcgtggccagacacacaagagaatgtgcgcccacccctcttcactggttcactgagaggcccactggcacgttcttcttcaaagttcccgcagggtcttatacgctggatagggagaccacgctgtttgccctcggaggaccacttgtgctaaactgggtgatcccctagacccactgaggtggtatttcccgctgatgtctcccgctgagttatgcctctgcactttctgccccccgcgaggagttgtgcgctgccacccctacggccgtatgcccgtccacgagagctggcacggcctcggacctataaaggttctggagagggtgagagcgagacctgcgaggagcctcacaccaggaaggggagaaggctgaccacgaagaatacctaccacgaccggagagtgctgtgccaccacccggggccgacaccacagagaagaccgaggctggggctgggtccagccaccgaattcccacatttagaggcggatttggtcgtggacgtggtccaccccccctccagatataaattggagaggatttttttgccacttgaataaaccttctaccacgcccctaaa

SEQ ID NO: 568192 - DNA, 171 bp, Homo sapiens
gttcttcaaatatctactcatcttccgaattaccatactaatcttagttaccgctaacacctattccacctgttcatcgcctaagaggccttaggatatatatcctcctggtcacatcagttgatgtatacgcccaagcagtgccacacacgcagcatcaagccattccta

SEQ ID NO: 568193 - DNA, 530 bp, Homo sapiens
  misc_feature (423)..(423): n is a, c, g, or t
cgcgccacaccccgctgggggcacataaaaggccccccgcgcaagataattcggtacaccgcgcacccacccctcttgtgggccgaggaggggccctccgccatagtggggcaccccacagggggaggttgctccccagccccgccggaggctccccccgccgggggagaggagaagaagtgggcagaaccctcgctctctctgtggcccaacacacatgtgtctgcataactccccctctggttgtaccccgcgttccaatagagtctccccccccaccgtttttcccccgcggcgcacattgtgtgtgtggggaggccccccccccgctagaagtacccccccgcctcttctcctacgcggtgcgttcgctgagcgggccacgctgaggtaattctcgccgtgtgatcaccacgggcaggntgaggagggctcccctgagtggctgtgaccttaacccgccctgggacactccacacgccacgtgggcgacccacgcagcccacagaggtccgcttattcctcagaga

SEQ ID NO: 568194 - DNA, 356 bp, Homo sapiens
cccactgtgtgctcccccgctttgatccaggccctcaaccgacgcacgccgttcttcaagttcttcctgaagaaggaactgatctgggtacccttcctgggcctggcgtggtgggcactggattacccgttcatgaagcgctacaccaaggcgttcctggccaagcaccctgagctggcagggcaggacctgaaaatcaccaaggaggcctgcgagctgttcaagcgccagccggtcacggtggtgaattacctggaaggcacgcggttcaccccggccaagcgcaaacagcaggattcacccttcgagcgtctgctcaagcccaaggcgggaggcgtggcgttcgtgctcgcggc

SEQ ID NO: 568195 - DNA, 1058 bp, Homo sapiens
  misc_feature (660)..(660): n is a, c, g, or t
aagtattgacagctttgataaaatctttttggtgcagtggagagagttatattaggagtgaagcattatcgacacgaaagtagatctgttatagtgaatcagtctagtgtgagtgggacctgtctaaatgaagaaagctatagttaacgaaaggtaaaattgtattaacatatattggtttgtttctgggtgagtatgatactccgaagataatagactaccagatgtaactcaattatgctattaaactgcttccaatgattattaatatattggagcatcagaaattaactttgaaagtgttcgtacctattctgttttgcagaacttactttctaaatcacttgtgtaatatcatgatacctcattatacctcattcggacttgcccatattactcttcgtctctgtgggtaatttataactggacgtatattccttggatatcacttatagggctagatatactattactcactctttggtggcttaccgaaatttattcgcattgtcacacatattcccaatatctaaatgtcttatgtcttattagatcgcgaggtagtaagccacgtgcttcaaataatggatgatggcggttctgagtaccaaaaataccctagtctcactttggcggattactatgttatctaataccaantatgattggttcctcgattttgttccctggagcaagatttcactttactctcaagagatatatcatggatagtgatatgcttgtctgataagacaccagaacaggtgggtggagagttagtcgaggggatgcgagggaaaagaccaagaaaaggggttaatggagtcccactgccatatttacgtttgctggctgcacaataaccaggctctgggaggtgtattaacattgccttgggggaaatattgtggtccccttctccattgttaacacaaagagcgaattgttcccttgcaagtgaaacgcaacttgatccaaaattttcgggaatctttgtggtccttgtttcaaatttaggtccgatttctcttattggtgaaattttgacctaactgaaa

SEQ ID NO: 568196 - DNA, 453 bp, Homo sapiens
gcctcggaccaattacgaactccaattccctcatctgtaaaaaagggacaatactgtgaggtatttatatattaagtggggatgatacaaactggtgagaattttacagataaaataagtaaatactagatatccctaaacactaaggttttttctttgtaagaaaatgctcgcctgtaatcccagcactttgggaggctgaggtgggcggatcacctgaggtcaggagttcgaaaccagcctggccaacatggcgaaacactgtctctactaaaagtacaaaaattggccagcgtggtggcaggcacctgtaatcccagctactcaggaggattacgtgaactcaggaggcagaggttgcagtgagccgagatggcgccactgcactccagcctgggtgacaagagtgagactccatctcaaaaaaacaaaacaaaacaaaacaacaacaac

SEQ ID NO: 568197 - DNA, 594 bp, Homo sapiens
  misc_feature (112)..(112): n is a, c, g, or t
  misc_feature (119)..(119): n is a, c, g, or t
  misc_feature (134)..(134): n is a, c, g, or t
tcatccctcaaaattcctccctttaaattccttccgtggtcggctaggcccggcttttgggagggaccaggcctactaattccaaggctatgaaaggggggaaactggttanggaactnccctgggggaagaanaaggagacttatgatgtgggaggcaaatcaccacacttacgctgaactcatgcagacgctccggtttcttggactctacaggggtgagcatcaggattttatgggtgagcaaaaacgactaaaggagcttcggggaagggggaaaccaaaggaggggggagggaaaagggcagcaaaaagggaataggggtgggccctcaagggggggactttcttcctcaggggcggagagaagaaagggcatttattggctttccacatattgggaggaatggcatcttcctaaagggaggttatttgggaggagcacaggcatctccttggggggaatctaatccggggtacatgggggggtgggttctgggacacattctaacgtggcaaaattatcttggccttggccgggtaatgggagggttacctgattctctatgggaataaatacctaaggtataaaaaa

SEQ ID NO: 568198 - DNA, 190 bp, Homo sapiens
ggactgtcgggctccttgtgtggttctgggcgtgagcagactgtttggtgccagtgaagtgacctaagcagcagcgcagacctgtggcgctcccacccagctccattcaaacaaggcgggacctgccagagacggtgctcgctggcagcttaaatccagctgctggaggggctgtccctatcggcgaaga

SEQ ID NO: 568199 - DNA, 165 bp, Homo sapiens
gagcacttctgagtgataactaaagcagtttggtggccttttcacattctccatgttcaaacatattttccactttccattttctctttcacctcaccttgcctctctatcccccatccctgcttatttctcaagccactcgatgggactcatacaaatgtattt

SEQ ID NO: 568200 - DNA, 602 bp, Homo sapiens
  misc_feature (232)..(233): n is a, c, g, or t
  misc_feature (264)..(265): n is a, c, g, or t
  misc_feature (489)..(489): n is a, c, g, or t
  misc_feature (514)..(514): n is a, c, g, or t
  misc_feature (529)..(529): n is a, c, g, or t
gatatgaggatgtatgaggatctagcaaggaggccagtgaggaagagaacagaggaatgaagggggcgggctgtgggtgacagtaaatgagtccagaggggcagccaggaccctgatcctggaagtctatggttaggtccttggacttggctctgacacaatctgatttgcacttttacagtcactgactgctgggtggagaccttactgcaagagggaaagagtgggggcnnagggatttgtgaggggggcaggcgcgccctnnagggcagaggaaatagtggtaagtaactaggaatgattgatgggtgagcacttcaacagcatctgcagttattaatgcaacaacaacaaacaacggcatccatgctgcaggtgtttccgagtcactgtgctgggaaagcagacactaatcatgaaacagcagcaattacagagttcagcatctcacaggcgacagcacagtgagggtccttgtttttagcatcntccttttctgaaacaaaattcgagnttcaaaaggtcaccngcatgcctgtgcctattagagggaaacaaacaaacaaacaacataaaaaaaacacgaaaaaaaaacacgatgc

SEQ ID NO: 568201 - DNA, 497 bp, Homo sapiens
tccaagagagacattgaagatcgcatcgttgctcgtagtgttgatgcagatgattctgacgttgaagtcaatagtgatgatgacagtgatgaagatgatgatgatgaggatgacactgaagcattgctggctgagcttgaacagataaagaaggaaagggcagaggaatagctacgcaaggaacgccaacaacaggaggaggagcttaaagtaaagcaggcagagcttctgcgtggaaacccactgctaaataatccaacagcatctttcaatgtgaaaagaaggtgggatgatgatgtggtgtttaagaaccagtcccgtggtgaaaccaaaacagctaagcgattcatcaatgacaccatcaggaatgatttccatagaaaatttctgcataaacacatgaagtaagtccttgtgccagaagtccgagttgtttggattttggtctccacagaacttattaatttgcagtttgtatctaaatgtatgattcaatg

SEQ ID NO: 568202 - DNA, 191 bp, Homo sapiens
ggagctcggcacctgtaacattcgtgtcatatccacgacaacatgaatgctgatgcagatctcatcaatgcaggcgaggaaacagttactattcttccaggagcctcttttttctccagcgatgaatcagtttgcaactgagttagagcgtggacacgttcggaatctgacaatcgctagtgagcgcatgc

SEQ ID NO: 568203 - DNA, 706 bp, Homo sapiens
  misc_feature (350)..(350): n is a, c, g, or t
  misc_feature (626)..(626): n is a, c, g, or t
  misc_feature (629)..(629): n is a, c, g, or t
  misc_feature (643)..(643): n is a, c, g, or t
accctgaagtgccagattatcccaggcaaacctcttgtgtgctccagacctatacatccaattgctactaggcatctctacttatatgtctcagctctcaagtttagtaagtctccaattgaaaaatgaccaatacctcccccttcactgaaactacaaaataaaaaactgctcctcccccagtactctcaccttaggcacaagaactactggccctggaagtcagccttttcctctccccaggacccccaaatctcatccatctctaaatcctatcaatttttcctcccaaaatttatttgtcaaatcaggctagtttatctctatcactgccatcctgaaccaaggtnccaccaactcttgactacattattgtaacagctaatctcaacgctattcaaattgtgacctgtgcactgacactggtccaaaaacttttgctactggtctgaaatgaaataaatatagaaacctagagaaagcatttaggaacgtttacagcaatttgacactgccaaaacaaacatcttattgtgtgttactaaataccagaatgaatagaaaattaaaacaaaattggtccttcaacacagacaagtttgagaagcaatgacttaattagtctnccngtatttacacttgnctctttccaacctgttcttgcagagcagcactgatttttttaaagcaaaaatttggcaattaa

SEQ ID NO: 568204 - DNA, 1031 bp, Homo sapiens
ctattgtgactcatgcctgtaatccctagcatttagggcattgccgagtctgcgcgggtcacctgagtctaggagttcaagaccagcctggtccaacatggagaaacctggtctctactaaaaatacaaaaattagccatgtgtggtggcaggcacctgtaatcccagccactcaggagggtgaggcaggagaactgcttgaacctgggacgtagaggttgcagttgagccgagattacaccactgacactccggacctgggtgacagagcgagactctgatctcaaaaacaaaaaaacaacaaaaaacaaaaaacaaacacaacaaatattatgaagaaagagagcagcaccaaaaacaggcttgatcaacacaagctcttcagtataaaaatgagcgacagataacacaaaggagatagaagagacaaatgagaacaacaaaccgatataacagcatgagagaaaacaaagagataaaacacacaaaaaaaaacagaaaaaaaaggagcacaaaagtagaaaccgacgccgaaataaaaaataaagaattataaaaaaaaaacatacacagaattataaaaaataacaaataaaaacaaaaaacgacaataatagaacaaaaaacaaaatagatatattaaagaaaaaaaataataaaccaccaaaataaaaaacataaaaataatacacacaaacacaaaaaaaagagagaaagcaaacgacaaaaaagacaaagatgaacacgaaaaacaagaaagaaaaagagaagagagaaagaacaacgcaaatagcgaaaagaaggaagcaaagaagaggacaggacaaaaaagaacgaccacaaattcaagcgaggtaagaaggaatgagaaaacgaggcagaatagaagaggagacaaaaggacaaataaggactgcagagtggacaaaaaaacaccaaacaacaaggacacgagaacaagaaataaataacaaaaaaaaacaagagaagaaacaaaaagaaagacaaacagaacggagaaaagacgaaag

SEQ ID NO: 568205 - DNA, 698 bp, Homo sapiens
cggattttagtgcgtgtttgagttgttttattgtgtatgtatgtttgtgaatgtgtgtgttatgagattggtgtgtttatttttaaggttttatattttcagaggattgtttgtatattttggtagtagtgtgtttttcctgttaatagtctagttttgatgtttttgttttgggggtataattgtgatgggttgtggtggattaaattaatttttggtggggttgtgtgaaaaatttttttgttgttatttgttgaggtagtgtttttccttgaggggtgagggagtaatgaagtaatgtgtggtttgtgtattggtgggttctggtttttggggtggtgttgtcttctgacagataatgattgttttattttgtttaaattttgggagttttttgctgttgttcagttttttattgatgtgtttgtggtgtatgtttacagtaaagacgttttatatatttttttttttatttagtatggggggggggggcccatattttatggtgttatattgttttgtgggtgtttggtgattgttttgtgctttgatttatagggtgtttgttttcccctgtagatttatagggattgtgtgaatatgattagtattgttgtattagtattatgtggggaggattgtagttgaaaaaaaaaaatctgtgttagtaaaaatgtaaagaaagaaaataatacagt

SEQ ID NO: 568206 - DNA, 182 bp, Homo sapiens
tttgaaagaaaaccatttattgagaatcaaaatcaatacctttctttttagtatctaccaagccaagagagaactgattcattcaagaatgaacacaatgtacaaaaaaagtatgcttatattataaaaatatgtcacatttactctgggtgctagcgagtcattaacaatcagcacgctga

SEQ ID NO: 568207 - DNA, 354 bp, Homo sapiens
gctactactaataaattagaagagtacgacggggacgcagctttgggtagctgaagtattaccctccacccccccccaaccgccatgtcctcccgtacattactgccagcgaccatgaatattataaggtacaataaatacttgaccacctgtagtacataaaaacccaatccacatcaacgcccccccccccatggcttaatagcaagtacaggaatcaaccctcaactattacacatcaactgcaactccaaagccacccctcacccactaggataccaacaaacctacccacccttaacagtacatagtacataaagccattttacgtacatagcacattacagtcaaatc

SEQ ID NO: 568208 - DNA, 233 bp, Homo sapiens
  misc_feature (17)..(17): n is a, c, g, or t
atctaaacgaccatcanacttcagttctcttcgcttttctgtaaactccttttccaaaagctcattgtgtaccaagcaagcacgtctgtagttaaaatttgttactgaggttggttcaaggtaagaagaatggagaatatttacaacatcttcaaattctcgagagcctggagttaatggctggaaaagtgctttcttttctctgctcttcctggggatctgaaaactcctcc

SEQ ID NO: 568209 - DNA, 951 bp, Homo sapiens
  misc_feature (787)..(787): n is a, c, g, or t
ttggaaaaaaaaaaaaattatttttattgggaactcatctgaacatcagatataccgggggtgggttagcaagaaccgttggtacattggatactggatgggggccaaagaccaaaacagggactagacagtgagggggcaaagatgtggcaggaacaaaaaccgtggatttgggcagcaggaaaataacaagccagtcagattcagggtgagggatgcacaacaccggcgtccaaaacaaaaacaaaacaaaacaacaaacaacacaacaaaaaacaacaaaacaaaacaaaaaaaagaggggggggggggcggaagaagaagaaactacacccaacgaaggaggggggacgacacagaaaagcacacaccaaagcagcacccacaacaagaaactcagtggtaaaaaaacaacgaggggggcgcccacaaaagtaaggagaggaaggaacaaaaacaaaatatcaaaaacacgagagaggagagagcgagggggcgcaagaggaagtacaaaaaaacaaagagagcgagaaagcgggaagggaagaaaaaaacagcgagagcaaagcaagtcgagaaggaaacaatcaagtgaggagcagagaaggacgcaccccccaactatccagagcggcggggggggcggcgcacacaagcaaacagcgcggcgacacacaaccctaacccacagacagaacagcaaagtaagaaaaacaccacgactcagacggaggacaacacacaaaatagacaacaacaacctgccaagcagaacggacacgtaganaaccgggggcgagcgacaccacaaaaaacacgagcgaatcaaaatgcacaccacgctaacacacacaacaagtaagtcgagagacaacaaaagcaggaaaccacagttaccgaacaccaaacaaaaattaaataacaaacccagcgcagaagcaaagacaaacg

SEQ ID NO: 568210 - DNA, 180 bp, Homo sapiens
agctgaagccctaatccccctaagttaaagacttctttccagtccaaggcaggcctgaatcccctgtctttaaataaaattttaagtgatgctgttttatatataggaaaaaatgcttaaaatcctgtcctttagaccagtgaaaagtatcttttgagattaaagtgactctttcctgta

SEQ ID NO: 568211 - DNA, 1054 bp, Homo sapiens
ggcttatcttgaccgcccgagccagccaactcaacgagacaaacgacaacaacctttgaacgtacgtggatctggatggactgtcaactacccctgatttaatggcacctgtgtctgctaaaaaagacaacacgaaagttatcctgcatgttcattacctgatgggcgggtgtactgtctctgctcgaattgacagaaacaggattctgtgaaggtgatagagatttccatccatgctgactttgcagaatacatgtacccgaattgtggtccccaaagctgccattgtggcccgccacacttaccttgccaatggccagaccaaggtgctgactcagaagttgtcatcagtcagaggcaatcatatgatctcagggaacatgcgcatcatggcagtgaaaagagcctatcgaggttcagaagatcaggccattctatcctgggactgcaaacatccttacgagttagaatattcctatactgatctatgtcagccgtacctggatccaatgaaggtcatccttgaacttgcccctggtaaattggaagcagatcaggtcaaaagccagaaaaaccatccagcatggcacagaccgaaccagatgaaacagagatgggaagaactgacacatcctgatacccagaaggaccaccctgaaaaaggatgaacaacactgaaaacaacgatagaagaaaccaaacagcctacagataaatgacaggaatgatacaaggaaagacaataataaatgaatggccgaatacacgtgaatacagcaccgagaaaaaggggagacacgaaacccacaacaacagtgccagacaaagcaacaaccaaaggcgcgttagcaaagacaaaagaggcacaacaagagccaagtagacgaagcacaagattacaagattggacaataaaagaaaacaagtgagtaggaagacacaaggagaaaaagagatcacagagcaagtggagtagataaagaaaaaaagacagattcatatcagaaaaagacacgaaagctggcggccagcgtccgcctcggaaagaagaaaa

SEQ ID NO: 568212 - DNA, 753 bp, Homo sapiens
atttacaataggattaagattttattaccagtttatattagtggtattatattattatctttaaggagacggagtcttactctgtcgcccaggctgaagtgcggtggcgcgatctcggctcactgcaagctccacctcctaggttcacgccattctcctgcctcagcctccctagtagtggggactacaggcgcccgccaccatgctcagctaattataggatattagtaagatagagacggtttcatcgtgttagccaggatggtctcgatactccgtgaccattggtgatccacccgaccgtcaagcctcccaaagtgactgagaatatacagagcgtgagccacacgagaccatgtgccatagtttccagatattatatggtgagctcatgtaaacaaagccttggctcatctacgctgactatcaagccaagtgagtctcttaacatcataatactaatcagtgaaaagcgtttcaaaagcatttgaatgaggctgtcgaatgactacgtgttgggaccactactattttaaggtaataagacgacaaacccttggggaactcagggaaggacaaaagacacaacacggaggaccatctagggacaagcagagatacaaacagacagttacacgtgaaaccacacatccggggagaaaccgatacccagttaaaaatgacgcacaaaaacagaaagagacaagacaggcaccagggaaacccgggacgacgcagtgaaacagaccccaa

SEQ ID NO: 568213 - DNA, 806 bp, Homo sapiens
ctcgggccgtggtggcacgggcggttgcctgggccggggtcgcccctcctcctaccgggctctccgtaggcgcctgtgtctagcctggcgcgtgtggccgattttcactgcgcggtgaacgatcggggccgtgcttcttctctgaggtctaccatggttcggcagccgaacagttcaggacataagtctatggatgctgaagatgagcagagctccccagtaatcgcggggcatacagcgacgtacgggaaggtgcatgctagagtgaaccggctcagtgcaccccagagatcctaaggttcatggcgagtcgtgtgtgcaccagcggacagcttgtcgacagctgcattagcagtagtagtagttgaactggggggacatttggaacagcgtgctcagactcccctgaaccgcctgtcctggcctggtctaggctcacagtctggccctgagtacattgcccgaggccttgcggtgtaccttgaagtcaaaaggtgtatttcaccgacgaagctcacatccaagaactgtctagtccgacgggaagatcgaggcttcaacgactgtcgatgggttgacttcagggctggccgaggaagattcctgtgtatagcggagggggcaatggaaggcagccatgtgggccgatggtgagggctccctcagtacttggcatggcatcctagagggtgttagcgggagtgagctgtatgatgagaaaggctgcaatgtctgtagacttccgggattgtcctctgtgagcttcatcgacccgagttactgcaagaccgttgactacctaccac

SEQ ID NO: 568214 - DNA, 271 bp, Homo sapiens
gtctcgcggtcgctctatgagcacccccgtctgcttcgcggtgctgactcggactgcagctctggagcggtctgcaagtgcagtcagcctactgcagtaattttctcatgaagtgagaagaaaagctcagataggactagtacggagcagctggagttcagatctctcctaagtcctcttctgttcagatttttcgtcacctttacagtatttcacatggtcccctgggcccgggggtcatggccagaacacagagactttataatgagga

SEQ ID NO: 568215 - DNA, 220 bp, Homo sapiens
gtacaaagcattttcacagatcgcttctttctagttttatctacttgggaggctgagtgcaggagagttgcttgaactcaggaggccaagattgcagtgagtcaagacggcaccaccgcactccagcctgagcaacagagcgagactccatcacaaaaaaaaaacaaaagtttatttcttgtcccccttattgctttgaagggcactcattactcattag

SEQ ID NO: 568216 - DNA, 390 bp, Homo sapiens
actccattgtgccactgcacagcgggtatttgatatagagagacggttacatgtgccaggtgtctcgagtctgactgtgatcaccccttggctccaagtgtgggtacagtgtgagcactatgcccgggcaattacttttacagtctaaaattatcttgtcagggaaacacctcaagccctttcctgtgatttgggcaggtggagatcctcagtagagtgtgcaggtctaggaagagttctcatcgctcccaaaacacatttttcttgagcttgtgggctcttaggttctttggaccaggcttcttgtatgtggtcatagaatatgcctgcatgagatgactaagaagtcaagcgacaatacttttgtgcacttttggggtgggttgggta

SEQ ID NO: 568217 - DNA, 144 bp, Homo sapiens
  misc_feature (93)..(93): n is a, c, g, or t
cgttttaaaatttttatatttttttacccaaaacaaaaatggtcaataatacagaagacttctgtgaccaaatgtggggttttttgccacatnacgagcagtagacaccagctgggtgttctccaattcagttccaacacgatc

SEQ ID NO: 568218 - DNA, 706 bp, Homo sapiens
ggctggtgcctccctgcggtgtgccctggccctggctccgtgcccccgctggtgtgcaatgctccccgtgtggcctgctgggatgatgccatgtgatcctgaacttgtgttccttgcccacatgtgcactctgtgcctgtgtcctggtgcatggcatgacccatgtggctgtggcatctgctgtgtgctctgtgctgtgccaatgatgctgtgctgtgccatttctgctccatgtgatgtgcctactgttgtgatgtgccatgaagtgatgtgacctgtgcctgagtgtgctcaatgccttgtactgtgcctggggtctccctgtgtgtgtgttggctgatggcttcctgacagtggctggccactgtgtgcactgaccctgtgccaacagtgccaagctgcctgtgacctgagtgcttgcccgtgcattggcagcctgccctgccctgtgccctgagggtgtggccttccatgtgctgcacagtgtagtgccttggctccttcatggcagctgcgacaacgtggccaccttcatctggctggttgccagcgtaggagctttggttgtgcctggaggttgctcatgtttgagactgaggacctggtgctgcgcaagaacgagaagagcgtggtgctgtgcctgctggagtgtggctgcggcgtggggcacgcctggggcctgctggcccacgcctcgtgcagttga

SEQ ID NO: 568219 - DNA, 846 bp, Homo sapiens
  misc_feature (82)..(82): n is a, c, g, or t
  misc_feature (102)..(103): n is a, c, g, or t
  misc_feature (113)..(113): n is a, c, g, or t
  misc_feature (117)..(117): n is a, c, g, or t
  misc_feature (581)..(581): n is a, c, g, or t
tgtcagtcaggagctcctcccccaggctttaagatctgagttcacaggaccacagaatactggccatggtgcaacttctggnttttggcagtgcttttacanngacaacaagngatntgaaaattcaggaccatgggttctggacatggcttgggaactggtggaactactaggatatttgttctggcagtcaactacgcatgcggcgaacatccacttcgtcaagacatcgctggtacgtaccacgtcctaatcgctccctcctaccctgagcagcgtggaaactagtggcgttactcagccaccttcatggcacgtgctacgggacagcataattcggtcatgttcaaagctccagacaccgaagaaccctagaacttgcatcacggactatgcgtgcgtaccagtgacgacgatacaacgtagcaaacgttggtagtcataatcactgagatgcatgacaattcttggagttttgtcatcactttgctctttagaaagaacaagtacgtacgctgttaagcaattgcggaaacaggggatattcaaagggttctggtggtgttatagtccacgtgtancgtttctgtattcgtattatttgaggctaaacagttgatagtgtgacaaaagtacttcatatgttagtatgtcagtggtaacagtgcagaatgtatatttgcagtttttgaaagtgatcattactgtggaatgctaaataatacattaatgtctaaaacctgtgatgccctaagaaagcattaaggaattgaaggtgttgtactaatagaaactaaagtacagaaaattgcagatatagggtgggtagtaggctgatggagttat

SEQ ID NO: 568220 - DNA, 372 bp, Homo sapiens
gggccgtgcggtgacgccacttcagggccggcccgcggaacttttgggcagtgtcagcgccgtgtcacgcacgtcgcggacatgtgatttcagaaagtatgatatactcttcagatagagagcttgatttgcttttcagctagctactctaatgaattttctcagagcactgaaacatgtgttgagtgactgtcactagctgtcttcaacgccttgtgttcagaattgcacagttcagtgtatatatgctagcagtgacataacacatctgagactgactgatgctctgctgtagacatactgcgcttatcattgagcagagagatatgaaattcatgagaagagacgtatcagacatgcatcaatagttat

SEQ ID NO: 568221 - DNA, 413 bp, Homo sapiens
atatgacatgccctcataagatgagagcacgttcttttttccctgactcgacgtgaatgatttcatggggctctttgtgaatgttaatagcaccactcttctctctctaccgaccccatttggataaaaaattatatggtcaccctacttaaaggtcgatttccccttatgtcaactcatcatagccctatttcacaatcacacatttaaccaaccaaccaaccaaaatgctaaattctattcacatatatgattataaatggggcatttctagacagttttcctacctctccctcaccaaagcccatagaaatataaaattataacggaccctgagaaccaaaatgaacgagaaggtggtcgctttattcagttgcccccacattcctaggcctacgcgcctgagaactgat

SEQ ID NO: 568222 - DNA, 436 bp, Homo sapiens
acgtgaaaatacccgcctaccccgacacgaaacacgaagaccccgctgccgagtaagaggtggccttggcacttacctaagagctatgctgaagatagtgctacggacaccttactgtggcttggctagaataaactaacacagggtgcccatgcgtatgagcccatgaccgcagtgagtgctgcaacggccgtaaagtagttcgacgttacaactgctagaaggacatgacattttggcaacggaaggaatgcacatatgtagggcgcaacggacgcgggtggttgataaagataaaaccataactagagtaatgatacaatatacagcgtgacggggggcaacctgaaggctagtaatggcgggatggagggccacccgagcgactgcagcgggcataagacgagggacgaattaaaactattgagcggggcac

SEQ ID NO: 568223 - DNA, 294 bp, Homo sapiens
ctcgtgtcaacgaagcacacaccacaaatgtccccttcgtctgcaccgtcctcctgtctacactggcatcactgccccagctataccaccaccccgtctacagtatccacctgtgtacaccacaatgtccgcgttcgtctacactgtcctcctgtctacaccagcaccactaccccatctataccaccaccccgtctacataatccacccgtgtacaccacaatgtccccttcgtctatactatccacccgcctatttcacaccaacccctgttcggttgagcggagaggggat

SEQ ID NO: 568224 - DNA, 406 bp, Homo sapiens
ggtggaagtgacccgattttccagttgtgtccgtaacccttttctttgactcggaaagggaactccttgaccccttgcgcttcccaagtgaggcaatgccttgccctgcttcggttcgcgcacggtgcgcgcacccactgacctgcgcccactgtctggcactccctagtgagatgaacccggtacctcagatgcaaatccagaaatcacccgtcttctgcgtcgttcacgctgggagctgtaaaccggagctgttcctattcggcatcttggctcctccaacccagtggaggcaggaagactaaaccagaagacagtcaccgtagtccagataagagatgcatatgttatcaatcggtcttcgattagatattacttcttttgaacaatcttccctgatgaccca

SEQ ID NO: 568225 - DNA, 294 bp, Homo sapiens
  misc_feature (2)..(2): n is a, c, g, or t
  misc_feature (65)..(65): n is a, c, g, or t
  misc_feature (87)..(87): n is a, c, g, or t
  misc_feature (176)..(176): n is a, c, g, or t
  misc_feature (199)..(199): n is a, c, g, or t
  misc_feature (269)..(269): n is a, c, g, or t
  misc_feature (284)..(284): n is a, c, g, or t
tncggcaggacgcgttccttgtggaggccctggcagaggatctgttccagccttcctcccagctnctggcggtgcggccattgcttngaaggaggcttggcactccttgcgtgtagacgcgtcactccaggctctgctccatcatcatgcagccttctatgggtccacgtctcctnctctgtttcttagaacggcactnctccctaggtttagggcccaccctaatctaggatgagctcatgtcaggagccttaagttaatcacatctngcaaagtccctgttntccaaataag

SEQ ID NO: 568226 - DNA, 150 bp, Homo sapiens
agggcagtgcggtgaaagtgagagcagatataagagagaacccagccagaaggtgatgctgtggaaggtgaaaaggtaactcaaagttaaaagcccaagaggggaagcccattgcagcccaaccctgtccttgtcagaggattggcaggt

SEQ ID NO: 568227 - DNA, 105 bp, Homo sapiens
aggtgctaaccgggattactccggtgagaaacttcatctatgagggctgggttcactgcttagatagcttcatgtgtttatcctttgccgggacgcacgcatacc

SEQ ID NO: 568228 - DNA, 859 bp, Homo sapiens
agaaacctgaatacttatccaggtgacctgatggcaagcttgcatcccccccatactacgacagctgatgctctattgaaaatcccacctccaggttggaggtcaaccaactcaagccattgcagcaactcatcaaagaacaaccccatccaggtggtgtggctcacacctgtaatcccagcatttgggaggctgaggcaggcggatcacgtgaggtcaggagttccagacccccctgaccaacatagagaaactgcatccagtttctactaaaaatacaaaattggacaggcctggtcttgcatgcctgtaatctcagcttcttaagaggctgaggcacgagaatccgttgaacctgggaggcagagattgtggtgagccgagatcacaccattgcactccagcctgggcaacaagagcaaaactctgtctcaaaaaacaaacaaacaaacaaacaaacaaaaaatccccactccaataaaggagaaaacaacagctaattccatcacctgtaacatcctggctaaccagaagtcctcctcagtctttccacgtgacaacttcactgctagaacaactaagcatatccaaaagaaaaacaaaaaaaaaacaaaccggggcgctaaaacaggaattacaacccaagggaccctcacaaaaggtcccacttttacctccccgtggtgggttctaccccagaagcgaggggggataaaaactccaatgggtgtgagaaaaccctgaaggacaggatcccatccaccaggacctctttgggcagaacacctcaccaggtccagggcccagagaccaagtaagccccgggggggggttaaccccaggagaagggaaaaagatg

SEQ ID NO: 568229 - DNA, 165 bp, Homo sapiens
cttgggacccctgtacacgtatttcctgaaaaccttgagggcctttaagggtcttatttttttacttaattaattttggggcttcagggtcccccggttgcttttccgcaccaccccccacctttccattttttgggccaaaacccaaccgcgaccccccttgaa

SEQ ID NO: 568230 - DNA, 224 bp, Homo sapiens
ggggcgatctagaggatcccgaaacctaattacgtataacatttttggatgtgacattaagtacatttacattgttgagtaatgtcaccgccctctatctccagaattttttcatcctcccaaacgtgacactatgtatccattatacatccattcccctttctccctgcctctcagcccctggcaaccaccattccatttggtctggatgaatttgactactc

SEQ ID NO: 568231 - DNA, 1229 bp, Homo sapiens
  misc_feature (642)..(642): n is a, c, g, or t
  misc_feature (1048)..(1048): n is a, c, g, or t
  misc_feature (1067)..(1068): n is a, c, g, or t
  misc_feature (1097)..(1097): n is a, c, g, or t
  misc_feature (1136)..(1136): n is a, c, g, or t
  misc_feature (1168)..(1169): n is a, c, g, or t
  misc_feature (1195)..(1195): n is a, c, g, or t
ttaagccggagtttcgtttttgggggggaaccccgctccaggttttgccccttggggggagccggcgcatgcccgccggctgggttgtgggggaccccgcccccttgagggaaggaccccccgcggggggcccgcgggattccccggcgctctttccccggggatcttttcttaggccctttaggggcccgcccgggggtaccgcgggatttacccaatttgtcgaccaccccgggggcacccagcctttatggcaccctcttttagcgcgccttatattttaaggggtggcaccccgtgtattagggcacacccagtttgtggggcgacgcccaaaaaagcccccagcgcttgggtgacccccgcgttcccccggggaattttcccccgggggagttattttcgtctcgagccccccaaccgcgggtctccgggcgccgagatttctcgcccgctcgtgagagcgccgcgagaggcgctcttttgggggtgcgcgcgtgctctcaacagaagatttctcacagcgttttctcacgccgcggtgtagaaccctcccctccccgccctactcgtggcgtctctgagagagagagagggcacatctttgcgtctgtctctgggagagggtgtgttaaaatgtgngagcgcgtctgagatataactcgtgctcttttacacacacagagagggtgtttctctgagaagacgctctcgcgcgctctcactctcccacgcagagtgtggcgccttcagagcgacacgtgtggagagtttttccgcgcgagatagctgtcgcgcacacagagcctctagagacgacacacagcgcgcctacacagcgcacactctctctttgtgttgtgtgcgtctgtgcgactactcgccacacactctgtgggagtggagaggctacatatgtgagtatgtgctcacacagtttgtgtgtggagaggcccctctcttgtgtgtctctgagaacacccaacacacttcacacacctcaatttaaagagtgtgtgagtggaccacacacacacgagaaacttanggaggaaatgggtaggccnnttgtaaaaattgaacacagaagaaggggnaaaccccctaaaagtggttggttgcacgttgtgtagtangttaaggactatggcaaggagtttccggccannggatgtcattgaagagtatttccaangccagaaatgaagaaataaatctttggctcacca

SEQ ID NO: 568232 - DNA, 627 bp, Homo sapiens
  misc_feature (163)..(163): n is a, c, g, or t
  misc_feature (187)..(187): n is a, c, g, or t
  misc_feature (203)..(203): n is a, c, g, or t
  misc_feature (390)..(390): n is a, c, g, or t
  misc_feature (444)..(444): n is a, c, g, or t
  misc_feature (514)..(515): n is a, c, g, or t
  misc_feature (591)..(591): n is a, c, g, or t
  misc_feature (614)..(614): n is a, c, g, or t
ctctccctgcatagtatctcaccactcaagtagtctggccccaacttctgtacaacatggcagatggcttctaagagagtaaaagtagacactgccaatccacttaaagcctggctcaaaagcctcagaatgtcacttcttctccattctattggtcaagacnactcacagggcaaaccacattcgncgggtagggggcaganattcaaggggaggcatacatgacgggaggaaggaattgatgggtggctgtctttggagactatctcccgcatactcgaaaagcagttgcatctaatacttaaaaactgaaaagtttatgaataaatgagctaaattaaagtgtcatccctttgaaatttcaccagatgttaattgtacatgaaattnttaagtgtgaagtaaataaccagattatagctgtttaaacgtaaacaaatatantaaacacagaaattttttctaaagaagggtgacagttaacactgaaagtgcttttttttaaatgaaagannaaatatctttaaaaattacatagtttctccaattctgtctactgaaactattgctctttggagctgtggatagganaaggtgatcaccagtaggtgatnatgaggcattctt

SEQ ID NO: 568233 - DNA, 1480 bp, Homo sapiens
  misc_feature (81)..(81): n is a, c, g, or t
  misc_feature (149)..(149): n is a, c, g, or t
  misc_feature (1132)..(1132): n is a, c, g, or t
  misc_feature (1238)..(1238): n is a, c, g, or t
aatcacgagaaaaagtctcctaaactgctaagcaactgtgaggctaccacatagacctatgattctatgtcatacactgantgatcttgatatcattatacatggtggaatagtaagaattcgagagtaactacaacatatgattattngaactacaatactagatactagacaaacacagttaatgatagtgaacgataacagtatagcatgactcagctaatactgtgcacatactttgtctcgagctatccggttacaattgatcgtgtggagcaccaactctggttgagattatcaataacaggaaacacctgaaaacgcacaagcaagtgcgagacgaccacgcgccccctttctcgttccaatgtacttttttaacaaagaggacacctggtgagcacgtccaaatttcaaaccacccttgcacactcttgtaatgcgcaacaaggacttacccaacctgacacatattttccactaatagttatttagcgctcacattcacaccacacctagtctgaagtgtgaatcaccgctaaattcgccaaactcccataaaccacgcaatcctccgcggtgtaaataacttaagattcaacttacttataaagatttaaacctagtcccgcatctaggggtaaccaattttttttcatcgccggttgaaccaattaaaaggccaaacaaatttttaacaccaaagcttccggacaaaaatatccgcaccatatcatcatatacgcgccttaccctcaacaaacctggtgtaggcgttagaaaccccacacggcaatcctcctgtgtccgaagagccaaaattacacgccgaagacgaatcacacacccatatatggtaggcaccggaacccccttggagttccccccatcccgcgggaacaggcaattccacccttccacaaactttacctctctccgccccttgtaccaatctaaccacctcgaaaaggtggggcattaacaacctttccatatcaataccattatccgcgcacaacttcacaccttggcggagttcgcaccggagggttcacatcccctattgggtattttcgtaagccgccgccggtttaccgcgacaattcacaacactctacgttcagactaacancctctcagaggtgttacccttcccctccttgaaacctatcatttcacccttgcgtgacaatcctccacaccgtaaaaaaccggtaactcgcaaacgctggcaagantttcgcacactagctaactctcgggccctccggtttctactacaaattcctcacgaccgtctcgccccatactcggatctcgtggtataagtaactcccccacacgtctctattcacacccaccctttatgcagagcgaccaattccaccctatctccaagcgccggcaacacacatcgcgtcgcaacaccttcgcctcaaccacagagcggggtgtaaaccctcacaaatcgtcgagaaca

SEQ ID NO: 568234 - DNA, 1302 bp, Homo sapiens
actctttgcgaggaccccggtggctggcccgggggagtgcggccgaggtcgtgctggtggcggcggccgggggcgacatggctggatggagcagtgacctatctggaggtggagctttgagcccctgtgtgtctctggatgtgagcccctgtttgccttgtcccctggtgtgagcgcgcccatcgcttaggtgccctgactggctggcggctgtgcgtgatcgggcctgcggaagccagccctggggccatggcgagcttgggcaagggtcaacgaaggagcatgcagtgactggcagagtgcggactgatgacaaggttccccgttgtgcatccggcgagggccctgtcagcccatgtgtttgcctcagcgggctacgaactttggacgcgtggtttgcccattgccctgttgcgcgttcaacgtggcgcccagtcaaaaatgcaagccgcatcgttcaaggcgggccccatttgaaacgccctttcagtggggtcgttgcggccctccaggggcatgctgcggcaggggaaatgcttcggcggggacccatgtttacccgctgcaatcctttgcgacaaacgggccttagaagtctacagcgcaaggaaccggcttgggggcaaaggctccttgggaagggcttgattggaaccgaaacatgtttgacaaaggcggcccccgctttctatccggagggaagggccttgaggccgggcatcccggtaattgccgaggcaccaaaggaaagaggacccaagcccggggaacctttacccaagtgttatcacatagggccccccaagtggtccgtgtgctggggagaagcacacccggcggtgaacaacgggtgccctggcccccccacggtggggtcgaaatgtgctcgttgtaatgttcttcccccccccggctgttgtcgtcgggacacgggtgccgtcatagacaacatgtggttttgtgtgctacgcggtgcgccggtcgccaaatacgctaggtgggcggcccccaacattttaaaccagatagtgaaagtacctgcggccaccccaactttttttgtggtagccccacgcccgggtgggtgtaggcccccccaacgggctatagtagaggtggggggctctcccccccgccaattttttttcagaaattttgggtgtcaaaacccccctcgagaggtgactagcgcctcccttcataggtgtgtgcagtagatcatccgttggtggtggtcggctcaaacacgacacgacacttttaagaaaatcgacgccgcgctggaaaagaaacagtgcgtgt

SEQ ID NO: 568235 - DNA, 156 bp, Homo sapiens
  misc_feature (154)..(154): n is a, c, g, or t
tcggtaccctattgggacctctgctcactgctgcagggagagcagagctgcatttatcactaccctcatacatatttttattatggtctgcctctgtccatctaatccttaggggcaagctggttcgccaggggattcctctgagagctctganct

SEQ ID NO: 568236 - DNA, 1569 bp, Homo sapiens
ggatctgcctgccttggcttcccaaagtgctgggattacaagtgtgagccactgcacccagcctgaatttctccattcttcccagcacaccctccccaggttctccttcctgagcctcatgacccttcttgtgtttcttcttttgttttatgtataattttgttggaaaatagcattctacacctgttgttcaccccaaagtgggagtgtgacaaaagccaggaaactgcggaataaaaggaaaacacattataacacgtccacgaaggcatcagagggagaatccctccgtggtctatatagcacgcctcccagagtataccgtgaggaatataatgaggacacaccgagcagcaaataccgcgcgcgtgcgctactaaatcgtgagggcacacgtcattaggaggataaaacaaagatgggaggttacaacgaccgagggacgagcacagagacgagtgagcaaaacggaacaacgcctaccatgcatcacacacaggagccgtgcacacagcgtaaccacagacgccagacaaccacaacagcgaaagaaaaaagagtgagtgagagaggaatataaccaaggagagaataaaagaaccacgcaacaaaagacgagcgggggcccacagaacatggacacagaaacgcaaaatagcagagacgacacagaccgccacatcacaggcaaacacacaaaggagcagaactaaaaaacaaaacacaagagaaaaagacacagaaaataaaaacacagcaagaagaacggagagacagcacaaaacaaaaacaaaaaattatacaagacaaagcagccacacagaaacaaagacacacagacgaagaggaagagacgggaaggagaaacacacaaccaagagagacagaagaagcagcaagcgacccgcagccaagagataggagaaggaaaaaacgaaacagcacactagaacaagaagcaacacagacgaggagcaagcagacgagtagagacagacagacgacgaccgagaaagagagcagaacgaaccgctagcagcgcgcatgcgaaacacacttacagtacaatacaccacacgacaagagaacgaaaaaccgacaacgatgaggtcagcacacgaaacagcgaaggcaaacgaagcagcccagagccaacaacacgcgagacaaaccacggcaacacagccagggcgaacaacgagagtcacacgacaaagacaggcggcgacaaccacacgccactgacacaacgaggtcgagcaacaacaaaacaagccagcaggggcgaggtcaccacaccacgcaacaacatcgacagacaccgtcgctcatcggaacagcaagcacgcaaagagaaacgacacagacacaacggcgcagaggtagagagagaaagaacaagaaacgccgggaagagagaggagagaacaacagcacagaacgacaccggcagagcagcccaacgaccagcgacgagccagaaggaagaagaaagcgcagacaacgaagaagagaaagcagacgccgcacacgggagagggcaaacgcgaccacaaacgaaaagacaga

SEQ ID NO: 568237 - DNA, 161 bp, Homo sapiens
gcccgaccgccgctggtcttcgctggacaccatgaatcacactgtccaaaccttcttctctcctgtcaacagtggccagccccccaactatgagatgttcaaggggggcccgggttgcttttcttgggcccccaaaaccttttccccgaggtccacgtttc

SEQ ID NO: 568238 - DNA, 425 bp, Homo sapiens
caggggtcccccaacccttgggccacagacccagtactggcctattaggagccaggccgcacagcaggaggtgagtggcaggcaagcaaatcaagcttcatctgtatttacagccactccccatcactagcattattgcctgagcttggcctcctgtcagatcagtggcgaccttgattgtcataggagcgtgaaccctctagtgaactgcgcatggcagagatctaggttgcactctccttgtgagaatctaatgcttgatgatctgtcactgtctcccatcactccgagatgggatcgcctagttgcaagaaaacaagttcaaggctctcactgattttgccttatggtgagttgtataattatttcattatatattacaaagtaataataatagaaataaagtgcacaataaatgtaaaaaa

SEQ ID NO: 568239 - DNA, 753 bp, Homo sapiens
gagggaattcctcctgtatcagcagagactgatctttgctggcaagcaggctggaagcatggactgtactttgtctgactacaatattcaaaaggagtctactcttcatcttgtgttgagacttcgtggtggtgctatagaacaaggaagaagaagtcttacaccactcccaagtaagaataatgcacaagcacgaaagtaaggttcaagctggctgtcctgacaagtatcatacggtggcatgagacatggcaaacagttagtcgccttcgtcgagagtgcccttctgatgaatgtggtagctggggtgtcccattggcacacttcgctatcgacactagcactcaattgtgggcatcagtgttagctctgatcgttactgtatatcaaacaaaaccagaaagacaagtaaacctgtactgacgtccactcacacacgaccatgaacctcacaccacaccaacaaccaacaaaaacctcgaagcgacaattcatactgctacgcgggatgccgcgatccacaacactcgacggctacaactcaaacaatttgagccgaccaagtcgggcccaacatcacgcattggattccaccgtggacccccaagaacttactttgctgtccacaacaaggttgggcaaacgcactctcgcacggggttcccccacatacataagccgagaccaagaacacgaactcttccgaactaactgccagggtataaacccgtgctctacactgaactccggcac

SEQ ID NO: 568240 - DNA, 391 bp, Homo sapiens
ttttgcccaagaacctttattggaaaaatgtccaacaagtgatatcactagcagctgaaggggctgccaggtgagagggggagcacctgaggctccatggaagacattggagtagtgcagtgcagcatctgcctctagggtcagacaattccttttatttgctggggtaagaggagtacccacagaaacacccctctctgagggccagaggcaagatgtggggcagctggggatgctcagagtcctgatacaggtgaaattgggcccccctttcggtcctaaggtagtacggtcctcctagcctctctcctcctggccttcggaatgtaagtagataccccatctcatattccactccccaggctcacgggtccatcctttccacaccctt

SEQ ID NO: 568241 - DNA, 250 bp, Homo sapiens
tactagtatgggatagggtgtagtgtctgtgtagagtggctaggcatataatctagaggaagctatatcatggccgtcatagggatgcatgctagttatagatagtggtgttgtgtagtagtgagcagagtcgagaggtagtgtgcataaaatgataggatactagtatagaatcagtcgtcttatgtgtgttgtacattgtttgagtagttgatagcattgtggtgtgatagcggttgtgagaatattg

SEQ ID NO: 568242 - DNA, 763 bp, Homo sapiens
gagccaggtgcaaacatttcccgtcaattggcagaaaacaaccttgaggaaccttgacgagtgtccggagtttagaaaacttagggatggagccccccaagatgaacccagtggtggagccactgtcctggatgctgggcacctggctgtcggacccacctggagccgggacctaccccacactgcagcccttccagtacctggaggaggttcacatctcccacgtgggccagcccatgctgaacttctcgttcaactccttccacccggacacgcgcaagccgatgcacagagagtgtggcttcattcgcctcaagcccgacaccaacaaggtggcctttgtcagcgcccagaacacaggcgtggtggaagtggaggagggcgaggtgaacgggcaggagctgtgcatcgcatcccactccatcgccaggatctccttcgccaaggagccccacgtagagcagatcacccggaagttcaggctgaattctgaaggcaaacttgagcagacggtctccatggcaaccacgacacagccaatgactcagcatcttcacgtcacctacaagaaggtgaccccgtaaacctagagcttctggagccctcgggagggcctggctactgtgcctcaacggttcggctcctcaacagacagtccctgcggcagaagtgggtgtggccgtgagcctctgcaggctcaagagtgttgtccagatgtttctgtactggcatagaaaaaccaaataaaaggcctttattttta

SEQ ID NO: 568243 - DNA, 790 bp, Homo sapiens
gagccaggtgcaaacatttcccgtcaattggcagaaaacaaccttgaggaaccttgacgagtgtccggagtttagaaaacttagggatggagccccccaagatgaacccagtggtggagccactgtcctggatgctgggcacctggctgtcggacccacctggagccgggacctaccccacactgcagcccttccagtacctggaggaggttcacatctcccacgtgggccagcccatgctgaacttctcgttcaactccttccacccggacacgcgcaagccgatgcacagagagtgtggcttcattcgcctcaagcccgacaccaacaaggtggcctttgtcagcgcccagaacacaggcgtggtggaagtggaggagggcgaggtgaacgggcaggagctgtgcatcgcatcccactccatcgccaggatctccttcgccaaggagccccacgtagagcagatcacccggaagttcaggctgaattctgaaggcaaacttgagcagacggtctccatggcaaccacgacacagccaatgactcagcatcttcacgtcacctacaagaaggtgaccccgtaaacctagagcttctggagccctcgggagggcctggctactgtgcctcaacggttcggctcctcaacagacagtccctgcggcagaagtgggtgtggccgtgagcctctgcaggctcaagagtgttgtccagatgtttctgtactggcatagaaaaaccaaataaaaggcctttatttttatggctgaggattttgaatattagaaaa

SEQ ID NO: 568244 - DNA, 743 bp, Homo sapiens
tcacagttatttgctttcccagtcaggctttggacccaccattttgaatttaagtgcagtatttttttagagccccccaagatgaacccagtggtggagccactgtcctggatgctgggcacctggctgtcggacccacctggagccgggacctaccccacactgcagcccttccagtacctggaggaggttcacatctcccacgtgggccagcccatgctgaacttctcgttcaactccttccacccggacacgcgcaagccgatgcacagagagtgtggcttcattcgcctcaagcccgacaccaacaaggtggcctttgtcagcgcccagaacacaggcgtggtggaagtggaggagggcgaggtgaacgggcaggagctgtgcatcgcatcccactccatcgccaggatctccttcgccaaggagccccacgtagagcagatcacccggaagttcaggctgaattctgaaggcaaacttgagcagacggtctccatggcaaccacgacacagccaatgactcagcatcttcacgtcacctacaagaaggtgaccccgtaaacctagagcttctggagccctcgggagggcctggctactgtgcctcaacggttcggctcctcaacagacagtccctgcggcagaagtgggtgtggccgtgagcctctgcaggctcaagagtgttgtccagatgtttctgtactggcatagaaaaaccaaataaaaggcctttattttta

SEQ ID NO: 568245 - DNA, 161 bp, Homo sapiens
gcggcaatgcttgactcacgctcatgtaatatcttacttcatgcagcacaactctccctcaagctgaggatcaggacttgggttgcttcctcatagaactctgaggctcttgtgttttttttcttctgctatgtgacttgcatcgttgagatcaggcatgt

SEQ ID NO: 568246 - DNA, 585 bp, Homo sapiens
  misc_feature (17)..(17): n is a, c, g, or t
  misc_feature (51)..(51): n is a, c, g, or t
  misc_feature (67)..(67): n is a, c, g, or t
  misc_feature (72)..(72): n is a, c, g, or t
aggtcaaacgagatcangtgcgttcagggtggtatggccgtcgacaaaaanggtgactctaaataancaatncctgtgttcccctggtggtcttctggaggcagctgaagggcacctggattgtgacatgcccaggggccctgggctgtgtgtctaccctcctctggcagggccactgcctggctcacagcccgtgatgagtgtgtggcatgcagtgggcgcacaggcattgattgaatcttttgaagataaaactaagctatctttgttccattctcctgctcagatcacccggaagttcaggctgaattctgaaggcaaacttgagcagacggtctccatggcaaccacgacacagccaatgactcagcatcttcacgtcacctacaagaaggtgaccccgtaaacctagagcttctggagccctcgggagggcctggctactgtgcctcaacggttcggctcctcaacagacagtccctgcggcagaagtgggtgtggccgtgagcctctgcaggctcaagagtgttgtccagatgtttctgtactggcatagaaaaaccaaataaaaggcctttattttta

SEQ ID NO: 568247 - DNA, 283 bp, Homo sapiens
  misc_feature (91)..(91): n is a, c, g, or t
  misc_feature (195)..(195): n is a, c, g, or t
  misc_feature (269)..(269): n is a, c, g, or t
  misc_feature (271)..(272): n is a, c, g, or t
gtacctcctgacctgaattaaatattccctcaaatgagccagaaccaaaaccctggtatccccaaaaacctaagccaaagaaatagatttnaaaaacaaaaacaatgcctgtaagaaatgaagtgggaattcatcaaattcaggaaagaaacagaagaaaaagacaaaaatatcttagaagtgaagaataaattnaaaaatgctcaagagaaaatagaaagaagatctaatgaaggacattgaatggaaatgagatttttgtaaaagtngnnaaggatctcag

SEQ ID NO: 568248 - DNA, 400 bp, Homo sapiens
aaggagccccacgtaaagcaggtgagcccagccctgctcccagcacgctcctgtcttctgtttgcagcggtctgtggagtcagcctcttcctcttccgtgagatccccggaagttcaggctgaattctgaaggcaaacttgagcagacggtctccatggcaaccacgacacagccaatgactcagcatcttcacgtcacctacaagaaggtgaccccgtaaacctagagcttctggagccctcgggagggcctggctactgtgcctcaacggttcggctcctcaacagacagtccctgcggcagaagtgggtgtggccgtgagcctctgcaggctcaagagtgttgtccagatgtttctgtactggcatagaaaaaccaaataaaaggcctttattttta

SEQ ID NO: 568249 - DNA, 208 bp, Homo sapiens
gagccaggtgcaaacatttcccgtcaattggcagaaaacaaccttgaggaaccttgacgagtgtccggagtttagaaaacttagggatgggtaagcctgctttcagtgtcttgggccaaaacatgaaaatttaaatttcttgcaggaaatttaaatttttgtttttgtgttttggttgagattttaataaaagaaaaatgaaatcaga

SEQ ID NO: 568250 - DNA, 339 bp, Homo sapiens
ccaaccacaaataatccatttttccagaatttgcctcctacgagggtggggggcaggattttgaacccaaaaaaaaacaaagttcaaaattttccatgtttttggaacccttagccctgtgcaaatcaaaggatgtgaggggaaaaaggggggggtcccccctggtcatttcgggaaaaaaaaaaggggcaattttggttggttgccccggaaaaaaaaatattttcaagcaggggtttccttggcttttttttttggatttcccactaaaaaccccaaggcccggaattttaaaaaaggaatttttggggggccctttgaaaaaaaaagcccttggga

SEQ ID NO: 568251 - DNA, 263 bp, Homo sapiens
gctttggcgtgcgttgacagcaaatgagcatgacctagcattgctattcgatttgacttgtaacccggcatcagcagagaggcccggatatccgcatccccacgcctgttcatccacaccaagcattaatctccccatcgccagctgatgactcaagattccaatggagttctgctcatcctaatgatggcccattctacttgctctggacctgccctcgcatcccctgccttcatcccagtaaagactccttgctatgttga

SEQ ID NO: 568252 - DNA, 2115 bp, Homo sapiens
  misc_feature (16)..(16): n is a, c, g, or t
  misc_feature (81)..(81): n is a, c, g, or t
ggcgaggacgcgggcnggggctggggcgggggcgggcccgctgcggggcgcctgcgcctccatcttgccgtacggcgcggncgccgcgggccggcccacgtcccgagccgtgtcgccgccgcgctccctccctcggggcggtccgcgggcgggcgggcggctagggccggggcctggctgcgcggctgggccaaggcccgcgatggtgatctgctgtgcggccgtgaactgctccaaccggcagggaaagggcgagaagcgcgccgtctccttccacaggttccccctaaaggactcaaaacgtctaatccaatggttaaaagctgttcagagggataactggactcccactaagtattcatttctctgtagtgagcatttcaccaaagacagcttctccaagaggctggaggaccagcatcgcctgctgaagcccacggccgtgccatccatcttccacctgaccgagaagaagaggggggctggaggccatggccgcacccggagaaaagatgccagcaaggccacagggggtgtgaggggacactcgagtgccgccaccagcagaggagctgcaggttggtcaccgtcctcgagtggaaacccgatggccaagccagagtcccgcaggttgaagcaagctgctctgcaaggtgaagccacacccagggcggcccaggaggccgccagccaggagcaggcccagcaagctctggaacggactccaggagatggactggccaccatggtggcaggcagtcagggaaaagcagaagcgtctgccacagatgctggcgatgagagcgccacttcctccatcgaagggggcgtgacagataagagtggcatttctatggatgactttacgcccccaggatctggggcgtgcaaatttatcggctcacttcattcgtacagtttctcctctaagcacacccgagaaaggccatctgtcccccgagagcccattgaccgcaagaggctgaagaaagatgtggaaccaagctgcagtgggagcagcctgggacccgacaagggcctggcccagagccctcccagctcatcacttaccgcgacaccgcagaagccttcccagagcccctctgcccctcctgccgacgtcaccccaaagccagccacggaagccgtgcagagcgagcacagcgacgccagccccatgtccatcaacgaggtcatcctgtcggcgtcaggggcctgcaagctcatcgactcactgcactcctactgcttctcctcccggcagaacaagagccaggtgtgctgcctgcgggagcaggtggagaagaagaacggcgagctgaagagcctgcggcagagggtcagccgctccgacagccaggtgcggaagctacaggagaagctggatgagctgaggagagtgagcgtcccctatccaagtagcctgctgtcgcccagccgcgagccccccaagatgaacccagtggtggagccactgtcctggatgctgggcacctggctgtcggacccacctggagccgggacctaccccacactgcagcccttccagtacctggaggaggttcacatctcccacgtgggccagcccatgctgaacttctcgttcaactccttccacccggacacgcgcaagccgatgcacagagagtgtggcttcattcgcctcaagcccgacaccaacaaggtggcctttgtcagcgcccagaacacaggcgtggtggaagtggaggagggcgaggtgaacgggcaggagctgtgcatcgcatcccactccatcgccaggatctccttcgccaaggagccccacgtagagcagatcacccggaagttcaggctgaattctgaaggcaaacttgagcagacggtctccatggcaaccacgacacagccaatgactcagcatcttcacgtcacctacaagaaggtgaccccgtaaacctagagcttctggagccctcgggagggcctggctactgtgcctcaacggttcggctcctcaacagacagtccctgcggcagaagtgggtgtggccgtgagcctctgcaggctcaagagtgttgtccagatgtttctgtactggcatagaaaaaccaaataaaaggcctttattttta

SEQ ID NO: 568253 - DNA, 825 bp, Homo sapiens
  misc_feature (332)..(332): n is a, c, g, or t
actcaatgcgtgctgcccacgcgatacggaccaggtcagtgcgaggattgagaggctatgcgttataaactactcacgtctgtatgggtgcgttggacttggatatcgatggtcaagattaccttccacaataacttaaggttctgacataaacgactgatgtactatatacacttcatggagtactgaatagatttagtctttggtctgacgagtagcaactgatatgcactgagtgtgacttcagattgcttcttgtacgtgacgggtagagcgtgacatgagataggtggcacacacatactgcccatttcatacgactacagtacggngttttcctgtctagtaggagatctactcgtgtgactgtacatatagatagccgctagtatctcttaacgtacgtggttatcctggtcgcctttaggctctcagcagtacatccctttgactgaatctcttcgctcgtatctaggcgatataaacgattaatgaaattacagtcgatgcacctataccaactcccgatgcggtgtagcggcaaagtgactactttttgtgattgatttgcgcattgtccccccaggggcttgatatcagtactatgagggcttttgcatgggtcaattatgcgcgaatggaccttaactgactcactctctagaacataagtggcttttgggccgaaacaactttttctccttgactactttcattttccacgcgcacataccctataggaatactaacccgaaaatacaattaaccaaggaagtgactccatgcgttcatttccttaatcgggtaaaatcacccgggacatca

SEQ ID NO: 568254 - DNA, 645 bp, Homo sapiens
  misc_feature (116)..(116): n is a, c, g, or t
tatcatcctcttccatcatcgtgcctatcttcctgctgctggacaaggatgacagcaagcctgccatgaggaagatcacacctacgagggcctgaacattgacccagacagccacnctatgagtacatagtgacgctgcgaccagggcaagtgaagtggtctgtagttgagcacccaggcccaggagtgagacccaggtcgccccaatgacctgggtgcagcctccctggcctcagtgactgcttcggagctgcctggctcatggcccaacccctttcccgaaccccccagctgtcctctgaagctggcccaccagagctgccatttgtctccagcccctggtgtccagctcttgccaaagggcctggagtagaaggacaacagggcaccaacttggagggagttctctgggcatggacggaacccagccttctgggggtcttatgaggtaatcctcccccacacatgggatggggcaggcagagactggtccagagcccccaaatggactcggagccgaggccctcccagcagagcttgggaagggccatggacccaactgggccccacaacagccccaggaacacccttcctctcccccaaccactcccacccccaggcagccctggcctccactgccttccc

SEQ ID NO: 568255 - DNA, 234 bp, Homo sapiens
aggtcgtggagggtctggtggtaattaggtttagattaaggcggtggatgtcttggtactttatatactcccctccaagggcactatcagacctcccactagaaaacagagagtacaatggtgaggggaagcgtggctgtagcacagacagcggaccaggcaggaccgacctactcctgagtgcagaagggcttagaggcaaacaaaggggaggaacactgccccgggccacca

SEQ ID NO: 568256 - DNA, 1958 bp, Homo sapiens
  misc_feature (93)..(93): n is a, c, g, or t
  misc_feature (99)..(99): n is a, c, g, or t
aagtggatgaagtcaatacggcttagggtgcgtgcaaaaatacttgttttgcttttacagttgattattttaaggggagacatttaattattnctaatnactttttgtcatttgtcctgtaggttccccctaaaggactcaaaacgtctaatccaatggttaaaagctgttcagagggataactggactcccactaagtattcatttctctgtagtgagcatttcaccaaagacagcttctccaagaggctggaggaccagcatcgcctgctgaagcccacggccgtgccatccatcttccacctgaccgagaagaagaggggggctggaggccatggccgcacccggagaaaagatgccagcaaggccacagggggtgtgaggggacactcgagtgccgccaccagcagaggagctgcaggttggtcaccgtcctcgagtggaaacccgatggccaagccagagtcccgcaggttgaagcaagctgctctgcaaggtgaagccacacccagggcggcccaggaggccgccagccaggagcaggcccagcaagctctggaacggactccaggagatggactggccaccatggtggcaggcagtcagggaaaagcagaagcgtctgccacagatgctggcgatgagagcgccacttcctccatcgaagggggcgtgacagataagagtggcatttctatggatgactttacgcccccaggatctggggcgtgcaaatttatcggctcacttcattcgtacagtttctcctctaagcacacccgagaaaggccatctgtcccccgagagcccattgaccgcaagaggctgaagaaagatgtggaaccaagctgcagtgggagcagcctgggacccgacaagggcctggcccagagccctcccagctcatcacttaccgcgacaccgcagaagccttcccagagcccctctgcccctcctgccgacgtcaccccaaagccagccacggaagccgtgcagagcgagcacagcgacgccagccccatgtccatcaacgaggtcatcctgtcggcgtcaggggcctgcaagctcatcgactcactgcactcctactgcttctcctcccggcagaacaagagccaggtgtgctgcctgcgggagcaggtggagaagaagaacggcgagctgaagagcctgcggcagagggtcagccgctccgacagccaggtgcggaagctacaggagaagctggatgagctgaggagagtgagcgtcccctatccaagtagcctgctgtcgcccagccgcgagccccccaagatgaacccagtggtggagccactgtcctggatgctgggcacctggctgtcggacccacctggagccgggacctaccccacactgcagcccttccagtacctggaggaggttcacatctcccacgtgggccagcccatgctgaacttctcgttcaactccttccacccggacacgcgcaagccgatgcacagagagtgtggcttcattcgcctcaagcccgacaccaacaaggtggcctttgtcagcgcccagaacacaggcgtggtggaagtggaggagggcgaggtgaacgggcaggagctgtgcatcgcatcccactccatcgccaggatctccttcgccaaggagccccacgtagagcagatcacccggaagttcaggctgaattctgaaggcaaacttgagcagacggtctccatggcaaccacgacacagccaatgactcagcatcttcacgtcacctacaagaaggtgaccccgtaaacctagagcttctggagccctcgggagggcctggctactgtgcctcaacggttcggctcctcaacagacagtccctgcggcagaagtgggtgtggccgtgagcctctgcaggctcaagagtgttgtccagatgtttctgtactggcatagaaaaaccaaataaaaggcctttattttta

SEQ ID NO: 568257 - DNA, 161 bp, Homo sapiens
tgggattacaggagtgagcccccgggcccacccttgccctgctttttaggagatggagttttttgaatttttctggatttaggttttctgtactattttttgtccccttgatgcaaactttttcagctgtgtagaaactttatgaaaagatgagggcttga

SEQ ID NO: 568258 - DNA, 111 bp, Homo sapiens
ttatcaccccttcccacgtaggtgaaacgtgcttctcgacacaagggacaaatggcttctattcccagagaatcaggtacaccataacctccctcttcagaatggaggtag

SEQ ID NO: 568259 - DNA, 2142 bp, Homo sapiens
  misc_feature (16)..(16): n is a, c, g, or t
  misc_feature (81)..(81): n is a, c, g, or t
ggcgaggacgcgggcnggggctggggcgggggcgggcccgctgcggggcgcctgcgcctccatcttgccgtacggcgcggncgccgcgggccggcccacgtcccgagccgtgtcgccgccgcgctccctccctcggggcggtccgcgggcgggcgggcggctagggccggggcctggctgcgcggctgggccaaggcccgcgatggtgatctgctgtgcggccgtgaactgctccaaccggcagggaaagggcgagaagcgcgccgtctccttccacaggttccccctaaaggactcaaaacgtctaatccaatggttaaaagctgttcagagggataactggactcccactaagtattcatttctctgtagtgagcatttcaccaaagacagcttctccaagaggctggaggaccagcatcgcctgctgaagcccacggccgtgccatccatcttccacctgaccgagaagaagaggggggctggaggccatggccgcacccggagaaaagatgccagcaaggccacagggggtgtgaggggacactcgagtgccgccaccagcagaggagctgcaggttggtcaccgtcctcgagtggaaacccgatggccaagccagagtcccgcaggttgaagcaagctgctctgcaaggtgaagccacacccagggcggcccaggaggccgccagccaggagcaggcccagcaagctctggaacggactccaggagatggactggccaccatggtggcaggcagtcagggaaaagcagaagcgtctgccacagatgctggcgatgagagcgccacttcctccatcgaagggggcgtgacagataagagtggcatttctatggatgactttacgcccccaggatctggggcgtgcaaatttatcggctcacttcattcgtacagtttctcctctaagcacacccgagaaaggccatctgtcccccgagagcccattgaccgcaagaggctgaagaaagatgtggaaccaagctgcagtgggagcagcctgggacccgacaagggcctggcccagagccctcccagctcatcacttaccgcgacaccgcagaagccttcccagagcccctctgcccctcctgccgacgtcaccccaaagccagccacggaagccgtgcagagcgagcacagcgacgccagccccatgtccatcaacgaggtcatcctgtcggcgtcaggggcctgcaagctcatcgactcactgcactcctactgcttctcctcccggcagaacaagagccaggtgtgctgcctgcgggagcaggtggagaagaagaacggcgagctgaagagcctgcggcagagggtcagccgctccgacagccaggtgcggaagctacaggagaagctggatgagctgaggagagtgagcgtcccctatccaagtagcctgctgtcgcccagccgcgagccccccaagatgaacccagtggtggagccactgtcctggatgctgggcacctggctgtcggacccacctggagccgggacctaccccacactgcagcccttccagtacctggaggaggttcacatctcccacgtgggccagcccatgctgaacttctcgttcaactccttccacccggacacgcgcaagccgatgcacagagagtgtggcttcattcgcctcaagcccgacaccaacaaggtggcctttgtcagcgcccagaacacaggcgtggtggaagtggaggagggcgaggtgaacgggcaggagctgtgcatcgcatcccactccatcgccaggatctccttcgccaaggagccccacgtagagcagatcacccggaagttcaggctgaattctgaaggcaaacttgagcagacggtctccatggcaaccacgacacagccaatgactcagcatcttcacgtcacctacaagaaggtgaccccgtaaacctagagcttctggagccctcgggagggcctggctactgtgcctcaacggttcggctcctcaacagacagtccctgcggcagaagtgggtgtggccgtgagcctctgcaggctcaagagtgttgtccagatgtttctgtactggcatagaaaaaccaaataaaaggcctttatttttatggctgaggattttgaatattagaaaa

SEQ ID NO: 568260 - DNA, 332 bp, Homo sapiens
  misc_feature (124)..(124): n is a, c, g, or t
  misc_feature (134)..(134): n is a, c, g, or t
  misc_feature (210)..(210): n is a, c, g, or t
  misc_feature (222)..(222): n is a, c, g, or t
  misc_feature (234)..(234): n is a, c, g, or t
  misc_feature (237)..(238): n is a, c, g, or t
  misc_feature (247)..(247): n is a, c, g, or t
  misc_feature (327)..(327): n is a, c, g, or t
gcttccgatacaagcgccaaaaatcgggttaaaagcagattaaagaagttttttacccgaagcccttccctgaaaactttgcaagaaaaagggcttattaaagatcaaatttttggctttcatntgcccaaagngtgtgaacgtgaaaattccccagttccgtggtttgtaaagcaatgcattgaagctgttgagaaaaaaggtgggtgnctgaatgtgcancagttccccccnttnntgccccctntacccaaccaatactcaagttagcagggccccctgatttgtttgagaagccatgcaattaaaacttgacttgtgttaatnggtta

SEQ ID NO: 568261 - DNA, 171 bp, Homo sapiens
cgagtacgtcgggcatactggataggcaagaaagtgttgtgggaagaatgtagattacgccgatgaatatgatagtgaaatggattttggcgtaggtttggtctagggtgtagccttgagagtaggggaaatcagtgaatgaagcctcctatgatggctatcaatagacga

SEQ ID NO: 568262 - DNA, 1690 bp, Homo sapiens
aaccacgtctaaggtccaaatgggtctatatagcttgtttcaaaagagataacgtcgagtctcttgtgagctcagacgttcaagtgagacctgctgtaccagcgtctcatttcctgacgaaaaggctggctgcgccgaagatccagccgcgtgtgagggacactcgagtgcgcacgcagagactgcagtgtcacgtctcagtgaaccgatgcagcaatccgcagtgaacagctgctctgcagtgacacaccagcggcagagcgcagcaggagcaggcccagcaagctctggaacggactccaggagatggactggccaccatggtggcaggcagtcagggaaaagcagaagcgtctgccacagatgctggcgatgagagcgccacttcctccatcgaagggggcgtgacagataagagtggcatttctatggatgactttacgcccccaggatctggggcgtgcaaatttatcggctcacttcattcgtacagtttctcctctaagcacacccgagaaaggccatctgtcccccgagagcccattgaccgcaagaggctgaagaaagatgtggaaccaagctgcagtgggagcagcctgggacccgacaagggcctggcccagagccctcccagctcatcacttaccgcgacaccgcagaagccttcccagagcccctctgcccctcctgccgacgtcaccccaaagccagccacggaagccgtgcagagcgagcacagcgacgccagccccatgtccatcaacgaggtcatcctgtcggcgtcaggggcctgcaagctcatcgactcactgcactcctactgcttctcctcccggcagaacaagagccaggtgtgctgcctgcgggagcaggtggagaagaagaacggcgagctgaagagcctgcggcagagggtcagccgctccgacagccaggtgcggaagctacaggagaagctggatgagctgaggagagtgagcgtcccctatccaagtagcctgctgtcgcccagccgcgagccccccaagatgaacccagtggtggagccactgtcctggatgctgggcacctggctgtcggacccacctggagccgggacctaccccacactgcagcccttccagtacctggaggaggttcacatctcccacgtgggccagcccatgctgaacttctcgttcaactccttccacccggacacgcgcaagccgatgcacagagagtgtggcttcattcgcctcaagcccgacaccaacaaggtggcctttgtcagcgcccagaacacaggcgtggtggaagtggaggagggcgaggtgaacgggcaggagctgtgcatcgcatcccactccatcgccaggatctccttcgccaaggagccccacgtagagcagatcacccggaagttcaggctgaattctgaaggcaaacttgagcagacggtctccatggcaaccacgacacagccaatgactcagcatcttcacgtcacctacaagaaggtgaccccgtaaacctagagcttctggagccctcgggagggcctggctactgtgcctcaacggttcggctcctcaacagacagtccctgcggcagaagtgggtgtggccgtgagcctctgcaggctcaagagtgttgtccagatgtttctgtactggcatagaaaaaccaaataaaaggcctttattttta

SEQ ID NO: 568263 - DNA, 320 bp, Homo sapiens
  misc_feature (124)..(124): n is a, c, g, or t
  misc_feature (134)..(134): n is a, c, g, or t
gcttccgatacaagcgccaaaaatcgggttaaaagcagattaaagaagttttttacccgaagcccttccctgaaaactttgcaagaaaaagggcttattaaagatcaaatttttggctttcatntgcccaaagngtgtgaacgtgaaaattccccagttccgtggtttgtaaagcaatgcattgaagctgttgagaaaaaaggtctagatgttgatggaatatatcgagttagtggcaatctggcaacaatacagaagttaagatttattgtcaaccaagaagagaagctgaatttggacgacagccagtgggaggacat

SEQ ID NO: 568264 - DNA, 878 bp, Homo sapiens
aatcttaacaacgggccccatccaccagaggggccccctaccccagaggggccgtggccccaagcggagtaaacaaaatgggcaaacaatggggaaagaatgcaccctttcagccccgcgggggtgggaatgttaacggcgccccccctgagcgaaaggtgtccccggtcgccgaacgtgtcacataagggtagacaccgggcgcccccactggttggcgagcgtagggcttgccccccaggagtgtgtcaaagaaccaaagtgtcgcaagacaggcgaagctggttttatacgctcaaattgtttggccgccgctttcgccctacgagcccccaactcggtgggcccaccccccacaaccattccatgcttgaattgccagacatccacaagtcaacaaatgtcaaaccacttgggaaattagtagtaccccccgtaaaatgcaagagcaacacctcttgagataacccttccaaaaaatgcaacaacctcattggacaacagcacccatgtaaaatgcccgaacttccatcacaatagttcccccacattctatatatctgcaagacccaccacggagtattgccttgactcactcaaggggaccaccaggagtgaccgcgtcgtggtcccccagagctccgagaaggcagaaggttgtgagtccccgagactttggacaacagccccgctgtactggggaacccccctgcatttccacggggaatcagacaatcgctgtttagacttagacacaatcaggggtgcacccaactatctgcggtagaaaaatttccacacgagctgagatagtatgaatgaacaagaccttgtacaagggtgtagtttcaaaaaaataccccccggaccacaagtcg

SEQ ID NO: 568265 - DNA, 635 bp, Homo sapiens
ttccccagaccaagaagttggaactctctatgagtgtttggcagtgatggtaaactggttttacattactgcaagtctcaggcgtggggatgaaccacaaagaaaatcaacttgctactacatgaactggcatttctccccggcaagagacagctctgaaaagttttgatgcttggtggcaagagattcacccagcatgtgcatcttcatttagtcatgtgtctcactctcatgttttatgccatcaagcaaaaacatccatcagccatgcaatggcactcccagcaacacacatgtggctctgctattcatgccccccccagccccatccatccaacagcatggtccatgcatcagtcacaccccattgctccctacttggtcaactattattgctgcagatctgcctccaaggttgaacaaggagactaagactgtataaacatcttcacttgtccagttctcacaaatgactgcaacttgttctcatggtaacaagttaaatatacctaaagggttcctttttattctctcaacggtcctaccatccatctctatgttttcccttttaacgccacatttgcactgctggctgcattccctcaactagtccagcaccaggccagtccacccgc

SEQ ID NO: 568266 - DNA, 758 bp, Homo sapiens
gttgttgttgtttatgcaaacagtgttgttatcagcctaaaataatgggctataagatagtatttacaagcctcaagttaccctcaaacaaaaaaacatacaacagataaaaataaaaaacacaagaaactaaatcatatcagcagagaaaattaccttcactaaaaggaagccaggaatgacagaaataaggaagagaagaccacaaaatagccagaaaacaaataacaagatggcaggactgagtccttacttatcaataataacattgaatgtaaatagtctaaatactccaatcaaaagatatagagtggctgaatggacaaaaacaaaaaacaaaaaacaaaaacccaaaaaacaaaacaaaaaaacccaccacaccaataaaaaacccaagacccattgatctgttgcctgcaagaaacacacttcacctataaagacacacagactgaaaataaagggatggacaaaaatattccatgccaatggcaatgaaaaagagcatgagttgctatacttacttctatcagacaaaaatagctttcaagatggaaactataagaagagacaaagaaggtaactatataatgataaaggggtcaacttcagtagaggatgtatactttaaaatattatgcaccaaaactggagcacctagactataagtaaatattattagagataagagaggagacggatctaatacaataataggtggaactttcacactccccttcaggctgggcgatttttaa

SEQ ID NO: 568267 - DNA, 142 bp, Homo sapiens
tggctggcatcgaaattgatccaaccctgggggttagtatagcttatttaaactttcgtattattgcataaagtgttaatcactgtcttgtttcccgtgggggtgtgactagcctaccgtggactactgggtaccgagctcg

SEQ ID NO: 568268 - DNA, 224 bp, Homo sapiens
gtctagcctcgtcagtggatatgaacttctcttgggtctagcctcgcctgtggtggtgcatgcctgtaatcccagctactcgggaggctgaggcacgagaatcacctgaacccggggcgatggaggttgtatgtgagctagagactgctgccacttgcactccgagccgtgagcaacaagagcaggactccaccattggcactggctgaggctaggacgtggta

SEQ ID NO: 568269 - DNA, 383 bp, Homo sapiens
  misc_feature (56)..(56): n is a, c, g, or t
  misc_feature (65)..(65): n is a, c, g, or t
  misc_feature (84)..(84): n is a, c, g, or t
ccaataggttccacaaaaaaaaaatttaataaaccacccacaccacggcaccatancacaatacnccatggtagccattctaantttttagaaccagaaatgagcttttaaaaagtcaccataggctgggtgtggtggttcacgcccggtaatcccagcacattgggaggctgaggcaggtggatcacctgaggtcaagagttcgagaccagcctggccaacatggtgaaaccccgtctctactagaaatacaaaaactagctgggtgtggtggcgtgtgcctgtaatcccagctacttgggaggctgagacaggagaatctcttgaacccaggaggcagatgttgcagtgagccaagattgtgccactgcactccagcctga

SEQ ID NO: 568270 - DNA, 99 bp, Homo sapiens
  misc_feature (29)..(29): n is a, c, g, or t
gttaatgtgtgctcacttcccctccattngttacgtgagagaatgcgtctgctgatcactgaaagtgtcccttttagtctcctgatccataggcgttct

SEQ ID NO: 568271 - DNA, 211 bp, Homo sapiens
ataccagctgattccattcacggtaaagtatacataaccagttgtcacattaaatcatttataagtatatggttagtggtctaagtacattcacactgctgtgcccccatcaccaccatccacctccagaacgttgtcatcttcccgaactgaaactctgtacccatgtaaactataactccccagtacccaccaccctcccagccccttg

SEQ ID NO: 568272 - DNA, 152 bp, Homo sapiens
  misc_feature (33)..(33): n is a, c, g, or t
cactctaccagattttacttgtagcacagcatntactccttaaaaaatgaggagagagaaaatctgctttctggacttgtaactctggtggagatcacgtttcccttgctgtttgcaggttcagaccccttaggacaagtatgaccccaaat

SEQ ID NO: 568273 - DNA, 1658 bp, Homo sapiens
  misc_feature (1250)..(1250): n is a, c, g, or t
  misc_feature (1491)..(1491): n is a, c, g, or t
  misc_feature (1658)..(1658): n is a, c, g, or t
taactggatcccaagtccccagggagggctttattttttcttttcaaacatccggtcctgggggctccctggggctcttttgggcgccggtatggccagaaaagccggggcggtggggcacggggccataacgggaaactaagcagaaggcttagagaaatttctttcttcttcctccagtgagatagactcagaggcttttctctcttctcttataaagacatggtcccggagacggggacttgagaccgggtcccgggtacacaggtggggtgggccaagttatacagagtgttctctacaggacaagaacgtggtgctccctctattctgggaggggccagaggggcgcctctcgcgtggagagaaaagaaggagagaggagaatgtgggagaggcgaggacacctctcatctcaagcacgcgcggtgcccagcgtgtgtggaccgtgagagaggggggaacactcgcgagggagaacgtgtggtctcgcggccctctcgcgcggagaccccacacagagaaaaagagtcgcgcagaaagtggcctccgggaggggcaccacatctcttctgtgggggtgaaaagtgcgcggggcgcaacacctgtgagaggacctcctctcccagagagggcgtgagaaacgccgggaggcgccgagaggggcggacacaaactatcgtcgcgctggggtgcgagataccgcgaaatcaacgcggtggggtgggccccaaagcgccaccagacgaagagggggccgccggagagtgtgtgacaccccgcgataaggcgcgggggagcgccgacgcgaggagggaaagacaacagagcagaggagaagcagcgcacccctggtgtggggacataggtgccgcggggggcccccattataaacagcggatcaacgaggagagagagaaacatccttacacaacggagagcgaccccacgtgacttgtggagctgtcgaagaaacacccccacaacgggtgttgtggccccaaaagagccacgccccacgatatgtagcacccaaaaggatcccacttggtggtggtgggcagaaccaccagggtgggggggcggcggacgactcatcaaaaagagagacaccccatatgggtggccccaataatctacacacaggagagacgaagtgagaggggcgcggcaccacaactgaggtgagcaatttgacgagcaccaaattaaacggaggggcgaccccacagtgaggagcagagagaacnagcacactgttaggcagggccaccaggctagatacaacaaacccgccggggcacgaggaagtgtatcgacccaagcaacggaagggtcggtagggtagcggccccaatgtgagaaggggcctcgctctggtgtgtggtgtgagcaccgccatgtgtgtgagcaatttggcggcgcgagaaacccctcagcgcggggtgagagagaagcacaaccaccgacagcaggagaaaagacgagagntcgacacgggacaacaaggctgagggaccaataccacggagagcgcacgacggaggagagagcacaccaacgggccaacgataggaacataacgcgcgacccacgtgcgtccaccaaaccagaggccggcgagtaaagaactccaggcggagacgaaggcacaagan

SEQ ID NO: 568274 - DNA, 170 bp, Homo sapiens
tcgactgtgttgcgtagtagtatgcggcagtagttacggactactataacttgttaacttaacgaactggttatgttacgggttgtacggtagaactgctattattcatcctatgtgggtaattgaggagtatgctaagattttgcgtacctgggtttggtttaatccac

SEQ ID NO: 568275 - DNA, 177 bp, Homo sapiens
aaacagggggcccaaaaacctggtttttttttttccaaatgggttttaaaacccctaaaggatccggtttccccaaaccctccgggggggggggtttcccccctcctagggggttccacccgggtttttgaggaaagccttccaaagggctttttaaaaaaaaatttttttttgcca

SEQ ID NO: 568276 - DNA, 706 bp, Homo sapiens
ctgatatttctggtcgagcagacatccccggcgctctccttccttaatatgggaataaacaccatgatcgtgctaagggaagcgagactcctggagacaaccccaggctcaaaactatggaatcctacacctagccacacaccagtgggagctgatactcctggacgaggtgatacaccaggccatgcgataccaagccatggaggcgcaacttccagttgctcgtaaaaacagttgggtatgaaacccccaaaaggagagagagatactcctgggcatggaaatggatgggctgatactcctcgaacagatcgaggtgtgagattctattggtgaaacaccgactcctggagccagtaaaagaaatatcgcggtgggatgaaacaccgtgctagtcagatgggtggaagcggtccagttctgacccctggaaagacaccaattggcacacctaggaatgaacatggctacccatactccaggtcacataatgagtatgactcctgaacagcttcaggcttggcggtgggaaagagaaattgatgagagaaatcgcccactttctgatgaggaattagatgctatgttcccagaaggatataaggtacttcctcctccagctggttatgttcctattcgaactccagctcgaaagctgacagctactccaacacctttgggtggtatgactggtatcaaatgcaaa

SEQ ID NO: 568277 - DNA, 379 bp, Homo sapiens
  misc_feature (222)..(222): n is a, c, g, or t
cccgaaccagtctttatctctccatcttccacttaatacccaagatctggtaactgtcatctgttgctaggatgatttaaatagcttcttactccacagccaaaaaaaaagattctttggaaaaaatgtaaatcatatactcagtcttccatttgctagattccaatggctttgcattacactgagaataaaatgcatactctaaaccatgacctaaggggncacggctaattctccaacatttccttccattttactcctccaatcattctctgcaccctttgaaaactttacaatttgactcactgcatgattcttcgtcactacctgtcatccataatgacccggattccagctgagggccggtcgtaccataccg

SEQ ID NO: 568278 - DNA, 210 bp, Homo sapiens
ccggatcccggtgccaccgcccgtgttgggcctcggcacctgttgcttgtgccaccgctaccgttgcgctgttacttgctcttgagttggatgcggttgcatttatctgcctgtcattctatttcattcttaatttatgctaggttttttttgtacgcgattcactgtacacactgagaaagggacgaactggacggtgcgttggcccca

SEQ ID NO: 568279 - DNA, 516 bp, Homo sapiens
cccgggactaaggttatctggtccaagcatcttctgaggaaagcatgaggctctagaggtggggaagttaatctctccaatgcgagatcaggtacgaccataatctatgtctcttctccgcccccctgtgtttacatgtatctctcccaatagaacagctgtctccttgatagaccacaaaaaaactttttgttagaccacaaaaaagcttaattcagataaacagtgctaattgatcatagaattaaagtcttggcctaatgagtggctaattgttttttagggatttaattcaagtccttagctgtcacattttttcatacgtattatacaaaattatatgtcaaaagcagattacttttatgtttaggttttcagactataagagtgactgatacatatcttctctattcttagagaatagactatgttaggaaagatttagtctgcattggctttgagggtgactgtctttggttaatgtctctcaaggtagattatattccttggcctttc

SEQ ID NO: 568280 - DNA, 1373 bp, Homo sapiens
  misc_feature (205)..(205): n is a, c, g, or t
atcatagagaatgtttaagagcagactgcattagtgacatttcgcacataagagatccctacaagtagcctgtatactagcacacttatgtcgaagttaatagatgaggacaccaagtatacctagtgaaccagcataacagagtggatcgaacgaagccataaaacggaaattctagagtcatggtatgagctcctagtctacntagtccggtatgtatagcatgaactagatatagagtagcactatgactgagaagcaattctgcataagtgaatatagtaaaagtggaagacgatcctcgaaaatatgcattgtaaaacatacagtctaatagcgcccacacgtgcaaatgacttttctctagcttgcgaatgactaaaaaaatgatgttggcctcttatgatcacataactcactattgaacgtgcgcaacttatccaggagccataatattagaagtaacacatagaatggagaattaaattcaaagtggcctggaaccattcgaaagaacattaatacgttgaaaataaaagaagtccattccacaagttggcgtatcccggaacgtctgaattgattgaaaagcaagcagctaaatccggagtagaacagcaccactcggaccgaacgcgaaaaggaacaaaactaaggtctagaaaattgactgaaacatgacaaacaagaggctacataaacccccgaacaagattcaggcaaaactctagaattgatgtagaacaaaacagcaccaacagaattcagacagagtgtaacctacccacgaagtctaaacaccaagaatgggcaacaaacgaaacgtgaagggaaaagcacgaaccgtacatagcaaaaagtcggccacaggcactccgatccccagaaaaagcaaaatgctggcgcctgacacacaacaaacacgcaaaacactgacccgtccaaccaaaagaacacaaaatgaacaccgcaacaacccagagaaaccctcactggacagacaccatccacaaaacacaagaccccaaaaggcacacaacaaacaaacaacccagaaattaaacggaaagaacacaaagagaaaaaagactggatcataaacaacaccacctcacaacaaaaatggaaccgacccactaagcaaaaacaccaaaaaaaagacaaaccacgcgcgaaccaagcacgacaacagatagcacaccacgcgcaccccacaatacacaggcacgtaccaccaaagcccggagatcatatacgaaagaatgaatgcaaaagagcgacgagacgacccacgttcaagacaacgaaccacacacccacaacacacaccgacgaacgaagcgacccaagcaacgacagaacgaatcaggacc

SEQ ID NO: 568281 - DNA, 567 bp, Homo sapiens
  misc_feature (85)..(85): n is a, c, g, or t
  misc_feature (281)..(281): n is a, c, g, or t
cgcttttatgtgtgccgcattggcgcaggcttttaaacgcgcttttctctcgggccccccccttggaagacacagtagggccacncctatttgtgctatgtggcccccgcgttttttcagtggggggggggccgccccatattgccttcaccacccacgacccgcaccccttttttttgccctcttggcaacaacaagcccaaccaatagtttaaggggtttaagtaggtttgcgggccccccctttcccaatcaatcccaaatcagtgggtgggaaaaancccccccccccccccagggcccctgaataatgtgcagttggaggatcccacccctcttgttcttgccgttccccccattggacctgaggggtgaaaccttgccccccctcctgtaagaaaaagggtatgttttaaattggccaaattgggccccgggttaccctggggggttcaaaccctaaggaaaaattggtttttgggggccaagggggattaaaccctttttgggattttgggtatagtttttttaaattttcccccaaataaaaaagggacatgggtttta

SEQ ID NO: 568282 - DNA, 104 bp, Homo sapiens
ttacgggtaaaacgagacaacgaaagtggctttaacatatctgaacacacaatagctaagaccaaactgggattagataccccactatgattttgggcttagaa

SEQ ID NO: 568283 - DNA, 140 bp, Homo sapiens
ttacccacaacaagcctcagtagtattcgagtctcccttcaccatttgcgacggcatctacggctcaacatgtaggggtagccacaggcttccacggacttcacgtcatgatgggctcaactgtcctcattacatgccat

SEQ ID NO: 568284 - DNA, 950 bp, Homo sapiens
ggcctcatcacttgtggtgagccgctgatgaagtagctgacaaggcaagtaccgttgggcattcgggcacattgtgggagaccaagccgccctgtcttgcgggttccacgtgcacgagttcacgtggtggcccggcgccgtcataggcggatgagtggcaacgcgtgacaatccacgggatggcagaagaactgtcctcgagcttcggccgcagcgtgagccatggaagggacatgcatatcctagtgtcccatcgcgcacactgcccgtcgatccactctgtcccgcgcgccgaatcgtcgttgacacgtcaagctgcgccgatgctcgctgggccgctatgcattcccacgcttggtatgcatccgacgtgtcaaacgcgccgcacgcacagagggatcatccaaaggcgtggtctgtaacacacctgttgaacgccaggggcccacaagtgcacgtcgattcgttccaccgcgtgggaccgaccaccgtgtaggcctcgagctttgctaggcctgtcctgtggtgaccacaggcttttcgccccaggtcgtctgaatggacgacacggtgttcgtagaaagggggctgcatggtcgaggaccaggcccatctcgtcacgctgagcgttcaggctcgcgctaggcacataggatgcccgacacctcccggtgaggctcaaatacatcattgtcactcaggtgcaggcacagggcctcaaatctctggatgacaccctgcgcccacctcctgggtctctgacggcctgccgaagccaagctgcctgactgcctcatgatgggaccagcatgccgcttggagaaggggtggcctcgccggagctagggagctggatgatggtgggctggccggactcactggacatgtgggtgttcggcttgaccccgggcccactgggcagcttgctgatggggcagtgcagggagtcc

SEQ ID NO: 568285 - DNA, 473 bp, Homo sapiens
tccaacaccgcatctaccaagattgaatcatgaagaaatggaaagtctgatcagaccaataatgagagagattgaatcagtaatcaaaaacctcccaacacagtaaaagcccaggaccagatggcttcatcggagaatgctaccaaacatttaaagaagaattatcgccaatcctcctgaaactcttccaaaaaaatgaagaggagggaacatttccaagctcattccatgaggccagctttaccctgattccaaagccagacaaagacaccacaaaaaaagaaaacttcagaccattatctccgatgaatattgatgcaaaaatcctcaacaagatactagcaaatcaaattcagcatatgaaaaggattataagccacgaccaagtgggatttgtccctggaatggaaggtttgttcagcatacaattaatggggagctgggcgcagtggcttatgcctgtaatcccatca

SEQ ID NO: 568286 - DNA, 199 bp, Homo sapiens
cttgcttcccagcccaaaggcccaataggggaatcaggtaatggccttttttgccggtgaattttaattttttgggagagaagagaaatcaaaaaagggtccaaacaggggaagaaaaggacaaaggggaaaaacccttttcaaatgcaagtaattcccttaaacacttggaacccgtgttttagacacaaatttaaaa

SEQ ID NO: 568287 - DNA, 698 bp, Homo sapiens
cacctaaaagccaataatgggaataggaaaagactcatatcaacattgtcgtcattggacacgttagattcgggccagtccaccactacgtgtgctcactctgatctataacatgcggatggcgatcgcatcaaagacgcaaccattgagaaacatgtgacaaggaggctgctgagatgggaaagggctccttcaagtatgcctggcgtccttggataaacgtgataccatgctgcacgtcgtgagacgttggtatacaccattgatatctcgcttgatggaaatttgagaccagcaagtactatgtgactatcattgatgccccaggacacagagactttatcaaaaacgtgattacagggactatctcaagactgactgtgctgtcctgatggttgctgctggatgtgtaggcttcgacatttgagaggctggttatctccaaaaactgggacagacccgatgagctagtgcccttcgtggcttacagcactgaggatgtgaaacaactaagttgtacagtgttaacaaacatggattcccactgagcctgcctacaagcataagagtatattgaaggaagttgttagggcatagtctagtcatctctcacattcaacgtatccctttgggtttaccaaaacgcacgtagtacatgtgagcattgtgtgccaaatttctggttcggaattggtgac

SEQ ID NO: 568288 - DNA, 885 bp, Homo sapiens
ttccgcccaccaccacgcgatgatcgtccagccccccgtggggcgacttcttcttctggtcgcccgccacctcatcacgacgccccgcaggtaggggttggtgctcttctcttgtggtgtgagtacgaccccacccctcacaacgcggtggtctgccaccgccgcgcgctctacctcttctcgtctcgttctacgccgcagcagcgcgaggtgtgttctcctctctctcgtcggaggcgggttgtcccccgcacccgaccacgacgacgcggggcggcgcaccgcgcccctcccccgcgcgcatagaattccactcccccccccccctccgttcactctctctcgcgcggcgtgcccacaccctgttgtttctccgcgcggaccactccaccctcttctctgtaggctcctctctcgcggcgtgctgctctctcccaccgcgcgccccgccgggcgcgcgccctctcttcgccgaccccagcgccgtgtcccccccacacgcctctcgcgctcgcacaatgttcgcgcgcggcgcgcgcgcgcacattacacgctctctctctctctcaccacgccacagcttggctttgtgcgacgcctcttctgtgcgcgcgcagcgggcgctggctctttcacccccgcgccaccgcggtgtgtctgtcactcccctctccttttgtcgcagccgattatcccggccctccctatgtgggtgtggcgacacatcccccatctctctccgctcgtgatggaaccccccgcaggacccacccctctttcttcggcgctggtcgctcccccgggagacccccccccccccttttttttggcccccccccccccccctttttggggggggaaaaaaaccggtttgagagagaaata

SEQ ID NO: 568289 - DNA, 203 bp, Homo sapiens
gagatcgcgccactgcactccagccttggcgacagagcaagactcaaaaaaaaaaaaaagaaatttctatttggggggtggatcctaccaccctgttttttaacacatgatggtgtttcaaagagcagagcccttaacccggtataaggcgttgctttgggttggggctgaagggcctgggcttgacttgggggccaaaccag

SEQ ID NO: 568290 - DNA, 384 bp, Homo sapiens
agcgtttaccgatcagtgcactggcctccagcgcgacgagtctcgtctgctttctacctcatgaactggcctttctctaacactgtcagatagctgtgaacgtgtaacagtctccctttttggtgtctggctactttcactaagcatcatgtcctcaagcgccatccacatagcagagtgtgtcagaatttccttcctttaccagactgagtaatactccattgtatgtacggacactttgtttgtctatcacccatcaacagacacagcctgtgtccacatatggtcactgggaacaacgctgctatagaccatgtgactacgcacatccgcttgagtctgtgttcagctatttcggatacgtgcgcaaggcggtaaaagctt

SEQ ID NO: 568291 - DNA, 652 bp, Homo sapiens
  misc_feature (2)..(2): n is a, c, g, or t
  misc_feature (84)..(84): n is a, c, g, or t
  misc_feature (101)..(101): n is a, c, g, or t
  misc_feature (166)..(166): n is a, c, g, or t
  misc_feature (269)..(270): n is a, c, g, or t
  misc_feature (272)..(272): n is a, c, g, or t
  misc_feature (319)..(319): n is a, c, g, or t
  misc_feature (359)..(359): n is a, c, g, or t
  misc_feature (447)..(447): n is a, c, g, or t
  misc_feature (468)..(469): n is a, c, g, or t
  misc_feature (558)..(558): n is a, c, g, or t
  misc_feature (563)..(563): n is a, c, g, or t
anaaccagacacagttcctttcgctctggttagttggttggcagtccgtgcgcacaccaagggcggacttcgattcaatgcccntgccccagccagctgtngggggcagcccatattccagggcagttcagaagttttctctctgaactggcctctcctccccgcngcctggcctctggcctgttcttcaaaaagctgccgctgccgcatgggatcattcagctcagtatacgcattgcatatctctttcttcatgacaaacagctcgnngngctcagtcagaccctctttagagcggtgccatttagcccagggctcnttatctgtgggtgatcacagatgaatgtaggattgatgcnagtcacttccaggaactccccaacaagcttgtcaaggagcctggctgtggtccgaggtggagggcattcaacagcttttgccacacanatatcatcaagaattttgcgnntttcttcagtttcaaagaggttcgtttctggcagcttcatccccagggctttctcaagctcttctaccatgttgattcgccggaagggnggggngaagtcaacatcgtaggcttagccctctgggcatcctgggtggtaggtgaccttgtaactgcctgtaatatgcttcaccatccctgaaa

SEQ ID NO: 568292 - DNA, 102 bp, Homo sapiens
  misc_feature (21)..(21): n is a, c, g, or t
tgggaggatgcttgatcccanggagttggcggctgcagtgacctatgatcacatcactgtactccagtctgggcaacagagcgagatttgtctctaaaaatt

SEQ ID NO: 568293 - DNA, 563 bp, Homo sapiens
  misc_feature (33)..(33): n is a, c, g, or t
  misc_feature (38)..(39): n is a, c, g, or t
  misc_feature (51)..(51): n is a, c, g, or t
  misc_feature (57)..(57): n is a, c, g, or t
  misc_feature (73)..(73): n is a, c, g, or t
  misc_feature (80)..(80): n is a, c, g, or t
  misc_feature (93)..(94): n is a, c, g, or t
  misc_feature (108)..(108): n is a, c, g, or t
  misc_feature (134)..(134): n is a, c, g, or t
  misc_feature (140)..(140): n is a, c, g, or t
  misc_feature (142)..(142): n is a, c, g, or t
  misc_feature (154)..(154): n is a, c, g, or t
  misc_feature (156)..(156): n is a, c, g, or t
  misc_feature (411)..(411): n is a, c, g, or t
  misc_feature (478)..(479): n is a, c, g, or t
  misc_feature (484)..(484): n is a, c, g, or t
  misc_feature (488)..(488): n is a, c, g, or t
  misc_feature (492)..(492): n is a, c, g, or t
  misc_feature (496)..(497): n is a, c, g, or t
  misc_feature (499)..(499): n is a, c, g, or t
  misc_feature (501)..(501): n is a, c, g, or t
  misc_feature (507)..(507): n is a, c, g, or t
  misc_feature (509)..(509): n is a, c, g, or t
  misc_feature (511)..(511): n is a, c, g, or t
  misc_feature (521)..(522): n is a, c, g, or t
  misc_feature (526)..(526): n is a, c, g, or t
  misc_feature (539)..(539): n is a, c, g, or t
  misc_feature (541)..(541): n is a, c, g, or t
  misc_feature (544)..(544): n is a, c, g, or t
  misc_feature (551)..(552): n is a, c, g, or t
  misc_feature (558)..(559): n is a, c, g, or t
cacagtaacatgaccagtcccgaacgtgacgantttanngcccatctccancgtaanctcggcgccggtgacntccctcncgctggtcaccannccggcaccagaaanctgtgaaggtcgaaacagctgcgttncctgtntnaatgttagcgtngntaatactacctgcttgcggatagaatgtaaagatgagagctattgttcacataactcaacagttagtgattgtcaagtggggaacacgacagacttctgttccgtttccacggccactccagtgccaacagccaattctacagctaaacccacagttcagccctccccttctacaacttccaagacagttactacatcaggtacaacaaataacactgtgactccaacctcacaacctgtgcgaaagtctacctntgatgcagccagtttcattggaggaattgtcctggtcttgggtgtgcaggctgtaattttctttctnnataanttcngcanatcnnangnacgaantnancacactctgnnaacngacccattgaatnantanggactgnntcattnnagtg

SEQ ID NO: 568294 - DNA, 537 bp, Homo sapiens
ggaattgctgcgtttgtgttgtgttgtgttgttgtcgtcgttttatgagatggagtttcactctgttgcccaggctggagtgcagtggcgtgatctcggctcgcccgcaacattctgcttcccaggtctcaggtgattctacctgccatcggcctcccgagtagctgggattagggcatgcgcacaccacaacctggcctaattatggacgtccctccagtacgagatcgcgcgtttctccaatgttggtcacggctggctctcgaacctcctgcacctctaggtgaatccaccacgacactcgaccctcccaaaagtgctgcggcatgatatacacggcattgacgccacgcagtaacccggaccgcgacgccagcccagcacgcccaaggcctcaccgatcgcgtccgcgtacaacgcacatccgaaacggatcccttaccccaaacaaggacgggcgcaccatgtcgggctacaccaccctggtgacatcccccgagcgcaccttccacggagcggccgaacgccgcgccggcg

SEQ ID NO: 568295 - DNA, 526 bp, Homo sapiens
  misc_feature (33)..(33): n is a, c, g, or t
  misc_feature (38)..(39): n is a, c, g, or t
  misc_feature (51)..(51): n is a, c, g, or t
  misc_feature (57)..(57): n is a, c, g, or t
  misc_feature (73)..(73): n is a, c, g, or t
  misc_feature (80)..(80): n is a, c, g, or t
  misc_feature (93)..(94): n is a, c, g, or t
  misc_feature (108)..(108): n is a, c, g, or t
  misc_feature (134)..(134): n is a, c, g, or t
  misc_feature (140)..(140): n is a, c, g, or t
  misc_feature (142)..(142): n is a, c, g, or t
  misc_feature (154)..(154): n is a, c, g, or t
  misc_feature (156)..(156): n is a, c, g, or t
cacagtaacatgaccagtcccgaacgtgacgantttanngcccatctccancgtaanctcggcgccggtgacntccctcncgctggtcaccannccggcaccagaaanctgtgaaggtcgaaacagctgcgttncctgtntnaatgttagcgtngntaatactacctgcttgcggatagaatgtaaagatgagagctattgttcacataactcaacagttagtgattgtcaagtggggaacacgacagacttctgttccgtttccacggccactccagtgccaacagccaattctacagctaaacccagcccatgaccccttacaggggccctctcagccctcctaacgacctcagcagcctggacttcactgtccatatcactatcagtaattcggtcacaaccactgaaccagtctctaagatgttctaagctttccctcatcatcctgtcttcctctgagccctccaaagtctgccacctctgcctattgcctagtccccaagtgtaatttatttttagccgt

SEQ ID NO: 568296 - DNA, 540 bp, Homo sapiens
agatataactgaagcttaaacttttgtggcttgaagggggtgtggtcaatagaggggctcaaagtcttccaaggaaacagtggaagccacttatgttcacacattgtttttggaacttttaccattggaaaacccccccctctggccagcagtttaacacagtgaactttccattaaatatactttggctgggcttaattcccaaaaattggctgagaataaccacatgatgtagagacatactcctcaagctcatggtttaaatgcaattgagggggtgacgaacgtgggctgtggtcaacctgacctcatcctagcctgaattgagagcttgatcaaaggccatgatgaactagtgcaaattattggcaagtgaaccttgaccaagtgagttttggacacataggcacactctggcataccgggccttgtccagccgttctttcaggtagcacttggaattccacttctgaataaaacaatccctcttaaacaagggggcactttacttacggtcaaattagagaagttttctttctg

SEQ ID NO: 568297 - DNA, 227 bp, Homo sapiens
gcggctttgaccgagaggctgctggagctcgtgtttggacgcgatgtttcgtctgaactaactttctgctttggaaaactggctgtgggttctcgatggtaccatggaggatcaagaccatccagatccggcgagactaatgatggtggctttcctggagactctcagtaactacagatactggtctttgtggaaaggccatcgaatctccacctgtatgaacacta

SEQ ID NO: 568298 - DNA, 128 bp, Homo sapiens
  misc_feature (83)..(83): n is a, c, g, or t
tacacgagtaaacatctctgggtgtgaggactctgaattctaacaaatgccagtgactgtcgcacttgagtttgagggcagtnggcctgatgaacgctcagacccctccagcttagagtcttgcattt

SEQ ID NO: 568299 - DNA, 113 bp, Homo sapiens
cggacttcgacaaccagacactggcagtgctgcggggcccatggtgcgtacctgatgcgctcgcgtgagatcaccctgggcagacaaccaaggataaccagattgatgtggac

SEQ ID NO: 568300 - DNA, 184 bp, Homo sapiens
tctcaccgtctacacctggactacgtccaaactctccacggcactgcacagaaggctgcacgtacaaaacacacagaggcggagaatttcaccatgacgaatcgatgtgtgccagatgagggagcgagaacatggacccgccccaagtgttccgctcttcctgcccaaacatattctgtgacgg

SEQ ID NO: 568301 - DNA, 720 bp, Homo sapiens
tagacctatttatgattcagtgccaatttcagataggatgtgaacatgggatgttcattggaaataggttaaatgttgttataataaaaagggttttgtatataaatgtgtggtcagtgactattttccgaaatcatgtttcatcaagaccaccctttgttctaaaataggccttgcataacaacatatgcaccacgtatgtgcacgggccacacatatttttgtataatagttgggtttgattataaaagtgttgtcaaaagttttatttatctgcatatagcagtggttggcttttttgaattgaaattattttgcgcattgaaagcattgaaataagggaaattatttatcttctgagcactaaacttatttttgcataatattctgtaataattgcagtccccagatccagaacatgggaagttaggggaaatagtgtgattttgtgttttgaatatactgtcaagaattacataacaccaattaccgaccaaactttttttaaaagacatttcattgtgactgccaaaaatctgaataatttatatttcttgtttttttctttatatgttttgcattttaatatgttgagccactgggaatttgtaacagattaatttgttataggagtttaaatgtgttgtcattgtctcccttgtctttgtccagagcctattattatgggaaccataaaatttattgtgtcagttgctttga

SEQ ID NO: 568302 - DNA, 488 bp, Homo sapiens
  misc_feature (4)..(4): n is a, c, g, or t
  misc_feature (183)..(184): n is a, c, g, or t
  misc_feature (187)..(187): n is a, c, g, or t
  misc_feature (195)..(195): n is a, c, g, or t
  misc_feature (206)..(206): n is a, c, g, or t
  misc_feature (209)..(209): n is a, c, g, or t
  misc_feature (266)..(266): n is a, c, g, or t
  misc_feature (272)..(272): n is a, c, g, or t
  misc_feature (286)..(286): n is a, c, g, or t
  misc_feature (301)..(301): n is a, c, g, or t
  misc_feature (306)..(306): n is a, c, g, or t
  misc_feature (314)..(314): n is a, c, g, or t
  misc_feature (321)..(321): n is a, c, g, or t
  misc_feature (327)..(327): n is a, c, g, or t
  misc_feature (331)..(331): n is a, c, g, or t
  misc_feature (400)..(400): n is a, c, g, or t
  misc_feature (411)..(411): n is a, c, g, or t
  misc_feature (483)..(483): n is a, c, g, or t
ggcncaccacgggcaggggcctgcacccagctgcagacgctctatcaaatggaacaaggagttggggaaaggcggggcaggcagcctgttgcaggcaggaggaaggagaagagacttaggggctgttacctctcctgaggcccccagcctgaaactatacaacatccaggtggaaatagaacnngtncctcaacnggggggcagtnctntacagtggaggggagggctttcacgcccacccaccccctggccctgccaacagaaantacatnaacacaatagaagnaaactaaaaaactcnctgcnccctgtantaaaganaactgntgancagaagtttcttgtttgcttggctccccatattgccttttgagttggcaaccctgggcttgggcccctncctccggcccnaagtgttggctctgcaaaaacactggggttcccttcaagtacacgaggggttaggctgctgtacctaagtantccat

SEQ ID NO: 568303 - DNA, 209 bp, Homo sapiens
atctagcaggattccccaatctgtgtcgaccaggttgagactgtcgaccatggttgagatcatatctggatgagggtgggtcctggtccatagtgaccgatgtccttgctaggatgggaaactggacacatgacacagcgataaatgccactgtgacggcatttaccgtggagttgtacgccacatactaagcacagagggtagcacca

SEQ ID NO: 568304 - DNA, 496 bp, Homo sapiens
gctctgccttcccacctctttgaagtgccttttcttggatgctccttgtggcccatgaggactctattcacttttttgctggtttttggcctacatgttttgaatcttttgccagggctgtttccctgtgtgttggcatgtttaatgaactgtgtatgtaacattgattccacatctagtgtttacttgctgagaaatatgtgcaaatgtaacttagtgcactgataacctcactctcgtcattggtgtctagctgccacctccctccccgcccctgccccccttccctttcctcctcttccctttctatcgcttcgtcttcccttcccacccccccatcttcgctccatccttccacgcttgccttgtctcctaacctctcctttcccctggcccttcggctctcccctacttcccactcaccctgccctcccctcccatgcatctccctctattccaattctcccttccaccctctcctcctcccacctcctca

SEQ ID NO: 568305 - DNA, 246 bp, Homo sapiens
gcgttgatatcctaagcttctcgacctgcagatgcacgcaggcatccacagctaagctggaacactgaagcgttccagcagactgagtccctgatcaggtaaccctgtgtatgcgacagaaaggcggtctgaaacatgtgatgcgctccttcatagaggccgtctgctccctctttgctgcccgtagcactgggagtcaggcccagtctgctccaaccttggtctggtatgaggacactgcacaaa

SEQ ID NO: 568306 - DNA, 312 bp, Homo sapiens
ctggcttactgtacacatggctggcaaaaagagaagatgtagccaccattttgaacatgcctagtcccaggtagtatagtccagtgggcacaactgctggcattcacctgtgcaagcttacagcttggttgtttatgtctgcagctcagtttcacaggctgctctttgttagagaagaaaatgattttggggttgcttttctggaaaaccttaccaaggactataccctcgctatctgcctaagtaatttcttcttaactcctatatcactgtgaaatctgaaagcaaatcaataagtatttcactctctac

SEQ ID NO: 568307 - DNA, 822 bp, Homo sapiens
aataaggcttaggtcgaggcctgtgtttggtgataccagacgaagcagtggcatgcatgctgccgcttgacctggactgtccagacagcacgcgcaggatgcgcaccaggtcgaagacgttgcggcgcgcgtgtaagcgttcagtgcagtgggtgaactgctcccgctccgcctcgctcagcagcgcggtcagcgcttggtgcagctggcgcacgttggcatgacaagtaacctgcatgccccgtgcccccgcctgcgcctgcccctgtgcgcctgatgcccagctgagcctggtgtgaggactgagctcacctgactgtgcctgtccaggcggcgctgttcatctccacgcctgaggcccgtgcgggctctgagcgcgcggggtgtgggcgtgtgccgctgtcctcgcggggtactggcgcgaccggctggatccccggtgagcgcggagacgagcggctggagccgtgggtttggggagcacgtggtacagtgggtggagtcctagggggtcggggagacccctgctagagtcccgggaggcgcgaagacggcgggggtcgcggaacctggaatccgggtgacgcggagacgtcggcgtggttcctgacgatacgccgcagtcggcttgctccagcccggagtgtgggcggagaactgttgctggaagtccgtggtttcgcggggatcagcaggctacattctggagggtccggagacgagcggtggtggtgtttggtgggcacggaagctgacctgctaccgtcaccatcccggggtccccaccgggcgccgtcctaggtgtgtacccagtagagtgtc

SEQ ID NO: 568308 - DNA, 407 bp, Homo sapiens
acagcacgcgctaacaattaggtgcactcagtaggttgtctgcagttaatgttagcaggtgttaggcgtacggccaggctattggttgaatgaagtaggctgatggtttctataattactagttatggtgataaggggtgtacgtgtgccttgatggtatgaagtgggctatggcatttttaatcttagagcgaaagcctataatcactggctgcccgctcattaatggggcatggtccatgtgctaggatttatatgatagttgaggtggttggtgtcaatcagtgaggcaggagtccgtaggaggttatttgtggctgtaaaaatcattaaggatactagaataagagatcaggttcgtcctttagtgttgtgtatggttatcatttgttatgaggttagtttga

SEQ ID NO: 568309 - DNA, 217 bp, Homo sapiens
ccataacttggtttagactgatgatgaggaattacactttggcaccaggttatgggtctggtattatttacgaacaaatgtttatccagcggtttgaactcttctatgtggattagtacagtctggacttctttgccttttaccagggtccgggattgtgactgttcgtttcttcagctctgtgcctccagaatttcatgtttatgctgcacaaggc

SEQ ID NO: 568310 - DNA, 175 bp, Homo sapiens
atccccgatggaaacgggttttcatcttataaacccagacagaagaattctcagagtcttctttgtgatgtgtgctttcaactcaccgagataaagatttctcttgatagagcaatttggaaacactctttttgtagaatttgcaagggtacattgagagcgctttcaggcctat

SEQ ID NO: 568311 - DNA, 616 bp, Homo sapiens
agcggaggctctcctgcggagtccccgcgagagtaggggcggtcggcggcgctagtctgctgcggagcgccgggtgccaccggaccactgcgggtaggcctatggccgtagggtcgaggagctggtctgtcgcccggtggagcctcggcttacctccgcatgtcgcccaggctgtccttccacgcggctatagacgtagccagcgcagaagtgtcttcgccgacataagggactgctgtggtggcgacacgcgggaagtggggctccgtgccgagttgaacagtggcaagcgtgagcagcgagtggaacttggcgtgaatctgggacccctgactagaatagaagggcaatacgggtaatcgggccaacccatcccataagctgaagaagagcaaacatgccgcagtgccccgaggaaggaagaggaggcaggtgcgtggtactgtacagcattcccgctggcaagcgcacagccagcgccatgggagacatgatggaagagttcgtgtacaaggtctgcgagggacgttggagggtcatcccatatgatgtgctccctgactggctaaaggacaacgagtatctgctagcatggtcatagacctcccatgccctc

SEQ ID NO: 568312 - DNA, 197 bp, Homo sapiens
agcgtctcatccgggtccccggctcacggcgagccgcttggggccttcggtctctcttctcgttgtgactcgtttggcacattattggtccttcgtgtcttgccccttgcctgatgtctccgtttacgtgctcaagctctcggcattgctgtagggcgagcgaacttgtccttgtggttctaatttggctgctatat

SEQ ID NO: 568313 - DNA, 307 bp, Homo sapiens
aggcggtcctatctcgtcatagcctacagcagtgccgtcgaatggtcgacgccgctctggccacttgcagcccagaagaggcccgcacggtcgtcctggagctagctgacccgagtgtcgaggttcttgtcagctgatacatgatcctcaatccgctaaagcccccgcagagggggctttagcatgctccgcgggggaggacaatggggccatgactaaaactgccgtggtcacaggagcaagttcgggaatcagcgcggtcacggtccgcgctttaacggacgatggctgaccgtcatctgtgcag

SEQ ID NO: 568314 - DNA, 488 bp, Homo sapiens
atcataatctgtcattatattctaaattttccccaaattctagccgagtatgtaattggaagtaacttatggaagcttaactaatttaaccaggcttggagtgcaagagattgaagagttcaaatctgacccagatgttgatgttgggtaaagagaattctctgcttcccacctctaagttggcagccctcctaaagctacctgtggagcaacctgctcagatacatcaaacatggagacagcactcaaagtagaattataaagaagatcatgtccatgttaacattattataaccctacattttgtgcataaagtgtaagtgtatagcatatcaatattaaaaagcaagcaagcagaatttggaattcatccaatccaaatgcggcatcttcaaacctccatgatgctgcttacatgtctcgatcccacttaactatcttgggctgtgacaaagtcacatggttcacacggcaggcatactcatctt

SEQ ID NO: 568315 - DNA, 1397 bp, Homo sapiens
tggtatgaaagtcttggtaatgttaccaaatgaaaaaatgcagtactttacacctctattgatgtaaatgaggctcaaacatctcaattcacatcctcgttcctacccccgcagccatcaaagcgtaaataacgtgctaatatgaacccttaaaaaaacaagaagacaaaacaaagaaaaaacaaaaaaacaaaaaagaagaagaaaagaaaaaacaacaagaaaagaaaaacacaagaagagaagagagggggcgccgagaagaaaagaaacgacacccccagggggacgcaccagagatagacgaacgacacagcataactacaagacacaaggggaccccacaaagaaaggcacgcggaaaaaataaagaacacaagagacacacggagccacagcgacaacacaaaacacgagaaaagtaaaacgagaaacacacagtgacaggaaagtgagaacataaagggaagaaagagagaccccagaaccaggggcgcgtgacagacaataaatcagtaggaagagaacagcacacacacgccagaggacaagaaagcaagaagcgagggccagcgcgagaactggacgaagagaacagacgacatgcgccacgagggcatcgcagcgcaggaacgagaggcacaagccgcacgccgacaaagcatgagcgggagcgcggcgacacaaaacacagtcagccacaccagcgcgacaccgaggcgagcccgaagtgagccacacacaccaggaccacccaacaagaacacccacaccacgcgagagagagcacgcaaacaagacaacaccacataacgaactagaagccaacagcgcccaccagcagacacaaagcacgagcacgaaagcagcgccgcaagcaaagaggacacccgacgacaacgccaacacacagcgcagccggaccaccacaaacagacgccacgcaacccagcacgacgagccagacaggaggaaaggagacgcaagcgagagaacagagcaaggagagccgagggaagcgaagaacggtaaaaagaggagagcgagacgacgagagagagaaggaagactagcacaaaggtcgcgcgagcagcagcgcagaaggccgagaagagaaagaagaaagaaggagagaggccagggcgagacgcacacaggacacgcaacgagcacgcggcagagaaagggacagacgacgcggaagacagacacagagaagacgagaggaccagcaggcacagagagccgacacagaggaagaacagaggagcgaaacgcaacgaggcacaacaacacaaccgacggcaggcacaggaacgacaagaagagccaggcacctaagcagaacgcgcgcagacaggcggcgagcgcgagagagggagcaaaaaaagcgcagg

SEQ ID NO: 568316 - DNA, 207 bp, Homo sapiens
  misc_feature (171)..(171): n is a, c, g, or t
acaaggtatagctcttgagactaggctgtaaaaagcctgtggcttcgctttagctctgcctgattcacttactctggaagaggaccctcaatggccctgtggagagatccacgtggactgaaccgcaggcctctggcccaacagcgcagctctggactatgcaagccacgngtcaatcccatcaagccacggttcaaccgcacaagc

SEQ ID NO: 568317 - DNA, 257 bp, Homo sapiens
ctgatctagaggatccgggactgggtcgagttcaggagtgatctgaagatacagtcagaaagataggaaagacgggcgcatggtcactgctgtaatacaaactttgagaggtcacggtgggcggatcatctaaggtcaagagttcgagactagcctggccaacatggtgaaaccccgcctctactaaacaatacaaaaattatgctgggggcatggtggttgcgtgccctgtacatccccagctactctggacggct

SEQ ID NO: 568318 - DNA, 126 bp, Homo sapiens
cctagaggatccaggccggtcagaaaggaaggctgtgagagagggcaggtttgcgggcttcgtccccttttccaaagacaacaaagagtccttccccaactcccaactcaaccccttttggaacta

SEQ ID NO: 568319 - DNA, 460 bp, Homo sapiens
  misc_feature (190)..(191): n is a, c, g, or t
  misc_feature (338)..(338): n is a, c, g, or t
aaaggcaaagggagggcccagaacccgggggtgtcccccgccccccttccccgagggagattccaaaacccaggcaagccctccctgcctggttaaaggtttttttccccccaaccttcccttggggtgggagagccatgggcgccgggggaaccattcaaagaccccccctcccgtggttgggttccgnngggtccttttttcttttaaacaagcttcccgtggacaaaaacaggtggcagcagggggaggtttttttttggtccgtgaaggatgggggtttggccaaccccttcacgcaaaagagcctttccctgttcccgggttaattagttggncgggcggcaagccccccctccccggggtttttgggttgcccggggatgtttgggccgttccccgtttttattttttcccgggcccccgcatgggaattaagcccccccccctgccctgggga

SEQ ID NO: 568320 - DNA, 386 bp, Homo sapiens
tttccttgtcagtaactactttgctgacttctttccaatttctttctctaaatcccccaaccaatccctgcacagacccttttggggctggtgtctgccaacattatgttgaagttgccggggacacacagatttctgattttaagctgtttaggggtttgcaccgtcttaacagcaagcaaaggtgagtgacttgtacgtaactcgctcaagttgacacagtcggagagtggaagctgggactcaaagccagcctgtgacttcttagaccacatgctgtctcccagcattagttctggaaaaggaagagcccccaggaaacaccattctgtccatcacatccctgtgcccctttcatcttgacggacccaccctagcactggccc

SEQ ID NO: 568321 - DNA, 1035 bp, Homo sapiens
  misc_feature (33)..(33): n is a, c, g, or t
  misc_feature (67)..(68): n is a, c, g, or t
  misc_feature (104)..(104): n is a, c, g, or t
  misc_feature (107)..(107): n is a, c, g, or t
  misc_feature (118)..(118): n is a, c, g, or t
  misc_feature (128)..(128): n is a, c, g, or t
  misc_feature (160)..(160): n is a, c, g, or t
  misc_feature (164)..(164): n is a, c, g, or t
  misc_feature (166)..(166): n is a, c, g, or t
  misc_feature (179)..(179): n is a, c, g, or t
  misc_feature (184)..(184): n is a, c, g, or t
  misc_feature (205)..(205): n is a, c, g, or t
  misc_feature (210)..(211): n is a, c, g, or t
  misc_feature (232)..(232): n is a, c, g, or t
  misc_feature (243)..(243): n is a, c, g, or t
  misc_feature (266)..(266): n is a, c, g, or t
  misc_feature (276)..(276): n is a, c, g, or t
  misc_feature (310)..(310): n is a, c, g, or t
  misc_feature (378)..(378): n is a, c, g, or t
  misc_feature (424)..(424): n is a, c, g, or t
  misc_feature (429)..(429): n is a, c, g, or t
  misc_feature (451)..(451): n is a, c, g, or t
  misc_feature (467)..(467): n is a, c, g, or t
  misc_feature (548)..(548): n is a, c, g, or t
  misc_feature (557)..(557): n is a, c, g, or t
  misc_feature (613)..(613): n is a, c, g, or t
  misc_feature (1006)..(1006): n is a, c, g, or t
acccccaacaccgcaacacaaatcgacagccantcctcaggcggcacttttttggagtggagagcanngccctgaatgagccacctacatggaacatagtattngcnatacgcaactngagccccaancgctcatgacacgcacagaagcgcggctgtanacanangcacacacacgcngggangctcatgcggacccccactcnacacnncgcaacacgccagcgccagtngttcccgacantcgtcatctatacagtgcctgantctgggttcngggcctggctcatgtaagacaggcagcaaggtcngggtgccatgaatcacacctgcaatcccagcactttggaaatctgtggtgagaggatctcttaaagcnatggccttgaaaccagcctgggtaacaaaaccaagcccttgtatcnaaaanacaaaagggcaggtagattccngataaataatgttgcngggagggggtgataaaatacagaaatgtgatacacagcaaaccctcaactgctgtttcattggctcccagtgtcttaatcngtgtctgcnaacactttaaggtacatctgaaataccccccaaacccagaaagcttttcaacagcnaggttgtccaagaacttggaaaattcaccttctgatgtcctccaagacagattccattttttatacaccttatttgctcagacctgtaacttcagcctggagtgaacacagacacctagttttcctcaaactcctcttgggctttagagagaaggtgctggccctttgagccaagcaggttattggttagtagtacctctcagctctgaaggtttttcaatggtatatagcaacaagctgctctgtaagatagaggcagactgtcatcaggaatacctgtattcaccctgggaggcagctgaattccccaggatagattatgagatgctgggaacattactgtaacgctggctttgcataaagatgggtcttgtccccattccttcaccagtnagctcttgtgggctgaacattgcaacaac

SEQ ID NO: 568322 - DNA, 560 bp, Homo sapiens
  misc_feature (128)..(128): n is a, c, g, or t
  misc_feature (500)..(500): n is a, c, g, or t
ggtctctaagttccttggctcactacagccttcaagcccctggggctcaagcaatctgcctcccaaagtgatgagattacaggagtgagccaccgcaatcggcctagtggatagtgtatactaagcancatatacccctgcttttgcctagaacatactgaaaaacatggcattaaaaccaatcacaaaagttgggagctgagaaaaatcatatactgtaaaacaaatctgacagatattaatctcaggaagctcctgaaaatgtctcaagaactcctatgctgcactctccctaataatttagactttctacagatattttctgatcatctaccgtgtgtcaggcaccatgccaggtaccaagatgccatggtgaggaatacacaaaaccggctcctgcttgcaggacacctactctctcaaacagtgcttgccaagctcgactgatcacaacttgggagcttgtttaagttccaaatcggcttccctgcttaggtgancacaatccgtggcatttttatcaggtgctcccaatgattcctacgctctaacgggtttgg

SEQ ID NO: 568323 - DNA, 1241 bp, Homo sapiens
gtctatctcagtgacctgtgtgtggttttgcttagtgtgcgtgtgctgtgtgtgtgtgctttttctctagtgtgttttgggttggctggtggccctggtgccttcctgagtttccatgagcgcagacgtgggacacgcgtgagccaaccattgccactgtggcccggatgcttgtggtttgtctgcacaaaccttacttgtgaccccgctgtgatgacccttcgacgacaatctcgtctctgaccaagatgctgaagcttgatctggcgactgtactggggctccgtgaaccaaaacgttgacggtcttgggacgggtacaaattttacccttgtgccaaagactcctgcaaaggcctgcccggtgacaccttggcttgactgctttgcattgatgaccaggacccaccggtgcgtcttgtatctgaccgtgcaaattggccctggcatgcgggagcgggttgtgttcccggcatatgagggttgcttggattgatgggcaaagactgacagctttgctttcacattcctgggggccctgcacagatcagcaggcatctcctttagaacgagagacttgccttgggagaagcccaagtggacgttaccaatgcttggtggcttatgggacccaaaggttcctagtcccaaacaaatggattccagataaagaaacaaaacacgataacatccatagaccaatcacagcgattagctcagctgcagcattgtgcgcatctccagaaaagaattatatacaaaaaacctaccgcttttgtgtggcggtgtgccccaagagtgagtgtgtgtctgaccaactgtgtcaaaccaaccggtactccctcgtaagctccctccgatcacgagaaaagatagtgtagaatcacaccgatcatcagcgagggcgtggtggaaacagaggcagatgtctgaacacacaccatgatgtgataagtgggagacaagtgggtctatctaccagcggagtcctaacgggtcccaactcaattcccgcctcgcacctgtggagagagagtaggcagaccgcaggtgaaatggaggcagggacgaagggctttgaggttagtatggttaactggaaatcggtagctgggaatggtagcgtgcggtgcgttgtgggtgcgtgtcgaaccgggaatgggaggagagaggcagctaatggattgtggtgcaggtagcgctgagggagcgggtagggtgtgctaccatcgtgagaccggt

SEQ ID NO: 568324 - DNA, 89 bp, Homo sapiens
  misc_feature (16)..(16): n is a, c, g, or t
  misc_feature (52)..(52): n is a, c, g, or t
gaatccggaacgaganctagtcccgggttcaagcaattcctcatattgaagngagtaataaaataaagaaatgtgtaatttataaatta

SEQ ID NO: 568325 - DNA, 1008 bp, Homo sapiens
tcactgggaccaaaatttagtttaatcattttaattaacaagtgtatttaaaaaatcataaagggggttgcataatccaaagtgtgaaacatttattcttcagtagcgttcagaaatttaacaaccaatggtaaaccgatgcttatccaaatccagtcttcgttggctatttatcaaaacttctgagatctagtatttaaagcggttcacattcataaatgtattagtttagaaattaagtattggtacactgtgtggaataagggttgtctgaaagcagtttatcaaatataaagaagggtttcatatctaagaatcagcaggtgagggaagaaattttaaacacctatcaagaaatcaagtaatccattttaaaaatacacagaaccgagtgctgctcgtctgtcataaaagagaccatgtaaacattaattttaatagactctgggataatatttgaattcccccaacagaggccttcaatccgtacttaaagatattttacacacagtaaccatcaggatcaactgagtaaaaatctcaggtataaaccagtgcccttaaacatgtgcatattccctaagcaggaacaggttactttggagcaacaaagctgacttgtgtaaccttcccctccaatgttacttacacataacactgctgatggcacactctttcacaaacactcgggcatacatggcaatcgccccaacaaaagaacagcgaataaaattcgtccaattataaaaagttcacgcgtaaaacaggaacacctaggcgcaagacagaaagagaaagaaggaaacacgcgcaacaacagcgactaagagacacaagagctacaaaagatgtaggcacaagaagaaacgtgaaaaaatagagaaacattagtccagcaaacataatagaagaaacacacatagaacaagcagagggaaaagtaatgtgacagagaaaacgccacgacggaaagtggacacacacctaccatcgcttccttgccaaagg

SEQ ID NO: 568326 - DNA, 233 bp, Homo sapiens
  misc_feature (102)..(102): n is a, c, g, or t
  misc_feature (164)..(164): n is a, c, g, or t
ctgcaacccacacctgggtccagctgactccttagcctgtgtgtcctttctatcaacaggctgtaagggacccacaccacctcgtgtgccttctctcctgtnactgagctgtaggactgcaagtcccttaagacagggagattttaatctctggatgcccagtnatagcccagtgcttggcactgtcagacgggggaacaaaagtctgttgcagtggacgaggcgctgcccct

SEQ ID NO: 568327 - DNA, 154 bp, Homo sapiens
aagctgctaaggtgatgaagtagtcctggagatagacagtgtggcaaggctgtacaacaatgtcagttgtatgtatgccattgaactcgtatactttagaaagtcaaaatggtaatttttttattaccttttattttctaatacctgggggaaa

SEQ ID NO: 568328 - DNA, 679 bp, Homo sapiens
aagggctgctcctgtggtgtcagagaaagacagccccttacaagaaatgtcaacatccagaacttccacataagctggcaaggatggcctcgggttctgtgcttgtgatccaccgagatcggcccgagcttgattgactacgggaagtctgcggcaaggatagatcgcagctcacagaatctgtaatacgcgcttattagacgatgagcacgaggaaagtgagcctggatcatccaccaatgatgctggatgccgaagatcatcgtctggaagctggcgcgaccgggatgaagaaaagcccatcagtgaacttaacgctggtcctagaacctgtacatagcgcaagcggccatatcgtcctgggaaggcaccaaggaaagggcccgggaggaacaatgcggagccaagtgcgacgatcgtgcccaagggatgttaaggggcgcggatccaaaaccccaaggggaagggaaaagcggagcccaaggcgtctacatggcacaggacttaaccgaaaggaaatgggctggcgcgccaaggtggaaattccctggtacaggacgttgcgattcctgtctcgcaacaaaattcccccgttggggcatggaggaaaccctgtgtgttgcccccggaaggaaaacaaccaattggcatttgccaattgtgaaaaccaaggaaaagc

SEQ ID NO: 568329 - DNA, 156 bp, Homo sapiens
tagcggacgttatctctgatcgctcccgactcatgagtctgtctgcttcggctaccaaagtgctgggattacaggcatgagccaccgagccggcccactgattttttcttgtatttttctcccaccatctctctcaggctatcgcattttattaat

SEQ ID NO: 568330 - DNA, 106 bp, Homo sapiens
tcaggtcactgggtctgggatcagattctgtgaagttagtgagcttcaggcacgtgcatgtgtattgtgtgcatagtaatgtgtcccctgtgtcatgtgtgcaatg

SEQ ID NO: 568331 - DNA, 177 bp, Homo sapiens
  misc_feature (161)..(161): n is a, c, g, or t
aacatatacgaatcgagctcttaccagcctgctgcacagctgcttactcaccagtgtttttgaggcacaggcttcaagagaacaccaccactgagtggcctggagggctctccctgcttggagctaggtagtcaaacatgtcaataatcaggccgaccttnaggctctagactttgg

SEQ ID NO: 568332 - DNA, 210 bp, Homo sapiens
  misc_feature (141)..(141): n is a, c, g, or t
  misc_feature (149)..(149): n is a, c, g, or t
  misc_feature (194)..(194): n is a, c, g, or t
gctcgaattcgtcgagtggagtcttggcaggttctgttcccagccggtcctttgagatcctgcctcaggggatgtgaccctatatcatcctgatatcccaaggagcaaaaaaacaaataccctcccttcggggttttgggnggccttgnagacccactctgccctccttgggctcccagactggagcagaacanaccacacactgcccaa

SEQ ID NO: 568333 - DNA, 122 bp, Homo sapiens
aggatacccagctgttcttcatgactgtatctagaaaatttactactgtggcagatgaagactgattaaatcgaattggggggaacgggaagggcctgtggttcttctttttgattaattgc

SEQ ID NO: 568334 - DNA, 189 bp, Homo sapiens
ttgcggatcctgtggaatcctcctgctgctttcttcataaaccagttgggatctccacggtagtgcccatcattcttggtcactgccgtggagatcccaactggtttatgaagaaagcgcaggagcatatgagggaattcacagcagagccagctgcaggagggaaagcatgtcattggccttcagatg

SEQ ID NO: 568335 - DNA, 387 bp, Homo sapiens
tccggcgctgtggagtagtcaataaaaagtctcatcatatggcttattctgtgactcgttattgtaccgatccgtagtgtctgagtactatcacgaaacaaatctgtgcaagataccagttgacattcagcatatattactatatatttcgtgttctatgatgcaaagatattgatcaagacttaagaggtgcaacaaatgtgtcattgtgtcttaacacgagcatgtcggacaactctcgagatttaatatactgatttaagcacagtaaattagaaagaccccatttagtctcattcaggagcggtccattatgtcgatcatctagaatcagcatggattgaccaatctctgaaagccgggagccccaggtccagagaatcatta

SEQ ID NO: 568336 - DNA, 145 bp, Homo sapiens
agcttgctcccaatcagctcattgcaaaagtgttgtcccaccctgcggtcggaaaggcaaatccattcaggtggtcatataagtgccagtgcagaggaatctgtgttgagtagtataattcagtcatccttcccataccagactc

SEQ ID NO: 568337 - DNA, 400 bp, Homo sapiens
acagcactgactgagtctctctctttttttcttcttcagtctgtttggtaaagatttgtcattttgtccatcttttgaagaaccaactttggtttcattgatttttctcttttgtttttctcttctctatttatctctgctttgatctttattattttcttccttctgctagctttgggtttagtttgttctattttatttttttgagacggactcttgctctgtcgcccaggctagagtgcaatggagcgatctcgggtcactggaaactctggctcccaggttcaagtgattctcctgactcaggctcctgagtagctgggattaccggtgcccggcaacaagcccagctaatttttgtatcttaagtagagatggggtttcaccatcttgaacaggc

SEQ ID NO: 568338 - DNA, 274 bp, Homo sapiens
cgctgcccataggtgctgtggaccaactgagctgtgacagctcccccgccacagaatacgccagccgcatgcggaacggagggagctgtgtccagcctggccgctgcctgctgcctgcaggatggcggggtgacacttgccagtcagatgtggatgaatgcagtgctaggaggggcggctgtccccagcgctgcgtcaaacaccgtcggcagttactggtgccagtgttgggaggggcacagcctgtctgcagacggtacactctgtttgccca

SEQ ID NO: 568339 - DNA, 443 bp, Homo sapiens
  misc_feature (58)..(58): n is a, c, g, or t
  misc_feature (76)..(77): n is a, c, g, or t
  misc_feature (79)..(80): n is a, c, g, or t
  misc_feature (83)..(83): n is a, c, g, or t
  misc_feature (90)..(90): n is a, c, g, or t
  misc_feature (92)..(92): n is a, c, g, or t
  misc_feature (102)..(102): n is a, c, g, or t
  misc_feature (125)..(125): n is a, c, g, or t
  misc_feature (330)..(330): n is a, c, g, or t
  misc_feature (427)..(427): n is a, c, g, or t
gataagacggcgtcggtgttgcagtctgtgtccttggaggtgaccagggccactgcangcatggtgctagagctgnncnnctntgaccgngngggaagcaangcccgggagatggaaccaaaganaaaccatttaaaacaagtctaaaagctttaataacaataaggaaaaaaccatttcctaccatttacgtagattcacaaaaagaaaataagaagtaaaatgttatttctaaatcacagttaaagaacattaaaaagatataacatagaaaacaaataaagagtaaatccgcggaaaaaaaagaaacagaagatagtttactaaaanaaaagaacctagaagaaacaaagaagattaccattaaaaataatccaagtctcccagagccaaaatatataaaaattaatacattagaaaaatatangaaccaaagagtgaaa

SEQ ID NO: 568340 - DNA, 863 bp, Homo sapiens
  misc_feature (621)..(621): n is a, c, g, or t
  misc_feature (783)..(783): n is a, c, g, or t
gagtgggcaggcccgagcttccacccagttacccccaggccctgaagtgactcggtcccggatgaatatctcagtctcgattcacctctaagcctgagacccactgtaatgcttcgcagggtattccctgtagaagtcgaccgagtctgtactcatagccagtctcagggcatcacattgggacttgtcacggcagggaatgccgcacgtaggagatagaagcactcagcactatctagcccctggcacctacatggcgtggaaggtcgacagactgacgtgcgccccatctcagcgagtcacgttttgagcgaggtcggtattcaacagaccttggatgacccatcacggcccaggccccttggggtggttgcctcgcggtgcgacttggttactagcgcatcgcgcgatctggtcgttccccttgacgacgttagcagactagactgcccaacggctgctggattgccaaggatgcttcagcaactagactcagaggattgccccaatcgagcacaaataacggctcgcacatgcatgttagccagacatccccttgtgtccatggcgatagctctaaatagaagagcgtggagcccaccttgtggcacaaacaggtcntatctccaaagttggccgtggtttaggacaaattctacccaataaagcccattgttaaccgacggttatcggaaatctcgcttttccccaatcccaacgtgtaattcggatccgcgcggcttcaaaattgtacacctaatggcgaatgtattgtcgaaatcntcatattggcaatctaaccacattgttttaccttttccccattcatttttgctgcaacttggctgaataaacctaggtgt

SEQ ID NO: 568341 - DNA, 107 bp, Homo sapiens
ctgaggtatttttcacagattgattgaattaaaaaaactcaccttgcattttcattgtgggtgcttagagaggttctacaaaattcaactgtgaggttatgctcata

SEQ ID NO: 568342 - DNA, 338 bp, Homo sapiens
taaatgggggttttttccccccccccccagtggccccccggggggagcgggcttttttggaaaacccaaggggggcggccccccgttccaaaaaaattttttcccgggtgggtccttttgggttaaattttcctttaaaaccccttggggtagggttaagccttttaaaaggtggttttgggaattgggcccccattctaatccgggggggatggggggggccctgccttaaacccttttttgggcggggattccccttgggggggtttttgctaagggaacccgggtaaattttttgggaacaaaattttttttttaaaaaaaaggctttttcccca

SEQ ID NO: 568343 - DNA, 644 bp, Homo sapiens
  misc_feature (314)..(314): n is a, c, g, or t
  misc_feature (576)..(576): n is a, c, g, or t
agcagtggttcagctgtatgatgggaatatgaatattccagaactttctgtatgccaggtgattgagaacaaccagtctttaaatattaccttggctttttaaaaagtttttggccattccattttgaaacttaaagatatttttttaaaaaaataaaaatcttggtccagggtccaggtgggtttacccccttgaaatcccaacccttttgggaggcgcgggccggccaaaatccaagggtaggggagttttcacaaacctttttcttgcccaaattggggggaaacccccgcttcttctataaaaacaaaanaatttcgcccgcgcccccggtgggccctaaaatctcaagggggtggggggggggagagaattttttttaccccccgcggcggggggggtgtgttttgttttataagagaaaaacaatttttctttcttcccgggggggtggaaagccccgcctcccttctttttttcttataaaattttttttttattttataaaaagaatatttttttatttttttgtggcggcccgcgcaaaaaaagaggcttttttttttgttgggacnccccccctttttgtgggggggggggggggttaatatatatgggggggggcgggggtgttttttcacgg

SEQ ID NO: 568344 - DNA, 160 bp, Homo sapiens
ccttcgagaactcatagaacggaagaccagctccttggatcgcaacgatcaggtggacatgggaaggcagtggcttgcaatccagaagttgcgaagcaaaatccacaaaatagtagataggagagccagcagaggcaggaaacttcgggttcatgtcctt

SEQ ID NO: 568345 - DNA, 489 bp, Homo sapiens
ggaccgctctagagtatccccacctcctaccccacgattcagtttgccagtattttactgaggatttttgcatcgatgttcatcagggatattgttctaaaattctctttttttgttctgtctctgccaggctttggtatcaggatgatgctggcctcataagatgagttagggaggattccctgtttttctattgattggaatagtttcagaaggaatggtaccagctcctccttgtacttctggtagaattcggctgtgaatccatctggtcctggactttttttggttggtaggctattaattattgcctcgatttcagagcctgttattggtctattcaggaattcaacttcttcctggtttagtcttgggagggtgtatgtgtccaggaatttatccatttcttctagattttctagtgtatttgcatagaggtgtttatagtattctctgatggtagtttgtaattccgtggggtaggaggtg

SEQ ID NO: 568346 - DNA, 395 bp, Homo sapiens
  misc_feature (363)..(363): n is a, c, g, or t
  misc_feature (387)..(387): n is a, c, g, or t
tgtgaggggcagccagtgacgtcacggctggctgtcatctgtggaacgtcttcttgtcacatggggatcagcaaagacccgatttttgtaccaggcgtctgggggccttatttctcagccatggtacctgggttctggctgaatgaaggtggtcagagcgttactggaaaattgatagaccacatggtacaaggccatgctgcttttccagaactacaagtaaaggccacagccaggatgccagagtatatattgcatatttgaacagtcacctgggatcttgattaaggaagggttcagcctgtggggttttcctttactgtttgattttacatgtttgggccagatttccctgggcaaccngttttccctttaggcagatcttgnacattaaa

SEQ ID NO: 568347 - DNA, 156 bp, Homo sapiens
tcttccctctcgccttgagtgaagaacatcccaagccaaaaagaagttaactacagtgtattcctttgcaccgatccccaccccagttcaatcccggaagggacctaattaggaaacccttctttactagatatcctggacccctgggcttgtgaa

SEQ ID NO: 568348 - DNA, 244 bp, Homo sapiens
ctcaccaagtgcatctggcagcttctcagcagagcaccatggctcgttctggaaagggccagtcggcaagtatcgcccctgtacacctctgaaatccacactcccaattctttctgcgacagaatactcctgtatgttagcgatcacagatcctggccccagaggcttgggccttactctcctccccagcttccttctcctgctgctcacgaaaccctttcccctctgagcacgcagggacaag

SEQ ID NO: 568349 - DNA, 274 bp, Homo sapiens
cacccatagagtacgacaccaatgaatgctaatatacactttataggcacagacagtccagattctaatttctggtactgctagaatactagctactagctctgtgcatattcaaccactattcctatacaataccatcctctacctattgaacgtgctgttgtgatgattaaatcggctcccagaatcttcacttcccagtaactttatctcccagattccctcccatatcagaatctcctcttaggcggttagttattcaacttcttcctga

SEQ ID NO: 568350 - DNA, 595 bp, Homo sapiens
  misc_feature (21)..(21): n is a, c, g, or t
  misc_feature (59)..(59): n is a, c, g, or t
  misc_feature (89)..(89): n is a, c, g, or t
  misc_feature (95)..(95): n is a, c, g, or t
  misc_feature (122)..(122): n is a, c, g, or t
  misc_feature (136)..(136): n is a, c, g, or t
  misc_feature (152)..(155): n is a, c, g, or t
  misc_feature (164)..(164): n is a, c, g, or t
  misc_feature (257)..(257): n is a, c, g, or t
  misc_feature (287)..(287): n is a, c, g, or t
  misc_feature (291)..(291): n is a, c, g, or t
  misc_feature (295)..(295): n is a, c, g, or t
  misc_feature (311)..(312): n is a, c, g, or t
  misc_feature (352)..(353): n is a, c, g, or t
  misc_feature (355)..(355): n is a, c, g, or t
  misc_feature (364)..(364): n is a, c, g, or t
  misc_feature (368)..(370): n is a, c, g, or t
  misc_feature (383)..(383): n is a, c, g, or t
  misc_feature (388)..(388): n is a, c, g, or t
  misc_feature (443)..(443): n is a, c, g, or t
  misc_feature (477)..(477): n is a, c, g, or t
  misc_feature (492)..(492): n is a, c, g, or t
  misc_feature (511)..(511): n is a, c, g, or t
  misc_feature (523)..(523): n is a, c, g, or t
  misc_feature (584)..(584): n is a, c, g, or t
acaagggggaagtgctgggcnataattaatgtttttattaaatttggagggaagttttngcagcctttggcgtagggctggcgttgagncccgtnaggtgcaaagcaagtgtcgttgatcgnaattgctagttttncccccccccccccccnnnnccccccccnggcgtacaccgaccgcgcagggaaacatcgagagtgtaaataaatacatcgcctcttgttcggatttttgctactaccgaaaatatgtaaatngtgaactctgttggctctttttggatatantttnatanttatgtgccagatttnntaggaaatctccagtctaatagtgtcttataaatatctanncnccccccccnacannnctcaacacctatntactnagctctagttcaggggaggtaacagcaagttgcattaataattgggttacttaantaggtaagattttcgtagataattgttaacgatnaataaaaatataggnttggtaatgttttggttgntacagtgagcgntttttggagttattttattttgggtaattgtgtatgctttgtatatgaaactggttggcanttattgctagt

SEQ ID NO: 568351 - DNA, 325 bp, Homo sapiens
aagagctaagaatcagattgcttattaaaacagaatttttttattttttcctagaggaactcatacttaacaaatccagttaaccataatactccacccaaatcccaaatttaaatgctttatgtccaccctggcatagtaaaattataaaagggtatttctaaattataatatttatccataatgcaccatttaaactgtcacatttaccagcagaattatgaaatcaaaaacaaattctacattcaagggacaaacgatacatgctcttccatggtttaaagagtccattccattcttggtagtatactactcccatatttta

SEQ ID NO: 568352 - DNA, 101 bp, Homo sapiens
cacagtgagcacagttggaaagggtcagtgagatatgttactatggcatcagtgaggacttaatgagggtaagagactagtgagggcacaggaggatgaag

SEQ ID NO: 568353 - DNA, 164 bp, Homo sapiens
atcgagctcggtacctttcctaatcacataacctattcccccgagcatctcattacaatatacacaccaagcaaacaagtgttcaaccagtaactactactaatcaacgcccagtaagtcatacaaagcccccggtaccaataggcatcctcccgaatcaaccc

SEQ ID NO: 568354 - DNA, 269 bp, Homo sapiens
  misc_feature (223)..(223): n is a, c, g, or t
  misc_feature (246)..(246): n is a, c, g, or t
cgaccagtcagtcaggatgacacttcggcatcatctcttccctctcccatcgtatttggttccctttttttttggttttgtttgggctaatgaaagagcgccttgactttaagaggtttcgtagtcaacttctctagccatactggggtatgctacacacgtgagcggggggacctagttgaatgtgtctttacgtgtggctatgtaacaaacaaagcgaaancaactgatcttctatacccctgncctcacagaaaacccaataagac

SEQ ID NO: 568355 - DNA, 353 bp, Homo sapiens
gggagacaagcgaacaatacagtcaggatggctaaaggtgaccccaagaaaccaaagggcaagatgtccgcttatgccttctttgtgcagacatgcagagaagaacataagaagaaaaacccagaggtccctgtcaattttgcggaattttccaagaagtgctctgagaggtggaagacgatgtccgggaaagagaaatctaaatttgatgaaatggcaaaggcagataaagtgcgctatgatcgggaaatgaaggattatggaccagctaagggaggcaagaagaagaaggatcctaatgctcccaaaaggccaccgtctggattcttcctgttctgttcagaattccgccc

SEQ ID NO: 568356 - DNA, 733 bp, Homo sapiens
ttaatctacatcgtcgagcggcgcctttgctgtgattacatggcatgagccaccctgatccggctacacatttggatttctttatgccatgttattttttattttgggggattgcttttggcatttaattttgttatggccgggcatggtggctcagactaaagtcccggcacttcgggaggccgaggcgggtggataccacttgagcccaggagtatagaaaccagaccattgggcaagcgtggtgagacccctgtctctacacaaaaaaaaatacaaagattaactgggtgtggtggctcacacctgtggtcccagctacttgggaggctgaggtgggaggatcacctgggcctggggaggttgaggctgcagtgtgccatgatcgcgccactgcactccagcctgggcaacagagtgagacccccctatctcaagaaaaaaaaaccaaatttgtttcataattatgtaaattaggcctgggcatggtggcttatgcctgtgatcccaacacttgggaggccgaggccgggcggatcacttgaggtcaggagttcgagaccagcctgagcaatgttgtgtttaaaaaccccgttattctaccaaaaattagaaaaaatgggccatgcaccgcctggtggtccccagctacttgggagggttgaggcaggagggatcctttgatccctgagaggccgaggttgccgtgagttgggatggtgccctgcctcca

SEQ ID NO: 568357 - DNA, 161 bp, Homo sapiens
tactttccaagaatttgtgtggctgtgaaactggctaagcacagcttgttccttttgctttagttagactagcattaaaagttacagaattggcaggctacgtgcgcgtggtataggacgtggtatggatggtatcagggcgtaccgagcctcgacattcg

SEQ ID NO: 568358 - DNA, 411 bp, Homo sapiens
  misc_feature (4)..(4): n is a, c, g, or t
  misc_feature (11)..(11): n is a, c, g, or t
  misc_feature (29)..(29): n is a, c, g, or t
  misc_feature (47)..(47): n is a, c, g, or t
  misc_feature (62)..(62): n is a, c, g, or t
tttnaaatttnagccccaacccctaaaanggtgtaacaaatgaaaancctaaccctaattgnggttttaaaatttgcaattccccctaagtgaccctaatgatgttgaaacatgtttttccatgttcctttgccccatctgccgtattctttttggtgaaaattcctattcatgttcatgcctcattttcctaatggaatctattttttactttttttttggagacagggtctcactctgtcacccagattggagtgcagtggcacaatcatgtctcactgaagctttgatgtggtcccggctgctaggaaggctgaggcaagagaatcgcttgaaaccgggagatgggggttgcagtgggccgggatcacgccattgcactccagcctgggcgacggtgagactttgtct

SEQ ID NO: 568359 - DNA, 918 bp, Homo sapiens
  misc_feature (74)..(74): n is a, c, g, or t
  misc_feature (96)..(96): n is a, c, g, or t
  misc_feature (121)..(121): n is a, c, g, or t
  misc_feature (151)..(152): n is a, c, g, or t
  misc_feature (154)..(154): n is a, c, g, or t
  misc_feature (165)..(166): n is a, c, g, or t
  misc_feature (219)..(219): n is a, c, g, or t
  misc_feature (247)..(247): n is a, c, g, or t
  misc_feature (325)..(325): n is a, c, g, or t
  misc_feature (390)..(390): n is a, c, g, or t
  misc_feature (410)..(410): n is a, c, g, or t
  misc_feature (455)..(455): n is a, c, g, or t
  misc_feature (480)..(480): n is a, c, g, or t
  misc_feature (510)..(510): n is a, c, g, or t
  misc_feature (528)..(529): n is a, c, g, or t
  misc_feature (566)..(566): n is a, c, g, or t
  misc_feature (579)..(579): n is a, c, g, or t
  misc_feature (594)..(594): n is a, c, g, or t
  misc_feature (622)..(622): n is a, c, g, or t
tgcgtctatacaaaaaaccaataaccaaaacataaagcgataataataaaacactctgcttggtcctcccccanccccccacaccatgtgcggganacgcggggggtctgaaacacgaagncgaagacaaaccccctcaccacacaccagnngngtcagccaagnncacttctcggggtcagctagggcagctgtgtgggtgggacaggggtgtgaggnagctgtccccagaactccctggggagtnaggggtgggcaaagccaactaagcaccctggagaaaaaagctggcatcttctggagcaggtgactcactccatatctnctccccatctcccctggacggtccctgaacttttcaagagaagttttggattttgggggtttgcntctcgaccctgggccctggncgccctgggggcttagggcagttggtcggtggagttcagtgaganaatcagacccagagaaggaaccaanccccttccgggccccaggcagctggagacncggaggctggaggttttnnggggcgttgctgggggaaaacagaatgggtacttgantctgaagctttanttgccaggtccacangggcggggagggggtgtcaggccctggncccatgcccaggacagaaaagcaggagcagaacactatcccaagaaagaccctacggaggacctctggaggcgcagggtgcagcaggaagttacaccccggcttccccagctcaggcacttttctgtcttgccccatcgcctgcacggagagcctctcagatgaggaaccgcactgggggccaggccgcctaggcaagcatgtggtctgcagtggggtacgggggcctgaggccgtcgctgtaggtgtcgatggggtagtctccatccatgtccatgtgcatctccagcgggtcaa

SEQ ID NO: 568360 - DNA, 697 bp, Homo sapiens
  misc_feature (238)..(238): n is a, c, g, or t
  misc_feature (516)..(516): n is a, c, g, or t
  misc_feature (529)..(529): n is a, c, g, or t
  misc_feature (542)..(542): n is a, c, g, or t
  misc_feature (613)..(613): n is a, c, g, or t
agcggggggagctggaattcgcgggggagagagggttcgtgccagaaaccgccaaggccgagcctgaagtccctccacaggagggcgtgccagcgtggctgccgaggtccttatggacaccgcagggcaggcgggcggcacgcggcttccagccctcagatctcccagccgcagaagggccggaagccccgggacctagagcttccactcagcccgagcctgctaggtgcgccggganccgaacggaccccaggatcgggaactggctccggcctccaggcgccgaggccggcgctgaccctgtccctgcttcctacgcacacgttgaccccggcgctgctgacacccagctcgctgcctcccagcgttcacttccggagcagcctgagtcccgctgcgccccgcagcccggccaagctctcctgccagcttccgtccagtggcggcgcccaggtgcacatcccttccatcggcgtggctggcctctcgacccccgcggtgctctcgccagggccncagaggccatgancacacagcaccancacccttctggggtcctccatccgtgctctctcaaggagaaacacagttcaactgaaagactcatgctctngatgtggtggggtggggatccttgggaaggatttctccaggagtgactctcattaactcctccacagaaaacactcagttccac

SEQ ID NO: 568361 - DNA, 142 bp, Homo sapiens
gtccccatttttcccctggggtcccgttcctttttgggggaaaaattttttgggaccccgtcccctttttttttagccccctcataagttgtccctaaaacccagttttgtacatgtacccttaaagggataaatgccccca

SEQ ID NO: 568362 - DNA, 484 bp, Homo sapiens
taagggggccatccacctactctctccacccacaaaggctcgcctttgtggggaggataaaacctgcccaacctgcctcaccttggttattcgcattgcaaggagtcattaccatgggcaatatgggctcaggccactccttccagtttgctttccataaatgcaaactgtccctaccgtgagtcaggaatgactcctgactcacagtggggctgctgtaaacttggggatggttgagggaacacagacacagtcttccatgctccccaggtggtccagcctgctgcccagaagcaaaccatggcaggctcaccaccggttctatgccgcagggctgttgtaggacaggctgggctttctcctggactcaccttaccctgggctgacctttgcccctggtatccaataatggcctccactaaatcctgaaaaaaaaattaaacacacttccttcttaaaaataaatattctaaaagttcaaaaa

SEQ ID NO: 568363 - DNA, 163 bp, Homo sapiens
acagtaatcatgactggggactcactgtccaggcagagttctgtcgttcaggctgagctcaaggcagcagaggagggaggacagtggggaggctggggaacgtgggcctccttgcactgccaacttcctaccacttgcttaagccactgctccctgccctgaa

SEQ ID NO: 568364 - DNA, 1237 bp, Homo sapiens
gactgcgagagcagagctgaggatatacctggagccatttcctctgccctggcagccatatgcactgctcactgtgggcactgcaccgacatgcatgggatgccaaggagacaggtcatgtaggcatttggccaatcagctaactgaagacagcagccagctcaggccatccctcatctcatggcctgcagcatcccatccatgtgaccatgcaccattcatcaaggttctatacatccatgctgaccttgatcagtgagggccatgatgccagtcttcatggggcaggagccccatggccttggaatccctgtcgtatgttgattcagggcaaggtaaaagtagtagattgggaagagtctactgaaggtacgctcatacattcctctcccttcttgtccttacggctccgagagacctgcacttgtgagaacatggacgacagctaggcagatgacgctagcatacgtcatccttaacccaattcgcaatgtcgctctcgtcttgtgagatgacagccacgactgctctactagggacaggcatatgagacacgcaaggggtgaccataagaagcctcacccaaggcccattggacattggatagggccatagcagaaccaaccacaatgcctttgtacatgccaccctgacaagaagaggatcaccggaatgaactcaaaccaagggaagccagatgcgattcctaattgactgggacctcccataaatacaatcacttggaggacagcatccatacaacggaaacagggcgcaagggcataaaccacaaacaagggcgaacatgtgcaggtacagaaaatgaggaacggacgcagaggacacacgaataccacatggatacataaggatccccgacggaggcacacgagcaaggaacgggaagcacacgaagaaatacacacccacacaaaccacgaaccaaaaaggacaactgacaagaaacagggaagaggcaacgcggcaacaagggcaagagccagaaaaccaggagaccaagagcaaacaagcagtaacaaagagaagaacaagtgaaaagaaaaaaaggacgccagacacaaatagacaacagacagcgcaccaccaagaggcagaactaagggcatgatcacagagacacaaaaacaaaagtaagagacagaaaagaacaaaacaaaaacgaaaaagcacgatccatagcgcagaggaacaatagaaagcgtcccgctcatagaag

SEQ ID NO: 568365 - DNA, 187 bp, Homo sapiens
ctccccatgacccaactccctctaggtcaatctcaacctaggcctcctattatattctagccacctctaggccatagccgtttactcatcctctgatcagtggtgagcatcaaactcgagactacgccctgatcggcgcacggtgcgttggcccaacacggtgcgtttgcccaatacggtgcgttag

SEQ ID NO: 568366 - DNA, 3051 bp, Homo sapiens
aaaagatgtctataataaaatttatttataccagtggttctcaaaactgactgataatcagaaaaccctggggctctttcaaaaacaattaacaaaacaattctatttttagacccatgaatacatattttgggggaggaaggaggagggtatagatctgtattttgaaaagttccccaggtctccttgggaaattatatgaacaatcatgtttgggaacaaatgaatcatgttaccactgggaagaagtttgttatacatcctaaccaagaaacctaaatggttcttaagcatctgctagcagaaacagttataattatgaatacctaatgtctgttagattttgctgatccctcacctacctcaggaagaaacaaacccaaaaaagtaagatacggtcttttttatttgtgttaattaaaaaatgctactcctaaaaatatactaactttccacacttataaaggtgtttcttattttaaattcctcaatgagtgcggagaagacaacatagaagcttcttctctttctttctgtcttccttcaactctgtttctcttcttccttttatctttcctttcttttcttctttcctctgactggattgtttataacactttagaaaatttccctgactggaagagggccaatctgaatgagcttttgtctgtcttgggagtagaatgaaagcagattctgagcatggaccctgacttccagaaagactcccatctcctcctcagtgcctcactcttccctcagtatccagaatagagtggggtggggaagtagaaaaggaaggaaataagaaggtggtagaaaactgaggcaaccctagtaatttgtttttctctaagtaaattacaggaagtatacattttctttaaccttaatgtccactactgtgtggacagcctctgggaaaacatctgttgcattagatactttatggtgaatattataataaaatcaacaaaatatgatttatgaggtctgctagttgacattttaaatttttcattattatcatttttatatttctgtaatagagtttgacctacattagaatgattcttaacttttcttcctcattaaatccttttttaaaaagagtgttctgtgtatgccaatcttgaagcatagaattgatgccaatttttaagctacttgctgtttttggttttagtcctgccttttttaagggaagaaaagaaataatattaatttgagagtgtattatgaattatgccattatcctaacagtaacttttattgtaatctcaccatgctaaaaagtatccaaaatattttgagatgggaagggatttgagtttggtttctaatgtttatcttttggtaatccctaccaaattttcatagtaatagtagaaagaaggaaagtgaatattggatattatttcctttacttaaaagcttttgatggatactatttgaattggtgtaatatgctgaagtgtatgtaatggaaaaacattattattttctaaattgaataaaatggatttaataaatactgaaagcagaattaactaagcaaaaataagtatgttttgcttagaaaatggatggcagttgcttaagaaaaaaggtttttttactaatttaagaatatacagattgtctggggaaaagaaacttttttttgtattttacttgtacagtctcacatataaccactgttgttctcatgacactctcctatattgatgtgatctttatatggtttgtaccttttttatctcttattccattatttcttaaattctattttatttaccagtttcccaaataaagctatcagggttgacatcagctatttccaggaaaataaaaaggttattactgctgaacactggaataatttgattatgtagattgaagaaaagtcaatctgttataattgctgtaaagaagccatttaattttgtgcctgtttgcattagtctttttttaactagatatgcagattagtgggatgaaaatatatattctttatttgaattgtgattgccaactgaaagatgaatatgagggcagaaaatgaatctaaatctttggtttaaatgataaagtctttacacattgtagagaattaaataagcagttggtcatacttttatttatcttcaggatcttttgctctctgataaaagtagaaagctttagggaatagattgtgtagaaagtaaatccgacttcaagattcagttcctttttgataatttattgttttaaatcctaaatatctgaagcagtaatgccatgactcaccagtaatgccatgactcacaaacatatctttgtgaaatgatttccagagattgggagaaaaaaatactaatagttgattttgctttaagtgttttttatttctcacaacattccaaatgtttgttttaggagatacaagagtttatcattttttcttttaattgctaagaagacttgttacaactttcaaaaaaagtcctcatggaacctgataaataagaagttcaatgtcttatttcattacgagctatctaaatatttttgtcagattcagaatatgtaactgaatgtatgtaattcttttttgtagcagccaagaataatttaagtttcacaactaatactgatatgcctttatcatatttttgctaaccagccaaatctgttttcccatgatcatccttaatgtttgtactagtagaggactatagtggtgcaaactgaaccaaaatagcaactaataagaaggaataaatgaggccgggcacagtggctcaagcctgtaattccagcactttgggaaactgaggtgggaggatcacttgaggccaggagtttgagaccagcctgcccaacatgttgaaaccccgtctacactaaaaatacaataattaggcaggcatggtgttgcacacctgtaatcccagctgcttaagaggctgaggcaggagaatcacttgaacccgggaggtgtaggttgcagtgagcagagattgcaccaccacattccagcctgggcaacagagcaagactctgtct

SEQ ID NO: 568367 - DNA, 335 bp, Homo sapiens
  misc_feature (147)..(147): n is a, c, g, or t
ggcacgaggacggagctcgctctgtcacccaggctggagtgcagtggcccatcttggctcactgcaagctccgcctccccagttggaccgattctcctgcctcagccacctgagtagctgagattataggtgcctgcccccatgccnagctaatttttgtatttttagtagagacagggtttcaccatgttggccaggctggtctcgaactcctgagctcagcccatctgccttgctcagcctcccaaagtgctgggattacaggcatgagccaccacgcccagcctcatattgttttggactttccttaaaggatagtaatctttaaggaatta

SEQ ID NO: 568368 - DNA, 321 bp, Homo sapiens
  misc_feature (3)..(3): n is a, c, g, or t
  misc_feature (20)..(20): n is a, c, g, or t
  misc_feature (64)..(64): n is a, c, g, or t
  misc_feature (96)..(96): n is a, c, g, or t
  misc_feature (119)..(119): n is a, c, g, or t
  misc_feature (128)..(128): n is a, c, g, or t
  misc_feature (193)..(193): n is a, c, g, or t
  misc_feature (212)..(212): n is a, c, g, or t
  misc_feature (219)..(219): n is a, c, g, or t
  misc_feature (236)..(236): n is a, c, g, or t
  misc_feature (240)..(240): n is a, c, g, or t
  misc_feature (252)..(252): n is a, c, g, or t
  misc_feature (262)..(262): n is a, c, g, or t
  misc_feature (281)..(281): n is a, c, g, or t
  misc_feature (311)..(311): n is a, c, g, or t
  misc_feature (317)..(317): n is a, c, g, or t
ccngggtcagcctcctaggntctcctgactgagcataaacaggcagcccactgacatcccgggntgagagagcagcacctatagacccctcctggnttctaagttagccagtgcctgangctgcgggnccgcctggaacacggtcccattgccaccagaaaccgtcgttgtatggctttcttcagaacggggngagacagtcacatttactngaggggnaaaacctaaacattttngggnacaggtgaacangcgtgtactntgtcatggccactcactgnactcaccacccaaaaccagctaggccaagncacctnccct

SEQ ID NO: 568369 - DNA, 168 bp, Homo sapiens
cgatgggcagtggggcgaatgtctaggctataatcggagaatagcggaagtaaagtacttagaatatagtagatggaataaaggtgatatgacggcgagattgtatgatatattgaattgatcatatatagggccgggtataatacctcaggtcgatgtccatgccat

SEQ ID NO: 568370 - DNA, 318 bp, Homo sapiens
  misc_feature (168)..(168): n is a, c, g, or t
  misc_feature (287)..(287): n is a, c, g, or t
  misc_feature (298)..(298): n is a, c, g, or t
gcatgtggtatctcttcaaaatactggacggggttgatggcgggtgactgaaatgcagaaatcgaaactatagaaaaaggggggatgattatacttgttccagaaacgaggcccatcacctataggcttggacaatcactcgtttccaccatttgtttcccgtttagnattcgtgacgatgtaagtgaagattcacagtgggaagttttatcatgttaacccagatgcctctaaactgacactggagataagtagtcacagcctcttgagagcactctggagcacangaccccaaggngtgcagggcgtgaggatccc

SEQ ID NO: 568371 - DNA, 871 bp, Homo sapiens
atcttcgatgcagtacttcgagagcagccgccgaccggggagccagcaagaacgagctcacagctacggccggatggagcgtccgcaagctgacagaatgtcccaggattttgatcagaggccctggaaggaggtcaccaaggaggtgcacatgccatgggcagagaaatgctgaagttacatgaggaatctttgcagaagggccaggtgagccgatgacggcttcaaggctggtgattggcctcgcactgataccagcatctatggtggccctggaggagggagattgagcgcaaacaaggaagagccgcagatacttcagcccctgtgctacttgcccagaagagctgcaccgcaaggctgccctggagcaggacctggccttctggtacgggccccgactggcatggaggtcatcccctaacacaccagccatgcagcgctatgtgaagcggctccacgaggtggggcgcacagagcccgagctgctggtggcccacgcctaacaaccgctacctgggtgaactgtctgggggccaggtgctcaaaaagattgcccagaaagccctggacctgcccagctctggcgagggcctggccttcttcaccttccccaacattgccagtgccaccaagttcaagcagctctaccggtcccgcatgaactccctggagatgactcgcgcagtcaggcagagggtgatagaagaggcaagactggcgttctggtcaacattcaggtctttgacgaagtagcagagagttgttgacccaatgccaccaagcaaccaaagcccttacacgggaaccaaggggtttacaaagttggccacgaacaatttggaggattttggcccgtgtggaatcccag

SEQ ID NO: 568372 - DNA, 224 bp, Homo sapiens
agtatcttagccactcaaaactaaactctaccaagggtgacggatgtctctacagcaaggttaagggctcgccagagggggaacatcaggggtgcatggtgggcactgccaagggaattaaggtaaggaagcagcaggcctgctagtcgggtttgggccgggcttcatatctagggcaggcataaggtcgtccgataggcctgccctttagtaccagcggttgt

SEQ ID NO: 568373 - DNA, 612 bp, Homo sapiens
  misc_feature (1)..(1): n is a, c, g, or t
  misc_feature (20)..(20): n is a, c, g, or t
ngacatgcatgttcgtctgnactgcagacatcatttactctctggaatctcatctgtcagcctgtcatctaaaggcataaagcactcaaatggtcgattatcattagtgtatgttctctgatggtatctctgagaatactggttgtaggactggccagtagtgccttcggtactgggttcacccgcaggtctacgacagttgtcgcagtgcaagccaagctggcctccagagcatgtgcataagcaaatggcactgagatattccttcagccactgtgctcctacgtggtatgtcttcccatcatcataccgtgctgcttcatcagggtcacactatccgtgacggtcccacttctctccaatcttgtagttcacaccattgtcatggcacgatgtagatcaatcacatatcagatgaccacttccaaagcctcagctctgagcacagcagtttgtagcctgatacagacattcgcttccactcatctccaacggcataatggaaatctgtgtaggggtcaaagcacgagtcatccgtaggttggttcaagccttcgttgacacagttgcccacggtacattcctcttccgaacctatgcctctctggtcat

SEQ ID NO: 568374 - DNA, 252 bp, Homo sapiens
aagtgaagtaaggatcagctgtagtaccaactagagcttagtagttgtctaaacaagaaacacttatcttttcccgacattctaagcaatggtcactatcctaggcatgaatcatactactagtgaaacaggcaaggtatagaccttctaataaagtgggaaaacctataattactcgttaaaactcatgaaatgcgcagattgtgggtaacatgttgctcattctgctgttcgcggataactcttgcaatg

SEQ ID NO: 568375 - DNA, 663 bp, Homo sapiens
ctggtacgggagtggagactgcagtgagccgatatcgcaccacagcgctccagcctggtcgacagagtgagactccatctcaagaaaaaataaaaataaagttgttctctgaagagcaaatgtctcattccagtaatgacccactcagcaggaatatggtggagttcagtccaattcaggtcagccatatccaaaagaccacaagtcattactaagttgagcaaaagagtttttatctattagcagaaagggcctctctggcagcagagattaaaaactggcccaacttcatttccatacttcagggaacagcaaatagaccgatttacttatctaggacatgaatacctttctaggggaccaagttaataaaagaccaagaaactcctgattaaactgaataatgaaggattctgtagacagggctgcacgtatcggctttgtttgacttctcttttctcagttaacatctcagagctagaacattccacattccccagcagcgtgtgggggctgactaaagtttacaattccaactaaaaatcaccctgcttctggcttatctgaatcccttacccaccccaccccaccaccctactcctatttattcagcaccacactaaccaggaaattacactagcaaattgtgcaatggaaagaacg

SEQ ID NO: 568376 - DNA, 144 bp, Homo sapiens
catgcagtgatcactgtggctataatgcactactcacttggctagatcatagcaatgatcatagttgctaccatgtacaggtcacgtgaatagatcatacccccatcaggtagactagatcatagcactagatacacgtaggct

SEQ ID NO: 568377 - DNA, 544 bp, Homo sapiens
ggccatagccccatttgcccgtggcctgcagggctaacctccacgggagcccaggagctctggccggcaggtccatggcacagggcatcggaagactgcaaaactgctggacttaccctgggctgcagtccattgtcggcccctgggttgaatcaagatagtacttgcagctagatggatgcttttagccaggggacattgcgaggggaagattcctgcacccagtctggcctgtggtgtctgttttcttcctgagaccacaggtttctcaagtagcatactcaatggcgccaccaaggggaaacacctggagcggacctttgccatcagtggggaaagcaggtccctagacccatgtggtgtcagttatagtctttcaaaaacaactgattttacggtcggtaataacatgtctagtggtgtcacaataaccagtacattgctccgcttcaaacgcgcacaacctgcatatcttctcccgtgctacgtcacctttacaacgacatctgataacaatttcgccagtctcacacgaagacgacgt

SEQ ID NO: 568378 - DNA, 165 bp, Homo sapiens
ggggctctggcacatgtcatagggcaggaaatgctttatcagccaagtagtgtcattgggcccggctgacaccataggtgataacgtggtgctggagccagaccatagccatgtgtgcagtggtgtctcgagtggcggcgtggcatgcacgagatccatcacggt

SEQ ID NO: 568379 - DNA, 177 bp, Homo sapiens
atggctgactctagaggatacactcgctattcatcggcacctactctcgatccggggtggttctgacgaaaaataacactacagaactctttctagaccctgtgattggaatgagtccactttaaaacctctaacgagggtccattggggggcaagtctgtggccgatgaatatcga

SEQ ID NO: 568380 - DNA, 996 bp, Homo sapiens
  misc_feature (277)..(277): n is a, c, g, or t
ctggccgcctggatgatcgcctgcattggatgccatgtgctggttgatgtggggctgaagatgtgccccagtgccctgatgtggcattggagctggttatgtgagagaaagccagtctgcctgctggagaatgttctggcctgcagaaatgtgtgtgaatctagcctgtgtctggtgtcttgactgtgtgaccccctgtggcctgggcaatggtgtgctgcctaagtgggtatgtggtggtgacctaggaatgtcatgtggcccctgatgtgatgcntacttgtgtggtgtgacctgtgtgtgattgatgcctgttgtggagccgtgccctgggatgcaagtgttccctgggactgctgagctggaaatcaagcgctggctcactttgatgtgctgcctgctggctacgaatgtgctcttttcccgctgggggccgccgcccaccctgggccttgcctctacctcagtcgtttgccccccgattttctggctggaagcccacgggcccctggccctcagcccccgctctagcttcgccagtagctctggccagccgactgctgagcaagcctgtccagcccccggggcatgctgctgctggactggggcgtgggtgcttggctggagcttggaggtatgcctggcccttgcagcaagtctgcaaccaggtcggatcagcagtgggctaagagccagtgcccatgtggagccctttgcatgtggggccgtggctgtattggccacccctgtgtccggagcaaccggcaggggtatctcccgggaggcgtcccggccggctaacccgggggtcaagcggggccttggcccgtatttcccatcgtggccggggtatgtgtccaggaaggcgcctagtatccgcatgtgccggcatacagagcgcgggtgaagggcttcataatgtggccggcattatatagggtgtgggcggaactctttcttttctctcctcttctcttctttgttttggtggggggg

SEQ ID NO: 568381 - DNA, 782 bp, Homo sapiens
cgcgtgctctccgcaccaacccacttccatctagctcaaaccaatccgtaccccctgaatttctccgcaaatattcctgccggcaaggtcccagcatttcgaggtgtgaattgatcgtgacttctgatgtgctactgatgaagcacaccgcccattgcctacctatcgtcgcacgcaagtgagcgagctagcgcgggaacgtactccagacggcacgccagtccaggctgagtgcaagctggcgctgagcttggcctcgattcccgcataatacgattggcccctcaagcagatcacctcgagcgatagttcccctcagcttcgaggtcaatcattgccatcccatcaatcaaaccatgggcctagtgccagaatgctatacggaaggcacacgtgacgcgcagaattcttggagtgctgcttgagattgcttactatgaacgatcgaagtgacttatacttggtcgggcgtctgaaacggaagttgcacatttgggttagatccactcctaacaaggtcgtactggtcagcaccgttggctcccgctagtgcgtcctgagtgaacgacaagaggtttccttatgaagcgcctttgctatttcccgtgcaagaggtcattgtcccgcataatagcgcaatcccgtcatggctcttcctgcaatccagtcactttaaaccagccctgcaggtatcccgaggactatgtccttgggcgcctgaaactggaaaacctagttgtcgaatagaggatgggtccccagttttgatgcttaccaaacgg

SEQ ID NO: 568382 - DNA, 738 bp, Homo sapiens
  misc_feature (679)..(679): n is a, c, g, or t
cggcgcatgcctgtattcggagaaattggacaggctctagttgtcacatgaatcgagatcgggagcgtaggcgaggacaggccgaccgcgatagtctcgtactctagtaacagaacactcacctagctcggattggcgaaagacgcctgcagtaccgacgaatcactagcccgcggcagagtattgagacgacccgggcaggctgatatacgagtcatcacatttcatgtgactgtaatgcaacttctgagacaccgtcagcgtagtacacgttctactagtaggcaaagttcttacaagcgatagcttactatgctacccagatagtatcatggtcaaggcgtgctattgcttcacacgtaaagacaccgtcagattactgcgctgcctacacagccataggcccattcatagtaagaagtgcatgatcagctctgtagaggcaatgacttactacatgaatacacacgactagacattcttgctacaaggcggcctgaccagtgggctcataagtacatgtaaggtcctccgacctatacttggcatattaggacagtgcacgggacttagaactacgcatgctcatcccatgaagcactaccattaggctcaatgtgccaacttcggcctagtaccagcggccctacggccagatatgtatggactactagccgangtctgcttattattaaccgccccggtggccttccagtatggtccacattcacgcttccg

SEQ ID NO: 568383 - DNA, 384 bp, Homo sapiens
cctcccccccctcccacctcgttcgtcccacgcctcggttacgtcggcagtcgaccagacgaagtttacttagaccaagggcgagctcgttccctttggtttatcgatctaaacgccaactcttcccggtaatatttccatagacatatttaggactaacatcccgtacttcctaacttaactaagtccaattactatgttaattaactcaaatatcgaaggtccaccgcgaagcatgggacatcgagaataacacgacgtcggaatggaggcaaacagaatagcaggataaagaatttagaagtacactcgcgcgcgtccgtcggccactagaagcggggacccaataaacgccatcagagtccggccccttagacggggggt

SEQ ID NO: 568384 - DNA, 465 bp, Homo sapiens
cggattcttgaaaagcttgtagacaaattatcatccacatcaatctcatatggagatttcaacaaggggtctttcgctcttaaagtgaaccgaagctttgcaagtacattgtccaatatgaaaacaatcatacctcccagaacagataaagtccttaaaagagtgaaaaccaacataaacgtgtttttaaacgtaaacagccggtttggatccccccagatcgggaagctgatcccctacgatcgggaggatgtccaagggaaggctctgaataaagatggaatccatggagaacccccagcatatccaggtggcccacaagatgctcatatcctaaccggaccgacaggaaagccaaagagtatggccaccccagaagtcactgcattgagacgggcatcgtgacatttgcacatgcgccatccacatccatgcttactggcacagacgccttccaagttaaaa

SEQ ID NO: 568385 - DNA, 545 bp, Homo sapiens
  misc_feature (545)..(545): n is a, c, g, or t
ggaacattttgcctgttctagaagcaacggtgttatttgcacaggcgcgatttgctattcagaatgcaatccagtcaggcgatgggggatagcttactatgccggggaaatcagtcacttatttgaaacatagaatgactcccaatggcattcagtgtaatgactggaactgctgatgattgcgacttggatggtgagcaaacaggcgctgagagttaccaggatccacatttatgggctatactagaagaagtatgcctattgcctcctgtcttaacaatgacccaggtatattgatgcatgagctcatggtccgcagcttatactgatggagtgactgtagtagacatatgctgctctaacatgttactgcacattgcacccaataaacgttccactatgtttagaacattgctggatttccacatcttaacatgttttatgacgcatacaagagtctcacgtctcaacaagatttaatatagttggcgtactcaaatgctattccgtgacctacaccttcgctttctgtagtgtgaacactn

SEQ ID NO: 568386 - DNA, 351 bp, Homo sapiens
gtactctgcagtcatcatgctagacattgtctcagtcgacatagtatgtgattgtctctcactctccactttgctccgatcaatgtatcttgtcttggccatcgtaggacgctcctcccttgattcccgctctactcaggcagactcccatgaatccccccttatgctataatccataacgctatcattatccggaatatctggagatcctctttgagcctagctgctgtctctctatgcgtgttcgtgcatgcccgtcgtcactctacgtcgtgtctctcactgcctctgcggattctaccaacttaaagtgtggttgggattatccaaggcagagtatactctgtgatt

SEQ ID NO: 568387 - DNA, 549 bp, Homo sapiens
attctagaagccgaggcggcgacatgttatttccttctttttcttgctttttttcagccttgacaactccctttttgggcgtgcatcaatggctctccatacagactcgagtatgcagaacaatttcgggagatcgacaaggaacgtacaagcagcaaagaaccagagcaaacgacacgacccagccacaaacgcagcacacacactgcaccaagggaacaacagacgaacggaccagaacgcacggacgcagaaacaaagcacgacaaaggaaggcacgagcgacatacacgtgcacatcaccacagcgtgaatacacgacgcagccaagcgcgtgaagcacagcaaacgagccagaataacacagcgaatagaagaccacaaaggacaaaaagaaaaacccatcaacaagaaacaagcaggaggcagaatgaaaaggaaactgagtcagcaagaggcgcgacaagacagcgacacacataggacaacaacgcacaagcgtgaaggagagaaagagaaaaaacatgaaaagtgaaaacagaaaacaaa

SEQ ID NO: 568388 - DNA, 476 bp, Homo sapiens
  misc_feature (1)..(1): n is a, c, g, or t
  misc_feature (38)..(38): n is a, c, g, or t
  misc_feature (279)..(279): n is a, c, g, or t
  misc_feature (321)..(321): n is a, c, g, or t
  misc_feature (446)..(446): n is a, c, g, or t
  misc_feature (456)..(456): n is a, c, g, or t
ncagcaaaaggtatttattttgtctctaggcatgaggncattgggcgcatgctacttgtagacagtgattgcgcccaccgatttcatggttaattgctagttggtaggtaaaggcctctagatgattagcaatcttgataaaagaggcctagtaatgttcttttgaggttagaaatccttgctgctaggacagtctctgtgacaggttgcgttgaatgatgtcttccttatcaatggtgagcccaccagtgaggattactgatgtggacaagtgatggnggttggttctgtatatttaattttatggacagaactttgtanaaacgaaactatttaaaaaaacaggattaacatttttagcattcttattcaaggagaattatggacttcaatttggctatcaaacattaaataactttttttttcccccccaatacaacacaacnctaacctacnctctcccctcatcccccact

SEQ ID NO: 568389 - DNA, 110 bp, Homo sapiens
aggatgcgcgaccgaacctggattcgcgaccgaccgggagtcgcgagcgaccggattcgcgaccgacctggattcgcgaaccgacctggacttcgcgaacggaggatcct

SEQ ID NO: 568390 - DNA, 222 bp, Homo sapiens
  misc_feature (31)..(31): n is a, c, g, or t
  misc_feature (53)..(53): n is a, c, g, or t
acttaacagtattactcagctaagaacacancagtgattgtattaggattcancaaccttgcagcaaaaaaataatttctctgttgttgcaatggaaaaacaagttagattgattctactgcatagatcagaaaaatgctaaccttatagccacatgatgtgagaaacataggcaataaaccttccactgagatgttccagaaaataaacattatgaacttg

SEQ ID NO: 568391 - DNA, 979 bp, Homo sapiens
ctggttctattgtcaaaatatgtttctctttccatgttcactcataatctaaagggtaaactagacccaattcacagataactatgagtgaacatggacagagaaacatattatctgtgaatgggtctagttaccctttagattatgagcatctttaacagtgccaatggaaataagtatattaaataatgtcgcctgaaataatagatactcttgcggagtgtattttcaaatctaacacacagtttcaacgaggacttgtcatctttctaaaaataaattaaaagatacctgaactaaacttggagggcttgaacacatgtatttgcttcctgaacattcccaaacaagcacatgacacaactgatactctccactttcaaggcacttaacttgctaacagactgcaaccagcacagggaaaggacgaccaactagcaaccaaattatcgctacaacgcctggcacaacagaaggcaattgacctctaccctaatctcccaaataacatattttttagccactgcatcagaggcacagtcacaccggcagccccacgtcttataccaccggatctacatcaaaggctgcataactatggatgccacaatacttcttggaaaatgggtcatgaaaaatacgctgacacaactgcaaacctggatcgaaaactctgcaacagaacgccaggaaatctacaaacccccatatgcaagcagcagccggaccataccagaaacaccgaccaaccctaaaaccgaaacatacagcacaccaggacgacgacggagacacagacaagagcgcaacataacgcatcacaagcacaactacctaaagtcacaacaaacaacaccacaagagccaagccaataccacaacacaccgccaccaaacggataaccacggacagcacacactcgaacaaaaacgacacaaaaacaaatatcaaagtcacagacaacacaaaaaacatcca

SEQ ID NO: 568392 - DNA, 712 bp, Homo sapiens
cctcactgccggccggcatctccactcacgccctacctggtccctaggcctgtccggcaccaggcggtcacagctctgtgtgctcggacgcgcaggccacaccggctgcgagtgaccccctagtcctgccgcgcccctttatagcgtacgccccgcccccccgcgcctcgcctgggcccattcacctgctgtcgagaaccagacaccgcagaacggaaagctagccgctcggctgcggggtcccgccgtcggactcgaagggcgggggcgcgggtgagatggatccggtttctacctttcttaaatgctctgttgaaagtcgagacagcccccgcccaagagccagcgtcgcttgctgcccgcgcagctcccttctcaccctgagaccccccagcctcactctaggaggggccgtgaaattgcacccgcaaggtcctcatacatatttaaggtagcaggctcgaccagtaactggagctggaccggagtggtgagggggcggtccccagggacccgatatcccagatcgcttacagcccggggctccggtcggtgaagagctcggacgaacccagatccttactttgctggcccgacgagtgtaccaaggctgcatgcaagtattctaaccttccaaattgtgcctacgagctgcggaataccccaagctaagatacagagatcctcccttccagaagaacaagacactctg

SEQ ID NO: 568393 - DNA, 445 bp, Homo sapiens
  misc_feature (38)..(38): n is a, c, g, or t
  misc_feature (91)..(91): n is a, c, g, or t
  misc_feature (145)..(145): n is a, c, g, or t
  misc_feature (286)..(286): n is a, c, g, or t
ctgtagttaggatgaagtcgtgactgtgtccttataanaagaagggtgacacaggagcccatgtggtggtggaggcagagatggaagctgngaatccacaaacccgggagcatctggagcttcggaggctgaggaggcagggagnaccctcccagctgttgggggagcacagccttgctggcaccttgattttggacttcaggcctccagagctgagagaagatacatttctgtggttttgagctccccggtttgtggtacttttccaactgccccaggacactgntgcgccaatgcccttgaccttcaaggttgcattctggctgatggagctgatgggcaccccggcttcactgcccttgggctcccactctgactggcctgtgctgaaaggttaaaaatagctctgcatatattaaaatagctatgtcaattcaaaaaaaaa

SEQ ID NO: 568394 - DNA, 2004 bp, Homo sapiens
  misc_feature (1944)..(1944): n is a, c, g, or t
  misc_feature (1948)..(1948): n is a, c, g, or t
  misc_feature (1971)..(1973): n is a, c, g, or t
  misc_feature (1977)..(1977): n is a, c, g, or t
ggaagtcattcctagcagaggactcagatatatataggattgaagatctctcagttaagtctacatgaaaaggatggtttcttggagcttccacaaacttaaaaccatgaaacatctattattgctactattgtgtgtttttctagttaagtcccaaggtgtcaacgacaatgaggagggtttcttcagtgcccgtggtcatcgaccccttgacaagaagagagaagaggctcccagcctgaggcctgccccaccgcccatcagtggaggtggctatcgggctcgtccagccaaagcagctgccactcaaaagaaagtagaaagaaaagcccctgatgctggaggctgtcttcacgctgacccagacctgggggtgttgtgtcctacaggatgtcagttgcaagaggctttgctacaacaggaaaggccaatcagaaatagtgttgatgagttaaataacaatgtggaagctgtttcccagacctcctcttcttcctttcagtacatgtatttgctgaaagacctgtggcaaaagaggcagaagcaagtaaaagataatgaaaatgtagtcaatgagtactcctcagaactggaaaagcaccaattatatatagatgagactgtgaatagcaatatcccaactaaccttcgtgtgcttcgttcaatcctggaaaacctgagaagcaaaatacaaaagttagaatctgatgtctcagctcaaatggaatattgtcgcaccccatgcactgtcagttgcaatattcctgtggtgtctggcaaagaatgtgaggaaattatcaggaaaggaggtgaaacatctgaaatgtatctcattcaacctgacagttctgtcaaaccgtatagagtatactgtgacatgaatacagaaaatggaggatggacagtgattcagaaccgtcaagacggtagtgttgactttggcaggaaatgggatccatataaacagggatttggaaatgttgcaaccaacacagatgggaagaattactgtggcctaccaggtgaatattggcttggaaatgataaaattagccagcttaccaggatgggacccacagaacttttgatagaaatggaggactggaaaggagacaaagtaaaggctcactatggaggattcactgtacagaatgaagccaacaaataccagatctcagtgaacaaatacagaggaacagccggtaatgccctcatggatggagcatctcagctgatgggagaaaacaggaccatgaccattcacaacggcatgttcttcagcacgtatgacagagacaatgacggctggttaacatcagatcccagaaaacagtgttctaaagaagacggtggtggatggtggtataatagatgtcatgcagccaatccaaacggcagatactactggggtggacagtacacctgggacatggcaaagcatggcacagatgatggtgtagtatggatgaattggaaggggtcatggtactcaatgaggaagatgagtatgaagatcaggcccttcttcccacagcaatagtccccaatacgtagatttttgctcttctgtatgtgacaacatttttgtacattatgttattggaattttctttcatacattatattcctctaaaactctcaagcagacgtgagtgtgactttttgaaaaaagtataggataaattacattaaaatagcacatgattttcttttgttttcttcatttctcttgctcaccaagaagtaacaaaagtatagttttgacagagtggggtcttttatccttgtcgtaggaaaaccatgacggaaaggaaaaactgatgtttaaaagtccacttttaaaactatatttatttatgtaggatctgtcaaagaaaacttccaaaaagatttattaattaaaccagactctgttgcaataaagagaatggtacctctatccanggcncggccacgtcaaggaattcaaannncccnccccctgccagcccatacagaaaaaca

SEQ ID NO: 568395 - DNA, 303 bp, Homo sapiens
actatgttggacttgtgagcaaacaaagtgatgattgtctctaatatgctccacggtcaacattagtgctgttattctctcttttgtgtaatagttctttgacaggatggtaaaattgcttttacagagatcaaatattggtattgcaggccagcttggtatagcaaagaccagtagatctatagtgtagggaactcttccttgtgaaagttcaacagctccttttctggattacattttagtgtttcaacagatggatgcacccaagccctagccctaagtattctccagctcatatcaata

SEQ ID NO: 568396 - DNA, 1964 bp, Homo sapiens
  misc_feature (1644)..(1646): n is a, c, g, or t
ggaagtcattcctagcagaggactcagatatatataggattgaagatctctcagttaagtctacatgaaaaggatggtttcttggagcttccacaaacttaaaaccatgaaacatctattattgctactattgtgtgtttttctagttaagtcccaaggtgtcaacgacaatgaggagggtttcttcagtgcccgtggtcatcgaccccttgacaagaagagagaagaggctcccagcctgaggcctgccccaccgcccatcagtggaggtggctatcgggctcgtccagccaaagcagctgccactcaaaagaaagtagaaagaaaagcccctgatgctggaggctgtcttcacgctgacccagacctgggggtgttgtgtcctacaggatgtcagttgcaagaggctttgctacaacaggaaaggccaatcagaaatagtgttgatgagttaaataacaatgtggaagctgtttcccagacctcctcttcttcctttcagtacatgtatttgctgaaagacctgtggcaaaagaggcagaagcaagtaaaagataatgaaaatgtagtcaatgagtactcctcagaactggaaaagcaccaattatatatagatgagactgtgaatagcaatatcccaactaaccttcgtgtgcttcgttcaatcctggaaaacctgagaagcaaaatacaaaagttagaatctgatgtctcagctcaaatggaatattgtcgcaccccatgcactgtcagttgcaatattcctgtggtgtctggcaaagaatgtgaggaaattatcaggaaaggaggtgaaacatctgaaatgtatctcattcaacctgacagttctgtcaaaccgtatagagtatactgtgacatgaatacagaaaatggaggatggacagtgattcagaaccgtcaagacggtagtgttgactttggcaggaaatgggatccatataaacagggatttggaaatgttgcaaccaacacagatgggaagaattactgtggcctaccaggtgaatattggcttggaaatgataaaattagccagcttaccaggatgggacccacagaacttttgatagaaatggaggactggaaaggagacaaagtaaaggctcactatggaggattcactgtacagaatgaagccaacaaataccagatctcagtgaacaaatacagaggaacagccggtaatgccctcatggatggagcatctcagctgatgggagaaaacaggaccatgaccattcacaacggcatgttcttcagcacgtatgacagagacaatgacggctggttaacatcagatcccagaaaacagtgttctaaagaagacggtggtggatggtggtataatagatgtcatgcagccaatccaaacggcagatactactggggtggacagtacacctgggacatggcaaagcatggcacagatgatggtgtagtatggatgaattggaaggggtcatggtactcaatgaggaagatgagtatgaagatcaggcccttcttcccacagcaatagtccccaatacgtagatttttgctcttctgtatgtgacaacatttttgtacattatgttattggaattttctttcatacattatattcctctaaaactctcaagnnnaaaaaaaaaaaaaaaaaaaaaaaaaaaagaaattgtgtgtgggggggcttgggcccttgggaaagggttttttagaaccaactccgtgggggccagcggggccccagaaggtaggggcaccatgggggccaaagacgtggtccccaagagaagaaccctggtccaaagaacaacgggcggggggagtttctcccccaagtagaaaacacccgcggggggacaaccgagctgtcgtggaacaactccagaagggagctcaggagggcacaacggggtcctacacacgcgggcgcccgagcgaagcccgatatcaaaatc

SEQ ID NO: 568397 - DNA, 2182 bp, Homo sapiens
  misc_feature (1041)..(1041): n is a, c, g, or t
ggaagtcattcctagcagaggactcagatatatataggattgaagatctctcagttaagtctacatgaaaaggatggtttcttggagcttccacaaacttaaaaccatgaaacatctattattgctactattgtgtgtttttctagttaagtcccaaggtgtcaacgacaatgaggagggtttcttcagtgcccgtggtcatcgaccccttgacaagaagagagaagaggctcccagcctgaggcctgccccaccgcccatcagtggaggtggctatcgggctcgtccagccaaagcagctgccactcaaaagaaagtagaaagaaaagcccctgatgctggaggctgtcttcacgctgacccagacctgggggtgttgtgtcctacaggatgtcagttgcaagaggctttgctacaacaggaaaggccaatcagaaatagtgttgatgagttaaataacaatgtggaagctgtttcccagacctcctcttcttcctttcagtacatgtatttgctgaaagacctgtggcaaaagaggcagaagcaagtaaaagataatgaaaatgtagtcaatgagtactcctcagaactggaaaagcaccaattatatatagatgagactgtgaatagcaatatcccaactaaccttcgtgtgcttcgttcaatcctggaaaacctgagaagcaaaatacaaaagttagaatctgatgtctcagctcaaatggaatattgtcgcaccccatgcactgtcagttgcaatattcctgtggtgtctggcaaagaatgtgaggaaattatcaggaaaggaggtgaaacatctgaaatgtatctcattcaacctgacagttctgtcaaaccgtatagagtatactgtgacatgaatacagaaaatggaggatggacagtgattcagaaccgtcaagacggtagtgttgactttggcaggaaatgggatccatataaacagggatttggaaatgttgcaaccaacacagatgggaagaattactgtggcctaccaggtaacgaacaggcatgcanaataaaatcattctatttgaaatgggattttttttaattaaaaaacattcattgttggaagcctgttttaggcagttaagaggagtttcctgacaaaaatgtggaagctaaagataagggaagaaaggcagtttttagtttcccaaaattttatttttggtgagattttattttgtttttcttttaggtgaatattggcttggaaatgataaaattagccagcttaccaggatgggacccacagaacttttgatagaaatggaggactggaaaggagacaaagtaaaggctcactatggaggattcactgtacagaatgaagccaacaaataccagatctcagtgaacaaatacagaggaacagccggtaatgccctcatggatggagcatctcagctgatgggagaaaacaggaccatgaccattcacaacggcatgttcttcagcacgtatgacagagacaatgacggctggttaacatcagatcccagaaaacagtgttctaaagaagacggtggtggatggtggtataatagatgtcatgcagccaatccaaacggcagatactactggggtggacagtacacctgggacatggcaaagcatggcacagatgatggtgtagtatggatgaattggaaggggtcatggtactcaatgaggaagatgagtatgaagatcaggcccttcttcccacagcaatagtccccaatacgtagatttttgctcttctgtatgtgacaacatttttgtacattatgttattggaattttctttcatacattatattcctctaaaactctcaagcagacgtgagtgtgactttttgaaaaaagtataggataaattacattaaaatagcacatgattttcttttgttttcttcatttctcttgctcaccaagaagtaacaaaagtatagttttgacagagttggtgttcataatttcagttctagttgattgcgagaattttcaaataaggaagaggggtcttttatccttgtcgtaggaaaaccatgacggaaaggaaaaactgatgtttaaaagtccacttttaaaactatatttatttatgtaggatctgtcaaagaaaacttccaaaaagatttattaattaaaccagactctgttgcaataa

SEQ ID NO: 568398 - DNA, 852 bp, Homo sapiens
aatacggcacgatagctaggcagtctttgcccaggtgcctggcctggctgtgaattgggcccatgatcatgtgtggactatcaattgacttctaccctggccatagcagatctactattgcagagtccctgcagtgcaattgtggacttgtgatgtgccaatttgacccccaatgtgggtggctacttcgtggacaatgttctgttggccaccagtgtaccacataccttgcatgtttttgcctacgtaataatgtttgaagttgattgttgctgccatgtgcttgcccttgcatgctgcctgccatgcctacattgctacttctgacccccaatggacatgctgtcattgcagcatgaaccttgtgttgtattacctgtgttccacctgtggtgctctgcttgtgtgtgccttggaaggatgtgacgtgacattccatgcaccctgtggatgttgatgtgaccatagctactaaccagcacaccatgaacctgcctgatgcttgctgtgagatgcttgctttgtgatgtttcacccccacaatttgtagccttgtcatggtccatgaataggattgaagcactttgtgatcgcgtttgcggatgtgaccgagcattgaaaatccctggcccctttgtgatggcccttgaaggtgaatttgcccctaattacttgaaacgctctgacggttttttgatgtgtgtgtcgatgtgtgttgaacgtatctagaatttgatgctgtggcatttgttactttgccttgaacattgggttgtgccctgttgatgcccctgtgacttgccaaaatggtgtttgacccggattgggcctggaattgcttgacgaccctag

SEQ ID NO: 568399 - DNA, 1922 bp, Homo sapiens
ggaagtcattcctagcagaggactcagatatatataggattgaagatctctcagttaagtctacatgaaaaggatggtttcttggagcttccacaaacttaaaaccatgaaacatctattattgctactattgtgtgtttttctagttaagtcccaaggtgtcaacgacaatgaggagggtttcttcagtgcccgtggtcatcgaccccttgacaagaagagagaagaggctcccagcctgaggcctgccccaccgcccatcagtggaggtggctatcgggctcgtccagccaaagcagctgccactcaaaagaaagtagaaagaaaagcccctgatgctggaggctgtcttcacgctgacccagacctgggggtgttgtgtcctacaggatgtcagttgcaagaggctttgctacaacaggaaaggccaatcagaaatagtgttgatgagttaaataacaatgtggaagctgtttcccagacctcctcttcttcctttcagtacatgtatttgctgaaagacctgtggcaaaagaggcagaagcaagtaaaagataatgaaaatgtagtcaatgagtactcctcagaactggaaaagcaccaattatatatagatgagactgtgaatagcaatatcccaactaaccttcgtgtgcttcgttcaatcctggaaaacctgagaagcaaaatacaaaagttagaatctgatgtctcagctcaaatggaatattgtcgcaccccatgcactgtcagttgcaatattcctgtggtgtctggcaaagaatgtgaggaaattatcaggaaaggaggtgaaacatctgaaatgtatctcattcaacctgacagttctgtcaaaccgtatagagtatactgtgacatgaatacagaaaatggaggatggacagtgattcagaaccgtcaagacggtagtgttgactttggcaggaaatgggatccatataaacagggatttggaaatgttgcaaccaacacagatgggaagaattactgtggcctaccaggtgaatattggcttggaaatgatgactggaaaggagacaaagtaaaggctcactatggaggattcactgtacagaatgaagccaacaaataccagatctcagtgaacaaatacagaggaacagccggtaatgccctcatggatggagcatctcagctgatgggagaaaacaggaccatgaccattcacaacggcatgttcttcagcacgtatgacagagacaatgacggctggttaacatcagatcccagaaaacagtgttctaaagaagacggtggtggatggtggtataatagatgtcatgcagccaatccaaacggcagatactactggggtggacagtacacctgggacatggcaaagcatggcacagatgatggtgtagtatggatgaattggaaggggtcatggtactcaatgaggaagatgagtatgaagatcaggcccttcttcccacagcaatagtccccaatacgtagatttttgctcttctgtatgtgacaacatttttgtacattatgttattggaattttctttcatacattatattcctctaaaactctcaagcagacgtgagtgtgactttttgaaaaaagtataggataaattacattaaaatagcacatgattttcttttgttttcttcatttctcttgctcaccaagaagtaacaaaagtatagttttgacagagttggtgttcataatttcagttctagttgattgcgagaattttcaaataaggaagaggggtcttttatccttgtcgtaggaaaaccatgacggaaaggaaaaactgatgtttaaaagtccacttttaaaactatatttatttatgtaggatctgtcaaagaaaacttccaaaaagatttattaattaaaccagactctgttgcaataa

SEQ ID NO: 568400 - DNA, 1930 bp, Homo sapiens
ggaagtcattcctagcagaggactcagatatatataggattgaagatctctcagttaagtctacatgaaaaggatggtttcttggagcttccacaaacttaaaaccatgaaacatctattattgctactattgtgtgtttttctagttaagtcccaaggtgtcaacgacaatgaggagggtttcttcagtgcccgtggtcatcgaccccttgacaagaagagagaagaggctcccagcctgaggcctgccccaccgcccatcagtggaggtggctatcgggctcgtccagccaaagcagctgccactcaaaagaaagtagaaagaaaagcccctgatgctggaggctgtcttcacgctgacccagacctgggggtgttgtgtcctacaggatgtcagttgcaagaggctttgctacaacaggaaaggccaatcagaaatagtgttgatgagttaaataacaatgtggaagctgtttcccagacctcctcttcttcctttcagtacatgtatttgctgaaagacctgtggcaaaagaggcagaagcaagtaaaagataatgaaaatgtagtcaatgagtactcctcagaactggaaaagcaccaattatatatagatgagactgtgaatagcaatatcccaactaaccttcgtgtgcttcgttcaatcctggaaaacctgagaagcaaaatacaaaagttagaatctgatgtctcagctcaaatggaatattgtcgcaccccatgcactgtcagttgcaatattcctgtggtgtctggcaaagaatgtgaggaaattatcaggaaaggaggtgaaacatctgaaatgtatctcattcaacctgacagttctgtcaaaccgtatagagtatactgtgacatgaatacagaaaatggggcaggaaatgggatccatataaacagggatttggaaatgttgcaaccaacacagatgggaagaattactgtggcctaccaggtgaatattggcttggaaatgataaaattagccagcttaccaggatgggacccacagaacttttgatagaaatggaggactggaaaggagacaaagtaaaggctcactatggaggattcactgtacagaatgaagccaacaaataccagatctcagtgaacaaatacagaggaacagccggtaatgccctcatggatggagcatctcagctgatgggagaaaacaggaccatgaccattcacaacggcatgttcttcagcacgtatgacagagacaatgacggctggttaacatcagatcccagaaaacagtgttctaaagaagacggtggtggatggtggtataatagatgtcatgcagccaatccaaacggcagatactactggggtggacagtacacctgggacatggcaaagcatggcacagatgatggtgtagtatggatgaattggaaggggtcatggtactcaatgaggaagatgagtatgaagatcaggcccttcttcccacagcaatagtccccaatacgtagatttttgctcttctgtatgtgacaacatttttgtacattatgttattggaattttctttcatacattatattcctctaaaactctcaagcagacgtgagtgtgactttttgaaaaaagtataggataaattacattaaaatagcacatgattttcttttgttttcttcatttctcttgctcaccaagaagtaacaaaagtatagttttgacagagttggtgttcataatttcagttctagttgattgcgagaattttcaaataaggaagaggggtcttttatccttgtcgtaggaaaaccatgacggaaaggaaaaactgatgtttaaaagtccacttttaaaactatatttatttatgtaggatctgtcaaagaaaacttccaaaaagatttattaattaaaccagactctgttgcaataa

SEQ ID NO: 568401 - DNA, 1922 bp, Homo sapiens
ggaagtcattcctagcagaggactcagatatatataggattgaagatctctcagttaagtctacatgaaaaggatggtttcttggagcttccacaaacttaaaaccatgaaacatctattattgctactattgtgtgtttttctagttaagtcccaaggtgtcaacgacaatgaggagggtttcttcagtgcccgtggtcatcgaccccttgacaagaagagagaagaggctcccagcctgaggcctgccccaccgcccatcagtggaggtggctatcgggctcgtccagccaaagcagctgccactcaaaagaaagtagaaagaaaagcccctgatgctggaggctgtcttcacgctgacccagacctgggggtgttgtgtcctacaggatgtcagttgcaagaggctttgctacaacaggaaaggccaatcagaaatagtgttgatgagttaaataacaatgtggaagctgtttcccagacctcctcttcttcctttcagtacatgtatttgctgaaagacctgtggcaaaagaggcagaagcaagtaaaagataatgaaaatgtagtcaatgagtactcctcagaactggaaaagcaccaattatatatagatgagactgtgaatagcaatatcccaactaaccttcgtgtgcttcgttcaatcctggaaaacctgagaagcaaaatacaaaagttagaatctgatgtctcagctcaaatggaatattgtcgcaccccatgcactgtcagttgcaatattcctgtggtgtctggcaaagaatgtgaggaaattatcaggccgtatagagtatactgtgacatgaatacagaaaatggaggatggacagtgattcagaaccgtcaagacggtagtgttgactttggcaggaaatgggatccatataaacagggatttggaaatgttgcaaccaacacagatgggaagaattactgtggcctaccaggtgaatattggcttggaaatgataaaattagccagcttaccaggatgggacccacagaacttttgatagaaatggaggactggaaaggagacaaagtaaaggctcactatggaggattcactgtacagaatgaagccaacaaataccagatctcagtgaacaaatacagaggaacagccggtaatgccctcatggatggagcatctcagctgatgggagaaaacaggaccatgaccattcacaacggcatgttcttcagcacgtatgacagagacaatgacggctggttaacatcagatcccagaaaacagtgttctaaagaagacggtggtggatggtggtataatagatgtcatgcagccaatccaaacggcagatactactggggtggacagtacacctgggacatggcaaagcatggcacagatgatggtgtagtatggatgaattggaaggggtcatggtactcaatgaggaagatgagtatgaagatcaggcccttcttcccacagcaatagtccccaatacgtagatttttgctcttctgtatgtgacaacatttttgtacattatgttattggaattttctttcatacattatattcctctaaaactctcaagcagacgtgagtgtgactttttgaaaaaagtataggataaattacattaaaatagcacatgattttcttttgttttcttcatttctcttgctcaccaagaagtaacaaaagtatagttttgacagagttggtgttcataatttcagttctagttgattgcgagaattttcaaataaggaagaggggtcttttatccttgtcgtaggaaaaccatgacggaaaggaaaaactgatgtttaaaagtccacttttaaaactatatttatttatgtaggatctgtcaaagaaaacttccaaaaagatttattaattaaaccagactctgttgcaataa

SEQ ID NO: 568402 - DNA, 231 bp, Homo sapiens
  misc_feature (130)..(130): n is a, c, g, or t
  misc_feature (143)..(143): n is a, c, g, or t
aagcagccagtggtcaaatgaaaggcgggggaaacggatgcccctggcccagagcaggccaaagggagggggcacagctcacagctgcaccctggccttaccacagtctctacactacaaccaacctttncccaaaacatganccggcaaggccaggtcagagctagtccaagacctcaagcacagcctgccttgccaccacgtcaccaggtggatagacagaagcagggg

SEQ ID NO: 568403 - DNA, 2128 bp, Homo sapiens
  misc_feature (1041)..(1041): n is a, c, g, or t
ggaagtcattcctagcagaggactcagatatatataggattgaagatctctcagttaagtctacatgaaaaggatggtttcttggagcttccacaaacttaaaaccatgaaacatctattattgctactattgtgtgtttttctagttaagtcccaaggtgtcaacgacaatgaggagggtttcttcagtgcccgtggtcatcgaccccttgacaagaagagagaagaggctcccagcctgaggcctgccccaccgcccatcagtggaggtggctatcgggctcgtccagccaaagcagctgccactcaaaagaaagtagaaagaaaagcccctgatgctggaggctgtcttcacgctgacccagacctgggggtgttgtgtcctacaggatgtcagttgcaagaggctttgctacaacaggaaaggccaatcagaaatagtgttgatgagttaaataacaatgtggaagctgtttcccagacctcctcttcttcctttcagtacatgtatttgctgaaagacctgtggcaaaagaggcagaagcaagtaaaagataatgaaaatgtagtcaatgagtactcctcagaactggaaaagcaccaattatatatagatgagactgtgaatagcaatatcccaactaaccttcgtgtgcttcgttcaatcctggaaaacctgagaagcaaaatacaaaagttagaatctgatgtctcagctcaaatggaatattgtcgcaccccatgcactgtcagttgcaatattcctgtggtgtctggcaaagaatgtgaggaaattatcaggaaaggaggtgaaacatctgaaatgtatctcattcaacctgacagttctgtcaaaccgtatagagtatactgtgacatgaatacagaaaatggaggatggacagtgattcagaaccgtcaagacggtagtgttgactttggcaggaaatgggatccatataaacagggatttggaaatgttgcaaccaacacagatgggaagaattactgtggcctaccaggtaacgaacaggcatgcanaataaaatcattctatttgaaatgggattttttttaattaaaaaacattcattgttggaagcctgttttaggcagttaagaggagtttcctgacaaaaatgtggaagctaaagataagggaagaaaggcagtttttagtttcccaaaattttatttttggtgagattttattttgtttttcttttaggtgaatattggcttggaaatgatgactggaaaggagacaaagtaaaggctcactatggaggattcactgtacagaatgaagccaacaaataccagatctcagtgaacaaatacagaggaacagccggtaatgccctcatggatggagcatctcagctgatgggagaaaacaggaccatgaccattcacaacggcatgttcttcagcacgtatgacagagacaatgacggctggttaacatcagatcccagaaaacagtgttctaaagaagacggtggtggatggtggtataatagatgtcatgcagccaatccaaacggcagatactactggggtggacagtacacctgggacatggcaaagcatggcacagatgatggtgtagtatggatgaattggaaggggtcatggtactcaatgaggaagatgagtatgaagatcaggcccttcttcccacagcaatagtccccaatacgtagatttttgctcttctgtatgtgacaacatttttgtacattatgttattggaattttctttcatacattatattcctctaaaactctcaagcagacgtgagtgtgactttttgaaaaaagtataggataaattacattaaaatagcacatgattttcttttgttttcttcatttctcttgctcaccaagaagtaacaaaagtatagttttgacagagttggtgttcataatttcagttctagttgattgcgagaattttcaaataaggaagaggggtcttttatccttgtcgtaggaaaaccatgacggaaaggaaaaactgatgtttaaaagtccacttttaaaactatatttatttatgtaggatctgtcaaagaaaacttccaaaaagatttattaattaaaccagactctgttgcaataa

SEQ ID NO: 568404 - DNA, 1869 bp, Homo sapiens
ggaagtcattcctagcagaggactcagatatatataggattgaagatctctcagttaagtctacatgaaaaggatggtttcttggagcttccacaaacttaaaaccatgaaacatctattattgctactattgtgtgtttttctagttaagtcccaaggtgtcaacgacaatgaggagggtttcttcagtgcccgtggtcatcgaccccttgacaagaagagagaagaggctcccagcctgaggcctgccccaccgcccatcagtggaggtggctatcgggctcgtccagccaaagcagctgccactcaaaagaaagtagaaagaaaagcccctgatgctggaggctgtcttcacgctgacccagacctgggggtgttgtgtcctacaggatgtcagttgcaagaggctttgctacaacaggaaaggccaatcagaaatagtgttgatgagttaaataacaatgtggaagctgtttcccagacctcctcttcttcctttcagtacatgtatttgctgaaagacctgtggcaaaagaggcagaagcaagtaaaagataatgaaaatgtagtcaatgagtactcctcagaactggaaaagcaccaattatatatagatgagactgtgaatagcaatatcccaactaaccttcgtgtgcttcgttcaatcctggaaaacctgagaagcaaaatacaaaagttagaatctgatgtctcagctcaaatggaatattgtcgcaccccatgcactgtcagttgcaatattcctgtggtgtctggcaaagaatgtgaggaaattatcaggaaaggaggtgaaacatctgaaatgtatctcattcaacctgacagttctgtcaaaccgtatagagtatactgtgacatgaatacagaaaatggagaattactgtggcctaccaggtgaatattggcttggaaatgataaaattagccagcttaccaggatgggacccacagaacttttgatagaaatggaggactggaaaggagacaaagtaaaggctcactatggaggattcactgtacagaatgaagccaacaaataccagatctcagtgaacaaatacagaggaacagccggtaatgccctcatggatggagcatctcagctgatgggagaaaacaggaccatgaccattcacaacggcatgttcttcagcacgtatgacagagacaatgacggctggttaacatcagatcccagaaaacagtgttctaaagaagacggtggtggatggtggtataatagatgtcatgcagccaatccaaacggcagatactactggggtggacagtacacctgggacatggcaaagcatggcacagatgatggtgtagtatggatgaattggaaggggtcatggtactcaatgaggaagatgagtatgaagatcaggcccttcttcccacagcaatagtccccaatacgtagatttttgctcttctgtatgtgacaacatttttgtacattatgttattggaattttctttcatacattatattcctctaaaactctcaagcagacgtgagtgtgactttttgaaaaaagtataggataaattacattaaaatagcacatgattttcttttgttttcttcatttctcttgctcaccaagaagtaacaaaagtatagttttgacagagttggtgttcataatttcagttctagttgattgcgagaattttcaaataaggaagaggggtcttttatccttgtcgtaggaaaaccatgacggaaaggaaaaactgatgtttaaaagtccacttttaaaactatatttatttatgtaggatctgtcaaagaaaacttccaaaaagatttattaattaaaccagactctgttgcaataa

SEQ ID NO: 568405 - DNA, 144 bp, Homo sapiens
agatgcggctgactgcacagtgatgagccaggcctggacaggccccaggcgccccgccctagccctgggtggctggtgtaaccccagctccacgctgcttctcagaacaggttgcctgaggggttggccacacgggccttgacg

SEQ ID NO: 568406 - DNA, 1903 bp, Homo sapiens
ggaagtcattcctagcagaggactcagatatatataggattgaagatctctcagttaagtctacatgaaaaggatggtttcttggagcttccacaaacttaaaaccatgaaacatctattattgctactattgtgtgtttttctagttaagtcccaaggtgtcaacgacaatgaggagggtttcttcagtgcccgtggtcatcgaccccttgacaagaagagagaagaggctcccagcctgaggcctgccccaccgcccatcagtggaggtggctatcgggctcgtccagccaaagcagctgccactcaaaagaaagtagaaagaaaagcccctgatgctggaggctgtcttcacgctgacccagacctgggggtgttgtgtcctacaggatgtcagttgcaagaggctttgctacaacaggaaaggccaatcagaaatagtgttgatgagttaaataacaatgtggaagctgtttcccagacctcctcttcttcctttcagtacatgtatttgctgaaagacctgtggcaaaagaggcagaagcaagtaaaagataatgaaaatgtagtcaatgagtactcctcagaactggaaaagcaccaattatatatagatgagactgtgaatagcaatatcccaactaaccttcgtgtgcttcgttcaatcctggaaaacctgagaagcaaaatacaaaagttagaatctgatgtctcagctcaaatggaatattgtcgcaccccatgcactgtcagttgcaatattcctgtggtgtctggcaaagaatgtgaggaaattatcaggaaaggaggtgaaacatctgaaatgtatctcattcaacctgacagttctgtcaaaccgtatagagtatactgtgacatgaatacagaaaatggaggatggacagtgattcagaaccgtcaagacggtagtgttgactttggcaggaaatgggatccatataaacagggatttggaaatgttgcaaccaacacagatgggaagaattactgtggcctaccaggtgaatattggcttggaaatgataaaattagccagcttaccaggatgggacccacagaacttttgatagaaatggaggactggaaaggagacaaagtaaaggctcactatggaggattcactgtacagaatgaagccaacaaataccagatctcagtgaacaaatacagaggaacagccggtaatgccctcatggatggagcatctcagctgatgggagaaaacaggaccatgaccattcacaacggcatgttcttcagcacgtatgacagagacaatgacggctagccaatccaaacggcagatactactggggtggacagtacacctgggacatggcaaagcatggcacagatgatggtgtagtatggatgaattggaaggggtcatggtactcaatgaggaagatgagtatgaagatcaggcccttcttcccacagcaatagtccccaatacgtagatttttgctcttctgtatgtgacaacatttttgtacattatgttattggaattttctttcatacattatattcctctaaaactctcaagcagacgtgagtgtgactttttgaaaaaagtataggataaattacattaaaatagcacatgattttcttttgttttcttcatttctcttgctcaccaagaagtaacaaaagtatagttttgacagagttggtgttcataatttcagttctagttgattgcgagaattttcaaataaggaagaggggtcttttatccttgtcgtaggaaaaccatgacggaaaggaaaaactgatgtttaaaagtccacttttaaaactatatttatttatgtaggatctgtcaaagaaaacttccaaaaagatttattaattaaaccagactctgttgcaataa

SEQ ID NO: 568407 - DNA, 363 bp, Homo sapiens
  misc_feature (49)..(49): n is a, c, g, or t
  misc_feature (187)..(187): n is a, c, g, or t
  misc_feature (232)..(232): n is a, c, g, or t
  misc_feature (290)..(290): n is a, c, g, or t
  misc_feature (349)..(349): n is a, c, g, or t
aggaggctgaggcaggaaaatcacttgaacccttaaccagggaggcggnggttgcagtgagccgagatcatgccactgcactccaacctgggcgacagagcgagactcgatctcaaattttttttttttgagagacaaggtcttgctatgttgcccaggctggtctcgaactcctgagctcaagagntcctcttgtcttggccttccaaagtgctgggattgcaggcgtgantaaccacgcctggcccattcacggatctttttgtggtcattgtccagtgttagcctantgataacagcctggctgggatgaatgccagcgtgggacagtcgtgccattagacttttncccccttgcactcg

SEQ ID NO: 568408 - DNA, 162 bp, Homo sapiens
agctacaaagtctcctccgtgctaactcggaaagggaagtgtgactactggatcaggacttttgtcccaggttgccagcccggcgagtacacgctgggcaacattaagagtaaccctggattaacgagttacctcgtccgagtggcgaacaccaccaataca

SEQ ID NO: 568409 - DNA, 1952 bp, Homo sapiens
ggaagtcattcctagcagaggactcagatatatataggattgaagatctctcagttaagtctacatgaaaaggatggtttcttggagcttccacaaacttaaaaccatgaaacatctattattgctactattgtgtgtttttctagttaagtcccaaggtgtcaacgacaatgaggagggtttcttcagtgcccgtggtcatcgaccccttgacaagaagagagaagaggctcccagcctgaggcctgccccaccgcccatcagtggaggtggctatcgggctcgtccagccaaagcagctgccactcaaaagaaagtagaaagaaaagcccctgatgctggaggctgtcttcacgctgacccagacctgggggtgttgtgtcctacaggatgtcagttgcaagaggctttgctacaacaggaaaggccaatcagaaatagtgttgatgagttaaataacaatgtggaagctgtttcccagacctcctcttcttcctttcagtacatgtatttgctgaaagacctgtggcaaaagaggcagaagcaagtaaaagataatgaaaatgtagtcaatgagtactcctcagaactggaaaagcaccaattatatatagatgagactgtgaatagcaatatcccaactaaccttcgtgtgcttcgttcaatcctggaaaacctgagaagcaaaatacaaaagttagaatctgatgtctcagctcaaatggaatattgtcgcaccccatgcactgtcagttgcaatattcctgtggtgtctggcaaagaatgtgaggaaattatcaggaaaggaggtgaaacatctgaaatgtatctcattcaacctgacagttctgtcaaaccgtatagagtatactgtgacatgaatacagaaaatggaggatggacagtgattcagaaccgtcaagacggtagtgttgactttggcaggaaatgggatccatataaacagggatttggaaatgttgcaaccaacacagatgggaagaattactgtggcctaccaggtgaatattggcttggaaatgataaaattagccagcttaccaggatgggacccacagaacttttgatagaaatggaggactggaaaggagacaaagtaaaggctcactatggaggattcactgtacagaatgaagccaacaaataccagatctcagtgaacaaatacagaggaacagccggtaatgccctcatggatggagcatctcagctgatgggagaaaacaggaccatgaccattcacaacggcatgttcttcagcacgtatgacagagacaatgacggctcagtgttctaaagaagacggtggtggatggtggtataatagatgtcatgcagccaatccaaacggcagatactactggggtggacagtacacctgggacatggcaaagcatggcacagatgatggtgtagtatggatgaattggaaggggtcatggtactcaatgagaagatgagtatgaagatcaggcccttcttcccacagcaatagtccccaatacgtagatttttgctcttctgtatgtgacaacatttttgtacattatgttattggaattttctttcatacattatattcctctaaaactctcaagcagacgtgagtgtgactttttgaaaaaagtataggataaattacattaaaatagcacatgattttcttttgttttcttcatttctcttgctcaccaagaagtaacaaaagtatagttttgacagagttggtgttcataatttcagttctagttgattgcgagaattttcaaataaggaagaggggtcttttatccttgtcgtaggaaaaccatgacggaaaggaaaaactgatgtttaaaagtccacttttaaaactatatttatttatgtaggatctgtcaaagaaaacttccaaaaagatttattaattaaaccagactctgttgcaataa

SEQ ID NO: 568410 - DNA, 1223 bp, Homo sapiens
  misc_feature (26)..(26): n is a, c, g, or t
  misc_feature (33)..(33): n is a, c, g, or t
tcaacgctgctcacacacatactccncacaggntgaagccacgcaggccccaccccaactgtaatggtgttcctgggaaggggatgggaacagaatggctgtaggaagggccattcccctttagtcctgcaatttaaaaatcccttccatctcctcactataaatctcattaaactacaagaaacaaaataatttgaagtttgacccagggcaacaatttacacttgatgattttttccttcctacaatttacataggaaagttctatgagctagaattagcttagctcatgtttataaagaactctgttatggatacaaagctagctaacgccatgggtggaaaatacttaagaatctgaaagattaatctggggctcagtcctatccaaatagaaacaatacttttctacaaacaagaaaacacacatcaggaaaacccaagtcttcaggttttctcctctcaagggtggagagcatgtggcactccaatgtgcgatctgctgctgacactgcttggcacatcaccctcttcacttggcctgcttcctcctttgtctcatgagaaggtgggactgcatcatctctccaggtactctcttcctatcagtctactcttcagagattaagcctcacttttggatataaagactccctagaaatgcttacttatataactgtctccacaaagagctaattcaacattaaactgcacgaatacaagcacaacgtccccaccaaagcacaggtatgttcctctatgcaaagttagacaatggagataccggactcagatcagaacattaccatgtaagagaaaaactgacatacatccagggagcaggaacttagatgtctcatctataaagagagaaaactgggcagaacaagaaaacactatttcctactattagaaaacaagtatcacaccaggaagataaagacagcttctctgcaactccaaaggcatccaaggacaggaaggggtcaggatggcagagaaggaagatcagtaatgaggggaagtaggatcagaatagcagaatggctggcaccaaaggtaaggagtgccctctaaaggaaacctcaagaagacattaggcatcaacgtggggtgagtatggcagtgggaaactcaagtattagataaaaaggaaactccagctactgcacgtgtgggatgaatggacttcagaagggcaacagcagagatagcgagacata

SEQ ID NO: 568411 - DNA, 380 bp, Homo sapiens
cgattcactctgctctccacgcaagccacagcactcagtgccgtttttctggctcatcaagagctgggtctgtagtgcttttgtcacaagagctaaatagccattttcagtaaccacacgaggcgtggcccaggggccagaaatgatcctgctgatgaccacacatgggatatgcttaacaaggctataataagctctacggctgatttgagctttaagcttactcagtgagaggtctatttcacaattcactgggctccatcaacaatcaaatgggccaaggtcaaactctgtcgccgagattgtatgctacaatgtggggctgtgtagacgttccttttcaacagccccacggaaaatcatcctcagaacaccgcgaa

SEQ ID NO: 568412 - DNA, 1021 bp, Homo sapiens
gcatttacatctcacttctacgaatactagtatatcgctcacacctcatatcctgcctactatgcctagagggactaatactatcgctgttgattatagctagctctgcataaccctgcaatcacccactccctcttaggccaatattgtgccctatggccatactagtcttgccgcctgcgaagcagcggtgggcctagccctactagtctcaatctccaacacatatggcgctagactacgtatcgataacctaaacctactccaatgctaaaactaatcgtcccaactaaattatattactaacactgacatgactttccaataaaacgacataatttgaatcaagcacaaccacccacagctaattattagcatcatcccccctactatttgttaaccaaatcaacaacaacctatttagctgttccccaagcttttcctccgagcccctaataacccccctcctgaatactaactacctggactcctaccctcacaatcatggcaagccaagcgccaattatccagtgaaacactatcacgaaaacaaactctactctctatactaatctccctacagatctccttaattatatcattcacagcacagaactaatcatatatgatatcttcttgcgaaaccaacatatattccgcacttgggataatcattcacccgattgaggaaaccaggcagaaaggctgaacgcagggccgatactcctattccacaccccaagtaggctccctgtcgcccagcaccgacacaatgaactcagaacaaccctaggtcacataaacattctacgatagcacgcagactggccggaacaccaatccggagcaccactctaaggccgttacacaagtaaagaagaaccgacggaacacaagagaccaatgacggaagcacgggacaaagtagggacagacggggagacaacagagcaggaaaaacgctcaacaggaaacacacgaacgcggaacagaagcacgggatgacaacacaccacagcgg

SEQ ID NO: 568413 - DNA, 144 bp, Homo sapiens
cacgaggcctatgttcataggttattataacaagggccctcttcctccaaatcgacatttgatcctgctaaagccaacattcgtacagttttttagtcagtccatcattattgctcagcacaggtgtaattgaagctgaacact

SEQ ID NO: 568414 - DNA, 3717 bp, Homo sapiens
gtgaggctcagtgctgtgggcttttccacctgagtgcccttggattgactgagatgccaagaggaaaatttatctgcaatgaatgtcgcacaggaatccatacctgttttgtatgtaagcagagtggggaagatgttaaaaggtgccttctacccttgtgtggaaagttttaccatgaagagtgtgtccagaagtacccacccactgttatgcagaacaagggcttccggtgctccctccacatctgtataacctgtcatgctgctaatccagccaatgtttctgcatctaaaggtcggctgatgcgctgtgtccgctgtcctgtggcataccacgccaatgacttttgcctggctgctgggtcaaagatccttgcatctaatagtatcatctgccctaatcactttacccctaggcggggctgccgaaatcatgagcatgttaatgttagctggtgctttgtgtgctcagaaggaggcagccttctgtgctgtgattcttgccctgctgcttttcatcgtgaatgcctgaacattgatatccctgaaggaaactggtattgcaacgactgtaaagcaggcaaaaagccacactacagggagattgtctgggtaaaagttggacgatacaggtggtggccagctgagatctgccatcctcgagctgttccttccaacattgataagatgagacatgatgtgggagagttcccagtcctcttttttggatctaatgactatttgtggactcaccaagcccgagtcttcccttacatggagggtgacgtgagcagcaaggataagatgggcaaaggagtggatgggacatataaaaaagctcttcaggaagctgcagcaaggtttgaggaattaaaggcccaaaaagagctaagacagctgcaggaagaccgaaagaatgacaagaagccaccaccttataaacatataaaggtaaaccgtcctattggcagggtacagatcttcactgcagacttatctgaaataccccgttgcaactgtaaagctactgatgagaacccctgtgggatagactctgaatgcatcaaccgcatgctgctctatgagtgccaccccacagtgtgtcctgccggagggcgctgtcaaaaccagtgcttttccaagcgccaatatccagaggttgaaattttccgcacattacagcggggttggggtctacggacaaaaacagatattaaaaagggtgaatttgtgaatgagtatgtgggtgagcttatagatgaagaagaatgcagagctcgaattcgctatgctcaagaacatgatatcactaatttctatatgctcaccctagacaaagaccgaatcattgatgctggtcccaaaggaaactatgctcggttcatgaatcattgctgccagcccaactgtgaaacacagaagtggtctgtgaatggagatacccgtgtaggcctttttgcactaagtgacattaaagcaggcactgaacttaccttcaactacaacctagaatgtcttgggaatggaaagactgtttgcaaatgtggagccccgaactgcagtggcttcttgggtgtaaggccaaagaatcaacccattgccacggaagaaaagtcaaagaaattcaagaagaagcaacagggaaagcgcaggacccagggtgaaatcacaaaggagcgagaagatgagtgttttagttgtggggatgctggccagctcgtctcctgcaagaaaccaggctgcccaaaagtttaccacgcagactgtctcaatctgaccaagcgaccagcagggaaatgggaatgtccgtggcatcagtgtgacatctgcgggaaggaagcagcctccttctgtgagatgtgccccagctccttttgtaagcagcatcgagaagggatgcttttcatttccaaactggatgggcgtctgtcttgtactgagcatgacccctgtgggcccaatcctctggaacctggggagatccgtgagtatgtgcctcccccagtaccgctgcctccagggccaagcactcacctggcagagcaatcaacaggaatggctgctcaggcacccaaaatgtcagataaacctcctgctgacaccaaccagatgctgtcgctctccaaaaaagctctggcagggacttgtcagaggccactgctacctgaaagacctcttgagagaactgactccaggccccagcctttagataaggtcagagacctcgctgggtcagggaccaaatcccaatccttggtttccagccagaggccactggacaggccaccagcagtggcaggaccaagaccccagctaagcgacaaaccctctccagtgaccagcccaagctcctcaccctcagtcaggtcccaaccactggaaagacctctggggacggctgacccaaggctggataaatccataggtgctgccagcccaaggccccagtcactggagaaaacctcagttcccactggcctgagacttccgccgccagacagactgctcattactagcagtcccaaaccccagacttcagacaggcctactgacaaaccccatgcctctttgtcccagagactcccacctcctgagaaagtactatcagctgtggtccagacccttgtagctaaagaaaaagcactgaggcctgtggaccagaatactcagtcaaaaaatagagctgctttggtgatggatctcatagacctaactcctcgccagaaggagcgggcagcttcacctcatcaggtcacaccacaggctgatgagaagatgccagtgttggagtcaagttcatggcctgccagcaaaggtctggggcatatgccgagagctgttgagaaaggctgtgtgtcagatcctcttcagacatctgggaaagcagcagccccttcagaggacccctggcaagctgttaaatcactcacccaggccagacttctttctcagcctcctgccaaggcctttttatatgagccaacaactcaggcctcaggaagagcttctgcaggggctgagcagaccccagggcctcttagccaatccccgggcctggtgaagcaggcgaagcagatggtcggaggccagcaactacctgcacttgccgccaagagtgggcaatcttttaggtctctcgggaaggccccagcctccctccccactgaagaaaagaagttggtaaccacagagcaaagtccctgggccctgggaaaagcctcatcacgggcagggctctggcccatagtggctggacagacactggcacagtcttgctggtctgctgggagcacacagacattggcacagacttgctggtctcttggaagagggcaagaccccaaaccagagcaaaatacacttccagctcttaaccaggctccttccagtcacaagtgtgcagaatcagaacagaagtagtaccaatcaatgtcacatgaacaaacaagctgcccccagggtaccatttggggaggggaaatcttttctttctttcccccttaaaaaaaaacacatctgccccgaacactttcccactgttattctttcctcatatcccaacactcagaactcttgtgacattagccagtgggggcttatggttgtgtgaaccatgtatgaaaatccagtgggccccaaccaaggagacagacagacttgggtctctttcccccaacttttccacatggtcatcgtgaaataaaaagtccactctgga

SEQ ID NO: 568415 - DNA, 700 bp, Homo sapiens
gggcgctggaaacccagcggcggcgcaagcggagcagtgagccccgcgcgtctcgcccgcacggctccatgtgtctggggtctgcgctggatgccgtgctggggagatggcctgtctctgcgacctgccgcgcccgcgtcccgagccgtccgggtccgcggacagcccggccaccatccatggtgctctggccctgctctcgctgcccctggtctgctgtcgccgcctgaggatgctgttgctgctgctgatgtctctgctgtcaggttggccatggcctcataggctgacgctaccgtctatttgaggcggctgtttgacagattatcaaggatgatcatcctggctcgagtagtccaacagatgctctagacccagtcgatcatccatttcgaggtgtgtccatgttctcagctggtgaaggtggatgaaggtaaaccagatcatggatgatccaaccgtgtggctcaaggcaagatctggaatgactacaagctgaacgtggaacccctctgactatgtgtggggcagagttcatgcgtgtccctgcacacgaagatctggaagccagacattgtgctgtaataacaaatgctgtcggggatttccaggtggacgacaagaccaaagtcttactcaagatacactggcggaggtgacttggcatacctccgaccatctttaaagctcgtgtaaaatc

SEQ ID NO: 568416 - DNA, 4287 bp, Homo sapiens
gtgaggctcagtgctgtgggcttttccacctgagtgcccttggattgactgagatgccaagaggaaaatttatctgcaatgaatgtcgcacaggaatccatacctgttttgtatgtaagcagagtggggaagatgttaaaaggtgccttctacccttgtgtggaaagttttaccatgaagagtgtgtccagaagtacccacccactgttatgcagaacaagggcttccggtgctccctccacatctgtataacctgtcatgctgctaatccagccaatgtttctgcatctaaaggtcggctgatgcgctgtgtccgctgtcctgtggcataccacgccaatgacttttgcctggctgctgggtcaaagatccttgcatctaatagtatcatctgccctaatcactttacccctaggcggggctgccgaaatcatgagcatgttaatgttagctggtgctttgtgtgctcagaaggaggcagccttctgtgctgtgattcttgccctgctgcttttcatcgtgaatgcctgaacattgatatccctgaaggaaactggtattgcaacgactgtaaagcaggcaaaaagccacactacagggagattgtctgggtaaaagttggacgatacaggtggtggccagctgagatctgccatcctcgagctgttccttccaacattgataagatgagacatgatgtgggagagttcccagtcctcttttttggatctaatgactatttgtggactcaccaagcccgagtcttcccttacatggagggtgacgtgagcagcaaggataagatgggcaaaggagtggatgggacatataaaaaagctcttcaggaagctgcagcaaggtttgaggaattaaaggcccaaaaagagctaagacagctgcaggaagaccgaaagaatgacaagaagccaccaccttataaacatataaaggtaaaccgtcctattggcagggtacagatcttcactgcagacttatctgaaataccccgttgcaactgtaaagctactgatgagaacccctgtgggatagactctgaatgcatcaaccgcatgctgctctatgagtgccaccccacagtgtgtcctgccggagggcgctgtcaaaaccagtgcttttccaagcgccaatatccagaggttgaaattttccgcacattacagcggggttggggtctacggacaaaaacagatattaaaaagggtgaatttgtgaatgagtatgtgggtgagcttatagatgaagaagaatgcagagctcgaattcgctatgctcaagaacatgatatcactaatttctatatgctcaccctagacaaagaccgaatcattgatgctggtcccaaaggaaactatgctcggttcatgaatcattgctgccagcccaactgtgaaacacagaagtggtctgtgaatggagatacccgtgtaggcctttttgcactaagtgacattaaagcaggcactgaacttaccttcaactacaacctagaatgtcttgggaatggaaagactgtttgcaaatgtggagccccgaactgcagtggcttcttgggtgtaaggccaaagaatcaacccattgccacggaagaaaagtcaaagaaattcaagaagaagcaacagggaaagcgcaggacccagggtgaaatcacaaaggagcgagaagatgagtgttttagttgtggggatgctggccagctcgtctcctgcaagaaaccaggctgcccaaaagtttaccacgcagactgtctcaatctgaccaagcgaccagcagggaaatgggaatgtccgtggcatcagtgtgacatctgcgggaaggaagcagcctccttctgtgagatgtgccccagctccttttgtaagcagcatcgagaagggatgcttttcatttccaaactggatgggcgtctgtcttgtactgagcatgacccctgtgggcccaatcctctggaacctggggagatccgtgagtatgtgcctcccccagtaccgctgcctccagggccaagcactcacctggcagagcaatcaacaggaatggctgctcaggcacccaaaatgtcagataaacctcctgctgacaccaaccagatgctgtcgctctccaaaaaagctctggcagggacttgtcagaggccactgctacctgaaagacctcttgagagaactgactccaggccccagcctttagataaggtcagagacctcgctgggtcagggaccaaatcccaatccttggtttccagccagaggccactggacaggccaccagcagtggcaggaccaagaccccagctaagcgacaaaccctctccagtgaccagcccaagctcctcaccctcagtcaggtcccaaccactggaaagacctctggggacggctgacccaaggctggataaatccataggtgctgccagcccaaggccccagtcactggagaaaacctcagttcccactggcctgagacttccgccgccagacagactgctcattactagcagtcccaaaccccagacttcagacaggcctactgacaaaccccatgcctctttgtcccagagactcccacctcctgagaaagtactatcagctgtggtccagacccttgtagctaaagaaaaagcactgaggcctgtggaccagaatactcagtcaaaaaatagagctgctttggtgatggatctcatagacctaactcctcgccagaaggagcgggcagcttcacctcatcaggtcacaccacaggctgatgagaagatgccagtgttggagtcaagttcatggcctgccagcaaaggtctggggcatatgccgagagctgttgagaaaggctgtgtgtcagatcctcttcagacatctgggaaagcagcagccccttcagaggacccctggcaagctgttaaatcactcacccaggccagacttctttctcagcctcctgccaaggcctttttatatgagccaacaactcaggcctcaggaagagcttctgcaggggctgagcagaccccagggcctcttagccaatccccgggcctggtgaagcaggcgaagcagatggtcggaggccagcaactacctgcacttgccgccaagagtgggcaatcttttaggtctctcgggaaggccccagcctccctccccactgaagaaaagaagttggtaaccacagagcaaagtccctgggccctgggaaaagcctcatcacgggcagggctctggcccatagtggctggacagacactggcacagtcttgctggtctgctgggagcacacagacattggcacagacttgctggtctcttggaagagggcaagaccccaaaccagagcaaaatacacttccagctcttaaccaggctccttccagtcacaagtgtgcagaatcagaacagaagtagtaccaatcaatgtcacatgaacaaacaagctgcccccagggtaccatttggggaggggaaatcttttctttctttcccccttaaaaaaaaacacatctgccccgaacactttcccactgttattctttcctcatatcccaacactcagaactcttgtgacattagccagtgggggcttatggttgtgtgaaccatgtatgaaaatccagtgggccccaaccaaggagacagacagacttgggtctctttcccccaacttttccacatggtcatcgtgaaataaaaagtccactctggaaaaaaaaaaaaaaaaaaaaaaaaaaaaaaaaaaaaaaaaaaaaaaaaaaaaaaaaaaaaaaaaaaaaaaaaaaaaaaaaaagggggggggcgacgactataatatactcttccccagggggggccgaccatatccaccacagccccccgttttttgttaaaaagggggcgcccacataagaaggaacgatctttatataagagaaagcaagtgggcccgctattttaaaaaaaaatcttttgtggaagaaaaaaatagagggtgagaattattttgatgagagcacaacaaaatcaaggggggggggggagcaaaaaatattggggggagacaacaaaattacttacttaagaaagagattaatttaaagaacccgctgttggggggaaaataaatataataaaattgagaggggctatatataatagtgaggtgaaacaaacaacatccgggataatataagaatgggaggaggaaagaaaaaatattgttgagtgaaacgagggagtagattatgatataatgaagaatattattatttacacgggggggttttttaataaaaatgtg

SEQ ID NO: 568417 - DNA, 392 bp, Homo sapiens
gggaccccgcccaaaccctatgctaagacttaccagcaaagcgaactactattttaattgatccaataacttgaccaacggaacaagttaccctagggataacagcgcaatcctattctagagtccatatcaacaatagggtttcgatgaccgtcatcaaaccctccaattaacgcggttatttggttgcttcctgtaaactccctgggtttagggtttcgatgacgtcatcaaaccctaccctgttcaactaagcactctactctcagtttactgctaaatccaccttcgacccttaagtttcataagggctatcgtaagggtttcgatgacctcatcaaaccctgaccaaaggaccacttcttctcaacatccccctagggtttcgatga

SEQ ID NO: 568418 - DNA, 1647 bp, Homo sapiens
  misc_feature (566)..(566): n is a, c, g, or t
  misc_feature (1192)..(1192): n is a, c, g, or t
  misc_feature (1257)..(1257): n is a, c, g, or t
taattggttaatggtttatttatcaagaggaactatttcttagcccacattatttcagtgtgtgttcatagtttcaggaaccacaagttcaggtgacaaactttctaggtaatttcaacctgtgaagaaaattctttatatttccaagattacttatacacctcgtgaaagaataccagcgcttccctcattcttccctcaaatattctttctcagtgacatctcgataagttctcgtggtaaaaaatctctgtggcgatattgcctttctttctctttgttatctcagcgcaccagcgaaaactttattaacaaaggcgtgtgaacaccccgagggaatattcgcccgagaaatgtgcgtaacagcgccactatatgtgatattctcgcgcaaagacccgccttgtgggcacaagatagtggcgcacggaaatttccagaagggtttgtggagcaaaaaacccttctcgcggagagcgcccatgttgggatatgatatcacggtgctgctcctccctagtgagaatacagcggtttatgttgtgctataaacacgcttctactanaccacaccagaggcgtgttccccctatagatatctctatagaaatatcgcggcgaaagagcggacggcggctctctaatagagagatatatatcccctctcgagagggggggccccccaaagagcttatagcggcgcgttatcccccgagcgctgttttctctttgtgtattaccacaagggggtgggtctcccccatatatatgatgtggaagacctcgcaatatttataacataacgcctataagagcacacacgtgggcccccgctacggctttttcacccaaagcgttctcgtgtagaaccggtgtgggcaaaacccgtgggataagccctgtggggggaaaccacccttttgtgaggtgacacgagggaacaacccccattatatcaatattcgtgagaggagggtgggttggcacccaataattgttgggcggcacccacaaatgatctataacctcttagcgaggcgacgaaaactcttttcaaagaaggacctcccatacaaagcgtgcttacacacacattattcacacagcactgtctttctacaaccacggtgggtctactcacaccgtgggtggttataaaaaccacttaatggcttggacacaataaattggnaccttggccacttggccctatgcgaccaaacaagcttacttgggcgcctcaaaacgttggggagnatcactgcccacatcatcagtgtgggcacaccaccactctcttgttttttcccccccagaatcggggagagcagtactgagaagcaataaacatcaacgccggaactagccaaccaaagacgaccgacaaagaacgatccaggcagaaagcacagagcatatcaacgcgaccgagacgagaagcatggaagagtacaacaactcccaatggtggtacagttcaatcaaacggtcaagcagcagacactccagaacaacacagacatgagcaagatagggcagcagcccaaaccagaacacatgcctaccacgacagcaatcataaacgcagacacgcagcaatactcaatcacagcaacgacaagcgaaacaggacaactaagtcgatac

SEQ ID NO: 568419 - DNA, 312 bp, Homo sapiens
  misc_feature (263)..(263): n is a, c, g, or t
gagagagagagagagaactagtctcgagtttttttttaaagagaaagagagtagaaaataataccgcccaggctggagtgcagtggcatgatctcagctcactgcaacctccacctcctggattcaagcgattctcctgcctcagcctcccaagtagctgggactacaggcacgcaccaccacgcctggctaatttttgtgtttttagtagagatgcacttttactgtgttggccaggcttggtcttgaactcctgacttcgngatccgccgcttcagctcacaaagtgctgggattacaggcatgagcacc

SEQ ID NO: 568420 - DNA, 531 bp, Homo sapiens
  misc_feature (211)..(211): n is a, c, g, or t
  misc_feature (234)..(234): n is a, c, g, or t
  misc_feature (241)..(241): n is a, c, g, or t
aggaggaacagctcaaatgaaaaggagggagctccttcagggtcaaagcagtgacagtgcccagggctctattgtgtctctcccagcttgtaaagggtgaaacagctgccttgtgtgggactgagaggcaagagttgttcctgcccttccctttgtgacttgaagaaccctgactttgtttttgcaaaggcccctgcatgggtttgtgttnatgtaggaataatgtgaggaggnggggagncccccccccccccatgtcccccatgaccctcttcccacggtgacctgggctccctccccaatcatttttcctgttgcaaaaaggtggggctgaggggtctccatttctgtttcaacttcatggggcactgagcgggaactttttccttccctattaaaattagaacctgagtataaatttactttttcaaattcttgccatgagaggttgatgagttaattaaaggagaagattcctaaaatttgagagacaaaataaatggaacccatgagacccttcccaaaaaaaaa

SEQ ID NO: 568421 - DNA, 140 bp, Homo sapiens
  misc_feature (42)..(42): n is a, c, g, or t
cctatacagcaatggagccatcgcggaagtccgtcctcccantgaggatgttgaccacaaccgggtggccgtctcgccatgcatgcatgggcctccgtgcagcacccttgaccaccctgactcctcgttctcccgtgacg

SEQ ID NO: 568422 - DNA, 775 bp, Homo sapiens
  misc_feature (13)..(13): n is a, c, g, or t
  misc_feature (67)..(67): n is a, c, g, or t
  misc_feature (81)..(81): n is a, c, g, or t
  misc_feature (83)..(83): n is a, c, g, or t
  misc_feature (85)..(85): n is a, c, g, or t
  misc_feature (90)..(90): n is a, c, g, or t
  misc_feature (100)..(100): n is a, c, g, or t
  misc_feature (104)..(104): n is a, c, g, or t
  misc_feature (110)..(111): n is a, c, g, or t
  misc_feature (113)..(113): n is a, c, g, or t
  misc_feature (116)..(116): n is a, c, g, or t
  misc_feature (126)..(126): n is a, c, g, or t
  misc_feature (131)..(131): n is a, c, g, or t
  misc_feature (134)..(134): n is a, c, g, or t
  misc_feature (136)..(136): n is a, c, g, or t
  misc_feature (138)..(138): n is a, c, g, or t
  misc_feature (143)..(143): n is a, c, g, or t
  misc_feature (146)..(146): n is a, c, g, or t
  misc_feature (152)..(152): n is a, c, g, or t
  misc_feature (180)..(180): n is a, c, g, or t
  misc_feature (186)..(186): n is a, c, g, or t
  misc_feature (207)..(207): n is a, c, g, or t
  misc_feature (225)..(225): n is a, c, g, or t
  misc_feature (232)..(232): n is a, c, g, or t
  misc_feature (237)..(237): n is a, c, g, or t
  misc_feature (241)..(241): n is a, c, g, or t
  misc_feature (244)..(244): n is a, c, g, or t
  misc_feature (250)..(251): n is a, c, g, or t
  misc_feature (253)..(253): n is a, c, g, or t
  misc_feature (265)..(265): n is a, c, g, or t
  misc_feature (277)..(277): n is a, c, g, or t
  misc_feature (279)..(279): n is a, c, g, or t
  misc_feature (283)..(283): n is a, c, g, or t
  misc_feature (287)..(287): n is a, c, g, or t
  misc_feature (291)..(291): n is a, c, g, or t
  misc_feature (300)..(301): n is a, c, g, or t
  misc_feature (311)..(311): n is a, c, g, or t
  misc_feature (317)..(317): n is a, c, g, or t
  misc_feature (319)..(319): n is a, c, g, or t
  misc_feature (325)..(325): n is a, c, g, or t
  misc_feature (328)..(328): n is a, c, g, or t
  misc_feature (342)..(342): n is a, c, g, or t
  misc_feature (347)..(348): n is a, c, g, or t
  misc_feature (351)..(351): n is a, c, g, or t
  misc_feature (354)..(354): n is a, c, g, or t
  misc_feature (357)..(357): n is a, c, g, or t
  misc_feature (359)..(359): n is a, c, g, or t
  misc_feature (361)..(362): n is a, c, g, or t
  misc_feature (373)..(373): n is a, c, g, or t
  misc_feature (382)..(382): n is a, c, g, or t
  misc_feature (395)..(395): n is a, c, g, or t
  misc_feature (412)..(412): n is a, c, g, or t
  misc_feature (429)..(429): n is a, c, g, or t
  misc_feature (434)..(434): n is a, c, g, or t
  misc_feature (439)..(439): n is a, c, g, or t
  misc_feature (454)..(454): n is a, c, g, or t
  misc_feature (458)..(458): n is a, c, g, or t
  misc_feature (462)..(462): n is a, c, g, or t
  misc_feature (465)..(465): n is a, c, g, or t
  misc_feature (469)..(469): n is a, c, g, or t
  misc_feature (520)..(520): n is a, c, g, or t
  misc_feature (523)..(523): n is a, c, g, or t
  misc_feature (525)..(525): n is a, c, g, or t
  misc_feature (552)..(552): n is a, c, g, or t
  misc_feature (560)..(560): n is a, c, g, or t
  misc_feature (590)..(590): n is a, c, g, or t
  misc_feature (593)..(594): n is a, c, g, or t
  misc_feature (601)..(601): n is a, c, g, or t
  misc_feature (619)..(619): n is a, c, g, or t
  misc_feature (655)..(655): n is a, c, g, or t
  misc_feature (668)..(668): n is a, c, g, or t
  misc_feature (682)..(682): n is a, c, g, or t
  misc_feature (685)..(685): n is a, c, g, or t
  misc_feature (688)..(688): n is a, c, g, or t
  misc_feature (691)..(691): n is a, c, g, or t
  misc_feature (698)..(698): n is a, c, g, or t
  misc_feature (702)..(702): n is a, c, g, or t
  misc_feature (706)..(706): n is a, c, g, or t
  misc_feature (709)..(709): n is a, c, g, or t
  misc_feature (742)..(742): n is a, c, g, or t
cagagggcataancctggccaaagttgcccagggagcagatttgtctgagcagggccagccccaggnagctagaagttaanananaaggntttatgggtntggnagattnnangcnactggtcccntaganagntntntctcntgnttggtnagattccactttggagaaaatgggctcntttganaggatggcctggtgagggaanacaggtactaacggtaanaggccgntgaanactnacnactggnntnagggtggagctnagctgactgganantaantccnttanaaggacctnntcctggtgcnaggctntnccactnaantgctcatggccatnaggannttnaanttntntnntctcctccatnaggcccctntttttttggcctnagccccggtcctcactntttggtggctattatgnaggantctcnaccctcttttggaanagtnttgnttnaagnaagggagattgttcttctagagggacaggaaaagaagagatgtccacatanttntntaaatataagaagaaaggaaaggtaantggtgaantaaaatataaaaagatggttgggtaatagnatnngagaagntgtaatggtgaagagtantagaagatgagaaggatgttgaattgtaaagatgtntaattataaaggnaggaatatgtaagnaantgnagntgggtgnaaantggntgnaagaggtaaagatgaatggaaggattggaaganagtgggaagtagagggagaaaagaagatgggtg

SEQ ID NO: 568423 - DNA, 526 bp, Homo sapiens
gctgcgcctactactactcacctcggaagaacaggctttttcaggtttggttcccctttaagttttaatagaaaaaaaaagttttaagtcaggtggtaccaatatatccccagaaagaatggcaatttaccaaggttttcacgtgtttggagagaaatcttacggaaagactagtgatgtccattttccagtaaatacggagcgaaaaacaatttttataccccaatctgaggtataaactggcttttggggggatcacaacggcggtaaattagacaatggtagcaacaatccaagacaacaacagaatgcctatgacagtcggccatattcgggtgagtgtctatcaaagctcatcatgatttttggtgagatcttcccggtaatgggtagctgggcttccaacaaacaggttccagttctccaatatttcctctttagttagcctctcatcctggttttggtctgattcatataccagatgcctggcctcagcgtgtgcgtgatcataatcttgagggaggat

SEQ ID NO: 568424 - DNA, 123 bp, Homo sapiens
tctctgacctggtcctgtcagccctgtatacgtccgtaagagtagtgaatgccatatcaggatctgtgtgatgtgtcaactctgcagtataatatcctagaggctgctagcgagtcccccaac

SEQ ID NO: 568425 - DNA, 363 bp, Homo sapiens
tgtaatcgggcacgccgacacgtagatttgacagctgctggcatagagcgtgcgtcagggacctgctgactggcgattactacaatgcaaggagagatgcagcatcaagcacttggccgaccccattgacgatcttcttcttgctgcgagtaagatacctggaatctcatcaactggagtcggtgatggaggcaacgagcttgggatgggtaaagtcaaggaggctgtgaggaggcacatacggcacggggatgtcatcgcctgcaacgtgcaggctgactatgacgtcattgctgatgtttctaactggggaggctatgccatggccatgcgcactctacatcctgtactcatgtgctgtcc

SEQ ID NO: 568426 - DNA, 1082 bp, Homo sapiens
  misc_feature (73)..(73): n is a, c, g, or t
  misc_feature (95)..(95): n is a, c, g, or t
  misc_feature (166)..(166): n is a, c, g, or t
  misc_feature (175)..(175): n is a, c, g, or t
  misc_feature (183)..(183): n is a, c, g, or t
  misc_feature (198)..(198): n is a, c, g, or t
gtaagtagctatagcaccgcctacttaattcttttccatatattgtgatacaaacttttgaatatggaatctnactatttgaatagaaatgtgtntgtataatatacatacatacataagcatatatgtgtgtgtgtgtgtgtatatatatatatatgcatgctgngaaacttgnctacacancataaatcacttttnaaattccaggaacggagtagtctgacacggtgattatccttaagaggctgactccgttataaacttgattatatagagtttttactcccagtagcaagggattctaacgttagattgcacttacatgattagttgttataataaaactaacgaataaaggctgcataattcaaagataaataggaatacgctagtaggtgaaataacaaccaaaatactgacactctgatgtacatacaggtatctacaggaacaagatcaggtataatacacaatatggagataacactaaacacagggactacccacgaaaaagtgacctagaaaacaatggtaccaataagatacgggatgctacactacagaaacgctaaagacacataacaaacatacacacactacatcagagtaactaaactacaaaaattaatagatataagataaagacacataagaaatacacagcgaataacaacaaacagcacgagacagaacataacaacgaacactgctcaaggcacatcaacaagagcaataaaacccctagaaccagaaaatacacatgaaacggaatatataaagacaccacacacacaaactaccacacacaaagtagacacacaacaaaagagcagacatagacatccatagaaaccaacagaaaacaacaaacacaagagtctggcatcacaacagcggtaggtaacaagtacactaacacaacaagtgaaaacgaaagcaaatcgatcatcagaattaggacagtactagcaagacaagaagaaacaggaagaaaacaacgaaacacagagtggaggacagcagaacaagacaaaataaaaacaaaaaacacacaaacaacgagtagacaccactaaaaactt

SEQ ID NO: 568427 - DNA, 300 bp, Homo sapiens
tggcacagggaaacacttaaacctttcgggggaaggtcggtaaactcccggggggtcccttcccgaggatgcctactggttttccaaagcccccgtgagtggtgtttggtttggttttttctggaaagggagtttcactctggtggcccaggcgggagtgcaagggtgcgatctcgtctcccgtgttacctctgcctccggggttcaagcgattctcctgcctcagcctcttgaatagctgaaattataggcttgcgccaccaggcccagctaatttggtatttttagtagagagggggt

SEQ ID NO: 568428 - DNA, 300 bp, Homo sapiens
cctactggagaccgaccctcgtttacggagtggcagcgcggttcctctgagtgcgaacgtctccccttctcctgcttctccagccccttcggactcctcgcccgccgcgggaacccgagaccccagggtacgccccacccctgaccccgctcgcgacatgtacaccccggctcggcggcgcctcatgcgggactccaagaggttgcaggaggatcctccagccggagtcagcgacgctccgcccgagaacaacataaaggtgcggaacgcggccattttcggacctgaagggaccccggg

SEQ ID NO: 568429 - DNA, 155 bp, Homo sapiens
tgcagctacttgtgatatgtgagtcacgttgccacaaaagcaaaagtctcgttggccttgaggatgacgcggtcgacctacagagcccgcaggcgcgtacaggattttggggtagctggtcatgacggtgcacaacggaggctcacatgtgctgt

SEQ ID NO: 568430 - DNA, 1973 bp, Homo sapiens
ggaagtcattcctagcagaggactcagatatatataggattgaagatctctcagttaagtctacatgaaaaggatggtttcttggagcttccacaaacttaaaaccatgaaacatctattattgctactattgtgtgtttttctagttaagtcccaaggtgtcaacgacaatgaggagggtttcttcagtgcccgtggtcatcgaccccttgacaagaagagagaagaggctcccagcctgaggcctgccccaccgcccatcagtggaggtggctatcgggctcgtccagccaaagcagctgccactcaaaagaaagtagaaagaaaagcccctgatgctggaggctgtcttcacgctgacccagacctgggggtgttgtgtcctacaggatgtcagttgcaagaggctttgctacaacaggaaaggccaatcagaaatagtgttgatgagttaaataacaatgtggaagctgtttcccagacctcctcttcttcctttcagtacatgtatttgctgaaagacctgtggcaaaagaggcagaagcaagtaaaagataatgaaaatgtagtcaatgagtactcctcagaactggaaaagcaccaattatatatagatgagactgtgaatagcaatatcccaactaaccttcgtgtgcttcgttcaatcctggaaaacctgagaagcaaaatacaaaagttagaatctgatgtctcagctcaaatggaatattgtcgcaccccatgcactgtcagttgcaatattcctgtggtgtctggcaaagaatgtgaggaaattatcaggaaaggaggtgaaacatctgaaatgtatctcattcaacctgacagttctgtcaaaccgtatagagtatactgtgacatgaatacagaaaatggaggatggacagtgattcagaaccgtcaagacggtagtgttgactttggcaggaaatgggatccatataaacagggatttggaaatgttgcaaccaacacagatgggaagaattactgtggcctaccaggtgaatattggcttggaaatgataaaattagccagcttaccaggatgggacccacagaacttttgatagaaatggaggactggaaaggagacaaagtaaaggctcactatggaggattcactgtacagaatgaagccaacaaataccagatctcagtgaacaaatacagaggaacagccggtaatgccctcatggatggagcatctcagctgatgggagaaaacaggaccatgaccattcacaacggcatgttcttcagcacgtatgacagagacaatgacggctcagtgttctaaagaagacggtggtggatggtggtataatagatgtcatgcagccaatccaaacggcagatactactggggtggacagtacacctgggacatggcaaagcatggcacagatgatggtgtagtatggatgaattggaaggggtcatggtactcaatgaggggtcatggtactcaatgaggaagatgagtatgaagatcaggcccttcttcccacagcaatagtccccaatacgtagatttttgctcttctgtatgtgacaacatttttgtacattatgttattggaattttctttcatacattatattcctctaaaactctcaagcagacgtgagtgtgactttttgaaaaaagtataggataaattacattaaaatagcacatgattttcttttgttttcttcatttctcttgctcaccaagaagtaacaaaagtatagttttgacagagttggtgttcataatttcagttctagttgattgcgagaattttcaaataaggaagaggggtcttttatccttgtcgtaggaaaaccatgacggaaaggaaaaactgatgtttaaaagtccacttttaaaactatatttatttatgtaggatctgtcaaagaaaacttccaaaaagatttattaattaaaccagactctgttgcaataa

SEQ ID NO: 568431 - DNA, 1593 bp, Homo sapiens
ggaagtcattcctagcagaggactcagatatatataggattgaagatctctcagttaagtctacatgaaaaggatggtttcttggagcttccacaaacttaaaaccatgaaacatctattattgctactattgtgtgtttttctagttaagtcccaaggtgtcaacgacaatgaggagggtttcttcagtgcccgtggtcatcgaccccttgacaagaagagagaagaggctcccagcctgaggcctgccccaccgcccatcagtggaggtggctatcgggctcgtccagccaaagcagctgccactcaaaagaaagtagaaagaaaagcccctgatgctggaggctgtcttcacgctgacccagacctgggggtgttgtgtcctacaggatgtcagttgcaagaggctttgctacaacaggaaaggccaatcagaaatagtgttgatgagttaaataacaatgtggaagctgtttcccagacctcctcttcttcctttcagtacatgtatttgctgaaagacctgtggcaaaagaggcagaagcaagtaaaagataatgaaaatgtagtcaatgagtactcctcagaactggaaaagcaccaattatatatagatgagactgtgaatagcaatatcccaactaaccttcgtgtgcttcgttcaatcctggaaaacctgagaagcaaaatacaaaagttagaatctgatgtctcagctcaaatggaatattgtcgcaccccatgcactgtcagttgcaatattcctgtggtgtctggcaaagaatgtgaggaaattatcaggaaaggaggtgaaacatctgaaatgtatctcattcaacctgacagttctgtcaaaccgtatagagtatactgtgacatgaatacagaaaatggaggatggacagtgattcagaaccgtcaagacggtagtgttgactttggcaggaaatgggatccatataaacagggatttggaaatgttgcaaccaacacagatgggaagaattactgtggcctaccaggtgaatattggcttggaaatgataaaattagccagcttaccaggatgggacccacagaacttttgatagaaatggaggactggaaaggagacaaagtaaaggctcactatggaggattcactgtacagaatgaagccaacaaataccagatctcagtgaacaaatacagaggaacagccggtaatgccctcatggatggagcatctcagctgatgggagaaaacaggaccatgaccattcacaacggcatgttcttcagcacgtatgacagagacaatgacggctggttaacatcagatcccagaaaacagtgttctaaagaagacggtggtggatggtggtataatagatgtcatgcagccaatccaaacggcagatactactggggtggacagtacacctgggacatggcaaagcatggcacagatgatggtgtagtatggatgaattggaacaggatatccaataacctcagggaggggccccggcccccaattgccctatatggggccgttaacaatccctggccggtgttttcaaccttctgcctggggaaaccctgggtttcccc

SEQ ID NO: 568432 - DNA, 1940 bp, Homo sapiens
  misc_feature (1273)..(1273): n is a, c, g, or t
ggaagtcattcctagcagaggactcagatatatataggattgaagatctctcagttaagtctacatgaaaaggatggtttcttggagcttccacaaacttaaaaccatgaaacatctattattgctactattgtgtgtttttctagttaagtcccaaggtgtcaacgacaatgaggagggtttcttcagtgcccgtggtcatcgaccccttgacaagaagagagaagaggctcccagcctgaggcctgccccaccgcccatcagtggaggtggctatcgggctcgtccagccaaagcagctgccactcaaaagaaagtagaaagaaaagcccctgatgctggaggctgtcttcacgctgacccagacctgggggtgttgtgtcctacaggatgtcagttgcaagaggctttgctacaacaggaaaggccaatcagaaatagtgttgatgagttaaataacaatgtggaagctgtttcccagacctcctcttcttcctttcagtacatgtatttgctgaaagacctgtggcaaaagaggcagaagcaagtaaaagataatgaaaatgtagtcaatgagtactcctcagaactggaaaagcaccaattatatatagatgagactgtgaatagcaatatcccaactaaccttcgtgtgcttcgttcaatcctggaaaacctgagaagcaaaatacaaaagttagaatctgatgtctcagctcaaatggaatattgtcgcaccccatgcactgtcagttgcaatattcctgtggtgtctggcaaagaatgtgaggaaattatcaggaaaggaggtgaaacatctgaaatgtatctcattcaacctgacagttctgtcaaaccgtatagagtatactgtgacatgaatacagaaaatggaggatggacagtgattcagaaccgtcaagacggtagtgttgactttggcaggaaatgggatccatataaacagggatttggaaatgttgcaaccaacacagatgggaagaattactgtggcctaccaggtgaatattggcttggaaatgataaaattagccagcttaccaggatgggacccacagaacttttgatagaaatggaggactggaaaggagacaaagtaaaggctcactatggaggattcactgtacagaatgaagccaacaaataccagatctcagtgaacaaatacagaggaacagccggtaatgccctcatggatggagcatctcagctgatgggagacaatgacggttgggtaacatcagatccatanacagtgttctaaagaagacggtggtggatggtggtataatagatgtcatgcagccaatccaaacggcagatactactggggtggacagtacacctgggacatggcaaagcatggcacagatgatggtgtagtatggatgaattggaaggggtcatggtactcaatgaggggtcatggtactcaatgaggaagatgagtatgaagatcaggcccttcttcccacagcaatagtccccaatacgtagatttttgctcttctgtatgtgacaacatttttgtacattatgttattggaattttctttcatacattatattcctctaaaactctcaagcagacgtgagtgtgactttttgaaaaaagtataggataaattacattaaaatagcacatgattttcttttgttttcttcatttctcttgctcaccaagaagtaacaaaagtatagttttgacagagttggtgttcataatttcagttctagttgattgcgagaattttcaaataaggaagaggggtcttttatccttgtcgtaggaaaaccatgacggaaaggaaaaactgatgtttaaaagtccacttttaaaactatatttatttatgtaggatctgtcaaagaaaacttccaaaaagatttattaattaaaccagactctgttgcaataa

SEQ ID NO: 568433 - DNA, 190 bp, Homo sapiens
cacaggacaagctgtaatacacctacttgggcggaatgatacgtaggtcaggagatcgagaccatcctggctaacaaggtgaaaccccgtctctactaaaaatacggaagattagccgggcgcggtggcgggcgcctgtagtcccagctactcaggaggctgaggcaggagaatggcgtgaacccgggaa

SEQ ID NO: 568434 - DNA, 163 bp, Homo sapiens
gaaggtgaagaaacttttgaagctgcaatgttgggcaggcagaagaagtggtcaggagaaaatttgtgatgatgagctgatcttaatcaaaatcctaaggctcgtacgtctcaatcgttatcttacgtgggcaaatgtttcatgtgtatgagatggcgcctct

SEQ ID NO: 568435 - DNA, 1890 bp, Homo sapiens
ggaagtcattcctagcagaggactcagatatatataggattgaagatctctcagttaagtctacatgaaaaggatggtttcttggagcttccacaaacttaaaaccatgaaacatctattattgctactattgtgtgtttttctagttaagtcccaaggtgtcaacgacaatgaggagggtttcttcagtgcccgtggtcatcgaccccttgacaagaagagagaagaggctcccagcctgaggcctgccccaccgcccatcagtggaggtggctatcgggctcgtccagccaaagcagctgccactcaaaagaaagtagaaagaaaagcccctgatgctggaggctgtcttcacgctgacccagacctgggggtgttgtgtcctacaggatgtcagttgcaagaggctttgctacaacaggaaaggccaatcagaaatagtgttgatgagttaaataacaatgtggaagctgtttcccagacctcctcttcttcctttcagtacatgtatttgctgaaagacctgtggcaaaagaggcagaagcaagtaaaagataatgaaaatgtagtcaatgagtactcctcagaactggaaaagcaccaattatatatagatgagactgtgaatagcaatatcccaactaaccttcgtgtgcttcgttcaatcctggaaaacctgagaagcaaaatacaaaagttagaatctgatgtctcagctcaaatggaatattgtcgcaccccatgcactgtcagttgcaatattcctgtggtgtctggcaaagaatgtgaggaaattatcaggaaaggaggtgaaacatctgaaatgtatctcattcaacctgacagttctgtcaaaccgtatagagtatactgtgacatgaatacagaaaatggaggatggacagtgattcagaaccgtcaagacggtagtgttgactttggcaggaaatgggatccatataaacagggatttggaaatgttgcaaccaacacagatgggaagaattactgtggcctaccaggtgaatattggcttggaaatgataaaattagccagcttaccaggatgggacccacagaacttttgatagaaatggaggactggaaaggagacaaagtaaaggctcactatggaggattcactgtacagaatgaagccaacaaataccagatctcagtgaacaaatacagaggaacagccggtaatgccctcatggatggagcatctcagctgatgggagaaaacaggaccatgaccattcacaacggcatgttcttcagcacgtatgacagagacaatgacggctcagtgttctaaagaagacggtggtggatggtggtataatagatgtcatgcagccaatccaaacggcagatactactggggtggacagtacacctgggacatggcaaagcatggcacagatgatggtgtagtatggatgaattggaaggggtcatggtactcaatgatgctcttctgtatgtgacaacatttttgtacattatgttattggaattttctttcatacattatattcctctaaaactctcaagcagacgtgagtgtgactttttgaaaaaagtataggataaattacattaaaatagcacatgattttcttttgttttcttcatttctcttgctcaccaagaagtaacaaaagtatagttttgacagagttggtgttcataatttcagttctagttgattgcgagaattttcaaataaggaagaggggtcttttatccttgtcgtaggaaaaccatgacggaaaggaaaaactgatgtttaaaagtccacttttaaaactatatttatttatgtaggatctgtcaaagaaaacttccaaaaagatttattaattaaaccagactctgttgcaataa

SEQ ID NO: 568436 - DNA, 262 bp, Homo sapiens
ttcttctgccagtcggaagtgtggagccctgagcttaccatagatgaggggtttatctggcgggatagataccctggggcttgttaatcatacttaactttaccatatataatctcatgaccgggttacaatatattatcttgttgctaataagaatttagaagcggggtgtaatccacgttttatctcagtgagcctccccctcgtactcagacccatgagggctttcggtgtatgtcgaagtcttggctggaccttttgc

SEQ ID NO: 568437 - DNA, 251 bp, Homo sapiens
acacacacacacacacacacacacacacacacacactacctatgagagttgtattaacgcagcaggctataaccaggtaattaattgtattgccactaatagagcttgattgagttgattatctttcaaatggcctctcggtttcataatggagacagaacagcgtagcccagactggagacagaacagcgtagcccagactggagacagaacagcgtagcccagactggagacagaacagcggtcgacgc

SEQ ID NO: 568438 - DNA, 2172 bp, Homo sapiens
  misc_feature (1981)..(1981): n is a, c, g, or t
  misc_feature (1987)..(1987): n is a, c, g, or t
ggaagtcattcctagcagaggactcagatatatataggattgaagatctctcagttaagtctacatgaaaaggatggtttcttggagcttccacaaacttaaaaccatgaaacatctattattgctactattgtgtgtttttctagttaagtcccaaggtgtcaacgacaatgaggagggtttcttcagtgcccgtggtcatcgaccccttgacaagaagagagaagaggctcccagcctgaggcctgccccaccgcccatcagtggaggtggctatcgggctcgtccagccaaagcagctgccactcaaaagaaagtagaaagaaaagcccctgatgctggaggctgtcttcacgctgacccagacctgggggtgttgtgtcctacaggatgtcagttgcaagaggctttgctacaacaggaaaggccaatcagaaatagtgttgatgagttaaataacaatgtggaagctgtttcccagacctcctcttcttcctttcagtacatgtatttgctgaaagacctgtggcaaaagaggcagaagcaagtaaaagataatgaaaatgtagtcaatgagtactcctcagaactggaaaagcaccaattatatatagatgagactgtgaatagcaatatcccaactaaccttcgtgtgcttcgttcaatcctggaaaacctgagaagcaaaatacaaaagttagaatctgatgtctcagctcaaatggaatattgtcgcaccccatgcactgtcagttgcaatattcctgtggtgtctggcaaagaatgtgaggaaattatcaggaaaggaggtgaaacatctgaaatgtatctcattcaacctgacagttctgtcaaaccgtatagagtatactgtgacatgaatacagaaaatggaggatggacagtgattcagaaccgtcaagacggtagtgttgactttggcaggaaatgggatccatataaacagggatttggaaatgttgcaaccaacacagatgggaagaattactgtggcctaccaggtgaatattggcttggaaatgataaaattagccagcttaccaggatgggacccacagaacttttgatagaaatggaggactggaaaggagacaaagtaaaggctcactatggaggattcactgtacagaatgaagccaacaaataccagatctcagtgaacaaatacagaggaacagccggtaatgccctcatggatggagcatctcagctgatgggagaaaacaggaccatgaccattcacaacggcatgttcttcagcacgtatgacagagacaatgacggctcagtgttctaaagaagacggtggtggatggtggtataatagatgtcatgcagccaatccaaacggcagatactactggggtggacagtacacctgggacatggcaaagcatggcacagatgatggtgtagtatggatgaattggaaggggtcatggtactcaatgaggggtcatggtactcaatgaggaagatgagtatgaagatcaggcccttcttcccacagcaatagtccccaatacgtagatttttgctcttctgtatgtgacaacatttttgtacattatgttattggaattttctttcatacattatattcctctaaaactctcaagcagacgtgagtgtgactttttgaaaaaagtataggataaattacattaaaatagcacatgattttcttttgttttcttcatttctcttgctcaccaagaagtaacaaaagtatagttttgacagagttggtgttcataatttcagttctagttgattgcgagaattttcaaataaggaagaggggtcttttatccttgtcgtaggaaaaccatgacggaaaggaaaaactgatgtttaaaagtccacttttaaaactatatttatttatgtaggatctgtcaaagaaaacttccaaaaagatttattaattaaaccagactctgttgcaataaaaaaaaanaaaaanaaaaaaaaaaagaaaaaaaaaaaatttgtgggggggccttgggcccttgaaaaaggttttttaaacacccattcggtttggggggggggccccaataggtttgtgcaccgtggcacaaacggggcccaaggaaaacccggggccagaacaaaggggggggattccccccaataaaaaagcccggg

SEQ ID NO: 568439 - DNA, 1840 bp, Homo sapiens
ggaagtcattcctagcagaggactcagatatatataggattgaagatctctcagttaagtctacatgaaaaggatggtttcttggagcttccacaaacttaaaaccatgaaacatctattattgctactattgtgtgtttttctagttaagtcccaaggtgtcaacgacaatgaggagggtttcttcagtgcccgtggtcatcgaccccttgacaagaagagagaagaggctcccagcctgaggcctgccccaccgcccatcagtggaggtggctatcgggctcgtccagccaaagcagctgccactcaaaagaaagtagaaagaaaagcccctgatgctggaggctgtcttcacgctgacccagacctgggggtgttgtgtcctacaggatgtcagttgcaagaggctttgctacaacaggaaaggccaatcagaaatagtgttgatgagttaaataacaatgtggaagctgtttcccagacctcctcttcttcctttcagtacatgtatttgctgaaagacctgtggcaaaagaggcagaagcaagtaaaagataatgaaaatgtagtcaatgagtactcctcagaactggaaaagcaccaattatatatagatgagactgtgaatagcaatatcccaactaaccttcgtgtgcttcgttcaatcctggaaaacctgagaagcaaaatacaaaagttagaatctgatgtctcagctcaaatggaatattgtcgcaccccatgcactgtcagttgcaatattcctgtggtgtctggcaaagaatgtgaggaaattatcaggaaaggaggtgaaacatctgaaatgtatctcattcaacctgacagttctgtcaaaccgtatagagtatactgtgacatgaatacagaaaatggaggatggacagtgattcagaaccgtcaagacggtagtgttgactttggcaggaaatgggatccatataaacagggatttggaaatgttgcaaccaacacagatgggaagaattactgtggcctaccaggtgaatattggcttggaaatgataaaattagccagcttaccaggatgggacccacagaacttttgatagaaatggaggactggaaaggagacaaagtaaaggctcactatggaggattcactgtacagaatgaagccaacaaataccagatccagtgttctaaagaagacggtggtggatggtggtataatagatgtcatgcagccaatccaaacggcagatactactggggtggacagtacacctgggacatggcaaagcatggcacagatgatggtgtagtatggatgaattggaaggggtcatggtactcaatgaggggtcatggtactcaatgaggaagatgagtatgaagatcaggcccttcttcccacagcaatagtccccaatacgtagatttttgctcttctgtatgtgacaacatttttgtacattatgttattggaattttctttcatacattatattcctctaaaactctcaagcagacgtgagtgtgactttttgaaaaaagtataggataaattacattaaaatagcacatgattttcttttgttttcttcatttctcttgctcaccaagaagtaacaaaagtatagttttgacagagttggtgttcataatttcagttctagttgattgcgagaattttcaaataaggaagaggggtcttttatccttgtcgtaggaaaaccatgacggaaaggaaaaactgatgtttaaaagtccacttttaaaactatatttatttatgtaggatctgtcaaagaaaacttccaaaaagatttattaattaaaccagactctgttgcaataa

SEQ ID NO: 568440 - DNA, 173 bp, Homo sapiens
gaggatcccctactttttcacaggtggaatgctttcatcttttccttgttcagtataaagttgggctgtgggtttgtccaaagtggcgttttaattaacttaagttatgtaccttctatgccagttttgcgtgaaagttttcatcacaaagttatagctggatttatgtcaca

SEQ ID NO: 568441 - DNA, 2279 bp, Homo sapiens
ggaagtcattcctagcagaggactcagatatatataggattgaagatctctcagttaagtctacatgaaaaggatggtttcttggagcttccacaaacttaaaaccatgaaacatctattattgctactattgtgtgtttttctagttaagtcccaaggtgtcaacgacaatgaggagggtttcttcagtgcccgtggtcatcgaccccttgacaagaagagagaagaggctcccagcctgaggcctgccccaccgcccatcagtggaggtggctatcgggctcgtccagccaaagcagctgccactcaaaagaaagtagaaagaaaagcccctgatgctggaggctgtcttcacgctgacccagacctgggggtgttgtgtcctacaggatgtcagttgcaagaggctttgctacaacaggaaaggccaatcagaaatagtgttgatgagttaaataacaatgtggaagctgtttcccagacctcctcttcttcctttcagtacatgtatttgctgaaagacctgtggcaaaagaggcagaagcaagtaaaagataatgaaaatgtagtcaatgagtactcctcagaactggaaaagcaccaattatatatagatgagactgtgaatagcaatatcccaactaaccttcgtgtgcttcgttcaatcctggaaaacctgagaagcaaaatacaaaagttagaatctgatgtctcagctcaaatggaatattgtcgcaccccatgcactgtcagttgcaatattcctgtggtgtctggcaaagaatgtgaggaaattatcaggaaaggaggtgaaacatctgaaatgtatctcattcaacctgacagttctgtcaaaccgtatagagtatactgtgacatgaatacagaaaatggaggatggacagtgattcagaaccgtcaagacggtagtgttgactttggcaggaaatgggatccatataaacagggatttggaaatgttgcaaccaacacagatgggaagaattactgtggcctaccaggtgaatattggcttggaaatgataaaattagccagcttaccaggatgggacccacagaacttttgatagaaatggaggactggaaaggagacaaagtaaaggctcactatggaggattcactgtacagaatgaagccaacaaataccagatctcagtgaacaaatacagaggaacagccggtaatgccctcatggatggagcatctcagctgatgggagaaaacaggaccatgaccattcacaacggcatgttcttcagcacgtatgacagagacaatgacggctcagtgttctaaagaagacggtggtggatggtggtataatagatgtcatgcagccaatccaaacggcagatactactggggtggacagtacacctgggacatggcaaagcatggcacagatgatggtgtagtatggatgaattggaaggggtcatggtactcaatgagaagatgagtatgaagatcaggcccttcttcccacagcaatagtccccaatacgtagatttttgctcttctgtatgtgacaacatttttgtacattatgttattggaattttctttcatacattatattcctctaaaactctcaagcagacgtgagtgtgactttttgaaaaaagtataggataaattacattaaaatagcacatgattttcttttgttttcttcatttctcttgctcaccaagaagtcgagaattttcaaataaggaagaggggtcttttatccttgtcgtaggaaaaccatgacggaaaggaaaaactgatgtttaaaagtccacttttaaaactatatttatttatgtaggatctgtcaaagaaaacttccaaaaagatttattaattaaaccagactctgttgcaataagttaatgttttcttgttttgtaatccacacattcaatgagttaggctttgcacttgtaaggaaggagaagcgttcacaacctcaaatagctaataaaccggtcttgaatatttgaagatttaaaatctgactctaggacgggcacggtggctcacgactataatcccaacactttgggaggccgaggcgggcggtcacaaggtcaggagttcaagaccagcctgaccaatatggtgaaaccccatctctactaaaaatacaaaaattagccaggcgtggtggcaggtgcctgtagtcccagctacctgtgaggtggagattgcattgagccaagatctcaacactgcactccagcctgggcaacagcgtgagactccaccttc

SEQ ID NO: 568442 - DNA, 1351 bp, Homo sapiens
  misc_feature (636)..(637): n is a, c, g, or t
ggtgacaggagccccatggcgacctgcccagccccacctcagcccatcttgacgagaatctaatggctccatgtcagccaccacggtggccccctcatgtcaattagtgggccgagccatcactctgggcagtgggcaactcgtctaaagttatagcctgctcgcaagcaagcgaacgcacggtggtgactgtacgggatggcatgagtgtctactgacgtctctagacaaggccctgaaggtgcggtgtctaaatcaggactggtgtgtggtctaccgactcatcaagggacgaatagacggttcactagcgtgtggatcatcagtccattgctccgcctggatggcgaggagctcattgtcgaggtccttgaagatgtcccgctgaccatgcacaattttgtacggaagaccttcttcgagcgctgggcgttctgttgcacgttctgccttaaggtttcatgtatccagtggcgttccgttgccaaacctgtggctacaagttccatcgcatgcattgttcctccaaggtccccacagtctgtgttgacatgagtaccaaccgccaacagttctaccacagtgtccaggatttgtccggaggctccagacagcatgaggctccctcgaaccgcnnccctgaatgagttgctaaccccccaggtcccgagcccgcgagccagttactgtgactccgtgatcacttccccttccctgcacccagtctccagatgccccacctacagtgtcactccgttccgatggtgccactctccaagcgtccatatgggtcagcatccacggcccccatggactccaacctcatccagactcactggccagagtttcagcactgatgctgccggtagtacaggaggtagtgatggaaccccccgggggagcccaagcccagtcagcgtgtcctcggggaggaagtccccagcattccaagttcaccagcagagcagcgaacgagccggaagtccttggcgatgacaagaagaccgtgaagaacctggggtacccgggtactcaggctattactgggaggtaccaccttcagatgaggtgcagctgctgaataggatcgggacgggctcgtagggaccgtgtttcgagggcgagtggcatggcagagtgtggccgtgaaacgttgctcaaggttgtccccagccccacaagttgagccaggcccaggctttcaagaatgagatgccaggtgctcaggaaagacgcgacatgtcaacatcttgcgtgtaatgcgcttcatgaccggggcctggatttgccatgcatcacacattgcggttgagggctcaaggcctctagcaatcacctgcatgttggccac

SEQ ID NO: 568443 - DNA, 2346 bp, Homo sapiens
  misc_feature (1627)..(1627): n is a, c, g, or t
  misc_feature (1631)..(1631): n is a, c, g, or t
  misc_feature (1633)..(1633): n is a, c, g, or t
  misc_feature (1635)..(1635): n is a, c, g, or t
  misc_feature (1637)..(1637): n is a, c, g, or t
  misc_feature (1639)..(1639): n is a, c, g, or t
  misc_feature (1656)..(1656): n is a, c, g, or t
  misc_feature (1660)..(1660): n is a, c, g, or t
  misc_feature (1665)..(1665): n is a, c, g, or t
  misc_feature (1674)..(1674): n is a, c, g, or t
  misc_feature (1676)..(1680): n is a, c, g, or t
  misc_feature (1682)..(1682): n is a, c, g, or t
  misc_feature (1685)..(1685): n is a, c, g, or t
  misc_feature (1689)..(1689): n is a, c, g, or t
  misc_feature (1696)..(1696): n is a, c, g, or t
  misc_feature (1701)..(1701): n is a, c, g, or t
  misc_feature (1712)..(1712): n is a, c, g, or t
  misc_feature (1722)..(1722): n is a, c, g, or t
  misc_feature (1732)..(1732): n is a, c, g, or t
ggaagtcattcctagcagaggactcagatatatataggattgaagatctctcagttaagtctacatgaaaaggatggtttcttggagcttccacaaacttaaaaccatgaaacatctattattgctactattgtgtgtttttctagttaagtcccaaggtgtcaacgacaatgaggagggtttcttcagtgcccgtggtcatcgaccccttgacaagaagagagaagaggctcccagcctgaggcctgccccaccgcccatcagtggaggtggctatcgggctcgtccagccaaagcagctgccactcaaaagaaagtagaaagaaaagcccctgatgctggaggctgtcttcacgctgacccagacctgggggtgttgtgtcctacaggatgtcagttgcaagaggctttgctacaacaggaaaggccaatcagaaatagtgttgatgagttaaataacaatgtggaagctgtttcccagacctcctcttcttcctttcagtacatgtatttgctgaaagacctgtggcaaaagaggcagaagcaagtaaaagataatgaaaatgtagtcaatgagtactcctcagaactggaaaagcaccaattatatatagatgagactgtgaatagcaatatcccaactaaccttcgtgtgcttcgttcaatcctggaaaacctgagaagcaaaatacaaaagttagaatctgatgtctcagctcaaatggaatattgtcgcaccccatgcactgtcagttgcaatattcctgtggtgtctggcaaagaatgtgaggaaattatcaggaaaggaggtgaaacatctgaaatgtatctcattcaacctgacagttctgtcaaaccgtatagagtatactgtgacatgaatacagaaaatggaggatggacagtgattcagaaccgtcaagacggtagtgttgactttggcaggaaatgggatccatataaacagggatttggaaatgttgcaaccaacacagatgggaagaattactgtggcctaccaggtgaatattggcttggaaatgataaaattagccagcttaccaggatgggacccacagaacttttgatagaaatggaggactggaaaggagacaaagtaaaggctcactatggaggattcactgtacagaatgaagccaacaaataccagatctcagtgaacaaatacagaggaacagccggtaatgccctcatggatggagcatctcagctgatgggagaaaacaggaccatgaccattcacaacggcatgttcttcagcacgtatgacagagacaatgacggctcagtgttctaaagaagacggtggtggatggtggtataatagatgtcatgcagccaatccaaacggcagatactactggggtggacagtacacctgggacatggcaaagcatggcacagatgatggtgtagtatggatgaattggaaggggtcatggtactcaatgagaagatgagtatgaagatcaggcccttcttcccacagcaatagtccccaatacgtagatttttgctcttctgtatgtgacaacatttttgtacattatgttattggaattttctttcatacattatattcctctaaaactctcaagcacccccncccngncntnantgtcccccccccccccncccntcggntcaaccccncnnnnntngcncctnatccccntctgntccccccatcnctcccgcccnccaagaagtnaacaaaagtatagttttgacagagttggtgttcataatttcagttctagttgattgcgagaattttcaaataaggaagaggggtcttttatccttgtcgtaggaaaaccatgacggaaaggaaaaactgatgtttaaaagtccacttttaaaactatatttatttatgtaggatctgtcaaagaaaacttccaaaaagatttattaattaaaccagactctgttgcaataagttaatgttttcttgttttgtaatccacacattcaatgagttaggctttgcacttgtaaggaaggagaagcgttcacaacctcaaatagctaataaaccggtcttgaatatttgaagatttaaaatctgactctaggacgggcacggtggctcacgactataatcccaacactttgggaggccgaggcgggcggtcacaaggtcaggagttcaagaccagcctgaccaatatggtgaaaccccatctctactaaaaatacaaaaattagccaggcgtggtggcaggtgcctgtagtcccagctacctgtgaggtggagattgcattgagccaagatctcaacactgcactccagcctgggcaacagcgtgagactccaccttc

SEQ ID NO: 568444 - DNA, 1711 bp, Homo sapiens
ggaagtcattcctagcagaggactcagatatatataggattgaagatctctcagttaagtctacatgaaaaggatggtttcttggagcttccacaaacttaaaaccatgaaacatctattattgctactattgtgtgtttttctagttaagtcccaaggtgtcaacgacaatgaggagggtttcttcagtgcccgtggtcatcgaccccttgacaagaagagagaagaggctcccagcctgaggcctgccccaccgcccatcagtggaggtggctatcgggctcgtccagccaaagcagctgccactcaaaagaaagtagaaagaaaagcccctgatgctggaggctgtcttcacgctgacccagacctgggggtgttgtgtcctacaggatgtcagttgcaagaggctttgctacaacaggaaaggccaatcagaaatagtgttgatgagttaaataacaatgtggaagctgtttcccagacctcctcttcttcctttcagtacatgtatttgctgaaagacctgtggcaaaagaggcagaagcaagtaaaagataatgaaaatgtagtcaatgagtactcctcagaactggaaaagcaccaattatatatagatgagactgtgaatagcaatatcccaactaaccttcgtgtgcttcgttcaatcctggaaaacctgagaagcaaaatacaaaagttagaatctgatgtctcagctcaaatggaatattgtcgcaccccatgcactgtcagttgcaatattcctgtggtgtctggcaaagaatgtgaggaaattatcaggaaaggaggtgaaacatctgaaatgtatctcattcaacctgacagttctgtcaaaccgtatagagtatactgtgacatgaatacagaaaatggaggatggacagtgattcagaaccgtcaagacggtagtgttgactttggcaggaaatgggatccatataaacagggatttggaaatgttgcaaccaacacagatgggaagaattactgtggcctaccaggtgaatattggcttggaaatgataaaattagccagcttaccaggatgggacccacagaacttttgatagaaatggaggactggaaaggagacaaagtaaaggctcactatggaggattcactgtacagaatgaagccaacaaataccagatctcagtgaacaaatacagaggaacagccggtaatgccctcatggatggagcatctcagctgatgggagaaaacaggaccatgaccattcacaacggcatgttcttcagcacgtatgacagagacaatgacggctcagtgttctaaagaagacggtggtggatggtggtataatagatgtcatgcagccaatccaaacggcagatactactggggtggacagtacacctgggacatggcaaagcatggcacagatgatggtgtagtatggatgaattggaaggggtcatggtactcaatgagaagatgagtatgaagatcaggcccttcttcccacagcaatagtccccaatacgtagatttttgctcttctgtatgtgacaacatttttgtacattatgttattggaattttctttcatacattatattcctctaaaactctcaagcagaactgagtgggacttttttgaaaagtttaggtttactttaagcacatgaatttcttttggttctttaattttctggcttaccagggttc

SEQ ID NO: 568445 - DNA, 205 bp, Homo sapiens
ctatggccctgtattaagggagagattcaggtttctatgactcaaccttgaggaagaggaatcctggtttctatgacttggctttaggggagaaagagggatgggagaaggtaagaaagaccttgtttctgaggccttccagtctttcttcagttccaggtactcagcataggggctgagtgccaaggtaagacttccccctcac

SEQ ID NO: 568446 - DNA, 1601 bp, Homo sapiens
ggaagtcattcctagcagaggactcagatatatataggattgaagatctctcagttaagtctacatgaaaaggatggtttcttggagcttccacaaacttaaaaccatgaaacatctattattgctactattgtgtgtttttctagttaagtcccaaggtgtcaacgacaatgaggagggtttcttcagtgcccgtggtcatcgaccccttgacaagaagagagaagaggctcccagcctgaggcctgccccaccgcccatcagtggaggtggctatcgggctcgtccagccaaagcagctgccactcaaaagaaagtagaaagaaaagcccctgatgctggaggctgtcttcacgctgacccagacctgggggtgttgtgtcctacaggatgtcagttgcaagaggctttgctacaacaggaaaggccaatcagaaatagtgttgatgagttaaataacaatgtggaagctgtttcccagacctcctcttcttcctttcagtacatgtatttgctgaaagacctgtggcaaaagaggcagaagcaagtaaaagataatgaaaatgtagtcaatgagtactcctcagaactggaaaagcaccaattatatatagatgagactgtgaatagcaatatcccaactaaccttcgtgtgcttcgttcaatcctggaaaacctgagaagcaaaatacaaaagttagaatctgatgtctcagctcaaatggaatattgtcgcaccccatgcactgtcagttgcaatattcctgtggtgtctggcaaagaatgtgaggaaattatcaggaaaggaggtgaaacatctgaaatgtatctcattcaacctgacagttctgtcaaaccgtatagagtatactgtgacatgaatacagaaaatggaggatggacagtgattcagaaccgtcaagacggtagtgttgactttggcaggaaatgggatccatataaacagggatttggaaatgttgcaaccaacacagatgggaagaattactgtggcctaccaggtgaatattggcttggaaatgataaaattagccagcttaccaggatgggacccacagaacttttgatagaaatggaggactggaaaggagacaaagtaaaggctcactatggaggattcactgtacagaatgaagccaacaaataccagatctcagtgaacaaatacagaggaacagccggtaatgccctcatggatggagcatctcagctgatgggagaaaacaggaccatgaccattcacaacggcatgttcttcagcacgtatgacagagacaatgacggctcagtgttctaaagaagacggtggtggatggtggtataatagatgtcatgcagccaatccaaacggcagatactactggggtggacagtacacctgggacatggcaaagcatggcacagatgatggtgtagtatggatgaattggaaggggtcatggtactcaatgaaaaaccatgacggaaaggaaaaactgatgtttaaaagtccacttttaaaactatatttatttatgtaggatctgtcaaagaaaacttccaaaaagatttattaattaaaccagactctgttgcaataa

SEQ ID NO: 568447 - DNA, 419 bp, Homo sapiens
tactcgcccactttgtctgggactcatacgctgcacttggtggcttctctgctatctcctcatttcttaaggcaaacctctaaaattatcaaaccatcttttgctggaattaaattctatagctttagatccttcctcttttgctttacagttgtcatacagtgactttgctttttctctaattgtattagcatctacaggtatgcctttttttttttttttttctttttgaaacggattgtcacccttgttcgcacaggctgaattgcagtgccacgattcttgactcattgcaaccttctgcctccgggcctcaggcatttcttctcctcagcctcccaagcagatggaactacgggcgtgcaccaccaaaaccagctaattttggtattctaagtagaggcagatttcaccatatg

SEQ ID NO: 568448 - DNA, 249 bp, Homo sapiens
  misc_feature (7)..(7): n is a, c, g, or t
agttcgnacggagaactctcatttggagtcctttcagatgttcggtttaaggtatccaaaatgcagatgtcaacctatttgtctattttgattagatgtgctctcattgtagtccttttatcctgtataatattttccctttcttccccatcttctatagaccagttttctcaaatttgagtatcattatcatcactttgtctctacaagaattttccctacgatttctgggatattcacttgatattc

SEQ ID NO: 568449 - DNA, 1493 bp, Homo sapiens
ggatgtttgctttctccaccagaagggcacattttcatctaattaggggtatcactgacgctgaagacaaagagaagggggagaaaacctagcagaccaccatgtgctatgggaacgtgtgcacgattgcatcggacacttctctggtgggagctcgccatcctgtgcctcgcggctaaatattttggctgttactttccccaatggggacaccaaagtatgcctccgaaaacaccaacctcaagccggcttcgaggtgaccactatactgggcatcgtaaggacgcttgggccctcgctcgctcgctcctgtgccagcactacagctcctccaatcggcgcactgcaaacacgcgccttgcactcgccctcgacgccacgcctgatcgcccactgacaacaacctgttgcccccacgaccgacatcgctggccagcaaccccccaaccccctcacaccaggtacattacggcgacgctggcatcacacaactcgagcaacaccgcccacgcggaacccctggcaccccaccctagacgctcacacgcgccgcgcccacaccccaagcggcacacctacacccccccaacaggcacccacccatcgctcctcggcacctaacgcccaccgccaccccaacacgacgaccccctacacacctctctgcacacacaccccccgcccgcgcaccaacaacaccccataacctgggactaagccgtccaaccacctgggcccccgaccgcagccccgtggaacccccaaacagccaccacccgcgcggccccccggccacacgctacaacaccggccaagaaccccccacacccgtaaaccacacaaccgggccacacctgcacccccacaccccccggaccaaccacaaaccaccgcgcacacctcacacggtgaacaccgcaccgcaacaccccccaccgccccggaccccacgcgccagcgcacccccaaccaacaccgcccaatcctcacaccgcgcgccaaacaccccacccacacccacacgccccaccacctcagcgccgaacacaaacctacacacaaaaaatccagccggcaacgcctcacacacatccacaacacgaggcccaccaacatctggcgaacacccaccgcgcccacacgcacacacgagcgaccaccccacaacacaaccctccaccaccacaaccgtacaacaggcggaccaccccacacgcacgctgggctgaccaaaaccacaccaacacccagcgccgcacacgcaccgaggcagcgacaccgagagagacaggaccaagaccggctcgtgaatcgcacgagccggaccacacgcactaacacaacgcagagctcagacaccaccacaacgcacttcagccaccgcacacacagacaccaaaagaccttctcctccccctggtcgctaatctaccttctcccgccccccgaccgccccacggaggaacgaaccacgcaaacagacagagagccct

SEQ ID NO: 568450 - DNA, 413 bp, Homo sapiens
gccctaccgtggagagtgcgaaggctgtacaagtctgcagcagtggagatgcaagtttgccctaaaggtctgactaggcgccgggacggtgaaggtagggtgcctgaatgcacctagatggagctggtgaatcgcgctgcaggtgaccctctctatgatccgtcctagataggtaactagcagaggagtggtggccacacatgttagagaagagttccgccgggttacgaaaggtcgagacagagtggacagtaattggatggaacggcaggcatgatagtcctatagcccggactctaagtcgcgggtctctcgagccctaagagcatcgcaggcgtgtgtcagaatagtcgaatcaaggctggggactggacgaagggatgaacgagccagcacgagacgcacagcatggg

SEQ ID NO: 568451 - DNA, 906 bp, Homo sapiens
caatatcgtcggtgtatcggttgatgttttctgtgtccatgttcgtgtgccccttttctctgttcgtctccacggaacgtcctgcgtcgcgccggtgtaacacctaggctcgttcccccgactgctggcttcattttgggacccgccaagtgttggcaacacttagagtttccgtccgctccgaatattcccggttttcgctcacccgcgcgcaaatggaccggcatcacagggtggcatgagatttgctgccctagccaagcgctgttgggctccccccccagaagggacgtggtgtccccccaccccccgggcacggacacccctgcctccacccggacaaggtgttaataacagccagaaccccccaaagcgggcctacattgggccccacgcattggctcccacagtggagggacaatatcctgggagggcatcaatcggtgatccgaggacggggacccccagcggtttttggcgccacgcaaccttccccctggggcaaagtggcccgcagcaaatcacccaacaggctatgcgccccacgaggcttcaaaatgacaaagttttttgcgcccatttttgtcaaaaaaagatcaggccccccctacttccgggatcactccccacgatactctcttccttgcggggggtagcaatactccacaccaccccggtgtgcccaaccccatctgcgtgcccctcgcttgttatttcccacaacgagccttctctgtccaagaggttatgtgtggcaccaaagcgtgatcaagaggtacttgttcgaaacacggcatcctttcctaaagcgcccggtagtccaaaatcgtcgcttggccagcccctttgtttttaaagcgtttgagggccccacaaaaaaaataacggcctcgttctatcataaca

SEQ ID NO: 568452 - DNA, 335 bp, Homo sapiens
  misc_feature (199)..(199): n is a, c, g, or t
  misc_feature (285)..(285): n is a, c, g, or t
tgagtgacttcatttagaataatggcctctggcttcttccaagttgctagtaaaaacatttttacgttgctttctgtgggtgagtaatattccatggtatatatataccacatttcctttatccattcatgggtcgataggcacttagggtggttccatatccttgtaattgtgaattgtgctgctataaacatacctntgcacatgtctttttcatataatgactggataaaagtactttaaaacaactgaatgattccaacattatttccagtggtactggtnaatgcattcaggcaggaaatttttttttactcctgggatttttaatcctg

SEQ ID NO: 568453 - DNA, 1026 bp, Homo sapiens
cagctgtgggcggatcatctgaggtcgggagtttgagaccagcatgaccaagatggacaaaccctgtctttactaaaaatacaaaactagccaggcatggtgctgcatgcctataatcccagctacttgggaggctgaggcaggagaatcgctagaacccaggaggtggaggttgctgtgagccgagatcgcaccattgcactccaggctgggcaacaaagagcaaaactgcaaaaaaaaaaaaaaaaaaattttaaaaaagagaaaggtacattctcaaaaaaaaggaaaggaaaagacaagaaaaaggaaaaaaaaaagaaaacacctttggtctttggtacaggctcaggggggcctcccagggaaaattgtccctttctctttttggtgggaattggcgcacgggggagaccgggtgcattcccgggctcggacactctcgtttattggggacggtaagtctgacctctatgaataatacttcaagccccttgatggctcccggtgccaagctccttgggccaaactttcaccttagctcgggtaaggtctggggcaacgccaaagcacgatctataaatcatccctttcagttcctgatgggtcctgggcaaaaggcgtgggcaaagttgaacccacacagttttcaagacacggctgtaaactagggcaatatcctttccttcccaggtcaataaaaagcgtggacccagcctggtaagagcgacattttcagacccccttttcgtgggggaaagaagtttcgtccttgctttttaaattcacttcaaccttcccttggggtaacccttaattcttagaggctaacaagaactccgggtttctcgacctacacgacggcacctggtggcccgctgacatagaaccggctcttggcgttggcaaaactaccacagtaacatccggccttggagcggtatcaacaaaggtaatatgtgctgtgatacaacaccatatagcagacaccagaggcgggacaccaggagtcggcggtgaaaaagt

SEQ ID NO: 568454 - DNA, 927 bp, Homo sapiens
tccggagagctgggcggtgcggagcgggcccgacaacccttgcccattctccttcgctttcctgagccctaaacacacgctgtgatgggtaactgcctggcacctgttatccctgcagacggcacagagcatccgtctcccctcgttaacacatgggttcctaaaatgcgcctgtaaacgggccttattgacgatgaaatatgtgattgctcataagtgtaacttcctcttaggatgtatcaccaaggcaatatcgagagagaagtcggccaggtaggatgaacacaggcaatgactggcacagaggggattaaaggcaacagagagaagagtccaggaaggcgcgggggagaagccttgggtggctcagcatcctcacaggggcttgcgcagatatggctcggggctgagctgggcgggagcagtatagcggtgtaggggttacaaaatcggagatgaatttcaatatacactaagaacatcaagtcactttgaaaatgtgaacacaaatcaggcggacatctgagtaacattccaggaaagttggttgtagggcaccaacatctgtccaggtcctgggaaacattctggtcaataaccccggtgaacgcaaatcatttcccccatcccggtcattacattcaatccccttgggacacgtgcttgatccgacttcggtgtcatcatgatggtcctaaaactaggggtatacccccgggttttctggggcaccaattcgtcccattatctaactgttcggaccttcacacacgggaaacaaaacaaacaatcacaacacaacactaacaacaacaaccgatcgtgacgcgcgcgcatcagcgtgcacacttcgatacagacgccggtcagaagaaaacaacacgacatgatgggggaccgtctcgtcgccccacatgagacgatact

SEQ ID NO: 568455 - DNA, 416 bp, Homo sapiens
ggaaggcgtaaagccccctggtgctataggagtcgtgacgcatgacctgagttactggctccattggagcctcatcagcgcgccgctgccgctcgagtcgcgtcctgagatccacgtctacctcactacccgcgtgactgtcggcgtcgtgccgtccttgtgactgtccgtaacgcgcacgacggcgtgcactcgggatttcctgagcgcaggctattactccccgtggtcgtatgtgcacggaccgcgtcgagtatcatcgatggcgctataagtgggtccgcgcgtgggcgcgccttcgtcccgtgctctctgctcgggctgctccttcgtcgcctcctcacattggccgtcgtgctagcagcacgtggcgaacgctgtacggtgtacccccacggacgcgttagcggaccccc

SEQ ID NO: 568456 - DNA, 152 bp, Homo sapiens
ccttggtgggagtataggagggatgggtcactaaggaaactggctgttgctctcagaagctcatgtgatggaagctgggcagtcaaacatgccaacagctgtccactctgctggccctagatggcttagttgattgctgatcttgtgcacgg

SEQ ID NO: 568457 - DNA, 126 bp, Homo sapiens
atgtcccaatttcctctgagtagcgtcggatgatcatgtatatagcagtatgctcattcatggtcgaacccatgctacctcaaattacaccttgggaacttcactatctgcgacatggttcctctg

SEQ ID NO: 568458 - DNA, 670 bp, Homo sapiens
taagtaacaccctccacttggtgaaccgggacaatacgaacccgagaccaagagccccaacagccgaaaaagacttagcggtaaggccactaatcagctactgccccgtcaaagacggaaccggaagataccctctctatggacctcatcgacccacgacagaaaaacggagagaaatacgacagaaagcggtcgacccatctaaaaataccagacaaagctccccgcccccgtcgcaaaccgcccagatacgataagagccgcggccatccagtaatcagcgcgcataacgaccggagaaactccctgaagtgatctgaagaatacgaaggtagttacgattataccacccgcacgatctgccggatcgagccagagctcagatcatagaataaaataatgaccgacaagcacgcttaataagaaacaaataaagaaaagacctaccggagggaagcatcagcgaggactaccgtaccagcgaagatctctgtcaaaaacaatccagtacccagaggagaaaaacaaaacgaccggcgaagatagaaacggggaacccccggagccccacccgagaagaacgttgagcccgaagcaccgacgagagagtacactagaaaaaaccgggggaggggaagacaaacctctcccactcaagcttttaaaaccg

SEQ ID NO: 568459 - DNA, 1922 bp, Homo sapiens
ttatttacctttttactttttaaaaaattcttgtgaagttactttgtgagttttccaggatgtgtgtaaactacacacatcagccacctaggtagttttgagttgctttgaagttcagctgttgttgacttcaaaggcagcagcttatgaaagttggagaaatagaacattttccagtccctattcaggggttggtgacctccgtggcccccagcctcgtggctttgggctttggaaggctggtgtctggtctcactgatggctacaggctggactcacccccaccatctctgtcctcaccaaccctgtccccagccccctggctcatccccagtatcctctacaaacctgctcctactcgggtccagggcaggaggctgagcactgtgggccatcctgggagcctcaggctgcacaggttgctgaccttggactgtaagggctgggtacgaaggcagaaggtggggattctcaggcaatgcagcaggcctgcgagagactctggggaggagcaacagggctctctaaattgccacctgcaagtggctgcgtcctcctaccatggggcacccaggacccagctcaggcttgcacctgggttcttccttgttgaacctgtggcaaagcaaggaggagacttggtctactccctcctgggcagcctctgctgactgccctataggtgctgggcactgtgtctgggacacagagactgtgaaaggcctcctctcccacagtggagagctgccagcagcatgaggaggccgggttcatgcagggtccttggcaggcctgagggccagtggggatcctgggggctttctggggtgtaccctcagctctgcatgctttgaaaggcccctttaaagtcaggtcctggtcagatctagaagcgggcaagtctcagctgaggctgaaacctcggcctccctgagccttgtgacttgcccagggtcggaggcccaacgccccctgaggaattctcttcctggtacggcagagaaaggtgggggccagggaatcagggtggggaaatcccagctgcctctccctgcaccctggcccatctcccccaggtcatgagccatcccccttcgactgttttcccaccataagggactatgatttacatctaccaaactctgccaccgacaaggacagtgtgggaagagggtgagccctgagtggagccaggtgagctggattcaaagcccagttccgcagcagagagcctgggagagccatctcttaaccttgggtacaccacaggccctttctgcacccacaggtctgtcttgctcatgagtgggtctcagagtttacaaatatagactgaggatcagagaggctgcatgcgtgcctgaggtcacacagctcagatccccagaaagagagcagaatggcagctcagacattccgagtcagtgcttttaaccatagtgctgcattatataccctcagcaccagccccaggcttccatcctcagtagcctgtctacatttcaagggttagttctccttcccctccatttcaaatgcccccctttcaagttccctcagggaaggccagtggtttttggggtcacctgggccagggttttctgcagctcaacccatcaggggtctaggtgatgactgggatttctagggggaaacaagggaaataaacatggctttttctgccaaaaggctctctcagccgagacttgctggcacggatattgcccctgccctgggctggctggcgtgagttgtctgcgcctccctgaaggcagacttcaggggctagctgtgatgggctagctgcggtgaggagtcccctgagccctgagtcacatcagaagcacattgctccaccccagggctcggccttgcccagggcctcaaaggcaccaaacgtatacacctgagctagaaagtgt

SEQ ID NO: 568460 - DNA, 1002 bp, Homo sapiens
cattcgcgcacgtggcgctgtctttgtgagtcggtcgggcacgtgatgaggtgttttaatgccggggggacacgctctccgtactccacagggtttgtcgccgcgttgtgaaacgaggatcatgggtggacacaatacgtgttcggccagatgtctgtggcccagaatgcgattgctcatatgtcggtggtggggaacgccctatgtagcgtcaacatgttccagatgcgtggaacctgcgtgttcgatgaaagctagcgacacgctgtatcaaatagaggtatttctcattagtgacagctgtcccagcacacgataatgttttgtgcgcgaagtggtcgcgccgccaatgcgtggtgaaatgtggctgcaaggatggctcctaccgctgtctgcgacctctattatggttagtgggccccagccacccgcgggccgctattgtggccacaacaaagggggccccaggtgtgtttgctgtagtaccccgccacaaactaataacggcggaatatattttctgagaagaatacgagaatatggcggtccactatgttattacactatcaacaatgcacgtctgctattacggttgtcccccactgagatgacccctaaataaggaagaagtaacgcgctggttatcataaagtaacgtgaggatatgctatggcctctgttctaaaaggggtgtatctaaatacaccatcattttaaaaccacatctctaatgaggcaactatgtgcaactacaccagtaataatgtagacaccccacaacaaagaggtataatctgctaaaattatttcttcactccacaaataattataggcgtgccacaaccccccggttgaaggaacaatatagtgtccccacacgttctaccagaagagaacaccacctactcctaggtcttcacccacaccgtctagattacttgccaagacgacccccctaccacccctttggtgtcccacgcaacgcgcttttaaaacaaaaca

SEQ ID NO: 568461 - DNA, 126 bp, Homo sapiens
tctagaggatccctatggacgcgcggacgactgggaatgatactgcccttgatgaccctgtacttgagtgccagccaggttttccaccacgatgtcaatgaagcagtgccacgaggccctgtgagg

SEQ ID NO: 568462 - DNA, 1055 bp, Homo sapiens
  misc_feature (648)..(648): n is a, c, g, or t
  misc_feature (873)..(873): n is a, c, g, or t
  misc_feature (911)..(912): n is a, c, g, or t
  misc_feature (952)..(952): n is a, c, g, or t
  misc_feature (1037)..(1038): n is a, c, g, or t
ccgaggcaggtggatcacctgaggtcagagttcgagaccagcctggccaacatgatgaaaccccgtctctactaaaaatacaaaaattagccgggcgtggtggcacgcgcctgtaatcccagttactagggaggctgagacaggagaattgcttgaacccaggaggtggaggttgcagtgagccccagcctgggtgacaatagcgaaactctgtctcaaaaaaaaaaaaaaaaaaaaaaaacctcgtgccgaattcggcacgaggactttggaagtccgtagtgtctcattgcagataatttttagcttagggcctggtggctaggtcggttctctcctttccagtcggagacctctgccgcaaacatgctccgccagatcatcggtcaggccaagaagcatccgagcttgatccccctctttgtatttattggaactggagctactggagcaacactgtatctcttgcgtctggcattgttcaatccagatgtttgttgggacagaaataacccagagccctggaacaaactgggtcccaatgatcaatacaagttctactcagtgaatgtggattacagcaagctgaagaaggaacgtccagatttctaaatgaaatgtttcactataacgctgctttagaatganggtcttccagaagccacatccgcgacaattttccacttaaccaggaaatatttctcctctaaatgcatgaaatcatgttggagatctctattgtaatctctattggagattacaatgattaaatcaataaaaaactgaaacttgaaaaataaaaacaccacgaagggtggccttttggagaacgcaaaaaaacagagggaactgactgggggcatggacctgagnattggcacatagggaaagggagtcttggctattaaaanntggatctgggggggcgccgggcacaaggtttttaataggnaaaaacttttgggcgggcccgattttctcgcccttttggagaaaaccccaatagggggccattccccacccgggcgcgccttttnngggggggggccttggcc

SEQ ID NO: 568463 - DNA, 185 bp, Homo sapiens
aattcttaacacggacattaacaatgcgctgcagtattacacaaaatgatatgcaataagaaatcggaaaaagggagcaaaggagagtgcaacgcatgtactgaggtctttctacgggtgcctgacagaatgcagattcagcataaaactgtagaccttaggcaccagtgtgcctttaaacgtac

SEQ ID NO: 568464 - DNA, 997 bp, Homo sapiens
  misc_feature (590)..(590): n is a, c, g, or t
  misc_feature (815)..(815): n is a, c, g, or t
  misc_feature (853)..(854): n is a, c, g, or t
  misc_feature (894)..(894): n is a, c, g, or t
  misc_feature (979)..(980): n is a, c, g, or t
ccgaggcaggtggatcacctgaggtcagagttcgagaccagcctggccaacatgatgaaaccccgtctctactaaaaatacaaaaattagccgggcgtggtggcacgcgcctgtaatcccagttactagggaggctgagacaggagaattgcttgaacccaggaggtggaggttgcagtgagccccagcctgggtgacaatagcgaaactctgtctcaaaaaaaaaaaaaaaaaaaaaaaacctcgtgccgaattcggcacgaggactttggaagtccgtagtgtctcattgcagataatttttagcttagggcctggtggctaggtcggttctctcctttccagtcggagacctctgccgcaaacatgctccgccagatcatcggtcaggccaagaagcatccgagcttgatccccctctttgtatttattggaactggagctactggagcaacactgtatctcttgcgtctggcattgttcaatccagatgtttgttggactcagtgaatgtggattacagcaagctgaagaaggaacgtccagatttctaaatgaaatgtttcactataacgctgctttagaatganggtcttccagaagccacatccgcgacaattttccacttaaccaggaaatatttctcctctaaatgcatgaaatcatgttggagatctctattgtaatctctattggagattacaatgattaaatcaataaaaaactgaaacttgaaaaataaaaacaccacgaagggtggccttttggagaacgcaaaaaaacagagggaactgactgggggcatggacctgagnattggcacatagggaaagggagtcttggctattaaaanntggatctgggggggcgccgggcacaaggtttttaataggnaaaaacttttgggcgggcccgattttctcgcccttttggagaaaaccccaatagggggccattccccacccgggcgcgccttttnngggggggggccttggcc

SEQ ID NO: 568465 - DNA, 340 bp, Homo sapiens
cccgattgacgggcagtgggtaggtggctgtagccctggctgcccctggggcatgccaggctgcccagggatgggttgtggattagagttggcatacttggcagcccgctgcttgatgaagtgcagccaagtagctggagggttggcagtgagaggatactacagcacctggttgctgctgcagggagagagctgggtagacctgagtagtccgcaaaacggttttgtaagggcttgttgagacacatgtgcctggatttgagatgggcgtgataccgtacctaggcccaagtcctgtgttgtggcagccgatgttcaaagggttgaccagtgctcgggc

SEQ ID NO: 568466 - DNA, 236 bp, Homo sapiens
  misc_feature (30)..(31): n is a, c, g, or t
  misc_feature (37)..(37): n is a, c, g, or t
  misc_feature (48)..(49): n is a, c, g, or t
  misc_feature (232)..(232): n is a, c, g, or t
cctgttgtactccaccccggcctactcgtnncatccnttcgcagccgnncgacggacttgacctttttgccgctgtggatctcatgacagcccagacccctgaacactgggtgctccgtggggttgcccttctgtgtgatgtcacgtaacatgtggggagtgttcccacccattgctttggaaaatgctcgatctaaattattgaaaacaaaaaaaacggctgcctgctggnttgt

SEQ ID NO: 568467 - DNA, 168 bp, Homo sapiens
caaccccccccccccaggttttttttttttctttccgggtccattgtacccccggtttttccccggccccgggggggtttgggcgaaaccccccgggattttttccggcccccttttggggtttggggaaaccccccccccccttttaaattttttttttggtgggga

SEQ ID NO: 568468 - DNA, 1124 bp, Homo sapiens
gggaatcaccatggctggctgggaccctgtacacgtatcctcaaaactgtgagggccttcaaggctctcatcgctgctcatgtacatgcggggctcaggtcctgcgtgctctccgacacgcatcacccaacttccagtattagggccaaattccagaccgaagcccctagaatattctccgcagaatttcactagcctggcaatggtcccgagcattttgacgggtgatgactggattctagtgatgttatgagagcaaacgcacattgccgtactattgtgcagcaaattgacgcgaggcttgcgggcggacacgttaactccccaagcaggggccaaggccaaggggccgccacacaacaggacgcgctttggtggctgtggcccactggatgcacggggtttgaacagcccatttaggccttggaaattttccgcggaatatacagtacagtgggtcccaccacgatagccccaatagtaaccctttggggacgactggattccccgacgtctaagatgcatatgagtgcgcaatatccaaattggcatacacgaagcgaagagaagagaaccacgtgtggccccaaaccattggaaagtcaactttggccacaatgatggcggcaaggcgccacacggcttgtgaacgggtgcccggtaaccacgtttgtcctttggggcggatagcacatctggcccattggcgcacatagttggacccactaatccaacctattgagccacaacagcgacaccgcgaaacgagcgggcacacactgattagtcgacgccactaggcggactcatgggtgactggaccatggaaacatacttccgagcaatggcttatgcgtaaacctatcttcttgtgggggcaccactattcgaacatcccaaattacccgaccgcgatggacatattcggcatccgcattgggagcaagaagccaccaccatctggtatcgtactacggcgatgcaggacccattcctcgttacagatttgcgaacgtctaccatagtgggtacattcttacgctgtataaggcataaggtgactccccatagtgactaccattgatctatgattccagacactggtcacactccaaatacctgac

SEQ ID NO: 568469 - DNA, 1614 bp, Homo sapiens
  misc_feature (431)..(431): n is a, c, g, or t
  misc_feature (831)..(831): n is a, c, g, or t
  misc_feature (1073)..(1073): n is a, c, g, or t
  misc_feature (1113)..(1113): n is a, c, g, or t
ggttgtccacacaagtggtgggcgtgagttgcgatcatgcctctccgtggtggcctgctgagggggacacgcggtggggggtgttgcgtccgacaaccgccgcgcgggatgttgtgggggactcaccaccttgtgggtgcctcagcccggtacatgcttgtttgcccaccggtgagtgtgttgatgttcgttgttgggggagtgcccgtccctgtggagcgcctgttgtggtagtggtgaatgttgttttttcccttgggggggccacccatttgtgtgggggccgttcccagagtggtctcagggaaagtctgtgtttttttgcttcccaagagggagttgtggtgttggttgcgtgggggcgcaatagcgcggtttgtccctttgggggtggatccccacgcccccactaattaggttggaggctcgcncgcgccccatgttgggggatatgccacatggcggtggggcgttgttgtaacactttggtcgttccacagggggtgaagtgtaatttccccccgtggggaccgccacggttcgccaacgggggcccccacattttttgtggccgggcccccgcgctgtaatttgtgcccccccccgggtatgatgttggggcagatttgggcgcacaacacacccggggcgtttctacccacagatggtggccacgttgggcgcaaagtggttttgtgccgtttgaaagctctggaaaagggacaataaagagattttgaagagtctccccccggttttctctgcgggttaaaataagccgctgtgagatagaattgcgcgcccctcttgatagatttctctgtgagacangtctctgtgggtagatatgtcggtcgcccacacttgtgctgtgacatatactggggcttctctctgtgcacacagcgccccacaatgtggtggttttgagagagagcctctgttctcccacggagtgctgaatggcccacccgtctttttggggtgtcgcactcttgtgcctctgttgttgtctgtgagaggttaagtcgagagacctcacagagctcacagttgattggctctgagtgtgngggtgtcgttgtcacttctcacatagagccccacagctgnggggagccccacaggagagaaggcgctcggctctgcgagagctcgcgccacaagggtggcacactccacgtgtctctgtccccgcgagatacagctctcacagagacagcgctgtatatatctgagatatatgttatatccctcttatatacactctggccccccccccactctgtcttcgatatccacgtgtggtgtgcgagaggaaaacggtgtctgtcacgaatactgttgtgggttcacacattggccacatttaaaaggttatagtatgtaaacagagactgggtataatgagtaacccacatgcactcgttaaacccttcacgagaaggaaaaggagaatttttttgtggacccctttggttttcttttttgcgtgtggccagttttaagttattagttttttaaatccgtactttttaatgggaaccaccttgagccccaaaatttgtccccacgaatttgtgagaccccctttaaaaagcttataatgaaaca

SEQ ID NO: 568470 - DNA, 160 bp, Homo sapiens
atacccatctactatctgtcccgttggctatgttacgcccagcattggctggggaaaatattcctagtgaatgctttaagagaagaggcagctggaagcttggcaatattccaatggcatgccctgtgctcccttggaagtggtctgtgtcatcctgccg

SEQ ID NO: 568471 - DNA, 330 bp, Homo sapiens
gtggagatgtggtgagtcagctaaatactttgacgccggtggggatagcgatgatctatggtagcggagagtgaaatatgctcgtgtgtctacgtcatatgcctactgtaaatatataggtgtagctcacacgactaaagcccttaggaagccaatatgatatcatatgcttagaccaatagctatggtatccaagagtggttcttgtattgaccaggagtagataagtgacaagtatgggagattattccgacatcctggtaggataagaatatgagacttcagggagaccgaaaaatcagaataggtgttggtatagactggggtctc

SEQ ID NO: 568472 - DNA, 1529 bp, Homo sapiens
ggaagtcattcctagcagaggactcagatatatataggattgaagatctctcagttaagtctacatgaaaaggatggtttcttggagcttccacaaacttaaaaccatgaaacatctattattgctactattgtgtgtttttctagttaagtcccaaggtgtcaacgacaatgaggagggtttcttcagtgcccgtggtcatcgaccccttgacaagaagagagaagaggctcccagcctgaggcctgccccaccgcccatcagtggaggtggctatcgggctcgtccagccaaagcagctgccactcaaaagaaagtagaaagaaaagcccctgatgctggaggctgtcttcacgctgacccagacctgggggtgttgtgtcctacaggatgtcagttgcaagaggctttgctacaacaggaaaggccaatcagaaatagtgttgatgagttaaataacaatgtggaagctgtttcccagacctcctcttcttcctttcagtacatgtatttgctgaaagacctgtggcaaaagaggcagaagcaagtaaaagataatgaaaatgtagtcaatgagtactcctcagaactggaaaagcaccaattatatatagatgagactgtgaatagcaatatcccaactaaccttcgtgtgcttcgttcaatcctggaaaacctgagaagcaaaatacaaaagttagaatctgatgtctcagctcaaatggaatattgtcgcaccccatgcactgtcagttgcaatattcctgtggtgtctggcaaagaatgtgaggaaattatcaggaaaggaggtgaaacatctgaaatgtatctcattcaacctgacagttctgtcaaaccgtatagagtatactgtgacatgaatacagaaaatggaggatggacagtgattcagaaccgtcaagacggtagtgttgactttggcaggaaatgggatccatataaacagggatttggaaatgttgcaaccaacacagatgggaagaattactgtggcctaccaggtgaatattggcttggaaatgataaaattagccagcttaccaggatgggacccacagaacttttgatagaaatggaggactggaaaggagacaaagtaaaggctcactatggaggattcactgtacagaatgaagccaacaaataccagatctcagtgaacaaatacagaggaacagccggtaatgccctcatggatggagcatctcagctgatgggagaaaacaggaccatgaccattcacaacggcatgttcttcagcacgtatgacagagacaatgacggctcagtgttctaaagaagacggtggtggatggtggtataatagatgtcatgcagccaatccaaacggcagatactactggggtggacagtacacctgggacatggcaaagcatggcacagatgatggtgtagtatggatgaattggaaggggtcatggtactcaatgagtatgaagatcaggccctttctttcccaacaaggccaaattaaggttccccaaatt

SEQ ID NO: 568473 - DNA, 911 bp, Homo sapiens
  misc_feature (668)..(668): n is a, c, g, or t
agcagatcggccaggaaagctcttcatcggtgggcttaatacggaaacgaatgagaaagctgcttgatgcaggtatttggcaaactatggagcgacatagtggaagtactcttggatgaaatgatccgtgaaagcaacaaatcaagaggattatgctttatgtctactctttgaaacgctccagtcgagacagcttaaggactgcatgacccacgaggacatgatatgtgaacaagtcaattaagaatgggaaaaagccggtcaatggctggaacaatgccacctaaaccaatcattcttgaatagatggtagacggtggaccgtcgtcctaccttccaagtaagtagaggccctctcatcgtaaggtgctttcagagggtgagagaaagaaggggagggcaacgctggagcaagtggaaatcgcaagggggtggatctcgtacaccatacgaaccgtgggggaagagtagcaaccaataggaattggacaggggtagtgcaataagttttcgccataggatagtttttgaaaccacttggatgatttcctatacgccacgtggtgcaactccaacattcctctagataaaagaatggagaggagcacaactcggagcactagaagcaaaagttgggtggggttccttcacttccccgtaaaagaagnatgtcgtagtatccctgtcacgaggatccattggtttcagcatagataaggcatggtgggatagggtggggaccgggaagaaggctccttgttaattacaggcagtgctaccagaaagactagtgatttgggaagggattccacaccctcgtaaatgtgggacacccgacatgttacctcttccggtatgaggaattgttttagttctgtctcccgaaagagactgaatagggatgttcgtac

SEQ ID NO: 568474 - DNA, 300 bp, Homo sapiens
  misc_feature (114)..(114): n is a, c, g, or t
cccttttttttttttggggggggggggttttttttccccaaaagggccccccttaaaggggggtttttgaaaaaatttgggggcgcgtttggaaaaaatttttttgggggggtncccccccccccctggaattttttttttgggggttttggggattttttttcccccccccccctttaaagggttccaaagggggtcccgggggttttggggggtgggtttcccccccccccccttttggggggggggggagggttccccccggtttttttttttacggggtttttttttttcccccca

SEQ ID NO: 568475 - DNA, 1592 bp, Homo sapiens
ggaagtcattcctagcagaggactcagatatatataggattgaagatctctcagttaagtctacatgaaaaggatggtttcttggagcttccacaaacttaaaaccatgaaacatctattattgctactattgtgtgtttttctagttaagtcccaaggtgtcaacgacaatgaggagggtttcttcagtgcccgtggtcatcgaccccttgacaagaagagagaagaggctcccagcctgaggcctgccccaccgcccatcagtggaggtggctatcgggctcgtccagccaaagcagctgccactcaaaagaaagtagaaagaaaagcccctgatgctggaggctgtcttcacgctgacccagacctgggggtgttgtgtcctacaggatgtcagttgcaagaggctttgctacaacaggaaaggccaatcagaaatagtgttgatgagttaaataacaatgtggaagctgtttcccagacctcctcttcttcctttcagtacatgtatttgctgaaagacctgtggcaaaagaggcagaagcaagtaaaagataatgaaaatgtagtcaatgagtactcctcagaactggaaaagcaccaattatatatagatgagactgtgaatagcaatatcccaactaaccttcgtgtgcttcgttcaatcctggaaaacctgagaagcaaaatacaaaagttagaatctgatgtctcagctcaaatggaatattgtcgcaccccatgcactgtcagttgcaatattcctgtggtgtctggcaaagaatgtgaggaaattatcaggaaaggaggtgaaacatctgaaatgtatctcattcaacctgacagttctgtcaaaccgtatagagtatactgtgacatgaatacagaaaatggaggatggacagtgattcagaaccgtcaagacggtagtgttgactttggcaggaaatgggatccatataaacagggatttggaaatgttgcaaccaacacagatgggaagaattactgtggcctaccaggtgaatattggcttggaaatgataaaattagccagcttaccaggatgggacccacagaacttttgatagaaatggaggacggtcaagacacacagagcatatttcactcgtccgctaccataatcatcgctatccccacacggcgtcaaagtatttagctgactcgccagactccacgggaagcgatatgaaatgaatctgctgcacgtgctcttgagcccatagcgattcatcttttcttggttgcacccgtaggtggcctgacgtggcgattgtagttagctagaactcagtcgacttagacattctgtacttacatcgacacgtactacgtggtagctcacttccactatgtcctatcgataggagctgtattggccatcataggaggcttgattcactgatttcccctatgtctcaggctagcatcctagagcaaactacgccagaatccatttcgctatcatattcatcggcgtaagatctaagctttcttcccacaaggagttttctcggctatccggaatgccccgacgttactcggactaccccgatgcatacacacatgaa

SEQ ID NO: 568476 - DNA, 128 bp, Homo sapiens
  misc_feature (101)..(101): n is a, c, g, or t
acatttccagcatgctgccgctggtctcgaaaccgccgtagtcggcgaacatgccgtgcagccagtccagcatcggctgcaggggtaccgacgctcgacanttcctaactcatgggtcatatgctggt

SEQ ID NO: 568477 - DNA, 1127 bp, Homo sapiens
ggaagtcattcctagcagaggactcagatatatataggattgaagatctctcagttaagtctacatgaaaaggatggtttcttggagcttccacaaacttaaaaccatgaaacatctattattgctactattgtgtgtttttctagttaagtcccaaggtgtcaacgacaatgaggagggtttcttcagtgcccgtggtcatcgaccccttgacaagaagagagaagaggctcccagcctgaggcctgccccaccgcccatcagtggaggtggctatcgggctcgtccagccaaagcagctgccactcaaaagaaagtagaaagaaaagcccctgatgctggaggctgtcttcacgctgacccagacctgggggtgttgtgtcctacaggatgtcagttgcaagaggctttgctacaacaggaaaggccaatcagaaatagtgttgatgagttaaataacaatgtggaagctgtttcccagacctcctcttcttcctttcagtacatgtatttgctgaaagacctgtggcaaaagaggcagaagcaagtaaaagataatgaaaatgtagtcaatgagtactcctcagaactggaaaagcaccaattatatatagatgagactgtgaatagcaatatcccaactaaccttcgtgtgcttcgttcaatcctggaaaacctgagaagcaaaatacaaaagttagaatctgatgtctcagctcaaatggaatattgtcgcaccccatgcactgtcagttgcaatattcctgtggtgtctggcaaagaatgtgaggaaattatcaggaaaggaggtgaaacatctgaaatgtatctcattcaacctgacagttctgtcaaaccgtatagagtatactgtgacatgaatacagaaaatggaggatggacagtgattcagaaccgtcaagacggtagtgttgactttggcaggaaatgggatccatataaacagggatttggaaatgttgcaaccaacacagatgggatttcaccatatttgtgaggctggtctcgagctcctgatgtagtgatccgcccgccttggcctcccaaggtgctgggattacaggcatgagccaccacacccggcctagtatttgattttcattaca

SEQ ID NO: 568478 - DNA, 1281 bp, Homo sapiens
  misc_feature (895)..(895): n is a, c, g, or t
  misc_feature (958)..(958): n is a, c, g, or t
  misc_feature (962)..(962): n is a, c, g, or t
  misc_feature (987)..(987): n is a, c, g, or t
  misc_feature (1013)..(1013): n is a, c, g, or t
  misc_feature (1040)..(1040): n is a, c, g, or t
  misc_feature (1077)..(1077): n is a, c, g, or t
  misc_feature (1092)..(1092): n is a, c, g, or t
  misc_feature (1197)..(1197): n is a, c, g, or t
  misc_feature (1231)..(1232): n is a, c, g, or t
ggaagtcattcctagcagaggactcagatatatataggattgaagatctctcagttaagtctacatgaaaaggatggtttcttggagcttccacaaacttaaaaccatgaaacatctattattgctactattgtgtgtttttctagttaagtcccaaggtgtcaacgacaatgaggagggtttcttcagtgcccgtggtcatcgaccccttgacaagaagagagaagaggctcccagcctgaggcctgccccaccgcccatcagtggaggtggctatcgggctcgtccagccaaagcagctgccactcaaaagaaagtagaaagaaaagcccctgatgctggaggctgtcttcacgctgacccagacctgggggtgttgtgtcctacaggatgtcagttgcaagaggctttgctacaacaggaaaggccaatcagaaatagtgttgatgagttaaataacaatgtggaagctgtttcccagacctcctcttcttcctttcagtacatgtatttgctgaaagacctgtggcaaaagaggcagaagcaagtaaaagataatgaaaatgtagtcaatgagtactcctcagaactggaaaagcaccaattatatatagatgagactgtgaatagcaatatcccaactaaccttcgtgtgcttcgttcaatcctggaaaacctgagaagcaaaatacaaaagttagaatctgatgtctcagctcaaatggaatattgtcgcaccccatgcactgtcagttgcaatattcctgtggtgtctggcaaagaatgtgaggaaattatcaggaaaggaggtgaaacatctgaaatgtatctcattcaacctgacagttctgtcaaaccgtatagagtatactgtgacatgaatacagaaaatggngatgacagtgatcagaacgtcaagacgagtgtgacttgcaggaatggatcattaacaggattngaantgtgcacaccagtggaagatactgngctacagtgatatgctggaatgtaantagcagctacagatggacacagacttngatgaatgagctgaaggacaataagtacttgagttcntgcgatgacacaatngttatgacattagaagcgatcctagtgcttatttggacagctctcacgttgtactaacatcggtaatcgacgtaaacgggtggaattgccacgatggaacgagangactgttgataggggttcaaaagaactaaaacannagtggaattgttttttctcaacgggtaaaattttttccaatggtgtttg

SEQ ID NO: 568479 - DNA, 93 bp, Homo sapiens
gagtcggagatctgatgatcattgccacttgcactcccaggccttgggtttgataatgatccatgatgacttccatactccataaataataat

SEQ ID NO: 568480 - DNA, 104 bp, Homo sapiens
cagcgagagacgtcaccctagaaaacaggctgcagaacatccggggtcacctatgcttgaacatctcctgcctccctaatttgccaggcctttcagtttcatgt

SEQ ID NO: 568481 - DNA, 409 bp, Homo sapiens
taacactgagaatctttggcctgagctccataaactgaacccgtgagggaggtgcctagctgggtgcaaactccttaattcctgtttgactttggcccagttagttaacctctctgagcctcagtttgcacatctgtagggtggggataaatagtacttgcttcctgtgactggagaaaagagtgatgtgataggggtaaaatgttcagcatcgtgcccgacacctggtagccacctgctacatgggagtaccatcggggcaccatgtaagcctgaaaattgatccggtgacagagccaccgaagtgttttgtcttctgttttcttttctttctttcttttttttttttaaatactagagagctgttaagaatcatcagatttccacataaaacacttgatgtttgctc

SEQ ID NO: 568482 - DNA, 453 bp, Homo sapiens
cgagccggtaccagtgttctcctacctgaactggcctcccacagtgttgggatacaggtgtgagccaccacgcctggcctgattgtatggtttttgtcattcatcttgttgatatgatgtgtcaccttgattgatttacatatgttgaaccatcctttgcatccctgggttaaatcccacttggtcatgatgaatgatctttttaatgtgttgttgaatttggtttgctagtattttgttaaggatttttgtatagtgttcatcaggaatattggcctatagttttcatttttttgatgtgtctttgtctgggtttggtatcagggtaataccagcctcatggaatgtgtttggaaatatttcctcctctactttatggaatagtttgagtagggtttagtattagttcttctttaaatgtttggtaaaatttagcagtgaagccatcaggtt

SEQ ID NO: 568483 - DNA, 179 bp, Homo sapiens
  misc_feature (82)..(82): n is a, c, g, or t
acagaggacccattcagtcaaccagacttgcctgtgcaggctgcacatcagcagaatagatctgtctgttagtgatacgtgntatcttatagacaggtacagtcgtgtagttagactatagtttgtactgtactttcttgggtggcagaggaaagaaaagtaaaacattaaaaaaaaaa

SEQ ID NO: 568484 - DNA, 110 bp, Homo sapiens
gggacttcagacactggaaaactggatgctgcagacactgaacgaggagccagttacaacagagcccggaaggtgaaccgcccaggttccccccagcttaagcaaagggc

SEQ ID NO: 568485 - DNA, 771 bp, Homo sapiens
  misc_feature (4)..(4): n is a, c, g, or t
  misc_feature (109)..(109): n is a, c, g, or t
  misc_feature (167)..(167): n is a, c, g, or t
  misc_feature (319)..(319): n is a, c, g, or t
  misc_feature (326)..(326): n is a, c, g, or t
  misc_feature (398)..(398): n is a, c, g, or t
  misc_feature (407)..(407): n is a, c, g, or t
  misc_feature (448)..(448): n is a, c, g, or t
  misc_feature (454)..(454): n is a, c, g, or t
  misc_feature (461)..(461): n is a, c, g, or t
  misc_feature (465)..(465): n is a, c, g, or t
  misc_feature (495)..(495): n is a, c, g, or t
  misc_feature (500)..(500): n is a, c, g, or t
  misc_feature (518)..(518): n is a, c, g, or t
  misc_feature (534)..(534): n is a, c, g, or t
  misc_feature (543)..(543): n is a, c, g, or t
  misc_feature (548)..(548): n is a, c, g, or t
  misc_feature (561)..(561): n is a, c, g, or t
  misc_feature (565)..(565): n is a, c, g, or t
  misc_feature (574)..(574): n is a, c, g, or t
  misc_feature (616)..(616): n is a, c, g, or t
  misc_feature (631)..(631): n is a, c, g, or t
  misc_feature (637)..(637): n is a, c, g, or t
  misc_feature (651)..(651): n is a, c, g, or t
  misc_feature (677)..(677): n is a, c, g, or t
  misc_feature (724)..(724): n is a, c, g, or t
aggnagacggggagttagtcagaatcgtaaatggactagatgaggggaaataggatgggcccttctttattacagcttgagcgcaaaaaggttgggataaacaggtgtntaaaaaagagaggaggtaaaagggaggatgggcaggggatagaggaaggtcaggggcngggttcacccatattacacagcattgtaggaagaagcagggtaaccatttgagttctcagcctggaacaggaggtgagggctcagcacctagagagaggagaattctaaggcctctttttcaactctattgtgattagatgcaaaagccctntcccttnagagaattcagaatggtctgttttaaggcaagagagcatagtgacagatctgtagccccagctcaggctgtntctccccantctcaaaggctcttctaggagaactatagaaatacagagtnccaggnctctgcncctnctccccagatccaagagagggagttgttanaaggnacaaagaccctggacgtnaaggtgaacatcagtntcgccacanaaaanaatattttgaganaggnaagaaagtncatgccccaaaagggatgccttccttcaccttgcaggtagcnggaactttgatagtngcaganaccacaatggagtngggttcacagaaatggcctgttaaanagaccctattcctagagagacagaggaaaaacctcagctgggatggnacaatcttgaatgggatgacagagggcagcgggcagatttcttccgc

SEQ ID NO: 568486 - DNA, 605 bp, Homo sapiens
ccagttatccgcacatgggttcaagcaattctcccacctcagcctcccgagtagctgggattacaggcacccgccatcatgccccgctaattttgtagaaatggggtttcaccatgttggccaggctggtcttgagcctctgacctcaggtgatctgcccgtctcgtgactcccaaagtgctgggattacaagcgtgagccactgtggctggccaggatttaagtttttggaaagctaggctcagtagattttatttaaataaatactttacgtttattttagtatcgtcagcatgaaaatgtagcagtgttgaatatgtaggctactaagattgtaaaccagtgcaatgttaataaaagtacactctacatgatatatgatatttttataattatacttttttctttaacgacagagtctctatgttgctcaggcgggtctcaaactctggggtgcaagtgattttcctgcctcggtctcccaaagtgcggggattacaggtgtgagccaccacacccagccttctaaatgcagtttataccaggctttaagaaaccactttgtcccaagcaaatgatcaggttcacatatacgttgatattat

SEQ ID NO: 568487 - DNA, 216 bp, Homo sapiens
gtatatggtctcaccgaactcttgaggcactctcataattctcatgatcatgttaactatcttatattcagcagatataaatcattgaaagttgtttgctaatcgttttttcgtatcttacagaattgataatcaaactctttaagattgaatccatccaatatttttaactgaaaaattgtaggtatatttctatggtgcccggagaaattaagg

SEQ ID NO: 568488 - DNA, 791 bp, Homo sapiens
  misc_feature (20)..(20): n is a, c, g, or t
  misc_feature (24)..(24): n is a, c, g, or t
  misc_feature (34)..(34): n is a, c, g, or t
  misc_feature (37)..(37): n is a, c, g, or t
  misc_feature (98)..(98): n is a, c, g, or t
  misc_feature (111)..(111): n is a, c, g, or t
  misc_feature (119)..(119): n is a, c, g, or t
  misc_feature (173)..(173): n is a, c, g, or t
  misc_feature (489)..(489): n is a, c, g, or t
tctcttaagtcatcgtacanaacntatctcactncanccacctttctacaagagtacatactgtggtgctagatgtcacccctcttcgaggcccttgngatcaactgaganaccatcantgaagttcctccaccttctgaatggatgccattatctgacgtgatagatcctantgggatgctgcttctttcctcacttactaaaataccctgataaggataccccaacctcacacactggccaacttgagggggcatcataacactaatcctggccccaaccattacccccacttttacctttttaccaactttttaacaattgccaacaattgccccccttccctccccattgaattaaataaacttcttgtctcatgattcctcaaattccccaaaaacacaggacctccacaactattccaaccacatcctcaccttgactccttgcatgctcatacacccctccccacctgcaacctcccaccanatcttccccctttccctccacggtaacctctcccccccccccttataagcggtacccaaacccccttcattgcccctcgctccccacttcttctgctccccttttcccccctcagcgcctcttccgttttccccaaacggcggtaccccgaagaatctttcacaaaccccccaatatgccctccctccacaccccctcttctctcttttcctagccctcccactcccacacgcaacaatcaacttctatccatcctggcccgccctctatattttatactgcccttctccctgaacctctcg

SEQ ID NO: 568489 - DNA, 195 bp, Homo sapiens
  misc_feature (183)..(183): n is a, c, g, or t
tcccgtctggacgtactagtggagtaattacgcgttgttaagtgaggtttaggtagggtgagtgtggctcatatggtggggattatacggcttttgttttttgtgaattcttcgcataatggcccatttgggctaataagccggttagcgggggcaggcctcctatagagaggagggtggatngaattcagggtg

SEQ ID NO: 568490 - DNA, 107 bp, Homo sapiens
tgcccacacactcgggaggtgtcttgagaattatcatccgtgagggtggaaggggagtgagcacacactcgggaggtgtcttgagattaccaccccgtcgggtggag

SEQ ID NO: 568491 - DNA, 169 bp, Homo sapiens
ggtgatctaagatcccaagatggtcctcagctgtagaagcagtggggctctggaaagaccatgtggtgtgagaaattaagcagctcactgagcatagatatccggtctgcttcctactatcaggctgatctaatggggttgggctgctcggcaaatggttgggtcaact

SEQ ID NO: 568492 - DNA, 105 bp, Homo sapiens
ggcaaaccgatgtccgatgctttctcctgaattggctgctttcattggaattcacggatctcgctactctgtcattgtggcagccctcggcttagacagaaggga

SEQ ID NO: 568493 - DNA, 339 bp, Homo sapiens
  misc_feature (30)..(30): n is a, c, g, or t
  misc_feature (95)..(95): n is a, c, g, or t
  misc_feature (97)..(97): n is a, c, g, or t
  misc_feature (132)..(132): n is a, c, g, or t
  misc_feature (146)..(146): n is a, c, g, or t
  misc_feature (155)..(155): n is a, c, g, or t
  misc_feature (220)..(220): n is a, c, g, or t
ggatcctaacagattgctaaataccccatnggtcaaggaataaatcaaaagggaagcttgaaagtattttgaactgaatgaaaatggaaataaancnacaaaatttttgaaattcagtcaaagcagtatttnctaggaaatttgtnctataaatnccaatattattatagaaaaggggaaagatctcacatcagtgatcttggtttctattaaaaaactnaaagacatacaaatggtcaacagacatatgaaaagacactcaatatcactaatcatcagggaaatgcagattaaaaccacaatgagatgtcaccttctacttgtcaaggtgtctattat

SEQ ID NO: 568494 - DNA, 228 bp, Homo sapiens
ctatcatcaagaggttgggtgacaccatcaccatatccatatgaacatgtacactcaggaaggccagcacaacagatcaagaagctaaatgtcaaacactaatacggcactgccgggcacttctccatccaagtcagcttccccataagaccaggtaagacaagcctaactgggcgtaatgcccatataacactacactccaaaaaaacactaccctaactactaaaa

SEQ ID NO: 568495 - DNA, 368 bp, Homo sapiens
  misc_feature (110)..(110): n is a, c, g, or t
  misc_feature (216)..(216): n is a, c, g, or t
agagtccagtttcggctctcaggagtgtgttcacctgtttctttctggcctgtgtcgagtctgcagacacagcaccaggccaggctcattcaggtacacgggcggccctntcagctccaatctggagagccgccggaccctgcagctggagtgcatatttctcaggataccatgcattagcactagtccctctgacctcctcttccctctgcaatntagggccttgcagccgaactcctgcacaggcctaaaggttttgaaattgagaaggaaaatcttctaccaataattttttttatagaatgaaaacaaaacatgaatgattgctacaatgattaaagagaggcgagaacagagccgatgaaagg

SEQ ID NO: 568496 - DNA, 239 bp, Homo sapiens
gagtggtctgtggactgggccaggtccctgtgctgtgtacagctagggacttggtgatcatgtgtcccgagaacactaccagcacatgggatgaaagggagcaacatagagctcagactgtggcttcagagagtccaagccccaatgtcttggcagcttccacatggtgttgagcctgcaatgtgcacataagtcaagaattggagtatgcagcacactccgccgcagattacagcagg

SEQ ID NO: 568497 - DNA, 885 bp, Homo sapiens
  misc_feature (1)..(1): n is a, c, g, or t
  misc_feature (218)..(218): n is a, c, g, or t
  misc_feature (222)..(223): n is a, c, g, or t
  misc_feature (377)..(377): n is a, c, g, or t
  misc_feature (397)..(397): n is a, c, g, or t
  misc_feature (406)..(406): n is a, c, g, or t
  misc_feature (456)..(456): n is a, c, g, or t
  misc_feature (472)..(472): n is a, c, g, or t
  misc_feature (485)..(485): n is a, c, g, or t
  misc_feature (487)..(495): n is a, c, g, or t
  misc_feature (524)..(524): n is a, c, g, or t
  misc_feature (538)..(538): n is a, c, g, or t
  misc_feature (582)..(582): n is a, c, g, or t
  misc_feature (624)..(624): n is a, c, g, or t
  misc_feature (628)..(628): n is a, c, g, or t
  misc_feature (786)..(786): n is a, c, g, or t
  misc_feature (880)..(880): n is a, c, g, or t
naaatgttttcataatactgaccagagggattacacagctcacaaaaactttccatataagaagcacgatgttaaaacacagcagaggccatcaaacacagtattaatgagaattttgttagcttctaatgataatcattattgtatcagaatgcaattcacactaattattagtaaaagtttacaaacattaaaaagtgcataataacatttggttntganngggctgaaaaaagacatgaaaacacaacaccagggctttacttttgtgattggtgtccacatgattgccaggggattactttctccacctgattcagcttagtgaagataagttgtcctccaaatttaaatagtatcatacagcattgtgaganatttgattccatagaacaanatatttccngtccttagtatgatcttggcttttcttttctacctttcccattgtccaanattctcataaattacnatatatatgtctntnnnnnnnnnggggggggggttctccacttgggggtganacagatttggcagnttgggttcccgtctgtgcgggcaccaaacaggctgggttcgggngatattcaccttagtgggtattttcgcatgtctctgtgatgncgcnatggagtcttgatgagtctgttagacttaatcaactcatcaacatacaatgagcaaggggaaagactgtgttttaaaaaagggtgttctatcctgtgtacaccaccacagtatggaaaactaaaatgaaaagacagcccttttaaaaatgagtggtanaaaaattcacagtaatgtacatcattttgtttttcataagcaatcagagaagggggcagtgctgagcatatatattgtacaatacaaaacagtnttaat

SEQ ID NO: 568498 - DNA, 538 bp, Homo sapiens
acacttcctctcctcccacctccgacaagatgggctatgacacaccgttgcattttgcttgtaagtttggaaatgcagatgtagtcaacgtgctttcgtcacaccatttgattgtaaaaaactcaaggaataaatatgataaaacacctgaagatgtaagtacttattacaatgcagttgctatctagagttagaaatggaaatatataaatttacagtctgtggtcacaggcacagggaagccacaaggagctctgtatgagttgtgtttgctttatgggcacatgttagaaccttggctgttgagtaagatgcactttgtgaagaagatgcatctgtagaaccaggagggaaggaactgacgcagtttgctgattttattttcctaaaactggcagtcagttgctttgaacagctcacagtcttttatcaagttccctctctgaacacatcagttgaccagagtcagagagaacagaggtggtgatggtggtggtgatgatgatggtggtggtgatgaggtgggaggagaggaagg

SEQ ID NO: 568499 - DNA, 427 bp, Homo sapiens
  misc_feature (1)..(1): n is a, c, g, or t
  misc_feature (218)..(218): n is a, c, g, or t
  misc_feature (222)..(223): n is a, c, g, or t
  misc_feature (264)..(264): n is a, c, g, or t
  misc_feature (298)..(298): n is a, c, g, or t
  misc_feature (308)..(308): n is a, c, g, or t
  misc_feature (340)..(340): n is a, c, g, or t
  misc_feature (353)..(353): n is a, c, g, or t
  misc_feature (355)..(355): n is a, c, g, or t
  misc_feature (358)..(358): n is a, c, g, or t
  misc_feature (412)..(412): n is a, c, g, or t
naaatgttttcataatactgaccagagggattacacagctcacaaaaactttccatataagaagcacgatgttaaaacacagcagaggccatcaaacacagtattaatgagaattttgttagcttctaatgataatcattattgtatcagaatgcaattcacactaattattagtaaaagtttacaaacattaaaaagtgcataataacatttggttntganngggctgaaaaaagacatgaaaacacaacaccagggctttanggggggggtggggggccacagggggggggggggngggggggggncaccggaggcagcggagggaagagaagggggncgccaaagggggngnggntcatacagcaaagggagagaggggaggccaaagaacaaaaaaggaccagaccanagaaagagcgggggg

SEQ ID NO: 568500 - DNA, 426 bp, Homo sapiens
cggtaccgatctctgtgctgggatgtgatgctgggaggttggtcagcagctcatgatatagagtaaagctgagtgccgtggtgggttaggaatgctgggcgctgtgagagccactcaggaataggcagccacgctgccgggcagaagcagagcctgcagatgctccctggaggtttcccctgctggtcctcggcatgggaggtgggccccagcagctgctagagagtgaaggagctggaccaagccccgggggaggaaggcatcacggcaagggaagggtcgcagtcacaaccacacctcgagagggagacctgtggccaaagcccgggggggcacacactacagctgttcccgtgcccactttggtcctgagagactcagggccaggggtccagaacagttcagcatcaggaatggggcggggaa

SEQ ID NO: 568501 - DNA, 1305 bp, Homo sapiens
ctacaatattgctggcagataggccccaagcatgacattcaatatagtttacatgttcctgtcaaggtcttttgttaacattaaccagctgcatgctttctggactttaagaaattgggtttctatagaaaacttttttttttttttttttttaaattgtgcaggctattcaagttttcaatagtaaaagctcaaaaagtgaagtgtttcatactctccagtgcgtgaaggagcgtgaaagcgtgccttctttacatatattttgtgcaccttttctggatagttctccccgtggtttttctcataatttcccataaaatgtgcgtggtggggtggagtgtggaccccttgcagaatagtgggggaataacccatgtggaccacagtagatatattgtgccctttgagacccgtgcaccaatgtagaccctattgtgcattacagcacaaactctattgtgccatgtagaaaacctctttgtgataaagtggatgtccggagccaacagaaatatgtggatggagctccacctattggtttaataagtctaaaagggggagaccaagtatgtggaagaaaagagctacaatattatacccaaatattataggagtagacaatattatatatcttccaaaggggtgtgataagataacttttaaatataaattttaagaaaataattaaaaggggggttacacatagtataaaagtactccgctagaaaaaatacattcgggaggtgtttggcgaatttcacaaggtgtttattgtggacaattggttgaaaaaaagagctatataaaagccaacaatagctttaccaggggaaaaactaagaaaaatatacccacctgtaagagcaaaagaggagaagagaacaaaaggacacccgaggagacacaacaggagggggcccaaaaaatactgtaaaaagcaggacgtagagacaaggagaccacaaaaggacgcatgtgataaaaccagagagattaggagaaaagacgggtgagaaaagaagaggcaacagagaaaaagagatgcaaaaaatcaccctataagaccaaaggaaaacatcataaacaagagttgttaagaaacaggaaacaagagagaaacaaaagagaagaagagcagggacgtaaagaggagagacaaaaaaaaaacagaaagccaggattaaaacaaagaaaggagggaaaaaaacggcgagaaacattaaaagtggagacaaacatgaggaacagacaaacacagtggtaataacgagacgagcccgaccgctctctattctgctccgcact

SEQ ID NO: 568502 - DNA, 185 bp, Homo sapiens
actgcatgacaaggactgagacgtatgacgcgcaccacacgcccagctagtttttttgtatttttttcttgagatgaggttttgccatgttgcgcaggctgatctcaaacttctgggctaaagcaatctgcctacctcagcctcccaaaatgctggggtaacaggtttgagccactgcccctagc

SEQ ID NO: 568503 - DNA, 774 bp, Homo sapiens
ctacaatattgctggcagataggccccaagcatgacattcaatatagtttacatgttcctgtcaaggtcttttgttaacattaaccagctgcatgctttctggactttaagaaattgggtttctatagaaaacttttttttttttttttttttttttataatgtgcgggcttttcaggtccaatattaaaaccccaaaaatgaatgttttaccccaggctgaaggagttgaaactgccttctccatatttggcactttctggtagtccccctgtttttcctaatcccctaaaattgtgtgggtggagtgaagccctgcagttggggggtaacatggaccactgattttgccctttgaccctgcacaatgacctttgcatcagccaaactctttgccatgacaactcttggtactgtgtccgtgccacagatctgtgggcccctttgttaataagtaagggggacaactttggacgacggccaattttagaccatttttggttgcaattttttcttcaaagggtgtaccgtagttttattttttttatacagtacttcaaagggggtttccctagttataactactcttagaaaaatatccgtgtgttgttggcacactaacaacgtgttttgttggagaatttttgaaacaaagcgctaaggctgcacactaggttatcccggggatgcccatagaataacgccctttgatgaccttattggcagtgaataacggtcaccagggaacacaaggggtggcctaaatactttgaag

SEQ ID NO: 568504 - DNA, 238 bp, Homo sapiens
ccatcatccacctcactgagagcttgctttcttgcgattttgattctgagaaactcaaaggagcttattgctttgaatgtgaacatttggctcctccacaaacttttcagtcatgagtttctatttctccagagttgtcacatgaggcctgggttgtttgggcttcagactgaagcaattagcagtcctggatctgcacgcatgcatctgcatagacatgtgtgcacatggtcgacgc

SEQ ID NO: 568505 - DNA, 428 bp, Homo sapiens
  misc_feature (4)..(4): n is a, c, g, or t
  misc_feature (15)..(15): n is a, c, g, or t
  misc_feature (29)..(29): n is a, c, g, or t
  misc_feature (41)..(41): n is a, c, g, or t
  misc_feature (195)..(195): n is a, c, g, or t
aatnggaatgttgtngatgggtccaggtnaggaggatattngaaataagccggaaagaattttggaaataggcacttaaattaggaattgaaaattgtccttacctaacaaacttttattttcccactgactttaattttctaaagagcaatgaaggtgatatttgaaaagtataactgacttatttttgagatntttgtattactttcacatcaaaaactctatatgccctacataagtataggcgtaaaaatgttttattgaaacaattatctgagctttctttcgcagactaccatttaaattctgttttcacaactaattttcagaaagaagagtctcccaaaactatattgacacttaagtatgctatttattgaaatttagccagacatttataaggtaacttttagtaattatcttttggt

SEQ ID NO: 568506 - DNA, 143 bp, Homo sapiens
  misc_feature (40)..(40): n is a, c, g, or t
ggtcctacatactaaactgcacctcttgcatatgtacccnctgaacttaaaattgaagaaaaaaaagaaaattagtacaacctctattgaaaactatatgagatctctcaaagaactaaaaatagagctaccattcaatccag

SEQ ID NO: 568507 - DNA, 450 bp, Homo sapiens
tccacctcagcacagaccctttacgggtgtcgcgctggcagacggtcaggtctttctcatcccacgaggccatatttcagactatcacatggggagaaaccttggacaataccccgctttcaagggcagaggtccctgcggctttccgcaatgcattgtgcccctggtttattgagactagagaatggcgatgacttttactaagtatactgctttgttaaacagatgcttgaaggcagcatgctcgttaagagtcatcaccactccctaatctcaagtacccagggacacaaacactgcggaaggccgcagggtcctctgcctaggaaaaccagagtcctttgttcacttgtttatctgctgaccttccctccactattgtcccatgaccctgccaaatccccctctgtgagaaacacccaagaattatcaataaaaaaataaattaaa

SEQ ID NO: 568508 - DNA, 149 bp, Homo sapiens
tccggcacgcgagtcctatggaaaacaagaaaagggtgggggacggctggcggcagaccatgtgtccactcaggagtgcagatccagaaagagaagggaaggggagaaggcaggtggggtttgggacgggcggtgctgggtttatccac

SEQ ID NO: 568509 - DNA, 478 bp, Homo sapiens
atgaacgcagtgctggactgtgcaacctgacgctgcggtgcatgtactttcattggcgtagctgctggtagcacaggattctctgttgatccagatgagctaataataggacgtactatcaatgtaacattgattgcagggcgcacaagtgttgattgtatatccaaagcaggtcactgactatatgaataagagattcaatttggatgcactggtgacccataccctgcattatgacatactcactgaggtatgtgacgctaatgaaccatggtatgagcatgcgaacaatgctcatattttgaggataccaggagcacttcagagtactcattgattgaatgtgaacctggctgtgtgatatattacctgaggtgatgaaccatgtaaagtcatgcgtttaaacatacattgacatataccatgtgaacatacacgagctattagtttagactactgacgctgagtatatatgttt

SEQ ID NO: 568510 - DNA, 275 bp, Homo sapiens
cgggcgccgctagaggccatgttaattgaggacgcagggagctgagatcacctcactaccctctagcgtgggcgacagcaagactctgtttcaaaaaaaaaaagcggcagagtgaacgtaggtccgaagggacctcctgtggggcgggccatctggggcacttgatgcccaacgtgaccattcccttccgggaggtctgcccaaactgctccagcccccatagcctgaggctcccggcacctcccacccagcatgtgtcacagcaaatcaatttg

SEQ ID NO: 568511 - DNA, 669 bp, Homo sapiens
  misc_feature (38)..(38): n is a, c, g, or t
  misc_feature (40)..(40): n is a, c, g, or t
  misc_feature (49)..(49): n is a, c, g, or t
  misc_feature (56)..(56): n is a, c, g, or t
  misc_feature (65)..(65): n is a, c, g, or t
  misc_feature (69)..(69): n is a, c, g, or t
  misc_feature (78)..(78): n is a, c, g, or t
  misc_feature (113)..(113): n is a, c, g, or t
  misc_feature (122)..(122): n is a, c, g, or t
  misc_feature (134)..(134): n is a, c, g, or t
  misc_feature (147)..(147): n is a, c, g, or t
  misc_feature (172)..(172): n is a, c, g, or t
  misc_feature (204)..(204): n is a, c, g, or t
  misc_feature (231)..(231): n is a, c, g, or t
  misc_feature (246)..(246): n is a, c, g, or t
  misc_feature (248)..(248): n is a, c, g, or t
  misc_feature (250)..(250): n is a, c, g, or t
  misc_feature (261)..(261): n is a, c, g, or t
  misc_feature (265)..(265): n is a, c, g, or t
  misc_feature (297)..(299): n is a, c, g, or t
  misc_feature (306)..(306): n is a, c, g, or t
  misc_feature (309)..(309): n is a, c, g, or t
  misc_feature (317)..(317): n is a, c, g, or t
  misc_feature (343)..(343): n is a, c, g, or t
  misc_feature (369)..(369): n is a, c, g, or t
  misc_feature (395)..(395): n is a, c, g, or t
  misc_feature (403)..(403): n is a, c, g, or t
  misc_feature (445)..(445): n is a, c, g, or t
  misc_feature (513)..(513): n is a, c, g, or t
  misc_feature (540)..(540): n is a, c, g, or t
  misc_feature (553)..(553): n is a, c, g, or t
  misc_feature (555)..(555): n is a, c, g, or t
  misc_feature (558)..(558): n is a, c, g, or t
  misc_feature (570)..(570): n is a, c, g, or t
  misc_feature (579)..(579): n is a, c, g, or t
  misc_feature (589)..(589): n is a, c, g, or t
  misc_feature (660)..(660): n is a, c, g, or t
tcccaaaaaaaaagtcacttttatttcttagcaaaacnanttcccccgngaggggnatttacaanaganaaaggaaanaagggggcaattcacagcgacttggagaggctggnggggcccgngggaggcccgangggggagacaganacacttcacacaattaactggaacngctttttccggtttccgacggggacgtccccngagggacttgatggggccggggccccncgtggcaagggaacncncncaaaccacccncccncctgggctggcccccggtcccccgcgggtgannncctgggngtncgggcccnggacccgggaggggggtctggcaggncccgacgcagcccggggacaggggcngggccaaggggcagggccggggcgcntgccaacnccgagggggagcgggccacacggaggggggcgccggcgcgcncgcgcgcgcgggggcgcgcgggggcgggaccgggaagggcagtcacgggcgccggagccgcccgtgcnccatgtaattctccagccccacctgcncctacaaccggcncnccnccccctcccccnccccctgcnccccccgccntggggcctcccggccgggatagtggcgcgaaggcggcaaggcgtggtggtagtggcggcggcgcaaggccnagggcggct

SEQ ID NO: 568512 - DNA, 598 bp, Homo sapiens
gcatgctgtatgtactggacacactgaggcatcttcagtatgcacctatttattggtatggcctcaggctacatagggtatgtcttcaagtccggtagactattaacttgccggaccttatacattacattctctctatccggtcaactttactttgtgtaaggcacagttcgctgcttcactgatgtgcttctcattcgacaaagtctccgtactactattttatggctctgagacgatagtcactgtcgaatatcagtgtcctatacgtactgtacctgctagaactgcgctaatcggtatatgtcaaatactgtaggaaagactctacattgcgcataacacagctgacagtctctttacttacactgactacatctgtgcatgactctcggacttatgtgaattctgacattaatgctctgataatctgagctcctagctgatgtagccagtggagactaggcgtccgctttgcacctctaacatcaagtgcgatgaacttcctataccgcacacttttcacagacgcgcactagcattttagtggtgctcagacccgtataatatacattcctagtctaggccctttaccgtg

SEQ ID NO: 568513 - DNA, 316 bp, Homo sapiens
atacatgtggtacccacgtttgtggtgggaggacggaggagcggcgatctccttgattcacagcacggggagttcctaacaccaaacacacttgatttcctgatgaaaaacaacagaagtcaacaggaaaacagattaaagatcaaaccctctcatattaaggcaacagaaaatcttttaggagggaggcaaaaacaaaaaagatcgagatctggtaacagcaggatcgtgtggccaaccacaaacagaaaaatttttttgaaaatcagcctataaggctaacctaacccagaagcctcccaccacaaacgtggga

SEQ ID NO: 568514 - DNA, 215 bp, Homo sapiens
gcaaaatcacagtcgccttacatgcgtcgtgacatggtgcttgctctgaactctcgtacaggtgtacctggcaatacaattcttctcccgaacacgaccggacttggctgctggagacggctactcgctttacgacctagcaggacctctctgacagacccacgacactccactgcttgtacgaccttccttactggtgccctgacaatgacgtt

SEQ ID NO: 568515 - DNA, 339 bp, Homo sapiens
agagtgagctgatcagataatgaaaaaggagagctcttgctctgttggaaggggtatgagtagagagcctggatctgacaacttgagacagcatgttatgaggagagaatgcaggcggctgctcagctactgctgccatttggagagcaaagttggcttgtacttccacgtggactgatggcaaggaactctgcctctgcgatcaactcttggatgaggagtgtgccaaaagcagtgataaggactcagtggtcctagcagatcacatatgaaagcaatgaaaatcagctgttagataccttttagtatcatgatatggcagtgaccttaagcatgaag

SEQ ID NO: 568516 - DNA, 1653 bp, Homo sapiens
  misc_feature (1)..(1): n is a, c, g, or t
  misc_feature (1208)..(1208): n is a, c, g, or t
  misc_feature (1305)..(1306): n is a, c, g, or t
  misc_feature (1425)..(1425): n is a, c, g, or t
  misc_feature (1495)..(1495): n is a, c, g, or t
nccctcccactgggactgctcacgctgtatgataacgctccgtaattaattaaataccgcacgtaccccccctgtgttagtggggttgtgtccgaaagacaccacaccgaatgagcgcgaatgtttttttaaagggggtgcgacaccagcagctattgaatgagtagaaaccttgctgcgtgagaggggagatatatccacccacagcaacaaaggggtttggttggcacaccaagaaagaaagagtcgacgagggcgcgtgttggtgttgtgaaacaccgcggccgcggcgcccccacgggtgaggacgctgatgtatagaccggcggttcgtcctttaaaagaggggttgtccgccgaagaaggcgctctctttgggggtttgtgccgcacgagaaaatctttcttggggcgaacccacaagaggggggggcggcgccctcccccacacccctgccccgcgagattatttgagccccacattgggggtgcctgttttgtggaaggccgccccccccgaccgggtgttctgcccagcaccacaacaggggattcctttgtggtccaacaaccaggtggtcggcgcccggtttggtggagcaccgaacacacaatgggggggggtctgaaaacagaccacaaaggcaccgcgggcccccccccggttatgagtagaggtttcctcgccccccatatgaggcggggttaatagagggccggccccccgcggcacaaaaagccagcacaacaaggggggcgcggcgctcgcagccaatagttttggacgcacgccacgacgtagcgcacccacggcgcgtttctacgaggggtactgcccactttcctcgcgggccccccttttcttgtggggcgggctgtggccccccacccgcgtttttcggcggttgtaccccacccaccgcggagaagggttttttccgcgcgccccgcggccactcgacgcgggttgtttcacagcctctctgtgagagagagaggtgctctctcgcgtgttgtgtggccacgcggcgcacattttcacacacacagagagaggggttgtgtcgccgcgggaggcacactattctgggcacaactgttctctgtgtgagagactctcgagagagagagtgcgcggggacacacacaggtgtctcacccggagaggtctccctgccacaggcgcacacacaggtgacacacccggncctgaaagagagagtttcacaccctctccacaacatctcatctcctttttctcccccagaggaagactccctctgggcgcccccacagagaagaggnngagacacacacagttcttgtctgatatagagaacatgtaaaacagtgtgcgccacacccagacgtgtgacccgggacacgcgttcataggcccgcttccgcgaacagcttcttatatanagaaagaggagaaaaagacttcgagattcatatcaccttgagagaagaagaaagaaatatttccaagacnctcttcgccttagtgtcttccgcttatgggcccgctgcaccaagccttcgggcttttctggcatacgggccaaaagagccacaggaagacccccaggaccggatgttgtaaaagaaaaaaattaagaccctcctggggaccttggaatccacatccca

SEQ ID NO: 568517 - DNA, 334 bp, Homo sapiens
ctttttttttaattataaaaataatacctgttcactagagaaaaactaacatacagaaaagcagtggctcacgcctgtaatcccagcactttgggaggccagggcgggtggatcatgaggtcaggagatctagaccatcctggctaacacggtgaagccccatctctactaaaagtacaaaaaagtggccaggcgtggtgatgggcgcctgtggtctcagctgctccagaggctgaggcgggagaatggcatgaacctgggaggcggagcttgcagtgggcggagatcgcgctgctgcactccggcctgacccacagagtgagactccatctca

SEQ ID NO: 568518 - DNA, 106 bp, Homo sapiens
ggatgatgagatagctgtagataaagtgttagggaacaggagatagctgtagataaagtgttagggaacagtgacgtgtagctgtcgataaagtgttaggggttag

SEQ ID NO: 568519 - DNA, 218 bp, Homo sapiens
accactgtcgaagcccccatcgctgggacaactagtacttgccgcagaaactcttaaaactaggcggaaatggtatcatacgcctcacactcattctccaccccctgacaaaagacatagcctaccccttcctgtactatccctatgaggcatcattataacctgctccatctgcctacgacaaacagaccttaaatcgatcattgcatactcttcaa

SEQ ID NO: 568520 - DNA, 154 bp, Homo sapiens
tctggtaagagcagactggaaatctaaacaggagttggatgacaaaagcgcaacctgtaaggcaatattccaaagcgtcatatgcttggactggtctactccacatgagagctggcgtcaggtaaacagcacattgtcgtgtggcatggttaca

SEQ ID NO: 568521 - DNA, 351 bp, Homo sapiens
ctgtgcggttcgtgcgccgcttggccactgttgccccgttcttcaacgacctgcatgggggaactgacgggacgacgactgccaaccggccacacgacccaggcagcagcacgcggggacacgctgaccagaagaaaggccgacgtgcaagcaaaccaccctccggcgcacagggcacatgtgtcccaaggcgcacgcacaccacagacggacagagcaagcacagagagggcgcacggaacacagcgagaagggcagcagcgcgcagcagcagagagcagcagcagcagcacagagagagcacgtgcgagagagacagaagtcggcacacagacacgcactgcgcgcgca

SEQ ID NO: 568522 - DNA, 179 bp, Homo sapiens
cccattaaacgctaatcgagtgcgttgtcatcttgcttctaacgcagtctgctctacttgtggcctctttgaggagacaggactccatatcttgggtgactgccccatggcacgagaggtatggaatatcattattcacccgtcctccctgcatgctttttacaactcgtctcttattg

SEQ ID NO: 568523 - DNA, 134 bp, Homo sapiens
ccacacagaacttctgagaggggctgttacgcattgcgcagattcttcagttctccagtaaatgatattgcgttcgtgcctcagttttaagcacaatgtagcagcagctcgtgtttgagttctgagggcatcat

SEQ ID NO: 568524 - DNA, 609 bp, Homo sapiens
cccagaattatcccagtatgtaaatgagtaggctataaaggtatatgctacatagggtaaaatttttggacctactgggctatatagttaaggcaaaatttttggaactgcaaattaattttgcctggactacttttgactgaagtatatgggaatattggtccttgattaaggaatcggttactagtatgtggaaaagtaggtgaggccatttaattgcattaatttagccattgcccaaaaaaaaaaataaaaatcaaataaaaaccatgtcggccgcttggcccaagcggattttagactggggcaggctaatgcatgcggccgcatttggagctaattgggccatttggccttatagggggccgaattccaattcattggccgccgtttaacaagtgcgtgattgggaaacccttggggttccccagttaaatggcttggctgaacatccccttttggcaggttgcccaattaccgaaaaggcccgaccggttggcctttcccaacagtggcccagcttaaatggcaaagggaattttgaggcgttaaaaattggtttctcgtgtaaattttgttaaacccgtcaatttttaacctggccgtggc

SEQ ID NO: 568525 - DNA, 109 bp, Homo sapiens
atgaggatccccccatgcctattaaattacatacggtaagacatacccagtcaaactatttttcagctcgaaagtttacaactaaaaagatttcaagtcttcacagagg

SEQ ID NO: 568526 - DNA, 400 bp, Homo sapiens
  misc_feature (64)..(64): n is a, c, g, or t
  misc_feature (80)..(80): n is a, c, g, or t
taattataatatgtataggtatattatatggtatgaaatagtgaaaaaagaaaaaaaaaagaancctagcttggcactanagcacaagcattgatccacctactcatggaggaaatactaaagaatgaaaatcacagatattaaatcaaaataaaaagccaagatttttatgaaaccgaacaactccttattaaataccaccaccgacgaactcccagactacacactaccaaactaaaacaataggcgagtcatttgtgtatttctctgtaattaatagaaccattaacgcaccccacattaccgcccacacccatggcgtctccgtcggagacaaatccaacgtaatacaccaatagcacccccgacatagcgagaagagccttgcactcccgcctcc

SEQ ID NO: 568527 - DNA, 333 bp, Homo sapiens
ggacgcgtgggcggacgctgtgggtcgacccacgcgtccgctgaaaaagggctctgggcatggtgactcatgcctataatcccaacactttgagaggccaacatgggagaattgcttgagcccaggagttcaagaccagcctggacaacgtacggagaccctgtctctacagaaaataagaaataattagtgggatgtggtggtacacgtctgtggtcccagctacttgggaggctgaggtgggaggattgcttgagcctgagaggttgcggctttggtgagccacaatcacaccactgtagtcccgcctgggtaacagagcgagactgtctc

SEQ ID NO: 568528 - DNA, 129 bp, Homo sapiens
cctggtatctggtgatcctatcttgtatcatctgtacaaaattagcgcttaagttccgtctgccgttccaacttttactgagctcgaccaacataaatctgtataccataagagctcctttccgatcat

SEQ ID NO: 568529 - DNA, 173 bp, Homo sapiens
gtctcacccacactcacacgcccaacacacacacttgtctagtgctaggcactcctcacaaccccggttctctcatctcccgagttagtggcagagcttgccaccagccagagcacaggccctgtgatgacacagtggaaagaatacgcctgcctgcccctgctgcagacacc

SEQ ID NO: 568530 - DNA, 1130 bp, Homo sapiens
gagaagaagtgacagtcacagcatgcacagcaacccatttgcttttctggggcagtcctggcggtttttcattaaggctgttccatgtgcaaagcccaagcaagcatgcaccaggcattgttcttgttgcaccaacaacatgtcaagtgtgcccggattacttccaggatcatccgttcttccgaagcatcctcaatgaggcacattgtggcagagcaaaaccatccagacattcattggttcctctgcaacaaccagggaagcacatatcatcatgatcccaccgtcacccattgcagaaccagcattatgtgataccattatgtcattgacctctgtcaaaacacatgtgatcctacagaagtggcgctggataatcagatagttactgctacccagagcaatatctgtgctgaagaccgtgctaccagagactgcctacacattatgaccagaaaccaaggtgctacaacagctgtggtacccacctcgttaatatgggtggagatgacgaacgaaaaatgggtggggagaagagaggtttaaaacccaggattggcgcttgcttattagcctgggagttacttataaggtccattgggttggattggcattaggtgagtatataaccttgagagaggatactacagaagagagggcatacggagaacggtttgaggataatatagacatacccacaagtgcagtgcgagaagaccaaggggcataagagaaacgcaaaaagcgggggagaagaacagagacaaacccacaacaccagggggacacccaacacagaaaaaaacaagccaggccaagagagaacacaacagaagagacgcacacaacgaaagaaaacaaaaaagagcaacagccagcagaagaactcaggcaaagacggcgcaacatggaaacgagcgcccaccagcgaaaaaacaggcgtaggagacagagagggagaaacactgcgagcggcaagtagcaacagatgacacaggaagagagtagcgaaaatgaagatcagcagggacgaaaacaacgcggcagagcaaccccagacagagcgcacaggcgcccgcacgacaacgcaggaggaagggcgcgaggacggggcggacgcaaccagcagc

SEQ ID NO: 568531 - DNA, 244 bp, Homo sapiens
cctcccccgggagggggcccccaaacttttttccccccccccttttggttttttgtgtggagggggagcagggaaatttaaactgtggtgtgaaagggtaggaaaaatcctggaggtgggggggttgttttttaaaccccccaaattatcccagtgtcccctgccccccttttccccccccccatgcccccaattttgtggggcatcccaattgtgaaaatgtccaataaatgtgtaatgggta

SEQ ID NO: 568532 - DNA, 872 bp, Homo sapiens
  misc_feature (638)..(638): n is a, c, g, or t
ccacgtggtcgtacgcataatggtcgatagttgccggtatctcctccctggctgacctgcagacgggagcgatgcgctgttccatgttcctcagggctcaggacctgacacctgtccgaggctacgtctggtgcatgcttctcgaccaggtgcgtgctatgtagagcgttcacaggctgagaggcgcgcgcgaacgtgctggggccatgcccgggctcgtctgttgttgcttgttgtggtggtgggctcgaaccttccatcacctaccccttggtatggtggcctcgggttgtgtgccaatctacgcttctctcggggtgttcatatgatgcttcgctttctccgcgtgctccaggacttactcgtatcttaccccgattccgccgttggtacctgtgtagttgccggaagctccacgagtctggcatgcgagaagaatgtggagggtcttgtgtgtgctcacggtcggacatcattccttcgcaggattgcgtgcattggtcgaatgttcgaatccttacaacaagggtgtagtgggtagaaatggggtctcgcagtaggttggaatcatcgcagaggacgtagacaggaagcttaagccatctagttgtcccgtcgattcagtacaaccgtggaantgggtcccgtagttagctctcgttcgagaaatctgtcagggcgctcgatggatgtcggcttggatgccaagttggagaaaggtcgggcgtgtgacttgtaaagcaatgagcattgctggggaaaactggtgtggcgtctgtggaatcattgaagggtgaccaaatcactgaatcgtattgaatcccattatagccattactgcaagatgaaaaattgccgcttctccccttgta

SEQ ID NO: 568533 - DNA, 956 bp, Homo sapiens
ctaatatctgtgatggtttccagcaggctcccccagagtgtacagtgcaggggtgagagtagaaattcaacctgactcctgtacattagagcttttctgagatgtagactcagcactgctcacataagagccagacaattccagccccacattacagaaccagcgtctcagtgggtggggggcattaggaagtataagagagcatcacccacaacagtgggacatcatgatgccatccaaatcaccctgtatagaaacatgtgacattcagtgtgaaccacgatcaagatgggcaacatgagaaactcgagcatgcaggatcctcaatgtggatgtgggcacacggtggaagcaaggactcttgagggacacgaagacaccgcagatgtcacgctgagagcatcacttgatactccactagaccatgcacttcatcatagtacagtgaaacacttcacaggatgcacgttacacatccatcgtgggattgtgacatcactcaaaacttcaaacacagaaatcgtcaacatgcaacgaggcagcatggcatcacgcacataacatcagcgcgtaaccaggaatggtaacctgtgagtacagacagggcgaccagggcccagaccatacggaaaggcaccacaactggggagggcactcctggaaggctcgcacgcagttgacgaccaatgacatacgtggaacacgcggagacagcagtcggggacccgaagggatggactcacgaacattaacggggccagagtgtttagagggcaaatgcgaaccaagggttcggacggatagatagtatccaccgaggtccgagtctctcggtgggagagtagctgagcagatattgggaagccagtgtgagcggggcgatggcctagcggctagacagggtacggcagcacaggagtagggaacgcagttgagataagcgcgagacgagggac

SEQ ID NO: 568534 - DNA, 305 bp, Homo sapiens
tggatcccccgtgcggatacgaaactcttccgatgtacactgcccaggccgaggtgctgccccctcctccgctggagctggagcccaggccagagccgccctgttctcgccgggagtcgaaaaacttcttcatcttgcgaatagggagcagcaaagcaaaataccgatggtttctagattttttttttttcctttttcttttggagcgtaccgggttttctccatgctgtttcttactctcctcttttgcacccctcccatttccctcgtttttctttgaaaatttctcccccctccagttcgct

SEQ ID NO: 568535 - DNA, 470 bp, Homo sapiens
  misc_feature (441)..(441): n is a, c, g, or t
  misc_feature (448)..(448): n is a, c, g, or t
attcggcacagatttatactacaaaaacaaaaagagttcagtttatgagccaccctgcctggccaggcttcactctttgatgtgacactaaagtgctgctgtgggaattggcattcacctaagatgtgagctgccagctgtgagccctgcgctatgggctgtatgtcagtggcaggtggtacgaaacaaaagaggacactggccaccagaagaggggaagcaagagtgctctagccagttcttcagggagtagagagccactgatttaaaatgcaagtagccaaaaagacagcacccttttcagtcacttttgtagaagagtgaaagtctaccttaagcagttacctgggcttcaagttgcaaactgaccttctgtcatggaagatgtgaaaagcttattttgtccttgaatataaccagtttagcatacatgggtgggcntccccantgaccggtgaatttagggtgat

SEQ ID NO: 568536 - DNA, 368 bp, Homo sapiens
  misc_feature (146)..(146): n is a, c, g, or t
  misc_feature (161)..(161): n is a, c, g, or t
  misc_feature (193)..(193): n is a, c, g, or t
  misc_feature (316)..(316): n is a, c, g, or t
ctgatgaatgttagctatgtttattataatcaggtaatgattccagaaggtcttgatgaaatatatggctaattcatgaaacttaaaataatttagaatttccttagcctatttataaaagtaagagaatattattaataattttngaatgaatattattnctctttatgttaatgaatattaagatattatncatttaatcttaaccatgaaacatttttgaaaaatgagcttggttcttatttagatctattgtggaacttaccacctaatgtatgttttctcctaaacacaccaattttttactaattatttnatgggcaggaaaccaaaataaacaggtaatcaactaaaaaaatactgtttcc

SEQ ID NO: 568537 - DNA, 135 bp, Homo sapiens
tgctccaaggtataggtgaagctgggaacttattccccttcttctctacaggtagtacaagacttcagatctctttagccactcaaattcttcttccaactttgtctgcctcattctaaaatttacacagtagac

SEQ ID NO: 568538 - DNA, 295 bp, Homo sapiens
  misc_feature (43)..(43): n is a, c, g, or t
  misc_feature (199)..(199): n is a, c, g, or t
ccccaaagaccaggttttggccttaggttttgggcctatgggngggccttcccctttacttccccccccccttttctccccccctttaagctctgttgggcggggggattttaattttcttttgtttatttccccccccctttttttcttccggcccgtttttttaagggggggggttggggttttttgtttttgtttngcctctaaaaaaacctttccccttctccccccccccccaaacccatcgggggaacaaaaagcgcccgcttttttccccatgtttttaatgtaagta

SEQ ID NO: 568539 - DNA, 114 bp, Homo sapiens
attacaccctgcttgaagctggcatttgagatgcttcagttggcacagcagcaacaagtttgctgttcaaagtaggccaagccacggtcaacccacaagccacggtcaacccac

SEQ ID NO: 568540 - DNA, 327 bp, Homo sapiens
cctgcgggccctattgctacgatccagctacgatccaacagtagatgcccaggatgcatgtgaattaacaaacgatgagacagagaagcaaagggactaaaggactatttagagccccttttccggagttcctgttatggctcagtgcttaagaacgcaactagtatccatgaggatgctggtttgatccttggcctcgctcagtgggttaaggatctggcactgccataagctgtaggttgcagatgcagctcagattcgacccctagcctgggggatcgtagcttttcagtacctgagcccacttcttgtttcggctctgcatct

SEQ ID NO: 568541 - DNA, 142 bp, Homo sapiens
aagcagtcaacgagaagcggaggtagtggcgggaataaggtatttgcgagcggtgaggaaacggaaagagagaaaaaagaaaaagggaaggaggaaaaaggaaagaaaaaaaacaggaacaaagagagaaaaaacagagaga

SEQ ID NO: 568542 - DNA, 416 bp, Homo sapiens
aggatctcaaacgacccgaagactgtgcaatgccagcctgccaacctcacctgtgaccagcttgttgacctgcggtccctgtcatcgagttctgcgagaacaaagtcttgaggctgtctgggggactggggtgcaggcgcctcaactgggaggtgccctttgtctgctggcctgctgtgtgctggtctacttctgtgtctggaagggggtcaaatccacgggaaagatcgtgtactttcactgctacattcccctacgtggtcctggtcgtgctgctggtgcggtggaagtgctgcttgccttggggccctgggatggcatcatttactatctcaagcctgataggtcaaagctgggttcccctcaggtgtggattagattgcggggacccagaatttcttttctatacgcccatt

SEQ ID NO: 568543 - DNA, 353 bp, Homo sapiens
gcttggaacagctggtgcagatggctggtggtgtgctgcccctcttgacatgtggtccagcactgaggacatgctgaagaacactaaatgcattgcgctctgctcttcccgcgacagaactttctgctacaaaagcagcatggacaagactgtctccattctgtcctcggatttcacctccagggtagtgggccttggcaccagataaaccaagcccacccctcatgtggagaaactgtccagcaactggctatcgaacaggatgactacacaccaggtccaatcaaagccattctggcatttgtgaaagggttctgaccgaggtattgtacctcctctgagtgtcactttcc

SEQ ID NO: 568544 - DNA, 233 bp, Homo sapiens
tgcctcagcctcctgagtagctgggatcacaggcacacaccactatgtctggttagtttatttttatatttattttttgtagagatggggtctccctatattcctgaggctagtctctaactcttgactcctgtgctcaagcagtcctaggcctcccaaagtgttgggattacaggcatgagccaccacacccagccagtactttgttgcttccggtggcatcgataaacacc

SEQ ID NO: 568545 - DNA, 227 bp, Homo sapiens
ccgcactcaggtgatccagccacctcagcttcccaaagtgctgggattacaggcatgagccactgcacccggctcttttgttgttgtgttagagacagggtctcactccgtttcccaggctggagtgtagtggcgtgatcatagctccctgcagccttgaactcctggtctcaagatcctcctgcgtcagccatattctcagtctttttcatttcagtcgttctact

SEQ ID NO: 568546 - DNA, 1243 bp, Homo sapiens
  misc_feature (340)..(340): n is a, c, g, or t
tgttgtgtggttgtgttgagagtggaagtgcgtttaataaatatttagaaagatatccttttatgttgttcttttctagatcatctccgagtgtagaagtatgctattaatttttattcttgtatattgtgtaggaggtcgagtcggggtgacagttgttcatgtagtggtgtcgatttaggagtagttattgtatttaaagttattagtagtgttgagagaggccagacaggtaagagaacagagcacgcaattaaaaaccagggggaagacaacaacaccgttagggaccaccctgttgagcctgtagaggggcacacacaggagggtgacacaaganacaccagcggttgtttttcccccccctccgtgtttttcccggtcttttatgtttcgaggcccgtgggggcgcatttctccaccatccggggggtttcttggaagaagggggtcgcccgcgtgcccgcgtgatccccggggggcgtcccccccctgtttttctcgcctgatcaccagagggtgccaacctgtgtggggggcagccccttggtaggacccctcttttgggactcgcgtccctcgccccctctgcctagaggggagccaagtttgctgagtattctccccccccggggttttctgtgagaagtgggctcgccttcttcccaggagcaccacggggggggacccccttcctcgacgtgctccacccggggggagggttggcaccgggtggcgcgcgaggagccccaacaacaagagggagaggaggacaccaaagagctgggggggccccccaaaaggaggctgctgaaattttgccggccaccacaagactgtgttaaacaccccaaggagatgttttctctggagaacttcaaagaggtttttgatgattggattttcttggtcgccttggagcactagatccccagggaccagaccaccctgataatgagactcccccgagacgcccgaagagcctctgagggcgggaagtacaccgcacgaaaaggagaaccttccccccgccaacacatgaggaagagagctcctgtctcgaggaaaaagaaacaacaagaggtgctccggaacaccagcaaaaaagaaggttccccaaaaaaaataataaatattccccaaaaaaacctgagaaaacaacaaaaattttggccccggggggtatttccccctttaaaaaaaaaggagattaaagggaaaaaaaaaaaacacccaaaaaaaa

SEQ ID NO: 568547 - DNA, 765 bp, Homo sapiens
  misc_feature (17)..(17): n is a, c, g, or t
  misc_feature (65)..(65): n is a, c, g, or t
  misc_feature (95)..(95): n is a, c, g, or t
  misc_feature (111)..(111): n is a, c, g, or t
  misc_feature (159)..(159): n is a, c, g, or t
  misc_feature (185)..(185): n is a, c, g, or t
  misc_feature (257)..(257): n is a, c, g, or t
  misc_feature (298)..(298): n is a, c, g, or t
  misc_feature (310)..(310): n is a, c, g, or t
  misc_feature (331)..(332): n is a, c, g, or t
  misc_feature (357)..(357): n is a, c, g, or t
  misc_feature (597)..(597): n is a, c, g, or t
  misc_feature (648)..(648): n is a, c, g, or t
gtggtgcgctcgcttcncattcagtttcagcgcgagtggtcgtggagaagtctttaggggcagangtggtgaaatgttatcttcattcttcgttnggcttggacgcttggngggaaataatttctaaagcacaaagaggtaaagaagtataatctttcngaaagatattcagtgttcaaaattcnggaatgcaatatcaatacacaatgggcattaggtggatatacacaatacgatgagagcaaattaatttattnggtactttttccattccatatcatcgggggggttgatttcntctttccttttncctccctcagcccagttgggnncggaactgtaccacccgcctccatncaggatttgttcatggcacgtttcacttcatcagaaccatctgaatagatctgctgaaataatctgtttaaagctgcatctccctccaacttttcattcttttcttcttctttgatctcaccaaccaatttatcccaatttcttgtataaggagatgatgatggatataggttctttacatctgctacgaattgttttggcgtaggcacatctccttgcccctctagcttttcccatctnacagcctctggcttttttcagtttaatttcaatctttgttgaaagtacttnaaacgtgctctgttctggtattataggatgaagaagtaccagtttcaaattgtaatcctctccagaaggaagtgtaaccaaagcagacaactctttttctgaaaattccacatttac

SEQ ID NO: 568548 - DNA, 127 bp, Homo sapiens
  misc_feature (39)..(39): n is a, c, g, or t
  misc_feature (43)..(43): n is a, c, g, or t
gctctacaggatcttacactctctatcaaaagctcggtntgtngaatgactcatggctaaaggattggggtctctccttcctataagggtcacctctagcacagaggcctgagtcatgggaaagggt

SEQ ID NO: 568549 - DNA, 806 bp, Homo sapiens
gagcggagtttatttccacccccttccctcctgtttctctctctccttctctctctctctctctctctctttttttcccgccctatctggggactgtgtaggaagagaggaagaacacgagagacagaggattgcattcatccgtatagcgttctctgaaagttatccgtaaactagcagggaccacgtcgaatgctggttgcagccctttacagaatcttgcacacaggaatattaaaacaataatgagatagacagacacatacacaacgccaagctccaccttcccgggccaggtttgtcgcctataaacgctgccctcttgaaccttatatattttcccagagagagagatgtcttatcgggggaaagcacaaatagttccacagcagtcactacagacgcaccgtgctgtggtcgcttcaggcgagtggtgttgaaccttggtacggtgaatcgggccatgcactctagcttcgtggcagggacgacttgtcctgagtggaatccatgcaggtgcgcatcttaacaaagcattgtgctggacggctcccggtgattgatgcatgcccggaggtgggccgaattccagtacgccgcggccacaacagcaccggagctagggagtagaatacccttgcgcgaggcaaatatggggactacccaaaccctcggtaacgggccagaatctggttccctatgcgggggaagttgccattcccggggtgcggaccgaattatgtctgccccggtaccatccgtgggcgttctgtttgcttgttggcgaacccccatctagcgccttc

SEQ ID NO: 568550 - DNA, 216 bp, Homo sapiens
gctcttagaaatccacattcttacacaagacagaccatattagaatctaagcccaacatgcacacttcacattaattaacgcatcagatttttccagaactcgctatcagtcaccattttcatatggggacaatgaagacaagcacacaggaggtagactatcagagtggggctgcgatcaagggcacaaactggtcattaagtcatctgacacta

SEQ ID NO: 568551 - DNA, 155 bp, Homo sapiens
actcagagtatcccgggtcgatcactgtactccagcctgatcacagagcgagactccgtctcagaaaaaaaaaaacggaacacgaaaaagttttgaccagggggtacttaccacaattaaaatactggatggtattggccctatcattctataag

SEQ ID NO: 568552 - DNA, 133 bp, Homo sapiens
cagtctgctctgatatcagatataggccattacaagtacagtactgagacgtgcagtcttcactaagctacctggagttggagacagaaaggccttttgcgttctgtacttttttcccttggatttttagggg

SEQ ID NO: 568553 - DNA, 129 bp, Homo sapiens
gtattcaatacctcttatgtaaccaaaaccatttttaattagtctttaagtacttagtagtatgcatcgatgttcgaactttgcattgagtgcttggcttgatttggcaattaattggctgaagctttt

SEQ ID NO: 568554 - DNA, 158 bp, Homo sapiens
gtgatcgtcacctatcaactcacaatgagaaattacctggccaagcgtggtgactcacgtctgtaatcccggcactttgggagggcaaggcaagagcttgagcttgagcctagacgtttgagaccagcttggtcaacacagcaagaccctgtttcttt

SEQ ID NO: 568555 - DNA, 146 bp, Homo sapiens
  misc_feature (78)..(78): n is a, c, g, or t
cgctggctaccggcactggaggctcgttgcgcgggccatgggtggaatgttctgctggcttagaccgtgatctgctgncaacttaccaagggcaggtcaagatgaccttcttggatccaggaacgctaacatagatcagtaaggaa

SEQ ID NO: 568556 - DNA, 150 bp, Homo sapiens
  misc_feature (142)..(142): n is a, c, g, or t
tccgtgaagcggcttcgcacgtggggtaaagtgtaactgagcctcttcgtgcgaattctgtcggcagcgatgttgtagatatgttgtggccactgagtttagtagctgttccacaaccaaaagctctgtggtccaatctgantgtggaca

SEQ ID NO: 568557 - DNA, 194 bp, Homo sapiens
cccccccccccccccaaaaccccccctttttccaagggtttttggggggggggccctttttttgggtttttggggaccccccctttcccgggggggggggggccccctttttttttcccccccccccccctttttcttttggggcccccccccctgggggttgggattttaaagccttgggtttttttttttta

SEQ ID NO: 568558 - DNA, 431 bp, Homo sapiens
ggctgggccgtattctagagatgaggatatcttccgcataggccagggtccgggcctggtcactccagaatcgctctctgcctgcagtatgccacaagagcagagttgcccagggagccagggtggtcactgacaccccattcccaccaaatacacacactctcccctggtgtactccttagccccttactgggtctcttctgctagcaggagctgctggatatgccatcaggactggctttccctgtgacccctttgtgagtggtgccttgcctggtaatccggagatccagatacagctctgttactgacttatggatatcttaggcaagtcactttcctgttattgggcctcataactgttcattgacttctccatctagaagactagtctgaggccagtttccaactccaattctctgactctaggt

SEQ ID NO: 568559 - DNA, 296 bp, Homo sapiens
ggccccgccgacggccagagcggcatcaccggtgtcgtgctgctggccgaatcgcatctggccgtgcacacctggcccgagttgggcgcggtgacgctggacgttctatgtctgcaactacggcggcgacaacagggacagggcccggaccctgcttgacgcgctggtccgcgtcttcgagcccgccgaagtcagccgccagcagttgctcagaggctgagccgggccgctgcctcgaccccggccgtgtaggcctcctcgaagaccgaatatgccgccaggtcgctgtgcgcgca

SEQ ID NO: 568560 - DNA, 133 bp, Homo sapiens
ggcacagtggcatgcgcctgtgatcccagctacttggaaggctgaggtgagaggatcactcgaggagatggggctgccatgagccatggtctggcacgtactccaaccgggtaacagggcaagaccctatcac

SEQ ID NO: 568561 - DNA, 539 bp, Homo sapiens
  misc_feature (82)..(82): n is a, c, g, or t
cgtgttcaacctcgaactgtgtacctcactagactgcataatcaatcaaaatttctgagtctcattatttaagtttgaaaanagccatcagcccaatcctttagggcaagatcattgtgcagatctcacaaagatccaagaatgtcgccatagtttttcgctatggaccaatagcacaacaaatactcacattttttgacattggtgaaatgtggatatcatgccttggcaaggatgcgctcccccaggcattcttgtaaaatataaaaggacatcccgttcgggagggtgatcaactaaacagtcacgtttgtcaaaccttgtttagctggaaaatgtacgtttcacaagagtgactttacatttgtgtagaacgcgcttctaaaacatggatttaaaaggtaataaatattttgaatagccaagtgttggactttgaatagctataacagtttctttgcaaatctgttaatctgcgatgaaacaggggccctccttttaaaatttaatgaataaacagttcatataaatgcagaaga

SEQ ID NO: 568562 - DNA, 160 bp, Homo sapiens
cggcaccccgccgttcgccccgctctcaggggttgaagttgtgcttgctgctgagggtaaaatgggtcgtgactttaagtactgggtcaatcgctggtgtggacggggaactggtaccattgatccaggaatgggcagtatctcggcgatttgggagtat

SEQ ID NO: 568563 - DNA, 1928 bp, Homo sapiens
  misc_feature (1087)..(1087): n is a, c, g, or t
atgctgagcagggcgtgtggtagtggtggaagctgtgggcatgaggcagcgcgcattgggactgctctgtattgcagcttgagtgacccgtgtgccaggagtgcttgtggggaggggaagtgcctgaggtagtaatctcagctggtctgcagactagggaggatccatctattgcatgaacaagaagtgtgctatcacagttacactatattgagagccacaaaaggacaggttgtaagcatgaatcccgtggtggattcaggattctcctgaaatttaggccattcatgtaaatttcgagactcagtgccgttgggatcctctacaagagatcgcattcagtagaatagtggccttccaatatcgttgggaaaccaattagtgtggagacccttagaagtgaataggacgttccttcaaacaggtcgcaaagcgcagaggtccccattggggagattgtccccaaatagatcattccggggagaatcttaaagtctgaagtcgcagcatccgtcacatcttgttacctttcttccgtagaaaaaagggttgggcaacgactggaaaattaggtcgtcccccaatacaccacgttggtccttccgtagaatagcggcgacacacatagggcggctccaagtaaccgtccgtggaacatagaagttaagagccctaaggcatccaatctcacgtacttatttggggtcgcgttgcgcaactacaattttgcgaggccatgcttgcaaccattccgatggagaggagaggccacaatgcagtacacatttttaaggggtacgcaatacagtgtttcgcaggtgagacactattaactatttaagttccacattctaataccaataaaccatttaaaccaagagaagggctgtgaggagaggagggacgattacaaagatgacgaaagacgcgaggaacaaacttccatagaggcccggagaaaacaccgaggtcggttcgctacatatacttaagtacaacatattattagaacccccgtatgttgcgcactgtacaacgagtcttatacatatacgcaaaggcagatatacccagataggcgacagtngagaaggaagattgcgggaaccactacaactccagaagttagagcacaaatgccaacatgtggatggaatgcatataaccactcgacagtagaaagtatacttaatgatcacagcgtgtagaaaatttatacaccacatttaaggcacccacgtagaaaaaccctttgtagccgagcactaaaatcaagaaatattatcgcacttgagtatatgaaacaaatagtccatcatttaaatgagacggcccacgattatccagataatatcaccaatagtcacaaagtgctgaagtacgtattacaaacccacaatgtaagggaggcccatgtatatgataacaaaaccaatgggtgtgtgtcaccacagtcacgtgacaagacgcggtttcttttcgacgaacaaaacgacgagggaaaataatacctctccataactagagagcacacagaaaatatatgcccggcatccacactacgtgagttggtagggagagaccgactacaactgtgttatcagcgagcgcagagtctaagtatagactactgcggagtgcccccgacggaggctcaatagactaagcgttggagacagagatagtaagctagctctcgctccctcacatagggaggagcgtagaaagcgacgtaagaggctcgacataacaagagtagtacggtcgaccaaacagacagacgaagaagaacgtactagagaagcagagcatagaccagctagtaataagaagaaggacgacagagaagagaaaattatgagttactagctgttttgtatcgagtagtttgttatgtatattattaggtaatgaatcggtgtgagcga

SEQ ID NO: 568564 - DNA, 2755 bp, Homo sapiens
cggacgcgtgggtgtgtttgtgttttgtatttttagtagagacagggtttcactatgttggccaggccggtctcgaactcctgacctcaggtgatccacccgcttcagtctcccaaagtgctgggattacaggcgtgagtcaccgcgcccggcccctgaagcatagttttcaatgaagagtcggcttggaaagcggtaggatttgtcccaacttcccagggcgtagtggaaggtgaaataagaccacagatttatcaacctaatccttagagacaacattcataaacatgaactgtcagttcatccaaccttctctccttttcagatgaggcctaaagagattaagtgacttgttcacttccattaatttttggtggatataggccgggtatggtggtgcacacctgtaatcccagcattttgggaggccaaggcgggcggatcacaaggtcaggagttcagtaccagcctggccaaaatagtgaaaccccgtctctaccaaaaatacaaaaaattagcaggacatagtagcaggcacctgtaatcccagctacttgggaggctgaggcgggagaattgcttgaacctaggaggcagaggttgcagtgagccgagattacaccactgcgctccagcctgggcaacagagtaagaatccatctcaaaaaaaaaaaattggtggatatagtatttccctaaagccctggagaacaggtggtatatacagtattacatagtgctatgctgtctgatattgtgtgtacagttaccttaacactctgtacttgggtaactttgataatgcagatgtagaaattggcagtggtggtaatgatgatgagaatgatcatgaaaatcatgagagagcagctacctgacatttattgagcacttactgtatgctgggcaacatgcttacacctattagctgtaacacaataattatattattgccccatttgacagatgaagaaagtgaatttagaggttaggcttgcccagtgtcacacagctggaagtggcagagttagcattctagctcacatttgcctaatttcagagcctgagttctaaattatgaggcttaccactaattattggggagggaaaggatagtatttatgatgctgagaaggaaagttcctgagtggtaccaggaatgacctggaagagtgaaaagccctaagagggattggaccatccagtgagcataggggattgtgtagatcaggtgaaaattggacctgcctcttcaacccacaagagaaagtgcagggcggagaagaaacctcaaggaacggagttgagctttgaaaggagaagttggctacaggtgctggagagggctgatggaatgtatttggggcagaggttgagatcctggccctcccatgtcacacaccctaaattgaggccacatggctgtcagtgaaaacaaacccaggtgctggtttcaataaaaggtgagactaggacacaaagaagggtagggagggcagagaacagctaaggtctgaacagctctgcgaagtaggtacatggctcccaggattatcagacacatttttcacatgggaagacagaattttcaagatgttaagtgactgttctaaatcattcagctgagactttcagtccccatatttgggatatttgatgtagagttatacaggtttggctacagaaggcatgactcaggcagagagaattagaggagccaggaagagggcagaataggcacagcctctaaaccagcaaccgtgctcacagcagcccagaagcccagggggagaacatgtgtgttcaaggtggttgcatgttcatggtaataattacactaatacccaataacagagaggttaccttgtggttatgagcctgggctctggagccagcctgcctcaagtcctacctctgcatcttctcgctatttatgttctgtcagattgttttccccctctgggccccagttgcctcttttgcaaaattagaataataattatacctcataggatgttgtaagagtttattaagcatgtagagcaggagtcagaaaccttttctattaaggactcaatagtaaatgtttttggcatttatggccatatagcgtcagtcatgactacttaactctgccataagttggtagaaaattcaggcatttaaaaaatctgtttgccataggaaatttgcagaagcccacagcaggcaaatgtctcttgatttataaatgaaattgtataaaatagtagccatagaaagtagacttctgattccaaattatcagcaaagtcatgcagaaaacaggcaactttttaaaaaatataaggttttagtctgtgtaaggtgattataagaggaatattccttctacgggtctgcttagctttctcctaaccactgcttttgatttatccagttcatcatcttttttttaaatagaaaatataatttggcggctgggcacagtggctcacacctgtagtcccagcactttggggggccgaggctggcggatcacgaggtcaggagatcgagaccatcctggctaacacggtgaaaccccatctctactaaaaacacaaaacaacaacaacaacaaaaaaatagccgggcgtggtggtgggcacctgtattcccagctactcgggaggctgaggcaggagaatggcgtgaacctgggaggcggagcttgcagtgagcagagatcgtgccacagcactccagcctgagcgactgaactagactctgtctc

SEQ ID NO: 568565 - DNA, 670 bp, Homo sapiens
  misc_feature (24)..(24): n is a, c, g, or t
  misc_feature (257)..(257): n is a, c, g, or t
  misc_feature (431)..(431): n is a, c, g, or t
actctagaggacccccacaccacntgagtcagtacgcgaatcagccgcgcccgggcaccggggtgcgtgcagccgcggtaaatctgttcggccagcgccagctcggcgcagcgttcgcaatactggccgatctggaacaacagcttggcgcggcgcttttccagccaggggttgtcggtacacaacgtagcgacctgcgccaacaccgtatccagcgcttcaccggcttcaaaggcttgctggcactggtgcaggancagaaacccgtgcacatcctcacggctgcgtaacccacgcgactcggcgcagaactcgactttttcataggtgtagatgcccagatctgccagcacgaattccgaccagtcctggtgcagattgccgaagaacatcaggcgcaggcgatcacacaactccattaccgtcaggcngtagagcgcgtcgtctacgtcggggcaccactgggcaaagctgcgcgactcggtaaattgcgcggccaaaggttcaagccatcggccttgttacccttgggttgatcgatccagggcttgaaggcgccgagcattcactcttttgcagcagcgcgaacagggtggcaacgcagcgggctttgatcctccacccatcccagctcacgcaagggccccgccgccgcatgggactcagggat

SEQ ID NO: 568566 - DNA, 153 bp, Homo sapiens
ctacttgttgttcaaagagagcggcgtgtccactagttgtgcttcagcctgggaaaaccttgattctctttgggcccccaagatctacagagggtctccctcatcctggcctcctctatccagtcccaggtgccaagcacctgtgggtccagt

SEQ ID NO: 568567 - DNA, 204 bp, Homo sapiens
attgcccattccgattgtggatcctgacacgggattgtgggggagttgagcagcagcaggaactcattctcaacatcttcttcttcaggcgctcgatggcccggctctggcctttgttgggtttctcccttctggatatcactcttgaggggagagatcttcatcttcatgtcctccagctcatggtctcggacatgggtgcag

SEQ ID NO: 568568 - DNA, 108 bp, Homo sapiens
tgtcatatgtaacatgatatataatcatttaaattactctgataaaataagacacagaagtagctgttgggtttctggcatgagccctttggattctgtgtttagcat

SEQ ID NO: 568569 - DNA, 116 bp, Homo sapiens
atagcggagccggatttaatgaagaaagcggcgagcgcgttgtcgccgcccaaccaacagggtcaatccagtacccgacgcccatcaagatggcggcggcgggcagcgtggcgacc

SEQ ID NO: 568570 - DNA, 537 bp, Homo sapiens
cggtgctggggcttcttatcctgaaggggctgcacgagggaaggcttagccatgtcgtgcttgatcagaagggggatcagcaccgcgaaagcgccaggggccattgtgccctacagtcaagctgtattagtcgacaggaccatttacatttgaggacagataggcatggacccttcaagtggacagcttgtgtcaggaggggtagcagaagaagcttaacaagctcttacatggtgtgaaattctgaaagctgcaggctgtgacttcactaacggggcgtacaaacaggatttcaagagttattttcctgctagagctgcttaccaaggtggtgctttacccacaggcagccgaattgttgaagcagtagctattcaagggccactgacaacggcatcactataagtgggcccagtgctgtgtagtctggaattgccaacattttaatttctacaattgatgcgacatcttaattaaccgtgtaattctcacacatgatgacagtgtgagcttgatgaatatatctggctatttggg

SEQ ID NO: 568571 - DNA, 236 bp, Homo sapiens
ttaggttttcttttcaaaaccgttcccggaagttttatttgttgaagtaactttcaagtggttggataccccgttattaacccacccaaccaaccattcttccctttaagtttttccgacctttggaggaccgtttcttggtccgtttcaaaattttcctttttttaatgttttaaaagtgggtttatttcaaccccttcactcccggttggtgaccgggcaaattcctgtttcca

SEQ ID NO: 568572 - DNA, 230 bp, Homo sapiens
cagacgtcggtgtacagaaatagaactctgtaagctatttattttgagacagggttgcacactgtcgcccagactagagctggagtccaatggcatgatcgtagcccaccgcattcttgaactcctgacctcaggtgatcctcccgacttggcctcccaaagggaggattacaggcatgagccactgtgcccggctgcataattatgggcactgatctataggagtggtg

SEQ ID NO: 568573 - DNA, 309 bp, Homo sapiens
tgctaaaattctctggggaaagctactgccacggaccacggtactgcgtgctcgctgctgaatgctcaggcagagctcataaggcaaccaacagagtcctgaccccacatgcctttcatgtcgcaacacagctgcgaaggaataccaggcgttgaggaccacaaattctagcgagaatatgagtcaccattaggcaattcatgtacattctttatttaccaagaccctcactaaacaagtacatcgttacaaatgcatgtacctttagatcctgcaatccacattatggaaattatcctagagataact

SEQ ID NO: 568574 - DNA, 226 bp, Homo sapiens
tgcagccgacagtgttaggctctgtcagaataatcgtttagactcatgagaaggatcaatgagacatcgatctcagacgcagtgtgattagtgcaagctcagtcatcattgtgttcccctcctaggaagtccgctggtcacaaggtgcacgtctggaggtcatcaacagagcatgttgctttgactgggtctctcgctctcttgatagagctcaagtgcatttcat

SEQ ID NO: 568575 - DNA, 310 bp, Homo sapiens
accctacctctgcaagacatcaagaaggggaagaaaaaggaccccaacgctcctaattgccaccatctgccttattcctgtatcgctctgaacatcgcccgaagattataagcgagcaccctggcctatccattggggatactgcaaagaaatggggcgaaatgtggtctgagcagccagccaaagataaacaaccatatgaacagatggcagcttagctacaggcgaaatccgaaaaggatatcgatgcatatcgtgccaagggcaagagtgaagcaagaaagaagggacctggcaggccaacacgctc

SEQ ID NO: 568576 - DNA, 446 bp, Homo sapiens
gagacttagaagggctccgctgtctggttgagttgcgcctccaactggagtcactgaaccatcacattatcaaatatgtcgactttattcattgcagataacagagggcgtagaatcaggctcgtccccaggctatgcatgtctgttcctgaggcttgttcggtgccatttaaaaatcccctgaaatagtcgggattaggaggatggacatacatcactgtcatcagcactgctgcctgtcatgcctttaggaagcctatatttttgtcaaggaagctaaagttgagtgtgattaaacaaccaattcaagtttacacagtaagtggcagatccaggatccaacctaagctggcattcgttcatgtctctgtaccactgctctgtctcagatgatgtctcctttgaggtgtagtcgacgcggccgcgaatttagtagtagtaggcgg

SEQ ID NO: 568577 - DNA, 1970 bp, Homo sapiens
  misc_feature (15)..(15): n is a, c, g, or t
  misc_feature (20)..(21): n is a, c, g, or t
  misc_feature (23)..(23): n is a, c, g, or t
tggctaagtgaggcngtggnntnaagttccgggctacagcagccgacgccgagaggcaccgtttcttcttaaaagagaaacgctgcgcgcgcgaggtgggcccctgtcttccagcagctccgggcctgctcgctaggcccgggaggcgcaggcgcaggcgcagtgggggtgagggcgcgtgggggcgcacagcctctggtgcacatggcttcctccccggcggtggacgtgtcctgcaggcggcgggagaagcggcggcagctggacgcgcgccgcagcaagtgccgcatccgcctgggcggccacatggagcagtggtgcctcctcaaggagcggctgggcttctccctgcactcgcagctcgccaagttcctgttggaccggtacacttcttcaggctgtgtcctctgtgcaggtcctgagcctttgcctccaaaaggtctgcagtatctggtgctcttgtctcatgcccacagccgagagtgcagcctggtgcccgggcttcgggggcctggcggccaagatggggggcttgtgtgggagtgctcagcaggccataccttctcctggggaccctctttgagccctacaccttcagaggcacccaagccagcctcccttccacatactactcggagaagttggtgttccgaggccacgagtgggcaggagcttgcagatttggaatctgagcatgatgagaggactcaagaggccaggttgcccaggagggtgggacccccaccagagaccttcccacctccaggagaggaagagggtgaggaagaagaggacaatgatgaggatgaagaggagatgctcagtgatgccagcttatggacctacagctcctccccagatgatagtgagcctgatgcccccagactactgccttcccctgtcacctgcacacctaaagagggggagacaccaccagcccctgcagcactctccagtcctcttgctgtgccggccttgtcagcatcctcattgagttccagagctcctccacctgcagaagtcagggtgcagccacagctcagcaggacccctcaagcggcccagcagactgaggccctggccagcactgggagtcaggcccagtctgctccaaccccggcctgggatgaggacactgcacaaattggccccaagagaattaggaaagctgccaaaagagagctgatgccttgtgacttccctggctgtggaaggatcttctccaaccggcagtatttgaatcaccacaaaaagtaccagcacatccaccagaagtctttctcctgcccagagccagcctgtgggaagtctttcaactttaagaaacacctgaaggagcacatgaagctgcacagtgacacccgggactacatctgtgagttctgcgcccggtctttccgcactagcagcaaccttgtcatccacagacgtatccacactggagaaaaacccctgcagtgtgagatatgcgggtttacctgccgccagaaggcttccctgaactggcaccagcgcaagcatgcagagacggtggctgccttgcgcttcccctgtgaattctgcggcaagcgctttgagaagccagacagtgttgcagcccaccgtagcaaaagtcacccagccctgcttctagcccctcaagagtcacccagtggtcccctagagccctgtcccagcatctctgcccctgggcctctgggatccagcgaggggtccaggccctctgcatctcctcaggctccaaccctgcttcctcagcaatgagctctcctccagctttggctttgggaagccagactccagggactgaaaaggagcaacaaggagagggtctgcttgagaaatgccagatgcttggtccccaggaactaaggcgacagagtgcagggtgggggcaagactgggctgtaggggagctggactactttagtcttcctaaaggacaaaataaacagtattttatgcaggca

SEQ ID NO: 568578 - DNA, 2889 bp, Homo sapiens
agcgggggggctctgggcagcctgggaactgccattgggattagtccgctccactcactgtcagcattaagtgggggtgcccaagacggggtggatggggggcgccctccagacctctgaccacggcctcaccgccactcgacccaactatgaagagcgcccccagctgcacgccaggacacgacctttccttcccctagaaaccagtaaaggccgctgccctattcaagatgaaatgtgtggaccgcccccagcccagttgaaatttcccgtgaaagtctctcgccccttccccacagctccacttcagtggactggagggcgcaggcctttgttctgactgcttctgtctgcctgcctcccacccgacgacactcacatggtagcgctgagcttcaacaccctgtatcatagaaggacggggtttggctccacacctgccactgctattgaaatagtttagtcttgccccagttcactgatgaggaaactgaggccctaacggcaggtggagccgggtccccgacccccgagatcggcagggcgctgaagacgtcccttccaccctccagcctctggtgcacatggcttcctccccggcggtggacgtgtcctgcaggcggcgggagaagcggcggcagctggacgcgcgccgcagcaagtgccgcatccgcctgggcggccacatggagcagtggtgcctcctcaaggagcggctgggcttctccctgcactcgcagctcgccaagttcctgttggaccggtgggcctgtcctgctgctcttttccaccctcaggtttctcactttaccaggacggcctgtgtgacttgtggcctccgagggtcctgctcccctcctcatggtctcagcgaatagcggcccttagggctggccccttacatgtgtgagtgcccagggctgagggtggctggccacctgagtcctgacctgcctcttctcctgctggcaggtacacttcttcaggctgtgtcctctgtgcaggtaggtaggggatggcagggggtgagagccagagggaagagggaccacagggtgacccagaaacaccctcctttcaaagggagccctgagtaagtttgggaagggtggggtgagttggggagcacagggtagtttgatggaggcaacctctgggtggggaagggagcaatgtctcaggatctagtgtgtctaggttctgaagaatgataaattggactggggctgaggttgccctggggtttgagggaacagggctccctgggtatggctctccagggtaagaggaggagacttcccagttcagcctgactgcttcccccacccctccaggtcctgagcctttgcctccaaaaggtctgcagtatctggtgctcttgtctcatgcccacagccgagagtgcagcctggtgcccgggcttcgggggcctggcggccaagatggggggcttgtgtgggagtgctcagcaggccataccttctcctggggaccctctttgagccctacaccttcagaggcacccaagccagcctcccttccacatactactcggagaagttggtgttccgaggccacgagtgggcaggagcttgcagatttggaatctgagcatgatgagaggactcaagaggccaggttgcccaggagggtgggacccccaccagagaccttcccacctccaggagaggaagagggtgaggaagaagaggacaatgatgaggatgaagaggagatgctcagtgatgccagcttatggacctacagctcctccccagatgatagtgagcctgatgcccccagactactgccttcccctgtcacctgcacacctaaagagggggagacaccaccagcccctgcagcactctccagtcctcttgctgtgccggccttgtcagcatcctcattgagttccagagctcctccacctgcagaagtcagggtgcagccacagctcagcaggacccctcaagcggcccagcagactgaggccctggccagcactgggagtcaggcccagtctgctccaaccccggcctgggatgaggacactgcacaaattggccccaagagaattaggaaagctgccaaaagagagctgatgccttgtgacttccctggctgtggaaggatcttctccaaccggcagtatttgaatcaccacaaaaagtaccagcacatccaccagaagtctttctcctgcccagagccagcctgtgggaagtctttcaactttaagaaacacctgaaggagcacatgaagctgcacagtgacacccgggactacatctgtgagttctgcgcccggtctttccgcactagcagcaaccttgtcatccacagacgtatccacactggagaaaaacccctgcagtgtgagatatgcgggtttacctgccgccagaaggcttccctgaactggcaccagcgcaagcatgcagagacggtggctgccttgcgcttcccctgtgaattctgcggcaagcgctttgagaagccagacagtgttgcagcccaccgtagcaaaagtcacccagccctgcttctagcccctcaagagtcacccagtggtcccctagagccctgtcccagcatctctgcccctgggcctctgggatccagcgaggggtccaggccctctgcatctcctcaggctccaaccctgcttcctcagcaatgagctctcctccagctttggctttgggaagccagactccagggactgaaaaggagcaacaaggagagggtctgcttgagaaatgccagatgcttggtccccaggaactaaggcgacagagtgcagggtgggggcaagactgggctgtaggggagctggactactttagtcttcctaaaggacaaaataaacagtattttatgcaggca

SEQ ID NO: 568579 - DNA, 1078 bp, Homo sapiens
  misc_feature (104)..(104): n is a, c, g, or t
cgacaaaatggacatctatcgtcctcacaaagccacctgctgaggagatgaccaagtttccacagcgatgacatacacttacctcctctgccagctccatccgntccagaataacatgtcgtgagtacagccataggacgaaatcgcaggaaggattcgaacgttgtggtgacggactcgtccagttgttgcgactaggaactcgtatgagctactcgtcagttagtcatacgtagcgtggcctcatgtgcgcccagctgccttgggaccaccttcacatcaccagcatctacgtacagtgcacaactcagcctgatgtaaattcgaggcatgcgaggccatggactcaatgccaaacgtaagtctccgagagacatcattggactttctgttaacagtccatgatatcggtcgttgcgtcatcctggatctgataatgcttatcaccatagggttgcggctacattgacattgcattctctcaaccatggctgcaagtgcgttgtgacagcacggaccctatctcaaactcatgtggatccgaggcttcattgcaactgggttgctactcctctctctataatagatactggggacggacgattacgtattcccctagggacatcttgcgggtaccctaagcatgtgaataatactggcgcgcttaggccacaagtggcttgatatcataggtgttaacttaaatcgcttctaccacgtgacatagatgtacggtaacggcctatgagaggccattatctccatttgccaggctacatagtcccattgggtcagatacgccatagttcgcatcctaataactgaggtcaatctagtgtagggctccataactcgcgtatctggcgagccttaggaaaaaagtcaggcataaaacaaaccatctaagggataagccctgcgcgatggcctattggctaaggactattctcagaactcgtgggtggggcttggaacagagggctggtcacccaaacttttaggtaagccggtgctggcctatatacatcttgggcccggaggggcactcctaagaatcctccagaggcgagacttggga

SEQ ID NO: 568580 - DNA, 105 bp, Homo sapiens
tgatctagaggatcccgtaagctatcgaatatctagtagctgtcctcgaagtttcctcaggatgctggcgtgtggggacccgacgcaccccgccacgcagtttta

SEQ ID NO: 568581 - DNA, 1738 bp, Homo sapiens
  misc_feature (15)..(15): n is a, c, g, or t
  misc_feature (20)..(21): n is a, c, g, or t
  misc_feature (23)..(23): n is a, c, g, or t
tggctaagtgaggcngtggnntnaagttccgggctacagcagccgacgccgagaggcaccgtttcttcttaaaagagaaacgctgcgcgcgcgagcctctggtgcacatggcttcctccccggcggtggacgtgtcctgcaggcggcgggagaagcggcggcagctggacgcgcgccgcagcaagtgccgcatccgcctgggcggccacatggagcagtggtgcctcctcaaggagcggctgggcttctccctgcactcgcagctcgccaagttcctgttggaccggtacacttcttcaggctgtgtcctctgtgcaggtcctgagcctttgcctccaaaaggtctgcagtatctggtgctcttgtctcatgcccacagccgagagtgcagcctggtgcccgggcttcgggggcctggcggccaagatggggggcttgtgtgggagtgctcagcaggccataccttctcctggggaccctctttgagccctacaccttcagaggcacccaagccagcctcccttccacatactactcggagaagttggtgttccgaggccacgagtgggcaggagcttgcagatttggaatctgagcatgatgagaggactcaagaggccaggttgcccagtagtgagcctgatgcccccagactactgccttcccctgtcacctgcacacctaaagagggggagacaccaccagcccctgcagcactctccagtcctcttgctgtgccggccttgtcagcatcctcattgagttccagagctcctccacctgcagaagtcagggtgcagccacagctcagcaggacccctcaagcggcccagcagactgaggccctggccagcactgggagtcaggcccagtctgctccaaccccggcctgggatgaggacactgcacaaattggccccaagagaattaggaaagctgccaaaagagagctgatgccttgtgacttccctggctgtggaaggatcttctccaaccggcagtatttgaatcaccacaaaaagtaccagcacatccaccagaagtctttctcctgcccagagccagcctgtgggaagtctttcaactttaagaaacacctgaaggagcacatgaagctgcacagtgacacccgggactacatctgtgagttctgcgcccggtctttccgcactagcagcaaccttgtcatccacagacgtatccacactggagaaaaacccctgcagtgtgagatatgcgggtttacctgccgccagaaggcttccctgaactggcaccagcgcaagcatgcagagacggtggctgccttgcgcttcccctgtgaattctgcggcaagcgctttgagaagccagacagtgttgcagcccaccgtagcaaaagtcacccagccctgcttctagcccctcaagagtcacccagtggtcccctagagccctgtcccagcatctctgcccctgggcctctgggatccagcgaggggtccaggccctctgcatctcctcaggctccaaccctgcttcctcagcaatgagctctcctccagctttggctttgggaagccagactccagggactgaaaaggagcaacaaggagagggtctgcttgagaaatgccagatgcttggtccccaggaactaaggcgacagagtgcagggtgggggcaagactgggctgtaggggagctggactactttagtcttcctaaaggacaaaataaacagtattttatgcaggca

SEQ ID NO: 568582 - DNA, 446 bp, Homo sapiens
agctctaccatggcgtgtccgtctcagaacagctcctttgggggtctcggtttggatatagccccactgtgcggggtctgacgcagcggagctcctagcggggtctcagttggctctccctaactagtaggaagagtcttgcttaaggagacttctccatcaggaagatttcagggagatttctcagatggagaataggaggatatgtttggaagggatactcttggagttgttggatagggatcagatttggaatccttctgtctgtctcatctttgcgggtttttgtatatgtgaaggggacctctgaagaaattgcttatggaagtccagcagacttaactcagaacccccccttatttatctggtcacatttggtgatccctaaagaaagctcaacaggcctgtcttagggtggctattcgctcttcaccttgaccagagat

SEQ ID NO: 568583 - DNA, 322 bp, Homo sapiens
tcgtcgaagaacaacggcacaaaacaaaaccctcgaggggccactcatcctgtctttactctcttttcccttctctattctttcacctagaagccctcatttgaccagtgaactcctatgccctcttgacccgcacattagcttggcgatttccttgttctgctaattcctaattctgcttcccatgtatttgtgatttcttgtttttgaccactttttatgcctggcactgtggtgcttgaaacccgatcttttccctggggaatgtttcatacgtttttattcattctatcacttcattatgccgttcttcttcgacgaa

SEQ ID NO: 568584 - DNA, 1463 bp, Homo sapiens
  misc_feature (15)..(15): n is a, c, g, or t
  misc_feature (20)..(21): n is a, c, g, or t
  misc_feature (23)..(23): n is a, c, g, or t
tggctaagtgaggcngtggnntnaagttccgggctacagcagccgacgccgagaggcaccgtttcttcttaaaagagaaacgctgcgcgcgcgaggtgggcccctgtcttccagcagctccgggcctgctcgctaggcccgggaggcgcaggcgcaggcgcagtgggggtgagggcgcgtgggggcgcacagcctctggtgcacatggcttcctccccggcggtggacgtgtcctgcaggcggcgggagaagcggcggcagctggacgcgcgccgcagcaagtgccgcatccgcctgggcggccacatggagcagtggtgcctcctcaaggagcggctgggcttctccctgcactcgcagctcgccaagttcctgttggaccggtacacttcttcaggctgtgtcctctgtgcaggtcctgagcctttgcctccaaaaggtctgcagtatctggtgctcttgtctcatgcccaagcatcctcattgagttccagagctcctccacctgcagaagtcagggtgcagccacagctcagcaggacccctcaagcggcccagcagactgaggccctggccagcactgggagtcaggcccagtctgctccaaccccggcctgggatgaggacactgcacaaattggccccaagagaattaggaaagctgccaaaagagagctgatgccttgtgacttccctggctgtggaaggatcttctccaaccggcagtatttgaatcaccacaaaaagtaccagcacatccaccagaagtctttctcctgcccagagccagcctgtgggaagtctttcaactttaagaaacacctgaaggagcacatgaagctgcacagtgacacccgggactacatctgtgagttctgcgcccggtctttccgcactagcagcaaccttgtcatccacagacgtatccacactggagaaaaacccctgcagtgtgagatatgcgggtttacctgccgccagaaggcttccctgaactggcaccagcgcaagcatgcagagacggtggctgccttgcgcttcccctgtgaattctgcggcaagcgctttgagaagccagacagtgttgcagcccaccgtagcaaaagtcacccagccctgcttctagcccctcaagagtcacccagtggtcccctagagccctgtcccagcatctctgcccctgggcctctgggatccagcgaggggtccaggccctctgcatctcctcaggctccaaccctgcttcctcagcaatgagctctcctccagctttggctttgggaagccagactccagggactgaaaaggagcaacaaggagagggtctgcttgagaaatgccagatgcttggtccccaggaactaaggcgacagagtgcagggtgggggcaagactgggctgtaggggagctggactactttagtcttcctaaaggacaaaataaacagtattttatgcaggca

SEQ ID NO: 568585 - DNA, 1301 bp, Homo sapiens
gttgtttcaagtttgagatcttttcagtttaggggctagggtcgggcaggggatggctgactgcccagaaagttaatgccatcttcctctttgttctcctttcagtagtgagcctgatgcccccagactactgccttcccctgtcacctgcacacctaaagagggggagacaccaccagcccctgcagcactctccagtcctcttgctgtgccggccttgtcagcatcctcattgagttccagagctcctccacctgcagaagtcagggtgcagccacagctcagcaggacccctcaagcggcccagcagactgaggccctggccaggtaacctgatggctgagacagaaagggcaggggcgtcctgggatgtggccctccctcgaggccctctgctccctctttgctgcccgtagcactgggagtcaggcccagtctgctccaaccccggcctgggatgaggacactgcacaaattggccccaagagaattaggaaagctgccaaaagagagctgatgccttgtgacttccctggctgtggaaggatcttctccaaccggcagtatttgaatcaccacaaaaagtaccagcacatccaccagaagtctttctcctgcccagagccagcctgtgggaagtctttcaactttaagaaacacctgaaggagcacatgaagctgcacagtgacacccgggactacatctgtgagttctgcgcccggtctttccgcactagcagcaaccttgtcatccacagacgtatccacactggagaaaaacccctgcagtgtgagatatgcgggtttacctgccgccagaaggcttccctgaactggcaccagcgcaagcatgcagagacggtggctgccttgcgcttcccctgtgaattctgcggcaagcgctttgagaagccagacagtgttgcagcccaccgtagcaaaagtcacccagccctgcttctagcccctcaagagtcacccagtggtcccctagagccctgtcccagcatctctgcccctgggcctctgggatccagcgaggggtccaggccctctgcatctcctcaggctccaaccctgcttcctcagcaatgagctctcctccagctttggctttgggaagccagactccagggactgaaaaggagcaacaaggagagggtctgcttgagaaatgccagatgcttggtccccaggaactaaggcgacagagtgcagggtgggggcaagactgggctgtaggggagctggactactttagtcttcctaaaggacaaaataaacagtattttatgcaggca

SEQ ID NO: 568586 - DNA, 1113 bp, Homo sapiens
  misc_feature (2)..(2): n is a, c, g, or t
  misc_feature (64)..(64): n is a, c, g, or t
  misc_feature (79)..(79): n is a, c, g, or t
  misc_feature (103)..(103): n is a, c, g, or t
  misc_feature (116)..(116): n is a, c, g, or t
  misc_feature (131)..(131): n is a, c, g, or t
  misc_feature (147)..(147): n is a, c, g, or t
  misc_feature (156)..(156): n is a, c, g, or t
  misc_feature (170)..(170): n is a, c, g, or t
  misc_feature (193)..(193): n is a, c, g, or t
  misc_feature (204)..(204): n is a, c, g, or t
  misc_feature (243)..(243): n is a, c, g, or t
  misc_feature (246)..(246): n is a, c, g, or t
  misc_feature (248)..(248): n is a, c, g, or t
  misc_feature (252)..(252): n is a, c, g, or t
  misc_feature (256)..(256): n is a, c, g, or t
  misc_feature (278)..(278): n is a, c, g, or t
  misc_feature (281)..(281): n is a, c, g, or t
  misc_feature (283)..(283): n is a, c, g, or t
  misc_feature (285)..(285): n is a, c, g, or t
  misc_feature (287)..(287): n is a, c, g, or t
  misc_feature (289)..(290): n is a, c, g, or t
  misc_feature (292)..(292): n is a, c, g, or t
  misc_feature (300)..(300): n is a, c, g, or t
  misc_feature (311)..(312): n is a, c, g, or t
  misc_feature (315)..(315): n is a, c, g, or t
  misc_feature (321)..(321): n is a, c, g, or t
  misc_feature (337)..(337): n is a, c, g, or t
  misc_feature (350)..(350): n is a, c, g, or t
  misc_feature (359)..(359): n is a, c, g, or t
  misc_feature (364)..(364): n is a, c, g, or t
  misc_feature (367)..(367): n is a, c, g, or t
  misc_feature (370)..(370): n is a, c, g, or t
  misc_feature (374)..(374): n is a, c, g, or t
  misc_feature (376)..(376): n is a, c, g, or t
  misc_feature (387)..(387): n is a, c, g, or t
  misc_feature (393)..(393): n is a, c, g, or t
  misc_feature (404)..(404): n is a, c, g, or t
  misc_feature (406)..(406): n is a, c, g, or t
  misc_feature (412)..(412): n is a, c, g, or t
  misc_feature (421)..(421): n is a, c, g, or t
  misc_feature (430)..(430): n is a, c, g, or t
  misc_feature (436)..(436): n is a, c, g, or t
  misc_feature (449)..(449): n is a, c, g, or t
  misc_feature (455)..(455): n is a, c, g, or t
  misc_feature (492)..(492): n is a, c, g, or t
  misc_feature (508)..(508): n is a, c, g, or t
  misc_feature (511)..(511): n is a, c, g, or t
  misc_feature (519)..(519): n is a, c, g, or t
  misc_feature (525)..(525): n is a, c, g, or t
  misc_feature (529)..(529): n is a, c, g, or t
  misc_feature (558)..(558): n is a, c, g, or t
  misc_feature (572)..(572): n is a, c, g, or t
  misc_feature (629)..(629): n is a, c, g, or t
  misc_feature (655)..(655): n is a, c, g, or t
  misc_feature (684)..(684): n is a, c, g, or t
  misc_feature (686)..(686): n is a, c, g, or t
  misc_feature (703)..(703): n is a, c, g, or t
  misc_feature (712)..(712): n is a, c, g, or t
  misc_feature (729)..(729): n is a, c, g, or t
  misc_feature (733)..(733): n is a, c, g, or t
  misc_feature (737)..(737): n is a, c, g, or t
  misc_feature (746)..(746): n is a, c, g, or t
  misc_feature (750)..(750): n is a, c, g, or t
  misc_feature (757)..(757): n is a, c, g, or t
  misc_feature (764)..(764): n is a, c, g, or t
tngcttcccctcttttgcctgccccgttagcaacttggggagttcaaggcccccaagtcttgcntccaaaccccccggnccttggggattgaaggacaacttncacaaaaatttgncccccaaaagagaantttagggaaaagcttnccaaaaaangaggagcttgaatnccttttgtgacattccccttggntttgtgggaanggattctttcttccaaacccgggcaaggtatttttgaangtnanccancaanaaaatgtacccagcaacaagcncancntnangnngntttttttntccttgccccnngangcgcangcccttgttggggaangttctttttcaanctttttaangaaancanccnttgnangggaggcacanttgaangtttgcaacangntgacanccccggggnacatacaantcttgntgaggttcttgcngccccngggtccttttcccgcaacttagcaagcaaaccctttngtcaattccaacaagnacngtattccnacaacntggnaggaaaaaaaccccccttgcaaggttgtngaggattattagcnggggttttacacttgtccggccaaggaaagggctttccccttgaaacttgggcaacncaggcgcaaagcaatagcaagaagancaggtagagcatgcactatagcagcttcncnatgtgaaattcatgcangcaaagcancatttgaaaaaccaaanagtnttgnagcccaccntagnaaaaatnacaccanccctgcttctagcccctcaagagtcacccagtggtcccctagagccctgtcccagcatctctgcccctgggcctctgggatccagcgaggggtccaggccctctgcatctcctcaggctccaaccctgcttcctcagcaatgagctctcctccagctttggctttgggaagccagactccagggactgaaaaggagcaacaaggagagggtctgcttgagaaatgccagatgcttggtccccaggaactaaggcgacagagtgcagggtgggggcaagactgggctgtaggggagctggactactttagtcttcctaaaggacaaaataaacagtattttatgcaggca

SEQ ID NO: 568587 - DNA, 2951 bp, Homo sapiens
agcgggggggctctgggcagcctgggaactgccattgggattagtccgctccactcactgtcagcattaagtgggggtgcccaagacggggtggatggggggcgccctccagacctctgaccacggcctcaccgccactcgacccaactatgaagagcgcccccagctgcacgccaggacacgacctttccttcccctagaaaccagtaaaggccgctgccctattcaagatgaaatgtgtggaccgcccccagcccagttgaaatttcccgtgaaagtctctcgccccttccccacagctccacttcagtggactggagggcgcaggcctttgttctgactgcttctgtctgcctgcctcccacccgacgacactcacatggtagcgctgagcttcaacaccctgtatcatagaaggacggggtttggctccacacctgccactgctattgaaatagtttagtcttgccccagttcactgatgaggaaactgaggccctaacggcaggtggagccgggtccccgacccccgagatcggcagggcgctgaagacgtcccttccaccctccagcctctggtgcacatggcttcctccccggcggtggacgtgtcctgcaggcggcgggagaagcggcggcagctggacgcgcgccgcagcaagtgccgcatccgcctgggcggccacatggagcagtggtgcctcctcaaggagcggctgggcttctccctgcactcgcagctcgccaagttcctgttggaccggttaggggccgggagaagggcttgggggagggtacccaggcagcagcccctagcctcctctccagggcctgtcctgctgctcttttccaccctcaggtttctcactttaccaggacggcctgtgtgacttgtggcctccgagggtcctgctcccctcctcatggtctcagcgaatagcggcccttagggctggccccttacatgtgtgagtgcccagggctgagggtggctggccacctgagtcctgacctgcctcttctcctgctggcaggtacacttcttcaggctgtgtcctctgtgcaggtaggtaggggatggcagggggtgagagccagagggaagagggaccacagggtgacccagaaacaccctcctttcaaagggagccctgagtaagtttgggaagggtggggtgagttggggagcacagggtagtttgatggaggcaacctctgggtggggaagggagcaatgtctcaggatctagtgtgtctaggttctgaagaatgataaattggactggggctgaggttgccctggggtttgagggaacagggctccctgggtatggctctccagggtaagaggaggagacttcccagttcagcctgactgcttcccccacccctccaggtcctgagcctttgcctccaaaaggtctgcagtatctggtgctcttgtctcatgcccacagccgagagtgcagcctggtgcccgggcttcgggggcctggcggccaagatggggggcttgtgtgggagtgctcagcaggccataccttctcctggggaccctctttgagccctacaccttcagaggcacccaagccagcctcccttccacatactactcggagaagttggtgttccgaggccacgagtgggcaggagcttgcagatttggaatctgagcatgatgagaggactcaagaggccaggttgcccaggagggtgggacccccaccagagaccttcccacctccaggagaggaagagggtgaggaagaagaggacaatgatgaggatgaagaggagatgctcagtgatgccagcttatggacctacagctcctccccagatgatagtgagcctgatgcccccagactactgccttcccctgtcacctgcacacctaaagagggggagacaccaccagcccctgcagcactctccagtcctcttgctgtgccggccttgtcagcatcctcattgagttccagagctcctccacctgcagaagtcagggtgcagccacagctcagcaggacccctcaagcggcccagcagactgaggccctggccagcactgggagtcaggcccagtctgctccaaccccggcctgggatgaggacactgcacaaattggccccaagagaattaggaaagctgccaaaagagagctgatgccttgtgacttccctggctgtggaaggatcttctccaaccggcagtatttgaatcaccacaaaaagtaccagcacatccaccagaagtctttctcctgcccagagccagcctgtgggaagtctttcaactttaagaaacacctgaaggagcacatgaagctgcacagtgacacccgggactacatctgtgagttctgcgcccggtctttccgcactagcagcaaccttgtcatccacagacgtatccacactggagaaaaacccctgcagtgtgagatatgcgggtttacctgccgccagaaggcttccctgaactggcaccagcgcaagcatgcagagacggtggctgccttgcgcttcccctgtgaattctgcggcaagcgctttgagaagccagacagtgttgcagcccaccgtagcaaaagtcacccagccctgcttctagcccctcaagagtcacccagtggtcccctagagccctgtcccagcatctctgcccctgggcctctgggatccagcgaggggtccaggccctctgcatctcctcaggctccaaccctgcttcctcagcaatgagctctcctccagctttggctttgggaagccagactccagggactgaaaaggagcaacaaggagagggtctgcttgagaaatgccagatgcttggtccccaggaactaaggcgacagagtgcagggtgggggcaagactgggctgtaggggagctggactactttagtcttcctaaaggacaaaataaacagtattttatgcaggca

SEQ ID NO: 568588 - DNA, 2571 bp, Homo sapiens
  misc_feature (15)..(15): n is a, c, g, or t
  misc_feature (20)..(21): n is a, c, g, or t
  misc_feature (23)..(23): n is a, c, g, or t
tggctaagtgaggcngtggnntnaagttccgggctacagcagccgacgccgagaggcaccgtttcttcttaaaagagaaacgctgcgcgcgcgaggtgggcccctgtcttccagcagctccgggcctgctcgctaggcccgggaggcgcaggcgcaggcgcagtgggggtgagggcgcgtgggggcgcacagcctctggtgcacatggcttcctccccggcggtggacgtgtcctgcaggcggcgggagaagcggcggcagctggacgcgcgccgcagcaagtgccgcatccgcctgggcggccacatggagcagtggtgcctcctcaaggagcggctgggcttctccctgcactcgcagctcgccaagttcctgttggaccggttaggggccgggagaagggcttgggggagggtacccaggcagcagcccctagcctcctctccagggcctgtcctgctgctcttttccaccctcaggtttctcactttaccaggacggcctgtgtgacttgtggcctccgagggtcctgctcccctcctcatggtctcagcgaatagcggcccttagggctggccccttacatgtgtgagtgcccagggctgagggtggctggccacctgagtcctgacctgcctcttctcctgctggcaggtacacttcttcaggctgtgtcctctgtgcaggtaggtaggggatggcagggggtgagagccagagggaagagggaccacagggtgacccagaaacaccctcctttcaaagggagccctgagtaagtttgggaagggtggggtgagttggggagcacagggtagtttgatggaggcaacctctgggtggggaagggagcaatgtctcaggatctagtgtgtctaggttctgaagaatgataaattggactggggctgaggttgccctggggtttgagggaacagggctccctgggtatggctctccagggtaagaggaggagacttcccagttcagcctgactgcttcccccacccctccaggtcctgagcctttgcctccaaaaggtctgcagtatctggtgctcttgtctcatgcccacagccgagagtgcagcctggtgcccgggcttcgggggcctggcggccaagatggggggcttgtgtgggagtgctcagcaggccataccttctcctggggaccctctttgagccctacaccttcagaggcacccaagccagcctcccttccacatactactcggagaagttggtgttccgaggccacgagtgggcaggagcttgcagatttggaatctgagcatgatgagaggactcaagaggccaggttgcccaggagggtgggacccccaccagagaccttcccacctccaggagaggaagagggtgaggaagaagaggacaatgatgaggatgaagaggagatgctcagtgatgccagcttatggacctacagctcctccccagatgatagtgagcctgatgcccccagactactgccttcccctgtcacctgcacacctaaagagggggagacaccaccagcccctgcagcactctccagtcctcttgctgtgccggccttgtcagcatcctcattgagttccagagctcctccacctgcagaagtcagggtgcagccacagctcagcaggacccctcaagcggcccagcagactgaggccctggccagcactgggagtcaggcccagtctgctccaaccccggcctgggatgaggacactgcacaaattggccccaagagaattaggaaagctgccaaaagagagctgatgccttgtgacttccctggctgtggaaggatcttctccaaccggcagtatttgaatcaccacaaaaagtaccagcacatccaccagaagtctttctcctgcccagagccagcctgtgggaagtctttcaactttaagaaacacctgaaggagcacatgaagctgcacagtgacacccgggactacatctgtgagttctgcgcccggtctttccgcactagcagcaaccttgtcatccacagacgtatccacactggagaaaaacccctgcagtgtgagatatgcgggtttacctgccgccagaaggcttccctgaactggcaccagcgcaagcatgcagagacggtggctgccttgcgcttcccctgtgaattctgcggcaagcgctttgagaagccagacagtgttgcagcccaccgtagcaaaagtcacccagccctgcttctagcccctcaagagtcacccagtggtcccctagagccctgtcccagcatctctgcccctgggcctctgggatccagcgaggggtccaggccctctgcatctcctcaggctccaaccctgcttcctcagcaatgagctctcctccagctttggctttgggaagccagactccagggactgaaaaggagcaacaaggagagggtctgcttgagaaatgccagatgcttggtccccaggaactaaggcgacagagtgcagggtgggggcaagactgggctgtaggggagctggactactttagtcttcctaaaggacaaaataaacagtattttatgcaggca

SEQ ID NO: 568589 - DNA, 281 bp, Homo sapiens
ccacttccttccccttccccaccccgtgccccctccatggagaggaacagaccccttctctgtccagtctaacccaggtcacgtacaccagtcagcaccacaacaagacagtagaaaacacggacgagaacaagagcctgatgatacatcaaaacagaacataaatactacggagcacaactaatgacacacagcaaaagaagacatagcgacagataacgacttagtgtgcaacacatcaagaaagagagagaaagaatagagaaaggacaagaataaac

SEQ ID NO: 568590 - DNA, 286 bp, Homo sapiens
cggaccatactttcaatataaacctgtaggaaaacacatgcaacatttgagggaccatctaaaactttaatttgggaagactgtgttaactcacatgcagtaatattaaaaaatgactcatatggtttagtaatagactgggcaccatagggctatttaaaaaacaattgctcctctgtggaagggaatgcctggaggctacttattttatttcttatcaggagaaagagaatcatcattcaaggatcagctcattcttttcccttaaatgggaagactaaggcat

SEQ ID NO: 568591 - DNA, 3040 bp, Homo sapiens
agcgggggggctctgggcagcctgggaactgccattgggattagtccgctccactcactgtcagcattaagtgggggtgcccaagacggggtggatggggggcgccctccagacctctgaccacggcctcaccgccactcgacccaactatgaagagcgcccccagctgcacgccaggacacgacctttccttcccctagaaaccagtaaaggccgctgccctattcaagatgaaatgtgtggaccgcccccagcccagttgaaatttcccgtgaaagtctctcgccccttccccacagctccacttcagtggactggagggcgcaggcctttgttctgactgcttctgtctgcctgcctcccacccgacgacactcacatggtagcgctgagcttcaacaccctgtatcatagaaggacggggtttggctccacacctgccactgctattgaaatagtttagtcttgccccagttcactgatgaggaaactgaggccctaacggcaggtggagccgggtccccgacccccgagatcggcagggcgctgaagacgtcccttccaccctccagcctctggtgcacatggcttcctccccggcggtggacgtgtcctgcaggcggcgggagaagcggcggcagctggacgcgcgccgcagcaagtgccgcatccgcctgggcggccacatggagcagtggtgcctcctcaaggagcggctgggcttctccctgcactcgcagctcgccaagttcctgttggaccggttaggggccgggagaagggcttgggggagggtacccaggcagcagcccctagcctcctctccagggcctgtcctgctgctcttttccaccctcaggtttctcactttaccaggacggcctgtgtgacttgtggcctccgagggtcctgctcccctcctcatggtctcagcgaatagcggcccttagggctggccccttacatgtgtgagtgcccagggctgagggtggctggccacctgagtcctgacctgcctcttctcctgctggcaggtacacttcttcaggctgtgtcctctgtgcaggtaggtaggggatggcagggggtgagagccagagggaagagggaccacagggtgacccagaaacaccctcctttcaaagggagccctgagtaagtttgggaagggtggggtgagttggggagcacagggtagtttgatggaggcaacctctgggtggggaagggagcaatgtctcaggatctagtgtgtctaggttctgaagaatgataaattggactggggctgaggttgccctggggtttgagggaacagggctccctgggtatggctctccagggtaagaggaggagacttcccagttcagcctgactgcttcccccacccctccaggtcctgagcctttgcctccaaaaggtctgcagtatctggtgctcttgtctcatgcccacagccgagagtgcagcctggtgcccgggcttcgggggcctggcggccaagatggggggcttgtgtgggagtgctcagcaggccataccttctcctggggaccctctttgagccctacaccttcagaggcacccaagccagcctcccttccacatactactcggagaagttggtgttccgaggccacgagtgggcaggagcttgcagatttggaatctgagcatgatgagaggactcaagaggccaggttgcccaggagggtgggacccccaccagagaccttcccacctccaggagaggaagagggtgaggaagaagaggacaatgatgaggatgaagaggagatgctcagtgatgccagcttatggacctacagctcctccccagatgatagtgagcctgatgcccccagactactgccttcccctgtcacctgcacacctaaagagggggagacaccaccagcccctgcagcactctccagtcctcttgctgtgccggccttgtcagcatcctcattgagttccagagctcctccacctgcagaagtcagggtgcagccacagctcagcaggacccctcaagcggcccagcagactgaggccctggccaggtaacctgatggctgagacagaaagggcaggggcgtcctgggatgtggccctccctcgaggccctctgctccctctttgctgcccgtagcactgggagtcaggcccagtctgctccaaccccggcctgggatgaggacactgcacaaattggccccaagagaattaggaaagctgccaaaagagagctgatgccttgtgacttccctggctgtggaaggatcttctccaaccggcagtatttgaatcaccacaaaaagtaccagcacatccaccagaagtctttctcctgcccagagccagcctgtgggaagtctttcaactttaagaaacacctgaaggagcacatgaagctgcacagtgacacccgggactacatctgtgagttctgcgcccggtctttccgcactagcagcaaccttgtcatccacagacgtatccacactggagaaaaacccctgcagtgtgagatatgcgggtttacctgccgccagaaggcttccctgaactggcaccagcgcaagcatgcagagacggtggctgccttgcgcttcccctgtgaattctgcggcaagcgctttgagaagccagacagtgttgcagcccaccgtagcaaaagtcacccagccctgcttctagcccctcaagagtcacccagtggtcccctagagccctgtcccagcatctctgcccctgggcctctgggatccagcgaggggtccaggccctctgcatctcctcaggctccaaccctgcttcctcagcaatgagctctcctccagctttggctttgggaagccagactccagggactgaaaaggagcaacaaggagagggtctgcttgagaaatgccagatgcttggtccccaggaactaaggcgacagagtgcagggtgggggcaagactgggctgtaggggagctggactactttagtcttcctaaaggacaaaataaacagtattttatgcaggca

SEQ ID NO: 568592 - DNA, 2875 bp, Homo sapiens
agcgggggggctctgggcagcctgggaactgccattgggattagtccgctccactcactgtcagcattaagtgggggtgcccaagacggggtggatggggggcgccctccagacctctgaccacggcctcaccgccactcgacccaactatgaagagcgcccccagctgcacgccaggacacgacctttccttcccctagaaaccagtaaaggccgctgccctattcaagatgaaatgtgtggaccgcccccagcccagttgaaatttcccgtgaaagtctctcgccccttccccacagctccacttcagtggactggagggcgcaggcctttgttctgactgcttctgtctgcctgcctcccacccgacgacactcacatggtagcgctgagcttcaacaccctgtatcatagaaggacggggtttggctccacacctgccactgctattgaaatagtttagtcttgccccagttcactgatgaggaaactgaggccctaacggcaggtggagccgggtccccgacccccgagatcggcagggcgctgaagacgtcccttccaccctccagcctctggtgcacatggcttcctccccggcggtggacgtgtcctgcaggcggcgggagaagcggcggcagctggacgcgcgccgcagcaagtgccgcatccgcctgggcggccacatggagcagtggtgcctcctcaaggagcggctgggcttctccctgcactcgcagctcgccaagttcctgttggaccggttaggggccgggagaagggcttgggggagggtacccaggcagcagcccctagcctcctctccagggcctgtcctgctgctcttttccaccctcaggtttctcactttaccaggacggcctgtgtgacttgtggcctccgagggtcctgctcccctcctcatggtctcagcgaatagcggcccttagggctggccccttacatgtgtgagtgcccagggctgagggtggctggccacctgagtcctgacctgcctcttctcctgctggcaggtacacttcttcaggctgtgtcctctgtgcaggtaggtaggggatggcagggggtgagagccagagggaagagggaccacagggtgacccagaaacaccctcctttcaaagggagccctgagtaagtttgggaagggtggggtgagttggggagcacagggtagtttgatggaggcaacctctgggtggggaagggagcaatgtctcaggatctagtgtgtctaggttctgaagaatgataaattggactggggctgaggttgccctggggtttgagggaacagggctccctgggtatggctctccagggtaagaggaggagacttcccagttcagcctgactgcttcccccacccctccaggtcctgagcctttgcctccaaaaggtctgcagtatctggtgctcttgtctcatgcccacagccgagagtgcagcctggtgcccgggcttcgggggcctggcggccaagatggggggcttgtgtgggagtgctcagcaggccataccttctcctggggaccctctttgagccctacaccttcagaggcacccaagccagcctcccttccacatactactcggagaagttggtgttccgaggccacgagtgggcaggagcttgcagatttggaatctgagcatgatgagaggactcaagaggccaggttgcccaggagggtgggacccccaccagagaccttcccacctccaggagaggaagagggtgaggaagaagaggacaatgatgaggatgaagaggagatgctcagtgatgccagcttatggacctacagctcctccccagatgatagtgagcctgatgcccccagactactgccttcccctgtcacctgcacacctaaagagggggagacaccaccagcccctgcagcactctccagtcctcttgctgtgccggccttgtcagcatcctcattgagttccagagctcctccacctgcagaagtcagggtgcagccacagctcagcaggacccctcaagcggcccagcagactgaggccctggccagaggaaagctgccaaaagagagctgatgccttgtgacttccctggctgtggaaggatcttctccaaccggcagtatttgaatcaccacaaaaagtaccagcacatccaccagaagtctttctcctgcccagagccagcctgtgggaagtctttcaactttaagaaacacctgaaggagcacatgaagctgcacagtgacacccgggactacatctgtgagttctgcgcccggtctttccgcactagcagcaaccttgtcatccacagacgtatccacactggagaaaaacccctgcagtgtgagatatgcgggtttacctgccgccagaaggcttccctgaactggcaccagcgcaagcatgcagagacggtggctgccttgcgcttcccctgtgaattctgcggcaagcgctttgagaagccagacagtgttgcagcccaccgtagcaaaagtcacccagccctgcttctagcccctcaagagtcacccagtggtcccctagagccctgtcccagcatctctgcccctgggcctctgggatccagcgaggggtccaggccctctgcatctcctcaggctccaaccctgcttcctcagcaatgagctctcctccagctttggctttgggaagccagactccagggactgaaaaggagcaacaaggagagggtctgcttgagaaatgccagatgcttggtccccaggaactaaggcgacagagtgcagggtgggggcaagactgggctgtaggggagctggactactttagtcttcctaaaggacaaaataaacagtattttatgcaggca

SEQ ID NO: 568593 - DNA, 130 bp, Homo sapiens
aagtctgggtagatatctatccacgacagatcctggaaggcagcacggtttggtggatctagattcattaggaatgtcttctggtcagccaggccaggacccgggcttgccaagagcagaggccctccca

SEQ ID NO: 568594 - DNA, 1162 bp, Homo sapiens
gcgggcgcgtcggggccgggccggggctactgtaaatggctggcggagggaggctggagcggcggcacgctcagcccagatcccccgaaactttagtgttcgaagccccacaactttcctggtgaatgctgctgcctgctcctgtgatgtgcgtgtgactgtgaatggtggaatgcctgaggctgggaatgtcttgggtggaatctgtgcagtggatgcctggggatgactcgaaccctgctgtgctgtgtgtgtgcgtgatgtcctgccagttgcctctgctgcctcctgctgtgccccctgccatctttctcatgcacccatcccctgcggcctgtgagcctggagcctggagcctggagccgtagtcagcagcctgcagcctgcagcctgcgctgcctgggcctcgcaggcatgctggctgcgtgctgagctgcaagcctggtgcccccatcctcgctgaccttcctgtggcccttgtatgctctgtggctgctaccttggctgctgtcgtgagtgcctgtgtggcccgggcagtatttcgaggaacgcatagacagtgagtgcctggtgccactgctgcatgccccttgcctggcccagggttccttgggtgcctgtggccccacgatgtaacgtagcatgctgggtgctgtggtgctggccgttgagcctggcagtgcgaaagatcggacacggcttaaccgctgagcgatgcggagcagaaaatactattcacgatctcttctcctactgcgacattgaggagcacccaaggaaggtggtggtcaacgggcgggtgctggagctgttccgggcgcgcaggtgccgaacgacgtgggtcctaccagatcatgggcagccttggtgggtgcaacaagacttggtaaatacgggagacagacagtctacatggcttgaaacttgtactgttgccaaactggtacccttaaaaatggacagttaactaccgaatgcacgtaccatgacaagatggtcgccccagaagtacgggatctgcccatgacctcattcactcaaccgaacaccgggcgacgtggataaccacaacggaggaagacacacgccgacaaaaaacacagatatgcaatcgacaccacatgacacgccagtacacgagaacccacctaagcgatccaga

SEQ ID NO: 568595 - DNA, 307 bp, Homo sapiens
gcatattgtatgctacaaaaggcagctcaagtaagctgaaatctagtattgtgcgcacaggaataagaccttctgcaacatcttaagatccacaaatgacgggatataaaactaatgtcatagcgtgagacctgcagcaacaatgacttaaccatataaatgtggaggctatcaacaaagaatgggcttgaaacattataaaaattgacaatgatttattaaatatgtttgctcaattgtaacgacttctccatcccctgtgtaatcaaggccagtgctaaaattcagatgctgttagtacctacat

SEQ ID NO: 568596 - DNA, 305 bp, Homo sapiens
gagccaccaccgctgggagctgccacctcaggagcagcggcagcacttggacccgccgggccccctcgcacccagcggctctgcaggtgccctacacccgggaggggccgagggagcctcagccgccggcgggaccgcagggatttgctggctctttctgcgctgaggggtcgcggcgcggggcggaggtcgggtgggccccgctggagccgcagggcacgcgcaggacaggctcgctgggtgtcgactctagccctctgtcagagaccttgggacccgcgcaatgtggcagtggaaggcgcagg

SEQ ID NO: 568597 - DNA, 273 bp, Homo sapiens
ctttccctttcaggggtttccaataattttccaagcaaagggatggttacataaacctttggtcaagacccgggataaaaagacggggggatagggcctagatccccaggatatgcgggggccaagagaaatgaaatattttggggataggggttcttaaagggggatacggtcccagtgaatttcccaaaagagggggcggccctaactggggttcaatcccgggataagccaggcccatttgaaggcaaataagggttttccccgccccca

SEQ ID NO: 568598 - DNA, 453 bp, Homo sapiens
atccccctgctagcgctcgggttcacacgagatgccagcagacaggcaggctagagttcctccggttttaggctctgctccgcacgcgatcccgcgcgcttttctgcgcagctggaggctgactgctcgcactgcccttttacatgtagctacgtgaaggtcatagggcgcggagacagccactagcagcaacttcggattctagcctgctctgaggcgtctgtccggagtgagcgaatcactcatggatgtgcaccagccctctcccagtgctctaagatactctatccacttgcctccgtattgcgacccccacacgggggcacgcaacggaaaaggaacaaagaccacctaagtttcccctgttcagcgagcagctaaatttggacgagctgtgcgacatgcttggcgagtgtctaaaggaactcgagtaatcccatgaccagcatgctg

SEQ ID NO: 568599 - DNA, 215 bp, Homo sapiens
gattcctaaagaattggacacagtaattaaggttttttcctcccaagtatacatgtattatctctcctgctcaaagggaacaccctcaaggttggttaaggtttaaacaatggacttgcgcctaacaacagtggtctctgtgtatctgtgtgtccccgattttaaggcaatgtgtctttatttttaaaatctatttctggtcataacagggggaa

SEQ ID NO: 568600 - DNA, 103 bp, Homo sapiens
atctattcaggggcagatgacttttgtgtgcacaagtggctcacttccatgcaagatcattcccggcctcctcaaggcaaaaaaagtattgaattggagaaaa

SEQ ID NO: 568601 - DNA, 582 bp, Homo sapiens
agcttatcttggtacgtttgtaacaattgatgagccaacattgatccattattattaactaacagtcaggattcactcttagtgtaggcactgaatgagtatgacaagtgtgtaatggcatgtatccaccatagtatcatacagattagtctcattaccctaaaaatcctcggtgtactgtatatatatccctttctgcccccaaaccgtcgcaaccactgatctttttgcttcatcgttttacctttttcagaatgtcgtatagttaaaatcacaccagatgtggccttttcagattggcttctttcacttagtatgtgcatttaaggttcctccatgtctttccatggcatgatagttcatttctttattgtgataaataatgtctcattagtgggtgtatcattgtttatgcattcatctattgaagcacatcttggttgcctgtaagctttggcaattattaataaagcctctataaacatttgtgtgcaggttttttcgtggacataagtcttcacctctggggtaaataccaaggagtgcactttctggctcgtatggtgagagcatgcttaaaga

SEQ ID NO: 568602 - DNA, 1474 bp, Homo sapiens
  misc_feature (324)..(324): n is a, c, g, or t
  misc_feature (903)..(903): n is a, c, g, or t
atagtgtgtcttcgtgctcactcgatgttagtctttctctccgttctgtgggtgttgtggtgggtggcgtgtcctcaatacgaactaggagtgcggtagatttgtccgccgcttctgtgtgttgtggtattgacatcacgtcatatgagttggtccaccacatcaggggggagtgcacctgctgtactgcttttcgtcacacacgttagtgaattggtggagtggtctgtcccctactcgtccagcatagttggtgcttacgtcgtagcatcgacctaggtgattgtgctaccgccgcagttgatgatttgcgattgttcttcnggggaggaggaagcattctctcctgggcgtctctctcctcgacacaacataagaggggggcagccttctgtgcctactcaggagaccttcttctttgctgttggctgttctctactcttgtgatatgatactcggtaattagagtgttcccttcctcatcactgcttgttttgttgtgtggttgtcacaaacaccacttacgtctgctgttaacgacaacacctgttgtgctggtgaggagaaaagtcagccaacactctgctgactggggagacacgaacacaacaacagcggtggggacgtggggtgtatgtataccacacccttggggggcccaaccacgcgtattagtatagtattggtgttgtggtgtgttgttgtactgtgctggaatgctactattgtggaggaggcttctcgtgttgttggtcacaaaatagtgagtattgttctggtattgttgtacctctcttgttgttggtgaggatgttgtgtgtgacgacacaaccccaggcctcttactactaggagtagacgacactactgatcctctctcctgtgtgtggattgtgaaaaganagagggtggtctctgtttgttgttctgctgtgctggatagttgacacacagcggagattctcactctgtgttggtggacacacttgtctgctgtgatgaataaataatgtgttgtgtggttagagagtattgtctcacactacgtgtagtgtaattgttgtgggtgtgtgacacacactatccacacagacacactcgtgtgctcaccgcaccaccccaccgcgggcttgctctctcgtgtatatagagagaccccatatatatagtgtagaatattctcgtgaagaaaatatattctgtggaggagagagtaagagagggagatatgtgacacactaaaaggttctgtttcccatcgggagagcccatctctcccgctgactcctcagaacctctgttagagacctctcgtgtgtgtgaagagttgtctctacctgtccaccacacagagtgagagacacctcaagagtgtgtgtgtgtacagtgattgtctcacagatgtgatagatgctgcacgacaccattttaaaagactgtgaatgtagttgtatatacacctcctgaaaataaa

SEQ ID NO: 568603 - DNA, 848 bp, Homo sapiens
  misc_feature (610)..(610): n is a, c, g, or t
ggaagtcagttccgcggtagaggtgacctgactctctgaggctcatttgcagctggtggaaattgtgccccgctgtgttcaatcatgtctgaacgcaatgcagagtctgttgttgacgtggtagtcagctggtctaacatggcatattcatcatgctgtacgaggatgggaaatggtatctgtcttcgggtaaatgatcatgcctataatgtctgtgtgcggtcgtgatatctaccccccagtgatgggtgtcctggacggtgtcctatggggaactgtaagactgtgcgcctttccctcgtcctgaaatgatgtcatgcgcacaccagaataacaggaaggacgtgtgcctgtcatataggacctggagtgtgtgcgcagttgcttgatgggcgtccattgccaaagaagggacaggcactggacgagacaatggatttacgtgaaaagcaacatgtgacgaattctttcaagatcccctagggtgcagcctgtacgattggaagtaccgccagggaaggtcagggtaacggttctcgtagggggtaatccagtcaataccaactgacctgagtgcttccaaagtcgagctccatccatcccccaaggnagaaccttcaggttgcttgaactcgttccggatcacgaaaccgaggctaaaggctcaaaatgtggtcttcaccccctgggtgtggactgctacatggatggtaacgacatgtcatgtatcttgcgggaaaaccattcctttcgcaatccagttcccagaatgtttaccacggccagggtgagattgtcacggaacggcaacgtgggggggcaagaaaacgccttgaagaatcaaactg

SEQ ID NO: 568604 - DNA, 422 bp, Homo sapiens
  misc_feature (2)..(2): n is a, c, g, or t
  misc_feature (17)..(17): n is a, c, g, or t
  misc_feature (45)..(45): n is a, c, g, or t
  misc_feature (180)..(181): n is a, c, g, or t
  misc_feature (183)..(183): n is a, c, g, or t
  misc_feature (303)..(303): n is a, c, g, or t
  misc_feature (324)..(324): n is a, c, g, or t
  misc_feature (398)..(398): n is a, c, g, or t
gnctgctggagctgcanccgaccgcgagcgtgccaagcgcttcanagctagcggagtgggcgtcggccccctcaggacaccaccagattcccctcttcccgcggcctcgcatgggaccccacggacagacttgcgcgcgtccaatgtgtattcctccatcatatgctgaccttggcaaanntncagagatattttcaacaaaggatttggttttgggttggtgaaactggatgtgaaaacaaagtcttgcagtggcgtggaattttcaacgtccggttcatctaatacagacacctggtaaangttactgggaccttggaagancaaatacaagtggtgtgagtatggtctgactttcacagaaaagttggaacacttgataacactctggggaacangaaatccgcaattgaagaccagat

SEQ ID NO: 568605 - DNA, 912 bp, Homo sapiens
ggctcaggattggcggacgctctcagcgtctcggcgcacggcgagcttccttcaggcctgtctagtgttcacgaacatcctgtgcaagctcagcttggagagtgatgactcttacagccccaagtgcatatgggtctgtcgaaagccaatactgattgtgatgctgagcgtcgatgctgtgaacattgaaagccgccatcaagaccaaaggtgtggattgagtgtcaccatgtgtcaacatatgaccacccgcagcaatgcactaggagataggatattgccttcgtgtaccagagaaggaccaacaacagttgaactttgcaatcagcactgaagtcagccttatctggccatctgaagacggtgatttggggcctattgaagacacctgctcagtatgacgcttctgagctaaaagctgccatgattggggctgggaaaccgagggaggcctctctcatgggatcatctgctccatggaaccaggaaggagctgcaggaaattaacagagtctacaagggaacatgtcaagactgctctggagaagggacattatgcggacacatctggtggatttcgaagctgatggttgcctgccaagggttagacgagcggacgaatggtcgggcattgagacgtgaactgaatgaccaagaagtcgggaactctatgacgcccgcacttgacacggacggactggtgttccaagcggatagttcaggacgagatgttgcccactacagaagcattgaaggtcaacagtcacgcctttaagggtggcacactcgcaaagggtacggacctgaatgcccgacgtgtagggctgaacccccgttgtggccgcgtaaacagggcgggcaaagcacacaatcagaggataatatctccagcgactacaaaagagaagcaaa

SEQ ID NO: 568606 - DNA, 372 bp, Homo sapiens
aaaccccccggccaggaggtggaaaacccccttagaccaatctttttaaaactccaggcatcctggtttaaaagcttgggggtttttaaaattcctacgtatcaagaaaaatgaagtcagaagctaccctgccatctgggccttggcagttcctatgcctactctcgaagtagcactgaattccgttccccattttcaatgtgtagcccaagggattgggaaccttgataggactaagaaagggaaaatggtcataaattaaccaggtgaattttaatttacagagaataggacttttcatccaacctgcatttcctacagatttatccaataagggtcaagtcaagctgcacacatcatgcttgctctcat

SEQ ID NO: 568607 - DNA, 283 bp, Homo sapiens
  misc_feature (194)..(194): n is a, c, g, or t
  misc_feature (229)..(229): n is a, c, g, or t
ctagaggatccttcacgctgagaacggctgtctctggtcatcctggctccacaccagtgtgtgtcaagaaggatggtccggccctgttggctcagcgctggtacagcttccttgggtcagagccagccgggataacagcctctttgtgcccaccccagtgcagagaggggccctggtccttcatccatggaganagtggtaacacaagagcaagcagaaccttctctgnaccgctcgcgccaaggccctacactttccaccctcatgggaggcccctctggca

SEQ ID NO: 568608 - DNA, 535 bp, Homo sapiens
actagtccacggttggcttgccaagtatctctcttttattttttctttggagacacagtctcactctgtcacccaggcgggagtgcagtggcgccatctcggctcacttgcaacctcggccttccaggttcaagcgattctcatgcctcagcctcctgagtagctcagattacaggagcgtgccaccatgcctgtctaattttggtatttttagggagatggaggtttcaccatgtgggccatgcgggtcttgaactctgggccttaagtgatctgcctgccttccaagtgctgggattacagatgtgagccacggtgcctggcctaaaaaaaatttatttcgattaaaagcattttttagactagtcacatatgcagtagtggaaagaggggaaagagtagaacagggagttggatctgcaactcactgcagccaaccgggaacgtagtactagtccacggttggctactagtgcagggtgggccacgagtccagggggggctactagtccagggggggctactagtccagggg

SEQ ID NO: 568609 - DNA, 163 bp, Homo sapiens
cccgggtcacattcataattgacccaaccactttgagtcagggaatatcgaggtaaagacctaatgaagtaggttgaagagacactggaaagagtaggaatggagaatgtcaattttgacattgtttgtaagaagttttgatgtaaatatcagaaaaatgggg

SEQ ID NO: 568610 - DNA, 336 bp, Homo sapiens
  misc_feature (148)..(148): n is a, c, g, or t
ttagtcccctgtttcacttatttttatttcattttttttgtagagatgaggtctctctatgttccccaggctgatctcgaactcctggcctcaagtgatccgtcctgccgttggccgtcccaaagtgttgggattacaggcatcagcncaccatgtctggactgttttactttttacatttatttttattttatttttttctctgttgccttggctggggtgcagtggcatgatcatggctcacagcatcctcaacctactgtgctcaagccatcctcctgcctcagcctcctgagtagctgggacgtacgcatgtaccaacatgcccagctaatt

SEQ ID NO: 568611 - DNA, 774 bp, Homo sapiens
tgtgtgtttcctcccacccaatagaacagcacgctctccgtatgatattttcttctggggaaggggtgtgttttaaaaacgcccgcgcggcgggtgtcccaaaaaaactttgtgtttgtggacccaaagatggtggtttttttcttagaggaaagagtccctctttacaaagatttctctcaaggtggtttaaaagagcgggttttccccttctcccccaggatatatagaaaataaaaaacacattcactgggcccaggtgtggttattggtggggggggggtcctctattaaatgtaaggggcttaaattgatgttggcccgacccccccacaaaagagaacctttcaaagataccccctccccccggtgggaaaaaaggggtttttaaaaacgagtttctttttccttacccaaaaggggggttgtgtcaaaagccttccaagctgtttttttccttttgtgggagaatgaaagcggcctttgccggtggacagttttcaaggaagaagccgtgaaaggctggtgggcccccccgggacttttctagaaaaaagttttaaaggttgttctacgtcccgctgcctatttaggaaaaaatgttttttttccgcccccgcagggtgcctttagaataaaataaagttctttttggttgtgggctgacccccttttactctttaatttaggaggcgtaattaaaaggccctgccccccggtgtgggtataataacaacattttgcctaatttctctgtgcttcaattaataaaaa

SEQ ID NO: 568612 - DNA, 1223 bp, Homo sapiens
  misc_feature (14)..(14): n is a, c, g, or t
  misc_feature (17)..(17): n is a, c, g, or t
  misc_feature (24)..(24): n is a, c, g, or t
taagctaggtgtcnccncgggtantgggatatcgtctgacgggcgtcgtgcagacccgggcttatcaggatcatagcatctgtgattcatgagtgtccccatactgatgaattggagcataccatatggaaagcaaaggcagaattatcccagctgtattatattggatcgtttaaggatgcaggtgccttcaatgacatgctctcaaacatattaacagagagctgctcagggagctgttggcgtggaactagtagaaggactacatatgatttatctcattagcatatatgtcgatatttatagattgaggacaactagggcaacaaggggtggtggtgttgctagacatggtagtagacgatagatggctgtagacactagctattgatagattgatagatcggtagattgctgctacgtgatagataggtagatagataggtgcatagttaggtagactacacaggccgacacaagccaagtggcccaacagacgaacctgacgacacagacccatggcaccaaaaattacaacgtaagacgcaatagaaagacaacttcagaacagtacaggagacataacaacagcataccagctacaaaacagccaagcaaaaagaacgagcacacaaataccagactctgggggagacatacaaaaggagaaactagcctatacgaggcaacacaaaccaccagagagaggaagcaactgacccagccgatatggcaattacaggattccgcacaacagacgaacacaaggatacaaggccccaggcgacagggacccgcacgaggcacagccgcgctaggagccggacacaagacacccgccacggaacgcacagagactcaagaaaacaagaagtaccaagagcaccaacagagatcagactagaaccaaaatgaagagtcctgaacgatgcaccagccgaacaacacaccgggagaaggtcaccacacgaattaaacgagtccaaagcacaaaacgtgacaaaagaaagatatgcggacccagacacgggagggaaaaacagagacacaaagcagcaatcacccaatgaacacgcaccagaacgacaagccacgattagagaaaatatggaggaaacaggcagtattgcacggtatctcaagaagacaggacagagtaacaccgagccgagatgggagcacgaacacgagacggatcagaagcacccgaccgacgataaacg

SEQ ID NO: 568613 - DNA, 418 bp, Homo sapiens
  misc_feature (398)..(398): n is a, c, g, or t
gccgcctactactactaaattcgcggccgcgtcgacaaaacttgttagtgggtcaggttacatttgtcagtttaagttctcagatagtcatccaattttagatttctatgtcctcctacctaagtgttttgcctatgatcatccatagttctggaagccctgaacctatgtttcatttaaactcttctttatagcctacaggcaaaaggcagctgggtcttgcacaggtaaatgcctgttgatgtcaactggagtttgaatgcccaagtgctgtggtgtccagcctcaagtcatttattataaatattttggacacatcagattcaaacccactctggtccagctgaaaagataaatagttcagactttacccagttactaaatgtcgacgcggccgngaatttagtagtagtcgacc

SEQ ID NO: 568614 - DNA, 377 bp, Homo sapiens
  misc_feature (143)..(143): n is a, c, g, or t
  misc_feature (207)..(207): n is a, c, g, or t
gaaaatatcccctttacacttacactttctccaactactccgtatcttccaaacaaatggtctcaggtagcccacttgggttgctgggacttttctggtttaaaaactggaagtctgggctgttatggtggctcacgcatgtnatcccagcaatttgggaagccaaggcgggtggatcacaaggtcaggagttcaagaccaactggncaacatggtgaaaccccgtctcttctgaaaatacaaaaagtggccaggcatggtggcacgtggctctagtcccagctactcaggaggctgaagcaggagaattacttgaactccagggagagtggcgtggcatgatcttgggtcactggaggcttcggctcctgggttga

SEQ ID NO: 568615 - DNA, 523 bp, Homo sapiens
  misc_feature (48)..(48): n is a, c, g, or t
  misc_feature (111)..(111): n is a, c, g, or t
  misc_feature (113)..(113): n is a, c, g, or t
cgcaatgtagcaccgagtggtaccggtgcgcgcctttgccaaccgtcnaggtgcaccccagcggctattacgcctggctggcgagcctcaatctgcccgagcaaagaagancnacgtctgcttggttgatcaaacacgcttggctggaaagcggaggtgtatacggctaccgcaaaattcacgatgacctgcgtgagctgggagaggaatgcggccgaaatcgagtcgggcgcttgatgctggcggcaggggctgcgttctcaaacgggctatcggcggcgtccagggttctatggtgacaagccaacagtggcctcgcccaaaccacctcgcgcggccgtccaaggtaagtgagcccgaacaaggtctgggtgacagatatcacttacatccgcacctataaagggtgagctctacctcgcggtagtgctggatctgtcctcacgccaagtaattggttggtcaatgaagccaaggatgtgcagcgacctagatatcgacgcgatgacattcagggctcaca

SEQ ID NO: 568616 - DNA, 217 bp, Homo sapiens
cagtgactagccttagcaactgaaccgtcatctacctcatcttaggcttaaacgtaaaagataggtatagtccatgtaaagcagttcaataacaataaatgaaagcgggcatactttgtatattgatttatctgagatggagtttttgctctcgtggtccaggctggagtgcaatggcgcgatctccactcaactgcggacctcccacctcccaggt

SEQ ID NO: 568617 - DNA, 900 bp, Homo sapiens
aaggatcgaacggggggaaaccacggcgcatatgggccccctctatggaccccgttgtcgggcaccaacaaatgggcgcaagaagaggcacattcccacaaggggcctcccacgtcccacaggggacgcaaggctgtctgggcggcaaacgtttaaacgaacgcgaggtcacacaaacgcccggtgtaccgccactcacgaaagactggcgcccctcttttaggacgtctcgcatctccacgttccccgggggccttcccccaacaggcatgtcctacggtccagaggggtccaaaacaggggggattacttcggatttttctgaagacgcctttgggtggtccccctcatgatgtcaaaagggcaggttgacaattaccagcggcttttattattccggcaccccatagagatgcttcctcggtacatacctgaaattcttctgaggatacccccctgtggcccacaattcgggcgagcaataatgcgacacggcgggcttttttatgtgaacaaataaacgagactctgtgaccgtattgatgttgcgataccaaccgctcgaacgtgggagtcaaaagtgcaggaaaaccccaaaactgggagaggcctgtccacacgctcttgctctttcttgatttagagaagataaaccaaacacctctgcgaactacgcatccgcgggacaatacctagtcatcaccttgcctcacgatgctccaattgcgagtgcattcattctcaggtgaaatctctccggacgattcatcctgccgtcgtggtgtgacaccgcctcactacccactaccaccgcacggattgggaccatttgttcaccgcggaccaataaaggtctctatcacaaggggttcgccgccccccatcccaaaaaaaaaaaca

SEQ ID NO: 568618 - DNA, 290 bp, Homo sapiens
gcgctgtcggcgggaagcggcgatcctgccaccgggaggtgtggaagagccgggtaggtgagcaaagtccctccgcgcggtggccgaggggcgcgcggcaccggggccggcagacgccagggacctgctgcgctctgctccggggcgggaagcgcgggtcagtctcgctctggctgcgggaggctgccgggaccgaagcgggaacggggagctgctcccgggggtggaggccggcgggtgccgcgggccgctgcgactggtgccgcgctcggccgcgggtccccgagccg

SEQ ID NO: 568619 - DNA, 705 bp, Homo sapiens
tgcccgggcgacaagcacgcaagcctgtcagtctgctataaggtcggaccgggggcggagaacggcgaggaaggggacatacaagaggaaatggagaatccggaaatggtggaccgtgctccgagaaactagatagtcatccagctgcggcatcgggagctgttcctctcccggtgagcgtggagtctctgcccgccacgcgacatacagggtgcaaggtgcaatcgttcactcgctgctcaaacgaggacgcgatgtctgcatcaaggtccgtaccatggtagctgggaggatttcttgcttcatattctctagtctacgatgccacagcagaagactcgcgtgtcttggctcgataatagggagagcattcgagatagtgaaaccggtaccaggtcggacatcagccgactagttaaaagaagcgcgaggaggatggccgagaccagtaccaggttggagacccaggtgtgggaggcgcagaagccactcacagacaaggccagatcgaccagtacctaggtggtggacccgttctagtggagcgaccttcgcacagtggccctggacttgcaagcacgctccagtccggacaggtccaagtcttgcacattgaagccgcctgcaggctgtctcgccgagacatcaaccatgtttccacgccaatggatatctctccacgaagaacatcatacgagatctccc

SEQ ID NO: 568620 - DNA, 82 bp, Homo sapiens
  misc_feature (22)..(22): n is a, c, g, or t
  misc_feature (25)..(25): n is a, c, g, or t
aacgctgcctggatggcggcangcntgcgtgaagaggctgcggaatgtgatgcgtcaggacaccaatatgctgtttgttcgc

SEQ ID NO: 568621 - DNA, 1001 bp, Homo sapiens
atccccaataaaaaagcgaaaagtactggtactgcctgtgctcaaagacgagttgaggcgtaagatgtgtcctgattcattatatacaagatcagataaggctctcattgcgctcttccgctcataaaagcctggtaccttaagctactttgtcctctcctggtgctcagaacacaggcaatcatgcttgtgaataagactacggtacgcaagtgtgcacaattgcatttgtctcgtaccatgacttaaagcgcaggatctgatcccattggtgtaaattcagtgattgactcgcccttcatcaatgcacatctctggattgtatctggatgctgttgttgtcctgtgcctaaatcgatggtagaagttcgaagtttgcccgagttgcactggttcacaccaaaggggtggtgtttaagaatctatcaagtgatctaagttgcatttttcttagagggggtcttctcgaaagagtcttaggtgtgataggtattaataaattaggtacgttagcagctcaatcgtcgtatgatacttggccggaaaaacgccatctgttcattgggcacctttctccgtctggttgattggtgttcaattttagtatgcctggtgggacggccattcatcttttgaattgtccaaatctaagtagctttcttagtgggtccacggggcctcttgactgagcctgttatatgttcacatagattgtccaatatggcgagttgacttagacgggttttccacccattgttaaccttgcccaatgagcccagaccggggtctaaagggggtcacactcggatctaccttcccttgccagttggggaatctgggctctctaacagtggacatccgcgaacgttatttgtggcctggcgcatcatataaaagggcggacagagagggtatcccctagagaagacaccacacactagtaatgagaaagtacccgcctaaatggtcacactcgtcaacctcatctctctcttcccaac

SEQ ID NO: 568622 - DNA, 298 bp, Homo sapiens
  misc_feature (2)..(2): n is a, c, g, or t
  misc_feature (43)..(43): n is a, c, g, or t
  misc_feature (115)..(115): n is a, c, g, or t
  misc_feature (194)..(194): n is a, c, g, or t
  misc_feature (272)..(272): n is a, c, g, or t
  misc_feature (291)..(291): n is a, c, g, or t
gntggggtttcccccatttttttgagcccggtgtcaaactccngacctcaagtgatctgcccaccttggcctcccaaagtgctgggattgcaggcatgaggcgctgcatcagttntgcaaaaaaaaaaaaaaaaaaaaaaaaaaaaaaaaaaaagcgtatgcattaaaaatactaagggggccaggcgcggtantcacgcctgtgatgccagcactttgggaagccgaagcggatggatcacttgaggtcaggagttctagaccagtcttgncaacatagtgaaaccccanctccgct

SEQ ID NO: 568623 - DNA, 103 bp, Homo sapiens
ggacacggggaggagaccagattgtagagcacgactaggcacggaggtcagacaggcagcccgggcccaggatgggtaagtgggcccaggggagagcttgcaa

SEQ ID NO: 568624 - DNA, 241 bp, Homo sapiens
  misc_feature (6)..(6): n is a, c, g, or t
  misc_feature (56)..(56): n is a, c, g, or t
  misc_feature (111)..(111): n is a, c, g, or t
gagganccccatcactgagagagaactgctcctggcatgtgtcacatggcattttnatagacactcccaacacttgaggcaccacaatagcaacaggaggggctacaaagntattatagagtacagaatgtactacagttagttttaaatagttatgatttaataatatgtctttacatgactggagtgtgaacggcaccatgtaaggtctgtatgtgtgtgcatagtattacatagtgtg

SEQ ID NO: 568625 - DNA, 820 bp, Homo sapiens
  misc_feature (9)..(9): n is a, c, g, or t
  misc_feature (13)..(13): n is a, c, g, or t
  misc_feature (19)..(19): n is a, c, g, or t
  misc_feature (28)..(28): n is a, c, g, or t
  misc_feature (132)..(132): n is a, c, g, or t
  misc_feature (140)..(141): n is a, c, g, or t
  misc_feature (146)..(146): n is a, c, g, or t
  misc_feature (189)..(189): n is a, c, g, or t
  misc_feature (222)..(222): n is a, c, g, or t
  misc_feature (228)..(228): n is a, c, g, or t
  misc_feature (238)..(238): n is a, c, g, or t
  misc_feature (240)..(240): n is a, c, g, or t
  misc_feature (243)..(243): n is a, c, g, or t
  misc_feature (250)..(250): n is a, c, g, or t
  misc_feature (261)..(261): n is a, c, g, or t
  misc_feature (267)..(267): n is a, c, g, or t
  misc_feature (314)..(314): n is a, c, g, or t
  misc_feature (316)..(316): n is a, c, g, or t
  misc_feature (321)..(321): n is a, c, g, or t
  misc_feature (323)..(323): n is a, c, g, or t
  misc_feature (326)..(328): n is a, c, g, or t
  misc_feature (333)..(333): n is a, c, g, or t
  misc_feature (356)..(356): n is a, c, g, or t
  misc_feature (381)..(381): n is a, c, g, or t
  misc_feature (450)..(450): n is a, c, g, or t
  misc_feature (458)..(458): n is a, c, g, or t
  misc_feature (465)..(465): n is a, c, g, or t
  misc_feature (468)..(468): n is a, c, g, or t
  misc_feature (490)..(490): n is a, c, g, or t
  misc_feature (499)..(503): n is a, c, g, or t
  misc_feature (507)..(507): n is a, c, g, or t
  misc_feature (518)..(518): n is a, c, g, or t
  misc_feature (530)..(530): n is a, c, g, or t
  misc_feature (535)..(535): n is a, c, g, or t
  misc_feature (539)..(539): n is a, c, g, or t
  misc_feature (542)..(542): n is a, c, g, or t
  misc_feature (545)..(545): n is a, c, g, or t
  misc_feature (547)..(549): n is a, c, g, or t
  misc_feature (551)..(552): n is a, c, g, or t
  misc_feature (558)..(558): n is a, c, g, or t
  misc_feature (617)..(617): n is a, c, g, or t
  misc_feature (778)..(778): n is a, c, g, or t
aaccacgcngctncctccnccacctaanccccatctcccttcatatgcacaaacacaggaacccaaagcccctcctccccacaatcctccccactcacattatgggaagaaatgtcactaaatggacttggnccctccanntagcncggaacaggtgaataaaaatatctttatgaagaattttgttgngctattatcttagggttgaatcagggccaagangggggnaggggcaagngnggnctggggntctcttagagntcagantttgtctgagaggcacagagcctatagttcacccagaaggggggttntntctangnggnnnggggntagaactggctaggctgaaagtnttttcaagagtatgtgtgggggtangggtagctataaatccattctctttcctcccccataccttccctagctcccagatagaagggcaggggnccctgaanagggaanagngtcacaattccctcaagtttcntctgtttcnnnnngggnttccagcgggnggggggtggggnatatncccnggngcngnnngnncccttnccccagctcagggcttcttctctccacctgtgagcaccagggcctgcaggatgtcaganagtgatacaattcccttgaccacatcattttcatccaccactacaagtcggtgaacctctgcttccactagcctgttgatgatggtctccagagtctcatgcaggtagcacttgagaacaccctcaaagtaatgtgatcgatgttgcaaggctttagtcanagatacatctaggttgttgtaggtcttttctgctgccagatt

SEQ ID NO: 568626 - DNA, 152 bp, Homo sapiens
gcagggcatcgtggaggtgaagagcttcctaggatgaccctccagccggtcacctcacagcctcctggatccaggctggcatgactcacatcgtcggaagtcgacaggcggatcaggtgaacaagaagaggtggtgaggcttaccatggagg

SEQ ID NO: 568627 - DNA, 244 bp, Homo sapiens
ggacatggcgagactatcacccaagggttggatgtggctgtctgagcgctgtgtcccagtacaacgaaggaccggagctgactccggcaagtggcgttgtgtgctgaagattggggaacacatcccctcaagcccttcgccatcattgtgaaaatgccaatgtatctggcccgtttattgccagtatccttgccaggcataattgggcctttgttgcccattcgttggagccttgagattccct

SEQ ID NO: 568628 - DNA, 186 bp, Homo sapiens
  misc_feature (49)..(49): n is a, c, g, or t
  misc_feature (144)..(144): n is a, c, g, or t
  misc_feature (146)..(146): n is a, c, g, or t
tcaaggtcagaagtaaaagatttttattgttctatagacacttctgaanaagacgatctaacttgagaaaattactacaatgcattttactattttcatccccagagactgactgatggcgttacagccctcctcttccaaggntnagggctgagaaccggtaagcaaatcgaatgatcagaaaaa

SEQ ID NO: 568629 - DNA, 1095 bp, Homo sapiens
gtggaagtgacatcgtctgtaaagcctgcgtggcactccctgacgcaccgtcgtgatgcccagggaagacagggcgacgggaagtccaactacttccttaagatcatccaagctcttggatgatcatccgaaactcgtctcattgtgggagcagacaatgtgggctcctcaagcagatgcagcagatccgcatgtcccttcgcgatgaaggctgtggtgctgatgggcaagaacaccgatgatgcgcaaggacatccgagggcacctggacaaacaagcccagctctggagaaactgctgcctcatatccgggggaatgtgggcttagtgttgcaccaaggaggacctcacgtgagatcagggacatgttgctggccaaagtaaggtgccagactggtgcccgtgcatggtgccattgccccatgtgaagtcactgtgccaggccagtaacactggtctcgggcccgagaagaactcctttttcacaggcttagagtatcagcactaaaatctccaggggcacattgaaatcctgagtgatgtgcaggatgatcaagactggagaccaaagtgggaagccatgagaaggcaacggactggcatgacagatgctcgaaatctacccccattctcctatgggctggtcatccagcacagggttgttcggacaaaggcagcatctacaaacctgaagtgcttgatatcacagaaggaaacatctgcatactaagcatatcctgagagggtggaccagccaaggttagccaaatgtctgtcatagcaagatgggctaaccaaaacttgtaggcatcaggtagccacaattcttatcatcaatgcggtacaaaaagcagttcctgggacttgatcctgaggacacacgcgacaaacaacaatatgcccagttggcatgaacacaagggacaagggccatacgtgggcaggatccacactagaacttggagagatgaatgccccttgtggcaggagacacaccacaagagaaccccaggtgatggtgcgagcccacaagacaaggttgaaagcaccacgacaaagacgagcaagacgaacacacgaccaggaaataggacc

SEQ ID NO: 568630 - DNA, 277 bp, Homo sapiens
  misc_feature (5)..(5): n is a, c, g, or t
  misc_feature (168)..(169): n is a, c, g, or t
  misc_feature (215)..(215): n is a, c, g, or t
cattntcttatgctttattggttaacaaagaaaccattatttgcttttgaaggcagagttattattttctaccatgaagttacttcaactcataaaaatgtattttatttacacctttgtagcaatggagcttggaaggaaatataaagcttacctacatgaacattnncatctagtattctgtggtctcacctggtcttctatgaagtttcagntcaagtgaggaaacagcaccatgctctattgtgaaaggaggcatttgccatgtgattggatc

SEQ ID NO: 568631 - DNA, 617 bp, Homo sapiens
  misc_feature (485)..(485): n is a, c, g, or t
  misc_feature (605)..(605): n is a, c, g, or t
gttaccagcatgcttgcggtaccagagcccccctctcctccccttcctcacccacgggcacgtttatctattataggcaggtatgacatgggcacctaggtcagatcttctcaactcgctcggcagaaatgactgtgattctgcggggggcggctgcgacggtcctgtcggtggacccggggctctacgtttatttatttcgttagattgagacttccacacgactccctgtagtccaggtagggcccagaaataggaaaggctaggattggataatgctgcaaatgctttttttgtgtgagaaactggagagatgtgatttctccttttgggagagaatgtcccaaaattgattaggctgagccttgggaatagtttggcaggtttaacatcccaaggctaacctaacgtagttgggcacggtcagcttgactgagacatgttttctgtgcttctaagtgttctgtcccttaggctgctatagnttcatgtttccattatggcaggtttagagaatccttaaaaagaacaattgctttgcttgcctaaaactacagtgcccccttagcctccattacttagtatctcttacagtttgctctggntctcaaataata

SEQ ID NO: 568632 - DNA, 186 bp, Homo sapiens
aggctaatataagccatatcataaatgctatgaagtgacatttaaaagcaccctgcatcactgtttatagtgtattttgctattctgccctttaatcggtgtcccttaaaacaatccccacagattactttcataaatagatttatttctcgtacgtagagggccaggttcatttatctcctattt

SEQ ID NO: 568633 - DNA, 366 bp, Homo sapiens
ttatgctacaggaataacaaacatttctcattggcaaaaatgtgttgattgtaatggttcctgttttgattaatagaatatgttttagcgtagttacaatgatttaaaattcgcagtctggaaatttaatttttgcatcaacctaatatttctatggtaaatccttgcaaacatggaaccaaggcattgggcccattccttgtgggtggggacttctttttcttggttttttaaaaaaaggccatggccgggcaaggtgggttaagcctgttattccaaccattttggaaggttaaggtgggtggatcacctgaggtcaggagttcaagaccagcctgactaacatggtaaaaccccatctctact

SEQ ID NO: 568634 - DNA, 225 bp, Homo sapiens
ggctgtctgaagatagatcgccatcatgaacgacaccgtaactatccgcactagaaagttcatgaccaccgactacttcagaggaaacaaatgggcattgatgtctctcaacccgggaaggcgacaattcctaagacaggaattcgggagaaactagccaaaatgtacaaggccacacaccgatgtcatctttgtattttgagtcagagactcatatattgtagg

SEQ ID NO: 568635 - DNA, 112 bp, Homo sapiens
gccggtaccagatgaggcagagaaccccagttctacgagctgctgatcaaagatcttgataccatactttaatctgtatcttcagtttctgaacataagtatgcaaaatctt

SEQ ID NO: 568636 - DNA, 257 bp, Homo sapiens
taaccctatcgcgtactgtttatcccaagtttatctgttatttttaattttttccccaagtttatttttctatttttttttatggaaaaatggggtaacttagcagtttcaatgttgacgacctgaagtttaaaaaacatttcaattcaaggtacttttaaaattcagttagaacagtaggctttaaaaattattagagacaagagtaccaaagcggtgtgtgtatgtgtgtgtgtatgcatgctggtggaagggag

SEQ ID NO: 568637 - DNA, 908 bp, Homo sapiens
  misc_feature (412)..(412): n is a, c, g, or t
tacatgcagaggcaatgctcgagcatgaatcggtcatgtcttgatcatgtccgagacgagagaacggagacgtcttcctactactacgggacgccactctctctatacaggatggaggaatctcaccatctccagcgctcaacacacctgacccaccgcgatgcgcatgcagcgatcacttgcagcgcgacgtcggaccggcgtcaggcacaacgtgacgtaatcagctatctcacgcatgacatcctcgatgatcctgtacgacaccacgtcgcgagctatcgatattgagctctcgacgcatatgcaacgtgcacgcaaacagctaatcaaccgatcatgacagatcgacctcacttagataatatgacgtatggacaccagacaagcatctgatatcacgacacactanagtctgacatacccgcacatcgtctcgcataagtacagcgaccgaacataccactacttcattactcaactacaccgcttgatgatcgacgtgtaagagataatgggatatccatgagtgcacgtgacacgctaggaccgtctactgtctacgagattgtagactcaggctctaatacggctgcacgccgtactgacacgaatgcatatccgaccgcgtcgatccgaattagacatcgggacagcgtctacttctatagcgaccaatgtttctacactaatatctggagttaggccagctagtgaacttccttacataagagctctctcacccgacatcaacttaacaattcgatgacacgcttacgtcgtcggcgcgggtcccaacgatacgcacgaacactaaggtagtcatcgcactacgagcatattccgacatcaacgcgtacagcctattcaccgctttatcacatgtgactaagtgaatccagtcgccc

SEQ ID NO: 568638 - DNA, 224 bp, Homo sapiens
ggggtggtcacgcctgtaatcccatctctcaggaggctaagaggcgggaggatagcttgagcccaggagttcgagacctgcctggtgcaatatatctgagacccctgttctccgagaaaacaggaacaaaataaaaaaactaaaagacacaaaaaaaaattaacggtgtaatttcccttcaaaagaaaaacaccccaaccccggtcgggtggggacgcggggat

SEQ ID NO: 568639 - DNA, 197 bp, Homo sapiens
ccactcacgatacctcaacattattatatttgagattagttcatgtcgatacatgcaggtctaagttaatatattttctttaactatctacataatatgtagggttgattgtataaacgcaccaaaatttattttacctgccaggcacagaggctcatgcctgtaatcccagtacttggggaggccaaggcaggtgg

SEQ ID NO: 568640 - DNA, 128 bp, Homo sapiens
agctgcagatgtctatcatataacaatcagtacaaggtttaaagttgaagatattttttacaaaggtaaatggttaaattttacatgacagatattttatctattggcctgttccccaaatggccatt

SEQ ID NO: 568641 - DNA, 195 bp, Homo sapiens
ccccaaagccctttggtttagaataggctttggggggttccaattggtggaaaaaagcttttaggcccgtcatgcaggtcaaaaaagctttttttgcagtagccccagttaaggggaatatgtattgtttcccaaaacaaacccaatatccagatgaaaatccgagatgttgaataaacttagcccttttgtcca

SEQ ID NO: 568642 - DNA, 342 bp, Homo sapiens
ccttggggccccccccctttttttccgggtttttttttttatttgtgggccccggggtcggggggggggcttttctttgtgttttttgccggaaaaaagcgtctttttttttttttttttttgggggggtgggaaagggggggggaaagggccttttgtctttttttttttttttttttttccccccaaggtgggttttttgcccttttttggccccccccggggttttgcccgggggagggggcgggggggggtttggtggtttttccgcccccccccccccgggtttttttctttttccgcccccccccccccctggggtttttaaggggtttttgggga

SEQ ID NO: 568643 - DNA, 160 bp, Homo sapiens
ccctcactgtacgcccaaaatataatatggatggcgagctactagtcctctgccttctctggtagagggcgacatgccgaagggtctggtgggggtttattggatgctgacgtgtcacgcctgcaagctgtctgtggcccacttgcgcgtacggagagct

SEQ ID NO: 568644 - DNA, 478 bp, Homo sapiens
tgaaattttcctaattgggccttttaaaaacatggctgggtggaacatttctgtaccctactggtttgaccagagccttagtaagtacgtgcctgaaactgaaaccatgtgcactttaatggaaggtaagctgaacctctttcttttcaaccctacatgtttcgccaaccagtgtacccgtaggtgttgggaacaatggaccacatagtccatggaacaagagtccgtggcacaagcaactggctactgacaaggttagctcgtggcatctgtcggctcttgtactggtttaagctttgccacagctggctcacttcattttatgcgccagtgggctggctgttattcttatttcttgacatttagtcaggtgaacgtcttcagatttcattatcgtatttggcagtgcacggtcaaatttctttctgttatatagtcgcaggccatgtctgcttaggattcaacatattggtgtcat

SEQ ID NO: 568645 - DNA, 411 bp, Homo sapiens
ccaaggccagcacagctggaaagaaaggagtaaagcggagaatggggctggagagggaccctaccaagccttgtgggccatgctaggcacttgtctttatttttttatccccagcctcagtaagtctatcaaaaactgctcatgcctataatctcagcacttttgagagactaaggcaggaagattgcttgagctcaggagtttgaggctgcagcgagccaagaccgtgccactgcactccagcctgggcaacagaacaagaccctgtctctgggtagggttgagtggagggagaaggccaggcacagtggctcacacctgaaatcccaagactttgggaggccaaggcaggaacatcacttgacccaggagttcaagaccagcctgggaaacatagtaactatgtttcct

SEQ ID NO: 568646 - DNA, 743 bp, Homo sapiens
atgcccctcattgacataaatattatactagcgtaaccatctcacttctaggaatacgagtatatcgctcacacctcatatcctccctaatatgccgagaaggaataatactatcgctgtcataatagcgactctcataaccctcaaagcaactccctcttagccaatatgtgcctatggccatactagtctttgccgcctgcgaagacagccggtgggcctagccctactagtctcaatctccaacacatatggcctagactaggtacataacgtaagcctactccaatgctaaaggctaatcgtcccaacaataatattactaccatgaacattgacgtttcccaataagttacacccgtgaaaaaacccgtgatcaccctgtgggtgcgtcccgggcatgcacgccagagaaggtctctaaaaaaccctgcgggtgtgcggccccggacccagagaatgctagaagccagagtggtcaggacacggacccaacgagagtaccccgggatggacagagagcgcagtgggttcaccgcgcaataaaaaagcgcgcccgtggacaacagtggtctcgcccacacatccggaggcttttgcgcgccgaattggcgtccactacgaggacgcccgggaggtgaaaacttgccgcgggaggagcagctcacctaaacatttagaccgttctacacacttaaccagattccgtccgaattcgacacggacctcagggttgcaaaaca

SEQ ID NO: 568647 - DNA, 222 bp, Homo sapiens
tacgtgatcacatatagttatgaaataggtatatcctgaatctggtactactaaactcactattttacatttgtagcacattttacttcaaaccagctagattcctccccagtatctacacatgtcgggtggctgtcacattgagtgcagccctgaggtctctgacctcaagaaagtgatggcctgaacgcgtcttttcagctggaggtgcaggacacaagt

SEQ ID NO: 568648 - DNA, 302 bp, Homo sapiens
agcagactgtctggtccctattccttatgaggggtttgttggggccccggtggagggaggggatttgggggttcagactgcggggaagcccgggtctccctcttcaacgccctcctccccctctgaccccccttccccactgggaccttctccagcttttcaccccgaaaaggaaaaaaaatgttatttttagataccttttatggataacttttgttatgaatatggctggtaacccttgtgtatgttattaaagataccaaatgttggggaaaaaaccaaaaaaccccaaaaaaaaaaaa

SEQ ID NO: 568649 - DNA, 725 bp, Homo sapiens
gccaaccgttgtgttctctgccccgcgtgttgttttccccccccccgcttttctctcgtgtgatataaccccccctctttattgccccccgctttatgcgcgcgctttgtataaacacccgcgctcccccccccccatggtattctgtttatataagcgctccccccctatatgtgagggcgcgctatatgtttgctcccccctccgcgccgagttacgcgctcgcgcgcgccccccgcttgtttcactctctgtgttgcgcgggaaagaccgcgcgccgcccgcaagtagctcttctgttttagtagcacacagcccccttttttgacgcacgggtttttcttactgcgttcgtgctcgcgcgtctccccgcgcacatatatatttcctccgcgcgaggtatttctctcgcccacacttcctcgcgcccgcgggggtctcaccaccaccaccaacatgggggtcgtctctctccccccgccccccctcttagtcggacaccatcacgctccctccattcttccgcgcgcggtgaacaccactcctctctctgttgttatacacacacgcatcatctctcccactctcttatcttcgcctctcctcctctcttccctcccccgccactcgacttctctccgccagtgcgttttcttctccttcttaatagaaaagaatagaaacaaaaccataataaaaaaaataaaaacagcccaccaatagaa

SEQ ID NO: 568650 - DNA, 290 bp, Homo sapiens
  misc_feature (1)..(1): n is a, c, g, or t
nccaaagcgtagtacccaacattgtaaggctgaggtgggcagatcattttagtccaggagtttgagacagcaggggtaactgcgtctctacaaaatttgaaagattagccaggcatggtggcacacgcatgtgagtgcagctgctggggaggctgaggcaggaggaccgcttgagcccgggatgtcaaggttgcagtgagccatgttcataccgctgcactccagcttgggcgacagagcaacacgctatcatttccccttgctgttttcttgggtactacgctttggca

SEQ ID NO: 568651 - DNA, 148 bp, Homo sapiens
ttcgaggttccccccattgactcctcggctttttggctgtcgcctcctgtgtgtctgtcccgtcttggtcccctggagcatatggtactttggaagcagagctagcaataattcctcttataagcagaggcaggacaagcagaggcag

SEQ ID NO: 568652 - DNA, 427 bp, Homo sapiens
  misc_feature (334)..(334): n is a, c, g, or t
atagcgacaccgtacccttcctctctgccggcattgaagcatcccaggtgaatgtttgccattcctggccaggtgttcccaatgtaccaccggaatattgattctggtatttgggtaacagtcctactttgtcaataacagccgttgaagttacttcaactcccaggccagctttctttcttccttttttggttgtgatcatgatcacaccaccttctgcacgctgaccatataatgccgtagctgcgggtcctttcaacacctggatatcgtctacatcatcggtattgatatcgttggcgcttacaggcgtaccatcgatcacatacaaggngtttacatcacccaaagatccggcgccgcgtaatctcactgtagcggcagaacccagtttagcgccggattccgagcgtacctggatacctga

SEQ ID NO: 568653 - DNA, 286 bp, Homo sapiens
tacacgcggctttgacgcgggacgtggcacaaattcctggcggagttcagttgcgcccatatcggacgaagctctactcccgggtactacaccacgtgccagtttgaacctggacttttgtcgtcgcgctacaaggcctgactgagcgagccctctactgaatgccacaccactgatgcctccacacttcacacatctaacatctgccctgaaccgtagtcgtgggtgtgattacagaggcgcgcgggagtctagtccggttcctagcgactaacaaactagttcc

SEQ ID NO: 568654 - DNA, 232 bp, Homo sapiens
ggtcacctgtttgagcctgctgaggtcgagaatgcagcgtgcaatatgtgacactgcacgccagcctgggagaaagaacaagactttatctcacaaaaaaaaagaaaaagaaaaagtaccccaccaatgggaaaatattggccaggtcatatttctgataaaggactagtatccagaatacataaagaactcatagcactcaaaaataaaggagcaaataacccaactctta

SEQ ID NO: 568655 - DNA, 1348 bp, Homo sapiens
ggccgcatcttctatcgcgtcgccagcgcgagccacatcgcgtcaccacacccatggcggcaaggtgaaggtcgcgagctccaacggcatttggtcgtcattggcgcgcctggtcacccagggctgcttgtcaactactaggataaagtggatattagttagcgcatcgaatgaccaccttcattgacctcaactacaatggttaacatgtaccaatatgattccacccatggcaaattccatggacaccgtacaaggctgagaaacgggaagctatgtcatcactggaaatcccagtcaccagacgataaccaggcagacgcagccacccatccaaaatcaagaagggagcgcatgcgtggccgccgcagatacgataggtggcagatccacgtggacgatctacacaaaacatgagagaacggctcgcgggacatcactacaagccaggcgggcgcagccaaaaagggcgtacactccagtactgcatgacaccaccgcatcaagcctgcactagaccaccgcacgcaaacagtaacactgggcgataggtgcaagcacacagcagcacagacgatcgaacgaagccacgcgcgtaccaacgaaaacaattacaagcacagatcggaggcgcctaacctagaccagcacacaccaacactaggcatcagagcaaccccccatggcgccacacggctccaacacccagcgcaacacaacctcaactgggagaatcccgcagcgaccaagcggaccctacaactagcaacccacaacagacaccacccacaggcgcccaagcccaccagtgcgcaaaaccccaagagaacggaagcctggcataggaccttggagaccccacctcccggagacgaaaaacctagataagagaagacagacttggccccaccggcacgcggctccaccacaacgaacacacaccagaccacacacagcaactaccagaacctaggcacgagccatagcccaaccgggcactgatggcgacgcaaacaggactcaacacaccacaggaaagcgtcgaaacacacaggagaaagagctcgcaccatgagccacatgagcgccctttccacgagggatagccacaaccgggcccacaacgatgggtcaccaaagcgagggacaagcacgaaaacgcagtaccggcgaagcagaaaccaacaccggcccaacacgactgacacgacgatcacgacgaacagacggaggaacacccgagcgacgtcgaaggggccccccacagccatgagcaaccacgcgaacgaaccccgtaacgcacacagagaagcaaaacacaccagcacagcacaaaagaaacaccaac

SEQ ID NO: 568656 - DNA, 291 bp, Homo sapiens
ctagctcggtacccttccggctctctggggaggagcttctcttttcagttcctgggtgagggcctgggattccatctgtgagatgggggtcctgtaagcaggactccatcccgctttgctgagaatttttttttttccctttttgcccaataaaaccttgctctactcaccctttagggtgtcctgtcctcatgtctaaattttcctggttgtgtgacaagaaccggattttagctgaactaaggagcaaaattctccaacgcttttgttgcccaggctgatcttgaacac

SEQ ID NO: 568657 - DNA, 547 bp, Homo sapiens
gatctgatcatcgtaggattcacacaggagagcagccctatgcatgcaacgagtgtgcgcgaaccttctagcctacagactcgtacacgtcagccagcatgagcggtacaactcataggagagaaaggccctataagtgcgggcagtgtgggaaggccttcgggtggagcatgcacctcagctcgaatacactagccgaatccacatgggggacacaagcgctatgaatgctgtgactgcggctaggccttcagtctctgctcgtccctcagcgaacattgaccgattgcaccaagctggtggataggcgccttcgaatgcaaccaatgtggcagagtctacactcagcttgggccgctcattcagaatcagaggatccacataggagagaaactctatgaatgtaaccagtgtggcacgagccttcagccagagctcccttctcatcgaacaccagaggattcacaccaaggacaagccgtatgggtgcaatgagtgtgggaaatccttcagccagtagttggagccagtagtgggtcggggatcc

SEQ ID NO: 568658 - DNA, 1386 bp, Homo sapiens
  misc_feature (1386)..(1386): n is a, c, g, or t
ggacccgctcaacatgggccgcgttcggaccaagaaccgtgaagaaggcggtccggagttcatcataagtagtaagtactacacgcgtcgctgggcaacgacttcgcacacgaacaatgctgcgtggtgcgaggagatcgccattgatccccagcaatgagctccgcagcaagatagcaggttatgtcgacagtcgatctgatgaatgcgaattgcaagagaaggcccagctagagatggtattctccagtctagaggctgccaggaggatggagcacgaggaacaggagagacaaagttaatagttaccgtagcaggtctccatgccttgtgatcaggagcagatgcgatcagacagtaagataccctgacacttaaagggaagatgcctgcaagcttgtcggacttgacggcaaggtctgtcgccaatctatcgagggtcaccgtcagccgcgtatcacgcatgtgcggcatgtgcaactgtgtccaatacaccggctcctgcggcgtgcagcactgcgattgtggacagttgtgtgtgtcctggtacgctgtctggctactcagtataacccatgatagacagtcttgcggaatcacaccagaaggacgcaagagcaccatagacaagaaccgccgtgccgcaaggggttaccacttaaaggtacctgcggagttgtcccggtcagcgaaacgcaacggaggtttatataactcggtagcaatcggggtgcacatccaatgtgagatgtgcggggcccactcgcacgactcgttggtctctgctgaactcttcgagacgatcgtgtgtccagttgaggtgtcacgcaagacacctgtgggctcaccacctaattctctgctgcatctggagagtatccgccccactgtaatttaccgccaggaaagaccgcgcccacacgtgaagaagggccattcgccatggcagacacagctcgagcacgacgtggagctagtaccaccgccgcgggcagacacctaaccatggggcatacactgccggggggtaacaacccaacctaaaaccaggaggcgaacaccagcgaagatcggcgcgaaggggcaacggcataggacagagaacgcacgacgacgggtaacaaagcgccaacatcggagcgagggagtaatggagacaacagctgaggggagcaacacaccccccgaagagagagcggcacaagagacagatacacgcgcaccaaacgagggacccaaccgcctagatataggcagacagagccagcaaacgatccagtagagacgcaagacccacagtagacatagggactaagacagaacagaacacgcacgcccacgagaagcgcaaagcgcgaacccaggcaacaagcggaaaacacaggn

SEQ ID NO: 568659 - DNA, 708 bp, Homo sapiens
ccttaaggggcatttttaaaagcccccgggcaccttatttaagggcttaaaattgaatcttttcatataaacaaggaaaaaaataaaaatactgttgttactcttttattcacccttttacttaagcttttaaccatgccataagtaagaaaatttataaagttttgaaaaaaaaaattaactgttcttattttaagaataatgactttgtttgtttacaaatctagaaatcttccaaaaatctcccaaaactaatcagtgagtttagtagtgttgcaaaatgtaagctctcaaaataagggggcttttgtatttctggaaataaacaatgagcctttggaaaattaaataagaaaccaatttcttttaaagtaacatttaaacaaattgtgggcttaaaaatagattcaacagcctggggagcctgtcttccccctgtaatctcaacccttttggaggccgaggtgggcagatcattgggtcaggagatggagtccttcatgcctaacagtttaaacccctcttttctaaatataattacaaaattatctaggcgtggtggcatgtgcctgtagtccagctcctttggaggcttaggcctgggaattgcttcacactgggaagcctaggttgcagttatgccatttcctttagctgccccctaacctggggtaaagagccagactttgttacttaaaaaacaatata

SEQ ID NO: 568660 - DNA, 131 bp, Homo sapiens
ctcccgctggggagacagacttcaggccagccgtgtatatgtgcgggttgctagttgccctttgctgggagactcccaatgactgtgcactctctgcttaaagactgtagcaggcaactggtgttctcacg

SEQ ID NO: 568661 - DNA, 346 bp, Homo sapiens
cgcgaacgcctcgtgtgcttgctgagcgggcgcactgccgctggtctggtctttcccgctaactcgtccgacggacaggagtcttctcctatctccctgtatccatgccttcctacttctgccagtctcccatgaagacacttccagcagcgcggcgtggactacttccagaacagggccctagagctcagtccgccagactgagcaaagcctcttagataaaacaagaactaccatagtagggccaacgcggtactcaggatacacctaggggggtcaccagggacttgttaaaccttcccccggtctgtatgcggaaacttcctggggcggaaggcatttgaac

SEQ ID NO: 568662 - DNA, 211 bp, Homo sapiens
ggaggcgtctagaggatcccgtgatgttatcgcccaacactcctgcacgatgactctggttctaatgcttgttcagtctcttcaaactgcattttctgccttttaagtatgctttgtaattttctgttgataggtagacctgatacactgggtaaaaggaattgcagtaaacagggctttcatcctgttttcaggtgttggggataacata

SEQ ID NO: 568663 - DNA, 517 bp, Homo sapiens
caaggagctcggcagatgtcaatgtcgctccatgcaccatccgcaagtccgacgaggtccaggtagttcgaggacactacaaaggtcagcaaattggcaaggtagtccaggtgtacagaaagaaatatgtcatctacatcgagcgggtgcagcgtgagaaggccaacggcacaactgtccacgtgggcattcacccaagcaaggtggttatcaccaggctaaaactgtacaaggatcggaaaaaaattcttgaacgcaaagccaagtctcgaccagtggaaaagagcaaggcataatatacagaacaacttattcagcaaatgcaggaataaatagaacctgttgtgcacccccggtttagccgtagcttttgaggttagggtgtgtctctttcgaacttttcgcaacgtatgccacatttcatttcctgttttgttacctgtgcctctgtacctcttctcatggcaattctaagtaatgtttttatcaatacaaatggccaatgcttcctaaaaaa

SEQ ID NO: 568664 - DNA, 104 bp, Homo sapiens
ttcgattggcgggcacttatgcaagcgtaactagtcttaacaagctttgagatgcaagggattgaaagagttcagactcgtgaccaagatgttgagtgtaggat

SEQ ID NO: 568665 - DNA, 428 bp, Homo sapiens
  misc_feature (56)..(56): n is a, c, g, or t
  misc_feature (81)..(81): n is a, c, g, or t
  misc_feature (92)..(92): n is a, c, g, or t
tggggttcatcctttcctagggagcttccaagggcccacacagcctgctccccgcnccccatggaggcgcaatgatagcanaattactggcnctgttaacctgctggagtgggaacctggagtcctggaaggtgggacttgctcagggactcactgctggccttggggagcagagaactcaggtctttgtgattccgaagtccaggttcttccacctgcaactgcagtttccagaattggtcccaccccaggaggatcagccagatgcaacgccaggagcagcatcagccacgctgtaaacaagggggaaacgccaagcgcattacagaggacgtcagccctgccatcactgggctggggaaacaatgccagccatggctggtctccgggttcacagtgataggggaaataaacccttatttgtctaa

SEQ ID NO: 568666 - DNA, 266 bp, Homo sapiens
  misc_feature (103)..(103): n is a, c, g, or t
agccttcctcgtagctttctaggagttagatacgggcctttcttgagaataagactaccaggaatagcaggttggcgggattcacttctacatttagtaagangccagttcccccggcccagattgctctggagctagttctcaatcggctgcatcttgagcatcagacacttcggtatatagcactagccggtaggaaccagcacttgagcccagtccagcacctaggttttcagactaataggcacagtatatgattttggtct

SEQ ID NO: 568667 - DNA, 520 bp, Homo sapiens
  misc_feature (56)..(56): n is a, c, g, or t
  misc_feature (81)..(81): n is a, c, g, or t
  misc_feature (92)..(92): n is a, c, g, or t
tggggttcatcctttcctagggagcttccaagggcccacacagcctgctccccgcnccccatggaggcgcaatgatagcanaattactggcnctgttaacctgctggagtgggaacctggagtcctggaaggtgggacttgctcagggactcactgctggccttggggagcagagaactcaggtctttgtgattccgaagtccaggttcttccacctgcaactgcagtttccagaattggtcccaccccaggaggatcagcctgcagtggctataacaagaccaaaggcttgaggtgcacttccacagtggagctgtcttcttggcttctgctgtgagaagattgtccccctgaatggctgccggcccttcagcctcgccccgccaagagacacatggaacagccagagcccagcctagagcctgtatcccagcctagcctgaggcagagacacccagccaagaccaactgaccttcagctaacctgcagatgcatcagggggaattaaatgattgttct

SEQ ID NO: 568668 - DNA, 467 bp, Homo sapiens
  misc_feature (5)..(5): n is a, c, g, or t
  misc_feature (37)..(37): n is a, c, g, or t
  misc_feature (46)..(46): n is a, c, g, or t
  misc_feature (105)..(105): n is a, c, g, or t
  misc_feature (255)..(255): n is a, c, g, or t
  misc_feature (328)..(328): n is a, c, g, or t
  misc_feature (330)..(330): n is a, c, g, or t
  misc_feature (398)..(398): n is a, c, g, or t
  misc_feature (439)..(439): n is a, c, g, or t
ttggnaaatactggttcctggataaaagttgttgganaattagganagaggtttaggcaggagagagaagagagatagggacagtgatgtccccaggggtctgtnaggactcaggcagctcaggctccttaaaaatgccccagaacagaccagaaaaggagttgggggcccaggctcagtgcttcacgccgtaatcccagcactttgagaggccaaggcgggaggatcacttgagccccaggaattcaagacaancctgggcagcatagtgagaccccatctttctttataaaacataaaaaagaaaattagctgggtgtggtggcananacctgtagtcccagctacttaggaggctgaggtgggaggattgcttgagaccaagaggtcaaggctanagttagctgtgatagcgccattgcactccatcctggacaanagagtgagaccctgtctcccactccaaa

SEQ ID NO: 568669 - DNA, 374 bp, Homo sapiens
  misc_feature (35)..(35): n is a, c, g, or t
  misc_feature (37)..(37): n is a, c, g, or t
  misc_feature (43)..(43): n is a, c, g, or t
  misc_feature (56)..(56): n is a, c, g, or t
  misc_feature (254)..(254): n is a, c, g, or t
ttacaggactgacgggagatgaggtgggaggatcntntgaganaggaatttgagancagtctgggcagcatagtgagaccccgtgtataaaaataaaataaaataaaaagcccctcaaacctgcaaacagtagaaatatacttttagtaaatgtttgattagtctgagtgctgattgtattgattaggtgacatgagccatggcagtagagggtcccctggacttgtgattagcatggtgggagggtgcatctngcttatgttcagggtgcagtgtgggcgattctggtcctcccacaactgccctgggtgcctctgatgcctgagccttctatcatgtgctcaccctatggccttggggtcctcagtctggga

SEQ ID NO: 568670 - DNA, 365 bp, Homo sapiens
acccttgaaaaccaattttggctaaggtgaattaagcccaaaccacaaattgagcattatattgtattgattccattcattatgaggtacctagaataggtgaattcataaggacagaaagtagaatagaggttactagggctgggggtaagggagactggggagttactgtttaatgggtgcagagtttctgtttgggatgatgaagttctggaaatagatagtggtgatgtttgcacaacattgtgaatgtacttaatgccagtgaattgtacacctaaaaaatgggtaaaatggtaaatttcattacaggtatttcaccccaataataaaataataatgccagaagctgaagagtaaaaaaa

SEQ ID NO: 568671 - DNA, 424 bp, Homo sapiens
acccgcaataaaatgagtttccccaaacccaggcgatcaacgagcaccttgcctggatctggccccagcgcagaactccatgcttcatacagccagagcaatggccacactgctgcggctacaaacacgccgatgcgccagatgggatagcgcatcagtagttcttccgcagatcgaggcctgtatataaagaagcgacctcaaccgaatagccattgaacatctgcgtctcgcgcacattcggactaaacaggccgctcggcagacggcgctcccgcgcctgggtccagcgcgggtgatcgaccgtaggattcacatccgcataaaacccatactcatcagatgcaatactctgccaggtcgttttcggctgctcactgaccagactgatacgcacgatggacttcacactcttgaagccata

SEQ ID NO: 568672 - DNA, 483 bp, Homo sapiens
gatccccccgggggcaggaattcggcccaaaaaaaaaaaatatcctactatttgtcccaacagggaggggcctggaaaaccttttattaaataaaataacccccccccaaaaaaaaaaatgttttcccttttttgtggaaaaaaaaaaaaaaaaaaagctccaaaccccaaaaaataaaacatggcgcccctggtagggaacaggaggaggaaacaaaaaaataggtcaaaggatacaaaaaaaccaatttccaaaatgaacaagtgtaaaaagttaatgtataacataagggctaaggttaaaaaaattgtattagggatttttttaactaaaaaaattttaacggcttttgtcccaaaaaatagttgtgtgaaaaaaataaaaatgtaaatttgcttccccccagtaaccctttttttatttttaagcatccccaaatcccctgttgtaaacccccaaaaaacccaataaaatgtttttta

SEQ ID NO: 568673 - DNA, 420 bp, Homo sapiens
ttcatgggaagatggtcacaagaaaggaatccagcccaagataaggactaagtctagggcacccacaaagatggcagaactagcccataaaacggcttgcgacagagtaaatagacggatgggcctgctttggcctcacctagctctggaggctatgtgctacagcagcagctgcactatacagtgagtattcggtaattacactttgctcacgggtagcaccttcggagtcctcctgccttgacccccaggtcagcttatggtggcctcacaacttcccctatgaggtaggtgaagtattattaccatcatttaacagatgggtaaaccgaggcccagggagtgcgggtgacttgcacaaattcctgggatggtggcaaggctccggtgccctccccacaccctcaagttcccccattc

SEQ ID NO: 568674 - DNA, 530 bp, Homo sapiens
tgattcggctctagtgtacagactcatgaaataatccatggtataaactagttatacaaattacataattcaaagataacatcgttattcttaagccttacatatatggtaacttgcatgtctccatacctggatttgggatgaaatacttaatgatctttccattggaattacctggaagtgaagaggtttggtagcttgtacagtgtcagatgatgagcaccactagtctaaatatggcgatacactgcattagctggtgctatttttatacggtgaagcaacagtttcgcggcacaataataaaatagttcttcgataatcatgttggtcctgatgttaatatttcatttagtacctcgtgctagtattagtgaaagtgctaacttaaacttacggaaagttactttacaaaaggaaatttaagccagagcaatgcaaagttccaagaaaatgtttactttagtcacaaatctggttcaactaaagccaagatctgtcacctttatcataatagattaagggtagat

SEQ ID NO: 568675 - DNA, 146 bp, Homo sapiens
cacagacaatgataagtgaaattgacatttgcttttcattttgaaaacatacttcatcattgttcaatcttcacctgtatgtgcccatcgatgagatggcaacaacaatcccattatctaaccacacatacaatagtcaaagtcat

SEQ ID NO: 568676 - DNA, 894 bp, Homo sapiens
ggaaggccgaggccaagaatgtgctggtgctgtcagatcctggcctgcgcggtttccgtatccttggtctgctctccagcgtgggcctggctgtgcatgcacgaggtgtccatcagagcgtggtcacctgatggcccaaggcagcgatcccagtcctgctcctgtccaaaaggtcacgtagacccgtgtgtttgcctccaagaaccccaggcaggccggggcgacgtatgtcggtggccaaggtcttgggattgaatcgccattcggttcaatccttgggagaccttcgtcgcagggaagatctcgtcttggttgtgatcccaatggattcgctccagagcccgttggcgcccgcttgtatttgcgggcccccgttgacgttcggacattgaaactggcggccccgaatttagggtacctttggttatccccgcccggggctgtttacaggaacgcttaggttttgtcgagcccctggcaatattatcggcgagcggttggggctcatttgccccaggtaaccccgatagtccgcctgctgctcgcggttcgcgattccggttgattgtactccgttggtgccctggtcgcgcgtttcaacccctaattgacgtgaactgtgtcctcccttcacgactttcgccgattgggttctctcgggaccccccgtcttggctctgtgatttccgtcggctaacggctgggtggcttccaattggaggcgcacggcattcgttcctctgcttgtgtagtgacggccttagttattcgcatgttaattccttttacttccagggttggggtgaagcgggcgcttgagaggaactccggaaatctggtgtcggctgttcgggcgtcattctattggcgctccccgatcggttgtggccccac

SEQ ID NO: 568677 - DNA, 115 bp, Homo sapiens
ataaaatagtttattttatttcagtgtttgctccttgcggttcagaagcacatctactgcctggttggaacccaaggagcaaacactgaaataaaatagtttatttttcacactc

SEQ ID NO: 568678 - DNA, 110 bp, Homo sapiens
tagggcgaatccgccttgatggatattccctgggtgccttaaacgtgtttaccactacggttgtgttgtgagtgtcctcgttcttggcagttgcgtcatgttgattaact

SEQ ID NO: 568679 - DNA, 1079 bp, Homo sapiens
ctatgtcgttttcttcgtgtctccatatttgtggcgccgctcactatttgcccctctgtgttagcttgcaacgcggggtttttcgcccattacacactggtgggcacaatccctgtggcccttgtgcttcacgggggtttatccccccttgctccctactctgtatctacctgctcttggtgtgcattttgcgaagatgctgtatgtgtttggtgcttcccctaggggggggcacaactcttcaggggggcccgggtttcattcgactatccctatctttccggtcctctgcgtaccctattcaggggacctctttgcccatggacctgccccagcagtttggagaggctgaagatttaagtgtaaatcaggcaagccaaccagtggtccaaaccagccgtctggtctccgtggataccggcgtccctacaattaccggcgtcgcccgcgtcctcctaacgctccttcacaagatggcaaagaggccaaggcaggtgaagcacccactgagaaccctgcgtccaccctacccagcacgaggcagttgctgaggtaacacccaggcgtccttcaggcgaccttgcaccatccggcaaggtggacctataagagattaatagagcccattctagagaatataagccaatatagcaaggccacaacccttataccacacaccccaatgagaaacactccacagcacatataaggtggaaaagctaacccacagaatttggaacaattggaaatgtttaactgttaattctttaagagaacacactaccaaaaggaaatgtcaacacaatttttccagcaagctgagaaccctgggaaattcctggaccggaagaccacagagagtagcctttccacgtttcagcacaccggctaggtttctattttttttcctggtttttactgttttggtgaatatatatattgaaaacacagaaatattaataccacactggggagaaccccacaccacaagaaattctgaaatatatagttaaatgcttttttttccgttttgtgttcattttggatgctggtgctaaacctccaagtgtcatgattta

SEQ ID NO: 568680 - DNA, 504 bp, Homo sapiens
ctaacacacattgagagatcacgttgaacatacttgaagctatcctgctagcctgaggattgtaggtggtgttataggtgtgtgtgtgtgtgtgtgtgtgtgtggacattttacatcttaatagtggtacatattagtgcctttctcaagggaatcttctgcgtgtctcagggtcataggagagacaaaaatatgcagggaataaatccagagtggacttgttccaccttacctttttttttattattatcggcttgtgtgtaatctttttttaagatgacaggttattaagcaagatgattgtagcacgacatctagtgctgcttattctaggcaatcacaccgttttaatcttcgcctcccttaaaatggttgcttgctaattatggtggaagatattctccatcttccaactactcattctacaacttgtgttcacaaagaaagtattctgtgaggccttacaaaaacagagcttcatgcctggcctattctctcaatagg

SEQ ID NO: 568681 - DNA, 110 bp, Homo sapiens
tgtttatggagaacaccaaagcgagacgaggaggaggaggacccgacccctctgtgatatttgcggcagagagcgaccgatgagggacaggctatattgctctgcagacg

SEQ ID NO: 568682 - DNA, 126 bp, Homo sapiens
  misc_feature (4)..(4): n is a, c, g, or t
cggnggagggcgcctgaaggctcttcacggcgcccaccatcgcctggtgctccatgcccagctcagccagcaactcggcgctgaccaggcgcgccatcagacgcctccagccgccgactgtcatct

SEQ ID NO: 568683 - DNA, 1190 bp, Homo sapiens
  misc_feature (267)..(267): n is a, c, g, or t
  misc_feature (287)..(287): n is a, c, g, or t
  misc_feature (302)..(303): n is a, c, g, or t
  misc_feature (352)..(352): n is a, c, g, or t
  misc_feature (354)..(354): n is a, c, g, or t
  misc_feature (375)..(375): n is a, c, g, or t
  misc_feature (390)..(390): n is a, c, g, or t
  misc_feature (401)..(401): n is a, c, g, or t
  misc_feature (404)..(404): n is a, c, g, or t
  misc_feature (408)..(408): n is a, c, g, or t
  misc_feature (411)..(411): n is a, c, g, or t
  misc_feature (420)..(420): n is a, c, g, or t
  misc_feature (530)..(530): n is a, c, g, or t
  misc_feature (865)..(865): n is a, c, g, or t
  misc_feature (890)..(890): n is a, c, g, or t
  misc_feature (903)..(903): n is a, c, g, or t
  misc_feature (987)..(987): n is a, c, g, or t
  misc_feature (1007)..(1007): n is a, c, g, or t
  misc_feature (1025)..(1025): n is a, c, g, or t
  misc_feature (1047)..(1047): n is a, c, g, or t
  misc_feature (1049)..(1049): n is a, c, g, or t
  misc_feature (1070)..(1070): n is a, c, g, or t
  misc_feature (1080)..(1080): n is a, c, g, or t
  misc_feature (1088)..(1088): n is a, c, g, or t
  misc_feature (1108)..(1108): n is a, c, g, or t
  misc_feature (1123)..(1123): n is a, c, g, or t
  misc_feature (1125)..(1125): n is a, c, g, or t
gtaggaacaaatctattggaaaggagagttggactgaatgttggcccacaggattgttgagctgtggcagctgccttcatgaaggcttgccaccttgggacgccccagtttactggggtgtcttgcggagtgcagaacggctttctggcagctgcctgggtttggccaggtaccctgccgtcccctcccgccggtcctagacccctagtccccgttccgtgtctccagttgctagttcatggggatggctgctgttctgagaacatnagaactgggaagagagatgnagtcacatggatttnnggtgggcattattctggactttcgtatccaagttagtcccccttattcnantgtgggattgccgttctaagnagttacctaatgccngctgctgaagngcngctnacnggaggcggnggcggccctggcaactgccccttgcattaggtcttgtgtttgatgtgttcttgtgaattgactttgtcagaacaaaatatttacgcgtttgggttcaggaatttcttttngctccccatctggctgtgaaattcaggaaacctcccgttgcctagtaatcaccccatgtaggtgtacacttgtgacaaagtgcatctgaccactaaggggcccccttggtgaccccagcacattcacagcagtgttaaaatggcctgcattttggagatgctggctggcctttcagtgcctcccaggaagacacatggcctttccctcttcagatgcctgaagggagtgctttgaggcaggtgatgtgctgggagtgtgggcggcctccctctggccccggggccctctgtggaccttggctccctccgtggacctgggcttcgtggtgagcacngcagcctccctgggcattccctccngcgccagcacccnctgcaacatatagacctaagtgctattgtattttggcttggtgtgtatgctcttcattgtgtaaaattgctgttcttttgacantttaagtgattgttttgttnactgtaagtttgaaaatnaaaattaagaaaaaaattccantnactgtgctgtggttggagacnttatttaccnagatgttnactcttcctttccccttccnttttgaggagctgtntnactcctcctccccccccgtgctttgtagtctctcctatgtcataataaagctaccttttctctga

SEQ ID NO: 568684 - DNA, 1025 bp, Homo sapiens
  misc_feature (267)..(267): n is a, c, g, or t
  misc_feature (287)..(287): n is a, c, g, or t
  misc_feature (302)..(303): n is a, c, g, or t
  misc_feature (352)..(352): n is a, c, g, or t
  misc_feature (354)..(354): n is a, c, g, or t
  misc_feature (375)..(375): n is a, c, g, or t
  misc_feature (390)..(390): n is a, c, g, or t
  misc_feature (401)..(401): n is a, c, g, or t
  misc_feature (404)..(404): n is a, c, g, or t
  misc_feature (408)..(408): n is a, c, g, or t
  misc_feature (411)..(411): n is a, c, g, or t
  misc_feature (420)..(420): n is a, c, g, or t
  misc_feature (530)..(530): n is a, c, g, or t
  misc_feature (865)..(865): n is a, c, g, or t
  misc_feature (890)..(890): n is a, c, g, or t
  misc_feature (903)..(903): n is a, c, g, or t
gtaggaacaaatctattggaaaggagagttggactgaatgttggcccacaggattgttgagctgtggcagctgccttcatgaaggcttgccaccttgggacgccccagtttactggggtgtcttgcggagtgcagaacggctttctggcagctgcctgggtttggccaggtaccctgccgtcccctcccgccggtcctagacccctagtccccgttccgtgtctccagttgctagttcatggggatggctgctgttctgagaacatnagaactgggaagagagatgnagtcacatggatttnnggtgggcattattctggactttcgtatccaagttagtcccccttattcnantgtgggattgccgttctaagnagttacctaatgccngctgctgaagngcngctnacnggaggcggnggcggccctggcaactgccccttgcattaggtcttgtgtttgatgtgttcttgtgaattgactttgtcagaacaaaatatttacgcgtttgggttcaggaatttcttttngctccccatctggctgtgaaattcaggaaacctcccgttgcctagtaatcaccccatgtaggtgtacacttgtgacaaagtgcatctgaccactaaggggcccccttggtgaccccagcacattcacagcagtgttaaaatggcctgcattttggagatgctggctggcctttcagtgcctcccaggaagacacatggcctttccctcttcagatgcctgaagggagtgctttgaggcaggtgatgtgctgggagtgtgggcggcctccctctggccccggggccctctgtggaccttggctccctccgtggacctgggcttcgtggtgagcacngcagcctccctgggcattccctccngcgccagcacccnctgcaacatatagacctaagtgctattgtattttggcttggtgtgtatgctcttccattagggcaactgctgctccttgctctgtcttaggggctaagattcattaagaactaaatgctctt

SEQ ID NO: 568685 - DNA, 111 bp, Homo sapiens
cctggcaggaggactacggacgctggaaggactcaccctatggaatcgggcctcgtaggtggggtgacaatgtcagagttgtctataaatcgggggggaggcgcgcgccga

SEQ ID NO: 568686 - DNA, 235 bp, Homo sapiens
gaggcacacacccatccacaataaagctaaaactcaactgagttgtaaaataacaccagatagacacaaaatagactacgaaagtggcatttaacatatctgaacacacaatagataagacccacactgggattagataccccactatgcttagcacctaaacctcaacagattaaatcaacaaaactgctcgccagaacgctacgagccacagcttaaaactcataggacctga

SEQ ID NO: 568687 - DNA, 897 bp, Homo sapiens
aatagttgagggctctgaagaatctgggtgactgggcatgtcgatccatatccaccattatgtgacattaaaggatcatatactgcgcagtttgaacataccatcctgtcgggtccagcatgtaggaagaagtcggtcgagtcagaggacgatgactgatattaagagctctggagatccaaagactcgaatcgtcaaacacgcttatatagttctcgagtccctcgctttggagaaccaacagtgatacccagtaattaagtatggtcgcttaccatgttaggtctgattgtataactagatgggatcggccagtgtagatactctgttagtccgatggttgtgaacagaaatgacagagaagttgggactacaaggcaaatgcggtctgagatgttatgaaacgcaacggaagaaacagcgtgttccggactttcacatgctaactgtattgtgcccctttcctgtctcagcgcatagagagtgcctcatgaaagctcgaagataacgtctcaaggaatgacttataccggttgtggttgcgagagtaccctgaggaagaggatactcttcgggcactgattgatgattgtccaatgaattcttcactgtggacatgcgtatcgaatgacgtagatccaggttctgaacgtattacctctggcgtggctctataaccttcctggagatgcagatctgtggacataactaaagacaattggcagatctgactaactggcaacgtagatcagaggggcccaagagacgggagggcgggacaagagcgttgaacgcgacacgggggacagagtggccacggagccaagaccccgacggcgggacgaacgggcgggccccacacggagagccaatgaacccaagaagccggggacccga

SEQ ID NO: 568688 - DNA, 177 bp, Homo sapiens
agcagcactcagcgaataggcaggtttgaaggatggaaaagggaagagaaccattgaagaaacagagatgtgtaactcttacataccgtaggctaaataaggaagggttagagtggggcgcggtggctcacgcctgtaagttccatgcactttgtggaggccagtggagggcaggat

SEQ ID NO: 568689 - DNA, 112 bp, Homo sapiens
ggtaatccatcggattgctaccgccaagcgtagaaagttgattcaaggagatcggcagaaacagagtatatgtattgcacacgttgcaaataaatcacaagcgcagttcacc

SEQ ID NO: 568690 - DNA, 237 bp, Homo sapiens
aacacttataattctcacaaccatcttatgaggtaggtactattagcatctttattttagagatgaaaaaaaaaggacaaagagatcataaaatttagagaggatcatacaggaagtaagcagtagaacttgggtcttaaactaaagcttactccagaggctgagtacttaaactgcggtgctacgctctctctccttgcgagagaggaaaacaggctacattctaagcaaaagcag

SEQ ID NO: 568691 - DNA, 980 bp, Homo sapiens
  misc_feature (969)..(969): n is a, c, g, or t
ttttcttgctgatattttcaatttattactgcagtagataattgctctgaaagtgcaacactaaatcactcttgtcatagcctctgctccgtttccactggcaaatacttggaaattcattcttcgagcattgtggaccacaagcttctctctgggtggaaaattattgccactgccagtatcatagggaacacacacacacacacacacacacacgaacagaaggattcaaaaagcagacactggagaggagtaggggccaatttcaaacagaaaacccaataaagggctggagaggagtaggggccaatttcaaacagaaaacccagtaaagggctggagaggagtaggggccaatttcaaacagaaaacccagcaaaggagttagaggagaacagctccaactgtgcaaagtggagaccgactctccactctccagtggcaacctcacattctggtactgtgcaaagcggagaccgactcttcactctcctcacattctggttacgttggccctggtagacctttatccctttgcctctgtaacggtgataccataatcataaccgtgccacatctcagcatatcagaggcccatggagtaaaaatagatgaaaagacctctcaagctagtttggaaaaatagagggtttagataaactgactatttaatctcctacttaaacctgttaggcagaatatctgggagaacactgggcgtaagatgctgcctaacaggcataaccccttgctctaaccagcctagggccagtatgtttttgatggaaaagacaactgtcaaatactacaacgacaaaaaggaagggaaaacatgagcagctctagaaaacgtaagattcaaaactctgaacaacaacaacaacaacaacaaaactatggacaacacacctagccaggaggcctgaccactcactcactcctaagcacactctacacatacacactganttcccacacac

SEQ ID NO: 568692 - DNA, 312 bp, Homo sapiens
tgagacagggcttcactctatctcccagactgagtgcggtggtgtggtcagagctcattgcgaccttgacctcctcggctcaggatgtccttccaccttagcctcctgagtaggtgggactacaggtgcacacaatccctggctaatttttttgtatttttgtagagacagggtttccccatgttgcccaggctggtctcgaacctctgggctcaagccatccgcttgctttggtccctcaaagtgctaggattataggcatgagcgatcatgctggcagagtctttttccttccaaagtttgttgatgggg

SEQ ID NO: 568693 - DNA, 104 bp, Homo sapiens
ccacctccaaggctatgctttgaatttttaatcgttcaacttgaggttgaagatctgatagccggttgacttcatccttacaaatttttaactgacttttaatt

SEQ ID NO: 568694 - DNA, 372 bp, Homo sapiens
  misc_feature (14)..(14): n is a, c, g, or t
  misc_feature (18)..(18): n is a, c, g, or t
  misc_feature (48)..(48): n is a, c, g, or t
  misc_feature (98)..(98): n is a, c, g, or t
  misc_feature (146)..(146): n is a, c, g, or t
  misc_feature (176)..(176): n is a, c, g, or t
  misc_feature (292)..(292): n is a, c, g, or t
  misc_feature (318)..(318): n is a, c, g, or t
ttaaaaataataantaanttgaggccggatgtagtgactcatgcctgnaattccagcactttgggaggccgaggtgggaggttcacttgagcccaggngtttgagaccggcctgggcagcttggccaaacctcgtctctataaaanattagctgggcatggtggcatatgcctgtngtcccagctactgaggatactgagatgggaagatctctggagccgaggacatcgaggatgcagtgagccatgattgtcccactgtgctcaagcctgggcaagagagcaagaccctntcgaagggaaaccacagtacaatccncataaagggttcaaggtaatgctttttcataggtaggaaccaaagtgttcttga

SEQ ID NO: 568695 - DNA, 381 bp, Homo sapiens
  misc_feature (35)..(35): n is a, c, g, or t
  misc_feature (47)..(47): n is a, c, g, or t
  misc_feature (149)..(149): n is a, c, g, or t
  misc_feature (264)..(264): n is a, c, g, or t
  misc_feature (301)..(301): n is a, c, g, or t
ggagtctcactttgttgcccaggctagagtgcganggcgtgatcttngctcaccacaacctccatctcctgggttcaagcgattctcctgcctcagcctcctgagcaggtggggttacaggtgcccgccaccgcacccagccaactttntgttctcagcagagacggggcttcgccatgttggtcaggctggtctcgaactgacctcaagtgatttgcccaccttggccacccaaagtgctgggattataggcgtgagcacttncacctggcctctaagcttaatcatttctaggcttttnatttaaagtgagaaacatgtgactctttcctttcatttgggacactttaaaaggggttattaaattgaccctaattacaa

SEQ ID NO: 568696 - DNA, 242 bp, Homo sapiens
  misc_feature (57)..(58): n is a, c, g, or t
  misc_feature (87)..(87): n is a, c, g, or t
  misc_feature (125)..(125): n is a, c, g, or t
  misc_feature (138)..(138): n is a, c, g, or t
  misc_feature (182)..(182): n is a, c, g, or t
  misc_feature (206)..(206): n is a, c, g, or t
gcccctctcgtcaccaccctcggtgcccagctaccccctcaagccccagatcccctnntcctcagaacccaggccacccagcttccnattatcccaactgcccagccctctctgaccaccacctncaggtcccctgtntctcctgcccatcaaatctctgtgcctgctgccacccagcccgnagccctccccaccctcctggcctntcagagccccactaaccagacctcacccatcagccc

SEQ ID NO: 568697 - DNA, 1027 bp, Homo sapiens
  misc_feature (355)..(355): n is a, c, g, or t
gagagatctagtagcgaccaagcgctccagtgtgttaagtggtctgtcacaagtattccactgtggagagaggtgcgatagacaaactactgcaactgcaaggccgaacacctaggatgagtattggaagagtattgtgtggaaccgactatgagaagcgtgctcctacacatcaagtaatcattactccatagaccaagctgcccactgtaaactagtgatcataagtagattgcgtaaggtaggctatctaagataaggatacgcctatctggataaggataccctcgaccctcatatgaggatatatcttatgaacaagtacatcggcaaaatagttagcaaatagcactcntgatatcattgcgacatgggacacagtaggcgagtagcgctaacgagaaaacggggggtctagctccttttttgtgaactcgcttattggactgacgcaatcgactcccggtagagatgaagcactctgtaattatatctagtaaactacactagttcacgtggtagaacactgggcccagacatcacttgggctcccaaacgtctcagtaaaaagctcactgtgcgtaaagcacaacgacgatgggcgtaagatgcatatcccatcctagcctgtagaaggatctgatggtgagatatctgtgccaagacattttggccggtgaggtccgttggaagagtcggtttgccgaggggaggcaaatggaccaacttcagtgtcagtttcgtaggtgaagacgattgacagcttggattccagtgggtgaggcattatgggttgggcaagggcgctggttgagttggtgtgccatatgcgatgtgccagtgtgagcgtagtgagactatctttaggaattggggagtaaaatgaaaatgggtaatggcagtgttttaggcaggttggtgctgggaaagcctctcaggtggatccttgcgggaaattcttataagaatattccaattggcctatcgagatttttggggctgcgcaatgaaaagggccgtgtatgaa

SEQ ID NO: 568698 - DNA, 492 bp, Homo sapiens
atgtgttgtctagacagcacaaccttccagtttctagcctttctttgtctttgagaagtctcataactctgttgaagttgtagacaggtgagtagcaatgcaaaataattcttgcctgatgaataggtgaaaatgccgcgtcactggagggacagctctcatccccggtcgaaaaggccagtaattgcctccatttgcagcatatcgtcgtatatcttccttttgtcttccagatgaatttgcccttctttgacttcacttttggattgattataacatctgcttggttccctcatgtaattaaataaaatattttaagcacccaaaaaaagaaaaaaaaagaaaaaaaaaaaaaacaaacttgtgttgggccccgccctgggcccccctggaagaaagccttttttataaacccattggcgtggggggccgggggccccgatggggaacgggaaacggtggccagaggcggttccctaaggaagaaccggg

SEQ ID NO: 568699 - DNA, 1674 bp, Homo sapiens
  misc_feature (1047)..(1047): n is a, c, g, or t
tctagctttagtaggccttcccttatacgggccccgttgttgtgtcgtagatactatcacgtttcatgtccttgtagatgtcttagatttataagacgcgtgtcttcctgttagttattagttgctctcccctctctatcacaagtggcctcgcccctcttagggggtacccggatgactgcgttctcgagaactctctctgctgcccttcttttaagaagcccttttatatacttccccccgagggagccactattatggggggggcgcgccccccccacagcacccacccgcggcgcatggggggacccaacacgcttctcccctcgctggggtgatccttatatattctctgtgggcctcgctactctcctcctcctggccacttttttccacgcaaacaagctcgtgggggcgcgcagaaaaaagcacggggggagaagttgttgggtggtggccagacgcccccgctgtcctcccccctgaggcgccctcctatatgtgtgaatccctccctttgtaaaaggggtcttttttttaagacaccagaattcttgttgccaagagagagctcctgttgtctctcctccccccttctaaagttcgccctccctgaaggacctctccggggtgacacctggggtcaacacccaatttgaagagggtttcataaaggggaaaaagttgggggtgaaacgaccgccccccctcgcttggtggtgttccccaacaccccctcccgggttgaagaaaagagatcccgcgtgaaaaaagggactcgttgtagagagacccctctcttttataggaggacccctttgggtgcccggggattaaaaccccatacggggtgtaggctcacggccccccccaaagagagggcgccccaacacaacaaagcgggcgcttctcttcttacgcccttccccctctagaagagaggtgctcaccccccccccccctctttgtgccgcccccctcttctccaggagtgtcccccccagaggccccccccgggccccactggtgtgccccacacacctctgngccgcccgcacactctcccaccttcggggtctcccgcgagagagtcttctctcgcgaggggacccctctcctccagtctctcccccctctgtgagcctcctcccagaggacaattgtgagcgcaaaccaagcggtgtctcttgccaaaaaagagagaggagagaaagagatagtctccccacgagagagagagagcctctcacactgtggagagagcccgcaccgcgcgttgtcctcccccacagaggagccccacgtctttaagagacctctcagcgccccccgggtttcccacacgccgccccaacggccgcccagaaaaaggtcaccacaaccacccgagaggggagaggagaagccgccaaaaacacacatatgggttccatccctcccaagcccagagcccaccaccagaagagagggagacccttgtgcacacaccggaacgcccgctgagccgcagagaagttatagctgagctttaacaccggagcggagttgccaagccaaccccacaccagagataaaaggcacgctgttgtcttttctccttatatgggtagggctctgaacacaaagcttcccgattaactgtaaataaaaaataatttttttttttttccagta

SEQ ID NO: 568700 - DNA, 757 bp, Homo sapiens
  misc_feature (402)..(402): n is a, c, g, or t
agattaaggaaataggggccaagaacgtccggaagcaaacggaagagcatggagaagcatattcgtggaagatgaggtcgaggtcatcggcagagccttcggatttcggagaatcccagtcatctctgtcctttcttcggcagagttggtggtgaggtgtatgaccgacagagtacaactgagagctcaaatgtgggacttcccgtagtaacgcgagtcgaaacgggctgacatccgagcaggcaagtctcgacacatgtgactgggcatacagaagtaccaacgcgaggcaggcaggctggaaggagatgtgtggagcagatgggcgaactcgcggcgcgatcctatcgactgtctcatgggtatcgagttcgactgcacgagtactttaccgaagtgccnaaggccctcaagttgagcattgggaggcgaacgaccacaggaggactgatggtgaggagctggcaggagacagggcatcaaggcagtcttcactggacaattgttatattggcactatcggccaatgcgttgggtggaggaatgcagggttgcggattgtgtaggaataacagtcatgcagtgggcacattgtccatgcactaccagtgggtaccaacggttgcgacgacagggcacggaggatgggaaacggaattagcacagcttgtgggaggacaacccaaggagttctaggtccccgggagagtaacctcggatcaattcgtccatgtgttgctcaggtaggtctgtggtg

SEQ ID NO: 568701 - DNA, 104 bp, Homo sapiens
cctgtgtcatattcattcctttttgtggttcagtaatattccattgcattgcattatcagtactttgtttttccattcaacttttagacatttgagttgttctg

SEQ ID NO: 568702 - DNA, 150 bp, Homo sapiens
tcaggacccatggaagaagagggtgccacgagagttaacagccttcagacatagatagcacactcatgggaagccccagcgacgtgcatgggtgtcgcacctcaaggggatcatcaaggtgtcctgagcccagtgttgtgggtcgagtac

SEQ ID NO: 568703 - DNA, 348 bp, Homo sapiens
gtgctcttcaacggatcgagtgatactttgatgccgggctcggatcgggggactcccttaggagatcaatcccctgtcctcctgctctttgctccatgagaaagatccacctacgaccttaggtcctcagaccaaccagcccaagaaacatctcaccaattttaaatccagtaagccgcctctttttactctcttctccaacctccctcactatccctcaaactctttctcctttcaatcttggcgccacacttcaatctctcccttctcttagtttcaattcctttcattttctggtagagacaaaggagacacgttttatctgtggacccaaaactccagcgctgg

SEQ ID NO: 568704 - DNA, 398 bp, Homo sapiens
cttattccatatctttacacaagcaatgagatgaggacgtgaggcagagccctgtgggggacggtcagggcttctggtgctaaatgccaggcaatcatgggttcccctgaggtggccagaaatgttatttgaccactcaatgctgcaactgagaaatacaggtagagttacaggaatgacaaagaaagcttcagggaactgctggcaggaggcctgatgtccacaaagcacgtgttcaaaactcaacctaacacaggttagaaaaagacaactgagatagaatcctcagccagtacattgacaaacacataaactgaggcattattacctctttataataatgcaagttgaaaatgctaacaagagcaataaacacttctgccaaaattccacaaggc

SEQ ID NO: 568705 - DNA, 174 bp, Homo sapiens
ttgatctaacaaccaaatttatttcagtcagcatttattgagaaatattacttcacactgaatcagctatatatttgtggggtcagtgaaaaatgaaaatacatatctcttgtttgaaaatgactaggattccaaggatgacaacagcagagcattaaatctagcatggtctgc

SEQ ID NO: 568706 - DNA, 108 bp, Homo sapiens
ctgtagtacaaagaaagctgggtctatgatgatgatgatgatggaaggcacagctgctattccacaaagtggtccccaggatcttggcctcgatgccggcacgaggcc

SEQ ID NO: 568707 - DNA, 744 bp, Homo sapiens
  misc_feature (358)..(358): n is a, c, g, or t
ctaacccactccaccttacttaccagacaaacttagccacaccatttattccctaaatcgaaagttataggctggatagaagatagtaaacctgggcgcatactagtatatacgtaccgctaaggagaggaactatgaaacacattataaccaagcatattatagcaaggactaacaccctataccttcatgcactaatgaattagctagaaaataactttgtgatcgagagccgacgctaagtacccccgtaaaccatgacgagctaccttaagaactagctaacaagagcacgcccgttctattgatacgctaataaatagtgtggaagatttactagcgtagaggcgacaaaccntaccgagcctggtgatagctggttgtccagagatagaaatcttagttcaaacttataaatttgacccacagaaccctctaaatccccttgtaaatttaagctgttagtccattagaggaggcagctctttggacactaggaaaaaaccttgtagagagagtaaatactatttatacacccatagctaggcctatatagcagttcaccaattaagagagcgttcaagctcaaacagcccattaccttaaaaaattcgcaatacatatatactgaactctctcgacatccaatgggaccaatcttatcaccctatagaagaactaatgttagtgataagtaacatgaaagacatgctactgcgtataagcctgtatacggagacaaag

SEQ ID NO: 568708 - DNA, 224 bp, Homo sapiens
atatcctgctctattgagaatgattgacaaaaatggtatatatctacagctatgcaacatgatgtcttgacatatgtatacactgtgcaaatgagataccacaatcaagattaatatatccaccacctcacaattatcttagtagttgttgtaagtgcaaacatataaacatctactctcttcacaaattgcaagtatataacacggttctattacctatattc

SEQ ID NO: 568709 - DNA, 149 bp, Homo sapiens
tgaaatgaagtctcagcaggtcacatatgatttatctcccagacgggacacatgagaataatgaggtgcgctattagatagcacgggagcactaggattaaaccagaacaacaggtcttacagtgacttaatagcatggagtctgatcc

SEQ ID NO: 568710 - DNA, 898 bp, Homo sapiens
  misc_feature (266)..(266): n is a, c, g, or t
cgcggacctgcagccatggcgagtcaccgcccagagcagccgcaggaaggagcgcgtcctctgcctgtgtgacgtggacgggaccctcacgccggtctcgccaggatctagtctcagactcctggatcaagtgatctttgctgcgcttggcctcgtgataagtgtagggatacgcagcatcctgagccactagttgatcccaaacatgtctaatattacaggtggtctaatgctttagtactggcattcacgatccgatgcaaganttgacgcctgatggtgtgccggcgttcctgcaagaagctaacgaagtccgagtgcagatcggggtggtgcggcggctctgacctactgtaagaggatccgctgcatgcgatgcatgggctgactgcgagggatagtacacgtcatttgaaggaacgttgtgacttcatcgtgttatgccgaagcaacgggacgcgtgcgagtgatagagcactggactgacgtggcttcatccaatgctagacctagtcgcagaacccacctggtgggaagagctgcttgcagtgacttcgatcaaactatctggcctcagactacatgggccctgcttcaggctggcccaagaaaggcgtggaacctttccatcgagcttccgagaatggcattgctgaacatctcgcccatcggccggagctgcaccctggagggagaggaatcgaggtacgtccgaaagctgggacaagaagactgagaaacgatcccgggcagaaaggatcggtggaacgcccctgaataaaccagagatttggctgggcacagggctgaagggttcatctcaaggcgcgcatgctcagctttgacgatttaccccgagggacctgagaacagcgctactggctggataacctggcca

SEQ ID NO: 568711 - DNA, 488 bp, Homo sapiens
tagaaataaatatgagtaattagtgcagaaatctttccactcagggtagatattaaggtgggggtcatacggaagaagtcttgaaagacgatttacagtagattatgataatttgggatagagacggtgccattaagagttgttaaacagcatgattcagacagctctgtatttccagtgactgcctattcctttatggtatatgtgtacccaagtgatgctctcacatttatcttaagtccctattattaatatacatttaaagtctcccgaggtatagtttggttggctatcggtccttttctggagtgatttgaagcagagttaattgtggaacctatttatagacatctttctatacttgcacaagtctgtgtataatcaattctgagaagtagaatttaaaatttagtgctttgaaaatggtcctcattttaattttttggattttaattaggtaaggttgaacatatttccttattttcatg

SEQ ID NO: 568712 - DNA, 754 bp, Homo sapiens
  misc_feature (353)..(353): n is a, c, g, or t
caccaaggcaatcagcttcctttttccctttttttgtattgttttttaacattttatatttttgctttattttattattattttattttattattattttattttttgagacggagttccactctgtcgccaggctggagtgaagtggtacaatcttggtctcactgcaatctccacctcccgggttcaagcaattctcctggctcagcctcctgagtgctgggactacaggcgcgtaccttctttagtagagactgggtttcaccatgttggccaggatggtctctatctcctgaccttgtgatctgcctgcctcagcttcccaaagtgctgagatgacaggtgtgagccantcagacccagcattatttttttgtaactttaaacttgtaaaattcttcttttccaatttttgttggagaggttcttcattggtacaggtcatagggtgcgataagatggctgaggtgacgatgggtttttagacgagcagatctggcgtctgtaccacccaaggactgggagttgcaaggtggcatgatcctcgtgaaaccgtctacctccccaggtttcaagccaattctgtgtgcctccagaccatcccaagtaacctcgggactaacaggtgccacgctacgcacacctgggctgatgtctagtcggtcacagtcagagaccggtgtttcaacccatgttgcccaggtcggtctctagaattcctgagctcaggcaataccaccgctgggcttcccga

SEQ ID NO: 568713 - DNA, 492 bp, Homo sapiens
tctacacctacctgcgctgacattaactaccattatgggaaatgcaaaagcttgtctgcgatatggtagtgtgtggttctctatttggaataccctttcacggtgatttaataactaatttaaaactactatagcaaactgcagagcaccgggaagtggcttaatgatcctgaagggacttcttctgatggtagctttcgtattatcaagtaagattctattttcagttgtgtgtaagcaagctaccggtaagtgtagaaatggaccgttcaattgctacacaccctgaaggctgacaataaaagttgacattatgcccgaagacgaatgaatcaaccatggagacagcgaaaagacaacccacagaatgggaaaaaatatttaccaatcatatattggggaagggtgtgtatctagaatacacaaaaatctcttaccaccaaatcttacacagacagaccaatttaaaaactggctaagtgtagaaattga

SEQ ID NO: 568714 - DNA, 441 bp, Homo sapiens
gtccctcacagaccgtaacactttcgcactgtaggcagtgtagagaaagaagtcttcttcatggtgtcctggtacagctgacccatgggtggcactggtggtgtggaatgacattgttgacaaagaaaaacaaggcgtcctcagctcggagatgaattcgcttccggatcacgaagtagaactgaccaactgtgagatcagaaggcaccaggtatttctttaggtccaggtctcctatccgagctctgggagccttttctactatcaccggcacccggcccgggtatttctttcggatcttctcgccctcagagcggcgctactcgaacggatgctcttctgtgtacactaacttcatcctcccgggaaccgtggtgtacagggctgggctgagggaacccagggtggccgggaccctgctagactctcacttactttttg

SEQ ID NO: 568715 - DNA, 157 bp, Homo sapiens
cactggcccgtttacggaagcattgatattgtggtagacagttgatctggctttatcgtaatttttttatctttttatggagaatggggtctcactatgttatccaagctggtctcgaactcctgcgctcaagctgtcctctcgcctctgcttccgg

SEQ ID NO: 568716 - DNA, 296 bp, Homo sapiens
  misc_feature (145)..(145): n is a, c, g, or t
  misc_feature (278)..(278): n is a, c, g, or t
  misc_feature (289)..(289): n is a, c, g, or t
ttggtgatacccaagagcaccgcttcgcacaccgcgggacggccgccttcggccagcacgcgggcgttctcttcgtcgaactccgaacggtcgatcgtttcaccgatgatgaaggtcgaatcgcccacctcgttcaccttcaccntgcggagcatctggcgaacgatcgtttcgatgtgcttatcgttaatcttcacaccctgcaggcggtacacttcctggatctgatccacgaggtaacgagcgagagtggtgataccgcgtacgcggaggatgtngtgcgggttgntcggtcc

SEQ ID NO: 568717 - DNA, 671 bp, Homo sapiens
caggccctgccgccgggccgcttgacgacgacgctcccgcgggggccccgcctgaggaggacgcggcggcggtggcggcgaggccgcgggaggccgcggaggatggaggagcggaaggaggagggcgaggccgagatccaggagcacgggcccgagcactggttctccaagtgggagcggcagtgcctggccgaggccgaacaggacgagcagctgccccccgagctgcaggaggatggctggctgtgcctgcctgctgcatgccctgatgcacaatgcagcatgaatgcttgtggcaccttctttccatgaacttcggccacctgcctgttggcccaagcttcttacaaatgacctgaagtgttgtcattgctatgccattgtgactttttcgttctcgtgtgggttcaccccttatcccatatatacggcgatggctctatccgtgtcctggttcaaacccatagttccgttgccttagaagctgaatatctaatggacaattaatattgtgtcccggggttttgggcgggccaaaggtttttaagaccgcccctatgctccaaaaatgttttttaccccccgaaagtagaacaatactcttgcagcctaggatgtagagatgtgcactctgctcttcctctctaagtcgtatgtgagtgtgttggtgg

SEQ ID NO: 568718 - DNA, 254 bp, Homo sapiens
tgatcatgctggctggtaaggggatctcgatgtgaacggacctccacaggtatgtagtctccacagcgcagagcgtccctggaacagctacccccgtgagcccaggataatgtctcctacccctgtgggcccaacctgaaggtccccagcccttcccacggaccatgctggggcccctttcctcatcttccatgtccactagtgagtctgagggctcaccatctgcagccagcatcacccttcaccagaattct

SEQ ID NO: 568719 - DNA, 102 bp, Homo sapiens
  misc_feature (36)..(36): n is a, c, g, or t
gtccgggaaaattaagaccctaaattcgaggatatnatctgtatataggaacagctgagctgttgatcaagcgttttctatgtatggtttttcaaaggagca

SEQ ID NO: 568720 - DNA, 1218 bp, Homo sapiens
  misc_feature (276)..(276): n is a, c, g, or t
aggatggggaaccctgccctctctgtcagacacctgtccttccttctacagaccatgctggacttcttgtcggatcaggaaaagaaagatgtggcccaaagcctagagaactatacgtccaagtgtcctgggaccatggagcccatcgccctccctggcggcctcaccctgccaccggtgcccttcaccaagcttcccatcgtcaggcatgtgaaactattgaaccttcctgctagcctccggccacacaaaatgaaaagcttgctgggtcagaangtgtcaaccaaaagtcctttcatctattcaccaattatcgcacacaaccgtggagaagagcggaacaagaaaatagatttccagtgggttcaaggagatgtgtgtgaagttcagctgatggtatataacccaatgccgtttgaacttcgagttgaaaacatggggctgctcaccagcggagtggagttcgagtctctccctgcggcgctttctcttccggctgaatctggtctgtacccagtgacgctcgtcggggtcccgcagacgactggaacgattactgtgaacggttaccataccacggtcttcggtgtgttcagtgactgtttgctggataacctgccgggaataaaaaccagtggctccacagtggaagtcattcccgcgttgccaagactgcagatcagcacctctctgcccagatctgcacattcattgcaaccttcttctggtgatgaaatatctactaatgtatctgtccagctttacaatggagaaagtcagcaactaatcattaaattggaaaatattggaatggaaccattggagaaactggaggtcacctcgaaagttctcaccactaaagaaaaattgtatggcgacttcttgagctggaagctagaggaaacccttgcccagttccctttgcagcctgggaaggtggccacgttcacaatcaacatcaaagtgaagctggatttctcctgccaggagaatctcctgcaggatctcagtgatgatggaatcagtgtgagtggctttcccctgtccagtccttttcggcaggtcgttcggccccgagtggagggcaaacctgtgaacccacccgagagcaacaaagcaggcgactacagccacgtgaagaccctggaagctgtcctgaatttcaaatactctggaggcccgggccacactgaaggatattacaggaatatcaccacc

SEQ ID NO: 568721 - DNA, 201 bp, Homo sapiens
gaggtgttcaacgtgcagaaaatgcgaaatgtcttgcaccagacctccctcttgttagtcagggagggccccagggctcaggggtggcattccttccgatcaacccatttcaggttaagggggaatcccttaaggagtgcctggggccccagtatatggagagggatagggctaccggaagcttccggaaattccggtaaa

SEQ ID NO: 568722 - DNA, 1226 bp, Homo sapiens
  misc_feature (276)..(276): n is a, c, g, or t
aggatggggaaccctgccctctctgtcagacacctgtccttccttctacagaccatgctggacttcttgtcggatcaggaaaagaaagatgtggcccaaagcctagagaactatacgtccaagtgtcctgggaccatggagcccatcgccctccctggcggcctcaccctgccaccggtgcccttcaccaagcttcccatcgtcaggcatgtgaaactattgaaccttcctgctagcctccggccacacaaaatgaaaagcttgctgggtcagaangtgtcaaccaaaagtcctttcatctattcaccaattatcgcacacaaccgtggagaagagcggaacaagaaaatagatttccagtgggttcaaggagatgtgtgtgaagttcagctgatggtatataacccaatgccgtttgaacttcgagttgaaaacatggggctgctcaccagcggagtggagttcgagtctctccctgcggcgctttctcttccggctgaatctggtctgtacccagtgacgctcgtcggggtcccgcagacgactggaacgattactgtgaacggttaccataccacggtcttcggtgtgttcagtgactgtttgctggataacctgccgggaataaaaaccagtggctccacagtggaagtcattcccgcgttgccaagactgcagatcagcacctctctgcccagatctgcacattcattgcaaccttcttctggtgatgaaatatctactaatgtatctgtccagctttacaatggagaaagtcagcaactaatcattaaattggaaaatattggaatggaaccattggagaaactggaggtcacctcgaaagttctcaccactaaagaaaaattgtatggcgacttcttgagctggaagctagaggaaacccttgcccagttccctttgcagcctgggaaggtggccacgttcacaatcaacatcaaagtgaagctggatttctcctgccaggagaatctcctgcaggatctcagtgatggtaagcgctttcctaattttaattagcacgtcagggtcctagatactgtgtagcaacccccatcccttgatgcctgctgtttgctgtttgtaactcacttgtcattcattaactcaagctgcctgagacatctcctgggcactttgttaacagagtgtgttactgtatgtgtctgaaagtaataaaagtactttttatctaaatgaaaaaa

SEQ ID NO: 568723 - DNA, 174 bp, Homo sapiens
gttacccaaagattgaacttcgctgacaatttcatctaatttaaatcgccacatgtgacaaccaggccagacactgcagtggtgggacttcagcaccttctagaagttgtattggagttgggagaattcaacttgacaggcggcttccatagatgggtgggcacaattatggag

SEQ ID NO: 568724 - DNA, 934 bp, Homo sapiens
tttacaaggaccttcacatatatagtctttcatttgggcccagccagccttgtgaaacaggaatgcagatgctgttatcctccccatcacgtacgaggacagtgagggtcgtggggttgagggcgggagtgtgggtgagcgccggcgggccccgggcagcttcggaactcaggtcttctgaagaggagccccgtactcttcgcactgcttcagccgtgggcgtgagacccaaagccttgccagtggagtgaagaagttccttttctattccaggttaccataccacggtcttcggtgtgttcagtgactgtttgctggataacctgccgggaataaaaaccagtggctccacagtggaagtcattcccgcgttgccaagactgcagatcagcacctctctgcccagatctgcacattcattgcaaccttcttctggtgatgaaatatctactaatgtatctgtccagctttacaatggagaaagtcagcaactaatcattaaattggaaaatattggaatggaaccattggagaaactggaggtcacctcgaaagttctcaccactaaagaaaaattgtatggcgacttcttgagctggaagctagaggaaacccttgcccagttccctttgcagcctgggaaggtggccacgttcacaatcaacatcaaagtgaagctggatttctcctgccaggagaatctcctgcaggatctcagtgatggtaagcgctttcctaattttaattagcacgtcagggtcctagatactgtgtagcaacccccatcccttgatgcctgctgtttgctgtttgtaactcacttgtcattcattaactcaagctgcctgagacatctcctgggcactttgttaacagagtgtgttactgtatgtgtctgaaagtaataaaagtactttttatctaaatgaaaaaa

SEQ ID NO: 568725 - DNA, 355 bp, Homo sapiens
  misc_feature (17)..(17): n is a, c, g, or t
aatttcaagtaaaagancagcttgtcaattgataataagatgtatcatgtaagaagatatataaatcggcggggcacagtggctcacgcctataatcccagcactttcggaggccaaggcaagaagatcgcttgagcttaagagtttcagaccagcttgggtaacattgggagaccctatctctatgaaaaatgaaaaattagccaagcttggtggtgtacacctatagtcccagttacttgaggagctgaggaggaaggattgcttgagcccagaagtttgaggtaatgagcgatattaacgccattgcactccagcctgggcaacacagtgagaccctgtctcaaaaaaaaag

SEQ ID NO: 568726 - DNA, 454 bp, Homo sapiens
aaaaataaaaataaaaagcagagagtaccttggtgagagtgaagtcctgcttcctggtgcacaggctcttgttcctaaagaggaagaaagatcacacccgagaatgtgtggaagcagcagtgcagtgtgcaaagcagggaccctcagcctgtctcctgggctccatccaagttgcttgtcttgtctgtccctcagtttcctcatctgttcagagggtactacaataatacctacctctgtaaattgctgcaatgaattacatgaggtatttcctgtcaatctccttgaacattaattggcacagtgtaaacactatctattagttcttcattctgatgtttctaaattaacacaaactaatcttatgctgtttctaaattaacacaactaatctaaatcttgatgctgcctgtcatactaataaagtatttgggcatatttcaaaaaaaaaaaa

SEQ ID NO: 568727 - DNA, 409 bp, Homo sapiens
  misc_feature (101)..(102): n is a, c, g, or t
  misc_feature (109)..(109): n is a, c, g, or t
  misc_feature (129)..(129): n is a, c, g, or t
  misc_feature (156)..(156): n is a, c, g, or t
  misc_feature (318)..(318): n is a, c, g, or t
ccacggtggagcccggcaagaccgtgaccttcacgctcggcgactggtacctcaacgacaagaagctggcggctggcgatgtcaaggatatcgtttggatnntggatgncaaggacgtgaccgctcagntcaagggcaacaagcttgaggtcaacncccccgcggctgaaggtacgatgacccttgagatcaagggcaagctggcgagcgatcccactaaggagctctcccagaagaagtccgtcacggtcaagaaggccggagcgacgcctgagcctgagaagaagagctccggcggcggctgcgacgcgggcttcngcgctctggcgctggagaaacaaaaaaattatgtaaaaatcaaataaataaaaattaaagagtaaaaagagtaaaaaaaagaatgtacata

SEQ ID NO: 568728 - DNA, 807 bp, Homo sapiens
tggtgtgatcccatttatttgaaatgtccaaaacagggaaaacctattttaaacaacagaaacacaaagtcgatcagcagttgccaggggaggaggaaaacgggaggggaaatgatggcttcacagggtgatgacagaatgttccggaacgtgacagaggtggtgcctacacaactttcgggatgtactaaatgccgctgatggtccacttccaagtgatggattttaaggtaattggaatttcatctcaattaaaaaacccaaacacgcaaattgttcccgccagttcagccccgagcagacgggcagcccgtggaggatgctgagcccacccaggtttctccccgccctttccgggactcttctctctttggcctttaatccactctgcgcagtcatggcctgtgtcatcctaccgggccgattctctctcaatattccctgtggtgaaacatcctaaaaggaagtcacattagagaaacatcacatatttcatctcataggccgtaaacaagggccatttagtgaagccaggtgtaccgaggggaagcacggatgctctgtgcccgtgttgcagggataacggtgcagtgccagggagctaccaattcacgccgtgtgtacaaggggctcaggacaggaccgaaagtgggcaaggtgcgggaccgttcacgaacacgcaaaggcacgaaatacattcgggtccgtctcgggcggcaaaagttacaaccaagggcgtaaacccgaaactcttgggacgagcaccgcataggaagattgctcgccacggaatgacccagtatgaaa

SEQ ID NO: 568729 - DNA, 1641 bp, Homo sapiens
cccggggtccatccgtcggctcctggggtccaccctacagcctccgggaggttcacccctcaaatcctggggtgcacccccacaactcccatgccccgcaagtgctgaggccccgcacattccctccgaaggaccagggaaacataccatcgccaccatccacccaaacaagagagaagcaggcatccacatcaccccgagccaaggacccagacgccaagggtggcatctatgacatttatgtcccaactggagaaggacaggcaggcatcgtcaacggtacagtgccccgccggaatcatataaacacaggcacatccaccacaaaacacaaagaacaaacacaagcagaggagcgcagcgccgagaactcatagagacagtaattccacatagcagagggcgcacccaacagggatacacaacgagatacacccccaggacaccccagagcgacacaaaagaggggcgccccccatatcaccggcgcacacacgacaatacaatagagagcaaggcgcccactggccccccgaccggccaccaccccaccacgcgtacagtcgcccgtgggccaaaccacccacctcgcacacccctctggccggcaactcccatcagcgcgcaacaccgaccaacccaaaaaaaacaaacacaagggacggcgcaggcccgcaccccacatccactcggcccgcccacacacacaaacccccaaaacacgaagccgaattaaccaccaagcgccacaaacacgcagagaaaacaaactatcaccaccacatcaaccaaccacgcgagcacaaataacccgggcgctggatcaaaaccccaccaacagcacggtgcgccaacaaaactgcgaccaacggacggagcgaccaatcgcacaaaaagcatacaggcggacaacaccccccggcgcgaccttcaggccgacccccctgcaaccacacatatagtacatccacccgaggagctaaacaagcatcaacaaatacaaccacccgacacacaacaccacacacgaccacgcacccacacacgaccaacacacgccatcacaccccaagcacagcacaaccctaccctatacaaccgcaacccgacaaagtaaccacacacaacgcagtacacccacaacatacgaagcaacacgaccaacacacacactcgtcgtgacacgacatccacgcacttcccatgcccgcgcacactagcagagacccacacacacaccccacctccacggtggacgacggcaccaaccataacacagaccgcgacggcaaccccacataacacgaacgcacccgcacacacgcacgcacaacgcactgacgagacgagacacacccacgaagcggagggacagcgcgcgagcacagacaaaggagacacaacgacacacgagggcccgcagagaacaagggaggagacgacaagagaggcacacacaagagagaggcctaccgtcgcgaggaccgagcgacaacaacaacagagcccagcgagagaagcagcgagacagagcaaggaaacagcgcgggacagagccaaggccgaggacacgacaacgagaacgaccgaagcaacgtgcgcagcagaacgaacgaagcaggacgaaggcgcgccgcgtgc

SEQ ID NO: 568730 - DNA, 324 bp, Homo sapiens
gaatatgctgtctcaagtgtcatcaatggaccaataaatagataaagaaaatgtggtaccatatacacaatggaatactatttggccataaaaagaatgaaaccctgtcatttgcagcaacatagatggaactgtgggttattatgttaagtgaaataagacaggaacagaaagacagatgccacatgttctcactaacatgtgggaaccaaaaaaacaaacaaaaacaacaaaaacctgatctcagctgagcgtggtggctcacacctgtaatcccaacactttgggagactgaggcaggtggatcttctgaggtcaggagtt

SEQ ID NO: 568731 - DNA, 987 bp, Homo sapiens
tataataaatatgatactagcatttacccatctcactgctaggaatactagtatatcgctcacgcctcatatcctccctactatgcctagaaggaataatactatcgctgtggcatctatagcgtagctgctcataaccctcatagcatccacctccctcttagccaatattgtgcctattgccatactagtctttgccgcctgcgaagcggccgttgggggcctatgccctactagtctcaatctccaaacagcatatggcctatcgactagcgtacatagatcctacacctactccgaatgctagcaacgtgagtcgtcccaacaatgtatattgactaccacgtgacatgactgtccaaggaaaacacataatgtgactcaagcaccaacgcatccacagcctaagttattagcatcatccctctactatgttttaaccaattcaacagcaagcctatttagactgtatccccacaccctttttccttctcgaaaccctcgctatacaaatcgccactcctccatagatagcgtagactagcctgcactccataccccatcactaatcatggcaatacgtcaaatgaccagctgtatcccgagtagaaccactatcacgacaaacactctcctacctcgtctatagcataaatcatccccgtatcaaaatgcgtctctatgattcatataccattgcaggagccacctagaagcgtacagtcacttgtgcaatatcgtgtctgcgggaaagccaacagtttagtccccaccttgggctaatatcccccgatgagggaaagcaccaagaacaggcctgaatcgcagggccgccttccttcctattttagaccctaggagaggttccatacccatatgcatatggcgataattacaacgacacgaaaacctaaggctctcaacatcgtactacccaacctcaggccgaaacaattaaattcctggccaccactagaggcggactcg

SEQ ID NO: 568732 - DNA, 959 bp, Homo sapiens
  misc_feature (1)..(1): n is a, c, g, or t
ngataggatgccagtagtatgctatgagcgaagcacgtaaacctctaaaaggcaggacgtcgggtgtcgatggagctacacgaggacgtaatactcggataaaacatcttctgtcaccgtggtgccagcccttgcgtatgctgcaatatcgcccgcgcgtttttttacgctagcaccctccaccgagggcccattcccaccggtactgtggcccttttctccagtataccggggttttaacccctcttgttaccgggcactgctttgaaggtcgccccaaatggctgttggaacacttgcgcgaaagagggttctccccttcttcagggggcgcacacctcgtggccagtcagaacgtgctcgcaaccacagacgcggcgcaatccttccctttccgggtaggcaagaagcccccccccgtcgttggtggggacaacccggcctcaaaacaaaacagcagggcgccctacaaactgcgggaaaaaaactggaaggccgtcccctcggccgaggttgccccccagtgcggcctcctgcccgatacaggagccccccacttgctgtggaacaggcctgtagggagccaccgaccccgaagatgtggcacgcgcgtgatacagcccacctaaaagaccggggggacaccgcgggactcaattaggctcccagaagatagggtgcgcccgtaaaacgcgcctcgtccggaaaatccgctctagccaagacaccacccccgcgcgggcggcccgcttgaactaacgcaaccagcctcggcggtcaatgtcccacaaaccacgtgggggggatatctccggggagcccaacggagggcaagcatatgtgggggcgccccttacccctggtaacaaaaccgtcggccccacaacacacacccaccaaatggacagcaggttggccccccccctcccaaaaaaaaatgttggcccccaacaataaca

SEQ ID NO: 568733 - DNA, 151 bp, Homo sapiens
acgatcgagggcgactccacggggcaaagcaaggccttgaggatcccgctaacataacttacaaacttattgggaggccgaggcgggtggatcacaaggtcaggtgttcgagacacagccttgggccttcccaatacgctggcgattatca

SEQ ID NO: 568734 - DNA, 438 bp, Homo sapiens
  misc_feature (96)..(96): n is a, c, g, or t
caggaacctaatgtttagtgaaaaatgaaaacttaaaaataaatgaataaagtactgtatgattacattccaatgtataacattcttgaccatgcngaaaattgttgaagtggacagctagttaatggtaacataatttaatgaagaactttaaaggacatgataggagtcacagaacagcaacctgggcaatattgctgtagaacaagtagtctgtaatatattaatattctggcattaataaaatgttataggcttaccagatgttactactggagaaaatgtgctaaaattataatttctgaccatttcatgctgattgtctcaaattttaccattatgtttaatgaatgtcttactatttttaatttttttctaaagccaaggtaattttaagtaacaacaccagtaatgactgtctaaaataaacatccttaa

SEQ ID NO: 568735 - DNA, 449 bp, Homo sapiens
gtcacgagcgagctctgtctcataagaaaaaatagaacaaagagaaattacttccaatgctggcaagcaattaacctgtaatttttcctgatgttggtctctctcctagtggctcacctatatttggacactgccttaaaaattggggtgtcgtggctccttggtggcgtctgtgctcctctttccctattaattgtccttaatcagggagggagccagcagcattggttggtcctcagcaatctgagtctcgggtctcccttaatccctgtgggggggcttctgcatggccattggagggtggtggtggtggcgacagtgatgtatctgtgtaggctcctgtctgtcccagctcacttaaggtgtgatggccaagtaaatgctgacccctatttacatcttgatttcacatattttacaataaattctttacatatggttccccttag

SEQ ID NO: 568736 - DNA, 398 bp, Homo sapiens
cgacgggagggcgggcacggtggctcacgcctgtaatcccagcactttggaaggcgaggcaggcggatcacgaggtcaggagatcgagaccatcctggctaacacggtgaaaccccgtctctacataaaaaattagctgggtgtggtagcacgcacccgtagttccagctacttgggaggttgaagcaggagaatcgcttgaacctgggaggtggaggttgcagtgagccgagatcatgccactgcactgggcaacagagcaaaactcgatctcaaaaaaaaaaaaaaaaaaaaaggggaaaaaaaagcggccctctccggggagagagggggggggactcccggagaggaaggccggaaaagcctgggggaaacggaaaaagccacccgggctcccg

SEQ ID NO: 568737 - DNA, 341 bp, Homo sapiens
cggatcgactccaagaagaaagcaacatgcttggaatgaccctagaaaccattctctcctttgcaacccagtagcatcaatgacaaaacctgtgcagtggacagcaagactcaagcgtttacactgatactagcatcgatgggatgattctttttctacgcatttcaggatttgttttttacttttaagttttgcagatgagaacattctttatgacagaaatcctatgcagcacatgtttggcttttgaagggaccaaggagctcaatattcctccgtgatgttaaattaaatgctaatcatgaatccgtattccattggcaaaaaaaaaaagcttgggc

SEQ ID NO: 568738 - DNA, 209 bp, Homo sapiens
gaatccaattttaattatactctctctctctctctctctctctctctctcctactaaaataggaataaaaggacatttttagaatgtaatgagattatcagaaggctgcaggaaacatcatgaaaacaggagaaaacctgccttagcaaacaagaatgcttgctgtctccattcctaatcattgttttggagcttctagctaatgcaaa

SEQ ID NO: 568739 - DNA, 503 bp, Homo sapiens
catgatgctccggctgctcagttccctcctccttgtggcgttgcctcaggctatggccactcttcctctcactcttccagcgcgcgtgtccatggtgaggatgcggtcccctacagctggcctggaggtttccctgctgtatgagaaaagtggaagcttctaccacacgtgtggtggtgtagcctcattcgcccccgatttgggttgtgactgccggctcactgtcatctccgatgggcatctgacctaccaggtggtgtatgggtgagtacaaccttgctgtgaaggagggacctgagcaggtgatccccatcaattctgaggagctgttcgtgcatccactctggaaccgtctcgtgtgtggcctgtggcaatgacatcggccctcatcatgctctcgacgcagcgcccagctgggagatgccgtccagctcgcctcatccctcccgtggtgacatccttcccaaaagaaccctgtaatcaccggtgggggcgtctatacc

SEQ ID NO: 568740 - DNA, 104 bp, Homo sapiens
tcaggatcaactgctctcctaatcactcataataatgtagtagtaggaagtctttatattttcctcatgaaatgctcttacatcagtggtcctagctactaaag

SEQ ID NO: 568741 - DNA, 986 bp, Homo sapiens
agccattagtgcaggaaaaggtcccggacagctgagcagccaaggatgtgtgacttcacccgaatacctgaccgcagagttcaagtagggctctttacagactgttttgaccgaacatggtgatggcaagatcctgtagcaagtcctagatgtgatgcgactgctgatcaagggccctgggacaggaaactccttactcaaacttactcgatggtgtctcaagggcctggtgaatccccaaaagtgatggacatgaatgtgaaggtgctggaattgtgcagcacttttcgagctccatgtcttgggttgaacagttggcccatgtaaccaggaccagggcacctagtgagcgattatagtgctgaaagactatcgacgtgtttgacaagtaaggaaatgggcaaccgtcatgggtgctggaaatccgggaatgaacgttggtctacacttgtgctgagaagatgaccagaggaataaatgtagagatgttgggtgtgcagtggccatgagagacttgcaaagtggttgtatcaacgtatgtagagggtaaggaaggtgaatctgtgcttttctccagagaaagtaggtagtttgtgctgcaggtgtagtatagtgtaagtgggctgttctctactacctgaaacgtagaggctccagaaaataagccagggaggcaagagtgcagggggcccagtcccaagccgagctgcaggaagtgggcagggtcagggccgaatacacggaggagaaggaaggggggagaattgatgaaagtgctggtacagcgcatcacaaagtgtagcacgggaaggtcgtcccgaagtgcagaacccgcagccagagttaggctgtcggcacataaaggtgccgcgcgcgggtgaaggaaaacgtggagtgacaccggaagagacgaacacacacaacgaaaaaccaggggtgtgcaccagcagcagcgtaaacaggaccgagaagcagaaaagaagcca

SEQ ID NO: 568742 - DNA, 480 bp, Homo sapiens
tttaaactttatcttgccatcgatttacaacactactatagcacataccctagtatctattcattgggggtttaatgtgaatttcagagatttaattttaatctggtgacatatcgagcgaaaataaggagtaatgtatacctccacatgtcctttctttttgtcttctcttaaattcacaatatccagtaggagtggttattcaatttcttcgtggttttaatcatcaaatgaagttagagaagtatactaatcccagcaactatgactcatctaggcatgttaagaccataaagtaattcaggaaactattttcctgatttttaaataacttttagtcgtatgtaacatctatccttctgttttagacatgcatttcacatatagttgaattctagattctaagataattcattttgggtaatacttcagagtactggatctagaatcaggcttcctgaatttaaactcaggctcccc

SEQ ID NO: 568743 - DNA, 798 bp, Homo sapiens
  misc_feature (746)..(746): n is a, c, g, or t
gtgtctttgccaggtactctcgcctccgccagtggaacaccctctatctgtgtgggacagatgagatatggtacagacaacagagaccaaggactctggaggagaggactaaccccccaggagatctgcgacaagtaccacgatcatccatgctgacatctaccgctggcttctaacattctcgttcgactattctcggtcgcaccaccgagtccacagcagaccaaaatcgcccaggacatctaccagcagtagctgaaacgaggttgtgtgctgcaagatactgtggagcagctgcgatgtgagcactgtgctcgcttcctggcgtgaccgcttcgatggagggcgatgtgtcccttctgtggctatgaggagcgctcggggtgaccagtgtgacaagtgtgtgcaacgctcagtcaatgctgtcgagcttaagaagcctcacatgtatacagtctggcgatcatgcacctgttggtgcagttcgagccaggagctgtattctggacctgacataacgctggagaagcgactgtgaggcagtggtcgcgtgcactgacatgacatggcaaatgattcggaaacctcacatgggacagtttataagctcgtgctggggatccgagcagtggtctccatcgccaacgctcgtggtacacccgagaccaccatatctggagaaatctcgtgcaccgcgtaaagagtgacgaagaaagaggtgtacgcatgtactcgtacagaatgancacgatgggctaacaggaatatctcggcaaatacacaaaacacggatcaagc

SEQ ID NO: 568744 - DNA, 1637 bp, Homo sapiens
tggggcacaaaccctgaccatgaccccccacagtgctgctgccacctgctgctgctgctgctagctctgctgctcgctgccagcccagtgaggctgccttgtgctgctggtgcccgagtgcttgctgtgtgcaatggtgtgatgcatgtgctgggtttgtccagtggtgtgcttgctgttggatgtgagtgagtgattgtgtgtgtgtgtctgcctagcctgatgtggcttgctgctgtgaaggcttgagtggcttgtctaccagtgatgtgtgcatgtgtgtgccatgtgatgttgctgtgcgtgtactcagcaccgccgtaaacacttgctgcccccgagtgcactatgcatgattggccctagtacctgcgccgaatgtgactgcactgcatgtgcgccgtatatagctgtgtggctgtcttggtttagctgtctgggacactgatgttgccttgcatagcaccatataccctgggtcaccctggcgtggctagccattgcattggttgtgcgaaggaggcgcagacataccctaacagggcaagatggtaacacaccccccagaggaccaagtggtcgatcacgttggcctctggcgcgcgagcgagggcagttgttagcacaacgcctgctcagtcagtaccgcagaaatcaacgtcactgttgacaatctcgcaaggtgggcgaacgcccattacttaagcacaagtctggcacatccgttcaccgccaagggcgcgcaagagattccttatggcctggcgggttggctaccccgaaacagagacacccacgccctatggacagaagctttggcgggcgccccccccaatgttggcccctggggtacacaggaaccacaatcatccgtattgggcaaccctatatccaagggctatcgcatgtttggcaacatgcgcgaagcacgccatttccgccaatagcaagcgttatggacgcgagggctaccataacggcgcatgggcatcggttggtgagcgacctgttaccatacacgaagctccacagcgtttcccatgcaacgccgaggttttgggccggcgccgagagagtttatatgggttttcgaacaccgccaagctcttcgcgcatacgcggcctcctgtacgtaaacagcgccctggaggcacaacgaggcatgggtgggtcctgtggttcttggcctccgcaggcagtttaacacgagctgcacccgcatatggttgggggtcgcagcaacccgcgtcggcgactctagacacgggctgtccacccccgatttagagcattgtagggagtttgcggaaatgagatggtggcgaacatcctgggtgcaactttatggaggtagccactatatcgtggatcgccccccactttgtcaccaccaagcggtgggagaacagataccccaaaaggaaaacatcgtagacacgaaacagctggtggacccagatgggccgctcccccataccccactttgtaatccctccccaaagcgtgtagtgtgtgcaatgggtactatagcgcacaggtgcgcgacgtaacaacatgcgcgactaggtaggagagtgtaggagcattacagcactcgtagtaggtgtcgcaatcgtcactctcgagtcgtccctcgt

SEQ ID NO: 568745 - DNA, 560 bp, Homo sapiens
  misc_feature (299)..(299): n is a, c, g, or t
  misc_feature (303)..(303): n is a, c, g, or t
  misc_feature (359)..(359): n is a, c, g, or t
gagatgagcgtctcatgctgttgggagagacagagtgccgcactctcagtctcggtaatcttggagagactctatggtgagtgctgacatacttgaaatggtgtgtggggcgggtctcgcctggtgaccccagctgtgagctcacgttgacgtattgaacaagtcctatgtagtgggcatggaactttacaattaggaccattgtccgatatgtggtggtggactggaagaggaggggccaggggcagctggtccttggtctgtggcttcaaggaaggttctttgcggatcatccgganatgnaattggaatccacgagcatgccagcattgacttaccaggcattcaaggattatggncactgcggtctgaccctaaatcgtgagactgatgacactttggtgctctcttttgtgggccagacaagagttctcatgttaaatggagaggaggtagaagaaaccgaactgatgggtttcgtggatgatcagcagactttcttctgtggcaacgtggctcatcagcagcttatccagatcactccagcaggttgcacaggg

SEQ ID NO: 568746 - DNA, 286 bp, Homo sapiens
gagcaagttgggaacagaatcatttgagcctatagaagagtcaagcctcaggaccttggaagtttggtgtctggggaagagtgtggggcatggaatagggaagggattcctatggacacggctcgggtgcacccagttctcacatgtgcagtcatgccgttctctgatgcatacggccattgcagatgtgaggggccttgccttcctcgggagggagtcaacatgcccaagtcatttgcacctttacctctcagatggatgctcccaggggttagggactggggta

SEQ ID NO: 568747 - DNA, 289 bp, Homo sapiens
gcacacacgtggacatctgcacacactcatacatacatgcacacatgcacactcacatacacatctgcacacatgcatacacacgtgcacatctgcacacacatgcggacatgcatgcaattactgtggccttgtactcctgtggtggctgatgaagccatggatccatggaagtattaagattagggtgaggcctccatgtggcaggttgtctggtgtggagccaaggagatactgagtacctgacctcaattcacttatcccttggtccaagtcacttagtgcaccc

SEQ ID NO: 568748 - DNA, 257 bp, Homo sapiens
atccggtgggcgagtggggcgtgaagccagttctctctgggcacttcaggcttcatgtctattgtaatggaacccacttgtgttgtttcctttcttcttctgcccgcctcgctgcatgcatgcggtgaggtgtcatcaatagcagtgagacaagtacaggctgctgagagctggacaagggtcaccaacgtcgtgcccagcaaagctcagtaaggctaaatgatctattatccctcaatacctgccaccccgtaatg

SEQ ID NO: 568749 - DNA, 543 bp, Homo sapiens
  misc_feature (60)..(60): n is a, c, g, or t
  misc_feature (309)..(309): n is a, c, g, or t
  misc_feature (313)..(313): n is a, c, g, or t
  misc_feature (383)..(384): n is a, c, g, or t
  misc_feature (416)..(416): n is a, c, g, or t
  misc_feature (418)..(418): n is a, c, g, or t
  misc_feature (438)..(438): n is a, c, g, or t
  misc_feature (440)..(440): n is a, c, g, or t
  misc_feature (442)..(442): n is a, c, g, or t
  misc_feature (480)..(480): n is a, c, g, or t
  misc_feature (482)..(482): n is a, c, g, or t
  misc_feature (484)..(484): n is a, c, g, or t
  misc_feature (535)..(535): n is a, c, g, or t
attcatagtgtcttgaaggcagtaaaacttgagggtgtgaagttgaggaaaacatgtggntaaactggacactgtgaatgtaggcgtgagacttcaaaccccggccttgaaagtacttgccacacaccagacaggcataagcattgatgtgtgagagggagatagaacacagtttctcaaagtcaaagtccagcacactcctgttaatggtgtccaggtacgggcagtggcggcttctccggtcctcagaatccactcggccattctttgctcgcacctcccgctcaggctccgagtcctcatcgaccntctntcccgcttcacccgcacaaacgggacaacagaagccggggcctcgcgcgcgctcgccggctcgaactccnnttcacgcgcacagggctgccccgggagctcgncnctcaggtcccgctcccgatncntnttcccttgacgcgaccggagctgccccgcgactcagancntncttcccgcgagtggaaccgcgagactcccgcttagaccggccggacatctnccactacc

SEQ ID NO: 568750 - DNA, 366 bp, Homo sapiens
  misc_feature (13)..(14): n is a, c, g, or t
  misc_feature (48)..(48): n is a, c, g, or t
  misc_feature (83)..(83): n is a, c, g, or t
  misc_feature (317)..(317): n is a, c, g, or t
  misc_feature (366)..(366): n is a, c, g, or t
ccgggtcgcgccnncccaagatggcgtggtccgcgtcggtgcgcggcntagggcagcgggtgctggcctgcagccgggagctncatggcgcctggcacacctgcacacctccactggtctgcgccaagaatcgggcggcgcgagtcccgttggccaaggggaacaagccggtgagctacgaggaggcgcacgccccgcactacatcgcacaccgaaaaggcctggctgtcgctgcacacaggtaacctggatggagaagatcatgctgcagagagaaccctggaggatgttttccttcgaaagtttatgatgggcanctttcccggctgcctggctgaccagattgttctgaagcgccgggccaan

SEQ ID NO: 568751 - DNA, 778 bp, Homo sapiens
cacggtggtctcaacacctgtaatcccagcactttggagtgctgaggcgagttgggatcactaaggtcagatcgagaccatccgtgggctaacatgcggaacccccgtctctactaaaaatctaacaaaaattagccgggtgtaggtggcgggcgctgtagtcccagctacttgggaagctgagcgcagcgacgaatggcatgaaaccctggagggcaggagctttgcagtgaggctgcagattggggccactgcaactccagcctgtgccgaacagaagacaagactctgtctcaaaaaaaatttctaaaggaacaaaacaaaacaaacaaaaaagattaagactttagcggccagtaacggtgggcctcatgccgtgtaattcccagccacttttggcagcccacgggaggtcagatcacctgaaggtcagggagttcagggaccagcctaggccaacagtggttgaaaaccccgggtttctaaccaaaagattccaaaaaaatttagccgggcatgagtggggtgcgaagccatggcaacactccaggaaggttctgaggcgcagcgacgaatccgttgaacttcgggcacacgggagcgttgcagtggaccccaagaatggcaccagtaaattcccagcttgggcaccaggagggaaacttcgttctcaaaaaaaatatgatcgacagacacagacaaagattttggggcatgccactcgaggaagttctaaacacaatctttgggggcgggcccaaaagtaagtaagtgtttc

SEQ ID NO: 568752 - DNA, 137 bp, Homo sapiens
tacgtagggttgtctcctgtaaatagcagagttgtctacaacttctgaattagcatggcagaagcacctcctcctccattgcaagatactggcaagaccgtattctccttgcttccccaacggtgaccggcgacttc

SEQ ID NO: 568753 - DNA, 1470 bp, Homo sapiens
  misc_feature (1112)..(1112): n is a, c, g, or t
gggggtgttgtggtcgttctcgctccggttgtggggtccgctcgttggtggtgtgtgtggtgccgccgatatgttgttcctcgttgttgggtgtgtgtggtcctgcagttgctgtgcgtgcgtggttgtgtggtggtggtggatggtgtggtgttttatcaacgtctttttgtgttgtgggtcgtgctcgtgtcgatgttgtgtaatgtggtgctgcttgtgtgttgtgtgctcctctctactagttattggggggggtggtgtagtgaggtggacgggctggtaggcgagtagttttggtggtgtagctatcgcatcgggagtgttgatgaccgccgcctctttgttgtatagtagtgggaggagagtgtcattatagggggtggtataatataaacaatatgttgccccatcatacaccaagagtgtgttgctaccacctggtggaagaatattttttcgtcgtggggaggaacaccaccaccatagtattatgttcgttagtataggggggaccaccagtgagtagtagtggtggtggtgtgtttttgtgggggggtgttgttggtaggggagtggtggttgaagaagaggaagagaagaagatagtaatattaaagagtggttgttttttttgtgcttctagcaggtgttgtagtgatgctgctgggtggtggagaaataatggtgttcaacggatagttgtgggtggttgttatattacgtgtagtaataatggggagtattatactccacgcttttagtgggggagaggatatatagaatattgttttggttttgatgagacggcgcaatagttgtggtccttcacatcacgcctctgctactatatagtggcgctgcaggagtagtactgtactacaagtgtagtagaacagcggcagaccactcgtgtgtgtgatgatatatatattttattgtgtcactccccacatattttataatatgttaaattatatatattgttaacatataaagagagaataatatataatatatgtgtgtgtgtagagagactatgtgtatttatatatgtgtgatatgtgttgttataacgacgtagagagtaagcatatagtggacactctctnccctgtatagcgtgtggtgagagatatatcatttgtgagcatatatatatatataataggtgcacatacaccgctgtgtgtgtgacgacagcacatcatgtttgttactacacgcccgctctctacagcgtgtaacaccttatagagggcgactctctgagagagtatttctgagaactataaaaatttggacggacacagagttggagtgcacggtgggtgagagaaaatagttactctttctctgggagttttgtataaaggcacaaaatacactttttttccccttggcgacatacctccccgagttttgtgtccccatcctttatttgtaaaaaaaaaagtgggtatggttata

SEQ ID NO: 568754 - DNA, 966 bp, Homo sapiens
acgacagtgaaatctagagtaaaaccaagctgcgccaaggtgtcctgcaggctgtaatgcagtttaatcagagtgccattttttttttgggtccaaatgatttacattatgggaatgtgcccaattttttaaatagtgcaacttaaaactgttttaccacaacgttaacaaaaacaaccaaacaacaaaacaaaacaaacaaacaaaatcacaaacacacacaaacatcacacaacatacagtaacacaaccacacacagacaaaatagcacaacaacaaaacacgaacacacatacaaaacaacacgaacgacaagaaacaacaccaacataccagcaaggaccgcactcgctacacgacgaacagagctacgagaagaaacaacaaacatcgatggttggtgagagaagtcaaactagatagtggagagaggacgacaaccccacgagcgaaggataaatgtaggtaggacaggaagacatggtctgcgtgagacatcatgcgatcaggagcgctgctagcaacacagagagaagtagaacaacgacgcgcggggacacagaaaagtgcgtgtaggccgacaaagaaagcagcccgtgaaagagaagagagaagaagaagagagcggagaagtgacaagacagtgcgcagagcaaaaaacaaggaaagcaagacagaacgtaacgcccacgcgacacgatagaagaaacagcacagagcgccagcgacgaagaacaaacagcgcgacccacacgacgccgcacccgtacgaccaagcgaaccgccgaagcagccagcacacagcaacaaacgccgacaccagcaggtcacgaccacaccagcacacgacacaatccgagatctccgccagcgaccacgtgcacataagactactgcacggagcgacgcgaccaacaccgaagacacgctacgatcgaacgcatcgacccacgctccccgtcagc

SEQ ID NO: 568755 - DNA, 492 bp, Homo sapiens
  misc_feature (1)..(1): n is a, c, g, or t
  misc_feature (72)..(73): n is a, c, g, or t
  misc_feature (75)..(75): n is a, c, g, or t
  misc_feature (77)..(77): n is a, c, g, or t
  misc_feature (79)..(79): n is a, c, g, or t
  misc_feature (83)..(83): n is a, c, g, or t
  misc_feature (95)..(95): n is a, c, g, or t
  misc_feature (99)..(100): n is a, c, g, or t
  misc_feature (106)..(107): n is a, c, g, or t
  misc_feature (112)..(112): n is a, c, g, or t
  misc_feature (116)..(117): n is a, c, g, or t
  misc_feature (157)..(157): n is a, c, g, or t
  misc_feature (164)..(164): n is a, c, g, or t
  misc_feature (186)..(186): n is a, c, g, or t
  misc_feature (239)..(240): n is a, c, g, or t
  misc_feature (257)..(258): n is a, c, g, or t
  misc_feature (264)..(264): n is a, c, g, or t
  misc_feature (306)..(306): n is a, c, g, or t
  misc_feature (412)..(412): n is a, c, g, or t
  misc_feature (421)..(421): n is a, c, g, or t
  misc_feature (457)..(457): n is a, c, g, or t
ntcgtaccttccgcagtcccccaaggaaggtcacatcatccaccccaaaagtaagggcagctggccccattnntngnanaggnaggggttggggnatgnngaggtnnagggngtgnnattgaactgggacaaagggaacagataaggaacgttaggngttaggngatcccatacactgtgggatcnagaaagggctgggctttccttcctgagttgggggatttggggacagggtcttnntggtcaggggccaaacnntagcanggccggcagcaggctcagcagcagcccggcacccagcagggngacgcttgcccgcagcccgccatcggccgcactgaaattgcacagaaagctctggcagcagctgatgcccatggaagccacaccaacattgacgccttctgggatngggcaggcnggggaacaggtcttgctcaggctgtggccaaatgtnacgagattcccaatgccggcactagcagacacagt

SEQ ID NO: 568756 - DNA, 977 bp, Homo sapiens
agcggcttggcccctctgtagggaaagagggtccgccatgttccccggcggcgccgcgcttggctctggtagccgccggcgaagatgaggagactgtaagaggggccaagccgcctgtcgagaaagtacagtagcctcggacggactgtgtgcgctgcatgccactaaacaccgtactccctgtactgctcgctaccgaccggtttgtggccggccgggcccacccgagcggaggggaagcacacaacagacgcccaatacatgggctgctataacaacaagcaccgctggagaaaatagaaaagaagagaaaaatatattcaaaagcagaaaaataaagagaaataaacattagagagcaaaaatagaaaaagaaataaaagagaaaatcaaaaataaataaacaagaaagaaaggaaaaaaaagataagattaaaaaaaagaaaaaaaaaaaaaaaaaaaaaagtgacaaaaagaaagaaaaaaaaaaagaaaaagagaggacacaacaatacacaacagagaacaaaaaaaaaaagagtaacaacaagcaaaacataagaggaaaaagccatgaacagacagaacaagagaaaaaagagatacacaggagacacaacaaccacaagcagaacagagaaacacaacgaaaaagaaaaaagaaagcaaacaacaaaaacaaaacacaaaagaacaccacaaacaagcagagaagacagacaacaacaaatgaacagaaacagaaaaaacgcaaaaaagcacaaagaagatgagggacaaagaaacaacgtataaccaaagattaagaaagaaaacgagaggcaaaaaaaacgccacagaaagcaccacacacaaccgagaggaaacaacacgatggggggacagataaacaacaaaaaagagacgtggggaagcacatagaagcaagcaggcagagaaaacgaacaccaacaaacagacgtcgacaaaaacacata

SEQ ID NO: 568757 - DNA, 776 bp, Homo sapiens
cacagaactgcagtcttgttcttcccttggatcatgacaaataagtctcacacagtgccgtaatacttgtagattctttatgtaatctttgtaatcttaataagggcattatgagaagacgactccatgtttttttaactaccttcaacacacacttgggactgtaaccaactgaactgtcacactgtacggaactggtgcgtttccgttcttaacgcgaactaacgcatgttggggacacagactgactgaacacatgtactacctgaacagttactacaccttccataggcaaatgggacttactgtcttgcaagcactacgtcctcatgcttaataaactgactgaaatcgtagaaattacacctaggaactgagctaggccaaattgccactttcgtctagagagttctcggaggctactacctgacggggacagagccttaacaactacttccaaacagtatttcggacattgaccgacttggtaactagtgaacgaacatcaaagttgggtactttcaatgtgccaagtttggcgtgaactaggttcggtttgcctctttcataacaatgtaaacacaatggtgtaagttcaacttaaattctgggtggataaggagcaggactgattactatgtcttgcccttcgcccttagtctattttcagaaccaaataacagacacatgtgtcatgtgtgaactgtatctgccatttccagcacatcttctatgaacactgtattccactgccttgcttttacccttctttccct

SEQ ID NO: 568758 - DNA, 149 bp, Homo sapiens
caaacacacgttgcacacgcaagcacccaccatgacaacacgcatgcacagcacacatgaacacagcacacacacaaacacacaacacaacatacccccacaggcgtgaccgctccgcttactgagctccgttactgaccgcttactga

SEQ ID NO: 568759 - DNA, 614 bp, Homo sapiens
gcacgagcagcaacatatgtctaggcctcctctgtgccagccctgtgggaaagcagagcccccaccatggcccctggctccttcctagggcctagctgccatcagcctgatgtgcagcagcctttgcagcggtgctgacaccagtttacaaggccctgagaggggtccctgcccttcgggaggttacaaggcaggaatccattaacagaatcagttaacaatgatttctccttttaacactccagacaggtgggcaagtctcctttctccacccagtggaggcctttagaaaccactaggcattctccatctatgaaaaataaaacccagattctagctgtaaacagttttaggtagtgcccattctttttccccccacatcaaacgagtaaagtgcatcgttgtaacaaggtttgagggccatctcatgcacgttggaaacccacatttatgaagcacaaaaggatcaggcggtgcccattctattcagaggaacctagattcagactaattgtatggacgaaaacctgttcctttggctcctgcctttccttcctttcattcaaagcctacagatctcttctcagaggagatttagttacaaatgaaaggca

SEQ ID NO: 568760 - DNA, 361 bp, Homo sapiens
atctttctagaaatagaacatgcattcactgtagatgtatggatatgtcactgagtactgtattcagtccattggtttatgtgtactgcttatatgccagaatcatgctgtattggttactataactctttagtctaattagacgtctgcatactgtgattcttccagtttagaccttactgctatagtatagtattagggaattctggacactttagtagtaccgtgtaagtataaggattgtcttaactatttctgtgagaagtgtcattgggataaaagatagggattgcattgaatctaatagattgcttaggatagtatggacagtaaaacaatattgattcttccagtccatgaa

SEQ ID NO: 568761 - DNA, 397 bp, Homo sapiens
ttatttaatgccactatgctctccaaaatatctactacactatcacttctcataaacatgcaccaagccggctgtggtggctcacccctataatcccagcacttggggaggccgaggcgggtggatcacctaaaggtcaggagttccagaccagcctggccaacatggtaaaaccccaactctacaattagccgggtgtggtggcacaagcctgtagtcccaggtacttgggaggctgagacaggagaactgcttgaacccgggaggcggaggctgcagtaagccacgatcacaccactacactccagcgtgggttgaacagaacaactctgtctcaaaaacaaaacaaaaaagcaaaaatatagaccaggtgagtctcattttggcatactgttgc

SEQ ID NO: 568762 - DNA, 259 bp, Homo sapiens
tagaggatccccctcgcggtctcataggatatctacaacttgcaggctgacaactctgctgatgtctggctgtacatcagaataaaaaaatcgaatggactatgccctgaacatgctcttacaaagatgtaactagaaagacttatcgaatggaccctatagggactcctacttttccacgtgtgagatcgtacagggaagcctaaaagaatgatctagcagtactgtagacagaagcatggactatgtggctggtacg

SEQ ID NO: 568763 - DNA, 289 bp, Homo sapiens
gggcctttactgagcaagcaccttccacctccttgggtgaaaccaggagagattgcttgtttcacttgtacaatgcaggaacggtggcatggggtggcgcgaaacttgcgagttcgcgaaggtggctaatctttgattctatgtttcttgatcctcctggccactccagtacctgtggtgatgtgcaggtagagcactactgtatagacaatccttggtgtcccatctacacccagtcttgtggggatccatctaggagttcgagcctggctaggcgggtcatagcgtt

SEQ ID NO: 568764 - DNA, 436 bp, Homo sapiens
cgcttatattgtacaatgttaaacttcaattcctgtaacctggttagtattaatgtcagtgactaaaaaacttagagttagttttagggcactttttattttgagagcatgaagtgtggaatgtgtcactacgattgttgataaagctgaggccacttgcaacctgattttttaaatgaaatagataaagtctttttgaataatatagtatccactgctatttgcctgattatgtaatgtcaaaagtttaaccatcttccaagtacaaaaacatcctggattccattgaggctcttcaacagcattcatgatgcacttcttctggtttggggcacgtctaccccagtacagcaatgtcgctacaactagcccaataaaactctacttcaaatctaaaaaaacacaacaacaaaacaaaaaaaacacaacacaaaac

SEQ ID NO: 568765 - DNA, 122 bp, Homo sapiens
cccccccaagtggaatcctagtcatctttctatactagctactttcattgtttgctttctagaaaacagcattacattccaatgataacttggatctgcatttagaacaagaaccattattt

SEQ ID NO: 568766 - DNA, 449 bp, Homo sapiens
  misc_feature (444)..(449): n is a, c, g, or t
acttaataaaatcaggatacagattcttttcagtcaaacatgttcattcaccaagatagacaatatcttagttcatagaacaaattcgacaagtttgtaataattgaagtcatacaaaggatattctaaccataatggaaacaaattaaaaatcactaacaagaaaaaaagaaaacaagaaaacctgaaaaattaacccactactaaatgatctgtgtcaaagaggaaactgtaagagaaataaaagctatatcaaaatgaatttaaatgaaaatatattaaaatttgtgggatactgcaaaagcattgttgaaagggaaatgtatgctttaagtcctaataataggaaaaaaagcaaggtttcaaatcaatgattgcagctcctgctctactgtaagaaactaaaaaaggactccagcctggacatcacagtgagactctgtnnnnnn

SEQ ID NO: 568767 - DNA, 301 bp, Homo sapiens
  misc_feature (164)..(164): n is a, c, g, or t
  misc_feature (195)..(195): n is a, c, g, or t
  misc_feature (284)..(284): n is a, c, g, or t
gtgcgcggtgattctagaggatcccggactggagatgtctgatgtgaagcgaaggagtgcagttaggcctctccctttatgaaggacaccacagcacaactaaaactcacaaaggctgatcattatgctctattccatcttattttattttagatgatgggggntctcattctgtcacccagtgctgtagtacangtggcataatgcatggcttctgctacagccctgtgaactcctgtggctcacagccgatccttcccacctcagactatctccagtccggngtaccgacgctcgaaat

SEQ ID NO: 568768 - DNA, 294 bp, Homo sapiens
tgttccctttgtctctactaaaaatacaaaattagccaggcatggtggtgcatgcctgtaatcccagctactggggaggcagcggcacaagaattgcttgaacccgggaggcggaggttgctgtgagccaagattgggccaccgcactccagcctggatgacagagtaagaatctgtctcaaagaaaaaatatatgtgtatatatatagtattaccacccaaggagattattacacagaccactaaaaacaaaaagaaaaacaaaagacaaccataggtaaccgttgaggccat

SEQ ID NO: 568769 - DNA, 490 bp, Homo sapiens
tactatggattagttactgagggagaagggaaagctcataataaatgtaaaaggaagaattacacaatcatttgacgatcgcagaaatgactgattcaggcacggatcatcaatggatgttaaaactagagagtatagccaggcacagtggcatgtgcctgtagtcccagctactcacgaggctgaggtgggaggactgcttgagcccaggggttcaaggccagcttaggcaacatagtgagacccccgtcacttaaaaaataaaaacactaaggccgggcgcagaggctcaggcctgtaatcccagcacttggggaggctgaggcgggcggatcacaaggtcaggagattgagaccatcccagctaacacggtgaaaccccgtctctactaaaaatacaaacaacaatttagccgggcgtggagatgggcgcctgtagtccaagctactcgggaggctgaggcaggagattggcgtgaacccaggtgtt

SEQ ID NO: 568770 - DNA, 389 bp, Homo sapiens
  misc_feature (221)..(222): n is a, c, g, or t
  misc_feature (236)..(236): n is a, c, g, or t
  misc_feature (240)..(240): n is a, c, g, or t
  misc_feature (331)..(331): n is a, c, g, or t
  misc_feature (358)..(358): n is a, c, g, or t
cgaacgatgaaaggaatcgggagcgttgccatttcctgttgggccatgcatgggatcctgcacgagaacgatgaaacagggcatgcctgtgacagctcgctgtggtgtttgtttgtaggtcctgataggaatctgcagcattctatcctctacccagctaccagtggcaggaagctttgatgaaattctcatgggtagtcatctctctccagctgacagcnnaaaaaagggtgcancccngttgattggaaggatggggatagtgtgatggtccttccaaccatccctgaagaagaagccaaaaaacttttcccgaaaggagtcttcaccnaagagctcccatctggcagaaatactncgctacacaccccagcctaagtctctaacga

SEQ ID NO: 568771 - DNA, 122 bp, Homo sapiens
ctgcctccagttctttctctgcccttgcccatctctctttcccctcaggcaagatagacgatggatggagtcagactgaaaggacaggcatcttgatctccagcaggcatggcgggccagtg

SEQ ID NO: 568772 - DNA, 350 bp, Homo sapiens
ggtactcctcccatgtcagttccagccctacctaacgccccacagacctttgctttctggcctctcatttgagtatctccagtccgtctcagaccgaaagtgtggagatcaagtattctgtctattacacagctcgggaggccaaaaagagtttgagcaacttgcctttagtacctccgcgttccagagtctgaaacagaagccaggtttcctgatttctggcctgaggataaccttattctctgcctttagacgcaagactgctgcctcttcgtcacctttctgagaagagccatcacatttccatcccctcctctcttctctgtacatctcgttcacttcacttgtaa

SEQ ID NO: 568773 - DNA, 210 bp, Homo sapiens
atgggcgatctcatgcaggatccccccgtaaatgtagatactgtgtttcatatatctatatttttaaaaattggtttaacgtccacagttcctggtttagtaactcccatagccctttgtgttagtctgtcttgagactgggtaatttgtaaagaaaagtggctttattgcgtgctcatgagttctgcacgtgcctatagagctaagcat

SEQ ID NO: 568774 - DNA, 389 bp, Homo sapiens
  misc_feature (358)..(358): n is a, c, g, or t
ctgtagtcccagctactcgagaggctgatgcaggagaattgcttgaacctgggaagcagaagttgcagtgggccgatgttgcaccaccgcactccagcctgggtgacagagtgagactacatctctggatttacaccaacgaattattttattatgcccaataagcttaacacattcaatgtccactcatgtgcctacgagccagctgagaaagcattaaatgtgaagtcattatactgaggcatctgggccctgaattacaagattccttccctcctccagaaatgacgagcacttataatcatgcactgagtgcttctatacttctgtgcaatcaactcataacaagtgtccctgntcattttgatgcgttgggctggattgcactt

SEQ ID NO: 568775 - DNA, 900 bp, Homo sapiens
ccttaaaagtccattttctccccccttaaaagagtttggtccacaacccccacccaactgttcgacgcgaccttacaaaacccgtgaacattttcagtcccccccgtgtcagcccccacatatgtgggcccccaccagattttgacgtaaccaccacgaccttgcgtaagacgagaacacagctctgaatataaagagctgcgcgtataaaagtttttgaaaaccaagcaatagtaccaacaccgtgacgtctttaaagacgacttctcacgggggaaccccacagctctctctggtttaataaaattaattagaccgcgccacatttcccacatatcctcccgtatcaatatagtgcgttcacacatatcttgcggaacccctcttgcaaaagattgtagcaacctaccatagagagggtattctgaaaactaaaagtcatgctaatatgtctatataaaacagccccttgattcactccattgtctctctctcatcttgaaaactgtcgacgccttacccccctacactttatattttttgaccacccctcttctactttatctgcaaacaaattgaaagacctccgacaatcattcaagagtatagaattacttagttgaggaatttcccattgagattttctctgtacaatgtgacaaagacttcttatagaacatatattggttgcaactctggcgaatttcaatagaatttctggcatgaaaaaaccaaccgccatgttgtgtaaaatgggaagcccaagcttttctctccaacaacccccggttcttaataagcataatgagtcgtgtggtgctattcttttctaataaacccccccccctcccttttttggtaaatacaaaacccccaaccccaaatatcccgccacaaaaa

SEQ ID NO: 568776 - DNA, 691 bp, Homo sapiens
  misc_feature (688)..(688): n is a, c, g, or t
ggcacgagcggtaacataggcgcgggcggcgtgtccttgggctagagcgcgggacgtctgtcttcgagtccgaacgttcgtggtgttgaccagcccggaacgaattaaaaatgggtgatgttgaaaaaggcaagaagatttttgttcagaagtgtgcccagtgccacactgtggaaaagggaggcaagcataagactggaccaaatctccacggtctgttcgggcggaagacaggccaggctgctggattctcttacacagatgccaacaagaacaaaggcatcacctggggagaggataccctgatggagtatttggagaatcccaaaaagtacatccctggaacaaaaatgatcttcgctggaattaagaagaagggagaaagggcagacctaatagcttatcttaaaaaggctactaatgagtaattccactgccttatttattacaaaacaaatgtctcatggcttttaatgtacaccataatttaattcacacaccaaattcagatcatgaatggctagcaatgtttttgttggacagtcctgatttaagtaaaactgacttgtcataaagtgggtacggtctttattaaagcacagttccagttgtatacatgctaccacggctctccctttctccaagataagattggacttaattagccatggtttactttccataatanggg

SEQ ID NO: 568777 - DNA, 1036 bp, Homo sapiens
  misc_feature (5)..(5): n is a, c, g, or t
  misc_feature (49)..(49): n is a, c, g, or t
tggtngcatttacaccggtacttaagcgcggaccgggtgtccttggacntgagagagtggggacgtccggcttcggagcgggagtgttcgttgtgccagcgactaaaaagagaattaaatatgggtgatgttgagaaaggcaagaagatttttattatgaagtgttcccagtgccacaccgttgaaaagggaggcaagcacaagactgggccaaatctccatggtctctttgggcggaagacaggtcaggcccctggatactcttacacagccgccaataagaacaaaggcatcatctggggagaggatacactgatggagtatttggagaatcccaagaagtacatccctggaacaaaaatgatctttgtcggcattaagaagaaggaagaaagggcagacttaatagcttatctcaaaaaagctactaatgagtaataattggccactgccttatttattacaaaacagaaatgtctcatgacttttttatgtgtaccatcctttaatagatctcatacaccagaattcagatcatgaatgactgacagaatattttgttgggcagtcctgatttaaaactaagactggcttgtggttaaatgaatatgttcagtttttgaattttaatagtaactccaattcagtaaatggtatcactgtttaccccttttaaagatatgattagacttcgttagtaatgttcaacttttcacaaagatggtgagtgccatcttaaaacttactggagattggtttatatttagatttatataactggttatgtgaatatatttaaatactggggaaattgcttcactgtcttagaaccaagcaagattcacctgtgttttgtgttcatgttcatttgcctcttaaaggcaagggttgaagataaataaggtagcaatgtctatagttttggccttaactatgccaatctaattataattccctgtatttaaaatggtttcttttacttattgaaaggcattttagtgtggtttatgtgtaatattaaagattattcaacacc

SEQ ID NO: 568778 - DNA, 982 bp, Homo sapiens
  misc_feature (5)..(5): n is a, c, g, or t
  misc_feature (49)..(49): n is a, c, g, or t
tggtngcatttacaccggtacttaagcgcggaccgggtgtccttggacntgagagagtggggacgtccggcttcggagcgggagtgttcgttgtgccagcgactaaaaagagaattaaatatgggtgatgttgagaaaggcaagaagaaattaaaaagagggataactgggatgacgatgatgatgaaaaaaaagaggaagcagaagtaaaaccagaggtaaaaatttcagaaaagaaaaaaaatagcagagaagataaaagagaaagaacggcaccagaagaaaaggcaagaagacatcacaaggagggatacctgggatgacgatgatgatgaccaaaaaagaggagcagatgtaaaacccagagcttaacaatttcagaaacgacacaaattcgcagcagaagacccacagccgacccgaccggcaccacgacgcaccggcccagcaagaccctccccacacagagggactcactggatgccgatgactgatgaccccaccccgaggccgcccgaagtaacaaccccgaggtacacatttcagaacacgacaacccacttcgcggagaagcatacacgacgaccagacacggaacccgcaaccaacgcccccgacgcaccttcaaccgcacgcctccctgggcactgacgacggctgcccggcccacccacgcacgcgacgcaggcaggcaaacaccccgaggtagacacctccctggaaaccaaacaacaatccgccgcggcagataacagagacactaaccgacacacagaccgggcccgaggacccaacacagcaggcatcacgggcagctcgcgcgaccaaacgaaggctaccccagtaaccagaggcacctccaacaccccccgtcgccatacaccacacgccacccacagcgccccacaccaggacacgccgcgcagacacacgaccccgaccacggacccaccagcggcaacacaaacgccgcgcacagcgc

SEQ ID NO: 568779 - DNA, 778 bp, Homo sapiens
gaaacaggcatgcgcgagaatggaggccgctcgtgccgatctatgggagcatcggttgacgggcctgtacgacgtggctaggctttcaagttggggacttcgtgctgaagagcgggctttcctcccccatctacagtcgatctgcggggctatcgcgtctcgagcgcgtcttctgagtcaggaactaagcgtcttgtagaaggacactattagtccaggagaaacctgtgtaatcattgaagatgttgtcaccaggggatctagtgtgtggaaactgtggaggttcttcagaaggagggcttgaaggtcaggtgatgccgaatagtgctgttggacaggagagcggggaggcaaggaccaagttgcaggcgcacgggatccgactccactcagtgtgtacattgtccgaaatgctggagattctcgagcagcctgcatagcaaagtcgatgctgagacagtttgggagagtgaagaggttattcaggagaagtgtctttgtggcagcgaatcataatggttctcccctttctatacaggaatgcgcccaaagaactcaggttcggtgcacgtgcagtagtctggccaggatccagccagtttgcctcgaagcttctcaggcttatgcgggcggaaagggaccaagtgtgtgtctatcctgtggatgtttcactggccacgagagcttgtggctgcttaaggcagatgctttagcgacctagttattcgggttgctgaagacttccgtgtagatgattggagtggtttacctcgatggg

SEQ ID NO: 568780 - DNA, 511 bp, Homo sapiens
agccaagtgttttaataaagtgattatcacttgtcagaaccaggcacagtggctcacacctgtaatcccagcactttgggggctgacgtgggaggatcacttgagcccaggaggtcgaggctgcagtgaactatgattgtgccactgcgctctaccctgggcaacaaagcaagaccctttctcaaagacaaagaacagtgaattgtccaattaaaaaatgggcagggggctgggtgtggtcgctcacacctgtaatcccagaactttgggaggccgaggcgggtggattacaaggtcaagagatcaagaccatcctggctaacacggtgaaaccccatctctactaaaaatacaaaaagtagccgggcgtggtgatgggcgcctgtagtcccagctactcaggaggctgaggccggagaatggcgtgaacccgggaggcggagcttgcagtgagccgagatcgtgccactgcactccagcctgggcaacagacagtgcgagactccatctc

SEQ ID NO: 568781 - DNA, 1304 bp, Homo sapiens
  misc_feature (5)..(5): n is a, c, g, or t
  misc_feature (49)..(49): n is a, c, g, or t
tggtngcatttacaccggtacttaagcgcggaccgggtgtccttggacntgagagagtggggacgtccggcttcggagcgggagtgttcgttgtgccagcgactaaaaagagaattaaatatgggtgatgttgagaaaggcaagaagatttttattatgaagtgttcccagtgccacaccgttgaaaagggaggcaagcacaagactgggccaaatctccatggtctctttgggcggaagacaggtcaggcccctggatactcttacacagccgccaataagaacaaaggcatcatctggggagaggatacactgatggagtatttggagaatcccaagaagtacatccctggaacaaaaatgatctttgtcggcattaagaagaaggaagaaagggcagacttaatagcttatctcaaaaaagctactaatgagtaataattggccactgccttatttattacaaaacagaaatgtctcatgacttttttatgtgtaccatcctttaatagatctcatacaccagaattcagatcatgaatgactgacagaatattttgttgggcagtcctgatttaaaactaagactggcttgtggttaaatgaatatgttcagtttttgaattttaatagtaactccaattcagtaaatggtatcactgtttaccccttttaaagatatgattagacttcgttagtaatgttcaacttttcacaaagatggtgagtgccatcttaaaacttactggagattggtttatatttagatttatataactggttatgtgaatatatttaaatactggggaaattgcttcactgtcttagaaccaagcaagattcacctgtgttttgtgttcatgttcatttgcctcttaaaggcaagggttgaagataaataaggtagcaatgtctatagttttggccttaactatgccaatctaattataattccctgtatttaaaatggtttcttttacttattgaaaggcattttagtgtggtttatgtgtaatattaaagattattcaacacctctcacatcttacagatctataaggtcacatgcttttaaaatagtagcaagttaaacttcactcttgaattctttacaatctaagtcaaactaagttataatttaggattgtctttaaacagccattcagaaacaaaactgtagaactgtgtatttgattgggaatggtgcttttgccaacttaaaaggattaaagtaacggagatatacacaaattttaaaattatgtgtgatcacaagactaaagataattaaaaagaaaaccaca

SEQ ID NO: 568782 - DNA, 1821 bp, Homo sapiens
  misc_feature (5)..(5): n is a, c, g, or t
  misc_feature (49)..(49): n is a, c, g, or t
tggtngcatttacaccggtacttaagcgcggaccgggtgtccttggacntgagagagtggggacgtccggcttcggagcgggagtgttcgttgtgccagcgactaaaaagagaattaaatatgggtgatgttgagaaaggcaagaagatttttattatgaagtgttcccagtgccacaccgttgaaaagggaggcaagcacaagactgggccaaatctccatggtctctttgggcggaagacaggtcaggcccctggatactcttacacagccgccaataagaacaaaggcatcatctggggagaggatacactgatggagtatttggagaatcccaagaagtacatccctggaacaaaaatgatctttgtcggcattaagaagaaggaagaaagggcagacttaatagcttatctcaaaaaagctactaatgagtaataattggccactgccttatttattacaaaacagaaatgtctcatgacttttttatgtgtaccatcctttaatagatctcatacaccagaattcagatcatgaatgactgacagaatattttgttgggcagtcctgatttaaaactaagactggcttgtggttaaatgaatatgttcagtttttgaattttaatagtaactccaattcagtaaatggtatcactgtttaccccttttaaagatatgattagacttcgttagtaatgttcaacttttcacaaagatggtgagtgccatcttaaaacttactggagattggtttatatttagatttatataactggttatgtgaatatatttaaatactggggaaattgcttcactgtcttagaaccaagcaagattcacctgtgttttgtgttcatgttcatttgcctcttaaaggcaagggttgaagataaataaggtagcaatgtctatagttttggccttaactatgccaatctaattataattccctgtatttaaaatggtttcttttacttattgaaaggcattttagtgtggtttatgtgtaatattaaagattattcaacacctctcacatcttacagatctataaggtcacatgcttttaaaatagtagcaagttaaacttcactcttgaattctttacaatctaagtcaaactaagttataatttaggattgtctttaaacagccattcagaaacaaaactgtagaactgtgtatttgattgggaatggtgcttttgccaacttaaaaggattaaagtaacggagatatacacaaattttaaaattatgtgtgatcacaagactaaagataattaaaaagaaaaccacaaaaaaaaaaaaaaacacaacaccaccccaccaaacaaagcgggggggcaccaccatcaaagagtacccccacgcaaggcggccccacactaaacggaaataccccacacattactcgtcggaaccaacgggagatcaccaaaaagaggaacgcccaaacaccaaaagcagaagcacagtgtgagcagcgcaggttacaacacacgcgtccgccgacacgcggaccaaaaccgtgcacacacgaggaaaaccacggcgcaccaggaaacccccataccaccgcgcgaccgaggagcgacaacaacaccggcggcacaaaacacccacacagacacacaccactaacaagagcccactcaatgccaaaaacccatacaacaacccccaccaccgcgaatacaaccagcgtctcacccgcaccccgcgcaagaggacactgccaccgcgtagaaaaactcggcgaccacgccgcgatctacctgacgaccaccctatagtccagggcaagccccaccacc

SEQ ID NO: 568783 - DNA, 439 bp, Homo sapiens
gcactggacaaggccctctgggctcttctgagtcgaagtgttatgtctcgccttttttcgtgggtgggtaagactgatgctgctgtctgggacgtgacttccccacatatccccaacagatcattacatccactgtcagtcacttcttgtcgtctaccaattcccttccccccacttaccactcaagttatgaaaacagtgagtcatcgtttgatcgtctgtgatcccaatttgcctaagactatacactgtccggaatatggatcctgtcacaagaggcttcacaaagtaaagggaccatgtgtgtttctaggttgttgtgcttttcaacagtctgtctcatttcaactattgtaacaatgaccgtttcttttagtttcttgataaccttgttgtctactttgtttcctgattaccttgttgtctacttcgttgcctg

SEQ ID NO: 568784 - DNA, 1385 bp, Homo sapiens
  misc_feature (5)..(5): n is a, c, g, or t
  misc_feature (49)..(49): n is a, c, g, or t
  misc_feature (1154)..(1154): n is a, c, g, or t
  misc_feature (1166)..(1166): n is a, c, g, or t
  misc_feature (1178)..(1178): n is a, c, g, or t
  misc_feature (1181)..(1181): n is a, c, g, or t
tggtngcatttacaccggtacttaagcgcggaccgggtgtccttggacntgagagagtggggacgtccggcttcggagcgggagtgttcgttgtgccagcgactaaaaagagaattaaatatgggtgatgttgagaaaggcaagaagatttttattatgaagtgttcccagtgccacaccgttgaaaagggaggcaagcacaagactgggccaaatctccatggtctctttgggcggaagacaggtcaggcccctggatactcttacacagccgccaataagaacaaaggcatcatctggggagaggatacactgatggagtatttggagaatcccaagaagtacatccctggaacaaaaatgatctttgtcggcattaagaagaaggaagaaagggcagacttaatagcttatctcaaaaaagctactaatgagtaataattggccactgccttatttattacaaaacagaaatgtctcatgacttttttatgtgtaccatcctttaatagatctcatacaccagaattcagatcatgaatgactgacagaatattttgttgggcagtcctgatttaaaactaagactggcttgtggttaaatgaatatgttcagtttttgaattttaatagtaactccaattcagtaaatggtatcactgtttaccccttttaaagatatgattagacttcgttagtaatgttcaacttttcacaaagatggtgagtgccatcttaaaacttactggagattggtttatatttagatttatataactggttatgtgaatatatttaaatactggggaaattgcttcactgtcttagaaccaagcaagattcacctgtgttttgtgttcatgttcatttgcctcttaaaggcaagggttgaagataaataaggtagcaatgtctatagttttggccttaactatgccaatctaattataattccctgtatttaaaatggtttcttttacttattgaaaggcattttagtgtggtttatgtgtaatattaaagattattcaacacctctcacatcttacagatctataaggtcacatgcttttaaaatagtagcaagttaaacttcactcttgaattctttacaatctaagtcaaactaagttataatttaggattgtctttanacagttctacanttttgtttctgnatngctgtttaaagaccatcctaaattataacttagtttgacttaggattgtctttaacagccattcagaaacaaaactgtagaactgtgtatttgattgggaatggtgcttttgccaacttaaaaggattaaagtaacggagatatacacaaattttaaaattatgtgtgatcacaagactaaagataattaaaaagaaaaccaca

SEQ ID NO: 568785 - DNA, 1319 bp, Homo sapiens
  misc_feature (239)..(239): n is a, c, g, or t
gaagcatagcatatgagcgatgctgctggggttgcgcgcgcccaggtgtgctaagtgaccatggtctatagacatgtaactctagtatgagtcctgtgtcatgactaggtcgctgtgagattctcacttccaatgaaagatagattgcccggtggcacaccgatgcggtacatggagacggcatcgcagatgaatgggcgtgaagagtcattcactgggctctattgagagcaggagangatccagagtcagaggcctccgtgagttactcttatagacagggccggcctgaataagaacaaaggcatcatctggggagaggatacactgatggagtatttggagaatcccaagaagtacatccctggaacaaaaatgatctttgtcggcattaagaagaaggaagaaagggcagacttaatagcttatctcaaaaaagctactaatgagtaataattggccactgccttatttattacaaaacagaaatgtctcatgacttttttatgtgtaccatcctttaatagatctcatacaccagaattcagatcatgaatgactgacagaatattttgttgggcagtcctgatttaaaactaagactggcttgtggttaaatgaatatgttcagtttttgaattttaatagtaactccaattcagtaaatggtatcactgtttaccccttttaaagatatgattagacttcgttagtaatgttcaacttttcacaaagatggtgagtgccatcttaaaacttactggagattggtttatatttagatttatataactggttatgtgaatatatttaaatactggggaaattgcttcactgtcttagaaccaagcaagattcacctgtgttttgtgttcatgttcatttgcctcttaaaggcaagggttgaagataaataaggtagcaatgtctatagttttggccttaactatgccaatctaattataattccctgtatttaaaatggtttcttttacttattgaaaggcattttagtgtggtttatgtgtaatattaaagattattcaacacctctcacatcttacagatctataaggtcacatgcttttaaaatagtagcaagttaaacttcactcttgaattctttacaatctaagtcaaactaagttataatttaggattgtctttaaacagccattcagaaacaaaactgtagaactgtgtatttgattgggaatggtgcttttgccaacttaaaaggattaaagtaacggagatatacacaaattttaaaattatgtgtgatcacaagactaaagataattaaaaagaaaaccaca

SEQ ID NO: 568786 - DNA, 1386 bp, Homo sapiens
  misc_feature (5)..(5): n is a, c, g, or t
  misc_feature (49)..(49): n is a, c, g, or t
  misc_feature (209)..(209): n is a, c, g, or t
tggtngcatttacaccggtacttaagcgcggaccgggtgtccttggacntgagagagtggggacgtccggcttcggagcgggagtgttcgttgtgccagcgactaaaaagagaattaaatatgggtgatgttgagaaaaggaataggaagagattctctcattcatgaacgttgttcactcacgatgccaatcacgcgtgtgaataagngggacggcagatgcactagatgacttggaggcataaatctcgcgatggtcgtcgtgttagggcaagataggacaggagtcacggcgcccgtgggatagctcgttacagcagctcggcatactaagaacaagagaggctactcagtcctgggggagagggatacgacgtagatggatgtactgtggcagcaatcccagaggaagctacatcgcctgtgatactaaaaatgaatactttgtagtgtcggcattaagaagaaggaagaaagggcagacttaatagcttatctcaaaaaagctactaatgagtaataattggccactgccttatttattacaaaacagaaatgtctcatgacttttttatgtgtaccatcctttaatagatctcatacaccagaattcagatcatgaatgactgacagaatattttgttgggcagtcctgatttaaaactaagactggcttgtggttaaatgaatatgttcagtttttgaattttaatagtaactccaattcagtaaatggtatcactgtttaccccttttaaagatatgattagacttcgttagtaatgttcaacttttcacaaagatggtgagtgccatcttaaaacttactggagattggtttatatttagatttatataactggttatgtgaatatatttaaatactggggaaattgcttcactgtcttagaaccaagcaagattcacctgtgttttgtgttcatgttcatttgcctcttaaaggcaagggttgaagataaataaggtagcaatgtctatagttttggccttaactatgccaatctaattataattccctgtatttaaaatggtttcttttacttattgaaaggcattttagtgtggtttatgtgtaatattaaagattattcaacacctctcacatcttacagatctataaggtcacatgcttttaaaatagtagcaagttaaacttcactcttgaattctttacaatctaagtcaaactaagttataatttaggattgtctttaaacagccattcagaaacaaaactgtagaactgtgtatttgattgggaatggtgcttttgccaacttaaaaggattaaagtaacggagatatacacaaattttaaaattatgtgtgatcacaagactaaagataattaaaaagaaaaccaca

SEQ ID NO: 568787 - DNA, 1456 bp, Homo sapiens
  misc_feature (911)..(911): n is a, c, g, or t
  misc_feature (1003)..(1003): n is a, c, g, or t
tgtttgttagccccccccggcgtgttgatttgctaggcaccccttcgttcggggagcttgggtggtaggttgttccctcctccccccgtgtgggtgggaccgggtgcgcccccccctcgtgtgtttgctttctgacagatgaggtgggcgccgtgttcgcgcacgacacgcagtcatggttcagttcgcatgtctctccctgctctactatactccgcacaccacagtgttggttgtggtgggttcgcctcacatactgggtgtgcgggattttttctttccgtccttctcccccctcgggtggttaactactacgcggcctttgttttatttttttcctctcctcgttggggggtgtgcccccacatgagtccactgtgaggtgctctcccttgtgtcgtgccgctactacgatactatcatctgtggcggtgcttacttaataaggtgggctcctcctttcatgctcccctacatatacatgggggggttagtctgtgagcgcaccacacgcagaagctagcattgttgtctctcgcctccctcactattaggtaccccctccccccccacaaagaggggaggggtttgaagaggcccaacaaagaggcggggtgtgccctccccaccagtggttgtagtcacaacagcagcgtgtgtcttttttgtgggatagcagttttgggtggctacttttttttctggttaggagacacacctcggtggggaagatttctctgtatttcctcttctctctcgagcgggtgctcttatacacacaactgtggttgtgtaacacaaataggtttgttctgatgtttctcccccccgcggagaggacacctctctacagcggcgttctcttctatagagaccactttttgtgctcgcctcaagcgcgcccacggggnggtgttatacacacccggccccctctcgcgtgggggtgcacctctccctcgggggtttcaccagggggccatctctcggttggcgggttctnttttcgcgcgagaagtatagagctcaccaccccgcacagagagtgtctgaccacacagcgtgggattagactccccctcgtcccacacacagcccacgcacctctcttgaacttgttctcttgttttgcttccacagagaggtgggagacagctgggccctcctccactgtgtttttccagacctttataccagaggagtgtgaactttcccttctggttctccacggggcctcccctctttgtgggccccctctacagtgcccacccctagaccctctcgctctccactgggtgccctctccagggaggggggacccccctctgtaatatggggggtacacaataaaggaggtttctcccccccttgtggggtggggggaaaatgggggccccccgcggttttggtgaaaatctcctccaagccaataaaaacaaaattttttttttccaga

SEQ ID NO: 568788 - DNA, 971 bp, Homo sapiens
agaaaattacggtggtggcgtccgacaaggaacttcagtagaactcacgattgtcgaagactccacggaagatgactccaaccgttgattcatgaacattaacaaatacatcgcattacaacattttgtacatgagaaaagtcaaatgtactcaagagaattaccagtgatagactttcacaaatgtctaacgagatttccccaaattggatgatattcatccgttctatgctgattggatgaatattctctacgaaccagaggtatcattgacaccgttggtgctctgtgggcaaataaactattgccaacaaattctagtgggacacatgttgctcagaagattactgtgcgactgatgaagtatggcgactctctctaccgttgccaacagaatgaagcgtgcggccctgggacggatgtgcacagtgatcaagaggcagaagcagagtttggactatctggagcaagtgcgtcgacgccattttatcccgtttgcaaaccattgatccgaataccaggaccctggtttggtgtgggtacccagatgtgggaagtccagcttcatcaaccaaggtgacgagagcagacgtggatgtgcacgccctatgcgttcacaactcaagtctctgttagttgggcacatggattataagtatctacgttggccaggtttgtcgacactcctgggattctggacaccctctggaggatacgacacaccatcgagatgcaggcatgatgccctggggcaactacgtgctgcggtctgcattgtgatggatttgcctgaccagtgtgggcattggtgcgggagcataaactctccgaaatcagaccgctttattcacaggcgtcaaatttgtcccaggtgagtgagagaacgcatagatagagatcaaatatacacttgggaagagtcgacaaaccccgcggaggtcacaaagatgaccggccatctcccagagaag

SEQ ID NO: 568789 - DNA, 1294 bp, Homo sapiens
ggcacgagcggtaacataggcgcgggcggcgtgtccttgggctagagcgcgggacgtctgtcttcgagtccgaacgttcgtggtgttgaccagcccggaacgaattaaaaatgggtgatgttgaaaaaggcaagaagatttttgttcagaagtgtgcccagtgccacactgtggaaaagggaggcaagcataagactggaccaaatctccacggtctgttcgggcggaagacaggccaggctgctggattctcttacacagatgccaacaagaacaaaggcatcacctggggagaggataccctgatggagtatttggagaatcccaaaaagtacatccctggaacaaaaatgatctttgtcggcattaagaagaaggaagaaagggcagacttaatagcttatctcaaaaaagctactaatgagtaataattggccactgccttatttattacaaaacagaaatgtctcatgacttttttatgtgtaccatcctttaatagatctcatacaccagaattcagatcatgaatgactgacagaatattttgttgggcagtcctgatttaaaactaagactggcttgtggttaaatgaatatgttcagtttttgaattttaatagtaactccaattcagtaaatggtatcactgtttaccccttttaaagatatgattagacttcgttagtaatgttcaacttttcacaaagatggtgagtgccatcttaaaacttactggagattggtttatatttagatttatataactggttatgtgaatatatttaaatactggggaaattgcttcactgtcttagaaccaagcaagattcacctgtgttttgtgttcatgttcatttgcctcttaaaggcaagggttgaagataaataaggtagcaatgtctatagttttggccttaactatgccaatctaattataattccctgtatttaaaatggtttcttttacttattgaaaggcattttagtgtggtttatgtgtaatattaaagattattcaacacctctcacatcttacagatctataaggtcacatgcttttaaaatagtagcaagttaaacttcactcttgaattctttacaatctaagtcaaactaagttataatttaggattgtctttaaacagccattcagaaacaaaactgtagaactgtgtatttgattgggaatggtgcttttgccaacttaaaaggattaaagtaacggagatatacacaaattttaaaattatgtgtgatcacaagactaaagataattaaaaagaaaaccaca

SEQ ID NO: 568790 - DNA, 2130 bp, Homo sapiens
  misc_feature (5)..(5): n is a, c, g, or t
  misc_feature (49)..(49): n is a, c, g, or t
tggtngcatttacaccggtacttaagcgcggaccgggtgtccttggacntgagagagtggggacgtccggcttcggagcgggagtgttcgttgtgccagcgactaaaaagagaattaaatatgggtgatgttgagaaaggcaagaagatttttattatgaagtgttcccagtgccacaccgttgaaaagggaggcaagcacaagactgggccaaatctccatggtctctttgggcggaagacaggtcaggcccctggatactcttacacagccgccaataagaacaaaggcatcatctggggagaggatacactgatggagtatttggagaatcccaagaagtacatccctggaacaaaaatgatctttgtcggcattaagaagaaggaagaaagggcagacttaatagcttatctcaaaaaagctactaatgagtaataattggccactgccttatttattacaaaacagaaatgtctcatgacttttttatgtgtaccatcctttaatagatctcatacaccacccagcaattccagcatccatgcaatgcactgcaccagcaatcatattagtatgggccagtccatgcatttcaacacactcacagcactgcgctatgtcggttacaaatgcaatcatcgttccagatatttatagacattattaaagtcagtcaactccaaaatatcccagtcaacatagagtcatccactcgtattacacccccgtatattcaacaagcattatccgcatatcacgcactcatctgtatccagtccaaatcggtattccaaacgtatttaccaccacacagcatccggtaggaggtagcccaatcgtctcaaaccactttcacctgggacagcattctcgggtatcatacatcatctctcaagcattcacatcattcacacctagggatatcacattagatgtcacactaattatatatgcaacaattcaaccataggagaggacacaaatatggactatcccaacattgagtctaataaaaaaaccaaacggccaagccatatcaagccgttacgtctatgcggaagtatagataaaccaatggttaccatatatggacgcctcctatacaaagagagggccaaggggatatgcaagacattccgacattaccacagtgggtacacgacaacaccatgattcctccttcacgacttatcgggaagccatactacatctaacattgccccacagacattcgcttcaaacgttataaattaacagtttacccccgtggaatcacctttatcacacgactggtgatctacccataagaagaccgtagacacttgggacaacaggcgacccgttctaaacagcctggtagcgcttcaacattgtctgcttcaccttcctttaagcccagggccatttcacattgttccacaacgaaagcctgtccattcaacgaaattctcattcctgccccgaggacatcgaataaatcaaggaagttcgaaccattggcacgcatattgtaaacagagacatatgaggataggcaagagggtgaacaacgccttatcacgagtctctatggggagagctcgacttaatagccacgatacttatagggagaacaccacgccgtcaagagattagtcctctcacgatgaacagaggcaactatggcaactatcaacaaagcaaggacgcgagctgtagcgaaaataccaacaaaagactgtgttagcccaccatgggtggcaactatatgaaactatggggagcacatagctgtcagcgcctaatgggcaccacagctaaacagggagaatacaacatgacacagggcgatataaaacaccaagttgataatagactaatttgtgaatcacacgcagcaacaaactaattatataacagaaaagcaagcaaaatataaaagaacacgagggggagtcaacaataaaacagtgagaccaagacaatgaagcaagacttaaaaaaaagaaaaaaataaatcgaataaaaacaaagcagaaacaacatgtaagaagaatggcagaaagaacacaagttgcgagagaagcaagcccacaaacatctacgactcgtacgtacttaatccttgcctccatcgactgtagtatg

SEQ ID NO: 568791 - DNA, 225 bp, Homo sapiens
ctaaagtccaaaaaaaaattgaagcccgctttaggacccattccttgattgttcttttttttcatttttccttttagcaattttttcagattcattttttttgacttaccattttgttaagggaatttaaagacccagacaaaatttacattaaatgatcttgaggttttaggggggcttaaaattttttttctttttggtaacctaccgtaatttatttctttc

SEQ ID NO: 568792 - DNA, 172 bp, Homo sapiens
tatcccctgtcagtcgatagccggcggtagagagtgtatatgatcagcccgctccccaataacagctgagactcacctgtagttgtaaaaaactccagttgacacaaaatagactacgtaagagtggctttaacatatctgaacacacgatagctaagacccaaactgggat

SEQ ID NO: 568793 - DNA, 1013 bp, Homo sapiens
cttcaagcccagcgagcatgtgaaacccagggccccaggaagacctgacagttcacaccaatgtctccgtacactctgactgctgacctggagcaacccgtatccccctgacaattacctgtataatcatctcacctatgcagtcaacatttggagtgaaaacgacccggcagatttcagaagtctataactgtgacctacctagaacccttccctccgtcatcgcagccgagcacccgtgaagatcgagggatttcctactagggacacgggtgagggcctgggctcagtgctataacaacacactggagtgagtggagccccagcaccaaggtggcacaactcctacagggagcccttcgaacagcaccctcctgctgggcgtcagacgttacctgcatagtcatcctggtccgatctgccatgttgtgcatatgtcagaagtcaccaagattacgaacagcaatggtgggatcagattcccaacccagcccggagaccgcctcgatggctataataatccaggatgctcaggggtcacagtgggagaagcggtcccgaggcccgaggaaccagccaagtgcccgacactggcaagaagtggcccttaagcaagctcatagaccatgaaactggcagcacaagactgaaaaagggatgaagatccacacaaagggatgcaaagagatgccaataccagggcatcagccagaacccagcacattgctagcccaaggggcaacacacagcaacgaacaagactcaggccaaagaagacacaagcaaaaaggacagataaagaacgatagagacacagaagcagtgtaaagcagagagaagacacacgacacaaaggacgccgcggagaccaaagcgagacagacgacataaacaagaagaagaaaggacaaaggccgacaagacaacgaacgacaaagagaaaggaacagagaagaccagaaagagaaaaaacaaaaaagacaaaaacacaccgaataagaagacaacacaag

SEQ ID NO: 568794 - DNA, 921 bp, Homo sapiens
atttatcaggtattcatcatgtgagctggtcatggattataagaatgatttttataaagtttaggagtacacacaaaataacttctagatgtgtttccaaaatttgtgtattatattttatttagaacattctatttcttctttccattgtagaatcctatataagcctacttttctttagttagtattcttttgtcttgttataggtgacataagtaaatttatttattgagctagttcaggtaagaactagaaagacttcataagtcatgaaaatgtttttatatatagatgtagcaaacaaacatgacattgcttatggtgtaacagatgctccataatgagccatatgtatttctgctggtgttagtttgtaactaacttcaagtcagagatggaaaatattaatagtgaagaactaacattgattttttatgtggagagaacattttttttcaggctgcaaagctgaatcttgctgttttttttttaatttcctaattatcttcagtttgtttatcttatgtgtcttcagtgtattcaacacagtccttctttttctgtgttattgccacagttttctcactgttgtcttcatgccatgtcattcacatggtactttgtagctttgatgagaaagttggtattcttctaatgggctggaaaatggcttattactaagaaggttgcttatccatattaaccttcgcattcgttcagaaaacaggcgctttacggtccccggcggagagttaaatcccctggtgtcccccgtcttttaagggacaccttttaaaccttcttaaggggcacatttattctgaaaacttcccaattttgaacaggcgggcgaaatattcccatttaccacattggacaccttagggaaccgcgcaacgcgctcacaatcttctgagaacc

SEQ ID NO: 568795 - DNA, 111 bp, Homo sapiens
gcggccgcctactactactactgctcgaattcaagcttctaacgatgtacggggacatgacaaataattatgaagaaaatatcctgaaagttgtactgcaccagcaaatcc

SEQ ID NO: 568796 - DNA, 160 bp, Homo sapiens
tgcttcattatcgctctagaggagccctggttttgaaatttgattatcccaaatcaactcaccactcttgctcagcctatataccgccatcttcagcaaaccctgatgaaggctacaaagtaagcgcaagtacccacgtaaagacgttaggtctacctgg

SEQ ID NO: 568797 - DNA, 1274 bp, Homo sapiens
  misc_feature (1274)..(1274): n is a, c, g, or t
tgagctcaagactcgaggccaatgactacttcaaagccaaggactactgagcaactgccatcaatgttctacagccatggccatcgagctgaaccccagcaatgccatctactatgtgcaacctgcagccatggcctacctgcgcactgagtgctcatggctactgctgctggagagactgccactgcgtggccatctgagcttggacaagaagtacatcaatggtgttattacctgcctggtgcttgccagacaacatggcactgggcaagttcctggtgcctgcgctgaagagactacgatgactggtggtcaaggtgaagccccatgacaaggatgccaaaatgcacataccaggagtgcaacaagatcgtgaagcagaaggcctattgagcgggccatcgcgggctgacgagcacaagcgctccgcggtggactccgctggacatcgagagcatgaccattgaggatgagtacagctggacccaagcttgcacgacggcaaatgtgaccaatcagtttcatcgcagtgagctcatgcacttggtacaagggacccagaacgaaactagcacctggaaagtgtgccataccaggatactgggtaccaggtcacaaggcggtccgtctcccaagcatgagcacgcatcgtggaaaccaagctcaaagcagacagacgcaccgattcacacgatgtgggggaacagaccatgggcgcagaccctatgcaccttaactcaaccatatccgagctccaacgggattaacctcggaagacacaacgccacatctccttcaatggtgaattatgttgcaccgaaggccatcccggtaaacgtacacctcacccttgttcgcgttcacacctcctgtacacgaatccaagctcccaccaccgtgcgagctgagccacgacaacacgacacacgagaaccgcaacaacagcgtccagggggagcggagcgtacaggcaacagcgaccgagagcgacagagacgaaagggccggaagacgggggaacagcaagcgacacggggaggccaaggaacaaccaggagaagtagagtacctcgacacgcggcggtccagtacagcggttacccctggacagcacaggcaagagcgcaggcagacagaagaccaggagatgggtcggagaaggtagcaagaaggacgcaccggagcggcagggagcggagcgagagaatagaaacgaagcagaggagtcgtcccgcaccgctgcgaccgcactcgacaacgggacgcacgcagan

SEQ ID NO: 568798 - DNA, 105 bp, Homo sapiens
tgctgggattacaggcatgagccaccccatgcccagctggaattttttaacttaaaaaaaaaaagtttcagggttggtccttacccattatgtgcccagttaggt

SEQ ID NO: 568799 - DNA, 619 bp, Homo sapiens
gaagaaagaagggtaaaaagaaggatcagattggaaaaggaacccagacagccctgccaaagccataccaaagacactcaaaagacagccaataaaattctgttcaatcaaaaacaaaaaaaaaataaaaaaaacaaacaaacaaaacaaaaacaacaatagaacgaaaagacaaagaaacaacacaaaaaaaagaaaaaaagaaaaaaacaacaaacaagagagaccagagcgggtggcgcgcggccgcaggggcacggggaccaaagggagcccacagaagccaccctcggggtgggagcgcggcgggggcgcccgacaagcaaagaaggtagtcagagaatctgctcaacaccacattgacataatatcccgacacggagaagacagagaccgacgcacagctaaatatcagagggtagtttatcttcgagagcacgattaaaagagcagggccgtgagggggggaaatcactaacgactggcgcgggtgaatcacacgaacgaggcaacggagattgatagaatagatacccacggcggacggcgaatcacacgagggagtggctgacgaatgcaacatgtacaaaattaagtaacccccgccgtgtagtagagc

SEQ ID NO: 568800 - DNA, 289 bp, Homo sapiens
gttgttgtttcggttgaacgcttggacctgacggcgtgcgggtgtggcttctccaacgaggccagaggtggtggagcgggcaggtgcgagtgttgttccagttgagcctgagctgctgggcaaggtcgttgattcctcaccgaggtctgcggttgtgagtgtggcgggtaaccctgtttgggtggaggctagggctgccggggaaggctagtagattcttcggtaagtgcccgaaagtggtgctgtcctcagtgaacagtgttgtgtgagttgagactggacggctgta

SEQ ID NO: 568801 - DNA, 420 bp, Homo sapiens
tcgttggttagtgaccggtgttgggctcgggctaaaccaacgaaatatgcagacagatagctaacagtatagggttctcagggtactataaactactagccgtctgaggaggattaggtagatacccaaacctagtcccgtccagagacataagcggggaccgtggttatcctgcgattggctccatgctgccctaggacattcgtagcagaccgtgctctaggcctccttaatcttgcaagttacacctgctcaagaggaataacctactcaaaggttgaagtcggacccgtcaattcatagttaacatgctgtatacctactctcaggaggccgcacgtgctagctacatgtgggcccttaacgcccatatgagtgacgatattcttaactcaaggccgacgaaaatcttcgacgagt

SEQ ID NO: 568802 - DNA, 408 bp, Homo sapiens
gcgtcgacccaccacctattaagagatgagacttccatgacaggtgggctgattacacaattgattgattggctttgggttgccttgcaatgatatgaatggtagaagcaatgcactgtcttctccctgactatctccctccttttgggaacccaagattcgagtatatgatagcacacttaattttggcgatctgcctgttgcttcactgtgcctgcttattaagccctaaagatgcatgcattcctgagcctgttcatccacaaggctccaccctgtagccagtagtccaattaagaaactagaattaggaaatcttacatacactaaatcttcagactgtctgtctgtctctctctctgtctctctctctctctctatatatatatatagtgtgtaatgtctata

SEQ ID NO: 568803 - DNA, 645 bp, Homo sapiens
gccgtggagtgaactgctgccgccgagccaccatcatgcctgggcactatacaggaatggcttctgtgctgcgtggtcaccaacctgattcgaccagttatttgacgacgaatcgtgaccccttcgcaggtgctgaagtgcagcagagaacaatgaaaaaatgaatgcctggcgtggtggctggcgtttggggtgccctgtggtgccaagatgctgcagctcatgtgcctgcggcccagaccaactccaacgctggcatgtgcaaacatgcctgctgcaatggagtcccagaaatgacctgcaagaaccctgctatgccccccagctgttgggctgtggttgacacgacagaggagcacgcagccggccccgtggctgcttacagaacagacagcgccataccgactgcgttcggaagcaagacctgatacaacaaactttccagcgcgttgacggcgcaacacttcactcctgatacgcagacgaccccagcaaacagggcggacacacgcctctgctgaacccctgcaccgcacttccgaccaacagccccactctgcaacccaccaagcggttgccacggccggtgcgaacattccacagtctgataacaacccgcaccatcggacctgcactcatcggagg

SEQ ID NO: 568804 - DNA, 328 bp, Homo sapiens
cacctggatcatgctcagaagactctatatatggatgtgatgttggaaaccaccccctcctctctatgggtgaggtgtgtgatcggcaacacctctggactcttacagttggtgccgggggtgtaaccatgtgggccatggggaggtcagaggtgctgtgtccaagggagtggcaggtgtgtaagatgatagaggatcccggccagattaagtttgatcccaagagtccagcccagatccggataattcgaggtccgtttgatgatgatttgtcaggccttccagcggtgcccacagattataaatagaaagtgaggttttagagcaa

SEQ ID NO: 568805 - DNA, 298 bp, Homo sapiens
agaggaggtgcggggttgggggtcccgctcaccggcaggtagtaggtcccgtccaggggccctgcctcagagacccagggtagctgggggctgccgagggcctgcgggcccggggacggtggcagagagaggctgggtataggcccataggcgggcgggtagaggccgagccccagggccagaggggtgtagacgcggtggggcggcccgggagacgagggcggcagcaacacctccacgtactgcccactctcagggtcgaagagcacccgcagccgaggctgccgcggcgcctcca

SEQ ID NO: 568806 - DNA, 489 bp, Homo sapiens
atcttgtaaagcccgggatcccaaagccctttcggcgccccgccaaagggtcccttgcagagtcctaaagaagaccccccttaaaactcttggatttctgtttaggcttaacccctttgcaaaggccctgggccgggaccccctttttttcccggcccggaattcccagctccgggttggttaggcagctttttccccaccggcccttccaacccatttcattttgaaggcggcggtttccggccaaaagccttttgttggttaaaaaggaaaaaaggcttctttttgttttttaaaaccaaaaaagccttttgttgggaaaaaggcccccgcttcccaaaaacccgcccctttaaaaaagccttccgagaagaaacctttttccaaggggaaaaagccttttgcttttatttttttttttttttttttccttaaggtccatttttttttggccgcttttttttttttaaagccttttttttccggcca

SEQ ID NO: 568807 - DNA, 213 bp, Homo sapiens
ccctttgttttttttttttccccttttttttcccaggtttgccccccttttcccccccccggggcggggaaaacccctttttttttttccccccccaggggggggacttcaagggccccgtttggttcccccccgttgaaagcccccccgggccccccccaactccgggccttttggggtttccctttgcccccgaacccccggggggtttta

SEQ ID NO: 568808 - DNA, 1346 bp, Homo sapiens
gcgacgctccaacgtttcgccatagggcgcctcccagcccgtactccccgactccagtttagaacctaattcccaattcccggaccgggcccagaccctgggctcttactgtccgcttttgctgggacctgtaccacaagatgggcgtcttctgccttgaggccgatgggggatcgggccggaaagctgcgagatcgccatgaggattttttttccgctgacagacatctatgagaccagacatctgcgagaggacccacattggcaagtgcccagtcacgcgatgacacaaagcaaagggagcaacagagactatgggagacaaaggagaggaggaaaggcccccataggtgaggacacgagcccccagacaccccggtatccacggtaacggagcgcccaggaccatcgaacagggattgacaccggaaagggccacgatctacggccgggcaaaccacccgggtgaggaaagagtagtccacgccaccagcaacacggcagggaacaacacaaacccgaagcacacaaggaggggggcacacaccccgcgcgagacaaccgtagggacagcaacaaacgaccacacacgcgaccaccaggagattatcgtgccagacagcacagtaattcccacgaagaagagagaaaacaaacacgatatagcccaggaaaacacccaacgcgctcagggaggaaaaccacacaaccacacacgccacagggaggagccgacctacacagagacaacaccgcgagtgaaagaattgggtgagcaccacgcccaccaacgcgggaaattagacgtagacacgagcgcccacccgatataaccgatacagcggcggagacagcaccaaacggcgccgacactggggacacaaaaggtacacccaacataatatggacaggagagagaccacaacagacgaagtggaccaaccacacaccaggaggaacacgacgaacaaaccacacgcacacgcaagagaatatagcgcaccccacagacacaagagacgactggatccgaaccaacacgaggaaacaaagacagaagagcagaagaagacaaacagcgaggccaaacaaaagcaaggggaggcacgaatattagaaatcgcccgcccggacggcgacaggcgagaggagagcaacaccgacaacacacgacacaacaaacgcaacacgccaacaacaccaggagcgagaagcagatcaaccagaccatctctgacgcgaatcgataccgaacacgattgacccacacaacacaaccgaggggagcacgccgacagtcagacaaaacgaaatatggcgaagagcacgaccggagcagaacacat

SEQ ID NO: 568809 - DNA, 863 bp, Homo sapiens
  misc_feature (10)..(10): n is a, c, g, or t
  misc_feature (90)..(90): n is a, c, g, or t
  misc_feature (289)..(289): n is a, c, g, or t
  misc_feature (302)..(302): n is a, c, g, or t
  misc_feature (310)..(311): n is a, c, g, or t
  misc_feature (318)..(318): n is a, c, g, or t
  misc_feature (332)..(332): n is a, c, g, or t
  misc_feature (338)..(338): n is a, c, g, or t
  misc_feature (346)..(346): n is a, c, g, or t
  misc_feature (351)..(351): n is a, c, g, or t
  misc_feature (364)..(364): n is a, c, g, or t
  misc_feature (366)..(366): n is a, c, g, or t
  misc_feature (375)..(375): n is a, c, g, or t
  misc_feature (382)..(382): n is a, c, g, or t
  misc_feature (385)..(385): n is a, c, g, or t
  misc_feature (408)..(408): n is a, c, g, or t
  misc_feature (413)..(413): n is a, c, g, or t
  misc_feature (418)..(419): n is a, c, g, or t
  misc_feature (427)..(427): n is a, c, g, or t
  misc_feature (431)..(431): n is a, c, g, or t
  misc_feature (434)..(434): n is a, c, g, or t
  misc_feature (436)..(436): n is a, c, g, or t
  misc_feature (442)..(442): n is a, c, g, or t
  misc_feature (446)..(446): n is a, c, g, or t
  misc_feature (450)..(450): n is a, c, g, or t
  misc_feature (462)..(462): n is a, c, g, or t
  misc_feature (488)..(488): n is a, c, g, or t
  misc_feature (494)..(494): n is a, c, g, or t
  misc_feature (497)..(497): n is a, c, g, or t
  misc_feature (513)..(513): n is a, c, g, or t
  misc_feature (526)..(527): n is a, c, g, or t
  misc_feature (570)..(570): n is a, c, g, or t
  misc_feature (594)..(594): n is a, c, g, or t
  misc_feature (605)..(605): n is a, c, g, or t
  misc_feature (630)..(630): n is a, c, g, or t
  misc_feature (636)..(636): n is a, c, g, or t
  misc_feature (658)..(658): n is a, c, g, or t
  misc_feature (662)..(662): n is a, c, g, or t
  misc_feature (690)..(690): n is a, c, g, or t
  misc_feature (695)..(695): n is a, c, g, or t
  misc_feature (757)..(757): n is a, c, g, or t
  misc_feature (781)..(781): n is a, c, g, or t
ccgagatctncacgggctagatgctcgtcggggcggagcgagtgagcggcgctaggccgcgagccccgccgcccttcctccagcgcctcngaccccgcagaagcgctcgcctccctagcccgcaaaaacatatcgatttttctcgctgtggcaacggggacgtcctgatagatcctctgctccaataggcaactccggccttccctgccctgacctggaacctctgggagggctgcagagtaagtgccgcctctgcgctcccaccaacccaccacccctctcaactagntccctctgttccnacaggtcnnacacttngcgctccatgcttncgggtnccgagagncctgncctcccccaggcncnccacctctnctggttnctntgtgctttcaccttaaacctctnccaancagannctcccgtncagnaananaacctntcancaancacctcaaattngccatgctggctggtggaagagtttntggtancanaagagtgctctccatnctctaatttccgnnctaaaactacccctgagtgtggtcccacaggatatgtagaaanaatcacatgcagctcatctaaganaaatgagttcnaaagctgccgctcagctttgatggnacaacncttattttggaagttcgaaggngctntcgtgtgtgtggccctgatcttcgcttntcttntcatcattcgtcagcgacaattggacagaaaggctctggaaaaggtccggaagcaaatcgantccatatagctacattccaccctngtatcctgggtcttagagaccctatctcagacagtgaaagtgaaatggactgatctgcactcttgtatctctgagcatttgg

SEQ ID NO: 568810 - DNA, 1216 bp, Homo sapiens
tgccaagatgcttgacccaagtccgagccatgatgtactcttggggagctgaagtctgagaagagaacgtcctcagcccatggtggcaggtgtgcgtccatagcctaccatatcgtatgagacagcggcttttcttgacaggagggatccagaccacacctccatcgagtacttttttgtgtgtcaagtggacatgtttaagaaaggacagaaaaatgcaagagaaagaaacaaacgataaaacagggggaggcgcgctcaaaaagattgttgcccactgtaggggccgctgaggctccgagcatacgcacggtacctatctcatgggttcccagaggaggggcccacgaagaagcgaagcgagcgacttataagtcacaccgccaagaggcggacggcacccgaggcggcaataacaaagcgacaaaagcgaccgcggagcatagacagcgaggacagcacgaagggggcacacctcaggggcgaaaagaggcacgaccaatagcctcaacgggagcgggagagtgggcaccatagcagatagtgcgagcgccaaacaggcacactcgctagaacaggaaccgatgacttatgaggacgggcactgcttcacgcgaggaacaagaaattatcaaaagaggaagtggtcgtcaccaaggggtgcgtactaaccgctggcgtgtcctccgaacaacatcaacgaacgggcgagcgcacaatgtaagccacatcgacagcggaccctgagaaagagagataagatgggggcaattaaaccggggggaagtgagtgtcgccacgcattcccacggcgacgacgactagctcatgacgacaacacacaccgacgagacaaacgccaaaagaggagacacaaaaaaaaccacccgggctcccaccaggggaatacacgccggagtgctgggaacgagaacccaagtacgtgtggacgacacgcaagatcgcaaaaggaggacccgccgtatggccatgcccgggaggcagccaatcgaacctgttaggcagagttccgcgagcggggccaaaataaccaacatacgagtgccttgaaacggaagctacagagtgggtcccgccaagtgattccagacacccgacacaaaaaggccggacaacaccggcgacgtgcggaggggaccaggcccagtgaacccagagaaccagagcaaggcgaacgacaccgctaccagcgacc

SEQ ID NO: 568811 - DNA, 488 bp, Homo sapiens
actagaaagaagctttttgagaaactcttttgtgatgtgtgcattcatgtcacagagttaagcctttcttttgaatgatcagtttggagtcactgtttctggaaaatctgcaaagtgatgttaagtagggcaaaaaggcctatggtgaacatggaaatatattcacataaaaactgtaaagaagcgttatgtgaaactgctttctaatatgtgcgttcttctcacagagttcaatcctttttttgatggaagtgttcagaatccaagtttttacagagtctgtgagagatattttggtgtgcattgaggaatatggtggaaaaagacatatcttcagaatagaaccagactgaagatttctgaggaactcttttttgatttgtgcattcatctcacagtgttaaacctttcttttgatagagcagtttgtaaaaactgtttttgtaaaatagccaaagagctatttggtagtaatagaagactatggt

SEQ ID NO: 568812 - DNA, 346 bp, Homo sapiens
tggggcccccccggggcaaaattccaaattttccccttgccgggggggggggtttgggaccccccccccccccaccttttttggggggggggccccctttcccccccccgggggttgtttttaataagggggtccctccccccccccctttttttttttttgggggcccccggggccgggccaaaaccccgggggggggggccccccttgggttcccctccctgggggaattttcccggggcccccgggggggggccctttcccccccggggggttttttttaggtttcctgggggggggttttttccgttgtgttggatcgggtttaggcgcccctttgggccca

SEQ ID NO: 568813 - DNA, 95 bp, Homo sapiens
ttttgggtttttttttgtttgtttgttcgtttttgagacggagtctcgcactttcatccaggctagactgcctagttctagatcgcgagcggccg

SEQ ID NO: 568814 - DNA, 277 bp, Homo sapiens
ctttgtggggtctttgctcagtatgtcaagggaacccaggaccagatgcataaagtgatagaacaatctaattgtatcacaaatgtataaaacaaccacagcgatggggtggatgaaattgttgtggacctaagtaattttggaaatagagtctataaaattaaaggcaaaagaaactgtatataagtactgcactctagttgaaaagttgtttcctgtgggatatgggttaacaattatgatactgctgtacaggtatgctgggactgaacaaata

SEQ ID NO: 568815 - DNA, 537 bp, Homo sapiens
gaaatagtaagctgaacttagtggtgagatttcagaacagacttctgtgaagtaagagatgtaaccatgcatctaaaatcggatggccgtgtaactgctcgggcatagaaatggtgggagaacctgtcctgggtacctggcatttcacatgagcccagggatatgtctttgccaaggcacacaagtgtccgtggacttggacaggtgccaagggtttttgtctctgttcctatgtgggaggctggctgtgatttacattaatttctgtatttcaaacgaagatgtctgcagatctccattttgatgttacagcctcattgcccaggcagtgggcagtggccagacaccctttctgactagccactgcattgggcttctgtgattcaaagtagtgtatatatttatttacttctctgactgtggccaacagccaaatgccattttatgttccttgtattcagtccattaccaaagaggtgtttgcactttgtaatgatacctttcagttcaaataaaaggaccacatcgttaagtgga

SEQ ID NO: 568816 - DNA, 118 bp, Homo sapiens
tatgcgaacctaccgctcttcatgacgtacactgtgcttcgggcgtcttatcacttgcttcctcacgttgaattttataagcttcgagagccatatttctcccacacccctcctaaca

SEQ ID NO: 568817 - DNA, 253 bp, Homo sapiens
cctcctcctcctggtggagcagttggataaaagtcagaggctgagtctgttccaacgatggctgcagcatgccacaatggacacatagcacaccagcagtgaagctgaacagaaggctggagtgtgccactgtgtgacaatggacgtggatctctgtcagtgccagtgtaatgcttcttgctcgtgccatgtgacactggaaatgggacacatgaatggtgccacatgatacatgaacagcagtgtcttgtgc

SEQ ID NO: 568818 - DNA, 400 bp, Homo sapiens
  misc_feature (5)..(5): n is a, c, g, or t
  misc_feature (47)..(47): n is a, c, g, or t
  misc_feature (60)..(60): n is a, c, g, or t
ccacngaaatttgtgagaaaagtccctaaggcagagctgagcttagncttcagatgcctncccaaatgccctaattagaaaagatgaaagagctcaaatcagtgacctcagctcccaccttaagaaactagaaatagagcaaattaaagtaagcgaaagaaaggactcccggcactttgggaggtcgaggtgggtggaccacctgaggtcaggagttcaagaccagcctggccaacatggtgaaacctcgtctctactagaaatacaaaatgagctgggcatggtggtgcatacctgtagtcccagctacttgggaaactgaggcaagcagtcacttgaacccaggaggcggaggtttcagtgagcaaagttcacgccactgcactccaacctgggcaat

SEQ ID NO: 568819 - DNA, 178 bp, Homo sapiens
  misc_feature (56)..(56): n is a, c, g, or t
agccagagcagaatggcgatgggattcccagccggacggggtgttctcatcaccanacagctgtagatttcatcaccgacagtggacagggggtctaagacagaacatggcttgagaagaggcgggacgtgggtcaatgtggtgtggagctccttccttgcgatgacttgcaacctgt

SEQ ID NO: 568820 - DNA, 910 bp, Homo sapiens
tgctaaacagagattttcttctcggcaacccattgttcccggcatctagttctgagctcgaaatttggagccaagccacttgcgttatcaagagttagtcaaaacacctttttctggttgtgaggagcagcgattgtgcttcccacagtgtggtgagctagggcccactccccgctttttttgccgtccctccctttcgttgggtcccagtcgaattcttgcctcgcccgcgttaaaaatcaccaagaggggtgccgaaagccctctccccgaggtgagtctcccccccgccgcctcgtgggggacgacctctcttctgaaaatattcggcgcaatccctccccctaactggagtgccgcgaaccccttggtgggcgccgcgcaagatcctcggggccaccgacgccggccatccactagaaaccgcggggtagcgcccccccacaggcgccacaattccagtggaggcccaaacaagttctgcggcccggtaaccgccccgctcttcagaaggacgctaaggttactggagcacacactactatgagagcgcgcccaccactaggggaggaaacacactctacaagaccctcgcctcggccaaaagacgccacagataggggaagatgtttttcaaaaactagagaacatttttatgactgtgggacggttgcggtcccaacccgataaactccggcccctttgtggaaagcgcgacacggggggaacctacgaagtgccagagaactggcacccccccggctaaacaccagcggaaaaaccccacgttctatggctataaggaagaaccgcaagaaaagatacacgtcgagtggaaacaagcgccacccgacactacccccccggggcaacaagccaaatccgtttccaaaccaaaaccgacaaaaca

SEQ ID NO: 568821 - DNA, 110 bp, Homo sapiens
agtcgagtagccatccactcaccgggtacatgacacgacgaccgaccgacacgatgtcacgtccagaacctacgatgccagttaaacgagcccagctagatcacggactg

SEQ ID NO: 568822 - DNA, 100 bp, Homo sapiens
tcgccatcttggatccgcgggacaagaaaattcaatgcgagggagacgtggtgggcggtccttcctgtgacaacgacccttgaagtgacaagttctattt

SEQ ID NO: 568823 - DNA, 551 bp, Homo sapiens
ccgatgtaataaatatatatctagcataaaccatctcagtctagaaatataagaatagtgtcaaactaacatatctactctatgctaaaggagactacacgtacatagtaggcatgagacagttatacgcatacttcgtcagtaggcactcacacacaccattccctctatatggccaaacaaattgtgcctacattgcatacgtagtcttatgcctgcatgacacagaggaggatggagtactaagcccattactaagtctcagatctcaaacaagaatagtgggtccatacgaacggaaggataacactaatacagccgtaagcgctaactccgacgaggctaaaagagaaagtagtccgctcccaaagcagatagaatattacaccgaacaccagctagaacataggacagttccacaaccgaacaccccgcacgtacacttatagagtccgagccaaaacgcagagcaacaagagacatcaagttagtaagacaactctgtcccacataagtactttttaaagacacaagatcacacagacacaagc

SEQ ID NO: 568824 - DNA, 903 bp, Homo sapiens
  misc_feature (903)..(903): n is a, c, g, or t
tctggagccctgagatacagaagctgattgcaatggcacaatgcagtgaagtgctgtgagtgctcaatgagcctgcactgatgtgcggagctgctgcagtcggatgagctgggcctcgcagctggctgccctgcgccagtgcctgatggatgcttgctgtggatgcagcttgtgatgctgtgtgatgaagtgatgtgctgctgtgtgccatgcatgtgatgctgctgaactgtgctctgtgcagctgtgttccatgcagcaccctggatgcatgtgatgcatgttggtgcgctgcatgcatgcaactggcagctgtgctgtacagtgatgtgtgtggcttgatgtgacgatgtggatgctggcttgtgtgccatggcatgtgcatgccatgtgcatgctgtgtgctgtgatgcttggacatgatgcttgatgtgcaatgcaggcttgtgatgtgatgatgcaagctcctagcacattgaaccctgatgcccctagaggtggctcgatggttttgagcgaatggggcatgtgggaggtgatgccagtgattgctgcctgtggcaaccaagaatttgggaggccttgaaattaacccttgaaatggcaggcaatgctagggatggcttgggatggatgttgcaatggtgctgggttgtgcggaggtggcccttgagccctgccaaccccaacttgaaacgtgatgtggacgtggctggtagtgccttagctttgaaaactcttgtgtgacacccaatgtgagccttgcatgtggcgaaaccgaaagagtaccgtggaaaaatgtggccctgggtggaccaaatgggaatggaattttgaagcgttgggttcaattttccacactgggctttggattggccccggaacaattgaggatgccttggn

SEQ ID NO: 568825 - DNA, 124 bp, Homo sapiens
gggttatcttgaggatcccagtcgccgatgatgtatcacatgcctcgtctacccatggaacctgagcctgacgtagaaggagtcagacgtgtgacatgaggaagagtctgagaagagaagacac

SEQ ID NO: 568826 - DNA, 342 bp, Homo sapiens
  misc_feature (2)..(2): n is a, c, g, or t
cngctcatcaggtaggtgacttcaataactagcggatatagggagatagtgttgagtcccggtatgtgagcaaaaaacccattctagaaagcatagccctggggccatctgtcctattaattctgttggggaatgcttagtaggaaaaacaaacaatagaactgaatatcatgggtctatgtgatctagctgcctctgagaaatagctggctctatttcctcaattacccttttggctgcaggagttaaatacctgggagagtctagggctgtatcgccctttaggatagaaaacaggtttggtaacttatcagtagttatgccctgatgggagcaagagcg

SEQ ID NO: 568827 - DNA, 156 bp, Homo sapiens
tgtctcgatctccttgacctcgtgatccgcccgcctcggcctcccaaggtacggggattatagggtgtgagccagggcgcccggcctctcataattttcttatttattctccatataccatctgaatactaatgtatttattggtttatttctgaa

SEQ ID NO: 568828 - DNA, 133 bp, Homo sapiens
tctgtaggaagctgtccataataaggcagggtgcagcaaaactaaaacatatgttcgtgtagctttcctagtctgacaacgcaatactgttgagacacagtccaatataatgacaacattggctggctagatc

SEQ ID NO: 568829 - DNA, 108 bp, Homo sapiens
ccgtgtacccttactggatgggtgtcttcggcttcctgagttctgggtccggagaggtgagtggcaactgggtggctgctggaccaggtggcagtgctctgacctggg

SEQ ID NO: 568830 - DNA, 156 bp, Homo sapiens
cgcacaggtgaggagcaggtagtcctagaacccgaatcgttcccagagacgtatgtgagaccaagcactgaaaacagtcgccatcgctctgacccggtcagtaacagtcagaaaattgggagtgacacgcagttctagcacttgggaggtcagctc

SEQ ID NO: 568831 - DNA, 362 bp, Homo sapiens
  misc_feature (265)..(266): n is a, c, g, or t
  misc_feature (343)..(343): n is a, c, g, or t
  misc_feature (347)..(347): n is a, c, g, or t
gtaatacgttaaaagcaggtgtacggtcaatcgggatatgcaccagcgtcgtgagagtatggcgaagttgcattgcagtctctgccatgatgctacacccttcatcttctcaattacatcccaaatgggtcatgcgggatggaaaacacattggggatgacgatgtctgggaccatccaccaaaccgaaaatttgggaaaacccgcattgggatgtaattgagagtatggccgtggaagtctgcagcttgcatggtcttcgtggnnccccaattgatgctacacccttttcatcttctcagaggagaacttcggccgttaaggaatacttggtgagactgttnctanaaaaaggggccctga

SEQ ID NO: 568832 - DNA, 326 bp, Homo sapiens
catcgtcattttattatacataatatatttgaggtggggtcttgctatgttgcccagactagagtgcaatggtgtgatcacagctcactggagagctcaagcaatcctccctcctcagcctcctgggtagctgggattataggcatgcatcaccatgcccggctaattttttttaaatttatttttagtagaaacagaggtctcgctgtgttgctcatgatggtttcaaactcctggcctcaggtgatcctcccaccttggcctcccaaagtgctgggattacagactgtgctcagctgctgttggtttgcttttgtttttgtttg

SEQ ID NO: 568833 - DNA, 151 bp, Homo sapiens
gtgactctagagatcccttttggtgtcatagtatcctatgggaaaggacttaaaattggcctagagttctcactttaaccagaatcaggttcattgagagtcaacgtattttctcttttataaaataaatatatggtatggaatatgacac

SEQ ID NO: 568834 - DNA, 178 bp, Homo sapiens
ctgggcccatttaagaaccagcctgaccaatgtggtgaaaccctgtctctactaaaagtacaaaaattagctgggcatagtggcacatgcctgtagtcccagctactcgggaggctgatgaacaaggcactctacgctggtagaagcagggtgagatgtaaagtgattgttccccgct

SEQ ID NO: 568835 - DNA, 388 bp, Homo sapiens
cataggattacttgagcccaggagttttagaccagcttgggcaacgtggtaaaaccccatgtttacaaaaattaactgggtgtggtagcgcccgactgtgatcccagctacttgggaggctgatgcaggaggatcgcttgagctcgggaagttgaggctgcaatgagcagtatttgtgcccctgccctccagctcgggtgacaaagcaagaccctgtctcaaacaaaaacaaaaacaattttgggcctgtgaatagatattaagctggagttttcattcctttttttttgagacaaagtttcattctcgttgcccaggctggaggttgcagtgagccgagatcgcccccctgccctccagcctgggggctgagcaagactctgtctca

SEQ ID NO: 568836 - DNA, 693 bp, Homo sapiens
  misc_feature (546)..(546): n is a, c, g, or t
cccccattaggaatcacaggtttgctacttcacatcctcatgtcttcacttcatggttaccttagtgaagccttcttcatccatcttatttaaaattgcaaaccacttcctcacaacctgtcccccttcctgtctactcctatccctctttttgtctgcttttttttcaaacatgtatcactatctaacatactaaattattttacttatcatatttaatcaaatctaaaacaaaaccaattttaagatgcataattagcttatataccactaaggcaagaaaagccgtgccaatttaactaggacatgaatgactaggcatttctacatttaaacatctttgaaattagaagacatgttggaatcagtgaagtgtgttattaaattactgtctgcctccccaactagaatgcaagcctataaaggcagatatttttatcagtttgtttgaggacattttgaacactgcctggcactcatggtaagtactcagtaagtgtggtttgaataaatgaatgaatgactgaataaaagtgccaaagtgcnaagaagggcaaataatattaagattatacctagaaatgcaagaataaaattacagaacatccaggataaagagaacataaaagtttccagacaagctgactactcacaaaggactgaccgtcagattgacagctgacttcccacgag

SEQ ID NO: 568837 - DNA, 204 bp, Homo sapiens
  misc_feature (15)..(15): n is a, c, g, or t
tcaggatcttactanccctaatcgcactaaccctaatccttaaagtataataataaaaaaaaaaaaaagaaaagattggcataaattgctaagggatgctcacgggagtatgagatcatttttggggggattggaggagagaggggtaggagtaaagataatcatgaagaagatggcattgagttgcagttgggtttggaacaa

SEQ ID NO: 568838 - DNA, 627 bp, Homo sapiens
  misc_feature (480)..(480): n is a, c, g, or t
cttataacgcatcgtcatcatcacattgatagtgtcaaccaattcatacaaactcgttccgatctagttaatcctatccctctttttgtctgcttttttttcaaacatgtatcactatctaacatactaaattattttacttatcatatttaatcaaatctaaaacaaaaccaattttaagatgcataattagcttatataccactaaggcaagaaaagccgtgccaatttaactaggacatgaatgactaggcatttctacatttaaacatctttgaaattagaagacatgttggaatcagtgaagtgtgttattaaattactgtctgcctccccaactagaatgcaagcctataaaggcagatatttttatcagtttgtttgaggacattttgaacactgcctggcactcatggtaagtactcagtaagtgtggtttgaataaatgaatgaatgactgaataaaagtgccaaagtgcnaagaagggcaaataatattaagattatacctagaaatgcaagaataaaattacagaacatccaggataaagagaacataaaagtttccagacaagctgactactcacaaaggactgaccgtcagattgacagctgacttcccacgag

SEQ ID NO: 568839 - DNA, 100 bp, Homo sapiens
cggcttagaagatgttgtcagatgaacatctgcatttggtctctcgctggggttgatggccatcacgttgccgtcaatgacggcatggcgcccctggtgg

SEQ ID NO: 568840 - DNA, 215 bp, Homo sapiens
gttcgacagtcagccgcatcttcttttgcgtcgccagccgagccacatcgctcagacacacattggggaaggttgaggttccgagatcacaccggttttggtcgatattggcgcgcctgtgcacaccaggctctctcttttactctctgtgtaagagtgagatatttgttccccatccatgacccccttacattagcactccatctaacatgggt

SEQ ID NO: 568841 - DNA, 232 bp, Homo sapiens
gtcggtaatattctggtatacaacatgaaataaataacccctccctaaccatagaaactatagatgatactggccaggcgcggtggctcatgcctgtaatcccagttactcgggaggctgaggcacccgaagggcagaggtggcagtaagctgagatcacgacatggcactccagccggggcaacaagcagcagcatcagcctcccacacacaaacagcaaaacaagcaatc

SEQ ID NO: 568842 - DNA, 121 bp, Homo sapiens
tcaatcgacggttctcaccttacatgttttagaaaaaggtctcatccttgcacgcacgctttgttctatgcagagtacagtactggcttcaagcaaatatataaaggttctgtgcactggc

SEQ ID NO: 568843 - DNA, 227 bp, Homo sapiens
gtgtgctttagctagtaccccattcacaagtctctgaaagcggtgcctcgttcttctgggaagggaaattgcggctttaaggagaacggcaggttctcccatgggcaggtggtctctcgggataagctgcgcccctttccaggacccagacctgagctccctggcaggccgggttctgcggtgtctggccaagcaccaggatggcctcgggcacgcagcaggcattc

SEQ ID NO: 568844 - DNA, 304 bp, Homo sapiens
ttgctgtggtgtctagaggtcccatctcaggcagagacgactggcgattcctttgacgttgacaatcgagtagtactcccgattgaatgacctcattcgtataatatttcacatcacaagacgtcttgcaatcatgagctgtccccacatgaggcttaaacacagatgcaattcccggtacgtctaaaccaaaccacttacaacgttatgcgatcggggagtatgactacggtctaaatgctctgaaatctgtggagcaaaccgacagtttcatagccacaatcgtctccttggccgtgacgat

SEQ ID NO: 568845 - DNA, 734 bp, Homo sapiens
cctgctttttgagagaccctttggcacctgaaaccccagggtttgtctccatgtggatttcctggccgagtggagtggaagggtcccaatcccagaagacacctgagccgtctttaagaaagctctcttagactgtcataggtgccgactcccgtgaccctggaggataagtacctggattgggcttatcgaagtggtggctaccaaaaggcccgagctgtgtttaaaagtttaccaggagacccgacccattttccagtgactttttcccggaaaatgattccagtttgaaaaggagccagaatccctgccatatggcgacataagagaatattatgagagagctttgagagaatttggatcccccagattctgatctttggatggattatatgaaagaagagattgagaccaccccccctggtagacctgagaacctgtggacagatctactggcgagcgatgaaaatgttgccacgggagagtcagcacgaggcactttgtagctaaaacactgctatgcatcacgactggccctttatgaagatgaagaataacccgtcacgctttgtgaaatagtattgccagccagccccgctgggccaatttgtattgagtccatctgtaatttgctccgtgatggcagaccagatggctgtctggttttgagacaccctttaattttatgttaacttgttaaatctttttaaaaatttaaaaatttttatgattga

SEQ ID NO: 568846 - DNA, 406 bp, Homo sapiens
tagggctgtgtggtctggatttccattagaaagcctctttaaaaatacagtgttgtaaaatgttgccaggttacagacttacagggtgtttcatggtgacaccaagagttcaaatgctgcaacccatgacaagtcagcatcattagggcatcctcgtgtgcccagagacatctcatcaaaattgcaccacgtcaaaggagcttcctcaccatcaccggtggcaggtggcattccttattcagtatgcaaatgcattatttgcaaacagctactgcatggaaccacagaccaagacgtaggattccagaacaaatggacgacagagcattaacaagattgggagtgcctgtgcacttccactggaggcctggccagagaagtaataacatcgtcaaactaataaata

SEQ ID NO: 568847 - DNA, 904 bp, Homo sapiens
  misc_feature (9)..(9): n is a, c, g, or t
  misc_feature (65)..(65): n is a, c, g, or t
  misc_feature (82)..(82): n is a, c, g, or t
  misc_feature (86)..(86): n is a, c, g, or t
  misc_feature (102)..(102): n is a, c, g, or t
  misc_feature (118)..(119): n is a, c, g, or t
  misc_feature (126)..(126): n is a, c, g, or t
  misc_feature (142)..(142): n is a, c, g, or t
  misc_feature (145)..(145): n is a, c, g, or t
  misc_feature (157)..(157): n is a, c, g, or t
  misc_feature (171)..(171): n is a, c, g, or t
  misc_feature (175)..(175): n is a, c, g, or t
  misc_feature (189)..(189): n is a, c, g, or t
  misc_feature (192)..(192): n is a, c, g, or t
  misc_feature (198)..(198): n is a, c, g, or t
  misc_feature (200)..(200): n is a, c, g, or t
  misc_feature (205)..(205): n is a, c, g, or t
  misc_feature (212)..(212): n is a, c, g, or t
  misc_feature (218)..(218): n is a, c, g, or t
  misc_feature (224)..(224): n is a, c, g, or t
  misc_feature (228)..(228): n is a, c, g, or t
  misc_feature (251)..(251): n is a, c, g, or t
  misc_feature (262)..(262): n is a, c, g, or t
  misc_feature (286)..(286): n is a, c, g, or t
  misc_feature (505)..(505): n is a, c, g, or t
  misc_feature (542)..(542): n is a, c, g, or t
  misc_feature (549)..(549): n is a, c, g, or t
  misc_feature (556)..(556): n is a, c, g, or t
  misc_feature (558)..(558): n is a, c, g, or t
  misc_feature (560)..(560): n is a, c, g, or t
  misc_feature (580)..(580): n is a, c, g, or t
  misc_feature (588)..(588): n is a, c, g, or t
  misc_feature (596)..(596): n is a, c, g, or t
  misc_feature (598)..(598): n is a, c, g, or t
  misc_feature (603)..(603): n is a, c, g, or t
  misc_feature (607)..(607): n is a, c, g, or t
  misc_feature (615)..(615): n is a, c, g, or t
  misc_feature (638)..(638): n is a, c, g, or t
  misc_feature (640)..(641): n is a, c, g, or t
  misc_feature (659)..(659): n is a, c, g, or t
  misc_feature (662)..(662): n is a, c, g, or t
  misc_feature (664)..(664): n is a, c, g, or t
  misc_feature (674)..(674): n is a, c, g, or t
  misc_feature (693)..(693): n is a, c, g, or t
  misc_feature (697)..(697): n is a, c, g, or t
  misc_feature (700)..(700): n is a, c, g, or t
  misc_feature (702)..(703): n is a, c, g, or t
  misc_feature (746)..(746): n is a, c, g, or t
  misc_feature (770)..(770): n is a, c, g, or t
  misc_feature (772)..(773): n is a, c, g, or t
  misc_feature (791)..(791): n is a, c, g, or t
  misc_feature (864)..(864): n is a, c, g, or t
cgtgggtcnggggggtggggcgttccaagggtcggcgcattttccagtggggggttgtgggggcnttatccttttgattatntggnccagtggcgttgggtntttttcttctttgtcnngggtttngtgggggggtcggccngtnctttttctcggngtctctgtgggggnggcnattgagggggcgcnggngggggncnggggnggggggngggggntggggngggnggggggggggggggtgccgggcngggggcggggnggcgggcggggcgggcgtggggcncgcgaggggtgggggggaggggggggggggggggcgtggggccggggggcgggggcggcccagggaggggccgggggggcgcggccggggggggagggtccgcgaagcgagggcaaggcggggggggcgccggggcggggggggggggggggggggggggggcggggggggggcggggccggggggggcgggcgggggggcggggggacggcgggggcngcgcgggtcgggccgcgggtggcgcggggatagggtnatgtttnatttatngngnaaatgggaagaatgagtatnatgttttnaatgggtngnttttnaatnggaatganagggaggatatgaaaatttaganannaaatgtaggtgtagttcngantnttaggttcanaggtgaaggataacaaatnattnttntnnatggggtttaagttgttgatggtgatgtaaggaatgggaagantagggaggagattatgggtgtatngnnaaatgaggatggaaatanatgggttaagtatttaaaattaatagggtaatgaaattttatttgtggaaaaatatagatagggggaatgttngttttggaatgatgaaaatggtgagtattggggaggtatg

SEQ ID NO: 568848 - DNA, 883 bp, Homo sapiens
  misc_feature (540)..(540): n is a, c, g, or t
gattccaagctggctctgagtccgtctccagctctctcctgcaccatgcgtggtttcctctcccagttccactttagttttttcccactctttcatctacaattttcaattttttaaaatttatttatcgatttttttttttttggagaaaagttcacactattcacccaggcgggtcttgaactcgtagcctcaagcaatcttctagcctcagcttcccaaagttctggggattacaagcatgagccaccgcacggggcttcccattttcatatagacactgtgcttacacacttaattaagattggtcttctcagaccagatgtgggggctcatgcctataatcccagcacttggggaggccgaggcgggcggatcatctgaggtcaggagttcgagaccagttgggccactgtggtgaaaccccgtctctactaaaaatacaaaatattagccaagcgtggtgggcatgcacctgtaatcccagctactcaggaggctgagtcaggagaatcatttgaatgcgggagtcagaggttngcagtgatctgagttcgccccacgcactccagcctggatgacaacgttgagactctgtctcaaagagaatacaagtacctaagcagcaagccagacaaaacaacatgtgttggcgcccgccacgcgcgccactgaagagaagtttgtgtaaaacctcttggttgaggcgcacgcgggcccatcatgcgactctgcaacatgcgcggcagaccgtgggaccaaaagaaacacccgggcggcacaacaatggcgcgagatcccccgcaatagaaaaacgccggggagaacgagcgcgttcgtacgacaacccacaagagggctgcagagcgcacacggaagccat

SEQ ID NO: 568849 - DNA, 925 bp, Homo sapiens
gatggtataatacgcctcacactcattctcaacccccgtgacgaagcacatagcctaccccttccttgtactatcccttatgaggcataattataacaagctccatctgcctacgaggaaagagacgctagaaatcgctcattgcatacctcttcaagtcagaccacatagcccgtcgtagtggcagccattctcatccaataccccctgaagcttcaccggcgcagtactattctcgataatcgcccagggacttacatcctcagttactattctgcctagctatgtcaaagctacgaacgcgttcacgagtccgcattcaataatcctctctcaagggacttcaaagctctgtatccctactaataggcttttctgattgactatgctagcgaaagcctcgcataacctcgtccttagcccaccactattaacctactgggagaagtctctgagctagtaaccgcgttactcctgatcaagtatcactctccatacttacaggactcaaacatactagtcaacagaacctatacgtccctctacatgatttatccagaaaaacaaatggggctcacttcacaccaccaacattaacaaccataaaaaccctcattcaacaacgagaaaaacaccctcatgttcatacacctatcccccatatctcctacatatcactcaaccacgacatcattaccgagtaacctcttaacaaacacaaaaaacaaaaaaaaaaaaaagcaacaaaacaaaaagaaaaaaaacaaaaaagagtggggcggcagaggacgagaagaacgggataaacacaaaaagtagcccggcgccaagaaaagaagaaacacagaagaagaggaccaggagaaagggaaaccaaaagtggagagaacaacaaaaaaagggcgagaaacaggtagagacaacg

SEQ ID NO: 568850 - DNA, 186 bp, Homo sapiens
cacaccacctgagtcagagacgccatcaccggcgctggcgaaaacctggggatggggccacagacgctgactctaatgagtctcccaggtcctaaaacacatgtgacgacgacgagggccctgaccggatgcagtgcatgccatcttgaggactcatacctaagtggggcaggctggcgctgacaa

SEQ ID NO: 568851 - DNA, 430 bp, Homo sapiens
atataggtgcaaccagtctatttcttaattgagaggattcttcagaggcatgtagcttgcttgatctatcctttggatgtttgccacatgaaggacagaagatcttctgagcctgtattgcaaaatgagtgcgcacggtatactaatcataaatatgatcatcagctataaacgacatgggtcttggatcttgttgtagagagatactgcaaaggtcaccatctatgattatcgagaaatgagaagtacatgcgaatgcttttaaacatattcatgacaacgtgacaatcacgttataggatctagagatattcctgacgtcaatatgtggatcttaagccacaggtagtggtgtcataattagttaagcacccagagtatttgattcctgctttgtccatatatgtatggtatactgtactgggggtgg

SEQ ID NO: 568852 - DNA, 291 bp, Homo sapiens
agtgcgaacagattcatgtattggagaggttacacgtcaggtccctcatcctgatcttctacattaacagtaactgttgctgtgctcatagctgatttcgggagataaactctctggaaaatggatctccattaactacaccaatttgcaagatcatctgttgcatttcttcataattcaaaggcttaactacacaaagaactccttcattggttttggcatctgttacaattttaaaattgccattttcattgccctttaaaatggtataattagctctccagttagcag

SEQ ID NO: 568853 - DNA, 130 bp, Homo sapiens
gacgtgtgtgcctcagctctgagctcagtgatctgcccgccttgattccaaagtgctgggattacagacatgagactctgccagttttctattttcatagtgaaaaaaattctaatgtcaaaccacgaca

SEQ ID NO: 568854 - DNA, 291 bp, Homo sapiens
  misc_feature (39)..(39): n is a, c, g, or t
  misc_feature (147)..(147): n is a, c, g, or t
gattccacagtgagtagttataaagaatagttactacanataaacgctggctaaatagaagtgcattttgtgaagcactatgggtggtatatgttttgccacatactcttgttaccttgaggaagataacgcatgcgtacaaattcnggcattcatatttcaagttgctagctgagtatcaaatgtgttttaagaaatgtgtacagctatgaaacaacttgaaacatattcattgaatgaaacaatgttcttaggaaaaaaatcagctattttccatgcacattatgtaca

SEQ ID NO: 568855 - DNA, 787 bp, Homo sapiens
  misc_feature (769)..(769): n is a, c, g, or t
aagctcctagtatcagaagaagctgatacatagtgtcatgtgctcacgtggatgcccaagtctaccaactttggggagctgcagggtctttttgggaggtcgggaggaagggcagatgacttttgcttattttggggttttcaagcattggaaccaaaggccaaataataaacagcctttagctttttaaagtaaaagttcatctttactttgtcagagtacatcttgtattggtagacctgatgtaaagaacaagtgtcttaatgactacatttactgcacatttataatggttacatctgctttttgtctttagaaattaaaaagagaaaatctcgagaaaagcccacctttgaatacgtggctgaagataacagccaagaattggtctttcctaaaaatgcaacagataatgctgctagattgttattcttcgtgttgcacttttttgttcgattggcatttttaaaatcggtatttaaacctgaagacattgtcatcgttttacttaatttaacaaagtgtgacacacgtaacctgctctcgtacatcatgaccttaacaatgttaatgctgtaagtgataagttcactgtcgtctgtatactaaatttacttggtgtttctaacttaaaagtaagactgcagattatcccccaccagccttagtccaggggtgtggctctgtccgggtgcagtatgcagtcatgtggaaccttgctttctagtcctgggaaaaaaaaaccgagtgataactaaccatccttctnggctttcaatcacactta

SEQ ID NO: 568856 - DNA, 1693 bp, Homo sapiens
  misc_feature (73)..(73): n is a, c, g, or t
  misc_feature (449)..(449): n is a, c, g, or t
  misc_feature (490)..(490): n is a, c, g, or t
  misc_feature (684)..(684): n is a, c, g, or t
ttcatctttgtttcttttcctcgcgtcatatctcctgtttttctttcttctgctgctgctttctcgtctcgtnttctatctcttccttgtcttcttttcgtctgttctgcttgctttcttagtgtgtgtttctgtgctacttcttgtcttctcgtcttgttgtctgttttctgcttacttgttgttccgtctctgtatactttctgttcattctcgctttcttctcgtgtactgtgttctcttatcgttctgtttcctgttgtctctttgtttttcctgctctcgtttgctgacgcttaagacgactaccatcactgacatgacgctgtatcatagtacgctgtccgtcgagtgtatgaggaggagggagaggaggggggaaggaggagccgcgcgcagtgcatttctctcccctgctgttagtctgtgtatgaggttgagtcgtcgtnctgttatcgatcagcatagcggctgcttgcggccctacttntgtatttggcattgtgctggggtctgtctccgtctgcttgttgtgtggtgggacctggacttgcctcgtcggttggtaggtggctcgtagttagcgcatcgagttgtagtattgatcggggtcttgtgtgttgccgtctcgtctccccgcccacactatgtttgtgtagtgtcttccttgctgcctggccttanttgtttgttgttggtgctccctcctgctctcgggggggttgtctatctattgtgggggcgccctcgctgggatatatagatgcgggggtgctcttctgtgatcgagcggctcctctcttcccctagatggtggcgcgaccctcttttggaggggctgtcttttgtgcagacgaatgttggaagagcccctgggttgagcacgaaggaagtggtgggtgttgctccttttggaggtgtcgtggggtatgagtgggttccctccgccccgtcgtaaaatatccctccttttgtgttgggggacataggcgcacgcccgctgtgggtcccgcctccatggggggcgcatctatgtgggcagcggccaccacccaatgggtgtgcgctgtttgcgcagcaccaggccatgttgttgccatgtcgggaagagcgtggttgttgcgcgccacgtgtgttcaggggacaaaacccagcgaggccatgtgtaagtcctgcgcaacagggtacagattgcccctcactggtgatagggtgtgttatgtcctcgcgctccacgaggacgcgcccatcaattagaagtttatagggagtgtgtgtagcgaggtgctccgcccccgctactgttgtttggttgtaccacatgggggtgcgcccactcacaatggtaccactctccgctcgctctcctctcgcactcctttcccatgcggcctttccactctgtattcctgcaccatagcactctgtgccgccactcctttggtgtgcttcgattgtgtgagtctctctctgtcaccgtgccctcactctccctggtgtgaaatcgcgggagatcgcgccttcttcccacactcagcgcgattgcgcacttcttgcagagtcggacttatcgtggtgcttcgaggaccgccacttttcgcatagcgtgcttatgtagcccccgaggagtagaattggttattcatgacgaaaaaagtgtcgggcttctgtttcatcaatagaacagaaaaat

SEQ ID NO: 568857 - DNA, 167 bp, Homo sapiens
agtcagcgtcgagaaatcggcgaagtcgtcctcgccgaaattgcggcgaactcaccaccgcagttctatataggccaaataactcgctttctcaggctgtaggcctgcgaggccgacgacagcaacgcggcagctgctgcaaatagtgctcttcaaagaatgctttg

SEQ ID NO: 568858 - DNA, 341 bp, Homo sapiens
gatgtagagaaacgccccagtcacaaggttataaactgccccaaacatgagttgacttttaaccgccatggtgtgggtcacgtataacttctgcatccaccatgattcttccatggactgctttgccaaatcaaagctttgcagcaggcaatccatacagttgtgactagatgcagggaatgacacctaacagtggaatgggcactggcaggcagagggcacgaagcagtcctttaagaaacagtagctgtggcacagaggccagtgctacagtacagatggcgtccaagaaccgcacacatgcagctcgatgtcacagtatggggaacatctgacatcac

SEQ ID NO: 568859 - DNA, 1353 bp, Homo sapiens
  misc_feature (87)..(87): n is a, c, g, or t
  misc_feature (305)..(305): n is a, c, g, or t
  misc_feature (1353)..(1353): n is a, c, g, or t
cgtgggcctacggcgcggccaaggtgggtggttccttcgagctgcggcgcttcctgacgcagccgtaggtggtggcgcgcgccgctntgcgttggtactacgcccttgatcgatggttctccatggcactctataaggtgaggtgctagcagcgaaatgacccacgcagatctagagcaggatgtacgtagcgttgttcaacgcgcgaagcgagcgatgtcgctgccagctaatggcgagtagccaatcggaggttgctggccattccgtggcctcggactttacttcgtatggtgagtcggacngcggtcatttcacccgcagatcaagccaacgggccactgaccggccatagtaacttggtacatatgggtgaccctgacttctatctcagctcatctggaaccttatccgtactagggtgttgttggggttatctagcgtatctctacagcgaatcctagttgtgagcagttctaccgaaactcctcgagaggaacggtgctgagtgtgggggccagactgtctgctgtaccgggcgacgccgatcacgcttacaggcgtatctgtatatccagtgcattctccatgggcgtgtgcttggcgctccctggacctactcagctgctacagaggctggctgtggcacgacattacagtaccaggacattacgtttgatcccaggtccgtgatccgcgaaacacgtgcggtaacgctcgtccttaccccaggtgcactctgtggagcaaaatagatcaagcagccagcccttgcatcccagaagcgcggataaccatcgagggggctaacccagcctgcccccctgtggtacttggaggctggaaggtcagcggtgggaccggggggacacacgagaagggccctccccttttgccctgggacgtttgccctttgagcccttctggtgacttggctggccctctatttttgaccttgtttcactcctgttgcggttggcgccgaggcataagaggccgccagtagacatgcgcggggggctggacaagaggcagcacccccaagaggccacgtgtcgccagtaggaggtaaaaaacacggggacataccccaaagggcacccattgagcaggacgagtcagcgaaaggtatgacccagcatctatgagcactcaatcaccgcagtagtgaacaacacgaggggcccgcgacaatcagagctagatttccaccggaggaggaggagacgcagattttgacgctacgagggatcatcgtcctacgtgagcgtatcgatgcaacggccgtagaatgtagtcgatagcatgatgattacgtctcctgctacttatttgcgtttatcgatctcatan

SEQ ID NO: 568860 - DNA, 657 bp, Homo sapiens
  misc_feature (22)..(22): n is a, c, g, or t
  misc_feature (350)..(352): n is a, c, g, or t
  misc_feature (492)..(492): n is a, c, g, or t
gagtgggtagccttatttcctntttttttttttacttcgtttatttcagggggtggggtttcggccgaatgcccccaaagggagggtggcatacggttaaaaattggggaaaaaaaattttaaaccccggggggggagccttttccaaatttttgggggggcttttggaattttaaaattgggggggggcccttttttttaaaaaaaattggtggttgggggggggggcaaaattttgtccggaaccccttttctctccctttttttggtgaaaaaaaaattatcacgcggcgggccgtctctttttttataaaaacataggaaagaggaggggggtgtgggggggggcnnnaaaaaacccccggggggggggggggtgtgttgttttttttctcaaaaaaaaaaaaaaaaacacccccccctctcttcttttataaaaaaagaaaaaaagaggggggcccgcgttcctttttcttttttttaaaagaaaanctttccgccgccccttttttttttttttttttgaaaggggtttttttttttttttaaaaccgcccgcccaaaaataaaccccttcgctcccccgcccggaaaaatatttttatggggggagggagggggtggtgtgttcaccacaaggggggcgggcggacctct

SEQ ID NO: 568861 - DNA, 135 bp, Homo sapiens
acgctctctctgtggggtaagggtgataggtatacctgacgactggtaaggggtgcacgatcggtcgccaaggagggagtagaggtatctatatacttgtgggctaccggtggggggctacaacgaggacggacg

SEQ ID NO: 568862 - DNA, 1079 bp, Homo sapiens
  misc_feature (19)..(19): n is a, c, g, or t
  misc_feature (39)..(48): n is a, c, g, or t
  misc_feature (51)..(51): n is a, c, g, or t
  misc_feature (55)..(55): n is a, c, g, or t
  misc_feature (59)..(59): n is a, c, g, or t
  misc_feature (74)..(75): n is a, c, g, or t
  misc_feature (82)..(82): n is a, c, g, or t
  misc_feature (103)..(103): n is a, c, g, or t
  misc_feature (106)..(106): n is a, c, g, or t
  misc_feature (109)..(109): n is a, c, g, or t
  misc_feature (139)..(139): n is a, c, g, or t
  misc_feature (160)..(160): n is a, c, g, or t
  misc_feature (187)..(189): n is a, c, g, or t
  misc_feature (191)..(194): n is a, c, g, or t
  misc_feature (196)..(196): n is a, c, g, or t
  misc_feature (209)..(209): n is a, c, g, or t
  misc_feature (215)..(215): n is a, c, g, or t
  misc_feature (225)..(225): n is a, c, g, or t
  misc_feature (238)..(239): n is a, c, g, or t
  misc_feature (250)..(250): n is a, c, g, or t
  misc_feature (257)..(257): n is a, c, g, or t
  misc_feature (260)..(260): n is a, c, g, or t
  misc_feature (273)..(273): n is a, c, g, or t
  misc_feature (293)..(293): n is a, c, g, or t
  misc_feature (300)..(300): n is a, c, g, or t
  misc_feature (317)..(317): n is a, c, g, or t
  misc_feature (320)..(321): n is a, c, g, or t
  misc_feature (350)..(350): n is a, c, g, or t
  misc_feature (357)..(357): n is a, c, g, or t
  misc_feature (372)..(372): n is a, c, g, or t
  misc_feature (377)..(377): n is a, c, g, or t
  misc_feature (408)..(408): n is a, c, g, or t
  misc_feature (410)..(410): n is a, c, g, or t
  misc_feature (427)..(427): n is a, c, g, or t
  misc_feature (434)..(434): n is a, c, g, or t
  misc_feature (438)..(438): n is a, c, g, or t
  misc_feature (444)..(444): n is a, c, g, or t
  misc_feature (447)..(447): n is a, c, g, or t
  misc_feature (465)..(465): n is a, c, g, or t
  misc_feature (474)..(474): n is a, c, g, or t
  misc_feature (477)..(477): n is a, c, g, or t
  misc_feature (483)..(483): n is a, c, g, or t
  misc_feature (488)..(488): n is a, c, g, or t
  misc_feature (491)..(492): n is a, c, g, or t
  misc_feature (495)..(495): n is a, c, g, or t
  misc_feature (500)..(500): n is a, c, g, or t
  misc_feature (510)..(510): n is a, c, g, or t
  misc_feature (520)..(520): n is a, c, g, or t
  misc_feature (527)..(527): n is a, c, g, or t
  misc_feature (551)..(551): n is a, c, g, or t
  misc_feature (559)..(559): n is a, c, g, or t
  misc_feature (596)..(597): n is a, c, g, or t
  misc_feature (603)..(603): n is a, c, g, or t
  misc_feature (607)..(607): n is a, c, g, or t
  misc_feature (611)..(611): n is a, c, g, or t
  misc_feature (642)..(642): n is a, c, g, or t
  misc_feature (658)..(658): n is a, c, g, or t
  misc_feature (799)..(799): n is a, c, g, or t
  misc_feature (841)..(841): n is a, c, g, or t
  misc_feature (1055)..(1055): n is a, c, g, or t
cgccgaggctgccgccggnagtcgccaccgccgcgcccnnnnnnnnnngcncgcncgcngcacccggccccgcnngcccccnccgccgccgccgcccgccccngcnacnacgcagcggccacccgcccacaccagctcnatttggcggccctcgctcgcntcgcgccggcagtattgggcctacacnnncnnnncncccgcaagcagcnaaaaanttgaccacgnaacgagcccaacnnccccgaacgcngcccgcngcncgcaatggatgcnggtgtgactaaaagtggacnaaatgtnactataaccattcggcntcnnatgcacggaaaggaagtaggaagcatcantgggaanaaaggggagtaggtnaaaangatccgcgaggagagtagcgcgcggataaanancacggaggggaatagtncggaganaatnatcacnctnaccggccccaccaatgcnatcattaangcnttcgcnataancannganaagcnggaggaaganatcaacagcnccatgancaacagtaccgcggccagcaggcncacaaaanaccctgaggctggtggtgccggccacccagtgcggcnncctgantggnaaangcgggtgtaagaacaaagagatccgcgagantacgggggcgcaggtncaggtggcgggggatatgctgcccaactccaccgagcgggccatcaccatcgctggcgtgccgcagtctgtcaccgagtgtgtcaagcagatttgcctggtcatgctggagacgctctcccagtctccgcaagggagagtnatgaccattccgtaccagcccatgccggccagctccccagtnatctgcgcgggcggccaagatcggtgcagcgacgctgggggctacccccatgccacccatgacctggagggaccacctctagatgcctactcgattcaaggacaacacaccatttctccgctcgatctggccaagctgaaccaggtggcaagacaacagtttcactttgccatgatgcacggcgggaccggattcgccggaattgacttcagcnctccagaggtgaaaggctatttgg

SEQ ID NO: 568863 - DNA, 456 bp, Homo sapiens
cacgaggtataatggcgttgctgccgataaccaaggcagcctacggcagggcatgccggaagtaacgcctgtggagatacgagcagcggttgcgcactcggcccaggaacccaccgaagcgactcattccggctcgatgtcggggtgagcgccgtaggaatcccccgactttaggcgggggaggatgtcaacgcgttggtgacgtacagccgctcgcgcggccagccgagcgcctccagggcgcgcgcgagcaactgcccggccgggccgacgaaggggcggccttgccggtcctcctggtcgcccggttgctcgcccaccagcatcagcggcgcgtgcaggtcgccctcgccccagaccgtctgcgtcgcatggaagcccagcgggcactcccggcagccggcagcctgtgcgcgcagcgcctgccagcgggcctcggggtccgtcagggtgtcg

SEQ ID NO: 568864 - DNA, 118 bp, Homo sapiens
tgaggttgagagtgactctagacgatccctgagcggacattttacatttgcatcaggcactgacggaggtatttccacatagaaacagatgctctaactaaacgaaggacttgtgacc

SEQ ID NO: 568865 - DNA, 161 bp, Homo sapiens
caggaaaccgctatgactgaatcgactgaatggatggccagtcgtactagcctggcctgggtaatggactggcagcttcatcactaaaatgactcctttcactggaatccacatgttatgcagcccacactgaccacagagcaactgaataggtcagcatt

SEQ ID NO: 568866 - DNA, 501 bp, Homo sapiens
cgaatagacgcgtccctgcatgagtctgaggcttggtcattaaaagtgatatggccgggcgcggtggctcacaccagtgatcccagtactttgtgaggccgaggtgggcagatcgcttgaggttaggagttcgagatcagcctggccaacagagtgaaactttgtctctaataaaaatacaaaaattggccggatgtggtggcacacgcctgtaatcccggctacctcggaggctgaggcacgagaatcgcttgggctgggaggcggaggttgcagtgagccgagattgcaccactgctctccagcctgggcgacagagtgagtgagactctgtctcaaataaaaacagggtgatatggcctctccttggatctctcttggaacacactcaggggaccccctcatgaactgcaggaaagacttctggtttccctgaagccaccatgctgaattgaccacacacgcaggagagcgacgcccgaggagaccgcttcaaaatcg

SEQ ID NO: 568867 - DNA, 213 bp, Homo sapiens
  misc_feature (42)..(42): n is a, c, g, or t
gcccccgaaagacaaagactaaagaagaggaaacaaacggangcctgccaggactgcatataaacctttcttatttgagctaggctgaacagacgtgacctagaagaaactgaacaaaagagaagggggtgggggctagttttcaagtgggaacctgatagtgaaaagcacagatggagaaaatgcttcagaaaaactgttggatgctttcct

SEQ ID NO: 568868 - DNA, 471 bp, Homo sapiens
  misc_feature (17)..(17): n is a, c, g, or t
  misc_feature (60)..(61): n is a, c, g, or t
  misc_feature (190)..(190): n is a, c, g, or t
  misc_feature (350)..(350): n is a, c, g, or t
ccgagacgtattacttntcaggaaggtattcaagattgcccttgtgcttgcctgttttgnnatcgcgtcgggcctggtgctcggaaaatggctgatcgcgcttgtgttcggagtcgattatgaacaaagctacattgtctttgtgatgttcatgctcgccctgcggtggcgataccgtctatcctactgngatacccattcttgggcgccatgggaaacgcgtctgcagccaatcgaagcgtgcttttcgccggctccgtgcagctcgtaacactcggagtgctctggatctatggatggacatcggcgcttgctgtagtggtcgccgtcctcatcgccgagataaggcnctcgcgtggcgcgtccggtatgcactcccctacttcaaactcaccacataacagcggatctagcatgaaagaggtaaagaacgtcgcggttatcctcgcaggcggcaaagggacccgtagc

SEQ ID NO: 568869 - DNA, 155 bp, Homo sapiens
tgtaaatctcagcactttgggaggcaaggcgggcatcaccgaggtcggagtcgagaccagactgatggagcagaatggaaagcccagaaataatgccacacacgctacgaccatctgattttttttttattcctggagagggagcgagactctgg

SEQ ID NO: 568870 - DNA, 319 bp, Homo sapiens
gcggccgcctactactactactaaattcgcggccgcgtcgactggggattctgagtgtggactaccaaatatgacatatacactgctagggatggaacccaggagcccgtgtgccatgctagaggagacctcttccttggtggccacaccccagccctggacgcagtgctttccagataatcaactccttgttgatcttggactcaatcactgccagtacccaacacctgctggaactcttggtcttcaaggtactggctgatcgcgcacagtccagtgacttcctgttatactatacctccttcagtccatgccgtcg

SEQ ID NO: 568871 - DNA, 436 bp, Homo sapiens
taccaccccatgtctacagctatcaaacgcctgggaccattcaataattatggctagtagattcaatcactagagtacgtatacgatggttctagtcaaatcacaaaccattactgccttcttcctccgagtgagaccccgagggagatatgaaagaatatacagacaaagaggatgaattaagagccttcaacacacatctgaaacgagtcctggggaagagacatggaaggaatagtaaagaatctctgaagagatcattacttatatttgcatctaattaaaaatgtgagtccttaccataaatactgagtaccaaaccggacatatcatagtcttttctggccgggcttggtggctcacgcctgtaatccctactttttgggcggctgaggctgggtggatcacttgatgtccggagtttgcgaccagcctg

SEQ ID NO: 568872 - DNA, 113 bp, Homo sapiens
tcgctttacatcggcactcgctattcatcggcaccattagctctagaggtccatgcatacttaatattatacttgaattcaactacgggtgccgatgtagcgaggtgccgatg

SEQ ID NO: 568873 - DNA, 165 bp, Homo sapiens
tgtgatgactcttgcgttcccgttcaggcggcagtggttcagccctgcggcgcaacgtctcattgccgcggctgtcagaaggccggactttcgcgctgtctgacttcatcgtggacccctgggatgcagagttatggtggcatctccttagcggtggaaggcccc

SEQ ID NO: 568874 - DNA, 1704 bp, Homo sapiens
  misc_feature (669)..(669): n is a, c, g, or t
  misc_feature (815)..(815): n is a, c, g, or t
  misc_feature (1040)..(1040): n is a, c, g, or t
  misc_feature (1301)..(1301): n is a, c, g, or t
gtcgttcgtggtatgcgtgcgtctgtccttgctttgtcgcgtcggttgcgcgtcgtccgcgtctgctgctcgcgttgctggtgatgctgtagttgtgcctcgtgcgcggacatccacccgggtgtgtcccttgatcgacggccgggctgatctccgtccgcgtctttatttaattgcccgcgggcgtgatatctctttcttccacccgaggagccgtgttgccccctttgcccccttttttttggggcagccccctctgtcgggccacacgcggtgtgtgcacccaaaacggcacgcggtgtgggtgtccccggtcgtccgtggagtttctccccgggggtgaattttgctgttcgagtccccaccggcgcgtcgctcgggtgtttaaaaagtgttgtaaatgggggatcttctgcggcccatacttttgtttcccccgcgcccgtgttttgtccccgacgaggatactggtgcactgcctttgtgtggcctgttctccccccttttttgtatggtggagggcctccccccgctcttgcgcccccagaggtgcgggacaaacacaacagtggtgtatctacccgtcgctccccgccccggcgtgttaatcccgcctctagtgacctccgggttgtccacaacaggggggttcagtggccaactatgaanttccagcacgtgtgggtggtcccccctcttctaatatttatatggggggacaccccctgtcttatatgtaaaaatggggcgctccccacacaccccaaagcgggttgttcaacacgctggtgttcttttcgttaacacttgctgtntggaaccgcaccacgcggtgtggaaaattgtggagaccccttgttgccccccgcctgtagtaagatagggctcgccgcgccacattatataccaccccacgcgcatcattagagcgccgtgggtaggaaggagccccccctcatttgggggaagccttttcttatatagtgtatatgtataatgcgccacacacacgtttatgcctctctacacacacagctccncacacacggggtttcctatagagactttcctcgcacacacccttgcgcacgtttgtaagaaaaatttccggcgctctgtgggggcgaaaccttctcggtggccacgagagacccacacactcttcgcgaggccccgggacacacacgtctataagagacttctacaccacgctttcaacaaggcgcgaactatcctatatatctccacactgtgagatccgcacactataacttgtagacccacctcgcggacacacacgnttatccctcatcgggagatataacacggcgcacaatcctatattttctaagagaggtctcacatatatcacaccacaataagggggtttatacgagacctcgagatgtgttggagatacacgcgagacactctcccacatgtgtcgcacacccgcctatttataaaagggtttgtttgtgtttctcaacgagtttaaagtctctaacgtgagtttgaggttctcgacccggaggtaaatcccggtctggtttttattttacttctcaaattctcctccccgtatcgaaaaggacaccaagaagaaaatataaggcctatcttctcccaaagcggcctttccccgtaaatgatatcatttccactttgtattataccccccccccccccagaaccggggtttta

SEQ ID NO: 568875 - DNA, 843 bp, Homo sapiens
  misc_feature (39)..(39): n is a, c, g, or t
  misc_feature (149)..(149): n is a, c, g, or t
  misc_feature (152)..(152): n is a, c, g, or t
  misc_feature (179)..(180): n is a, c, g, or t
  misc_feature (182)..(183): n is a, c, g, or t
  misc_feature (217)..(217): n is a, c, g, or t
  misc_feature (273)..(273): n is a, c, g, or t
  misc_feature (290)..(290): n is a, c, g, or t
  misc_feature (335)..(335): n is a, c, g, or t
  misc_feature (342)..(342): n is a, c, g, or t
  misc_feature (345)..(346): n is a, c, g, or t
  misc_feature (348)..(348): n is a, c, g, or t
  misc_feature (360)..(363): n is a, c, g, or t
  misc_feature (366)..(366): n is a, c, g, or t
  misc_feature (369)..(369): n is a, c, g, or t
  misc_feature (374)..(375): n is a, c, g, or t
  misc_feature (384)..(385): n is a, c, g, or t
  misc_feature (391)..(391): n is a, c, g, or t
  misc_feature (393)..(393): n is a, c, g, or t
  misc_feature (396)..(396): n is a, c, g, or t
  misc_feature (399)..(400): n is a, c, g, or t
  misc_feature (407)..(407): n is a, c, g, or t
  misc_feature (426)..(426): n is a, c, g, or t
  misc_feature (440)..(440): n is a, c, g, or t
  misc_feature (461)..(461): n is a, c, g, or t
  misc_feature (466)..(467): n is a, c, g, or t
  misc_feature (476)..(477): n is a, c, g, or t
  misc_feature (507)..(507): n is a, c, g, or t
  misc_feature (512)..(513): n is a, c, g, or t
  misc_feature (525)..(525): n is a, c, g, or t
  misc_feature (544)..(544): n is a, c, g, or t
  misc_feature (546)..(546): n is a, c, g, or t
  misc_feature (551)..(551): n is a, c, g, or t
  misc_feature (553)..(553): n is a, c, g, or t
  misc_feature (558)..(558): n is a, c, g, or t
  misc_feature (566)..(567): n is a, c, g, or t
  misc_feature (575)..(575): n is a, c, g, or t
  misc_feature (577)..(577): n is a, c, g, or t
  misc_feature (828)..(828): n is a, c, g, or t
tttacatgggggaattttattttatttttttaccttttnaaaagtttttggcactacaaggttctgtaaagaatagaagtgacaatttaaaacacatgaaattctttcctaacttttaagaacaatatataaagtctgaagcaaccaangtntgaatacagctaatagaaaataaaganngnnattttttaaattctctctttatacaattcatcanggttaaacaaaacataaaattcccttaaaaatagggtaataaaatagatgaaattngtatcactcaatttggngatactagtaaaaactatagttcatatttatatacaaataatacngtctgtnaanncngtcttagaattnnnntangcnatctnnacgtgttannattttnantcnggnnctgattngtttagctttccattaaangtcactttttctgntgaatgtactgacattgaggnacggnnccccttganncagcagattggctgttgctgtgcatcggtngaccnnctgaaagaaaanggactgcattactccgacncntttcntnttggngggtgggnncaacgctntntaaccgacgggtggcacatctgtcttgagtatagaaaggtttgttgggctggaatcgggcatttccctgatgcatgaagttttgatgcaaaccataaggccacgaagctgggacaagggggaaatggggacgcggtgcatgttcccaaggaattggaggagtcagtcctcgaaagcctggctctgaattccccactgcaccactgtttaccagggaatttggagccacagtacggggccagtgtccatcgngggacgtgttagggg

SEQ ID NO: 568876 - DNA, 404 bp, Homo sapiens
tgatgttggagtgggccctggtgggaggtgttcgggtcgtgggagcagatccctcatgaatggcttgggccatcctcttggtgatgagggaacactcactctgagtgttcacaagatctggtggtttaaacgtgtgtggcacctctccccacccccactctttcttgttcctgcttttgccatgggactcgcatgatccctttgccttctgccaggactaaaagctccctggagcctcctcagaagctgagcagtgttggcgccatgcttctggtacagcctgcagaaccatgagccaattcaacctcctttctttataaattacccagcctcaggtatttctttatggcaagacaagaacagcctaatacaccaggggtttgcaggtaacccgggcccctgtc

SEQ ID NO: 568877 - DNA, 126 bp, Homo sapiens
ttcagaattttggaaaaatgtccctgaagtgattgaaagagtgcctggcatgcaaggataagaggttctttccataacatttcctaaacccctcataaacgtttgttgcccttggtttagaaattg

SEQ ID NO: 568878 - DNA, 456 bp, Homo sapiens
ctacggaaatactttcttttcggtctaggtcgcttccacgttggctatgcctagaacacagtctccctcatctccaaacaatttctcccgactttctttcttttttgagatggagtcttgctctgtcgcccacgctggagtgcagtggcctgatcttggctccctgcaacgtctacctcttgtgttcaattgattctcctgtctcagcctcccaagtagctgggattatggcacatgccagcacgcccagctaatttttatatttttagtagagacggggtttcacccatgttggccaggctggtctcaaactcctcacctcaagtgatctagccaccttggcctcccaaagtgctgggattacaggcatgagccaccgcgcccagccaggaagggaggtctattttagatataatggtccaggaagaacttactgagaaggtgaaatttagtaaa

SEQ ID NO: 568879 - DNA, 442 bp, Homo sapiens
  misc_feature (14)..(14): n is a, c, g, or t
  misc_feature (19)..(19): n is a, c, g, or t
  misc_feature (53)..(53): n is a, c, g, or t
  misc_feature (131)..(131): n is a, c, g, or t
  misc_feature (344)..(344): n is a, c, g, or t
  misc_feature (393)..(393): n is a, c, g, or t
  misc_feature (438)..(438): n is a, c, g, or t
  misc_feature (440)..(440): n is a, c, g, or t
cctaactcaacggnataanccccttgccccctgcccctttcttttttacgcanagcccaacccgggtaatctccgtttcccatctctgcaaacctcccccggtgcccagattgagcctagaaagggggcanaggagggggcccagattgagcctagaaagggggcaggcaacagttgtcacgcctgtaatcccagcactttgggaagccgaggcgggcagatcacgaggtcaggagttcaagaccagcctggccaatgaagtgaagccccatctctataaaaataaaaaattagccgggcgtggtggcacgcgcctgtagtcccagctacatgggaggctgaancaggcgactcgcttgaacccaggagacggaggttgcagtgagccgagancacgccactgcactccagcctgggtgacacagtgagactctgatntnta

SEQ ID NO: 568880 - DNA, 332 bp, Homo sapiens
gcagatctatgtatcaacgagaaatataggactggggctactctctgggagtccgaggtgagcggatcacttgaggccaggagtttgagaccagcctggccaacgtgacaaaaccccgtctctactacaaatgcaaaaattatccgggcatggtggcacatgcctgtaatcccagctactggggaggctgaggcaagagaatcacttgaacccaggaggcggaggttgcagtgagccaagatcgtgccactgcactctagcctaggtgacagagtgagactcaggtctcaaaacagaaacagacatagaaaaaatctttgctgaatcgaaca

SEQ ID NO: 568881 - DNA, 456 bp, Homo sapiens
tgatggtgcgctgtgatgaatgtggcacagtcatgcttccctgtgtgtggcctggtgtcattgttggtgactcgctgtgtgtgctgtgggtgcactggcctgtgcatttcactgcattgcttgccaccccagatccaccttgtctccactttcacatgcctccagagtcttgtgtgctcttcccttcttgtcctcctgatgtggggcttgccattctcatcgtttgtccagtgtgatgtgttgcatccaggtgagtctgtgcttaacgcttaggactgacatgccctgtcccccatccccctttacctacgcggtatccttggttcccctatatgaactggtggggtcctttggcgttccttggagggccctttggctggttttcccccttatcgtgtttgggccgtccgggtggcccatttcccaaggtcttttggcgcttttgtgggggttctg

SEQ ID NO: 568882 - DNA, 170 bp, Homo sapiens
tactaatggtaaccagtcaaataaaaggacatcagtggatacctgacttctcagtgatccttattctagctacaatgtcaaatgataactcctgaatcactgtgtgcatcacttctgtgtggatcctacatagagatctgacactgcatgtgcatgcaatgcttgtgcac

SEQ ID NO: 568883 - DNA, 1191 bp, Homo sapiens
  misc_feature (276)..(276): n is a, c, g, or t
  misc_feature (713)..(713): n is a, c, g, or t
tggaaacagagtctccatttgtcccccaggtggagtgtaggggtgcaactcttgggctcactgtgcaaccttctgtgttcccccatggtttcaaggaagattctccgttgccgaagacctcccatagtagcgtgggattatatgcatgcccataccaggttccaacataattttggggaatttaaagataacagacgggggtttcaccagtgtttgcgccacggcatgggcttgtcagaacctccttgacccctcaaggggtgactccttctccanccttgttggcactcatcaaaaggtggttgagcaattataccgaggtgcttagaagcacaaggtgcgtgccacaaagcctgtttaatttattcataagacaagaccagggggctcttaagcatcggttgtgtagcccacaagtgcgtggaggacgccaaccactagtgtggactgtggccctccaacagttgaagatggccttgtctagtaaaacatcctctgtgtggcctactcaaaaagcccgatttcaagtattccacaaatcttttataagacccgctcctatgttgaaaattttaggctgtaagggactccttaaccagggtgtgtgtcattgtaggccacagacacagatgtgtcccagtttgggagacgaaaactcgttagttagaaaaacacgttattatggagtataacaaaaaacgacgaccagaggnagaaccacgactgtgtgcgcaacacggaagatatatagcaccacaagagttcattggggtaccaatcaaaaaagcgtcccgtgggtgcagcaatcaagagggtgtgaacatccctgtttttaccacaagcaaattgtggggatatatcccacaaaagaaggtttccacggcgggaattatataaccagcgggttgttgttgaaacaccaaccaaaaaggggcgatgtgggcccaatataaaatttagctgcatttatcaacaaagaaaaagggggcatgcaggctaatataactgatgtcgccgttgtaacaagtccagttttttggcaccagcagacgtcacgttgtggttatcatgggggtacaacatacccaacaggttgattatcgagaaagtagtatgccaaaggtcggcaaatgttgagacgacgagagcagaaccaaatatgtgtagtatatgatcagatgaaatcaatcg

SEQ ID NO: 568884 - DNA, 203 bp, Homo sapiens
cttatcataccaagctcagccagattccatgacctactgcgccagttaagcacattatgaccagaagcatgacacaccagaggacatctgtgtttgctcttctttctaatttgctgcgcttataccgtggcccactgttgttcagcattgctttggtttcatggcctgcataaaccacaatgcccacaacagcctctgtgttt

SEQ ID NO: 568885 - DNA, 141 bp, Homo sapiens
tgggtaggagatctgtgacttcttggtgatgacagggctgggaatagggtcattctgatttcaagtgaggagcaggctgtgtgtactgtttagagaatgtggcacctacctgtcttcagctcttggtacttggccttatcg

SEQ ID NO: 568886 - DNA, 127 bp, Homo sapiens
aaaatgagaggcagagggtggatgtaggaggtgtagttcttccccgagagcaactagcccaaccgagaaaaggttttaggtcctgggtaagaaggagggcctcagtcccactctcttaccacctacc

SEQ ID NO: 568887 - DNA, 497 bp, Homo sapiens
cagagaagggattgaggagccctgggcttcctgtctctgggagcatcagcctggggttgctgtggccacagaagccgtccagcctcatctgggcaccaacgtggccttccccagcaggtctcagcactacaggtctgtggcccatgtccactcttaggccatccaggggcaagatagtcagagcaggactgattttgcccagggacatctgaggagccaacaggccagatcagggacaaatggtgtgcccgaggctgtgctgctggtagagggtgtgggcagatggggcccctttccctcaaatgcctgccataccaggaagggaaatggaaatggcctcttttcttaaataaatgcatggtgtaggccaggcgcagtggctcatgcctgtacgcccagcactttgggaggctaaggcaggtggatcacttgaggtcaggagttcgagaccagcccagccaacatggtgaaaccttgtccctatcaaaaaatgcaaa

SEQ ID NO: 568888 - DNA, 1718 bp, Homo sapiens
  misc_feature (98)..(98): n is a, c, g, or t
  misc_feature (181)..(181): n is a, c, g, or t
  misc_feature (227)..(227): n is a, c, g, or t
  misc_feature (570)..(570): n is a, c, g, or t
  misc_feature (1381)..(1381): n is a, c, g, or t
ctcgatcgtcgttacgggtatcgcgggttgcagtcgcacatggaccactcaatgtgcgcgggggcctgaagactgcagggcaaggagcacagaagccntgagtgcgcaagtctcccaggattcatcatctgaccctggggatggctagcttcgcgtagaacagagacgctgacagcgttcncctgaacacgtgaggcaataaccatgcactgtacaccacacttgtncggtatggcgtgctgtacagtcacgcagcaccaaggcacgagtactccggaagtcagtcataattggactcagaggaaacattttccacctcgaagttgcgaacgatggctgcagagcatacacttaatcacctggctaagaatctcgaaatacacaaaatcacactctataggggggcaaatacctgggcacacaacacgattttacccgcgtggggggttgcaatcacaaggaccgccgtctacacatcgcttgaaatttgcatgacccagctcccaattgtaggtcaagacccaaattccagagggagtctctcacgcaatgccgtccggaaattgaagnctcgcgacagtcaaagcggaatcacaggtccccgcggccacggtggggcctgcccatggccacccggccagtcatctaccacagaagtgtgtgccagcattgggcacccaatatctggcaatgtccaacacgattcgccttaattcggttgagattccggtaggagcgaatcttcaaccgcaacacggggggagagcgccacaccttcacaagggggttccccggtgatcgctaatcaggtgaggtacagtgaacacgtttcccacaagaatcttacggcgttccacgcggtcggtttatcagttagcacacgggggcttcgaaatccacgtaaccatggagaggggcgcggtcaggttttgcaccggaatagaagggcggtgcccggtagaacccacccccggatatagacactcggaattacttcacgtctttccaacatccttatgagcgtcaatccattgtagcgcccaacttaccctccaattccccggagggaaaacaagcggggttatgaacttacacttcccattggtttggccatacccaaattaggattgccagaggaaggcctaggagccaccaccaaaagaggggtggacgttggaagcccacgatgagacaagacaatacgccacccgtgggaaagggcccaaaggggggccaatggggcacacgtgggacaccaaggacaaccggaaagcccgataatcacgttgcgcaggaccatggaaatccaggcaacgcatcacccaaggaccccaccttcagcgattgcatgggggggggcgcaaaaggcagaacgccccanttcccctgtaacgcgttgggactagataagcactggaggcacaaagcgtatgccgaatcccgccgctgccgattcgccacaaagaatcaatggtcagcagtaaaaagagcacacccattacgggcccgtacgggggacacacgagacaagcaagcagaaagagagcacacagagggccacagaaataacaaccacaacacagcgaagacaagaagagttcagaaaacaaacagggagtaggcaagtaacagcacagaaacacaaacacagggaagcgaagagaagtaatacaaccacagcaacgagtttcaaacaagaggaagcacagcaagtacag

SEQ ID NO: 568889 - DNA, 217 bp, Homo sapiens
atcagagaaagggctgcacggccagcgcccaggcagtagtgtataggaattcttagtcctcgcctaaaacctgctccctttcaccctaatccagtctccacctgcccctcccccagaaaaaccaaattccaaatggctgagacagtaagacggctactaatctcgccttcctctaaatctctacaggacgacagaccatactgtattctacggctcc

SEQ ID NO: 568890 - DNA, 159 bp, Homo sapiens
gaagtgagagcagatctaggagaaccgagccaagaggtgatgctgtgcaagtgaaaggtaactcaagctaaagccagaagggagcccatacagcgcaacctgtctgtcagagattgcagtataccgtctccatgtatccagaagccatctacacaagag

SEQ ID NO: 568891 - DNA, 386 bp, Homo sapiens
tctgttggggaacatatggctgaatggggaatagttcgaatggaaaaattagaaatcggtcattaggaaagagttaggttactttagtgaaatcgcatcttcctgtgaaccaacatcatatttctcttatagtagcagatttagtggagggtttgctgcccgagactaccgacaaagtaccggtgccaacacttccagcttcagcatcagtcgcgcaagaagcagccgcagtggcggaggtggccccggtagcagcagaggatttggtggaggtagtgttaatctgtaacttcatagctttgggacgggtttatattccttttagtcatctttttcaaagcctaattaaacaatttaagttcaccactatagaaacttgatggcaa

SEQ ID NO: 568892 - DNA, 224 bp, Homo sapiens
ggggacttgaattgtgggagtagccgagacatgtggaataagtggttagctatggaatgtgtataaaagttttgggagaaggaaacatgggggcagcctcctctctcctttcggtccctggcaacctcatagatcttcatatctagaaggaaatctatgatagattttactgttgatttgttgatttctaccttgggaatacagaaggagtagcccattgtggt

SEQ ID NO: 568893 - DNA, 179 bp, Homo sapiens
ctggtccatactagtactctttgctgtcacagacaggaaaatatcatcataagaaaactacaggccgggcatggtagctcatgcctgtaatccaagcactttgggaggccgaggcaggcagatcacttgaggtcaggagttcgagaccagcctggccaagatggtgaaaccctgtctct

SEQ ID NO: 568894 - DNA, 909 bp, Homo sapiens
ttctttgctgtgatattgttctgttttgggctggggttgtgttgaccagtccgtttgtcatggtgtctgcgcgtttgtggtccatgtttaactattgggtcgtcgcgaatccggttgcttcacgtattctttggtcgccccctgccggggtcggccgttttccgggtcctggcgctcctggatttttcccgaccagttgcgcatgccttggcggtgggtgcttctgctgtccctggtcactggtggtggtccctccttccatgtgttgcggacgccccccctgggggtcatggttgctcccgcctctccgggatatatgccgtggttcatggctgtggcgtctggccgcgtatgtgtctcttggggccaatatccactacgcgggcgtcttatcttcgggtgcgggttgcctgtaggggtttatatctgagtgtacataatctattcgtatgtgcagtgtagtcgcttctcgttaggcagtctccatttcgggaccccctcgggtgtgcggtgattttgccgtacattccctattggggggggcgttttttttcgtggatcacggctcggccgctgtcgcgtgttttggccgtatgttcctgcagccggtgcacccccttcacgtggttggcaaaggtcggtgttcccgcttgtattccttgtcatggccgcttgctttcttctgatacgctttgcaatggatcccactgcttggcggtacaccctctctgttgtctggcacgctccgtcgcacaacgaggggggtctgtcgtcggaccaccaccttattttttgcaggagcgtcggctccgtctcttccccgcgggttgtatggccagccccgggcgaggctccaccctacggggaatataacagacgaagcccccgtcagtaaccgaacaaatcgca

SEQ ID NO: 568895 - DNA, 193 bp, Homo sapiens
ccggacccggaaatggtagctgtactggggcgtccctccaggccgttactcatactacaggatatatactattactcccaggtatcagcagaagattgcgtagctctcaaatgtgtgttcctgctttactaatggatattttaaattcatgcaacaagcaccttgtaggtgcctgctgtatccctacattaca

SEQ ID NO: 568896 - DNA, 148 bp, Homo sapiens
ggttggccccatgggtggtggggtgtgaaaagcctgcaataccccaagaccccagagggcagtccttaggaagcccttaccccccctgggaacccctccgttttttccctttactttcatcctaggaataaagcatttccccgccaga

SEQ ID NO: 568897 - DNA, 226 bp, Homo sapiens
  misc_feature (92)..(92): n is a, c, g, or t
  misc_feature (194)..(194): n is a, c, g, or t
tgtgcgttccagcacagaggacgtaagtgatctaattcctcagtaaatattttattaaattaaaatagggggactttgctgcattaacaaanacttcttaaatgtgcttgttttgttgccgagcttttaacttttttttttgtttgtttgttttttgcactgtatcaaagaggagccattgaggaatactgttnctcctatcccagaaggagcggcacatgcgttg

SEQ ID NO: 568898 - DNA, 456 bp, Homo sapiens
tgttgtgtgtgtgtgtgtgtgtgtgtctgtgtgtgtagggactgggttcaccatgtcgcccaggtgtgtgcatgtgtgtgtgtgtgtgtgtgtgtagggactgggtcacaccgtgttgcccaggtgtgtgtgtgtgtgtatagagactgggtttcgccatgtcgcccagggtggttcccaactcctgagctcaagtaatccatctgtctcagtgtctccaagtgtagagattatgggtgtaagccccgtgcccagacagtggtgcactacaaatcttcaaaggaccagcatatctggagggtgatgcagaaataccccagagtatctctaagcaggactccaggtctctgctgcatccctagtgtgtccagtctgtgatatgctcaagaatactaatatcagtgtgtcacagctaacgtgacgctcatctaatcaggaaaatcttggggtggagag

SEQ ID NO: 568899 - DNA, 1078 bp, Homo sapiens
ccacgcgtacgcccacgcgatcggtacccatctatagtacactgtgtcccctggtcacgcagagcagcctgaggcacaatgcctatgtcgcggctgtggcggtttgaccatgaatgctgggaacgtggctgaatgagcggtctgggtcttgtgcaccaggaatggcagccagctgactgtggacatacattgcccccacagttggggtactgggtggccgtcatgtcccctccacatcccaggtcccgtagtaacacaggacattaccacgtatcacacggtgtaacttataggcccattttcaggcaggcaatggctatacataacttatatgtgtttatgctgtagtctacctatttcatcattcattgccaggcaggcaagtagcttgcaacacctccgatcagcaccacagcaaaactgcagcatcccatgccaggacctggagagttccaacaatgagaccagctaccacgtccactgtcacaccattacacttgcatgttaatcacgccagagcgtacagcaattccctgtgaccctgaaatgtccgatcacacatgccacatggccagatcccagacggccacccagagcatcgacaggaactggactgatgtgtgatgatcaaatcatgtgaaaactgattgtcctcccgaggcaggcgacaagtggtgcccccttgctacaacgccccacatagcttccactgcctacttcgctaacaagctgacctttcacccaagagacacatataaggcatcccctgtggatgtggacggctaccatcatccatggccactggtcaaagatggactaacactggcacagatcctcctttttgacacacccgtacaccaccccaccgatgggggcacgccgtgggggccaaacagcacgaaaacgcaataacgcatcgactgggcaggcccaacacacccacacaaaccggtcaagcaccgcccactcaaaggaggacagacgcacccaggagccaccaccatcccaccagcgccaacgtgaccgacacacaaagagaccataactaccacgacacggcaccaccaaccagacccaa

SEQ ID NO: 568900 - DNA, 101 bp, Homo sapiens
  misc_feature (8)..(8): n is a, c, g, or t
acggtctnaccacttttagttggactgtattcttactgttgagtttaagagtctctgtgtataccaatacaggtcttagttgacaggtgattttgtgatat

SEQ ID NO: 568901 - DNA, 520 bp, Homo sapiens
gctggagtcggagttgtaacgctccactgactgatagagcgacctgtgtcctgtaaccatttgcgcccggagtggcccgcgggccgacgccgtactggaggttgacggcctcgggtggcgccgcgctgctcctgcttgcttcaattccctgtgattgtgcctgtctgttgccagtgatgccatcacaccgtgaaatagaccgttgccttttgggtttcccttccagcaaaactaagaaaaaaaccataaaaagccctttgctttgacaatcgaaagtttggcccctttgaaaatggaagaaaccccggattttttaattattccccctttgggagtttagcctattaacatgggagggtttggcgccaaaaatccaaccggttaaagcaaagagcgtttgtacttggagctaaccccaggttagcaacgcggtctttgccaacctggcgttacccgtttccgtaaaattggacgacttctttgtccaaaacacgggccccttttggtgccccgcgggaaa

SEQ ID NO: 568902 - DNA, 793 bp, Homo sapiens
  misc_feature (7)..(7): n is a, c, g, or t
  misc_feature (23)..(23): n is a, c, g, or t
  misc_feature (175)..(175): n is a, c, g, or t
  misc_feature (184)..(184): n is a, c, g, or t
  misc_feature (199)..(199): n is a, c, g, or t
  misc_feature (202)..(202): n is a, c, g, or t
  misc_feature (307)..(307): n is a, c, g, or t
  misc_feature (319)..(319): n is a, c, g, or t
  misc_feature (396)..(396): n is a, c, g, or t
  misc_feature (402)..(402): n is a, c, g, or t
  misc_feature (409)..(409): n is a, c, g, or t
  misc_feature (448)..(448): n is a, c, g, or t
  misc_feature (475)..(475): n is a, c, g, or t
  misc_feature (481)..(481): n is a, c, g, or t
  misc_feature (485)..(485): n is a, c, g, or t
  misc_feature (496)..(496): n is a, c, g, or t
  misc_feature (502)..(502): n is a, c, g, or t
  misc_feature (521)..(521): n is a, c, g, or t
  misc_feature (527)..(527): n is a, c, g, or t
  misc_feature (532)..(532): n is a, c, g, or t
  misc_feature (534)..(534): n is a, c, g, or t
  misc_feature (545)..(545): n is a, c, g, or t
  misc_feature (554)..(554): n is a, c, g, or t
  misc_feature (561)..(561): n is a, c, g, or t
  misc_feature (569)..(569): n is a, c, g, or t
  misc_feature (607)..(611): n is a, c, g, or t
  misc_feature (638)..(638): n is a, c, g, or t
  misc_feature (727)..(727): n is a, c, g, or t
  misc_feature (735)..(735): n is a, c, g, or t
  misc_feature (776)..(776): n is a, c, g, or t
gttcgcnatgcgtcccggggcgncagggccactctggcctctgccctggggggccctggcttgggccgtgggcttcgtgagctccatgggctcggggaaccccgcgcccggtggtgtttgctggctccagcagggccaggaggccacctgcagcctggtgctccagactgatgtnacccgggcngagtgctgtgcctcnggnaacattgacaccgcctggtccaacctcacccacccggggaacaagatcaacctcctcggcttcttgggccttgtccactgccttccctgcaaagattcgtgcganggcgtggagtgnggcccgggcaaggcgtgccgcatgctggggggccgcccgcgctgcgagtgcgcgcccgactgctcggggctcccggngcggtngcaggtntgcggctcagacggcgccacctaccgcgacgagtgcganctgcgcgccgcggctgccgcggccacncggacntgancgtaatgtacnggggcngctgcgcaagttctgtgancacgtngtgtncncgcggccacantcgtgcgtngtggacnagacgggnagcgccactgcgtgtgtgtcgagcggcgccctgccctnnnnnctccagccccggccaggagctttgcgncaacaacaacgtcacctacatctcctcgtgccacatgcgccaggccacctgcttcctgggccgctccatcggcgtgcgccacgcgggcngctgcgcnggcacccctgaggagccgccaggtgggtgagtctgcagaanaggaagagaacttcgtg

SEQ ID NO: 568903 - DNA, 773 bp, Homo sapiens
  misc_feature (492)..(492): n is a, c, g, or t
  misc_feature (607)..(607): n is a, c, g, or t
  misc_feature (625)..(625): n is a, c, g, or t
  misc_feature (640)..(640): n is a, c, g, or t
  misc_feature (644)..(644): n is a, c, g, or t
  misc_feature (657)..(657): n is a, c, g, or t
  misc_feature (659)..(660): n is a, c, g, or t
  misc_feature (668)..(668): n is a, c, g, or t
  misc_feature (721)..(721): n is a, c, g, or t
ctacacatccgtcatggttgatggagaactttattcggggacgtcgtataatttttttgggaagtgaacccatcatctcccgaaattcttcccacagtcctctgaggacagaatatgcaatcccttggccgaacgagcctagtttcgtgtttgctgacgtgatccgaaaaagcccagacagccccgacggcgaggatgacagggtctacttcttcttcacggaggtgtctgtggagtatgagtttgtgttcagggtgctgatcccacggatagcaagagtgtgcaagggggaccagggcggcctgaggaccttgcagaagaaatggacctccttcctgaaagcccgactcatctgctcccggccagacagcggcttggtcttcaatgtgctgcgggatgtcttcgtgctcaggtccccgggcctgaaggtgcctgtgttctatgcactcttcaccccacagctgaacaacgtggggctgtcggcagtgtgcncctacaacctgtccacagccgaggaggtcttctcccacgggaagtacatgcagagcaccacagtggagcagtcccacaccaagtgggtgcgctataatggcccggtacccaaccncggcctggagctgcatcnacagcgaggcacggnccgncaactacaccagntnnttgaattngccagtccagaccctgctgctgtcttcaaagaaggtcctgcagacattcgctntgtctgcgagaagaatgggcgagctctggagacctgtgtccctgtacagacc

SEQ ID NO: 568904 - DNA, 251 bp, Homo sapiens
cgtgcgaccttttacatccgtgaaacatgctccttcacctctgtctgtgtaccccctcgcttctctccatctctcagtcccatcttgatgcgctgtgggagtttcacacacgatcgcgggtctttgtccatctagcgttggacgcgttctgcacggttgactgtggcctatatgctgagagtataacctgcaaagctgactttctgcaaccaagcatgtatcctgggtcaggcccagaaggtccaggtatg

SEQ ID NO: 568905 - DNA, 347 bp, Homo sapiens
aggcatttctgacgtcaaagagtgtgcgcgtcaaaatgctcactaaccgactgagcgctcataggctattggagacacacgtcaccatggggacattctttctgtgacgggtattgcaaggtagagacactctctactggcacacagactaaagcaccaaacgacagtcaacctttaatgcgagcagcaggagttccgcctattaaggatctctcagttatacacgcctgatggcttcactccaagaacccatatgtttacacggcacacctggccaatgaggctgggattaactgtgcaagccttcgtgtccctctcacgggacgctgatttttatggaggggggc

SEQ ID NO: 568906 - DNA, 191 bp, Homo sapiens
ccaaccataactgacgtacggtggctggcgtcaaagtattctttctccttgtccagctggcttccaactggctgtctttacactctggcagatatagctgttggcgcaacagatatggtcacgtacagacagccgagcgctgtacttgatgccacacagagtgcactctggaacgggtcgcgttataccct

SEQ ID NO: 568907 - DNA, 1298 bp, Homo sapiens
  misc_feature (56)..(56): n is a, c, g, or t
  misc_feature (63)..(63): n is a, c, g, or t
aatctttccagactttggcgacattatcaaagatgtatcttttctgcacccgtttnatccagnttttcagctcctcagtagtgacaaagccatccccatcattgtcgattcgatcaacaatcttccctagcctctccttgctctcgtccggggtgagctcgtcgaagttcttggagtcctccttgcccaggaaggcctcgtggtcgtactggaagctctggttgtcctcagggggccgcttgcccagctccgagtcgggccgcaccacggctctttgcgcaccgtgggcttggcccgcagaacccgcgcgccagcaccagcgccagcagcagcccagggctaaccccagcggccaccgcgcgccatcgtcccgaggagagggcggccgggagggagacctgagcgagcgacaacagcggcagctcgggaatgggggctcggagcgcggcggccaagttttatgttatgtatattttacaagtaaaaaaattttttcacctcagcctgaactgaacactagctgacagacgttttgatttctttgaccatcacggaatcgtggccaagcgcggtggctcacatctgtaatcccaacactttgggaggtcaagatgggcggattgcttgaatccaggtgtttgagatcagcctgggcaacatgacaaaaccctgtttctagtaaaaatacaaaaattaaccaggctcaagccatgaccatgcaccattgcactccagcctaggcgacagagcaggaccctgtctcaaaaaaaaaaaacaaaaaaaaaaaaaaacgagaaaaaactttctacaagggtggaaaagggaaacaaatattttttcagatgaaaaaaaggggggaacagcgtgtttaaacaagggggggggccaaaaaaatgagtgaccaagccagagtataaggctagcaacaagacctattaaaacagcggctaccaccaagaggggtagagaccacaggagagaacaacacgaggggtcaccgcaacaatcacacaacagaccagtgtgggagacaaccacacggagcgttacaagccccggcagtcagaagaaaagacgaccccgccacgagtagtgacacaacgaagaagtggacaacactcactcagggcggtgacacccgaccaacgaaagaaatagtagtacacggcgtggtcgatatttgtcgcccccacaacgatctggtgcgaggtattcagagacggagacgaagatcagcacgcggggatgacaagagaccaacatgggcggcgtcacaaccaagggttgtgacaacacgc

SEQ ID NO: 568908 - DNA, 544 bp, Homo sapiens
  misc_feature (8)..(8): n is a, c, g, or t
  misc_feature (11)..(11): n is a, c, g, or t
  misc_feature (13)..(13): n is a, c, g, or t
  misc_feature (29)..(29): n is a, c, g, or t
  misc_feature (36)..(36): n is a, c, g, or t
  misc_feature (38)..(38): n is a, c, g, or t
  misc_feature (40)..(40): n is a, c, g, or t
  misc_feature (42)..(42): n is a, c, g, or t
  misc_feature (50)..(50): n is a, c, g, or t
  misc_feature (56)..(56): n is a, c, g, or t
  misc_feature (58)..(58): n is a, c, g, or t
  misc_feature (63)..(63): n is a, c, g, or t
  misc_feature (74)..(74): n is a, c, g, or t
  misc_feature (89)..(89): n is a, c, g, or t
  misc_feature (99)..(99): n is a, c, g, or t
  misc_feature (101)..(101): n is a, c, g, or t
  misc_feature (103)..(103): n is a, c, g, or t
  misc_feature (105)..(105): n is a, c, g, or t
  misc_feature (107)..(107): n is a, c, g, or t
  misc_feature (155)..(155): n is a, c, g, or t
  misc_feature (157)..(157): n is a, c, g, or t
  misc_feature (172)..(172): n is a, c, g, or t
  misc_feature (215)..(215): n is a, c, g, or t
  misc_feature (219)..(219): n is a, c, g, or t
  misc_feature (238)..(238): n is a, c, g, or t
  misc_feature (252)..(252): n is a, c, g, or t
  misc_feature (255)..(255): n is a, c, g, or t
  misc_feature (264)..(264): n is a, c, g, or t
  misc_feature (268)..(268): n is a, c, g, or t
  misc_feature (274)..(274): n is a, c, g, or t
  misc_feature (306)..(306): n is a, c, g, or t
  misc_feature (308)..(308): n is a, c, g, or t
  misc_feature (336)..(336): n is a, c, g, or t
  misc_feature (366)..(366): n is a, c, g, or t
  misc_feature (369)..(369): n is a, c, g, or t
  misc_feature (389)..(389): n is a, c, g, or t
  misc_feature (398)..(398): n is a, c, g, or t
  misc_feature (409)..(409): n is a, c, g, or t
  misc_feature (411)..(411): n is a, c, g, or t
  misc_feature (417)..(417): n is a, c, g, or t
  misc_feature (537)..(537): n is a, c, g, or t
tgggcatnaananttctttattttaccanaaggganangnantggggcantacaananccaanccccaaaccanaaatgcagcatccanatgcaggaanancnananaggctggggcagggccagggtggggagctgggaccactggacattcanancacccctgccaaaangcttgggtcctgggctcttctgcctccattggagcaaggaganaaangattgggttgcttccccanggctggaaccccancantctggccangaanaaaaanggcacaagggctctggggtctggccaggctanancactcgattctgtacagggttggcacanccttttccaccaaaagggcccaacacccanganaattcagccctagcaggaanaaggtctanacacttttctntncccaanagggctaaaccctcatctcaaaaaacttaacaaaattgggaccaaaccgcaccgccccagcaggaacatgcccatgaagaggccttccctgagcacaagcaggggcctcctaaggcagtnggaaact

SEQ ID NO: 568909 - DNA, 193 bp, Homo sapiens
ttcgagatgggcacctcggatagcagttcccccccaaacataattagtacatcttttttttaaaccctgggcatacatcattcacattggaggatccaaggccaggaaacacaggtttgggaagactatttaagccagtacaaccgagcttggggggggcacgagtggccagggcagaaatcccagcattggg

SEQ ID NO: 568910 - DNA, 295 bp, Homo sapiens
tggttttccccttttgggttttaggacatccatgccaggtgaggggcctgggtccctgttacaagtcaggagccctgtagggagacccctccttttggcaaaggacctgaatgctgcgccaaacagatttttgtaaaattttatattagtttttaatgtcagtggggactcggtttctgggggtgcaaccagcctggggcttttgtaaaaatttttgggggactcccttaaatgttgtttcctttttgcccccttttcctttttgtaatttaagggcctttaacatttttgcaga

SEQ ID NO: 568911 - DNA, 146 bp, Homo sapiens
tcgcggcggcctcatgaggccacagcccctcatttacataaatattatactagcatttaccatctcacttctaggaatactaggagtatcgctcacacctcatgaggccacgcctcatgaggccaccgcatgaggtcatgaggcca

SEQ ID NO: 568912 - DNA, 170 bp, Homo sapiens
cacgaggggtatggtgacacccagacaccctgcaagtatcacgctccaggtgtgggctgattcctccagcctcttgcacggattgccggattcgtgggaccaaacaacctttcctgagtttacacgtcacttgcacaagcagtgggggtggtcacacgattgtgaggcca

SEQ ID NO: 568913 - DNA, 393 bp, Homo sapiens
  misc_feature (312)..(312): n is a, c, g, or t
gtgatgggttaataggtgcagaaaaccaccatggcacacgttacctatgtaagaaacctgcacatcctgcacatgtaccccagaagttaaaataaaaattaaaaaaaaattcaaacattatttgcccttttcactgtgttgacgtgtacactcatgataaaaagtaatgaagggtaagtctgttggtggcttagcatgaatcatggcagtggtcccgaaccgtattagttgccatagaattctgcatttccatacagccacagttaaaaacaacaaacaaaaagttttacttaataatgcccttgatgcatnagtaaaaatggggtaattttattaaatcttgataactcagtagccctgttaataccccatgtaataaaatgggaaatatac

SEQ ID NO: 568914 - DNA, 161 bp, Homo sapiens
ccgtcttcgcacggtgcattcaagtccagcagttggcagggtcatacaggcccccgacgctcctcttactggccagcagcagtcagcactccccggctctcctcacggctttaggctgcgaaccttcagcagcagtattggacttctctgctggatacctt

SEQ ID NO: 568915 - DNA, 112 bp, Homo sapiens
gagatcgtgccattgcactccagcctgggtaacaagaacgaaactctgtctcagaaaaaaagaaaaaaagtcagactactgcaggagctcccgtgggttctgcgaattaggg

SEQ ID NO: 568916 - DNA, 119 bp, Homo sapiens
tacgatcgagctcggtaccgaacgggtgatgtggttgaagaagctgggttgtgccagggtgtcatatgtccttctcgtggaacactgtgctggtgctgtgtcaccctagtgcgtgagct

SEQ ID NO: 568917 - DNA, 158 bp, Homo sapiens
ctggccgtatgaactggttagaaggcaaagataaaaggtttctttttgattcctgttttggtctatgaagtagctgttattttttggggccggttcgagtgtatgtgtgaaacaaggtggtccaagcaataaacaggaattttatttggcgagcgata

SEQ ID NO: 568918 - DNA, 427 bp, Homo sapiens
agcggctctttcccttcggtgtgccactgaagatcctggtgtcgccatgggccgccgccccgcccgttgttaccggtattgtaagaacaagccgtacccaaagtctcgcttctgccgaggtgtccctgatgccaagattcgcatttttgacctggggcggaaaaaggcaaaagtggatgagtttccgctttgtggccacatggtgtcagatgaatatgagcagctgtcctctgaagccctggaggctgcccgaatttgtgccaataagtacatggtaaaaagttgtggcaaagatggcttccatatccgggtgcggctccaccccttccacgtcatccgcatcaacaagatgttgtcctgtgctggggctgacttgaaaaggcttccacaaggcattgcggaaggtggccctttgggcccccagggc

SEQ ID NO: 568919 - DNA, 227 bp, Homo sapiens
acgagaggatcacccatatacgcacaggggaaattgaagtggatgcataacagtgccaaaatagtgtgccactagaaatggtgtaaaggctgtctattacttatttttaacaagaaaagtttataccatgtattaggagaggcaggttacaaacactacaagtctggagtacagaaggaaagaggacaacagaaaacacaccaatccccagtatttaaaaaaaaaca

SEQ ID NO: 568920 - DNA, 430 bp, Homo sapiens
agcggctctttcccttcggtgtgccactgaagatcctggtgtcgccatgggccgccgccccgcccgttgttaccggtattgtaagaacaagccgtacccaaagtctcgcttctgccgaggtgtccctgatgccaagattcgcatttttgacctggggcggaaaaaggcaaaagtggatgagtttccgctttgtggccacatggtgtcagatgaatatgagcagctgtcctctgaagccctggaggctgcccgaatttgtgccaataagtacatggtaaaaagttgtggcaaagatggcttccatatccgggtgcggctccaccccttccacgtcatccgcatcaacaagatgttgtcctgtgctggggctgacgctcaacaggatacgaggtgctttgaagccaggcactttgcagggtcttaagcaatt

SEQ ID NO: 568921 - DNA, 401 bp, Homo sapiens
  misc_feature (89)..(89): n is a, c, g, or t
  misc_feature (153)..(154): n is a, c, g, or t
  misc_feature (157)..(157): n is a, c, g, or t
  misc_feature (168)..(168): n is a, c, g, or t
  misc_feature (173)..(173): n is a, c, g, or t
  misc_feature (180)..(180): n is a, c, g, or t
  misc_feature (193)..(193): n is a, c, g, or t
  misc_feature (199)..(199): n is a, c, g, or t
  misc_feature (202)..(202): n is a, c, g, or t
  misc_feature (205)..(205): n is a, c, g, or t
  misc_feature (215)..(215): n is a, c, g, or t
  misc_feature (236)..(236): n is a, c, g, or t
  misc_feature (248)..(248): n is a, c, g, or t
  misc_feature (256)..(256): n is a, c, g, or t
  misc_feature (259)..(259): n is a, c, g, or t
  misc_feature (285)..(285): n is a, c, g, or t
  misc_feature (287)..(287): n is a, c, g, or t
  misc_feature (298)..(298): n is a, c, g, or t
  misc_feature (310)..(310): n is a, c, g, or t
  misc_feature (321)..(321): n is a, c, g, or t
  misc_feature (324)..(324): n is a, c, g, or t
  misc_feature (335)..(335): n is a, c, g, or t
tcaacgtgctgacaagcgctcgaaaatagcgcatgcgcatgtgtattggatatcgcctcggggacagtagccatggaattcacatcggncacattatcatgtccatccgcaccaagctgcgcaacataggatcctgttatacatgactcatgnnccnggccgtgtacncgttncctggtngccagaagatccncatctncancangtgtggcttnaccgaaatccaatgctcactnaactagaagacnttctgccngantcgcgcgtcatccctgatagctgtgnantcgactacatnccccgtcgtcantactaggaccntcntggcgccctgnactcatgagggcttccaatgtgctgcccccctcttaatactcaccaataaattctacttcctgtcc

SEQ ID NO: 568922 - DNA, 173 bp, Homo sapiens
gcaatttatgagggcatcatttttcagaaaacagctcttaccctgcatctggtgacgatatgaaaccactccagcccacgtcgctgcttctaaaacaataacagtctgtatgataggttcccaccctgaacggcctgtcccagatgacagtgtcttttatcgctggagatgtg

SEQ ID NO: 568923 - DNA, 267 bp, Homo sapiens
  misc_feature (3)..(3): n is a, c, g, or t
  misc_feature (27)..(27): n is a, c, g, or t
  misc_feature (34)..(34): n is a, c, g, or t
  misc_feature (40)..(40): n is a, c, g, or t
  misc_feature (48)..(48): n is a, c, g, or t
  misc_feature (63)..(63): n is a, c, g, or t
  misc_feature (84)..(85): n is a, c, g, or t
  misc_feature (119)..(119): n is a, c, g, or t
  misc_feature (123)..(123): n is a, c, g, or t
cangtttccaagtttttccttggcccnccccagnagagantcccaccntcctccaaagaaagnggggggcttccacccaagttnnaatggctggatggaatttggaaggacatggtggnctgnaaagcgggctcatcccagatggctgtggggtcaagtacatccccagtcgtggccctctggacaagtggcgggccctgcactcatgagggcttccaatgtgctgcccccctcttaatactcaccaataaattctacttcctgtcc

SEQ ID NO: 568924 - DNA, 196 bp, Homo sapiens
ctcttggcgtggcacattgtggggctctttgcgtggctcattgcgtggctctttgggcggctctatcaggctggctcgttgtggggctcattgtgcggctaattaagcgtggactcgtggcgggccctgcactcatgagggcttccaatgtgctgcccccctcttaatactcaccaataaattctacttcctgtcc

SEQ ID NO: 568925 - DNA, 758 bp, Homo sapiens
  misc_feature (22)..(22): n is a, c, g, or t
tcatgctggtacggcccggtanttcagtatgtgaccggcgcctcgcgtggtgtgtgatgtccgcgacactagccgttgtggggggtattgtaagaacaagccgtacccaaagtctcgcttctgccgaggtgtccctgatgccaagattcgcatttttgacctggggcggaaaaaggcaaaagtggatgagtttccgctttgtggccacatggtgtcagatgaatatgagcagctgtcctctgaagccctggaggctgcccgaatttgtgccaataagtacatggtaaaaagttgtggcaaagatggcttccatatccgggtgcggctccaccccttccacgtcatccgcatcaacaagatgttgtcctgtgctggggctgacaggctccaaacaggcatgcgaggtgcctttggaaagccccagggcactgtggccagggttcacattggccaagttatcatgtccatccgcaccaagctgcagaacaaggagcatgtgattgaggccctgcgcagggccaagttcaagtttcctggccgccagaagatccacatctcaaagaagtggggcttcaccaagttcaatgctgatgaatttgaagacatggtggctgaaaagcggctcatcccagatggctgtggggtcaagtacatccccagtcgtggccctctggacaagtggcgggccctgcactcatgagggcttccaatgtgctgcccccctcttaatactcaccaataaattctacttcctgtcc

SEQ ID NO: 568926 - DNA, 776 bp, Homo sapiens
agcggctctttcccttcggtgtgccactgaagatcctggtgtcgccatgggccgccgccccgcccgttgttaccggtattgtaagaacaagccgtacccaaagtctcgcttctgccgaggtgtccctgatgccaagattcgcatttttgacctggggcggaaaaaggcaaaagtggatgagtttccgctttgtggccacatggtgtcagatgaatatgagcagctgtcctctgaagccctggaggctgcccgaatttgtgccaataagtacatggtaaaaagttgtggcaaagatggcttccatatccgggtgcggctccaccccttccacgtcatccgcatcaacaagatgttgtcctgtgctggggctgacaggctccaaacaggcatgcgaggtgcctttggaaagccccagggcactgtggccagggttcacattggccaagttatcatgtccatccgcaccaagctgcagaacaaggagcatgtgattgaggccctgcgcagggccaagttcaagtttcctggccgccagaagatccacatctcaaagaagtggggcttcaccaagttcaatgctgatgaatttgaagacatggtggctgaaaagcggctcatcccagatggctgtggggtcaagtacatccccagtcgtggccctctggacaagtggcgggccctgcactcatgagggcttccaatgtgctgcccccctcttaatactcaccaataaattctacttcctgtccaaaaaaaaaaaggggacctctagagtc

SEQ ID NO: 568927 - DNA, 186 bp, Homo sapiens
ctgggcggggaaagcattcagggggagactccatggaagcatcctcagctttgtctccctatgggaactttccctgcacaggttggtgcggttaggctggaaccagttcccccatgggtaaacttgacccttcaagccccctcgggcggaaaactcccactcttcctcgatgggcctctagaattg

SEQ ID NO: 568928 - DNA, 783 bp, Homo sapiens
agcggctctttcccttcggtgtgccactgaagatcctggtgtcgccatgggccgccgccccgcccgttgttaccggtattgtaagaacaagccgtacccaaagtctcgcttctgccgaggtgtccctgatgccaagattcgcatttttgacctggggcggaaaaaggcaaaagtggatgagtttccgctttgtggccacatggtgtcagatgaatatgagcagctgtcctctgaagccctggaggctgcccgaatttgtgccaataagtacatggtaaaaagttgtggcaaagatggcttccatatccgggtgcggctccaccccttccacgtcatccgcatcaacaagatgttgtcctgtgctggggctgacaggctccaaacaggcatgcgaggtgcctttggaaagccccagggcactgtggccagggttcacattggccaagttatcatgtccatccgcaccaagctgcagaacaaggagcatgtgattgaggccctgcgcagggccaagttcaagtttcctggccgccagaagatccacatctcaaagaagtggggcttcaccaagttcaatgctgatgaatttgaagacatggtggctgaaaagcggctcatcccagatggctgtggggtcaagtacatccccagtcgtggccctctggacaagtggcgggccctgcactcatgagggcttccaatgtgctgcccccctcttaatactcaccaataaattctacttcctgtccgcaccttaaggggggatcctctataatcgccgag

SEQ ID NO: 568929 - DNA, 386 bp, Homo sapiens
tgtgtccgtgtggagggctgcagagcctgcagggtgacctggttccccaaaggccaacagcattggcctggccaaaccaggtgacattagatttggtgaacaacgtactatggaagccacatcagtattgggcccccaggtctgatgtgggttttgcatctgcccttggtgatatgctatgaggcattcgcgcccttttctttaagtcatattgagcctgtcatttctctttcacaaaggcggtgtatttgggtgttgatggagtatgtttccttttcaaagtaaagttgtttcaacaccagcggaaacccatggagtttgtcctttgtaaaaactttcaagtcagtgtcccgatatcctgatcacaaatccggttagcactcccc

SEQ ID NO: 568930 - DNA, 1196 bp, Homo sapiens
  misc_feature (1196)..(1196): n is a, c, g, or t
agcggctctttcccttcggtgtgccactgaagatcctggtgtcgccatgggccgccgccccgcccgttgttaccggtattgtaagaacaagccgtacccaaagtctcgcttctgccgaggtgtccctgatgccaagattcgcatttttgacctggggcggaaaaaggcaaaagtggatgagtttccgctttgtggccacatggtgtcagatgaatatgagcagctgtcctctgaagccctggaggctgcccgaatttgtgccaataagtacatggtaaaaagttgtggcaaagatggcttccatatccgggtgcggctccaccccttccacgtcatccgcatcaacaagatgttgtcctgtgctggggctgacaggctccaaacaggcatgcgaggtgcctttggaaagccccagggcactgtggccagggttcacattggccaagttatcatgtccatccgcaccaagctgcagaacaaggagcatgtgattgaggccctgcgcagggccaagttcaagtttcctggccgccagaagatccacatctcaaagaagtggggcttcaccaagttcaatgctgatgaatttgaagacatggtggctgaaaagcggctcatcccagatggctgtggggtcaagtacatccccagtcgtggccctctggacaagtggcgggccctgcactcatgagggcttccaatgtgctgcccccctcttaatactcaccaataaattctacttcctgtccaaagaaaaaaaaaaaaaaaaaaaaaaaaacaacgtgggtgggcgcgcgccccgggccccggcgaaaaaagccttccagagaacccaccgcgcggtgaggcggcgcgcgcgggacccccgagaggcggcaacagtggaaaccgtgggcccaaagcggtgttcccacagaggagagacccctgggcggcaagagagacaatagagcgcgcgcgggagcatctcccacacccaaaaatataaaaaaaaacgcccccgaggcgggaacaaccccgagagagacggttcgcgtgaacaaaaattcctccgagaagggtgcagcgtcttcgagaggggactcaatacatagagggaatacttattatcaaacgagggagagtaccccaaaggaggaaagacctctcaaaaaatatcaaacaatatatacaccccgaactctgtggtgggaccn

SEQ ID NO: 568931 - DNA, 139 bp, Homo sapiens
ccaagcaatatggggtgtgtgtgtgtatatatacacatatgttaatatatgagtggcgtgtgtgtgtgtgaagtgtgtgggtgtgggtatcgtgtatgttagtttatgtgcatgtgtgaacatgaatgtatgagtggcg

SEQ ID NO: 568932 - DNA, 777 bp, Homo sapiens
agcggctctttcccttcggtgtgccactgaagatcctggtgtcgccatgggccgccgccccgcccgttgttaccggtattgtaagaacaagccgtacccaaagtctcgcttctgccgaggtgtccctgatgccaagattcgcatttttgacctggggcggaaaaaggcaaaagtggatgagtttccgctttgtggccacatggtgtcagatgaatatgagcagctgtcctctgaagccctggaggctgcccgaatttgtgccaataagtacatggtaaaaagttgtggcaaagatggcttccatatccgggtgcggctccaccccttccacgtcatccgcatcaacaagatgttgtcctgtgctggggctgacaggctccaaacaggcatgcgaggtgcctttggaaagccccagggcactgtggccagggttcacattggccaagttatcatgtccatccgcaccaagctgcagaacaaggagcatgtgattgaggccctgcgcagggccaagttcaagtttcctggccgccagaagatccacatctcaaagaagtggggcttcaccaagttcaatgctgatgaatttgaagacatggtggctgaaaagcggctcatcccagatggctgtggggtcaagtacatccccagtcgtggccctctggacaagtggcgggccctgcactcatgagggcttccaatgtgctgcccccctcttaatactcaccaataaattctacttcctgtccaaaaagaagaaaagtcgacgcggccgcg

SEQ ID NO: 568933 - DNA, 351 bp, Homo sapiens
atggatgaggctggcacctgagcagtccagcgaggaacttggtattagttgagcaatttggctaggatgatattatgcagcacgagttcctagagtctgtgggatagctgccatgaagtaacctgaaggaggtgctggctggtaggggttgattacagggttgggaacagctcgtacacttgccattctctgcatatactggttagtggggagagcctggcgctcttctatgcgctgagctaaagctacatacaatggcttttgtggccacaattctaccgttcatttctgtaactgctttagtggcttcttctggggaggagaaacatacaaaaccaaaccctttgctgc

SEQ ID NO: 568934 - DNA, 545 bp, Homo sapiens
ggccgcctgagaggaatgatgcggagaacatggtcatctctgcctcttgaggaatgtgtttgtctgaccagtgataaccagctctctcagcaggatgtggccagaaagaacacaccagccctcgtcctgttatagctagagggtctggattcacagagcaggagcattgccatctacgacacacactgccatcttggaaccattacaccatcttggacacacaccagccatcttgtataagcaccaccaccttggacacacaacatcttgaacacacatggccatcttggagaagcaaccaccatcttgcacacacactgccatcttggataagcaccaccatcttggacacacaacatcttagacacacacggccatgttgaataagcaccaccatcttgaacaacacaccgccatctggaaaaaacacaccatcttggacacacaccatacttggacacaaacggacatcttggaatagcaccaccatcttggagaaacaccatcttggacacaagcgtcatctggctagggtaccgagctcg

SEQ ID NO: 568935 - DNA, 115 bp, Homo sapiens
aggatcgccgtcacatgcagatcctccactcacatgccactgatcgcatcttggaacaactgcccaaggaatttgagatggagctcatacaggcaattccctttcagatccatgg

SEQ ID NO: 568936 - DNA, 188 bp, Homo sapiens
tcatctttctcacaaataattgcagaatagcagacagacgtcatgacgggctcaaactaacgtgttggatactatctgctgctcactcagtgttggcctctatccagtctgaacacccgcatggttacttgctgcccttccttcagcatgcttctccatgctgcctgtacatgctccatcggactggg

SEQ ID NO: 568937 - DNA, 350 bp, Homo sapiens
tcgctaggcacagagtggatcttatctcaactagtaatatatgtaataactaggtcgcagagttctgacgccgtgagtatgtcatgcctgggggcaccgagggcatggtgtgctttgttcatgagtgttccacagcacctttcagagttggtatggtgcctgttccatggaataaaagctgaagcctagagttggtctgtcattgcctctgacagtagcgttgataaacgaattactacaccaccgtccctgcagctccctaagaccttgcacaggtggtcagaggtgcctgggggaggttagcttccaggcgtgagaagagtacaccctggagtacaacctgccggtgg

SEQ ID NO: 568938 - DNA, 173 bp, Homo sapiens
cgtacacatagtgtacgaatccatttatatgaaacgtccagagcaggcagattcatagacagcaagtagattagtggttgctagaggctagaggaaggagggcggagggagagactgctaaagctgggtttctatttggaccgatgaaaatattccagaattagatagtggcc

SEQ ID NO: 568939 - DNA, 259 bp, Homo sapiens
tggtcgtagctggaccggtgatcaatgatgagaggtcatcatggagaaacccttggggggtgaaagaggtgggggaggcggcagggaggtctcctgagggatggcggtgtgggtcccgcctggtcccgcccggctgcaaagacgtggggtgtgtgttgagtgccagacggggctggcttgattcaggcgtgcctttacatgttatcagccgtgggtctgaccacggccatgccatgacctaatagctaacctcaatttc

SEQ ID NO: 568940 - DNA, 203 bp, Homo sapiens
  misc_feature (200)..(200): n is a, c, g, or t
atcctcgggcatctggactgtattagggctgagcaagaaatggggaaagaagataaagatattaaagataaatgtcaggacttgatggctaatgctttgggagagaagctagtagtgagacagagactggagacgcactatgaaaatgaaaggcatgcacagaatgtaagacattaacaacaatttaaccaacaaatggncca

SEQ ID NO: 568941 - DNA, 417 bp, Homo sapiens
tctaattgtggtgtctttcaagtataacagcaaaagatgctgccttccagccatagtcttagaatcactgaacctaggctgacgggcattgcctcctagtaggtataccagcctgtcaatagccactggatgacagcagccccacagtcttgtgtgtaatcatcgtgccttctggccgtgtggcagttatccatgcacagttccataagagcgtcatgggttgcctccttgagagaagccttaccttctgagacaacctgttcactgtatggcagggcccgaccatgacaaatgcttagttcacacgcctctggtacatgacattggttgacagcagtaagatggagagtgacatacttgtctcgcatggcagcagccagtgaacggatgccaggacaaactacagatacagtccgg

SEQ ID NO: 568942 - DNA, 1122 bp, Homo sapiens
gaaagaggacctgatgaccagctgcagagagcagctacggttgtcaggagttcgagaccagcctggccaatatggggaaaccctgcctctactgaaaatacaaaaattagctgggtgtggtggcaggcgcctgtaatcccagctactcgggaggctgaggcgtgagaattgagaatcccttgaaccctggaggtggaggttgcagtgagccgagatgggccactgcactccagcctgggtgaaagagcgagactcagtctcggaaaaaaaaaaaaaaaaaaaatttagagaggacttacctttttgtgccgtagagggggacaagattccccgttgcgggggaattacccttctcacgggggacctcctctctggaggttgggtttaaaccctctcaggtaaaaaggctccctttggggtccttggttacaccccacattggatctgggagacctctacatttctttcccggggatgcgcgggaccaagagaacccccagggcaagggtggccaccaaacacacgggaaggtctcttcctgctcagcgaacaagtgttggacctcgtgcaaaaaggctccccggttaaacagaaaggtttgttaacaggttaccccccaagtttttttctccccaaaattctctgtgaacagaattgggtgtttctcccaggggggggggggggggacattgttgttcagggaaacctcaagccaaaggcgcggaaatttccacaacaccttttccagctttttttgcggagcaaaacagttttggccacctttttctcctttagaaacgtgggctcttgagggcgcttttgaagcgcctgtggaattcgcagcataaaactttaaaagagcggggacgtttcccgagattgtgtgccctcccattcaggggggggaaggggacaagttattaattcctctaccatattcacaggcttaacaagattgcgaaatcttgtgcttgccaacgagaattttggtcctcccctcctccctttattcttccctcggggaacagaagatgtgccaatttttcttccaacaattctttaaacaggcacgagttgaggctccactttggcccacgctgtatggaactcttaacattttcg

SEQ ID NO: 568943 - DNA, 170 bp, Homo sapiens
atctcgacaggtacaggagttactagagtcactatccggcaaatctacgaatatctcttagtcatcacaacaaccagatgtctaccagagccctgcttcagatacttacatagttagaggggaagccccgatcgaagatttatcccagacaagcacaacatagcagactg

SEQ ID NO: 568944 - DNA, 458 bp, Homo sapiens
tcactcaaacctggaaggtggaggttgcagtcagctgagatcacgccactgcactccagcctggacgacagagtaaggctccgtctcaaaaaaaaaaaaaaagaaaaagaaaaggagttaaatcttggcttttttttaacgtgcaagagcatcctttacatcagtgcatgtgggaagttttatccaagttagcagttccccgtgggatttataaaaattccccgaggcattttgtctgtggtgtggtgcccttttttggggtggttgttttttcacgttcccttccccttccccttttctcctataaacaagaggaggctttaccttgggaatgtccggtggaaagtcttaagaagcgggatgggtgtaatttggcctggctttcccttttagttggaacagcgttaactctgggaagaggtcagtggcctttttctgggtggtgatttatgcaagtg

SEQ ID NO: 568945 - DNA, 102 bp, Homo sapiens
gtgaggctgccagcatgtgcgatgagacgtgcacctaccttatgcaggttgccaggctctgaactgacccatggatggaccgtgagggcatccgagaatagc

SEQ ID NO: 568946 - DNA, 1225 bp, Homo sapiens
gtgacgagaagtgtatttatggcagtcaatttcagagatctgccgatgccggacatgtcgtcattctccgcatttctttgctgcctttctccctgtgatgcaactgtgacaatagctcaccagcatcaccacccccacaagcagccacactgcaagcattccatcacggccagctggccagcatcattcatccatcagttgcttgcaggtcattccgacagtggcattcactgtctgcatcataggttcaacatgcacaggttgctagcgtgtcaaattggcatgtagcggtcatccacactccatggtaccaactgcatcccacagtcgcaccaagggcacacagccaccacaacaatctcagcttggcgcagccatgttagagcactttctgcacagcttggtttcaacacaaatgaacacgctcgggctcttactcaacttccatgtatccagggacggctgtcggggaccccactggaccaggtggcacatcggcttccttgaatgcaacaccccctttcctggccgcttacataaaacacttcacttatagcgtacggacatccacgcatttgacacacggggacttacacaggacacaaccctggacacggtccactggactacttcagtgtacaaccttgtggaccacacacgggtgtacacacacccctttttactacttgtcgagctacacctaacgcatacttttaactttgtactaagcattggggctattgataattatatgatgttaccaatgtgcgcatgcacacattcgacttatgggctggaacattcaaggttgtgcagtattcagcatttaaggattaaataattggcaaatatatccatgtggagttacaagtatatcacttagtagggcagttttatcaaaggcagaaatgaatgcgccatcgtgacacaatctttgcccacaatctggacaacaagcatatctgtacggtacacccaacagctgtgggttctgaccacattctgtgggacgcggtgagtcactatggggctgtccaccttcaaccacatatctcacccactcaccgccaacgtcacacagcgtggggcatcacactatcacggtactacagtctagacacttatctactgtcttgtcgtgtgtcccccacactttacgtcaatatacttaaccagcacttagcggaccgtgccactgattctaccacaaccccgacagtcctat

SEQ ID NO: 568947 - DNA, 1505 bp, Homo sapiens
catggtgttgttggtgttgcggagtggaagatactatcttgcggctgttgtgtgttgttgttcatctcccggtgctggattcttgtgttttgtttcgttcagtccctcttctcccgttttggtgttgtgtggtcgtggtcagcatcctctgttgctgttcggtgttgcgcatgcgatgatgtgcgtcgggcggggtggaggtggggggtaggtgtccgtcccgccattcccatcgtgtggttgtttgtgcgtcacggccgcgagttttgtgttttttttatgcattcttagtggcgtaactggttgtgtgctgtccgtctctctccgtgttttgtgctgttggtattacgttcacgtgtggttggtttcgaagcctatgtgggtgtgagtatcattgcgtcattctttcagctgcattgctagttgctttttttgtgtgtgatgtggtgtgtaggtgtgtcgccctgtggtggttgttctcttgttgtcccgtggggcggagggttgtgtttttttttgttgtgtgttttgttgtcttggggttcggaggtttggggggtggggtggttgcctctggttggtcgatgtcgtgttgtgttctccccttgttttggtggtgtggttggtctgtcgttgtggcatgcgcgctagtgtgtgggtgggtggtcgataaattcatctggttagggagtgggatgtatacgtagtgatttttttgttctctgcgcggtgaggggggatggtgtgtcgtgacttagtacatggtgggctcggctgctccccacaacacgcgattcgggtgtgttttgtgacatcttatgttagtgtggttgtctagtagttgcttgcatgttgctgtcttcacgatctctctgcgtcgcgcgctcgcgcggcccgcgctgcgtggcggcgccctccctgcgctaggcggcgcgcgccgcactcgcgcggttgggttgtgttctctcacacgcgcattgtattgtgtgtgtcctctctcgctcggcgtactttttgtgtgtgtgctcctctcttctgtgtttcggtgtgttgtgctcacctcgcctcggcgcgcgggggcacgccttctcgcgcgcgggggcgctctcctctcttgtctatgtttgtcgtgctctcgccgctcgcgagaggagacgtcttcgcgcgcggcgcgcgcggtcgtaccttcctccttctctctctacgcgcggggtccctcgccccccagcagcgacaccatttgtgtattctctcgccgcgcggtgggtctgctcgccgccgtgcctcttccccgcccgcggggaggtgcggctctcccctccttttgtgtgtggctgcgcctcttcgcccctctcccgctgcgcccgcgcgggagcactctccccgcgcgctcctcccccccccgcgcgctccgcctcccctcccctcctctcttgtgtgggggggggccgccccccccccccccccctccttttttttatgagattattttttcttcccctcca

SEQ ID NO: 568948 - DNA, 803 bp, Homo sapiens
  misc_feature (2)..(2): n is a, c, g, or t
  misc_feature (68)..(68): n is a, c, g, or t
  misc_feature (88)..(89): n is a, c, g, or t
  misc_feature (91)..(91): n is a, c, g, or t
  misc_feature (97)..(97): n is a, c, g, or t
  misc_feature (114)..(115): n is a, c, g, or t
  misc_feature (117)..(117): n is a, c, g, or t
  misc_feature (123)..(128): n is a, c, g, or t
  misc_feature (148)..(148): n is a, c, g, or t
  misc_feature (170)..(170): n is a, c, g, or t
  misc_feature (190)..(190): n is a, c, g, or t
  misc_feature (208)..(208): n is a, c, g, or t
  misc_feature (272)..(272): n is a, c, g, or t
  misc_feature (303)..(303): n is a, c, g, or t
  misc_feature (326)..(326): n is a, c, g, or t
  misc_feature (368)..(368): n is a, c, g, or t
  misc_feature (505)..(505): n is a, c, g, or t
  misc_feature (507)..(507): n is a, c, g, or t
  misc_feature (573)..(573): n is a, c, g, or t
  misc_feature (575)..(575): n is a, c, g, or t
  misc_feature (588)..(588): n is a, c, g, or t
  misc_feature (727)..(727): n is a, c, g, or t
  misc_feature (737)..(737): n is a, c, g, or t
  misc_feature (742)..(742): n is a, c, g, or t
  misc_feature (768)..(768): n is a, c, g, or t
cngcaaacgggatgggtaattggtattcctctccttcttcctcaccctctccttcaacagagtccgcnccagcctcctcgtggtgcgnngngggggnggggggtatcttcacgnntntctgtnnnnnnaccttcctccatcccctcanccacgtaccagtgaacaaaggnacgcttgggatacatcaggncaaacttgtggtccaggngagcccaggcctcagcaatggctgtggtgttgctcagcatgcacacagctctctgtaccttggncaggtctccaccaggcaccacagtggggggntggtagttgatgccaaccttgangccagtggggcaccaatccacaaactggatgctgcgcttggntttgatggtgcgcaatggcagcattggcatctttgggaaccacgtcaccacggtacaacaggcagcaagccatgtatttaccatggcgagggtcacatttcaccatctggttggctggctcaaagcaagcattggtnanctctgctacagaaagctgttcatggtaggctttctcagcagagatgacaggggcatatgtggccananggaagtggatgcnggggtagggcaccaggttggtctggaattctgtcaggtcaacattcaggcctccatcaaatctcagggaagcagtgatggaggacacaatctggctaataaggcggttaaggttagtgtaggttgggcgctcgatatcnaggtttctangacanatgtcatagatggcctcattgtctancatgaaggcacaatcagagtgctccagggtggtgt

SEQ ID NO: 568949 - DNA, 606 bp, Homo sapiens
ctgtttagaaccgggtttgccgacacaacgcaggagtggagaaagctaccattaacagccaaaatgggaaagggaccgactcatatcaacatggccatcgttggacacagggattcggtcatgtacactattactggccatttgagctataaatgctgtgtcatcgacaaaggaactattgagaaattggataacgaggctgctgaaatgggaaagggctacttcaagtatgccagggtcttggataaactgaaagctgagcgtgaacgaggaatcaccattgatatgtccttgaggaaatttgagaccagcaagtactatgtgactatcattgatgccctaggactacagagactttatcaaaaacatgattacaggtacatatcaggctgactgtgctgtactgattgttgctgcagagagtggtgaatttgaagctggtatctccaagaatgggcggacccgatagcatgccctattggctaacacactgtgtgtgaaacaactaattgacggtgttaacaaaatggattccactgagccaccctacagccagaggagcattgatgaaattgtaaccgaagtcagcacttacattaaggtaaa

SEQ ID NO: 568950 - DNA, 400 bp, Homo sapiens
caacgagctcggccccattatacggaaagtcacaagcttattgtcatctggcagcaagcatggggaagggactgaagcagggttcacattggccaagttatcatgtccatccgcaccaagctgcagaacaaggagcatgtgattgaggccctgcgcagggccaagttcaagtttcctggccgccagaagatccacatctcaaagaagtggggcttcaccaagttcaatgctgatgaatttgaagacatggtggctgaaaagcggctcatcccagatggctgtggggtcaagtacatccccagtcgtggccctctggacaagtggcgggccctgcactcatgagggcttccaatgtgctgcccccctcttaatactcaccaataaattctacttcctgtcc

SEQ ID NO: 568951 - DNA, 399 bp, Homo sapiens
atagaggatccccccttgaagtgttgacaggtccaaaaggcatcgaggtgctttgaaagccccaggacattgtggccagagttcacattggccaagttatcatgtccatccgcaccaagctgcagaacaaggagcatgtgattgaggccctgcgcagggccaagttcaagtttcctggccgccagaagatccacatctcaaagaagtggggcttcaccaagttcaatgctgatgaatttgaagacatggtggctgaaaagcggctcatcccagatggctgtggggtcaagtacatccccagtcgtggccctctggacaagtggcgggccctgcactcatgagggcttccaatgtgctgcccccctcttaatactcaccaataaattctacttcctgtcc

SEQ ID NO: 568952 - DNA, 540 bp, Homo sapiens
aatatatatatatcttttccacataaaaaaaaaaaataaaaaaaaaaaaaaaaaaaaaacaaaaaaaaaaaaaaaaaaaaaaaagaggggggggctaaaaatctcccccggggggccccttccctccccccccttttttttaaaagggggccccctatagggggttttttaaaaacacgacggggcgctgtttaccaaacgtccggcgtgggggaaaaaacaccggccaggcctgccgggaacctctgttggtggaggaggagcccccactttcttctggggggggggccacactatgttgtggcgcaacaaccaccctcctcgaacaagaaatattatagccaccctcctagcaggggagacaatcaatcaaaacattttccaacgtgttgcttataggtgggttgaccaccaccgaggcgcgtatctttctatcggctggcgcgataaaaaaactatgtgtctcgctgagtggacttattatgattgataagaaaattatttatttagcccgcggggatcgttgatttaattataagt

SEQ ID NO: 568953 - DNA, 969 bp, Homo sapiens
  misc_feature (339)..(339): n is a, c, g, or t
  misc_feature (342)..(343): n is a, c, g, or t
cggcttgcagaaggataagcagagcatggacggtggccccagtgacctaagccactatgggctactagaaaagcaaggctggcaaagtgacatttccagcggtcaactcaggaccccttccctgcagatacaatcgagagcagtgagtaagtcatagcaagctcttccccacaggtataggggaaacactggtgatgggagtagctcttcttgctcttagctgcatgacaaccatcgtgccagccaggtagctgaagcctggcagaggacgcccagtggcgccttttcagtaggttcttgggaatgctccgcagccaacttaagccgactgagttcctntcnncatggggaccagtgtgcgatggctgcacacagcagcttccttggtagtgtacgcagcctgttggttgtatgggttgctctaagggaccttggagacaggcctttcaggtggatgttcatgtttctgaccttgcactaccccaatgtaggctccaaacaggcatgcgaggtgcctttggaaagccccatcctagggcaacatgatggcgcagggttcacattggccaagttatcatgtccatccgcaccaagctgcagaacaaggagcatgtgattgaggccctgcgcagggccaagttcaagtttcctggccgccagacaggtatcgtagtgcgtgcagcacgccgcgttctccgcaccatattgcctccaggctctccgtgatctcagttctgtatgccaatggctccgtgtagatccacatctcaaagaagtggggcttcaccaagttcaatgctgatgaatttgaagacatggtggctgaaaagcggctcatcccagatggctgtggggtcaagtacatccccagtcgtggccctctggacaagtggcgggccctgcactcatgagggcttccaatgtgctgcccccctcttaatactcaccaataaattctacttcctgtcc

SEQ ID NO: 568954 - DNA, 339 bp, Homo sapiens
  misc_feature (110)..(110): n is a, c, g, or t
  misc_feature (177)..(177): n is a, c, g, or t
  misc_feature (222)..(222): n is a, c, g, or t
  misc_feature (262)..(262): n is a, c, g, or t
  misc_feature (325)..(326): n is a, c, g, or t
ccccccgccaccatcacccacgtaccctaggtaggagctgtttaagaggatgcacctgggccgggcgcggtggctcatgcctgtaatcccagcactttgggaggccgaancgggcggatcacaaggtcaggagatcgagaccatcctggctaacacggtgataccccgtctctactnaaaatacaaaaaattagccgggcatggtggcaggcgtctgtactnacagctactcgggaggctgaggcaggagaatggcgtgaanccgcgaggcggagcttgcagtgagccgagatctcaccactgcactccagcctgggcgacaganncgaactccgtctc

SEQ ID NO: 568955 - DNA, 200 bp, Homo sapiens
  misc_feature (30)..(30): n is a, c, g, or t
  misc_feature (35)..(35): n is a, c, g, or t
  misc_feature (56)..(56): n is a, c, g, or t
  misc_feature (119)..(119): n is a, c, g, or t
  misc_feature (163)..(163): n is a, c, g, or t
ggaggttctggatgaaggctgaacacaggnttgtnaatgtcggtctgtactgaggncctcagggacttgaggtggcatttttaagcatggggtgcaggtgcctttctggatttggatgnggctatggaaagaacacagaagccaaggtcatgtgcatgaaatnaggagtttgagttaagtcacctcgggggattttttcc

SEQ ID NO: 568956 - DNA, 119 bp, Homo sapiens
actggccggcgctttagattgggaaaccactttcaaccttaatttaaattaaatggtttgaggttccgggggagaaccgactttcaaccgaaacttaaagcaattgttttaagttaccc

SEQ ID NO: 568957 - DNA, 222 bp, Homo sapiens
  misc_feature (6)..(6): n is a, c, g, or t
  misc_feature (37)..(37): n is a, c, g, or t
  misc_feature (46)..(46): n is a, c, g, or t
  misc_feature (49)..(49): n is a, c, g, or t
  misc_feature (73)..(73): n is a, c, g, or t
  misc_feature (116)..(116): n is a, c, g, or t
  misc_feature (160)..(160): n is a, c, g, or t
  misc_feature (169)..(169): n is a, c, g, or t
aggggnggttaaaccgcgtctccagtatatccaatgntattaatantcnaagtctcattcgtaatctcaaaanaataaatagtattcatattgccaatgaaacctcgatcggtggntcacctgttattccacattatcataaacagttaggtccatactngttttagtngttgacaatggtgtttacgtcagtcgacgtgcgatatcggtgcgcaagttagc

SEQ ID NO: 568958 - DNA, 156 bp, Homo sapiens
tattgtgatgcagactgctgcacagtgaccaactaggccacccaatgagcacttacactatcgtactccaaaagacacaggtatgttttgctaataaataatcagtgggaacagggtattcctctgtgtcaactcccccatacctcatcccctttc

SEQ ID NO: 568959 - DNA, 178 bp, Homo sapiens
ggggctagatataatggtaatacaaaaaacaattaaagtcatgtggttttggaagcaaagcaaacatttttggaaatgttttggaaatatggacacaaccacaaattcaagacattttttaaaaagcaacaagccagcttacaaagctttgaccaataaaacccaaaggcctcctctg

SEQ ID NO: 568960 - DNA, 341 bp, Homo sapiens
  misc_feature (5)..(5): n is a, c, g, or t
  misc_feature (18)..(18): n is a, c, g, or t
  misc_feature (24)..(24): n is a, c, g, or t
  misc_feature (29)..(29): n is a, c, g, or t
  misc_feature (36)..(36): n is a, c, g, or t
  misc_feature (42)..(43): n is a, c, g, or t
  misc_feature (56)..(56): n is a, c, g, or t
  misc_feature (62)..(62): n is a, c, g, or t
  misc_feature (77)..(77): n is a, c, g, or t
  misc_feature (97)..(98): n is a, c, g, or t
  misc_feature (101)..(101): n is a, c, g, or t
  misc_feature (137)..(137): n is a, c, g, or t
  misc_feature (197)..(197): n is a, c, g, or t
  misc_feature (264)..(264): n is a, c, g, or t
  misc_feature (278)..(278): n is a, c, g, or t
  misc_feature (283)..(283): n is a, c, g, or t
aatanatttataaatcanacgatntctcnatacgcncatagnnacatatggaattntgaganaaataaagcatgctntctctaggaatatttatacnnctntgtctctctcccttaatatatgcctctagctgctcntggcaatgatgaagtgttatgtatgcattaatgttttgcagccccaaaaggtgttcacantttttcctatataagatctgtggagtgtgtgtttcaaagagagaactacagaaatgttaaagcaggnaaaacctgaatgtnatgtncacattttcatcccacatggacaatgtatgtgttttaataaatggaattttcagattc

SEQ ID NO: 568961 - DNA, 847 bp, Homo sapiens
ggcccgcctacgcgggacccaaccgcgggaccggacgtgcactcctccagtagcggtgcacgtcgtgccaatggcccgtatgaggaggtgagcgtgtccggcttcgaggagttccaccgggccgtgaacagcacaagtgctgaacccagtcgtacgagaggggtctgaagcacattagtgaaggatgtgtgtcatctagttgccaagtaaggaagaaaagccttatgggaaagatccaaatagtgactttcagaaaaaacttgtgaaaggtaacagcaggtgcttacattacttagtgtagtggaaacacctcaaaaaagtggtagaatcgtggaggtgtcttcaggccaaactctgggggaaacagtgtgtggttctctgaaggattaaggaatcttgaggaatggcaaatccagtgtcctgtgatggtccgtgattgggttctaggtatcaataaactgtatactgtgcttggggaattccaatgtaggcaataagtgttgacaaccaccacacaaacccacaaacaaccgaacaacacacttgtgtgggcgggcgggggcacggcgcccctggagaaaaaacgtttcttacagagcaccactcgggctgtggcggcccggggggcccccagtgagggtatcgcggcacaccgtgggggccaaacgcggggtccaaaagaaaatcctcgggccatagaacctggggtgggggttttctcacccaataaaaaaaacggcgcgggcgacacaccgggcgggttctgcgacacaactcccagcgggcggtgtcggcaggccacgccgggtctcaacaccggaggccaagcaggtcggtagtagcatga

SEQ ID NO: 568962 - DNA, 428 bp, Homo sapiens
gaatgagaaggagatggtactcgctactgttacaacaccagttggtggtgacagtaacgggcgtacccgcggtggtttaacttcgcaaaatgccttgatcttatcctactgaagatgtgcctcgcaagctgttgagccacggcatgaaaccctgcagtcagcacgtgtgataactgcgagccagcatgacccccgggaccattctgatcatcctcactgcacgccacaggggctcagagggtggttgtcctgtaagcagctggctagtggcgttattacttgtgacctggacctctggtccgtcactcgagttcctctacctagcaatacaccagcaaattcgtccttgccacttcaaccaaaatcgatctccgcgatgttaaactccctgaacatcttactgatgcttaccctcaggagggtaccga

SEQ ID NO: 568963 - DNA, 269 bp, Homo sapiens
  misc_feature (32)..(32): n is a, c, g, or t
  misc_feature (39)..(39): n is a, c, g, or t
  misc_feature (41)..(41): n is a, c, g, or t
  misc_feature (48)..(49): n is a, c, g, or t
  misc_feature (51)..(52): n is a, c, g, or t
  misc_feature (55)..(55): n is a, c, g, or t
  misc_feature (57)..(57): n is a, c, g, or t
  misc_feature (69)..(69): n is a, c, g, or t
  misc_feature (87)..(88): n is a, c, g, or t
  misc_feature (158)..(158): n is a, c, g, or t
gacgggcagattacagcatttcagaagtctangctaacngnactaggnntnnttntnacatcattaganataacgagtacacttttnnagattctgcaaagctagtcaaaatgaagatgctgtgccttctgaacatatactacaaacacacatactanaaaacaatatatttatctttacaaaaattacagccagcatagaaagaaggatgttaatgatgaagattgcaacacatatttttagtacatatgtgttgcagtgtgcttccg

SEQ ID NO: 568964 - DNA, 322 bp, Homo sapiens
atcgagctcgccacccgctcttcactgcagcctgagcgacgccttataagatcttataagcggcactctgaaaataggtcccagtagccctcaggataacattgcagcagcattctcaccagcaccacttgcgaagccttcactgttaatgtgtgacatgggttcttgcttcgatggacacaattcccattgaccaagtactcagagtatcactgtggtgctggaaaccctgtcaagccctttactgcaccgtttcattaaatcctcacaagaaccctggtgtaagcgctgatattactgcttccatttccgaagagaaggc

SEQ ID NO: 568965 - DNA, 648 bp, Homo sapiens
  misc_feature (4)..(4): n is a, c, g, or t
  misc_feature (6)..(6): n is a, c, g, or t
  misc_feature (11)..(11): n is a, c, g, or t
  misc_feature (13)..(13): n is a, c, g, or t
  misc_feature (49)..(50): n is a, c, g, or t
  misc_feature (52)..(52): n is a, c, g, or t
  misc_feature (54)..(54): n is a, c, g, or t
  misc_feature (62)..(62): n is a, c, g, or t
  misc_feature (71)..(71): n is a, c, g, or t
  misc_feature (81)..(81): n is a, c, g, or t
  misc_feature (87)..(87): n is a, c, g, or t
  misc_feature (119)..(119): n is a, c, g, or t
  misc_feature (147)..(147): n is a, c, g, or t
  misc_feature (158)..(158): n is a, c, g, or t
  misc_feature (166)..(167): n is a, c, g, or t
  misc_feature (174)..(174): n is a, c, g, or t
  misc_feature (180)..(180): n is a, c, g, or t
  misc_feature (185)..(185): n is a, c, g, or t
  misc_feature (198)..(198): n is a, c, g, or t
  misc_feature (204)..(204): n is a, c, g, or t
  misc_feature (207)..(208): n is a, c, g, or t
  misc_feature (211)..(211): n is a, c, g, or t
  misc_feature (213)..(213): n is a, c, g, or t
  misc_feature (221)..(221): n is a, c, g, or t
  misc_feature (224)..(224): n is a, c, g, or t
  misc_feature (228)..(228): n is a, c, g, or t
  misc_feature (230)..(231): n is a, c, g, or t
  misc_feature (233)..(233): n is a, c, g, or t
  misc_feature (238)..(238): n is a, c, g, or t
  misc_feature (259)..(259): n is a, c, g, or t
  misc_feature (269)..(270): n is a, c, g, or t
  misc_feature (282)..(282): n is a, c, g, or t
  misc_feature (284)..(284): n is a, c, g, or t
  misc_feature (286)..(286): n is a, c, g, or t
  misc_feature (291)..(291): n is a, c, g, or t
  misc_feature (309)..(309): n is a, c, g, or t
  misc_feature (317)..(317): n is a, c, g, or t
  misc_feature (321)..(321): n is a, c, g, or t
  misc_feature (326)..(326): n is a, c, g, or t
  misc_feature (353)..(353): n is a, c, g, or t
  misc_feature (368)..(368): n is a, c, g, or t
  misc_feature (379)..(379): n is a, c, g, or t
  misc_feature (390)..(390): n is a, c, g, or t
  misc_feature (397)..(397): n is a, c, g, or t
  misc_feature (401)..(401): n is a, c, g, or t
  misc_feature (442)..(442): n is a, c, g, or t
  misc_feature (461)..(461): n is a, c, g, or t
  misc_feature (503)..(503): n is a, c, g, or t
  misc_feature (537)..(537): n is a, c, g, or t
  misc_feature (635)..(635): n is a, c, g, or t
taangnaaaananttcattttatttcttaaatgcctgaatatttaaaannananaaattttnatccattanataatttatnaccaantgtactttcaaattaattaaaaaaattagganactctaatttaaccacttctgaaaaaangaatggctgancaaaaaanntcaaaanacaaanaaaancccaaaattttancaaaancannaanancatttaancangaanannantattnaactttaaaaaccaaacttanagttttaaannaaaaacccaaantnantcaanaaaactttaccccaaaanaaagccanaaanggaanaaaggttttaattcaaaattttattanagtccacgtaaaaanaaaattttcangagggttacangatgganagcnagcaaaaaaaaaatgctagcacagggtggtaactgccaacnaagcatgccctgaaccaanaaactacttcagtaagtccttgattattgccagcttttctanaatgttcaggttcccaaaggtcactgaattttanaattatctccaaacaattttcttcatggtcatttaagctttgtctaaacagctgggtgtgttgccaagcgacatcaccatctcctctgcttaattctncaaaaaaaaaaaa

SEQ ID NO: 568966 - DNA, 148 bp, Homo sapiens
atggcagagtctacacgtgatctgacggacatatatggtacaagtattcaactagcttattagaatactccctaaatgcagtagattaataaaaaaaatcaaatctacaagtgggttcagtattatgtacgaattggtgaacaagaaa

SEQ ID NO: 568967 - DNA, 405 bp, Homo sapiens
  misc_feature (405)..(405): n is a, c, g, or t
agcaatatacttgctagagctatcggcgcgcctatctatgttgtataccacactatctatgctagatctatctatgctttatactatctatttcgaacattgacttaccatatctttatcatgagacaagactcattcttacactgcactgtaccagcactcgtatcatgggtcgcgacagcctatagtctgagcccagaagtacgcttcggatgacctcatacgagacgcatgaatgtgtacactgacctcctagagcgagctggatatatcatagcacagatagacctagaaggaactcaatgctctgatcaggctgagcgtcgaactcaagctacgcactgatcggagcactgatagcaggagcccatacactctcatatggtcacactagccatcagtctn

SEQ ID NO: 568968 - DNA, 585 bp, Homo sapiens
  misc_feature (2)..(2): n is a, c, g, or t
  misc_feature (9)..(9): n is a, c, g, or t
  misc_feature (15)..(15): n is a, c, g, or t
  misc_feature (103)..(103): n is a, c, g, or t
  misc_feature (112)..(112): n is a, c, g, or t
  misc_feature (145)..(145): n is a, c, g, or t
  misc_feature (156)..(156): n is a, c, g, or t
  misc_feature (173)..(173): n is a, c, g, or t
  misc_feature (183)..(183): n is a, c, g, or t
  misc_feature (314)..(314): n is a, c, g, or t
  misc_feature (347)..(347): n is a, c, g, or t
  misc_feature (406)..(406): n is a, c, g, or t
  misc_feature (439)..(439): n is a, c, g, or t
  misc_feature (455)..(455): n is a, c, g, or t
  misc_feature (488)..(488): n is a, c, g, or t
  misc_feature (538)..(538): n is a, c, g, or t
  misc_feature (553)..(553): n is a, c, g, or t
  misc_feature (572)..(572): n is a, c, g, or t
  misc_feature (582)..(582): n is a, c, g, or t
gnagaatcncaccgncccctccttatccccctccaaaaataagccattgcacacagacaggcagcatggctagcatacgaaaatctacaactccatgcatggntcggacatnacaagtagtagaacaagatgtgcccgaggaagnagacagggccnaagagaaaggaatcggnacaccacagnctgacgtggccaaggacagctgggcagcagaacttgaaaactcttccaaagaaaacgaagtgatagaggtgaaatctatgggggaaagccagtccaaaaaactccaaggtggttatgagtgcaaatactgnccctactccacacaaaacctgaacgagttcacngagcatgtcgacatgcaacattccaacgtgaattcttaaaccccttttacgtgtgtgcngaatgtaactttttacaaccaaaaagttccganttccctattccgaccnacaaattccaagtttccattcccgggggaaggncaacttttaaagcttgaaagttaattaaaccgccattaattcaaacctgnctttggaaacaagtncattcgaaaaccacccaanccttgtcgtngtt

SEQ ID NO: 568969 - DNA, 366 bp, Homo sapiens
  misc_feature (258)..(258): n is a, c, g, or t
tttttaaaaactacttcagtgattttgatttatattctttttgatagttcagaagtgtattgttaaaaaacataagcatggccgggcacagtggctcacgcctgtggtcccggctctttgggaggccaaggcgggtgaatcgcctgaggttgggagtttgagaccggcctggccgacatggggaaaccctgtctctaccagaaatacaaaattggccgggcatgatggagcatccctgtagtcctagctgcttgcaanggagggggggaggcttgcttgcacccgttaggcggaggttgcagtgagccgaggtcgtgccattgcactccagcctgggcaataagagcaaaactccgtctcggaaaa

SEQ ID NO: 568970 - DNA, 989 bp, Homo sapiens
gctagcttttctcttctgtaaaccccacacgccttctgggcacaatgaagtgggtaacctttattttcccttactttattctctttagactcggtttattccatgtgtgtgtttcgtcgagatgcagacaattagtgaggtttgatcatactggttattaaagatttgggagaatgacacaatttcaaatgccttggtgtgtgattgcctttgtctcaagataattttctagactaagttagttccatttttgaaggatcgatgtaaaatgtaagtcgatacttgaagtaatctgaacttttgcaaagaatacaagtgatgtttgctagtatgtaggtcaagtcgttggaaaattgtgagctaaatatccacgtgtcaataccccgtatattttggtagacgttagttactgtcacttagttttgcatacttctttcgtagaaactctattggatgaaactcgtattgtactgtctgtggcaagatacaagaaagcccgtgtacgtaggaaaatgaactgctttctttgttaaccatcagatagggatgaccaaattgcgcaaaacgcttcctcccgatttgggttgaaggaaccaaggagggatttgactgctgatggtggtcgactggacttatgcctatgccaactatatgccacagagaggaccattttctgtgatggagaagagataactattataattgctaaaagtttgctcaggcaaaggatacgaatctcctataagcttattaatgcccgcggaagctcgcttattcttttgctaaaaggtataaaggctgctttctacatgaatggttgctcaagcgtgcttgataataggccttgcttgcccttgtttggcaaaagggctcgattgcagctttcgggcgattgaagggaaaggctttcggtctggcaaaagagatagacttccaggtgtggcaaggtcctcccaaaaattttgggaagaaaacgaagccttttcaaa

SEQ ID NO: 568971 - DNA, 108 bp, Homo sapiens
gggagtgttagtctgtttagttgatcagtttatggcatgttaaatataaccattgccatatgttaacaacgattttccattaaataatgcttttgataaaaaaacttt

SEQ ID NO: 568972 - DNA, 267 bp, Homo sapiens
catgtcagccgtgagatgtagggggtggctgcgtgcaacacagggccgagatggacatggtggcctggtgtgtggagctggcctcagtggatgcagcacattaacagccaccggggcatccataactccatcggcgactatcgctgggagctggaccaaaatcaaagccgacctgtgcgagaaatctgcgatctaccagttggaggaggagtatgaaaacctgctgaaagcgtcctttgagaggatggatcacctgcgaacctatga

SEQ ID NO: 568973 - DNA, 871 bp, Homo sapiens
aggtccgagaacatgtgggagccgcttagtgtggccctcgggagtcagcctgtaacacagtaggcattcggaacacgggcgaaaaaaaaagggtggcccaaaaaccaacacgggcggggaacccccccccaccaagcactggtatacagccggccactattatccgaagccggggcgccccaacgaaatgctcgaggtcctggagcaaacaaaaggcggttcgtgccctagttgacaccctggcgtccctccccgcctctaaaacaaaggacttaggaaaaccaccggttgggcccagaaagcggaaatggacagcccaccgggagcgatacaagaaccgaacttttcctgggccatcacatgcgcgtgagggcccaaggaggccgtacattcgctgggaccaccccctagtcccgcaaagtttctttccacagacacgtcatcccatccatggttatccccagcaagggggtctgtggatactacctagtaacgtcgcaactagcctgtcataaatgttttgggcgacaacccctccgccacatttgtgatgcttgattctacccacaatgagcttcaggtgcggacttatcatctgttaatttggaccacacaaaaatcgcgatccatggatacctataaatgaagaatcagctgctgtgcccccaccatatgagatcaagcgagggtatcccgcttaaaaacagagcagagcggcgcacctcctcttcaagatattggttcgtacagacatcggtgacactagagacagccaaaatgtaaacgaggggcaatggccctcaagaacacggcgacttcggactatttacgggggggcctcccaacaaaaacgaaaaaaaaacaaacatac

SEQ ID NO: 568974 - DNA, 687 bp, Homo sapiens
caggactctcccatgaggggcatatgtcacgctaaaacccactgctgtttgtctcttagtcatttctttacccaagctgtgttaagattttttccctactgcgctgagaatgaaactaagtcctttttgatgagccctaaatcctgtggctttgtttttccacaatcccataaactagataagaacggtattggcacagaatatattttaaacatttgtatgaaaaatgggacccacacgttctcacgtgcttctggtgttgaggcaacagtgatggctggcggagatggagatttgacagctttgaagaagattctgcgtaagccccttagcacggcgctcccctcttcttcccagacgtgacactcgacggcggctctgaactgggctcgttccttcgtcatgttacccccggctgtggtctagagggacgcacctgatagaaatacaatgtcaagccctgagtgtgaggcacgaatgccaatttacactttttagccgccaccgttccaagaaggtaaaagaaaacaagtggaatgaaccttgataatgtattgtcatattacctcataaacccttaatttactttcaagggaatccatattaaattatttaaaacccattttataataatggttaaattaacaaccctaattaccattttttgcgatggcttgtgggggtggt

SEQ ID NO: 568975 - DNA, 1002 bp, Homo sapiens
ggtgagctgtgcccctgctccatgcagctgtctggacggcttccaatctgagagctctgtgttcatttctaccttgtgctgatttaatttacaacctggggcaaatctcctgagctcatttccttgtctattaaatacaaggtgtctgagacgtctcccatggatttgagaaggctgttgggaaaactacagagcaaacttctttactctgcctacagcaagctctgcaggatggatttcagtgttcagcgtccctggacatctgcctctaaaacaaatctgcaccacaacagaggtggcatcagtcaacacaaagggctcagaaaggttggggtgaaactctccactcctgctttcataccatttgaagttcagaccagtgagatttccatcagttgggagttgaagatgccacaaggacaagaactgaggatggtttgctcagagctgatttttagacaccattttccagggatccctggtgacagaggagcatttttttgtggttgagttctgaattaaaaagtgtcgtactataaagaaaaaacacaaaaacaaaaaaaaacgaccgccgggggccacctatatgtccggggggcggaaaaaaggagggttatgtgaacgggccacgtggcccactacgagtggtttccgggaccccagcttctcttggtaccacaaggctggcaaactctgcgcggggtccccccccataataggggggaggcccggtattaaaactttcggaattaaagcaccgggtttaacccccgggctctagaaaacgcggcgggagcaacaaacggggggagagcacgagcaggcgcagcaggaggcgggcgggcaggaccggcagcggacgtgagaaggcggacgtcataccgatggtgatgccagcccacacgacgacgggatgcgacgacgccgtccagagcaggagcgtcagacagagacacaccgccgccaccggcggcgaccaacgactagacgaaccgacacgcg

SEQ ID NO: 568976 - DNA, 918 bp, Homo sapiens
tggaaaggaatatggtccctttttgcaatgctactgtgtacacacacacacacacacacacacacacacacacagtgtgtgttagatctaaaatacacacacccacgcacacattcgtgtagtgtttagtggtgacctaactactatacacactatgcacacacactatactatatccattcatgtcattcattcagagtggtgttcccagtgtcgtgtgttgtcacgtgtcttatgcagtttcccattttcccatgtgaattatgcgtggaggggcaatcgttttctaaccagattgtctttctcagaacaaagcatcgtgggaatgacggaagatgttcggaaagagggagacggcaagggaagagagagctttaaatggaagagggttaatttcctaagaggaatgggggcgtgaagtgacatagagtgttgataccctccaaatctttgcaggtgggtagtggaacacgtgtttgtatcactcgtgggcggggtatatatctatatatccaaaaaaacacaatatccatccatcaatatatacatggtgggggatgagcaggtcaatagttgggaagaagggagtggcacatttattttctcaattatactcttaagtgggtgtccagttatcacacaaacagagaggacaccgtgggcaaacctgtggtgtacgcttttatatgaagggtttataatatagaaatattaacaaattctggcagttactaaagggaggatctccggaatatttagctgaatttctcagatttaactgatggttggttaagggaacagttaaaagaaatatggggataaaatatatattatggggtggagcggatccggaataaggatacaaaaatagcgtgggaaatgcaaagtgggtgaataacatttggtctgagaaaatgc

SEQ ID NO: 568977 - DNA, 972 bp, Homo sapiens
gctcttccactgccatcggaggcgggagagcgttgtggtgctagtgctctaagccatccagtgctatcctcgtcgtgcaggacaaacgctctcgccggtgcatgatgagcggatgatccttcgtggaaacctcgagggacagaagggggggtaacctagaatggatagtagctccggagttcgcggagaattgatcttgctccggatctcgaagattaagagcattcgatcatgtggaagagtagaccctagggatagagaaacaaattatgagaattgtcggacagaggtgtttagtgtaggggttcatcaccaattgatgtaaagtgatgaggattatctgcgtcaagatggggacagtttgccctctctaggctcctcgtggatgggaaccacatgcagcctctgggatcttcacaaatgggcaacgcatcgacagaaggcgatcggtgggggccaatacctatgggctgttgcatgagtgtgggccttgtcctttctgatcacctcgggagccttgcctcgaggatctcgagatgaacatgattcacatgctattggaatacccctggattgttgtgcgagatattactgtccagtgatgaggacggcacgccaacatgtgggtgggctgtagtcccgcttctcgccgcaacaaggtagtgacccataataatttagtcctccgggtggctagggacaagctgggcggggcagggaaaccgggcttacctaggaagcgtgatacccaaccgaattggggcacgagggcgtttgaaaccagctgaagagccttccaagaaagatcgccgtggcccggggccggcgggcagccctgactgggctccggaggccgaccttaccacagaaggggggaccaaggccgggtagcccagggtggggcgtgcaccccaacagttccaacacacttctccacccccccagacgaccacccccacagtaggtccgccc

SEQ ID NO: 568978 - DNA, 205 bp, Homo sapiens
acttctgcaccaccagaaattaaattgatggtggtgcagaagttagaagtataaagcgttgaggaagtataaagcgttgagaacgtataaagcgttgaggaagtatcaagcgtttagaagtatagagcgttcagacgtataacgcgttcaggaagtataacgcgttgaggaagtataaagcgttgagagtctttgaagtagatta

SEQ ID NO: 568979 - DNA, 101 bp, Homo sapiens
ggggtttttccctttttttgggggaagggacccaagtttgcctttcccccccccacccggggtggggggggttaaacaaaaaaaacggtttccccttttga

SEQ ID NO: 568980 - DNA, 918 bp, Homo sapiens
caaccttaggtctctcgacgaggaatctgccctcagacagccaggacttgggtcaacatggattagaagaggattgtatgttataaaagaggatttctcccaccttgacaccagcgcatgtagtgagcatatttctatgtaccatggtgcatatgattaatcttgggacaaagaatctatagaaattttgaacacatctgaaaaagaagcttaagtttgtatcagtccttttcttgttgctcatgaattcttaaaggattatgctttgaagtgctgtcatctatcttatggtgcttgagaatacctgcattgtgtggtatcatgttcagccaacatcattatgagaattaagttagattcccatgagccgataaaatggctttaaagaatatatatatagtttctgaaaacgtagcttgagaagcaaatggcaggtaatatgtcatacctacattaagactctgacttggatggtgaatcataatgatatgccccttttcttataagaacaaaaaagaacaatagtgaacgccagggactttgtaaagtgggggtcttggacttatctcacagggtggagtgtacctatatagctatgacttggatgtgctgcgagcaagcgacgcgtttgcctaccagtatgactgcgtaactaaacccgaattaggtccaattgcctcgtggcgccgaacacctcatagtagaccctgcccggatttgggtttccagggtctattattaagcgaatttccgtaaaatagaaagggggccctcaaaatcccgggccgacctcagacactctgcaggcccatgacataaaaaggcgcgtcaagacggaagaggactgtcacaccgcgcatgcccacaaccgccaattatgtacttccgcaaacgacacgggtaccaatcatcacgaac

SEQ ID NO: 568981 - DNA, 311 bp, Homo sapiens
  misc_feature (184)..(184): n is a, c, g, or t
  misc_feature (242)..(242): n is a, c, g, or t
  misc_feature (276)..(276): n is a, c, g, or t
cagggaagcagctcgtctgagtttcgttctcagagagagaataaaatagacagtggagcttttccaaatcacaaataaagccatcagcagtgctcctttcctgctgttccagccactgtggacatttgccatcctacattttcttctggtgtcctctggagtggctgtgctgctagagcctggngaactgctaggagctgcccagtgttatggagaggcggccgaagtggaatataagcccnctttcggcgcattgcggtacatgtgtgtcgtacncatttaatgtggcctcatcgtggactagtagaatt

SEQ ID NO: 568982 - DNA, 108 bp, Homo sapiens
ctgatgacacccgggcgaggaaggcgtaacggggcgatgaggtggagtccaggatgaggttcagcgcacctcggacatcttcggggctgacatccggagtctcggggt

SEQ ID NO: 568983 - DNA, 372 bp, Homo sapiens
acccttttggcccttgccgaaggggggtccgaactggtttggggcttcacattcgaatacgcggcgggccccttggccctatttttcatagcggaatacccaaactttttttataataaacacctcccccactccattcttcctgggaacaacatagggggcactttcccctgaactctacccaacatatttggtcaccagggccctacttctaacctcccggtttttaggaattggaacggcataccccggattcgggtagggccaattcatacccctcctatgaaaaaacttcctacccctccccctggcattacttatatgatagggctccatacccattccaatttccgggattccccctcaacccta

SEQ ID NO: 568984 - DNA, 1203 bp, Homo sapiens
  misc_feature (1203)..(1203): n is a, c, g, or t
ggagagagagagaactagtctcgaggttttctatgtctctatggcagttcccaaccattttatacagagtcccagtgtcaaaactctggtggaaaacagggtggggtcgggggatgacttccaactcaggaggtgtccagggtctcgcctttgatttcgttgaaaaggaacggcgtcctgggtactcccttcatgtcctggcgtgagagcggaggactcgtccaggaagagtgatgtaagacccgcttgatgtcatccacctgcacattcttgtgaccctttgggtgtattccgggacaacacacaagtctgggaagctttgtagatagacgctggagatggggctataagcagcagtgaccagttctccagcccagatagcggtgtacagaacccgtgtagagtgtccctcactacattctcacaaattctatcatttcacgtcgcaacccgagattgccgaagagactctgcatacagggatccttacctcgccatgataaggggagtggttggaaaacagatataagcagacccgagtcacagcagagtcataagtggggagaatgcccgaagaaaggggcctcatagagaacgcttggatgtgcccccccggaaattacagcggatgctagtgacaccacagggaatagtgatggcccaagtgaacatcacggaaacagagacgcccgaaatggatacaaattcttacacaggggtccccccagggtatgtacgaaaaaagcggacaacaaaggcattcatgaggagtgagtccaagaccatgtgtttgaggaacccctcgatgcaggaatttagaacagacagggaaaactcaccaaaggagggaaattaaaaatcatcaccaagacatatttgccccaattcacattcagcagacccacaatattacatgacacacagctttatggggccaacttgagcgacaacatgaaaaaccaagggagaacagtatcagggagaactttgaatcttccccacaagagaaggtataccaccccgtttaataaaggtagtcgcccatagagaagcgacccccatagggttagtaagcaagaacagttacgtaactaacagatgtaagcaaccactacagttgaaaagagggacaacgaggtgcgtgtggtggccaaccacaaccgcatccatggggcgaggtaatccatgggtgagaacaccccn

SEQ ID NO: 568985 - DNA, 411 bp, Homo sapiens
tcaaggccgaatctgctctccctcagattctggtctgtagggagaggccgtgatgagtgatgggagccttggtagggggaggactagggggcagaggggatttcctctggcaaaaggaagagtcagcccggcatctgccctacgccctttcccactgccgaccacccctccgaccctgcatcactgggctgcgggtgcatcttatcccattttacagctgggaaaagtgagacccagacgctccatctcagcttccccatgtggtgctgtgctctgtggtggccaagactgccatgttgccatgctgtgatgcagcaagaaagtcctcaccagatgcagccccttgatcttggacttcccagcctccagaactgtgagccaaataaacttctattgtttatcaattaaaaa

SEQ ID NO: 568986 - DNA, 700 bp, Homo sapiens
  misc_feature (490)..(490): n is a, c, g, or t
  misc_feature (634)..(634): n is a, c, g, or t
actgacctaatataatgccagcgttggtaaccattgacatagttaagaatcgcagtacttagaatttgtatttacaactagaagtgttaaaacaacattcctcatatagaaataatttaggcatatttgtatatgtgttattggtcagaatgatttatttacataacccatttctgctgttcagcagtataacaattgaataacaatttcattaaaatgtttacatatttaatcacaaaacagtttaatcattttatgatgttgctactactccataatttcaaaataattaaaactaatatgaagtggccacatggccacatggtcctagagacatatagttaataccttgtgttaaatataaatgcaccaagtaaatccgatataatatgcattcataataaatgtaggtgaacccacaaggctgatagaactcagaaataaactcaacatacaataatactgcttgagccagaaatacctgaagttnttatatttccaatttatatgtagtagatgcttaaagtggaaaatagtcgtatgatgacttattaagcaatgaagttagcacagtttctatttggacagaaaaatctgacttatatttcttttctctctctacgtctgatagctngtgtgaattttatcttgctttgcatcactggcataagctgtcgcattatcagcagaaacgttattt

SEQ ID NO: 568987 - DNA, 236 bp, Homo sapiens
cagatttcttcagtccaatgtccttcagaatgagcattagcaggggcttgaggaaggatctccggttccccttggcaaactctctgggacaggctgagctgctggctcaggtttgccaagaactcgatagacggagcgcttggtctgtgttcgttcgatgtattctcatctttgtccatcgagaatatggtctgatctagagtcaacgattgcagcgttcgaaaggcacgcaaaag

SEQ ID NO: 568988 - DNA, 197 bp, Homo sapiens
tctgggtctagggtgttcctgagaactaggggaaatcagtgaatgaagccacctatgatggcaatacagctcctagttgataggacatagctgtgaagtgagctacaacgttgtacgtgtcgttgtagatacgattgtctgagtgatgagatttgctatatacaactgccagtcatggcctcctcaccggtcaacta

SEQ ID NO: 568989 - DNA, 386 bp, Homo sapiens
agtgatagttggtagttgttagacaccccaccttcagcttgtactctaaagctttatctcgttataaatattcactgtatttaggggaagtatgtcctgttgctcaaaggattctcaaacctgccatccccaggaaaatcatgtattagtattgctaaataatggtctgtatcttctttgtattgaaggtggctagatgtttgctgtgaacattaataggagaattatattcttaaagtttacaccccctattagccttaagccatttaaattgataaactgagagagactaatagattttgctctcaggtataaaatccattatcttatcatattcctgagctccccccgactccgactgaatttgctgcagggtaccgagctcg

SEQ ID NO: 568990 - DNA, 797 bp, Homo sapiens
  misc_feature (230)..(230): n is a, c, g, or t
ggggaattggtgatgaggcgtgaggtaaatcatgcgcaccttgtgctcacggcataagcgctcgatctggtcggtgcggcaaccttcatcatcaatgtcgaccgtgaccaacttcgccccgagcttgcggaaaatttcccatgccggtgggtagctcagacgttccaccaggaccacgtcgccgggcttgagcagcaggctggcgctcaggaacagggacatctgggtgncctgggtcaggcagatattttcggcagtgaccgtcagcccacggttgttgcgcagcatttcggccagggcgcagcgcaagtgatagccggtgccttcgctgccgtagcgcacggtattggaggcaaagctgttgcgcagtgcatggcgatagtaacggtgcagaactgcctggggcagcaggcggtggtcgctggtgccgttgtcgaaaaacagcgcatcgcgccgatgctgtagagcgaccacttgggcattatgggtgaaatagggtaccagcggttgctccagtaacggcggcgcgaatgacggttgcgtaacgctgggcaggtgtttgagtgtcagctttacattgacgaaggtgccacggcgcggctcgctggtcagccagcccttggtcatggcttcttcgtaggccaggatcaccgtcttgcggttgacgtcgagcaagtgtgccatttcccgcgtgcccggcagtaacgtcccgggcggcaggcggccttcgaggatggcattgaccaagccttcggcgatcttgcggtaagtcgcctggcgtgcaccttcttcaagcg

SEQ ID NO: 568991 - DNA, 318 bp, Homo sapiens
gtcgcaatagctaaaacctccgggcagcatgtctgaaacacccgatatggctgagatcgagaaatccgataagtcgacacactgaagcaagacagagacgcaagagaaaaatccactgccttccaaagaaacgattgaccaggagaagcaagcaggcgaatcgtaatgaggcgtgcgccgccaatatgcactgtacattccacaagcattgccttcttattatacttcttttagctgtttaactttgtcaagatgcaaagcggttaggctcaagtttaaatgactgtgctgcccctttcacatcaaagaaccacgacg

SEQ ID NO: 568992 - DNA, 172 bp, Homo sapiens
gaatcaggtatataaatctattagtagccatgataaccttgatagttcttaggtggcctcaaagccgtcgagctgggggagcaactacagcatcgtgacgctgcacttacactagtacccctaccagaaccccacctccagccgcgagggagccgactggaggtcgatttcg

SEQ ID NO: 568993 - DNA, 687 bp, Homo sapiens
  misc_feature (1)..(1): n is a, c, g, or t
  misc_feature (109)..(109): n is a, c, g, or t
  misc_feature (121)..(121): n is a, c, g, or t
  misc_feature (131)..(131): n is a, c, g, or t
  misc_feature (138)..(138): n is a, c, g, or t
  misc_feature (153)..(153): n is a, c, g, or t
  misc_feature (177)..(177): n is a, c, g, or t
  misc_feature (182)..(182): n is a, c, g, or t
  misc_feature (190)..(190): n is a, c, g, or t
  misc_feature (197)..(197): n is a, c, g, or t
  misc_feature (204)..(204): n is a, c, g, or t
  misc_feature (247)..(247): n is a, c, g, or t
  misc_feature (254)..(254): n is a, c, g, or t
  misc_feature (260)..(260): n is a, c, g, or t
  misc_feature (340)..(340): n is a, c, g, or t
  misc_feature (380)..(380): n is a, c, g, or t
  misc_feature (408)..(408): n is a, c, g, or t
  misc_feature (452)..(452): n is a, c, g, or t
  misc_feature (463)..(463): n is a, c, g, or t
  misc_feature (546)..(546): n is a, c, g, or t
  misc_feature (617)..(617): n is a, c, g, or t
  misc_feature (624)..(624): n is a, c, g, or t
  misc_feature (627)..(627): n is a, c, g, or t
  misc_feature (666)..(666): n is a, c, g, or t
nggggggctcggcctcttttggtaagccaaagggacaggtttttaaaaacctaggcctcttcctagagttcccttaattttctgggccggatctttttttcttcctggnttgggccctgcnagggggtgcncggcttntcgggtgtttgtgtncttgtgggctctggtttttttgtnctggncttttggntgggtgnggttttntcctccggcgggggcgttttggggggtgtgctgggcgtggggngctgctncctggnccccttctctcttcgcgcggtgttccttcatccggccatgggggcgcggctgggtggtccagggggcggtgccggttgtnggctgtcgtgtgcctgcctatgtgtgtgtgttctatgggnactcaggccttagaatggtttcaaagtngtggctttcaaaattactgtttgcctcttcaaacttcacacctnagggaaatggnaacatgcagagcagggacacagaaggggcattagctggcgtggggtaggggcaagagctaattgtgaaggaagaaggcctganatcacgttgccatgtcggagaacagctgttctcgctgccctgcctctttgcgcgcatgttaggcagctccnggctccngcngcttgagtttctcttgggagtccccggagctggcttcgnccccagttaatgcggttctgg

SEQ ID NO: 568994 - DNA, 940 bp, Homo sapiens
ggctgagccagctactccgtccatttcactctccggcgctcgttctcacggctgtactcccgttccgctgcccgccctgccgccatgacggaactggtcatctacttcgctcaagcgacttcttggctcggtgaagtagctgtctgctcgtcacgccgatcgtcgcagagactggccgtggttcctgattcgatgcgggtcacagctgctgccttgctggtccagcacgccaggaagcacgactcgccgtcgactaagtagtacaagggcatcgtgcgactgcattgtccgcattccccgatgagcagggcgtgctgtccttctggaggtgctatccttgccagacttctttcgctagcttccccatctcacagccctcaacttcgtccttcaccggatatgtcctaggcatgatcttcgctgccggggcgtggatcgaagcatcgacttcagttctgtgccggtacctttgctgggtaatgctggcctccggcggtgcggccggcgcgatctccctctgcttcgtgtaccctgcctggactttcgccagagacccgcctggctagcggatcgtgggaaagtcaggcacgagagcgcgagttccggaggcctgggagactgcctggtgaagatcaccaagtccgacggcatccggggcctgtaccagggcttcagtgtctccgtgcaggcattccatcatctaccgggcgggctacttcggcgttgtacagatacgggcaagggcatgctccccgaaccccaagaacacgcacatcgtggtgaagctggatgatcgcgcagacccgtgaccgcccgtggcccggcgttggtgtcctaacccttcgacacggtgcggcggggctgatgaattccgtcccggggcgcaaggagctgactcctgttcacgggccccgtcgcttgttgggggagatcttcgagt

SEQ ID NO: 568995 - DNA, 191 bp, Homo sapiens
cggcacgaggaagaaaagaaaaaagaaagcattctgaaaactgagaggggcagggctggagaaggagcaagttgtggggcgccaggcttcccgcacgcagcctgtggtggatgtgggaaggagatcaacttttcctccctttgggacagacgttgtgtggaaactaaaaagaacatgcggcacgttaatca

SEQ ID NO: 568996 - DNA, 492 bp, Homo sapiens
  misc_feature (76)..(76): n is a, c, g, or t
  misc_feature (101)..(101): n is a, c, g, or t
  misc_feature (113)..(113): n is a, c, g, or t
  misc_feature (117)..(117): n is a, c, g, or t
  misc_feature (152)..(152): n is a, c, g, or t
  misc_feature (161)..(161): n is a, c, g, or t
  misc_feature (167)..(167): n is a, c, g, or t
  misc_feature (185)..(185): n is a, c, g, or t
  misc_feature (222)..(222): n is a, c, g, or t
  misc_feature (232)..(232): n is a, c, g, or t
  misc_feature (240)..(240): n is a, c, g, or t
  misc_feature (248)..(248): n is a, c, g, or t
  misc_feature (257)..(257): n is a, c, g, or t
  misc_feature (281)..(281): n is a, c, g, or t
  misc_feature (284)..(284): n is a, c, g, or t
  misc_feature (291)..(291): n is a, c, g, or t
  misc_feature (314)..(315): n is a, c, g, or t
  misc_feature (325)..(326): n is a, c, g, or t
  misc_feature (331)..(331): n is a, c, g, or t
  misc_feature (334)..(335): n is a, c, g, or t
  misc_feature (340)..(342): n is a, c, g, or t
  misc_feature (344)..(345): n is a, c, g, or t
  misc_feature (360)..(360): n is a, c, g, or t
  misc_feature (386)..(387): n is a, c, g, or t
  misc_feature (399)..(399): n is a, c, g, or t
  misc_feature (402)..(402): n is a, c, g, or t
  misc_feature (409)..(409): n is a, c, g, or t
  misc_feature (418)..(418): n is a, c, g, or t
  misc_feature (424)..(425): n is a, c, g, or t
  misc_feature (428)..(428): n is a, c, g, or t
gaagtgatctagaggatcccagactcggcacccgttcattccatttcatacattcagattgattctattcaattcncttacactccattatattccaatcnattctggttgtntccnttccattccattccatttcactccattccattgcnctcgggttnattccnttccattccattccattncattccattccattccattccggatgattccattccnttgcattccnttccattncattcccntgcactcgngttgattccattccattccattcnttncattccnttccattccattccattccattnnattacattcnnttccnttnnactcnnntnnattccattccattgnattccattccattccattccattccnntccattccattncantccgttnattccattncattcnntcnattccattccattccattccattccattccattccattccattgtacctcggccgcgaccacgc

SEQ ID NO: 568997 - DNA, 309 bp, Homo sapiens
ttaggcttgggaaattttttttttggctttcccccagataaacttttggctaatccaatagggaaagaacctgtttttttaaagctttttttgggttaaaaccgggattagagatcggcctttatcaggggtccctttttttttttgacccttattttgggggaaggaccccccgagggggtcccgtcatgtcgggtttgtttgggggggaagggacccgccagggggttgaaagtttttttttaaagatgaaaagcttgtgaacccctgtaaaacatgcgggttttgaaaaacctttgttaaaactta

SEQ ID NO: 568998 - DNA, 1617 bp, Homo sapiens
  misc_feature (727)..(727): n is a, c, g, or t
  misc_feature (836)..(836): n is a, c, g, or t
  misc_feature (1179)..(1179): n is a, c, g, or t
  misc_feature (1276)..(1276): n is a, c, g, or t
tctacacgggcgactctttgtggtggggccccccccacttcctttgtttttggtggtcgctttcgtcgccccgcccgtcaatgtctgccgttgttgtgatctgtgcgggtcttcttccggcgcccgcgctgtttattttcttattgttgggcagggtttctttttttcgcaagattgtgtgggccccggacgcaccagatgacccgccgacaagtgaggaaatatgttgggggggggcgtgtgcctttctgttttggtgtccaccacagaatctgctttcgggggggcaccccccacactgtttggttggtagatcacttgttggtaggaaccccccgcccctctcttgtggtggacattatttattgtaagagcgcttttttggtgggggtggaacaaccgcccccgcccccccagtagggtgctccctgcacgctcttctcctctattgtgtgccctcccccccccccacggtgagtggtgggataatattgttggtgcctttgcttcgttcttttatataagaggggtctcccctcctcctcctccccgtcgtggggtgcgcctcctagaggtgctctttcatcacacggcgagttggttttttctctccacgcggggcagctcttttctctctttcttttgggggtggccctcttggggctccctcccccgcgccaccccctctctatttgagagaggcccgcggcgagtcttttttttcccncctcgtcgcacacttctcgtctctgagtagagagagagtaggcccctcttcggggggacaccgcgcccatcgcggcgttgtttgtcggcgagcagtcttcttttcctcncgctcgggaggagagagttgtacacactctggtagaccctctcactctgtgagtgtttgtgtgagagcctctttgaagtgtgagccttctctatagcgcgatgatatagtagtgtgagagtttctgttgtgagagagcgccgcccccccccacacacagcaggagggcgtctctcacagacgcccactctctttgtctctctttctctctctgggggagcgcccccactgcggtgatgtattttctcgcgcaccacacgctggagagaggcgacgcatctctgtctcgtcgtacgacacactctcgcagagtgtgagtctctctctcccccacgctgcgcggngcctctctgtgatacacccccacagcagagtagtgtttagtgtctctctctgtgtgtgtggtgtcgtctctctgtggagaacacacctcgccacgcnccccggtgagacacttttgtgcgcgctctctccaaagagaacaccacatctgtgtaatatattcttatatgtgaatatttgtggtacacccgcggtgagaattgaggctccgtatattctgtgttcaccacaaaatatatttttagagagagaacacatcttggcgcgttctggaaccacattttcttcttcttgacctgctgcgcttgaaatgttctttggaggcctgttttttatatgtaatggggtttttttataatgtgagatccccttccaatttgagaatattataatggcgtttttccccgtaaaaaataaaatattttgggccaacccccaca

SEQ ID NO: 568999 - DNA, 240 bp, Homo sapiens
ggttgaaacagcactcggcatctttatatgttatgactttgttttgtgtttgaatgttcagtaacatctttgggatggtggtggaagtaaaacagatgtcagcaaaagataggttggagagaaaaaagtacatgggtgtgtggagatgggagtctaaactgacggccaggataatgagtaggttccctgtgaatgtgaccacgtagatggacaggaacagcccaaataggagtgctgttt

SEQ ID NO: 569000 - DNA, 579 bp, Homo sapiens
  misc_feature (63)..(63): n is a, c, g, or t
  misc_feature (92)..(92): n is a, c, g, or t
  misc_feature (99)..(99): n is a, c, g, or t
tgcccctcactttacataaactattatactagcatttaccatcctcacttctaggaatactangctatatcgctcacgacctcaatgttccnttccccntaacttaattggccttagcacacgcgcaactaaattacctaatcgcttgatgtccagttcacttaggtcattaccattccttccaattaaaaccactcctttccaaaatcgaatcacccacaaacctttcccccacatttccatttttttaaggtcccccaaaaattttaaccttacgtgcgtttagggacccccatttaaatttctggggccccccaaaattttaaagcccgttttaaaggcattccccttttcttatcgggccgcccatggtctccccttgtcggccccggagaacacataggcaccataaagaggccagagagggcggtatactaggagaggtgaagaggcacacacccaccccttcttcaaaatagtgagcacaccctcaccacacaccactctcttttataaaccccccctgttgtttcttaaaacgcgcgacgtctttcccctatgttcttcaccagaaataag

SEQ ID NO: 569001 - DNA, 303 bp, Homo sapiens
  misc_feature (46)..(46): n is a, c, g, or t
tttcctgtgattttcgaaactaaacccccgtgtgtcctgtagtgtncaggtttacatttcttacccttggagtctgtgtggggaatttccagcccttttatgcctgtgtgatcccaccccacccccatagttgtataaaggtcatagtgaagaagctcgcgcaagtctgccccatccagatcctggggcggggtccttaagtgctctctcaaaaacaacccccgaatgtttttatagtagtttaattgcatttttttgtaatgcccgtattatgtaaaaaataaagtattttaaaaatatggc

SEQ ID NO: 569002 - DNA, 275 bp, Homo sapiens
  misc_feature (39)..(39): n is a, c, g, or t
  misc_feature (43)..(43): n is a, c, g, or t
  misc_feature (192)..(192): n is a, c, g, or t
  misc_feature (202)..(202): n is a, c, g, or t
cagaagttcaagagcagcctggccaacatggtgaaactntgtntgaaacccaacaaaaattagctgggcatggtggctcacacctgtgatcccggctactcgggaggctgaggcaggagaatcgtttgagcctgggaggtggagattgcggtgggctgagatctgactactgcatcctagcctgggcgacanagcgagtctncatctcaaacaaacaaaaaatttagctgggcatgggtggcatgtgtctgtggtcccccggctaagtttggaaa

SEQ ID NO: 569003 - DNA, 145 bp, Homo sapiens
actaaaagagaccaacaacctaaaacaatctcgtgtatatacatatacagactcacatcaaaacttcagcagcaactgcaaaaccacaaaactacggtatgatacacgaaacaaataatgaaacatcaactcaaactacaccact

SEQ ID NO: 569004 - DNA, 178 bp, Homo sapiens
atcttatggcaagaggtaaaggcctgaggggtgtcaatccatatgaatggcaaggtcatagaagaggctaggtgacggggacatgaaactagaagctaggagctccacgcaaactagacaccctaagcctctagccaggctagggagtagggagcataggggcagggaccatgaagtg

SEQ ID NO: 569005 - DNA, 405 bp, Homo sapiens
atgctaaatttactctgcctgtgctctataaaaaaaaaaagtatagatgacaatacatctatttacagcatagtttactgagtattttaagccaactgttgagacctgcaaaatattactattggccagatgtagtgattcccacctgtagtcacagcactttgggaggcccaggtgggaggactgcctgacccaagagttcaagaccagcctgggcaacacagcaagaactcctctctacaaaacatttaaaaattagccaggcatggtggcacacacctgcagtcccagccactttggaagctgaagcaggaagacaacctgcactcatgagttcgaggttacagtgagctgtgattgcatgactactccagcctgggcgacagaacaagagactgtctccaa

SEQ ID NO: 569006 - DNA, 144 bp, Homo sapiens
ctcggtaccgacgacagtgtgactccaccaggtagcacgcagtgacaaatggaggagacatagccaccagcttccaggccatccaggtccccgggtcgccttgggatccggaccggtacaggccattcagggctgccacatccc

SEQ ID NO: 569007 - DNA, 952 bp, Homo sapiens
  misc_feature (345)..(345): n is a, c, g, or t
ggcaattaccttaatccagctacaggattgcagtggatttgaagttgatctttaacacctttaaggactgttctcgtccccatttacccctgcttctagggtgtcatgcttcatggtttcagcctaaacatagggcttatcaggattccctctctctcttctgacaacagatgccccttagggaaaagctgctcaaaacacctggctcatctttggttcccttcttctgaattttggccctgtaactcttcactaccttgttaactttctgatgtcttcatgcaatttttttttagttgtccagcttttctagttgtcctcaggagggttgatccactattaacnaattttctcaactttgttttccaatcttgtttagcttttcataaatagtaatactatgtttttaattccaagaccttttctgttttctaggttttttttcccgtgcgtgcgtgtgagtatgtgtatgggtgttttagaaaaataggatcctattcttgttaaacacaatattttatctttctgagaatatcaatatgtgttgctattgtgtaatttttttgtctctagtttcttaaagttacttttttcagtttattttggtaccttctatgtcaagttgcctgcttattgttggtgagttggtcatattgaagagtacagaataagaagcagttgagcctgggcgtggtggctcatgcctgtaatcttagcactttgggaggccgaggcggatggatcactttaggtcaggagttcgagaccagcctggccaacatggtgaaagcccatctctactaaaaatatatttttattagccgggcatggtggtgggtgcctgtagtcccagctacttgggaggctgaggcaggagaatagcttgagctcaggaggaggaggttgcagtgagctgagattgcacttgggcaacaagagtgactctgtctcg

SEQ ID NO: 569008 - DNA, 221 bp, Homo sapiens
  misc_feature (176)..(176): n is a, c, g, or t
  misc_feature (195)..(195): n is a, c, g, or t
tgatctagaggatccctgggctcagtgatcctcccgctcagccctgcagtagctgggacataggtgtgcgccatcatgccagctaattttgtattcgttgtagagacggggtttcgccatgctggccaggctggtcttgaactcctgggtgcaaagctgtctgcccactctcccanaagctgcttgggcgttacntgggcacttgagcccacgtgcaccct

SEQ ID NO: 569009 - DNA, 459 bp, Homo sapiens
agttgaccaagactaatactgaaggtggcataagttatcaagccattctacaagagataacttacataaccagaatgtctagtaaggctcgcagctgtcacagataggcagggcactctgggatatgacctttctgtccaggtgattcacagactagacctttcttatcctcctcctagagttatgacttgggactctagtgttaagatgatgagcccgtgcatcaggtccttctgcactttggtggaagtctcccagggtaggtttcctatttgaaacagtggaatcatgtttccagtgataaagtttaatgacctcatcctttataatttataactctatctgccattggtgtagtctaaaatgggtaaaaatggcatgaatgtggctaatgtggttctcaaaattgggtcagattggcccacaatagctccggctctgtctaacggactcaatccc

SEQ ID NO: 569010 - DNA, 659 bp, Homo sapiens
  misc_feature (655)..(655): n is a, c, g, or t
ctggactctgtttatagccatcttcctgacctgctgtagaacatagggatactgcattctggaaattactcaatttagtggcagggtggttttttaattttcttctgtttctgattttgtgttggggtgtgtgtgtgtgtttgtgtgtgtgtgtgtgtgtgtgtgtgtgtgtgttaaacagagaatatggccagtgcttgagttctttctccttctctctctctcttttttttaaaataactcttgtgggaagtgggtttataagcctttgccaggtgtaactgttgtgaaatacccaccaataaagttttataagttccatattttctccattgggccttcttatgtattttcaagattattcgtgtgcactttaaatttacttaacttaccataagtgcggtgtgactttttcccacacagtggattgtgaggctcttaacttcttaaaagtataggggcatcttgtgaactcctataagcagtctatatgtctcttaacattcacacctactttttaaacaacatatattattactatttttattagggggggccttttataaattttcttagagattaagaaaatttaagaccccatttgtgttactgttgtgcaatcaacttgggaggtatcttctaaatatgtctgtgnatag

SEQ ID NO: 569011 - DNA, 924 bp, Homo sapiens
  misc_feature (5)..(6): n is a, c, g, or t
  misc_feature (11)..(11): n is a, c, g, or t
  misc_feature (17)..(17): n is a, c, g, or t
  misc_feature (20)..(20): n is a, c, g, or t
  misc_feature (30)..(30): n is a, c, g, or t
  misc_feature (39)..(39): n is a, c, g, or t
  misc_feature (41)..(42): n is a, c, g, or t
  misc_feature (47)..(47): n is a, c, g, or t
  misc_feature (50)..(50): n is a, c, g, or t
  misc_feature (56)..(56): n is a, c, g, or t
  misc_feature (60)..(60): n is a, c, g, or t
  misc_feature (63)..(63): n is a, c, g, or t
  misc_feature (65)..(65): n is a, c, g, or t
  misc_feature (71)..(71): n is a, c, g, or t
  misc_feature (75)..(75): n is a, c, g, or t
  misc_feature (77)..(83): n is a, c, g, or t
  misc_feature (89)..(89): n is a, c, g, or t
  misc_feature (120)..(120): n is a, c, g, or t
  misc_feature (136)..(136): n is a, c, g, or t
  misc_feature (149)..(149): n is a, c, g, or t
  misc_feature (173)..(173): n is a, c, g, or t
  misc_feature (192)..(192): n is a, c, g, or t
  misc_feature (202)..(203): n is a, c, g, or t
  misc_feature (216)..(216): n is a, c, g, or t
  misc_feature (233)..(233): n is a, c, g, or t
  misc_feature (447)..(447): n is a, c, g, or t
  misc_feature (452)..(452): n is a, c, g, or t
  misc_feature (742)..(742): n is a, c, g, or t
  misc_feature (745)..(745): n is a, c, g, or t
  misc_feature (838)..(838): n is a, c, g, or t
  misc_feature (840)..(840): n is a, c, g, or t
  misc_feature (843)..(843): n is a, c, g, or t
  misc_feature (901)..(901): n is a, c, g, or t
cgccnnctccncccccntcnggtgtttgtngtggggctncnnactcnccnatcccnccgnaancnccaggncaanannnnnnngggagngagtacactatattcaagtggtgctcatcgngactcaggcgtggcanagcaactgctgtngcttcaccgcaacgagttcaactngagagcaagagaccatcgncgtgagttcnncacccgcagcatncaggtggacggcaagancatcaaggcgcagatctgggacaccgctggccaggagcgctaccgcgccatcacctccgcgtactaccgtggtgcagtaggcgccctgctggtgtacgatatcgccaagcacctaacctataaaaacatagagcactggctaaaggaactacaggaccacgcaaacagcaacatcgtcatcatactggtgggcaacaagaataacctgcgccanctgcnggctgtaccactgacgaggcccgcgccttcacaaaaagaacaacttgtccttcatcgagacctcagccttggattccactaacgtagaggaagcattcaagaacatcctcacagagatctaccgcatcgtgtcacagaaacagatcgcagaccgcgctgcccacgacgagtccccggggaacaacgtggtggacatcagcgtgccgcccaccacggacggacagaagcccaacaagctgcagttctgccagaacctgttacccctgcgcctccacccagcgtgcgttcanttnctccgcccgcccccgccacggtatcctctggcccctccctgctgttcctctgtggccggctcgttccagccctcccagtgagctctgcacggncnggncggggcccaggaaggacaggagccagttctacccgttctgcccggggaaagctagaancccggtttgctgcaccatgaaat

SEQ ID NO: 569012 - DNA, 607 bp, Homo sapiens
  misc_feature (603)..(603): n is a, c, g, or t
ctggactctgtttatagccatcttcctgacctgctgtagaacatagggatactgcattctggaaattactcaatttagtggcagggtggttttttaattttcttctgtttctgattttgtgttggggagagaatatggccagtgcttgagttctttctccttctctctctctcttttttttaaaataactcttgtgggaagtgggtttataagcctttgccaggtgtaactgttgtgaaatacccaccaataaagttttataagttccatattttctccattgggccttcttatgtattttcaagattattcgtgtgcactttaaatttacttaacttaccataagtgcggtgtgactttttcccacacagtggattgtgaggctcttaacttcttaaaagtataggggcatcttgtgaactcctataagcagtctatatgtctcttaacattcacacctactttttaaacaacatatattattactatttttattagggggggccttttataaattttcttagagattaagaaaatttaagaccccatttgtgttactgttgtgcaatcaacttgggaggtatcttctaaatatgtctgtgnatag

SEQ ID NO: 569013 - DNA, 450 bp, Homo sapiens
tgtggtcgatctctagcaggactcccctacctaatgctgtttagtgttcactgcagttgggtcaaaattagtatcacgagttagtcttctgtgggtattagggagggattatggtgcctccctcccacccctactggtcttccttgttgtcacacgcctttattatctactcctgaacaggagctaggagatgagtgaacacgcctcttaacgtagcaccataatgcttgcggccaagaaaacctgcccccttgtttcttggtcgtgttttcccaatatcttttatacttcagtttccctgggtgggaataatgccacacctgggttgatgcccgaggcttggatctctgatgcctcaattccatctctatgggcatgcctgtctagcttcctatgggcgctgtcagcttcacgctccgctggtcacccatggtttcgttctttcgccac

SEQ ID NO: 569014 - DNA, 276 bp, Homo sapiens
atgagaacgccagctagaactgatcgcgggtgtgatgctgtgacttcaaattatactggctcaagttagcccgtcatacaaacactaaaatatcgacaaatgcatcctacgccgggtgcagtggctcacaccagcactatgggaggccaacgcaggcggatcacccgaggctgggagctcaagaccagcctgaccaacatggagaataataataagccgagatcgcaccattgtactccagcctgggcagcgagagtgaaactccatctcaaaaag

SEQ ID NO: 569015 - DNA, 428 bp, Homo sapiens
tctagcaggatcttatcggctgcctttttttttgtcaccatgccggccgggaagaggcgctcctcacttcctagatgggatggcggccgggcagagacgctcctcactttccagactgcgcagccaggcagaggggctccttatgtcccagacgatgggcggccaggcagagacgctcctcacttcccagacggggtggcggccatgcagaggctgcaatctcggcactttgggaggccaaggcaggcggctgggaggtggaggttgtagcgggccgagatcacaccactgcactccagcctgggcaccattgagcactgagtgaaccagactccgtcttgcaatcccggcacctcaggaggccgaggctggctgatcactcgcggttaggagctggagaccagcccggccaacacagcgaaagcccg

SEQ ID NO: 569016 - DNA, 905 bp, Homo sapiens
gacagatggcagttttgtggcggtgacaccacaaaactattttagcgggccccagagggccctgtgtgaagaaattattcatgcccgcctggtgtgacagaccgacatgttcgccaaaactgtgggttgttcatctggccgccaattacctcctggggccacgagcacgaacaactcattttgggggccaaaggggcccccccccacatggttggagaaacgagtttccttttccccccaaagagtgtcttgtacagggtcgcacacaccagacgggtagatttcttggcggaggttcgcgccccttatgaggtgtgcttaggttggtgagcttccccgccctagtaatcttggctgggacagtgttggtaaaacaagggagcggccacacccgcgcggttcctcagaacaaaaaaactcgcctattgagtgtaccccacacaaagtttgtgacagtatctaacggggttgtctcgattactgagcacgcttggtggtaacacctcgctctctgtcgtagtcatgtgccgccccacgcgcgcctccttttatttcttacaaacaagtagtacacagctgtgcgcctctctttcgggttcttctgctccgacggagtccacaattaggtcggcgacctcactattctcatgtgactccactccgccgtacctctattctcgacatctctgtctaggtcagaaaagtctctagggtcgactctcgcgcgcgattagccgttctctttgcccggcctcccaccctcttgcgataccacctggcgtcaggacatgtgtgcccaaccgacacggtggtccagcccacccggagcagagtgcagtccccatgtactccgcttgatctctgtattcttgaaaaaaaatgtgaaagatcccgcaaacatgaca

SEQ ID NO: 569017 - DNA, 326 bp, Homo sapiens
  misc_feature (100)..(100): n is a, c, g, or t
gatcatgggagtgttaccggtggagggtgtccaggtttttgacattttgaacaaagaatgggacaaaaagcccaaagaaagccaaaaaagaatgaagcanccaaaggagagagtgattgaaaatgaaagccccctccacagggtgggagcagccccggcaggggctcagggcgcggttacacaatgtcccggggtttaaatatcctctagaggcttcccatcggttacttggtgtgagccccatgtaaatgaagaggctgaagtggagttacaaagttatttacttggtgtacacactatgcaaataaaaagggtgtttcctgtca

SEQ ID NO: 569018 - DNA, 223 bp, Homo sapiens
atagggtcctcttgaagttactatttatgttttcaccttattctaatgcctttttatttgattctcagcattataaatttaacctctaaaaatttaaatattcatgaactgaattagtgcccaaaatatccacggtggatacttatagaaaatcatgagacgttttaagttgtattgtatgagtatgctcacacacacacacacacacacacacacactacat

SEQ ID NO: 569019 - DNA, 235 bp, Homo sapiens
acctgggatagtattgaactctatgttttttctcatacctatgtataagtctaatttatataataggtgcaggaactaatagaacagttatgacaatgtagtaaaggttacatgaatgtggtctctctttttcaaaatatctgattgtactgtactcacccttcttgtgatgatgtgagatgataaactgccttcctgatgaggtaaggtgaatgacagcattgtgatatagcct

SEQ ID NO: 569020 - DNA, 144 bp, Homo sapiens
actgctatcacctgattcatatccttttagctgatatgctaaagagcttcccaaggtttttcaagtcatggcatacacaagaaatgatatctgtacatacacgggtaaaaaattgcaagagattgctctcagctggatcagcta

SEQ ID NO: 569021 - DNA, 256 bp, Homo sapiens
agaggatcccttatcgtgttgcctttgggagactgaagcaagaggatcgattgagcccaggagtttaagaccagcctggacaacacagtgagaccccatctccaaaaaaattttaaaaattagccaggcatgctggtgcatgcccacatacccagctacttgggaatttgaggattgcttgagcccaggaggtcgaggctgcagtgaactatgatcacactactccagctagggcaacagagtgagaccctgtctc

SEQ ID NO: 569022 - DNA, 92 bp, Homo sapiens
gaaccacccactacagggccaacaacccccacaccccgccgcgcacaactacatatacccgagcaattaactcaaccacacctcaccaccac

SEQ ID NO: 569023 - DNA, 267 bp, Homo sapiens
  misc_feature (116)..(116): n is a, c, g, or t
  misc_feature (160)..(160): n is a, c, g, or t
  misc_feature (175)..(175): n is a, c, g, or t
  misc_feature (211)..(211): n is a, c, g, or t
  misc_feature (222)..(222): n is a, c, g, or t
  misc_feature (250)..(250): n is a, c, g, or t
  misc_feature (263)..(263): n is a, c, g, or t
aaacttcaaaacagctacaacgggaaaaagagagttttgtcccacagtcagcaggccactaggttattaacttccagttcaccttggatttttgctaaaatgaaggactctgcagntctacacttctcctgttactgcttgtggcctctggataaagccngcaccaccaacccgnccgggactcaggcattatctatggattatgggaacngataattttgnaggaatccatatttggccaggattatgngggataaataccnggga

SEQ ID NO: 569024 - DNA, 157 bp, Homo sapiens
ctagacatggctccatacaggcatcgaggtgtatttgtgaaagccccaggacactgtggccagttttcacattggctaagttatcatgtccctccgcaccaagctgcagaacaaggagcatgtcattgatgccctgcgcatggccgcagtcaagggc

SEQ ID NO: 569025 - DNA, 532 bp, Homo sapiens
catagctgactcttgaggatacaccttatgctcctgacaccaccagatccacagcagaaagcatccttcctcgaggaccatcagctttgaataaatgcttgttccagagcccatgaatgccagcggggacccctcctttcctggggtaaaggttctcagatgctgcatcttctaaattgagcctccggtcatactagttttgtgcttggaaccttgcttcaagaagatccctaagctgtagaacattttaacgttgatgccacaacgcagattgatgccttgtagatggagcttgcagatggagccccgtgacctctcacctacccacctgtttgcctgccttcttgtgcgtttctcggagaagttcttagcctgatgaaataacttggggcgttgaagagctgtttaattttaaatgccttagactgtggatatattagaggaagcagattgtcaaattaagggtgtcattgtgttgtgctaaacgctgggaaggtacaagttgctcattcctaaatctgtgtttgagaaa

SEQ ID NO: 569026 - DNA, 485 bp, Homo sapiens
  misc_feature (335)..(335): n is a, c, g, or t
  misc_feature (345)..(345): n is a, c, g, or t
catgtgctgacgtcactaagatcaatacagcaaactctgaaagatggacagagagacaggagatggtcctttataatgcagtgtgatctgtgctgcaatagagttttggaagctagaagttcaaaacgaggtgttggcagcaccatgctctctctgaagatgctaggaagaatctgctccatgcctttccattcgcttctggggtttcctgcaagccctgacattccttggcttgtagatgcatcaccccagtttccgcccccccccccccccccccaaaaaaaaatttttttcccccccaaaaaattttccccaaaaaaccaaatttggggggncccccctccntctctgtgtgtgcctctgcgttccctctattcttcttctaaggacaccgacaccagtcatagtggattaagtgtccactcctaaccaattacatctgcaacaaccctatttccaaataaagtcacattctaagattcaaa

SEQ ID NO: 569027 - DNA, 398 bp, Homo sapiens
gagggtacactctcgctactggatcctattgtttgtaactgagctatttcctaacaagaagccttcagcggaaataatggatcctagttatgtcaaagaaaacaaggagacagaatggcaacttcacagtcttcaagtaaatagaatccctgatataaatggaaattaacatgtaattttgggggcaataaaaacaacaacaaaaacctgtgacaactctgtcctactcctttaaaaatgagctttgactctgtagtctcttaaggcacaaaacctgatagacggcatttaactggtggcctgcacctctgatttggattttaaaaaacaactattgacatttaaataaaaataaaccattttgttagagctggagatcctaggatacagtagggaga

SEQ ID NO: 569028 - DNA, 289 bp, Homo sapiens
  misc_feature (56)..(56): n is a, c, g, or t
  misc_feature (84)..(84): n is a, c, g, or t
gtgggaaatgtagcggggagagggggagaaagagaagttgttgaagggtacaaatnacgtggttatagaaggaataagacctantgtacatagatcatagttggcaattgcctactgtatatttcaaaatggctagaagagaagaatcggaacggttctagcataaagcaaaaacaaatatttaaggcgatagatattccaagtaggctgatttgattttcacaattatatgaatgcattaaactatcacatgtaccctgaaactatgtacatctattatgcatcagtg

SEQ ID NO: 569029 - DNA, 1126 bp, Homo sapiens
  misc_feature (313)..(313): n is a, c, g, or t
  misc_feature (565)..(565): n is a, c, g, or t
  misc_feature (575)..(575): n is a, c, g, or t
cttacactattcctcatcacccaactaagaatattgaaagcagcaaactaccacttaccttccctcaccaaagccccataaaggataatataaattactatagcgaaaacccgtgagaaacctaacacatgcagacgaacacatctagttcgacgtttcattcattggcccccagcaagtccgtaggcctacccgcacgacagctcactgatcagttcgtagtttgccccctcgtatttgactccctcacacgtcctaatattatcatcagtcaacgagacctgatcttaagttactcgacactctaacgaantgagcataatccgagaactaacgctccaaatacgttagatgagtagcgcaggtacactagatcgatcattaaaggagcagaacgctgatactcatgtatagcttagtacttcctatgaaatcactgtatatgtattggtcgctactaagcgtaagcgctctctcgaggatctccgttactctcacctcagttgtgacagccaacgcaaccgcaacagtgatcctattaggaacctgtgagcctcatggaccnattcacaccnttgatgcagtgcgggtcgacccagtgtgcattcatcagggcctcttcgctctcgtcaaggcacttatagaaatgcctctttagacccgagctctccttacacactagagggcagcacactacagcccacttgagtcccctatacgtacgttattgatcggaaaccatttcagcgctactcgattcaagccaattgagcccctggccggtactgcctaaccggctaacattactgcaggccacctacttcatgcacctaattgggaagcgccagccctaggcaatattcatccattaagccttcccctctagcacttaatcaatcttcaacagaattctaattttaactgaggtattcctagaaaatccggatggtccacccttaaatccaaaggcctacggtttttccgcaacttgcttaggtaaaggcgcccttatcaggctggcgaaggaaacgcgcctttaaaaaaaacacaaaacagcacagggcaaggccagcacacacaactcggacgcagcgagacatccataaccaccaacaagcgagggcag

SEQ ID NO: 569030 - DNA, 599 bp, Homo sapiens
ctagttctacttcctgtccacctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaggggggggggcgccaaaatttcccccgggggggcccctccccccccccttttttttgaaggaggggccgctataatgaggacatggtttttatattaatacgaacgaggaggggcgggcgtgttataataaaaatagtaggggggtgagaaaacacgatggtactaggtggtgattatttttggatgagaagcgaccacactatctatgcggtgggggggggggaagaaataaataggtggggaacaatatcctaactctgtcatgagaatatatatatataagatccgttctagggcgaataataatatatacatttagtagtaggattagtactattaggtggtgaatgaaaaacacagacgcgataatatatttgtgtggagcggtgaagaaaaaatattgtggtgaaacaagtgagtgattgtgttgttgttgaaagatatttttttatccagaggggaagtgattaataa

SEQ ID NO: 569031 - DNA, 120 bp, Homo sapiens
ttttcacacgggatgcataccaacacaacactcactccaaattcatctttcattgcagcatgccatgttgccattgcaggcagtccacttgcacctatagtggagcactttttcaaaatg

SEQ ID NO: 569032 - DNA, 183 bp, Homo sapiens
acaaaccaaaaaacaaacaaggcatttactcttggccctttcagtacaggcgagtgttctattgcatcacagtgctagtgatgcagtaacagatccaagggcatattattaaatatgtttttgtccactgcgatttagttgaaaatacatatacagacatatattatggctatcagaccagca

SEQ ID NO: 569033 - DNA, 599 bp, Homo sapiens
  misc_feature (25)..(25): n is a, c, g, or t
  misc_feature (62)..(62): n is a, c, g, or t
  misc_feature (110)..(110): n is a, c, g, or t
  misc_feature (112)..(112): n is a, c, g, or t
  misc_feature (114)..(114): n is a, c, g, or t
  misc_feature (118)..(118): n is a, c, g, or t
  misc_feature (124)..(124): n is a, c, g, or t
  misc_feature (128)..(128): n is a, c, g, or t
  misc_feature (143)..(143): n is a, c, g, or t
  misc_feature (168)..(168): n is a, c, g, or t
  misc_feature (209)..(209): n is a, c, g, or t
  misc_feature (256)..(257): n is a, c, g, or t
  misc_feature (259)..(259): n is a, c, g, or t
  misc_feature (275)..(275): n is a, c, g, or t
  misc_feature (277)..(277): n is a, c, g, or t
  misc_feature (284)..(284): n is a, c, g, or t
  misc_feature (290)..(290): n is a, c, g, or t
  misc_feature (292)..(292): n is a, c, g, or t
  misc_feature (296)..(296): n is a, c, g, or t
  misc_feature (304)..(304): n is a, c, g, or t
  misc_feature (307)..(308): n is a, c, g, or t
  misc_feature (314)..(314): n is a, c, g, or t
  misc_feature (372)..(372): n is a, c, g, or t
  misc_feature (594)..(594): n is a, c, g, or t
ctcaattcagccacagtcccaagtnccccaaccttcctgattgcatctctattttaaataanccagcctggacatcaaggacaatgatctaggaggcgggtcaaggaganancnaggnaaagtnagancagacttggggcttncaggctatgcccggtgacagctganctcttcagaaatgcgtcacattcagcgttcacttccttcgnttcctccactacctatgacatagcgggggaaagatacaaccatgggnnangggtccctcctcgctncnctcctcncagctntncttnattttcanatnnggagangtttgttagggaccggcacagggacagccagagccggcaccctccggcccaccgtggnacccctgatgatcgcggggtggggtaggagtgagggtgggggtcggggtgaggtagtgctgttgggagggcactgtgaatgatggaaacgtcccttctcagcctgggtcgtgcctaacctgggtctcaaatcccactctgccttcaccctggagtacactccagcgaaccgagggcccagccaacgcgcgggaaggggccacggagaagagccggcaaaacncccac

SEQ ID NO: 569034 - DNA, 373 bp, Homo sapiens
tccccttttttggggggggggggccccccccccaaaattattttgggggggccgggggctttttttagggggggggggcccccccggggggggggccccccggtttaattttccccggaaattttgggggggggggccggcccctttaaaccccggggtttttttcccccccaaaaaacccatttttttggggggggggggggggggaaaggggccccccccaaaattttaaaccctttgggggggggggggccccaaaaggggggggggccccaaaaaacccccccccccccccccctttttgggggccggggtttttttcccccccccccccccctttttttttaaaaaaaaggggggggggggggggtta

SEQ ID NO: 569035 - DNA, 513 bp, Homo sapiens
accatgacctgccaatttttggttttgaaaccgaagaataattaggaaaatgatgattattcctattacatgattataatttaaaatagttttgttgaatggatacgggtgctgaaataatgcattctgggtatcaaatggatgcttggagtggatggatagattggatacctggtccctccaaatctcatgttgaaatctgattcctggtgttggtggtggagcctactgggagtcttggggtcatgtgcctcttggtgccatcctcttgtcccctcgggaaggagtgagttcttgctctgttagtttttgccagagctgatgttgaaacgagcctggcacctcccgcactcctctcttccttcctctcttgccatctgatgccagctccccttccccttctgccatgagtggaagctccctgagggcctcaccagaagcagatgctggcgccatgtttcttgtacagcctgcagaaccttgagccaaataaacctcttttcttcataaaaa

SEQ ID NO: 569036 - DNA, 436 bp, Homo sapiens
acgcgcacgcggttcaacagttcttgagcctcagctccccagtagctgggattacaggcacctgcaacacacccggctaatatttggtttttttttccggtagagacagggtttcacctattggccaggctggtctgaaactcctgacctcaggtgatccacccgcctcgacctcccaaattgctgggattacaggtgtgagccaccatgcctggccttattttaatttttggagacaaggtctcgcttggtcaccgaggctggagtgtagtgccataatgataggccactgatggattgaactcgtggactaaagggatcctcctgcctcagcctcctgagtagctgggactacaggcatgtacagtcacaccacactaatttttggaattttggtagagtcagggtctcaccatgttgcccaggccagttttga

SEQ ID NO: 569037 - DNA, 372 bp, Homo sapiens
aggatccccgtagtatagtgcactcaggaaagggaagcatgtgtgtgttgaatagtgaacccgtatctggagtgcttctttcacagtcagggaaggaagagggaagaggcagctgtgagagagtgatgaggttgagggaggtggggtatctcgctgctctgaccttaggtagagtcctccacagaagcatcaaagtggactggcacatatgggctcccttcacaggccacaatgatgtgtctctccttcgggctggtccggtatgcacagttggggtacctggagccgtttgtcaggcggcagtctgtgatgtgcatgctggagttgctcttgtagcagttgccctgcccgttcttgcaggtgaccttttcc

SEQ ID NO: 569038 - DNA, 364 bp, Homo sapiens
agcggccggccgggcaatgacactgaaaatgattaaaatgatacattttatattatggatttttaaatcacattttaaatgtatactaaaaactgaacaacaacaaaacaatccagttagaaatgggtaaaagacaggctgggcgtggtggctcatgcctgtaatctcagcactttgggaggccgaggtgggcagatcacctgaggtcaggagtttgagaccagcgtgaccaatatggtgaaaccccatttctactaacaaacaaacaaattagccgggtgtggtggtgcatgcctgtaatcccagctacttggaaggctgaggcaggataatcacttgaaccctggaggcagaggttgcagtg

SEQ ID NO: 569039 - DNA, 268 bp, Homo sapiens
tgatacccgctatgatatggatgaaacttgaactcattatagtaagtaggagaagccagtcccaaaagcccccagattgtttcattttatggacaactgatcctcaatttcatttcattataatgctgacaagattaaaaaaaaaaaaacaactcccagcgggggcccctgcctgtgtggagtttgtgtgttctccctgtgtttgggtgggctctttcctggtactctggtttcctttcacccaataaaaatgggcatgttcccttca

SEQ ID NO: 569040 - DNA, 968 bp, Homo sapiens
atgggtttgcagggatgcatttgccttaacgagtgcctctggtatcccgctaaagccggaccaaagcgtggcccagagtgcaggccagcctctcagcctgcggcccggggaggcagggcagcgcgggcgcgggctgggggtggcgcggggcggcgctcaggcatttcggtgccaggcgcagcagtgcggcggcatttgctccaagcaggcagcagcgcaggcggatttgctcccaagcaggcagcagcgtggggcgccgtgctgggcctcgccagggcacggcatcctctcgcggcggtcccctctgactccctgcccgagcaggcatcagtccttggccagcagcgggccccaggcctcgcagggccagcccctcgttccgcggtggcctttgcatcatcgcagtgtccgcaggcgcaggtccagcggtcaggcgcgccagctcacccacgcgctgcaacgcccctaacgcaggtcgacccagagccggccgcgcgcgtcagcattccgcgggcgcacagccgcgccagggcgctcgcagcctcagcgcgacaccgacccggcgatccaccctgagactcaccattggcgctgcgacctacacgataatacacacgcacctgccaccttacacacactccagaacaactgatacccgaaccgaccttaatcaaaaacacccacacacatcacgagaacagacaaccacgcttactctcctcggcactaccccccctcgcctcactcaacaacctcggaattaaaatcaataacctacacctccccacccactctaccctactcttcctcgcacccattctcacaacctgacgcagcacaatctcaacgcgcacaatcgtaaacaggcacctgtactgcgacacactttcacaaaaaccgaactacacaatgcaccctccacacacgcactgacccgccccgcccatgccaccataacgcgacagcac

SEQ ID NO: 569041 - DNA, 186 bp, Homo sapiens
  misc_feature (16)..(16): n is a, c, g, or t
  misc_feature (28)..(29): n is a, c, g, or t
  misc_feature (34)..(34): n is a, c, g, or t
ggaacagaaggtattntcattttcctgnncaganacccccccaactcctctgtttcagagtctatcgacctcaacaggaggaaacacaacagtcaacctagagctgctccgcatctccctgctgctcatccaagtcgtggcttggagcccgtgcagttcctcaggagtgtcttcgcccgcctggtg

SEQ ID NO: 569042 - DNA, 167 bp, Homo sapiens
  misc_feature (7)..(7): n is a, c, g, or t
  misc_feature (87)..(87): n is a, c, g, or t
  misc_feature (157)..(157): n is a, c, g, or t
tttttanttgttctgttagctgatgtcagtgaaactagccagttacgaggctggcccttggctggggacctccccaactccctggtngttcagcctggtgacctctgctcttccccggacccccgggcctttggcattatgctgatggggggctgcnggcagtgaag

SEQ ID NO: 569043 - DNA, 399 bp, Homo sapiens
cgtcgacacgagagcgcgaggatgatcatcatccccatctggcttagcatggagatgacaaaaccagcctggcgatggtgagcgaaatcgtagaacacccagggcaacaatatcgcgatgccgagcagcgcgagccaaacgataacagaccgtcgcctcatgtgtcgcgcgtgccgagcaggccacgcgggcggaagaacaggatcaacaccatcatcagcaacggcagcagcgcgccaatacgtgccacgggcacggtcaggatctcaccaagtaggtcgtcgttgcggggcacgatgccgatcggccgcaacaaatcggcgatcgacgcatcgatcacgacggaaaacgtcacaaccatccccattatgaccgagggtcgacgcggccgcgaattta

SEQ ID NO: 569044 - DNA, 290 bp, Homo sapiens
tctcttgtcgagatcattgtgctctaaagtttttttttttaaaatatagatctttatttttgataataaaaaaaattagtagttctagtctatatttgggggctcccactgggaaacataatttgatttaacggaaagaaccaccctctttaattagtgggagggggggacatttacttttaattcagtttcaccccctgcccaaggccctaagcctgtcatccagctgaccccataccataaagcataacggaggctttgtagccaacccaggccctatcattgagtaa

SEQ ID NO: 569045 - DNA, 1159 bp, Homo sapiens
  misc_feature (851)..(851): n is a, c, g, or t
agcggacggccctcaatgacacaccatggtgccccagagtgcaggtttgctacacagcagcgacgacgcaggcggcggccccagcggacgtcgcaacgtgccgtccctgaccgagcagcggccaccgaccaatgacccccgatgaagcctatcgccaccagccgcggcaggagaaccttagggtccaataacatgccatcttcgcgattcgactaaagctacagtcaagcaactatcggcgggtgcgactggcggctggctgggacagacggctggtgcgcggaagcgatgggcgttgttgtacagtcaaccgcaccgagggaccccgctatcctgacgcacgggacaggggggcctgcgctcagaccccccttcaaagagattgggcgtgctatgcaagtccggatgcggctcgtgctgtatcaagaacctccatcactgtcagctgccaagtggcctctggcagagggaaggtgacggtttctccggtacgaggccgctcgaggaaaggtgttacggaagcagacgttcagaagcgcccaatgagttggggcccgataaaggacacatgggtccccccgagttgagcgcatataacccgtaaaccactgagacattaggaaacggaagtatctccgagttccccagaattccttgctggataaaggaaagagaataggttcgatggacgcatagagctgcacgttcacataaccttttcccgggttccttacggggccgacggctggttaaacgccagatggcccttgccaggatcgccaccatgggcaagatacccaccgatacgggaaccaatttgaaaaggaacgggtccgagaaaacgggagcanttcaccccctgagccgattgtcaagtttcgaagcgcaaggacatacggtccaagggacggcgaagggcctccttccccggagggttataccaaagcgccagattcccttcacctgtgaattaaaccgggatacagcaaagagggaaacgcagagcggggtcccatttgtcgtagtgtggaaaccattacctttcgaaggtttcgcgcatccctgggaagagaacgcggaattggaaaagggccgattcttttccacccgaagaatgcttggcagttgtatatgaggcccgagaaccggaaattccgtc

SEQ ID NO: 569046 - DNA, 327 bp, Homo sapiens
  misc_feature (304)..(304): n is a, c, g, or t
gttctcattctatacgcatgcgagaaaacgacagaaaagggttgctgtgggggccattcaccagtttaggaggtggcgcaaaaatgacatgtgaataatgaccaagaagccggccctccaagagtgcagggaaaaataacaggggcatcccaacaagagggaaaagctggcatgaggctcttctgcagaggccattgaggcaagtgcaagaacaaataggatcaaagcctgtatggagtgaggcccagtgaggcagcacgcagcacctcatgggtcactccaagtgtgagggcaggccctggcncactgcttttcttaagttttgga

SEQ ID NO: 569047 - DNA, 1141 bp, Homo sapiens
  misc_feature (860)..(860): n is a, c, g, or t
tatacccttacatcctccttcgagacccggtcggtagtcgtctgccccagcccgcctgggggctgcatgctgccctgagccgcggccctcgagacgggaccgagagcatcatgggcagctactgtcccgctgctccgtcctccgtgctgcttctgctgctgctcctggcgccgggccgagcagccctgcgtgggccgagctcaccttcgagactgccggacaaccgccaagcatgtgtcttccacgaggcaggtggagcatgggcgtgaagttctccctggtattaccaggtcatcactggaggccactacgactgtcgactgcatatgtagaggacccccaggggaacagcatctacagagaaacgaagcaagcagttccgacagcttcacgtaccgggctgacagtcacagggcgtttatcagctctcgcttcagctaatgcagttttccaccttctctcacaagaccgtctactttgactttcaacgtggcgccgatgagcctcccattctcccagaccatgggcgaacagggtcacagtctctcacccagtatggacgtcacgcctgcgtgaccatccatgacggctctgacaacggtgattgactcccagaccgcattatccggctgcgggacggcccacgaacctgggcccgagcggcaacaccttaatacacagagctctcttactggctctgcttggtgagcacgatttgcgcttgtcgatggtcagcttcagccaagtgctactgtttgaaaaagcttcttcacacgaactacaccgacccattcaagcaggtcacttctccactctattaatcccgggcaatgcttgcatctaagagccctatttggccncaagcgctctgaagactgcttaatccatatggttcaattgttaggtagcatcatgaggtcaccgttaccccaactcgtttgatgcgctaactagcactctgacatagataacggcactaggcatcatatcaacaatgattatatactgacccacttcgactcatgacttcgctcagtgcccatcccttccacaacgcgcctccctgactacaaaatctgcaccgctcagactacatacaatttctaagcatcacatcatcatcgtgccgactgtacctctg

SEQ ID NO: 569048 - DNA, 318 bp, Homo sapiens
aaggtcaggcgttcaagaccatgctggccaacatggtgaaaccctgtctctagtaaaaatacacaaaaaattagcctggtgcggtggtgcacacctgtagtcccaggtacttgggaggctgaagcacgagaatcacttgaacccaggaggcggaggttgcagtgagccaagattgcatcactgcattgcagcccaagcaacagagactctgtctcaaagaaaaaacacttcgttgtgccaagccagactattatttaagccatctggtacttaaggaacatgttagataggtcacacttcatctctgtgataaataat

SEQ ID NO: 569049 - DNA, 583 bp, Homo sapiens
gggggtatgcccaggttgaagtgcaatggacaatctcagttcactattacctccgtctccagagttcaagcgattctcctgcctcagcctcccaagaagctgggatacaggcatgtgccagctaagctttgtgtattgtatttatttatttcatttttttgagacagagtttcactcttgtcgcccaggctggagtgcaacagtacgatctcggttcactgcaaactctgcctcccgggttgaagcgattctcctgtctcagcctcctgagtagctaggaccacaggtgcacgctaccatgccttgttaatttttgtattcttagtgcagacagggtttcgccatgttgcctaggctggtcttgaattcctgagctcaagccatccacttagcttggacttccaaagtgctggttttacaggtgttagccaccacaccttgccttacttttccccttttatttgctttgctatgaccgacttctgttaagttcaattctccacttcgtgcctttgccaataatagctgaacctgatttgagggacatagatagccttcttgactgatcttactttcagttcat

SEQ ID NO: 569050 - DNA, 117 bp, Homo sapiens
acgctcactcggccactcactacgctgttacttgatggtatccaagaagaaatggttggtgatggacaaattcagcactgcttccccaaaggtgggtggtttttcaaaagtttcagg

SEQ ID NO: 569051 - DNA, 509 bp, Homo sapiens
aaaagtatttacttgtgagttcaaatttatgaatttctagcatttgcttcaaaataatccagaaggtagggaaaaatgtaataaaagagatgaaggtcagcctccctagttagcctgggaccacaggcgcaggccatgatgccttggctaatttttggtatgtttagtagagataggggtttcaccatgtttgcccaggctgatctcgaactcctgacctcacgttgacccaccttgcctcagcctcccaaagtgtgtgggattacaggcctgttataagtttggatgttgaaagcacaaataagtcttggtgcttagagagaactggtctctacaaaaacaagaaaaaaaattcagccaggcacagcagcttgtgccccttagttgccagctactgaggaggctgaggcaggaagatcaccggagcccaggagttggaggttacagtgagctgtgatcactgcactccagcctggggtaacagagcaagaccctttctccaaaaaaaa

SEQ ID NO: 569052 - DNA, 1265 bp, Homo sapiens
  misc_feature (87)..(87): n is a, c, g, or t
tctttccccacaggctgagctggttgcccacaggggcccccgccccatctcagggagtgtccacccagccctgagcccgtcgtgagnggtcagagatggcgctgacccccgagtccccgagcagcttccctgggctggccgccactggcagctctgtgccggagccgcctggcggccccaacgcaaccctcaacagctcctgggccagcccgaccgagcccagctccctggaggacctggtggccacgggcaccattgggactctgctgtcggccatgggcgtggtgggcgtggtgggcaacgcctacacgctggtggtcacctgccgctccctgcgtgcggtggcctccatgtacgtctacgtggtcaacctggcgctggccgacctgctgtacctgctcagcatccccttcatcgtggccacctacgtcaccaaggagtggcacttcggggacgtgggctgccgcgtgctcttcggcctggacttcctgaccatgcacgccagcatcttcacgctgaccgtcatgagcagcgagcgctacgctgcggtgctgcggccgctggacaccgtgcagcgccccaagggctaccgcaagctgctggcgctgggcacctggctgctggcgctgctgctgacgctgcccgtgatgctggccatgcggctggtgcgccggggtcccaagagcctgtgcctgcccgcctggggcccgcgcgcccaccgcgcctacctgacgctgctcttcgccaccagcatcgcggggcccgggctgctcatcgggctgctctacgcgcgcctggcccgcgcctaccgccgctcgcagcgcgcctccttcaagcgggcccggcggccgggggcgcgcgcgctgcgcctggtgctgggcatcgtgctgctcttctgggcctgcttcctgcccttctggctgtggcagctgctcgcccagtaccaccaggccccgctggcgccgcggacggcgcgcatcgtcaactacctgaccacctgcctcacctacggcaacagctgcgccaaccccttcctctacacgctgctcaccaggaactaccgcgaccacctgcgcggccgcgtgcggggcccgggcagcgggggaggccgggggcccgttccctccctgcagccccgcgcccgcttccagcgctgttcgggccgctccctgtcttcctgcagcccacagcccactgacagcctcgtgctggccccagcggccccggcccgacctgcgcccgagggtcccagggccccggcgtga

SEQ ID NO: 569053 - DNA, 450 bp, Homo sapiens
tctttatcggtgagcaacttttccctctgtcacttttgaaatcagaaactccaagactccaaagtataaataaaatgaatctaatttttatatagtatgtatattcgagacggagcctccctttgtcgcctaggctggagtgcactggcgcaatcttggctcactgcaacctccaccttccaggttcaagcgattctcctgcctcatcctccgaatagctgggactacaggcatccatctctactaaaaatacaaaaattaggcaggcattgtggtgggtgcctgtaatcccagctacctgggaggctgaggcaggagaatggcttgaacctgggaggtagaggttgcagtgagccgagattgcgccactggactgcagcctgggcaacagagcaagactccgtctcagaaaacaaaaaacaaaaacacccccaccccaccaaaaaaaaa

SEQ ID NO: 569054 - DNA, 105 bp, Homo sapiens
  misc_feature (94)..(94): n is a, c, g, or t
cagagatcccctagcggctacctgctggcagatgcctgctgcagcctgacacatggcttttatcacacatgagagccactgtgcctagctgggnttcctcatctt

SEQ ID NO: 569055 - DNA, 716 bp, Homo sapiens
ttttcccctataaaaaggaaaccggtcgcggattaattgtacacctatataaagggaggcgtggtataataaaggcaggggggagccttatacggggctgcgctgttttaattgtttctcggccaaaaggactgtgggcacgccctcaggtagatctttggtttctgttcccaaaaccacgccgtaggttctcgaaaagcctctccaccaaaaaagtgatgccgtgggtcaggcacacaacttgtgatagcctgcacaccaggtaatctttttccttaggtctgcaccgagtaactcattccccaaactctcgccgaaattgtatttccaagacgtcagtatgtttgaataagacataaatcctagcatgcgtaacacagcgccgcagtgttttccttcatggtacacctgtgtgtgtctaaagcatccagaccctggtgtgtagtgtctcttgtctacacccagtgtattggaggcggtttgctttatttaagtttatacatatggcatgactccctcaaacatgtgatgtgcattataagcacagctgtgagctcatgtaatactctggctaagatggtggtaaattcaaaaacctgcttttctctggactctcatctcccccaaagccatgttgttcagggtaccttccagtgtagctgtaacttgtgaggtcaatttcggtaatattgaactattgagaaaagatcccgtct

SEQ ID NO: 569056 - DNA, 261 bp, Homo sapiens
gtacctctggataacactgagctttgagacagacactgagctgtggagacagacactgagcttgtggagaccagacactgagcttgtggagaccagacactgagcttgtggagaccagacactgagcttgtggagaccagacactgagcttgtggagagcagacactgagctagtggagagcagacactgagcttgtggagaccagacactagagcttgtggagagcagacactgagcttgtggggtaatcgtactaagat

SEQ ID NO: 569057 - DNA, 239 bp, Homo sapiens
  misc_feature (172)..(172): n is a, c, g, or t
cgctagagatctggctcagtgatctcgcagtgcaggcaaggaacacaggggtgaggggggaggttcaggaagatcgaggagcaggagtgggaagggtcttgaacagctgagacagaggcagggagatttaaaggggctgatctactccagtcagcgggccagtgtcaggaancaaccctcagaagtttcttctgcttccttaacctccatcccatccctcttcatcctgtagggctcta

SEQ ID NO: 569058 - DNA, 454 bp, Homo sapiens
acctctgacgagttccaaactaaataactggccaggtgcggtggctcacgcctgtaatcccagcactttgggaggccaaggcgggtagatcacccaaggtcaggagttcgagaccagcttggccaacatagtgtaactccatctctaataaaaatacaaaattagttgggcgtggtggcgcacacctacagtcccagctaatcgggaggctgaggcaggacaatcacttgaacccgggaggcggaggttgcagtgagccgagattgtgccattgcactacagcctggacaacaggagcaaaactccatctcacaaaaaaatgtataaactaaccatctatatgctacactgataaacctgtcacccgtcctgaatccacacatcacaagctgaccaacccccatctcactggcacacccctgcctcacccagtctccacccaccgctctgcgct

SEQ ID NO: 569059 - DNA, 370 bp, Homo sapiens
ctgggggccagcatggacgctggcccaattttgagagggtcagccttgctgagcctatgtttgcagcactttttgggaggcctggtcaccacagtcaccttcattgggatgatgcgctgcagccagttggcccccagggccctgcaggccacacactacagccttttggccacgctggagctgttggggaagctgctgttgggcactttggccggaggcctggctgatgggttggggccacatccctgttttttgttcctgttcatcctttttgcctttcccgttttgtacctggacctagcacccagcccctttttttgagttgagtggttggagtggtcaataaagccacatgtgcctgtggcccaga

SEQ ID NO: 569060 - DNA, 202 bp, Homo sapiens
tttacatatttgctacacctcatgccccagagccatccttaatactttgagtgtatgattttacccttatgtgcagaagaattcgagacaataaagtctcctggtttagatactgtgctatttttacttctatttatgccatgtgagattacagtactctctctataaggtatcgtaactgcttaatctccgagctggcgtt

SEQ ID NO: 569061 - DNA, 676 bp, Homo sapiens
attttggttttatttttgaacattttcctaatgatttggagagaaaactatttacaaaaattccacatcatcagtgatacaatttcttgctgtcaccaattttttataatagcagagctggcctgttctacgaaggccatatttctttaagttatctttcagggtaacatggcacatcaactataaagttggatgtcaaacctttaatatgtttctcagtgttctctaattttttggaatttctgtacgactttacacctggaaaacaacagatttgtaaaatcaccggaacaatcgtgtgcttcatttcataggtagtggttcattacggtattacatccccattttaaaaacaaaaacataataatggttacaacacgtggagtcttactaacatacatattacactcaacagtatattcttaaaagtacttgtgaccgtaaaatctttcttgtgcattttccaatactttgtcaaactgggaacctcaggaacatattttcactatgacacacggaaaatctgaccatatcgccctttttgataatgtccattcacttaactgaattccttaatgggggcctcatcacataagtttaactatgcacagcatccttaggaaacacgtttactctgcaaaccacttttaaaaaccataattgcctacttgattcc

SEQ ID NO: 569062 - DNA, 159 bp, Homo sapiens
ccccccaggggcttaaagatgtgctctgcttttttccaccttcggagtgtcactgctttttaggtcagtcccccccgcctcttttcaactttttccctatagggaacttactccgcgtcctgcccccccctcctaaataaataaaggaatcggcgaaca

SEQ ID NO: 569063 - DNA, 336 bp, Homo sapiens
  misc_feature (212)..(212): n is a, c, g, or t
  misc_feature (219)..(219): n is a, c, g, or t
  misc_feature (226)..(226): n is a, c, g, or t
  misc_feature (298)..(298): n is a, c, g, or t
gcttcttcacgtcgacgttcatgaacaccttcttcgtcacctgcacgtccacgccgaactgcagtgcggggccgaagctgctcttgttgatcgacacgccctgcccgccgacgttgagcccgttgttgtagaagtacgtgtagttcaacccggcgccgacgtacgggcgcaccttgcccgcatggttgaagtgatactgcagcagcagcgtncggcggncagacgnccacgccgccgaggattgccgaggcttcgacgtcatctggtgccgcgacgtgccgaggatcagcttcgacgncaaggtagtcgcggatcatgtacgtgaagttcgagttt

SEQ ID NO: 569064 - DNA, 526 bp, Homo sapiens
  misc_feature (497)..(497): n is a, c, g, or t
gtgtctccaactacagtctattactgcatggatcattctagcctccccttgcttattgtaaccttctactccaactgtgagaaacctgtctcctactatctgccatccattttactaattgtttattaattatataaatatatagtggcttcaaaattgtaaacctgtgcccctgtggaaaacaactttatcaactggagtagagtgctatgtacagttcctttgcctttggtcttacagactccactcatttccaaatttacctatgtcagtaccttattcccccatccctttcagtgagatgtttcatacatttgtgatacattaaaattcttttctcacattctgcatttggggactgctatgtaaatggtacttttacatttcaagttctaatgttcattactagtatataggaaagcaactgactttgtatattaatcttgtatgctgggacttgcaccaggcattgtcagttcttggcagccagtcaacgncagaataaagacaggtttatttcttccct

SEQ ID NO: 569065 - DNA, 143 bp, Homo sapiens
cctaattcgtgaaacttctgagcaacagccaacctgcctctatatgaatctgcagcctgtcctgcgccatatcctggaagctggaaggcaaacgaagagaagaagcagtacctgggaatcttacattcagtgacaaccgtgga

SEQ ID NO: 569066 - DNA, 188 bp, Homo sapiens
ccctttgagtgaggggctgcggctcctccctggggcagtgtggcctgctttttggttttccactggagttcacagctccctccttggctgaggtcaagggagccacgtgtgcagtgttttgtgtgaagtgtgcggggtacagaccctttttcctctgtaatattcaggaaataaacctctttgctgta

SEQ ID NO: 569067 - DNA, 173 bp, Homo sapiens
gctcggtacgcatttcgctgtcgctgggacacagtcatgtgcctcagcccggctaatttttgtattttcagtggtgacaggctttcgccatgttggccaggctggtcttgaactcttgacctcaggtgatcctcctgccctggtcccccaaagtgctgggattacaggcatga

SEQ ID NO: 569068 - DNA, 114 bp, Homo sapiens
tgttctaatgcagaactgaggatatagcactgaggaagacatgagcctcatgagctaggggcagtatgccacactgtataataaaatgtataattgttagatggtgttaagcat

SEQ ID NO: 569069 - DNA, 757 bp, Homo sapiens
  misc_feature (563)..(563): n is a, c, g, or t
  misc_feature (708)..(708): n is a, c, g, or t
gggagcctcgtagggctggagagcggcgaagacaggcagctgctcggggacgttgcagcaggacatcaccaggagggcgaaactggccactgggaggggggccccggtgtacattgctgcagcagggaggtctgcacggggctcggtactgctggggcgccggtcccgacgaggcacgtgcgggccccagggatctggttgctgtaggagtggtgccacaagtggacattggttgacgcgtgtgtgtccctctaggcgcttctaggccgcctgaggggcgtggctttgggctggaaccagggtaccagagaatctcgagggagacagtcaccagtgggcaattggaggtgggaagaacccagggactggagggccggaagggctgtggctgtgtgggccggggcagttggaccttagaaggccatcttgcagggacgtgggaaggcggcattggtggtgccagaggcaaggaggcttggaaagcgagagccagccaattccgcgcgccgaggaacgccattgcggtggtattgtgagccgtggggatcctttgcatggatagnttgccaggtgggatacctaaccggggctggtgtcccttgcgcctgttggcacgtggccgctactgtcaagtcggctgagcgatagttcgagtggatggacgcgtacagggttcggttatacaccgcgatgcgttgttaaccggcnacggaaacggtgcccaaggaggtactctaccgaagacctatgggagatt

SEQ ID NO: 569070 - DNA, 100 bp, Homo sapiens
agtcagtcctggccaggtcagctcatccaggactcggcgcaagccgttgatgtctagcctcaacgccctggcgcagggccagctcattctcatacttgag

SEQ ID NO: 569071 - DNA, 139 bp, Homo sapiens
gacgactgactgcgcggtaagcttcgcgggtttggactagaatggctgttactacgagggctatgtggctgattgaagagtatgcatgagcgattttcggtctgtttgtcgtaggcagattgagcttgttccgatcgta

SEQ ID NO: 569072 - DNA, 863 bp, Homo sapiens
  misc_feature (46)..(46): n is a, c, g, or t
  misc_feature (82)..(83): n is a, c, g, or t
  misc_feature (91)..(91): n is a, c, g, or t
  misc_feature (111)..(111): n is a, c, g, or t
  misc_feature (115)..(115): n is a, c, g, or t
  misc_feature (118)..(118): n is a, c, g, or t
  misc_feature (134)..(134): n is a, c, g, or t
  misc_feature (138)..(138): n is a, c, g, or t
  misc_feature (155)..(155): n is a, c, g, or t
  misc_feature (166)..(166): n is a, c, g, or t
  misc_feature (185)..(185): n is a, c, g, or t
  misc_feature (226)..(226): n is a, c, g, or t
  misc_feature (256)..(256): n is a, c, g, or t
  misc_feature (263)..(263): n is a, c, g, or t
  misc_feature (284)..(284): n is a, c, g, or t
  misc_feature (286)..(287): n is a, c, g, or t
  misc_feature (292)..(292): n is a, c, g, or t
  misc_feature (337)..(337): n is a, c, g, or t
  misc_feature (356)..(356): n is a, c, g, or t
  misc_feature (393)..(393): n is a, c, g, or t
  misc_feature (414)..(414): n is a, c, g, or t
  misc_feature (418)..(418): n is a, c, g, or t
  misc_feature (425)..(425): n is a, c, g, or t
  misc_feature (456)..(456): n is a, c, g, or t
  misc_feature (490)..(490): n is a, c, g, or t
  misc_feature (519)..(519): n is a, c, g, or t
  misc_feature (547)..(547): n is a, c, g, or t
  misc_feature (712)..(712): n is a, c, g, or t
  misc_feature (725)..(725): n is a, c, g, or t
  misc_feature (727)..(727): n is a, c, g, or t
  misc_feature (752)..(752): n is a, c, g, or t
  misc_feature (857)..(857): n is a, c, g, or t
atggactggcattgtcccagatatagccgttggtacaaagcggggntctgatgagcttttctctacttgtgtcactaacggnncgtttatnatgagcagcaactcggcttntgcngcnaacggaaatgacagcnagangttcaaaggtgacagcngaagtgcaggngtcccctctagagtgatcnacatccggaagctccccatcgacgtcacggagggggaagtnatttccctggggctgccctttgggaaggtnaccaacntcctgatgttgaaggggaaanannaggtnttcatcgagatgaacacggaggaggctgctaacaccatggtgaantactacacctcggtgaccnctgtgctgcgcggccagcccatttacatccagttttntaactataaggagctgaagantganagctctnccaaccaggcgcgggctcaggtggccctgcnggcggtgaactcggtccagttggggaatctggtnttggctgcttcggcggcggccgtggacgnagggatggcgatggttgggtagagtttngtgctcaggatcatcgtggagaacctcttctaccctgtgaccctggatgtgctgcaccagattttctccaagttcggcacagtgttgaagatcatcaccttcaccaagaacaaccagttccaggccctgctgcagtatgcggaccccgtgagcgcccagcacgcnaagcttttttttnangggcagaacatctacaacgcctgcngcacgctgcgcatcgacttttccaagctcaccagcctcaacgtcaagtacaacaatgacaagagccgtgactacacacgcccagacctgccttccggggacagcnagccct

SEQ ID NO: 569073 - DNA, 426 bp, Homo sapiens
  misc_feature (47)..(47): n is a, c, g, or t
  misc_feature (57)..(57): n is a, c, g, or t
  misc_feature (159)..(159): n is a, c, g, or t
tgattctcatccgctctggccccaagcactatttcttccttttccanttaggccccnacaagcctgtagcctttctcactccatccccacccaaagtggtcagaccttgtttagttatttataaaactgtatggacctccctcacttttttcctatcantgctttcctactttccttttatctcactttagtccaggggccaagaatttcccttctaccctctatttttttgtgtttgtaagttacaaagtcaggaaaagttttggctggacccctttcctgctgggtggatccagtggtccaggactggggtttgggcccaggttttagggaaaaggttgcaaagcccttcccccctctttgaatagtgggtatgtgttggtttattgattctgtaaataagtaaaatgccaatatgaatcctca

SEQ ID NO: 569074 - DNA, 911 bp, Homo sapiens
tgtacacaagcaatcgaccggtatgttgatagcacagggagtgtatggttccctgtaaacactaagttagctgtttgcatttaaggacctgtggtttaaccctttggatcactaccagccagttatcaggcaccagagctgtagcagcgtatatcctttttattgacatcatggatcagtgtcatttcgattccatctcattcaccaaaatattcgatgaatgtaatggtcactctgtcacccaggtccctatgccaagcatctgggggtacatcaggttagtggctaaagtagaacaatagcgatttgttcattaggagcttagcagtccaggaggcattgtacgattcaggataatgacaacaatcaaatataaataggcaatgatgtcactaggtgtgaatgaagggagagtgcggagtaggccaaatgaggtaatgtgtagaccatggaggatcacaaagcaatatatatctatgtgctgtaactggtaccgtaagagggtagtatattagtcactacaatgtaactaatttcacatgattgaaaatttaatgtaagttgagattacaaaaaggccagttcctcaattaattaagcaaccgttgtcaagtgcttgatgaagacagtgcatgattatgtggttggcgctattggaataggtcagaagtagaatcttttcatcatcacaggacatgtgcgtattggacagtgctcttgctagaatctatgcatagactacccgaggacttttcaaagtcatgcatgtgcagtcaagggaagaggtcgtatttggagcagggtgttgaaaagtcccttaagaagagaaagaccagaaaagttgccgtggaatggcccaactgaatcaaaggatattgccccatttagattgttgaggaaaacagaggcgc

SEQ ID NO: 569075 - DNA, 324 bp, Homo sapiens
gctaactagtaacggaagggtccccgaggttggggagagccccacgttgagaacatataatgcaacacacttattgtactgaagccactgttaccaaacagctgatcacaaacaacctgtgtgtaatatttttcccctaaaacgtagcacccttcagcaggaccctataaaactttcctccagcccttgcctctttgcaggtagccccttctctgctgagctgcccactgcaacatattttcacaatttctctaataaatctgcccttctttacctacaactatcttggtaaatggctttaccacctgcaaaactgaccctagg

SEQ ID NO: 569076 - DNA, 1659 bp, Homo sapiens
  misc_feature (1213)..(1213): n is a, c, g, or t
  misc_feature (1363)..(1363): n is a, c, g, or t
caagtgaggaactagctgcagagtggatgagtgaccaccatccaggctgagactgaaaggaggcgaagcttggaaattacacggaattctttcccctgctagcaaccatgtgcctcccatccgtgactgtggagtttgggatgttggaagtggggctggaacaaagcgttctgcctagggaggagcgtaagcaggagcggcaagtcacgaaagacaaacggaaggagaaagaagaagcgagagagaaaaaagaaaagacaaaaagaagcagcgaaccgagcgcgcgacgagcaagcggggaggagagagagaccgggggagcggcgagcgagggaggagggcggcagcagacgagagggccggaggggcggacacgcggagaggggagagaggggaggacaggaggagggcggggacgggggggagaaggcagagacgagggcgcagagcggagggaacacgagaagcagccgcacggagagcacgggagagagcagaggaggagacaagagagagagacagaggaagcgaccagacccagagacagacagaaggagcacagagagcacgacgaaagagcagggcaggcagcgaagggtacgaaggcgacagaacgaggaagcagggagacacggggagagaggcgaacggagactgacgagcaaggagagacagaaacaggaccagaaagagacacgcgcgaagaagaagacgagagacgggagaaccggcaggcgaggcgacgcgacagacagccgagagacgagcggcagcaagggagcaggagcagaggcgagatggacagaagagagaagaaggaagagacgagagagtacggggagcagcacggggcacgggagcagaggaagacgcagcaggggagacaagccagcgaagcagaagcgagagagaaggagaacagagcaagcgagaagcgaggagaccgagcagagatggagacgagcgacagaagcagcgcagacgagcacgaggagccacaggcaagaggcagcagagaggaggtgacgcgtgagggtgctagagcagcgcacgacgaacagaagcgagaagcgaacatgagaaggagacagcgatagagagcagcaggagaagagcagagatgcgagggtacgaaagcgagagagaccgcgacgacgaatcgcagggacaaggagaagcgaaaggcagaggaagggagcgacgagacgaaagngtgaggaacgaagacagcagcgaatgggcagagacacgagagcggagaagagaagagcgcgatagagacgaggacgaggagagagagaggagagacgagaggagtacgggagcgcgagaacaggacagaacagcagaacagggaggaggngcgagcaagaggacaggcgaagcagcgaagaagagaggagcggaagagaagagaagaagcagagacggcagaggacgagcgactcagacgcaccagacgagcaacgagcgaaaggagagggagagcgaagctagacacgaggagagagacagcaggagcaggagaagaagcgagcagacgaagcggagagaagagaggggaagcagacctagaacgcgtcggagagaggagacggagacgcggaggaagcaggggccgcaggaggacgaagcaagagacgaaggaaaggaagagag

SEQ ID NO: 569077 - DNA, 1363 bp, Homo sapiens
  misc_feature (442)..(442): n is a, c, g, or t
  misc_feature (723)..(723): n is a, c, g, or t
  misc_feature (771)..(771): n is a, c, g, or t
tgcagtggctctcacctgtaatcctagtactttgggaggctgaggcgggcgatcacctgcggtcaggagtttgaggtcagcctggccaagatggtgaaacccatctctaccaaaaatacaaaaattagctgggtgtggtggcacgtacctgtaatcccagctactggggaagctgagggaggagaatcacttgaacccaggaggcagaggttacagtgagccaagatcgcacaactgaattccagcctgggtggcaagagcgaaaactccaactcaaaaacaacaacaaaaaaagtatagtatgctttcatttatttggggaggctaaggtcagttagaaatgtgaaacaacagaggtatgagagagaaatgcattttgtgtgtatatcaaagtctaggaaaatgcaaaacaaatgttccaccatcattaagatggagtggnggatgcaacgaaggaggaagtattttctctatatattttgctgatatatttgctgatatatttggctgataagggatgccaaaatatgaccattctggtttagaagataatattggtaatgaaccaaatttaggtgatatgatatatccttacaggtaaaatattgaagtttactttcctggaagaacaatggatttgaatgtaaagagcacttgcccttggagaaaagaggttcttcttcttccttgcctatcttggccttgaaggaaaggacttaatcntcacaccggttcttaaatcccttatgcggattacgaaagggcttatcngtttcaggtggtaagaatatggaacctaatgatgctttggctggttttccttatggaatcaaacccattcccaagggatacatgacacctcttggtgaaacccggaatcattacaccccaaacatccaatttttgcgcaaacctcggaagaatttgaaactgtgcaactgggtcaaataaaagggctccacttgtgaagaataaccaattctggtcaccaaatatctatccccgtgaaaataaaggtgtggaatatgttcgcaaacatgcccatatttttctcatacaagttcctagtaagaaggctcatccctctctaaatatgtccacggagaattcttgtggtctaagatatacctcaatcatggtgtcgtaatcctttcacgtatatgtgcgacttatttattgggggtaaaataactctttactctaaaagctcttatttctcctcctcgttcctttcgtctcttcgctctcaactctctggttagctctataccttacatctttgtactccctgttacacagttcctttaacatcttctagtctctagccctctctcgtatctgatgctccgcgtctcgtgctccc

SEQ ID NO: 569078 - DNA, 317 bp, Homo sapiens
agtgagatcgctaaaaaaaaaaaaaaaaaaaaaaaaaagagaatggctaatccctaaaaggggttaagtaactttactttgatattggatgacaatgatgtaagcttttttccctctgcacaattaaaatattttattttgacttttcacaaaaaaaaaccccaaacagttaccctgtcatagcctcggtgaaccccctgatttgaattcgtgtaccttaaattcttctcaatcactttattcgggtaaatgcccttctgattgtgaggataggggtttcgccccagaaagaaaccatcggccgtgttgccacgaga

SEQ ID NO: 569079 - DNA, 852 bp, Homo sapiens
tcggatcggtgaccagcgcgtcggtcacgtgggggtgtctgtggggactcccattaaagcagagcggcatgctgctcggaagtcgtgagtcgagtcttcccgggtctaatccatgccgggttggaggctgctgacgcaggtcggcgcccaggtgactgtgatcgactcgagggacggactgggctgctgccctgggcccggggaacagaacgagacatctggcttttcgttagaggtcattcatggaaagatgtggtacatggtggtgatgagcatctttctgaacgaacaatgtcccattcattaagcagttggtctctgatgaagactaaagcccaattagcacagtaaactgtgtcctctgaaaggatgaaccatggcctataacatccttgggaaccaggttcctttagagttggtcttatttgccttgaagctgggccatgatgcctttatggaccaaaggatggtcacaacgcatgtggtcaccattactacagggtacaaggactgtccatgtccttagccaatactagcgtcacacagcgcacacacacctgtcaactggccaccacactggccacaccgcttgtcctgtcgcagcagggcacaagaaccttgtagtccacggtatttcgcggctaagaggcgtagcattcccatacttcggaacatatttaccccgtgggacgccttgggagtatgccccggccggacaagccagaacgaaggttaacacacgtctttttacttattacaccccgaattaattgcgctgccagacttaagcgcagtgccacctcccgtcgttctactgccttggtccacttatcggaggcagggcacggtccg

SEQ ID NO: 569080 - DNA, 1630 bp, Homo sapiens
cccacgcgttcgggcacggtgcttctgggaccagtgccttagtgagactgaccaggtgtaggaggtgataccagagagtgtggcatgaaggccaatgtcacctgagaatgcccgtatggcccatgctgacgtgctgcacgcgtttggacttcagagtgaggatggggataggccatctgaatgatgtcatagaccgagaggatgggcacgaccgtgtgtacggtgtcaagttgtgcggttacattgttttggcctggtccactgtctgaccgtgacgtgacttagatgtgtagcccctgtcatatgtacaagacaagccacagtagtggaccatggatgcactgggaaaatccagacgagagtgccaaataggaaaatgtcgcctgtcgagggtgatactacgaactcaacattcgtactaccgtgcgatatcaaggcgacagacatctcagatacatgactagacggagaaaaaagcagcttaagcaaaatagccattcccacgtccataatataacatcaaccagaaagacgcggtggtgcacacgacgatcatttgacatcacaaggatcaaccccctaagaggacatgagaacattgaacatttatgggtgtggccatagaccactagtgggcaggtaccaccataggaaaatcccatgcgtggcgcatcccacaagcggttacaacagttggaaataacacataaattgccgcatacaagacccatcccccgagaagattaagcatcgggagtaatactacaaaggcgacgctacagcaaacccaaaaacagtagacccaccggaggatatgagatacacggaaagtacaaacaaacgacaacgaacagaaaacgggagacaactaaggcgcacagatgatcatgaagcaccaaacgcgaacatggagacactctgcacacatcacggtgcaacacccaacaaagggacggaaaaccccaacacaagacaccatacaagaaccatcacccaacaagaggtagccacagggcaaaataaccccaacgcggcaagtagcagcacccaccactggagcagccatgggagcgcacaagcccaaaaacagaaagacacaagcgatgaaatacccaagactgaacaatgtgacaacgcaacacaaccgggggagcaataataggaagcaccacacagaccacacaaacacaagcagagacaaaacgatcaaagaccccccaaacaactaccaccaacacaacagaagaaaaccaagcagcggtagccaaacaacacaagaacaggtagcaagaaacaccatagtgacgcccagaccagaccactcccggagcaccaagccagggccataaacccggttagatgaactcacatcaatgcaacgcaaagggacacccaacaacaaaaacaggacaccacaaatggagacgagcccaccggacggaaagatacgtataagagagaaagatcagtcacaaatgacgagatagaacgaagaacaacgagaacaagcggcgaacacagccgcgcagagagagcgaagaacgacagaacaacattcgccacacagaaagagcgactagaaggaacacacagacagcaggaccaccgtacactcctcatgcacaaggca

SEQ ID NO: 569081 - DNA, 287 bp, Homo sapiens
  misc_feature (74)..(74): n is a, c, g, or t
  misc_feature (139)..(139): n is a, c, g, or t
  misc_feature (175)..(175): n is a, c, g, or t
  misc_feature (265)..(265): n is a, c, g, or t
gtctctgacggactccccggggtcggggactcacgaacggactctccgtttggtgggtcacgacgacttctggntgtcgtgtctgggtgacggtcccaacacccactgcacgacgacctttaccttccggttctggggnacgacacacgacactctgacacacacgctctcctgncagcaaccacctttctacgactgccaaactacacactcaccacggaccgtgcagcctttactggacactgaccaccggagtacccgacgnctcgacacttcgtacctcactg

SEQ ID NO: 569082 - DNA, 344 bp, Homo sapiens
aatccaaagaaacaggaagattattagttgccagagactggagggagagagagaatgggaaactgaggctaactgggctgcagtggatctcttgttggggctgatgaaatgttcttaaactagcacagatggtcaagacgctgcacaacgctatgcatatacaataaaccacagaactgtacattttaaaaaggagaattttataatatgtaagttatagcttataatgattacatgtaaaaaaaattccaacgaggaaaacgctctaccattgcacatttctttctaagaaaagaagtagttcctttctcactcactatttaaataatacttttacttgaaga

SEQ ID NO: 569083 - DNA, 882 bp, Homo sapiens
ccacgcgtcgcgcggggcctgggccatgcggcagttaaggcccgcggtgacagcatgggtgaacggggagcgggtgcagaggaggccttgaggcatgttttcgtgcggaagggtgaggcgcgtggggctggcgggtcagattcccgggttcaggccggggctctgactcgcggttgtgtgttcccccgaccccgcagcgcggggtgtcctgtcctcgccatgaggccgcatactaggcgccaggtgtccagcaaaggtgttcattcttgcgagactacagctaggtggggacatcgcttgacagttctcgagatccaaggttccctgcggagcgtggatgaaccggattgatagggcagcagtttgaagaaacagttcgaactctaaataacctttatgcagaagcacgcagaagcttggcggccagtcatatctcgaaggttgtttggcttgtttaagcagctatataccatcttcctatgcatggaaactcattatgagaaggttctgacagaaagtctccaaatacattcaagaccgagaatgagaacgcatctattgctccagaagggctcgtcctgacagagcctatttgagcgaggactgcagagttattcgaaattgaccatttcatgaagacagaggcatgagcagtggaagataaagcgaagaattacagatcccacttccagccgggcccctcatgtatccactggccgaacgcagagttgtccgtacctcctctccgagagcatcattccttttctatctgctgccagagccacggtgccatttactcgaaggaactcagttttctaaaattccacacctggagttgaccttctagatcgctcagaatccacttgtgtctcaaattgtgta

SEQ ID NO: 569084 - DNA, 696 bp, Homo sapiens
gcacatctgtaatcctagctacttggcaggctgaggtgagaagatcattggagtttaggaattggaggctgcagtgagccatgagtatgccactgcactccagcctgggggacagagcaagaccctgcctcaaaaaaaaaaaaaaaatcggccaggtgctgggattacagggtgtgagccaccgcgtccagccagctttataatttttttaaagctgtcttggtgtcaaaatgatagttcatgctcctcttgttaaaacctgcaggccgagcacagggggctcatgcctgtaatcccagcttttggggagaccaaggcggatggatcaccctgaggtcaggagctcaggaccagcctggctaacatgggtgagacctcatctccatcttaaaatacaaaatttggccggccgcggcggctcatgcctgtaatccccagcatcttggggaggcctaaggcgggtgggatcacgaggtcaggaaatcgagaccattcctgggctaacacgggtgaaaccccgtctcttttaaaaattagaaaaaattaggcgggcgtggtgggtgagcgcctgtggtcccagctactcgagaagcctgaggcaggagaatatggcttggacctgaaagggggagcttgcggtgagctgagaatggtgccactgcactctaacctggcgacggagtgagacaccgtctc

SEQ ID NO: 569085 - DNA, 250 bp, Homo sapiens
tgaggtcgggacgaggttccccccaagagaggatgctgtcctcataaacggatgtacatgaaccattgagcgacatgtgagggtactacccagaaggaagtggtgccctcccgtcctcgccaaaaactcgggcatagttggcacgccgtcccaaacttcaggcctccacaacctacagaaatcactgtctgctgtgtcagccaccagtctctggctttcctcacgactcccgggtgactatttttgccat

SEQ ID NO: 569086 - DNA, 311 bp, Homo sapiens
ggtcggtacccggtaggctatcaaattcatgttggttttcctcaaatcgtgtaaaacaaaaagaaaaacccacaaactggccatctactatttctccaggactgggccagtctggccctcaaagagcttcagaacaagattcatgattttaacgcctgcaaaaagagaaacctacaagcacccggaaattcggccctagcgtctccccattattaaatctcccttttacaccttcagttacgaaacacctcccccatttattatttagaaaaattaaattacaaagggtttaccattaacgttaaggttct

SEQ ID NO: 569087 - DNA, 113 bp, Homo sapiens
ggatttgctggtccagcccaactaggcttaatagggacatgttcatacacctatctcccattctcctcctatccctcaaccccgacatcattaccgggttttcctcgtaaaaa

SEQ ID NO: 569088 - DNA, 640 bp, Homo sapiens
  misc_feature (390)..(390): n is a, c, g, or t
gtctgtcattgatgggcatttaggttgattccatgtcttgctattatgaatggtgctgcaatgaacattcgtgtgcatgtgtctttatggtagaatgatttatattcgcctgggcatatactcagtaatgggattgctgggtcgaatggtagttctgcttttagctctttgcggaatcactatactgctttccacaatggttgaactaatttacactcccaccaacagtgcacaagtgttcccctttctctgcaacctcaccagcctctgttattttttgattttttactaatagccattgtgactgatgtgagatagtatatcattgtggtttcaatttgcatttccctaatggtcagtgatattgagcttcttttccatatgcatgtnggcaacatgtatgtcttttttggaaaatggatggcctgtccttgcccactttttaatcagggtcgtttttctcttgtaaatttaacgttccttttaaatgttggatatggacctctgtcagatacatagtttgcaattattttctccctttctttcttttttaattaaatgagtaaacatgaacacattcttattgttaccaaattggttaggataattactgtctggatggcatgtgttgacgagatcg

SEQ ID NO: 569089 - DNA, 409 bp, Homo sapiens
tttatgcttccggcacgaggttttttttgagacaggtgagacagggtctctgtcgcccaggctggagtgcagtggcacgatcgatcagtgctccctgcagcctccgcctccctggctcgggtgatcctcctgcttcaaccccctcttcccccaccaccactacagtagctcggactacaggtgtgcgccattacgcccgactaattttttgtatttttagtagagaccagattttgccacattgcccaggctggtctccaactactagacccaagcgatctgcccacctcggcctcccaaagtgctggaattgcaggtgtgagccacctcgcccagccagtacttaaaaaaaaattttttttaaccataagtaatgcattcattaaaatacctccaagctgttgcaaaa

SEQ ID NO: 569090 - DNA, 575 bp, Homo sapiens
  misc_feature (8)..(8): n is a, c, g, or t
  misc_feature (11)..(11): n is a, c, g, or t
  misc_feature (13)..(13): n is a, c, g, or t
  misc_feature (15)..(15): n is a, c, g, or t
  misc_feature (377)..(377): n is a, c, g, or t
cctgcacnagntncngtatctataagcttgatctttgatggcttgttggtggtcgttgactttttttttggtgtgtgatgctcaccctcacggcggtttgatctttgtccatttcttgttttttcttcttcttttttcacataacaaacaaaccagggagaaaaacttttttaggttttttgtttatatcgcgtttttttttgtttctaaggatgtctgacgaagaacagtccgctattgtctgtgacaacggctctggcatggtgaaggccggcttctccggcgatgatgcgccgcgccatgtgtttccatccattgttggccgaccaaagaacgagcaagcgatgatgggaagcgccagcaagaagcttttggtnggcgacgaggctcaagcaaagcgtggcgtgctttcgctcaagtatcctatcgaacacggtatcgtcaccaactgggatgacatggagaagatctggcatcacaccttctacaatgagctgcgcgtcaacccggagttcccacagcgtcctactaacagaagcccttatgaaccccaggcaaaatcgtgagaagatgac

SEQ ID NO: 569091 - DNA, 237 bp, Homo sapiens
  misc_feature (8)..(8): n is a, c, g, or t
  misc_feature (11)..(11): n is a, c, g, or t
  misc_feature (13)..(13): n is a, c, g, or t
  misc_feature (15)..(15): n is a, c, g, or t
  misc_feature (174)..(174): n is a, c, g, or t
cctgcacnagntncngtatctataagcttgatctttgatggcttgttggtggtcgttgactttttttttggtgtgtgatgctcaccctcacggtgggttggttcttaatccctctcgtggttcttttaattcttttttcacataacaaacaaaccagggagaaaattggttaanggttttttggttaatatacgcgttttttttattttgggtgggtttctaaaaggagttgtgttt

SEQ ID NO: 569092 - DNA, 502 bp, Homo sapiens
  misc_feature (42)..(42): n is a, c, g, or t
  misc_feature (304)..(304): n is a, c, g, or t
ggttttgtagaacttcatgtcttccccaccgatgtccatggngagtgccctcttcttgtttacccacataacaaacaaaccagggagaaaaacttttttaggttttttgtttatatcgcgtttttttttgtttctaaggatgtctgacgaagaacagtccgctattgtctgtgacaacggctctggcatggtgaaggccggcttctccggcgatgatgcgccgcgccatgtgtttccatccattgttggccgaccaaagaacgagcaagcgatgatgggaagcgccagcaagaagcttttggtnggcgacgaggctcaagcaaagcgtggcgtgctttcgctcaagtatcctatcgaacacggtatcgtcaccaactgggatgacatggagaagatctggcatcacaccttctacaatgagctgcgcgtcaacccggagttcccacagcgtcctactaacagaagcccttatgaaccccaggcaaaatcgtgagaagatgac

SEQ ID NO: 569093 - DNA, 737 bp, Homo sapiens
agcggagaagcctgaggagccggatagggtgctggctgccgcgtcgtccgagtgtgtttatggaccatgtgctgctatgtatgcctgaacaagtacttgacatgcacatttggggagagctttgccatataaatgctctggctggattaagcgcctaattaggatggttatgtcaatcaagttggagtacgcatgcaatcagtgtacttttggtctaggaagccatatggttcgtctcgaaggtatccgtagaggcaaaattggtactaattggtctctgcattcagtgtccaatgagtacagtcttcagattaactagccatgcaacagaatggagtcccagccacccaggagaggatgcagttggcgtctgttatgctgactgtttggatgggtagccaaacgaagaaggagagtgtatcagcaagactaaggaccacgaggtcagatcaggaggccagcccttcaggatgacctttcttttctttcgacgaaggcccctaagcagagcagatttccttaccatgactgggtctacaatgaagaggctcagcctgaagatcccagcgcgggccaaatgaggaagccactgcaggaatgattgtgcgctctcgaaaaaatgaacttgctgcttctcagagactcagattgccagaattgttgacccagcaggagcatgcaaaattctcactgcaggttgacttagattctagcacatttggtaccagtacaacaaa

SEQ ID NO: 569094 - DNA, 175 bp, Homo sapiens
aagtacgggattgttcgtctgaggcccaacttcctagctctttgcgaccccgactggagccgggtcaactgctcggtctatgtgcagctggagaaggtgtgcagggcaaaccctgctgatgtcaccgaggcacaggtgtctttctactcgggacactcttcctttgggatgaact

SEQ ID NO: 569095 - DNA, 992 bp, Homo sapiens
aattattaatgaggtcgtacttggttttaatttcggtactgtggggtggcatccgatgaacgctgtacggctgacgcttcgtttcatgctgcatgccctggtcctggccatggctggcccccgcccgtctcccgcgatctccgtttcggtctcgtgctccggctttttacgccccgcagaagaatgttcggccctgtggtggccccaaagcccaaatgtgaatcccttcctggccctggggacgagcgagcctcccccgtgcaccctgtgggcccatgctgctgcacagattgggcctgggtgggcgagattccccctgcgcccctggaaggactttcccctgcctccagctccccttgctggggatgggcgacgattgcaagaggcgctgctcgtgggagggtgccttcccgcccgtcccccttcctccggagtccgaggaatccatttcccccgcgttcgccctcgtggtaagcgaggaagatacttccgctttccccccgtgctgccgtcccttccgtgatgatgagtgaaggtggggggccatgagtggcaccacacaataaacgggacacacaacaaacaacaagacacccatggagacacaaagtgttgacgacagattaatattgaaatttatggacagaacatcgtaagtaccgtccttacaccaatcacatatgcatgggaaagtaaacgaatatggtctccaaaagcaaaatgtgattcacttttcataaaaaagtcccgagagtgttattattaattcataggaagaaaagttggttggcgccacaaccaataaggaacacaacaatccgatttacagggtttcccgagatgttacgagtagtaccaaaaaagctaatgacaaggccagggtggaagcaacaaagaaaacacaccgtttacaatcgtaataggaaaattaccacattaaccaggaatcctcagtactttatgaccaaatgataacacaggagaacgagacc

SEQ ID NO: 569096 - DNA, 497 bp, Homo sapiens
  misc_feature (20)..(20): n is a, c, g, or t
  misc_feature (73)..(73): n is a, c, g, or t
  misc_feature (83)..(83): n is a, c, g, or t
  misc_feature (88)..(88): n is a, c, g, or t
  misc_feature (90)..(90): n is a, c, g, or t
  misc_feature (120)..(121): n is a, c, g, or t
  misc_feature (282)..(282): n is a, c, g, or t
  misc_feature (325)..(325): n is a, c, g, or t
  misc_feature (330)..(330): n is a, c, g, or t
  misc_feature (334)..(334): n is a, c, g, or t
  misc_feature (337)..(337): n is a, c, g, or t
  misc_feature (343)..(343): n is a, c, g, or t
  misc_feature (372)..(372): n is a, c, g, or t
  misc_feature (374)..(374): n is a, c, g, or t
  misc_feature (377)..(377): n is a, c, g, or t
  misc_feature (424)..(424): n is a, c, g, or t
  misc_feature (489)..(489): n is a, c, g, or t
tcattccatcaaaagaactnaaactagagaattaagcccactttatgaagagcgaattcacggcagcttgaancaatcgaaantgganangtgttcagcactttaaaagggtcaacattnngcttctacccagattggtctcaggtctgtcttctcatccatccctttctaaagccaaagcacatttgtagcacataatccaggagaagcagaagtaaatgctatgactggtggtatttcttggcctggtttttgtagtttttaggcagtaagtagattatnagcgaacaaatgtgaaggttcatgtggagtcataatacctgtnatctnggtnttntttttntcaagctcagagacaacaaagccttccangncantaggcaatggtgggtttctagcaccatagactgtctactgacctcantttttcttttggaatggagttagacatggggagcttcaaaaagaacagacctagcaattcatttnagtggaag

SEQ ID NO: 569097 - DNA, 526 bp, Homo sapiens
aggccagaatgagcatatctagcagcctctacttatctaactatggtacgctgctccatcacatcaatacgccgccgtatagtgctgcacgacacgtggagtaacaagacgctgaatcttgggtgcttgggtcctaggtttcttaccttctttagtataagggctttcttacaacatactggcggacatcatcttcttaatagagattgaaaagtttgcggatgctgctaactcttttggggcccatgcggtgaggcactgtagtatcagtcagtccaggaatatccttctctcctttttttacaataaccaagttgagaacgctcagatttgcatccacaatgcaaccatgaagctgatgttctctttcagacccaaatattcgacttgatgcttgaccctgctttcctcccagtctctgggctatcttggtttcgtttggctagatccagcgaatgtagtggggcgtacatatcatcagggtgctcacaagctcatagctgtgtcctgatatttcgcttccggc

SEQ ID NO: 569098 - DNA, 393 bp, Homo sapiens
  misc_feature (150)..(150): n is a, c, g, or t
  misc_feature (233)..(233): n is a, c, g, or t
  misc_feature (237)..(237): n is a, c, g, or t
  misc_feature (252)..(252): n is a, c, g, or t
agaagctaaagagaaaaacagagaaacttggtacttgtcttgggccttagacacaaatcaggaagaacgagacaagggtaaaacagtagaagtgggtcgtgcctattttgaaaccgaaaagaagcatttcacaattctagatgcccctgncacaagagttttgtcccaaatatgattggtggtgcctctcaagctgatttggcctgtcctggtaatctcagccaggaaaaggngagnttttaaactgggggntttttaaaaaaggagggccagaccaagaggaacattgcaattgttgggcaaagacagcaggtgtaaaacaccctaattgtgctaattaataagatggatgatccaacagtaaattggagcaatgagagatatgaagaatgt

SEQ ID NO: 569099 - DNA, 420 bp, Homo sapiens
tggtgtgcaatggcatgctcttggctcacggcaacctctgcctcccaggttcaagtgattgtcctgtctcagcctcccgaatagctgggattacaggcgcccaccaccatgcccagctaatttatgtatttttaatagagacaggctttcaccatgttggccaagctggtcttgaactcctgacctcaagtgatccgaccgcctcagcctttcaaagtgctgggattacagacatgagccaccttgcccagcccctagcatatttttaaaaattattttaaatttttgtggggtcatatgtagggtatatatttatggattacatgaaataatttggaactataaatttttcggataacagtataattgcaatcctttcttaaatcatatttatggtgtttacatgtagaactcgtacca

SEQ ID NO: 569100 - DNA, 386 bp, Homo sapiens
  misc_feature (57)..(57): n is a, c, g, or t
  misc_feature (112)..(112): n is a, c, g, or t
  misc_feature (182)..(182): n is a, c, g, or t
  misc_feature (184)..(185): n is a, c, g, or t
  misc_feature (204)..(204): n is a, c, g, or t
ccagttacaacagctctggtatatcagcagtagggtcatcttcatcaatacccagancaagtttgatcatcctgtagatcctgttagcatgtgtctaggggatcttccaganctgaagccagaagacatggagcgcagtttcataaacgcaagatgaccagatccttcacagacttgtcgtncnntatcagcctctgccttatngccttaaggtctcaataattggcctggtcagggttaatctccagtgtgttactatatgcttgccatgtaacccattgtctgagtttgtctctataaggcttgagctatcatgatactctccatgtaagcttgtcacatccaatatgtgctagtgacaaataacagcaaggagatgtcaccaa

SEQ ID NO: 569101 - DNA, 670 bp, Homo sapiens
catgcttcttattcttatacaagaaacatttgcctatccaaaggctacaatattttctcctatattttcttctagaagtttgataaccttagccttatatttagttctatgacccattttaagtcaacttttctgtatgacgtgagataagagttgagattcaattttccccccaaattgatatcccatttttaccacactatcggttgaaaacaccatttcccctgttggcaccttaactgaaaaaaataaattgaccatacataagtggatctaattctagatgctttattgttgtattagtttacatttctctacttatatctacaataattatgtgattgctccatgtttatattaagtctttcaataaattatatccttcagctttttgttcttttccaaaattgtttgagctattctatggcacaaaggtcatattttatataaatttcagcttgccaacttctaaaagaaaacaagcctgctaggtttgcacagaatacataactcaattggggaagaaatgccatttaatgatattgaattttccgattcataaatccagtatatatctccattttccttcaacattatgttatagtttttggtgtacatgtttgcacatatttcattaaaatttcactgaatatatttcataaaaaaaaaa

SEQ ID NO: 569102 - DNA, 969 bp, Homo sapiens
ataaacaagagaggtgccatgccccctgtctcctggtgccagactggtaccccagctcctccaggacctgccactagtgaatgccggatggaacttgggattgaccccaccaacaagtgaacgcttggtcaggctgctacacgggaaggaatgggggcaatggtggaactcctccatgcattcaaccgtgcagcgtccgtgtgagctgagttgagccccaagagaatactgtctgccggatacatagtaagttggccagtgtctagttggcgtctatgatccgttagaagaaggaaccgttttggactagccagaattcctacccgtgggaaagtgtgagggattcctgccaatagttagatctaagcctgctgtacgtactcgtagggagtatgctggaggcggagggcaagggagcggtggtatcacaacaagtcagtttctgtgtggtatatcgttgaagtcagttctgtgtggtgcatccctgaagtctctaagtgtgactgtatgagggcctggggcaaaccatgccaacggtggatccagttagagcccactttatctgatcattccgggtcgcttgcttggcccacctgtgtcaaatgagtgcccgggacccacgagacgggactttgaatctgtccgcccaggtcgaacgggaagggccacgaccgcggaacaggaacactcggccccgggtacaggcgcgacaaggcgtgagctggaacaacgacgccggataaccacggtcggcgccccacaggcgcgcatcaacggtgagcaccgggccaacccagtgggacttatctaaccccgagcccaaagtgcgaataccggacacacacccaagacttgccgtagcacacccagggaataagcagccaagcagcagacaggctgaaccaaacctgtgtagaacgacaactcaggtcaacagtagccattgggcaaaccgagtaactacaaaga

SEQ ID NO: 569103 - DNA, 361 bp, Homo sapiens
cagcgaaggcggctgcatcagggtcggttctgcaacgctgtatcgcgtcgccggcagggaggcataacgcctctctgatcttcctgcatggctcaggtggatttcataacatacgagactgttaaatacaactctggaaacatcctcccctcggttaccccagtattgcccaagtggaggtgtcgccctacccaaatattgccgaatgagtggctgccccgtccccagccccggctgtagatgcacgggcagcgccacctgcccccagcctcccccgttagtcttcctctttctatcggccgggcactggtacagcaccctcgcttagtggccttgtgtcccgccgctcagccagccctcc

SEQ ID NO: 569104 - DNA, 785 bp, Homo sapiens
ggaagagccggggcctgtggctgacatggagcagccctgctgctgaggccgcgccctccccgccctgatgtgggggcccaccgaggatgagcaagctgcccaggaagctgacccgagacttggagcgcagtgctgcctgtccggggcctcccgtgtggctcctctactgtcccgacagccagagcctctcctcgcacctcgcttccgactcgcctgagaagctgaagggccttctcgtgatgtccgccgcaccgttctgtctcttcgtcaccttcgacctgctcttcatcttccctgcgtctggatcatcgaactgagataccaacacaggccactccgtacacaacttgcgacctaggcagatcatccaagtcacgaactttaaaacttccttcttcgacatctttgtccgtggccttcttccgcttctctggactgctcctaggctatgccgtcgctgcacctccgcgcacgtggtcgggtcgattgccggtcacgacgctggtgtccagtgcattcctcattgtcacggtcatcctctctgaggctgctctatgcaagagggggcgagttcggcgtacctgctcccccgatcgtctcttttgtcctcgcctggtgggagaccgtggttccttgacttcaaaggtcctaccccagtgaaggctgaagatggagccgatggtatcttgccgcccaggttgctgttgcccgtggacccctgctgttctccggtgctctgtccgagggacagttctattcacccccagaatcctttgcagggtctg

SEQ ID NO: 569105 - DNA, 633 bp, Homo sapiens
  misc_feature (595)..(595): n is a, c, g, or t
gcggtggctcacgcctgtaatgccagcactttgggaggctgaggcgggcggatcatgaggtcaggagatcgagaccatcctggctaacctggtgaaaccccctctctactaaaaacacaaaaaaaaaaattaaccgggcgtggtggcaggtgcctgtagtcccagctactcgggaggctgaggcaggagaatggcgtgaacccaggaggcggagcttgtagtgagccaagatcacgccactgcactccagcctgggtgacagagcgagactccgtctcaaaaaaattaaaaaaaaattttttttttaaatgacagcacctatcctggtggtgacgagaattttgccatcctctaagcagacttcagtgaggtgcactgtcccgaatgatgatacacctgcagaggagacgcagcacgcagagtggaaagtgtgtgtgttcctggggccacccctattcactcacagtggttaacctgcactaacaagcactgccaggtagaaacacttcctagtctacatgtggactgtagcctgcacagacctagggggactgaccaaaggggggcgaatgaaggaataaaagataagatacanaagagtgtatttgtgcttaagcacaccccctggcgcag

SEQ ID NO: 569106 - DNA, 994 bp, Homo sapiens
gcaggcgggtggagcgagagcagagtacggggaatgcgtactacacgttcagatgtacactgactgtgatacctcgtatataatgaccttgcagccatgtgtactccaagcatgccatgtgaggtacaaatatactaatgtagtatatctcacagcacgactcagcatctaggaatctcaacctgaatccttctattgactggacattccatggcagagccttggcacctggtatagcccaaacagacgtgtctttggttattttcacatgcatgcgtcacttcacttgccactcgggtgcaatgtgagttcaatccaatgtgttgaaggctgtgatagtgtaaccggaaagacgtagtgggcgtgaaatagtcctaatatttatgttttggtatacagtgctgcatctatttgcggaccaaattaattgaaggagtaattatactaggagctcgtcgtgtacgagcttcgtcagtgtgttggcctttatagatatagactggaatatctccagtcctagatggaatactgagtggcacagagagtgtaaatttgtcactaggcaagtggagtagcactcattttgcctgtcttgtatcggtttaacgaagagtgctagactgattactcctccctggacatgtcctcctgtacggctataaaaggctggtacatatttggcgatcctcgttgcggcatagattctgtaggacgattgatttcgtcagtccggtcagggaatgaaccgcagattctggtgtatgcacatgagcgctgactgctgtaagtgctctggtccatgtggggccaccaacattcgtagggtccaaacaggggtccccgtccccgggaagattggcataacaccacaagggcttgttgacgcagggggtgagcgggtgttccaaggtccaacgaggcaccggtgtcttttggagcgctgccggtccattacacacgggggcggcacaggcacagggcgtgaacgcagaag

SEQ ID NO: 569107 - DNA, 233 bp, Homo sapiens
ggtgttctggagtctcgcgctgtatccaggctgacgtgactgacgtagctctctgctcactgctagctctgcctcccgggttcactgccattctcctgcctcaaactcccaagtagctgggactacaggcacctgcaacactacccagctaattttttcgtatttttagtagagacggggtttcaccgtgttagccaggatggtgtcgatctcctggcctcgtgatctgccca

SEQ ID NO: 569108 - DNA, 158 bp, Homo sapiens
cacgaggcggcacgaggcgatacgctgacgccctcctatggcaccgcggtcggcgcctcgggcgatcgtcccgcggcgctgtcggagctggtgggcatcctgctcagcggcggcgtgcagccgtataccgagaccgtgcgctggctcgacttcgccgt

SEQ ID NO: 569109 - DNA, 118 bp, Homo sapiens
gtcgcggctgcaggtgttggtgggagcggctccagcgggcatgccgggagtgtactgtgtgcagctgacccaaggacggacacatctagcgtttgtcctttagagagtgacttatgac

SEQ ID NO: 569110 - DNA, 198 bp, Homo sapiens
gaaaaaatcccactgcattgacgaagtggataatgatgatatgcctgctgacttgccttcattactctgtctgatgtttgttgaatgtaaggatgtgtgcacaaataactatgctgatgtcaaagagatgtctgccttgggcattgttgtactagttatgaagtaagtgcctaagtaatggacatccatgagtatact

SEQ ID NO: 569111 - DNA, 622 bp, Homo sapiens
ttttgtggggtaaaaagggggaaatcttttaattaacgagttaccgggaaaggtttaatactcaaggggataaataaggtggtcctttctaatggaaactactttttggggtcaccacattatgggccacagcaaatggcgtagggctgggaggtgggcaccacttgtcaacgaggttagtaatccaagtgccaatctacatataatgggtaaagccggcacacacaaaagaaagagataaaacacctctagagttagaaaaatagaattttatacaactctcaggttttacacgagaattaatctccaagagaagaatatcagtggggtttatgtgttaatctctttgtgtgaacaaattatatcacgttcatctataacacaacactataaaaaaaacggggctaagagccgtggattataattctcaactattgagacaagagatataatattaatggcaaacaattagtgtagacacaccaaaaaccacctatcttgagagtgccagtggggtcaccacttaatcacgggtggaagcagagtttatcatatgagaggtaatggaactatggccacataatatttatcacacttgaggaattggcagaatggctgcgta

SEQ ID NO: 569112 - DNA, 177 bp, Homo sapiens
gtcgctggccgagaacaccgccgctccgggcctggcgccgtacaacgcctcgaaggccgccgtggagcacttcgcgaacgcgatgcgcctcgaggtcggctaccgcggcgtcgacgtcggctcggcgcacatgtcctggatcgacaccgcgatggtccgcgacaccaagtccgacct

SEQ ID NO: 569113 - DNA, 1021 bp, Homo sapiens
cggtggcgggccgggggctccctgtgcgggggtccgccgaatggggggttgggtgcgcgtgccgggggccctctcggtccggctgttctcgatcgcggttcgcgggtccaccctgggtcccgtcaaccgtcgcgcgcgggcgccggagatcggttcgttgtggctccggggacgggccgagggacgctcgtgtcgcggggggcagatggcgcgtgcgaaggtcaagaaggtctccgcgcaaggagtgcgtcgtcgtggccaacgtggacgcgggggacacgcaacaaggacccacgccatcggaagcagccgggcttcgaggtgcctgcaggggcacagtcgtgaaccagtccgaggccagagagagagcagcgcgggctaggacgcccatggtagttgggagtgtgcgcacgacgcgcgtcaacagtgtggcagcggcaaggcttggcgtgagctgaacgggaaacgagttgactcgcgcgttcgtgggtgagagaggctggaagagtggcccgtagaagttgctgtgaagtgctggtgactgctgctcattgggtgatatcggttcctggcaatgcccatgtgtgttgagagcttctcagagctatgccagcctttgggtcgctttgcgtgttcagtgatcatgagagcagacagttgcggtgggtgtcatcgaagcagtggacgagaagggctgctggagctggcaaggtcaccaagtctggcccgagataagctcagaacggctaaatgaatattatcccgaatacctgccaccccactcttaatcagtggtggaagaacggtctgcagaactgtttgtttcatatctggtccatttaagattctagtagtaaatagactggttaatgataagcaatgcatcgtaaaaccttcagaaggaaaggagaatgtatttgtggatccatctttggttttcttttttgcgtgtggacagttttaaagttagttagtttatttataatgcagtacttaattaagtgaaacatctgcccaaaaa

SEQ ID NO: 569114 - DNA, 425 bp, Homo sapiens
  misc_feature (349)..(349): n is a, c, g, or t
tgaaacagagtcttgctctgtcacccaggctggagtgcagtggcatgatctcgattcagtgcagtcttgacctcccaggttcatgtgatcctcttacctcagcctcctgagtagctggggctacaggcgtgcatcaccatgcctagctaatttttgtattttttgtagagacggggtttcaccatgctgcccaggctggattgggcttgttgaaatgttgaaaatacggtcatggacccttgtgatgatttggggctgggagctgtgcctgtcaattcatgacctgggccagcagactcgcattatggacaaagtcccttcttcccacacaaaggaagacatacaccgnatagtccaatttcaattcagctcctgatgggaatctgaacggccgtgggacacttcccaagtgggtctggcctttc

SEQ ID NO: 569115 - DNA, 731 bp, Homo sapiens
gggactcgcgtcgctggctgggagacgtgaagctctcgatggctcctcccgctgcgtggtctggtgctcgccctcgctctcctcgccctccgccccggccccggcccctggcccgccatggagaagactgatgctgatccagaatggccaatgctggcctgatgcatggcctgagctgctactgacgacatggccacctgcatgaatggcagtgacctgagcagggcgcctgagctgtccaacgaggagcgcaacctgctctcctgtggcctacaagaacgtggtctgggggcctgaggtcctgcctggtgagtgtgtcatctctagccatcagagcagaagacctgacaaactccgacaatgaatgtttgcaagctgattaatgtgactatcattgggagaaagttgtgagtcctgagctgagatccatctgcaccatggtgattggaattgtatggataaatatataatagcacaatgcaactaatccagagagtaagtgtcttctatctgaaaatggaagggtgattacttccggtacttgctgaagtagagtgtggtgatgatcgaaaaaaagatagataattcccaaggagcttaccaagaggatttgatataagcaagaaagatatgcaaccagaaaccaaatcagatggggctgacataacttactggaatataaatgagaattataacagagtgcttgagtggaaaaggttgagagattgtga

SEQ ID NO: 569116 - DNA, 872 bp, Homo sapiens
  misc_feature (294)..(294): n is a, c, g, or t
aggaaaagggcgaagagtcgagcaagagctgtgcgcgtcaagtagcgcagtgcagaaccgtcccctggacctgctacacaagatggagtcatagagctccaagcagactatgctggctctcatgtatccatggatgctgccctaggttctgcaggactactatatttcaggatccagcgtacacggggggcgttagacgataggcccgcatcaagcatgcaaggcgtttggacatctgaaacgcttcgacagtccatccccaaggtgcatgccatccctggtggtctgcagacnacgatttctggactacacgtcatttcaattctggcgcaaggatattgtcccagcctacttcacacaggcagtgcggaccataagagaacaaactgtgatgagtgaatcggtgaaaggggtgaactgaggccttgtagaccatgcctccttgactggttcctcacatgacagtgtggcattatgcagcatgaccgttctgggcatcgttgattggtaaaacctaggacaacgctgacatgtcagaacgcggagaaggaccccatcatactccgtgaagatcaagtgccattgaagcagcatggcggatgaaggggggaaagcctcttcatgaacagcctcaagggcctcatccactggggtcgaagctcatgagacactgttagtactacgaccccagtcaatccgatcggagacatctatctataactgagaaactcctcagactcctttctctcatgatcaattgctctcacagagaacaaggttgtcaagaagcccaggctaggttcttggcagacggtgcttcctccaccagcagtgcacctaaacagatttaccacagcagcaatggcgggttc

SEQ ID NO: 569117 - DNA, 779 bp, Homo sapiens
caacctccactttcggggttcaagcaattctcctgcctcagcctcccgagtagctggggttacaggcgtgtgccatcacacctagcaaatttttgtatttttagtagagacggggtttcaccatgttggccaggatggtctcgatctcttgaccttgtgatccgcccgccttggcctcccaaagtgctgggattacaggtgtgagccaccgcgcctggcctgaaagtcattttggaaccaggatgtatcaaatgatatagagagtaggaaggagaaaagcaacaagaggtttgatttaaattacaaagttgggttcttattagaatatcctgagcacaaccctgtagggagggagtggggaaggcagcagtgagagcagtagaaaggaagtgcccccctcacttccttcatgtcccctaagcttcaaggaagcatcaaatatccaccttctctttgaacaagataagcctcagatgaataaaatacctaaaagcatctgatatataagccactgtatctttttccctgccgatttaagtttgatttctttaatcaataacaggaaaacatacccagtgctttggaaaaagttcttttggcttctttgtcacttcaggaggatttctgggctgacagcagagcacacagtctgagctgggaagccaagctcctctggctactctgaggccaggtgctgcttcacgacagggggaatcttttcaaagtttgcaaaaccaagtaaacagggttgaagcactgaggggtggccactcctcagg

SEQ ID NO: 569118 - DNA, 194 bp, Homo sapiens
tcctccaatgtctgtcttctcttttgtatggggatgcagcttgcaattagaaggtggttccattatcaattcctgggggtataaaccttattaatataaatttggcgagctagaattaatgaggagagctttgagcagaccgacatcagctcactgttaaggaaaccattgttgagaactagagccgtccgtag

SEQ ID NO: 569119 - DNA, 220 bp, Homo sapiens
cggagtatgacaggctccagcttgaacgatatggggaggtcagcacggcgctcacgtgtcgacggaactggtacagggtaggcatgcaccgcaggggtgatacacgtcgtaccaggtttcagcttaacgtatatttgggaggtcagcacggggctcacgtgtcgacggaactggtccagagtaggcatgcaccgcagtggtgaatacacgtcgacctgca

SEQ ID NO: 569120 - DNA, 511 bp, Homo sapiens
  misc_feature (77)..(77): n is a, c, g, or t
  misc_feature (132)..(132): n is a, c, g, or t
  misc_feature (176)..(176): n is a, c, g, or t
  misc_feature (277)..(277): n is a, c, g, or t
  misc_feature (307)..(307): n is a, c, g, or t
  misc_feature (346)..(346): n is a, c, g, or t
  misc_feature (406)..(406): n is a, c, g, or t
  misc_feature (488)..(488): n is a, c, g, or t
ctgctcagctctgatagtgatcagtgctgcacaaccagcaatttctgtatttagtagagatgggtctcaccatgtgncagctgtctcaactcctgaccctcatgatcgtccgctcgcctcaaaaagtgctgngattacaggcatgagccaccgggcccagcccataactgcctgtntagaaaattaacttggctacttcattcaacctcaggggacaagaactacaaagagatcagtagagcttaaaccccattaatggagtctctctgaatctatnctggttgggggatggaaggagtgtctgatncaaagtaataatttaaaagacaccttaacaagagagatnactgaaagagaggaagaaatggatcccaggagccctgtgagatgggaaaaggctactatncacttatctctgaaatgctacacaacactgagaaggacctgggtttcctatgtgggcctggtggctgggtagggatgtaggnaggtatagataagcctgaaattg

SEQ ID NO: 569121 - DNA, 489 bp, Homo sapiens
  misc_feature (75)..(75): n is a, c, g, or t
  misc_feature (232)..(232): n is a, c, g, or t
  misc_feature (235)..(235): n is a, c, g, or t
caaggaggtggcccccccttccgggggggcctcatccgggccaagctctccatggccccgtgggccaaagggtantgggggaacaagatcggcaagccccacactgtccccttgcaaggtgacaggccgctgcgggtgtgtgttggtacgcctcatccctgcacccaggggcaatggcattgtttccgcccctgtgcctaaaaagctgctcatgatgggtggtattgatgantgntacccctcagcccgggggtgcactgcccccctgggcaattttgccaaggccccctttgatgccatttttaaaacctacagctccctgcccccccccctttggaaggagactgtattccccaagtttccccatcaggagttccttgacccccttgtcaagaccccccccaaagtttccgggcaggggactcaggcccccgctgggggtcccacatagggtttttatccaaaaaaaataaagtgaattaagggtga

SEQ ID NO: 569122 - DNA, 254 bp, Homo sapiens
tgagcggtacctcggaacgtgtatcagataagggaattcgtactcacgcaatacaaggaatgaataatggattcacacaagggatgaatctcacaaataattatgctgaaagcaagatgccagacaaaaaaagagtatgtggtatgctttacagtggatgagtttgaacgagatttgccgtctacaggtgtattcaagtcaagaaaattcgggcccgtggagtatttatagctaagagatagtactaaagagac

SEQ ID NO: 569123 - DNA, 467 bp, Homo sapiens
aacctcacagataatgcatatactatgaaaccgtgtgtgatgaactcctacagtactcacctcggtgtctcggatggccattagaaatggaatgaactggacctggtcctagccatcagtgaactcattgtctagtaaaatataaactataatcaattgtgtgacgataagtagcacaagttagggttaacatcaacaagtgtaagtaagttgggtagtacaggtaacacgatgcaggcagaatcgacatcatcagcgaatgttaagggtcaagaaggcacagggcaggtctcaaaaccggagaaggggcttgggttgtaagttgataagcaaaggaccaggtccctcagcatagcattggatgacgatcaaaggatggctttcagatcacaactacatttcactacagacgttcggacgattcagattactcaagacttgtcctcgtgccgaattcctgcagcccg

SEQ ID NO: 569124 - DNA, 409 bp, Homo sapiens
  misc_feature (247)..(247): n is a, c, g, or t
atgctcaggaaatcgatgagatgaaccaaaaactgcaacgcctgcagctggcattggtcaacagaaagggcccaattcttctccacgacaatgcccgaccgcatgttgcacaacccacacttcaaaagttgaatgaattgggctatgaagttttgcctcatccaccgtattcacctgacctcttgccaaccaactaccacgtctttaagcatctcaacaactttttgcagggaaaacgcttccacanccagcaggatgcagaaaatgctttccaagagttcgtcgaatcccaaagcacggatttttacgttacccggctcaagcaacttttttttcgttggcaaaagtttcctgaatgaaattgatcctatatttggataataaaaatgcgatggacctaaaaaaaaaa

SEQ ID NO: 569125 - DNA, 139 bp, Homo sapiens
tttctgggctccgtaaacagtggctgggacggcaggtggcgcagcttcctttcttcagaaccttcatctgctttggtctccgaggttcttctggcgggtcagcttttcctcccttatacatgtcttcttccagctcaat

SEQ ID NO: 569126 - DNA, 184 bp, Homo sapiens
ctcagtagtattggtaccacaaacctttgtaaacaatttaaaagttggaagaaaactgtgggcaatttatttcagatgctctgaccggaccgggagactgtcatttccacagtttctagtcccactaattttaggttttttttttttttgaaaggaattgtgcgcttagggctctcaggggttc

SEQ ID NO: 569127 - DNA, 172 bp, Homo sapiens
ggctatacctgtacgcctctctctgctgcgacacggtaaccacgacgacttgacactgagcactgtccgtgacactggacacttttgttggcctcagcacttatcctggtgccctcgtgtggtggccacagctgctcggaacgcctgtaccacttcatggaacagctttggc

SEQ ID NO: 569128 - DNA, 167 bp, Homo sapiens
tatacgaatatccttcagtagtcgcacctatttcgtaagcctctacagataaactacgatatatcttgtagcatgagaaaatatactgtcatcctaagactctagtccaccaaggggatagagtgcatatctctatccactggggaaatggacggtgatacagaaca

SEQ ID NO: 569129 - DNA, 299 bp, Homo sapiens
gtcgatctagaggccaccgatagtttggacgactcacaaacatagcatgggaaacgacttgctcacatgacttcgacttatctcccactgggtcccatcccacaacaagtgggaaatcacaatgagatttgggtggggacacagccaacccatatcatcagtgcttgataactgtgcttcattgcttttcctattatctcataacattctactctctgtcttcaatatctggattttatctatctctccatacttggctagtgtactaatttggaaatgtagaatatttgatcaatgtg

SEQ ID NO: 569130 - DNA, 924 bp, Homo sapiens
taaccttactaattatactacttgttaggattttcacattctggcttaatcattttcattcctaaagaaaaatatctggcctaaacctcagttattacatgtaattgatgaggtattttttccttttttctttttttttttttttttggaaaacaagtctggctcttattccgcccaaggctgggatgtggcaggggccgcatattctaaggctcaattggcaacttctggcctcccataggcttaacgtggatcctctcaacctcaagcctctccaagtaacatataagctggacaactcaccaatgggtggtcgcccctaaggcctccaataaattttggtaataacattttcttggtcaagaagacgggtgtgttttcggccattggtcgggccaggtcggtgtctttgaactccggggactcaaggcaacctaacccaggtgttggcctcccaaatgtggctggggatcacaagacacgagccacctcactttagccggattcgaagattttaacaaaatattttctctgggacttcgcatcctctttcaatggaggggccattggtcccgttgaaatactgggaacaatttttctgggtggtgttgttgacaactcttgtttaactagcttctgttgaacaagtgggcgattaagccagtttgggtcttatggttgtaaacccaacactgggcctatttcactggtttaaaatctctagcctcccactgttgttttcttcaactcacactctactcgttccctaatggtcccatttttctctttcccggaaccttatggcatttggcttcacataaattttaacgggggcgtttggtccatccgggagttaacttaacggcattataaacttcggcggatgcgtcggcgcaaatacaaaagttaccactcaaggttaaa

SEQ ID NO: 569131 - DNA, 371 bp, Homo sapiens
gtgaacacaatttgtaaatctcttaaccatgggagttaagtctcagcgttctggcgatacacgtggttgaaacttctgtatacaaatacatattttacatttactagctattaattatgtggtaaattagagtacagcactctctttatctgtggaaacttcagactcttccctattactctaatttcacagagacattattaaatataactgggcttacacatttgttaagctatactgacacttaatacacatcttggaggcttgattcacctttctatccttcctcttgtgcaacacttttctgattttgtgattcgaggtctgtttatctacctgaggctccattgagaccgtatatacgtgacctt

SEQ ID NO: 569132 - DNA, 1125 bp, Homo sapiens
  misc_feature (451)..(451): n is a, c, g, or t
gctgcagaggggtccatacggcgttgtcctggattcccgtcgtaccttaaagggaaattgtcacaatgtccgggagcccttgatgtcctgcgaatgaacggaggaggcatgtccttcaacgttcctttgcgaaccaggagacccacgttaggtggcaccaatcttgactatccagaatgtgaagcagtaacatcgtaatagaggatggaaatagtgattgtgcactctatactcatagagatcatcaagacggacctggagaggaacgcttactgctggcgagcatcgctgcaattggtatgccattggaacatgcctggttgattgtcagatgttatatcgcgtcgctagggaatacttggctcgagagaggcttgtgcatgtcaagtttgctgctgtgcctacttggcagcctacttcaccaattttgctggtcctgcctgtgacatcnctgggaatctttctacgtagaccaagatcctaggcagtgctttccgcggagcctacggtgctttcttgtgggttactgacccctagggtctgaccaccagactctcacggaggcagtcttaaatgttaacctaccataccattgcgcgtgttgtaacacagcattctccgtctgacgctatgtggacattgccatcccatgcaacaacaagggagctcactcagtgggtttgatgtggtggatgctggctcggcaagttctgggcatgcgtggcaccatttcccgtgaacacccatgggaggtcatgccttgatctgtaactactacagagatcctgagaagattgcaaacgaagagcaggtgctgctgagaaggccgtgaccaaggagaatttccaggtgaatggactggtaccgctcctgagatcactggtatcagactaaatttgcgcattgtctgaagtatacagggtggccccgagccgattacagaaaccccattggaatggagaggcacacttgcccaggaactggtcgcaacaccacggtccgcacagagtggtgagccacccaagagggtaaccggggcgaaggaaaaacacgaacacaggcgggagacacattacgaaaaaaacgggaacgacgggaagacaagcgacgaggacaaccaccagg

SEQ ID NO: 569133 - DNA, 235 bp, Homo sapiens
gcaaggatgctgttactgcagtggttctactgcttgctgttcaccagagagagcagttttatgatatcatcattcatgccacacaaccctctctcctaatatataagtttgacaaaaggcagagcacttagggaactagcattcatcatgcttgtttgcacaaacctgatttatgtttacctatcctcttacctcccctgcccctctgttctctagataccagtaggaagctcca

SEQ ID NO: 569134 - DNA, 526 bp, Homo sapiens
  misc_feature (32)..(32): n is a, c, g, or t
  misc_feature (252)..(252): n is a, c, g, or t
tcacgagcttccacaaattctgctgttctatntgggtatttgacaatggactttgtaatgtatgacagtgcatatggaacaatacaatgttcatgtggggtatggggaaagagaattctcagcaaatgaattggaattataatataaagcagtatagcattaggatttgaatataaaatcatataaagccatataacactggatataggtggttaagaagtggataaaaaaatttcatggctgagtgcggtnagtaacgcctgtaatcccagcactttgggaggctgaggcgggtggatcacctgaggtcgggaatttgagaccagcctgaccaacatggagaaacatcatccctactaaaaatacaaaattagctggacatggtagcgcatgcttgtaatcccagctacttgggaggctgaggcaggagaatcgcttgaagccgtgaggtggaggttatggtgagctgagatcgcgccattgcactccagactgggcaacaagagcgaaactatgtctcaaaaga

SEQ ID NO: 569135 - DNA, 925 bp, Homo sapiens
  misc_feature (20)..(20): n is a, c, g, or t
  misc_feature (74)..(74): n is a, c, g, or t
  misc_feature (98)..(98): n is a, c, g, or t
gtgggttatgtgtggggagnggcctagcaccgaccaacggagggggttttcgagcacatttgcccactgcatgnctgtgtaaaagacccaacctgaanctactgcatgatgcaaagtctctgccagaagcaagatggaggtactctggtgacagctagtaccatgttccaaaggccatacttcgagcctgcagcatgtcaggggaagacatcagatgatggtagccacatgagcccagcgctgtcatcctgcaaaaaaagtaacatctgttttgacatctccagtggtagagactttaaatcagcttccacattgcttatctgctggctaatcagaatggatgcagtattcttaccaactcattgacagggaaaaaacacaagatatgcagagaaataggggaaactaagactgatatgatgaattcaaatgaaaaatgtaatggcactttgcatatattatatctaaactctcattgcatgtacaatgagataatttgattttacttcctaactgagccgcgagcggatctcgcgcttactcttacctgatgggtacctttgcttgcacttaaatgtaataccacatttcagcctcactagaaattaatttttgagctcgaaggcctctagcaggacccctctgctgaccgttcgctttggaggaggggcgactcgcaccacaccgcgatcgctaatccagctaacgacacccccttatcattgtatcaaagccctgtaatacaatctcagcgggccgcagatcttcaactaccgccggtttcgcgcccttgtcacccacaaccgtacctttgtgtacgagacgtgtctgtaatatagataagcaaccccctcgatagtttcgatataacgacacaatgtttctctaaataccacacccccgcctccgacccagatccgaacag

SEQ ID NO: 569136 - DNA, 253 bp, Homo sapiens
aattacaccacgactgcgcgttaattaggtgcctagtaggtcgctcgcagtaaatgtagcggttcggcgtacggccacgggctattggttgaatgagtaggctgatggtttcgatcactcctagtatggggataaggggtgtaggtatgccttgtggtaagaagtgggctaggccatttttaatcttagagcgaaacgcctataatcactgcgcccgctcaataaggggacgcgccatcgtgcgctacggaga

SEQ ID NO: 569137 - DNA, 1033 bp, Homo sapiens
catctcacgggtgtccgtgaaattcgcgaccgtataagaagaatacagctcgagacgcctcactcctccaggtttcaccggccccctgctgacaatcaatccaggctgtcggaaaatggcatctcttgccttcgcagattgattgatacgaacaaaaaacggcgagagtaagtcttaccctcgacacatagtcaccaaaagcgtagtcccgtgattcccacctaaaacgcgactgaggtatactcgaggacgatcaggaatggctggaatgcgtcccagttgactcgttgccagtccttctcgggtactcctaagagtcaaagctgtcatctggatcgtgcatttgcgccgtacctctgtccgtggacgcatgcggcaactattcccgagatgctactctctctgacctctggacttacctcgtagtatatatcacttcgggtggtttcattcccttcccttgttcaggcgaatataataggcgctcagtccgttactaatcacgcgacgaattgttcactctcccgtttgagggggtaataatcatatcttggcgtgtgacctacagagagatcagatgattgaagggcatacttcgtactgagggacgggacccttattctgcgatctgagggaggttactttacaactagtgttgacaatccccctgacgaattgttaaccgttctgtgaacaaggcccgtcataatttggagccctaattgaattctgctccattctggctgtccggcacgaactatatcgcaggattcttccccttcgtggattcatcctttggcctgtttgcaattgggtggcctggatttcggtccctggtcttaggggctgaacatgtcccaagtctggcgccgcattatttaccctaagggccgaccacgggggtttgatgccagggccgcccaaaggcggcaggagcgcgcgaccctacttccacatgcggcactctctccgggggactgtgagaacctcatctactcgcgcgtgtgggttgttgtggtgtcgctctgggggt

SEQ ID NO: 569138 - DNA, 943 bp, Homo sapiens
gggagcgtgtggtgtacctgacgggcgcacggggccgccgggcccacctggcatggcagtggtgacgctggtgcgaggagcgacccatatggacacctgcacctggacgctgcgccacctgacatggagcagcacggcgaccgactttgactggttcttcctggattgcctgagagcacgctacaccgaggcgcacggactggcacagcctaactggacaccgtcagacctggcctccggcgccacctgtacctgggccggccccaggacttcatcggcggagagcccacccccgagcgctactgccacggaggctttggggtgctgctgtccgcgcatgctgctgcaacaaactagagcccccacctggaaggcttgcctgcacacagacaatcgtacagtgctgcgcccatgaccgagtggcttgggtctgcatgcacttctcagaatgccaccgagtggatgtggacgtagaaccttggtgaacacagaggagggggtggcacgtaataagccatctaggacgctgaggccctaggcgagaagccagtagcaagaagggggacacctacatttagccgaaagatagacactaaaagaacaaaaacaatgaaaagagaacgcaagagcagagatgagcaagagtgacacaaacgagataacggcacgagacatgaaacagggaacacaggaaaccaaggagactacaagagatacagggacagaaccagaaaacccagacccacagacgacgaagatagggaacgagaaatgatagacagaagagtatacacaaacgacaaccagaggcaccgacagaagatgacgcaagacacatcacgaggaacaaaaacaagagaaaaacaccgaacaaccaagggccacgacgacggcaccagagaaaaaaagaaaacacaaccgcaagagaaaacaagaagaaacc

SEQ ID NO: 569139 - DNA, 143 bp, Homo sapiens
tactgccaagttgcgttgtgtgctgaagattggggaacacactccctacagcctcgccatcatggaaaatgccaatgtatctggccctgtatatagccactatcttgccatgcagaatggccattgttgcccatctgtggagc

SEQ ID NO: 569140 - DNA, 331 bp, Homo sapiens
  misc_feature (72)..(72): n is a, c, g, or t
  misc_feature (85)..(85): n is a, c, g, or t
  misc_feature (130)..(130): n is a, c, g, or t
  misc_feature (145)..(145): n is a, c, g, or t
  misc_feature (147)..(147): n is a, c, g, or t
  misc_feature (211)..(211): n is a, c, g, or t
  misc_feature (237)..(237): n is a, c, g, or t
  misc_feature (323)..(323): n is a, c, g, or t
ccaacctccaggggccgggggggttttcaggccaatggcccctgtccgggctgttatggccccaaggcaggnggagccccagggnccccccaaatggggtttcccccaggcttttccccgggggtttcanggagtttttccccancnctggtcggagtttgcaggaactggccttgttttccttagcccgtcccccccaacagtattaggngaggatggatgcgggggctgtccctnccgggaagtccctgtttaagtttcagtgggttgtttccccctgtgggaaaaaaaatgaaaactttttccctgcctttaaaagtttngactgtga

SEQ ID NO: 569141 - DNA, 479 bp, Homo sapiens
accgcgccggacccaacagggatttccccatttctgtttgctgcctgaaatagtatgaggaagccaaggagagtccttgccgggtgagtttcaggatgaggaaatgacacgaggaagacgtgggtttgggttagtggctgctggcgttttggcccttggtgtttctggagcctccagggatctaggggagcctgggctgcgtgcatgtcgataagcagagctgttcttggggagaaggagggaggtctcgggagtgtagcaccatgccaaccagccctgcgcgaagacagagtgagccacgcccggatggcagggcatgtttctgttttggtgtctcactttcctcccagcgtgacttatttggggattcctcagggcctactggaatgtgactgcccactgcccagctgcctcgggtacaagtcctggccctatgtcccagctgtcaggggctcagggaatcctacccagccacctgt

SEQ ID NO: 569142 - DNA, 151 bp, Homo sapiens
gaggcagaggcacaaggaagggcaggctggcccaggcctcagctctgaagtgattggctgatgccagcctttggctttgggtgaggcctgtccgggcctgtcttgctgtggcctggggcagggttgggggtgcctccaatccctgctctgg

SEQ ID NO: 569143 - DNA, 760 bp, Homo sapiens
gcaagatgccgaacaggacagaaggccaagggaaacgaacgtggttccggccccagctgtcgtgaacaagctcgagtgctagacagtggtgaatccgcctgttttgagaacaaggcctacagaattttggcgagttggatcaggacagtccagtcccaaatagagacctcagccgctttgtgaaatggacccggtatatcaggttgcatcggcagagagccatcctctataagcggtttaaagtgcctcctgtcgattaacctagttcaccgcagagtcctggtaccgcgcaagacagctactcagctgctttaatgctgtgcccactaagtacatgaccatgatgacaatagcaagagaagaatgcagagaactgtctgtgcccgtggccgacgacacgaacggctgtatgggcaaataggggactgtcctcaactgaaagatatcacctgtccttcgatgcatgcgagttacatcacctgatcactcgatccctatggtggcatgaagcgaatgagaagtctcaagcgtggtggtgattgcacacgatggggatcccagtcgatctggattgtcttcttgcctgtcctgtgtcgtacaattgggggatcccttactgccttatcatcggagaaggcaacggactgggacgtctaagtccacaggccagaccttgaccactgttgcctttctcacaggtgacactcgggaagacaaaggcgctttcggcgtaatgctggtggaaagctatcaggaccac

SEQ ID NO: 569144 - DNA, 357 bp, Homo sapiens
  misc_feature (76)..(76): n is a, c, g, or t
  misc_feature (317)..(317): n is a, c, g, or t
  misc_feature (320)..(320): n is a, c, g, or t
  misc_feature (347)..(347): n is a, c, g, or t
agagtagtagggttgaaggttagtgggaaacttttatgtgtgtgggtagggagattaatttgtcaggttcagaggntttctgttgggtggtagtaggcgatgaggttggcctgttcaggatgtgtcagaatgttcctgtaaattccatgatacttggaaatgaatttgtattctattaagtgacacatatataactttgacaaataagtagttatcatcatatgtatgtttgaactgttttacatgctatctgcaatgtttggtacatttagtggattccttgccattactctggcctctagtctcagagctaagcntantagactgtggaccactttgactactgngtaaggcagt

SEQ ID NO: 569145 - DNA, 187 bp, Homo sapiens
ttcttcatagaaaggcacatgggagaagaccaggtggagatgtcaaggtacaccgaggcacgaggacttccacgatggaccaggctgaccaccgctgaaggtgcctatgatgaacgcgtttaggcatgtttaacatccagacactgtaagaagctgtccagcatgggtgctgcatgatgaaatacct

SEQ ID NO: 569146 - DNA, 217 bp, Homo sapiens
gggcccggttttttagccccgcttgggccccataggggggccccctttctccaaatattaaaatatttacccccctttggggacggggggggggggtcccccctcctcgggggacttacgtgaggggtttcccttagcccgggggggggggattccagtgagctgtgtttgggcccctgttcccccgcctggggggcaaagtggggccctgtttcca

SEQ ID NO: 569147 - DNA, 192 bp, Homo sapiens
tatggtctgtagggacagtcagtcaggatgacacttcggcatcatctcttccctctaccatggtattgtgctcccttttttacgtttggtttaggaaatgaaagacgcctagatttaaaggctccgtgtcaattctctagcatactgcgtatgctcacactgacgctgggacctagtgaatgagctatactg

SEQ ID NO: 569148 - DNA, 206 bp, Homo sapiens
tagtacaagctacgagtcaaaccaataccatcagcactacttactggctaatagaaaacttcagcgtggactctggtggacatggtggagatatgtatttataccaccttttgagctgtacccacaagcaagatcacataggacactgcaggaaacagacccttgagccagctttgctccagaaacagtgccctatgggaaaagaa

SEQ ID NO: 569149 - DNA, 647 bp, Homo sapiens
ggccgggcgcggtggctcacgcctgtaatcccagctctcagggaggctaagaggcgggaggatagcttgagcccaggagttcgagacctgcctgggcaatatagcgagaccccgttctccagaaaaaggaaaaaaaaaacaaaagacaaaaaaaaaataagcgtaactttccctcaaagcaacgacccccccccaattcggactgtgccaaattctccggttggccccgggatattaatagaaaattattggtattgaattaattggaaaaataaaacacaccttcggttggcatttggaaaaaaaaaaaaaaaccaggaaaaaaaaaaaaaaacaaagaacaacaaacaacaaactggtggcggcgcgccgccctgaaaaaagcttttctatacaaccactccgggtgggggcggcgcgcggcgccccacgataggatatagcgcaaccgggggcctatgacgggtggtcccaagaggacaaccgggggcagcggacactacgcgcgggggttctcccccaaatataaaaagacgccgggggggacccacgagcgggtttggaaccaacctccgagggggggcccggagagaccaaacggggacctcataacaagggggaccaagaagagggccccagataccagt

SEQ ID NO: 569150 - DNA, 215 bp, Homo sapiens
catggaggacgccgaaacggtggccgacaagatccgcgacgtgctggcgcggccggtgacgatggacggccatgacctcacggtcggcgccagcatatgcatcgcccgctggccggaaaacggcgacagcgcgaaggatctgctgctgatcgccgacgccgcgatgtacgcggccacgcggcggcgctgagggtagcccgctcagcgcgcggtca

SEQ ID NO: 569151 - DNA, 632 bp, Homo sapiens
gacctcctgtaatgtcgcaaggtggccggtactgatcttacgtcatcccagtctaataggtttggagattaaaccctttctcaacttgtgctgtttatatagcccagcgttcccgtccataaggcttcattgtgactttgaaccaaccttatcttcccacatacccgggactattggacaattattttacatggggaaaattatttgggataattaagccggaacttttcctgaagattgccatttatactgtatggcttctttttcactagtttcattctaggtttttagaagatgaagatataagataaatttggttcgtttaattgtgaaggcgcctgggaattacatggacataccacccttgttaaggcacagtttctgtaagcttacacttgctatttgtaaagtttgccttcacagcctttcagatgctgttggacttcatgtcccccacctagcttggtgagggctgtaactgtttcccagtacttgtaccttggaagttctgaatgttgtaaccatatttatgtatttagagttcctcatgttgcacgggtttaagaatttgacccaccacaggtcatgtgacttttctgtactgttaaacttcattgtaattaaatgagaga

SEQ ID NO: 569152 - DNA, 184 bp, Homo sapiens
acgctcggtaccgctggagtggcatatactctacccaagcccacatccagccaggtcccagtcctgctgggatgcaggtacctacaaagcactggactgtgtgaaaggatctcagtctttagaggaaatggaagaaagctggaaatcgtatttgcatagaattgagagttatatgccactccag

SEQ ID NO: 569153 - DNA, 391 bp, Homo sapiens
  misc_feature (234)..(234): n is a, c, g, or t
gaaaagatatatattgcatgtggtgtgtgattttgtatctgtcaggataatcatagttcaatttctattattattataccaatatcatttagttttctttttaattctgagggtattaatcagggtctttctatcacgtgagacacaaaacaaatccaaactgtgtaacagaaaaaggaattcattgaccacaaggactgagaagctcccagacttaacttgcttaggcttcanctatatgtacagtttcaagtggcatcctgtaactctctctctactctactcccccaacatcagctccatgtttacctccatgaacttcagacttaaacagcatcactggctcctgaccaggatttcagctccacaaacttcaaactagagcaccagc

SEQ ID NO: 569154 - DNA, 419 bp, Homo sapiens
ccgatatcttacaggatcccctcaagcatcactccccgctattccgcactatcctccctctctctgttaccagccaattaacccccccaggcccctgacttaatatctttcgaacacttagtcctacggatctttgtgttatgttctgtagtaatgctcttctctcggatacctgcatagactacccttcctcactatcttcagatctttgttcaacatgtcctgtgaggtcttctctgctcacctctatgttaaattgtattgactgattccacatttttttccctataatgtgatgcacactccactttgcattcagcccgctctcccattcttcacagctctggttcgttgatttcctgagggacgattcggccaccttcgttggttctgcagcttcatcagttttttcagcatgt

SEQ ID NO: 569155 - DNA, 175 bp, Homo sapiens
agcccatgtacaagtacattgtgattgaacccactcgcattggcgacgagacagtccgctggatcaccgtgtggcataatgcctgcacaagactggccgtgctggctgtggcacctgcctgcctcttcaacccgctttgcgctgctccttgggattcttccctactacattttcc

SEQ ID NO: 569156 - DNA, 314 bp, Homo sapiens
ccccccgccccctggggggcccccccccttggggggggggggggttttttcccccccccccgccggggggcggtttccccccaaaaaaaacccccccccctttttttttttggttttttgtcaccccccgggggggggggggtttattttttttggggccccccccaacaaggggttttttgggggggggggccccctttccgccttccaacccccgttggggacccccgggtttgggtacttggtttccggtttttttttccccccccccccccgggtttttggggttttggaaaaattttttttccctttta

SEQ ID NO: 569157 - DNA, 1052 bp, Homo sapiens
cagtctggggcaactgggcttcccaaacactcctacgtggttggacctctggcttttcatccttgttcgatagtggtggtgtattctcattatgtgtattttatgtgccatgacttgtatcgcatgatatctcaaattcaacgcacagttggttcttgacgtgaattctgaacaatgggctacaaacttcttgaatcaaacgaagacaggactctcaatagacagaagtttcacatctccaagggaccccgttccgtattcattttacacttgagttcactaattttgccaagaactctacttaactcgggtaggatttcacccattcctagctaagttcttcacccttacacccctttggtctcgtgtcctcacacaactttcaagacatctgatgggctttacaagggtgctgaatatcacacagcattttgtaccttcaacaggtcttagtagtatagcattacacgacactatagtacctggtctctttaactgtgtccaagagttgattccagggttaaactaactgatgcacaggtccactcgcgctgcatctacactacccgggccacggcttacagtgcaattccaacaaacgtcacattaatccaaacacggcagggcacacagatacccgacgacagaagcgggcaacacacaagaaattacctgaacgcaatctcggcgtcacgcacaaccatggctacgcgcaccccagaagaccacaaatcacacacagggaaccacggagagccacactggatcactcgcacccacggactccgcgatcaatcgagagaggggagccgaaccaacgagatcatatcaaacggacctcgaaggacacacacggcacagagtacaattgttccaccagatactttggaaacagcctcaagcacatttgcattggcacacttcttaaccatgggggaattcttcacccccgtatattagaccctttttcaaacttcattgagccctcaccatatacagaaggcattatcgcggaccaaaacgcacgttaatagagaccacgtatacctacg

SEQ ID NO: 569158 - DNA, 388 bp, Homo sapiens
cgagctggccgcccgggcaggcacccgatacttattttttctgctcctctccctcctcccacccttcaatctcaaagaggccccagtatctggtgttcccttctttgtgttcatgagttctcattatttagctccctcagtgagaacatgtggtatttggttttctattcctgcgctattttgctaaggataatggcctccagctccatccatgttcctacaaaagacattatcttgttcttttttatggctacatagtattccatggtgtatatataccacattttctttatacagtcgatcactaatgagtgtttaggttgattccatgcctttgctctcgtgaatagtgcagaaatgaacatatgcatttatattacctgacact

SEQ ID NO: 569159 - DNA, 143 bp, Homo sapiens
cacagtcatggcaacatttaagtaccccccagcaggcaatgcacctgtcacttcaacatttttgccattgtaaacaccagggcacgcagcagtcaatggacaccacagtctcatccactccatcaaccttttggaaacattgc

SEQ ID NO: 569160 - DNA, 802 bp, Homo sapiens
gagcagacaggaagcccctgtctagcccccgagaggcctgcctcagccctcgaaccagagcctgcaggcctcccctcagtgcttagccccacccatggttctccctgaccccacgagtcgcctgagctgctcacttgggagggggtccgggaaacggggccggaggggaggagaggggacttagtgcggcattaaatggttgaagtgccatggcacatgccctgtgtggcccgacatgccctggccacccggctgggcagcctggctgaatggccctcaaatgggtggacactgtggtggcttcaatgtgacaaatggaaaggtccccacgccagaacccaacatctgcacagcatacatcggagtgagctgactgaagcgcggctgctgagcaccaaggatccacacacactcaccgggccccatagcatgaggaaccttaagggatgcacaccgcggagatactcacaaaccgatctcgatcgctggccgaagggagaaacaactacaaccgcctaaccggaagcaggcaatagagtccacacacagggacacattaccctatgagaagacccacgacccttaacagaacaacgacgcaaagacgctccacaactggacaaccacgggacacagacccttgagcacgaccttgcgccagacaacaagaggaggacaactggcccccatcaagcacgaccataactggcgcatgaacttgaccctgcatggaggaaaagctagagtgcatgagccttgggaggccctgcaagcaactgacaatggagacaagatgatggcg

SEQ ID NO: 569161 - DNA, 147 bp, Homo sapiens
  misc_feature (14)..(14): n is a, c, g, or t
  misc_feature (46)..(46): n is a, c, g, or t
tcgcgtcaggcggnttcaccactgtgcctggataacaaccgcagcnggcagtgcgtgaggccacggtgaggcctgtcagctgatgctctgctacctatcaggactcctggttccttgccttctgcagctgtcctcctaagatctagg

SEQ ID NO: 569162 - DNA, 101 bp, Homo sapiens
  misc_feature (94)..(94): n is a, c, g, or t
gatcttcaagtgaacatctcttgccctgattgaaggctttgccacatgctggaaggccccctcccaggaagatgggggtcattaaaggaaactnaacattg

SEQ ID NO: 569163 - DNA, 434 bp, Homo sapiens
cgctgccccgcaagacggggtcaggcacctcctcccatctcctccatgttcccctcctgcaccacatccttgtgtccctctgcccccggtggcctattcatggcgtctcactcgccctgcaggacctgctaccgtttcccctgtgccgggcgccggcgtgctttgcagtcaggtagtgctcagggttgctacttaagtgcggaagttgctggttgacccgttgacaagctccactcttatgtgcatattaggttccaaacgctgggcttgtaggaagatccgggtgaggtgggcccgcgcttcagatattgtctcggaacctttcccccagcgtctggcctatgtctcgccagtcgcccctccggtggagggactgggacgaggttccaagtcctctgctcttgccgcgggcttgccgggtaccgcagctcgtc

SEQ ID NO: 569164 - DNA, 476 bp, Homo sapiens
  misc_feature (408)..(408): n is a, c, g, or t
caatcgtaggtcagaaaggaaatatatgcagttacaaatagacatgtcatttgcgccttcattctagactttttttttgagacggagtctccccggtcccccaggcaggagtgcagtagctctatctcggctcgacggcaacctccgcctcccgggtcatagctgtgctcgggcctcagcctcccaagtagctgggatcacaggcggccgccaccacgcccgggtaaatttaggtatttttagtagagacacggtttcaccatgtaggccacgctggtctcaaactcctgacctcaggtgatccacacgccttggcttcccaaagcgctgggattacaggcgtgagccaccacacctggctgatttcatttccttggggaagatacccagtagtgggttggctggatngaatggtagttctgcttttcgttctttaaggagtttccatactgttttccatagtggttgtactaatt

SEQ ID NO: 569165 - DNA, 702 bp, Homo sapiens
atgttcccccaaaaaagaatttggttttgtgcaacaatggaaatatttttgtgaattgggcttccagatttttaatttttatgccaaagaaaatattgggcccaacccattttttttatgatggatcacttaaaaaggtgatcccgcctctggggtaaaaggtcttttttcttcttttacagtgttcaatatgatttaataagaatagaacggtaatctatgacctaggggtttatgttgaataattagcagttgagaatggaggaattacttcaaagacatgctttccgttgttttcttgactgatctctcaaaccaatatgacggtgtcttttcaatcttcgacttttggctaataaaataagtggattttgttgtttaagatccagaaaaacttagcccgtaaatattttgctcaaaaagcatatagaggtattttaaagatccgttgatattctgtacatggaagactcatcctgattttaggtatcccacatgaataaagcctttgtatctttaaagaaaaaaaaaaagatctcgagactagagcggccatgcctggcccaaaatctgcaggtatttccactaacactcgcatgctgctaacgcgtgggtctcatgccctaagaagagttgaagtgcatgggatccatcatttcattatgtagccacaaaggttgacatccgatcaacacaagtgtt

SEQ ID NO: 569166 - DNA, 462 bp, Homo sapiens
gcggataatgcacatgccagtgcttgggagtacttttatcttttttttgcacaggctctctctgtgtcacccaggctggagtgcagtggcgcaatctcacctcactgcaacctccgcctctagggttcaagtgattctcccacttcagcctctcaagtagctgggattacagatgtgcgccaccgtggcataactaattttttgtatttttagtagagacggggtcttgctatgttggccaggctggtcttgaactcctggcctcaagtgattcacctgcgttagcctcccaaagtgctgggattacaggcatgagccagctcgcctggccaatcactgatctttttactgtctccatagttttgatgttaccagactggcattattgcatgtagccttttcagattgactttttttcacttagtaaagtgcagggcttcattatttcaaaaatgttgtgct

SEQ ID NO: 569167 - DNA, 363 bp, Homo sapiens
  misc_feature (48)..(48): n is a, c, g, or t
  misc_feature (360)..(360): n is a, c, g, or t
tgcgctccggcgaagtccgccgcgtgcacatcgactgccgcgccaccntcggtgaagtgagcaacgaagagcacagcctgcgccagtacggcaaggccggcgcgatccgctggaagggcatccgcccgaccgttcgtggcgttgccatgaacccggtggatcacccgcacggtggtggcgaaggccgcaccggcgagggccaggtccctgtgtcgccgtggaacaccctgacgaagggctaccgcactcgcaacaacaagcgcacgcagacgttcatcgtctcgcgtcgcaagaagtaagggctaggccatgactcgttcgctgaagaagggccccttcgttgaccaccacctgatggcnaag

SEQ ID NO: 569168 - DNA, 859 bp, Homo sapiens
  misc_feature (335)..(335): n is a, c, g, or t
  misc_feature (520)..(521): n is a, c, g, or t
  misc_feature (528)..(529): n is a, c, g, or t
  misc_feature (532)..(533): n is a, c, g, or t
  misc_feature (539)..(539): n is a, c, g, or t
  misc_feature (543)..(544): n is a, c, g, or t
  misc_feature (564)..(564): n is a, c, g, or t
gagtcgggaaaatggctgcgagtacctccatggtcccggtggctgtgacggcggcagtggcgcctgtcctgtccataaacagcgatttctcagatttgcgggaaattaaaaagcaactgctgcttattgcgggccttacccgggagcggggcctactacacagtagcaaatggtcggcggagttggctttctctctccctgcattgcctctggccgagctgcaaccgcctccggctattacagaggaagatgcccaggatatggatgcctataccctggccaaggcctactttgacgttaaagagtatgatcgggcagcacatttcctgcatggntgcaatagcaggaaagcctattttctgtatatgttattccagatatctggttgagggcatttaaaaattgtcatctgcctttagtggaaacatccatatttagaaccagtggaaaagttaatctttaaatagcttagcagtgggccattgaatgaatgtacttaatacatagcatataaaacagnnttcatanntanngttacnaggnnggtagagaagaaaatatctnaggatgactaaacagacacgtaacaactgatgcatatgtctgacagtaataacaggacttcatgcatgtgaattaaaattaaggggtacaacataagttaacacgcctggaatgacaataaaatatatagcaatacgtcaccatgaaaatgcaatttgattgataaatgcaggggaataaaaggattacctggatcaggccaggcacataacacaaaatagaagggatggagacaacacacatcaatataaacagtggagttcgaaattaagtacacgtgataaaaggaaccgta

SEQ ID NO: 569169 - DNA, 819 bp, Homo sapiens
acacagagccgagcgccagtaccgtcatttcatgtccacctcagagaatagcattccttaacgaacaccacggccaagtagacattgctcgtactcccatcggaaggcagcactggattcctggtcgggtggataccagtggtcttcagtctgatcgatgcaccgatgagaactctccttattgctgtgaagaggcagacaatgcatggctgactctactctgttaccaagtggctttacctagtgacacgtcccccggtctaggatcgaactgtataacacacgggagctctccaggacactcacccagcggacgctcgtgggggaaacctacctaaaccggacagagctccaaaagaagctagccaaccgacttggggctgcactgcggaacccccaccaacggtgacacctcgagctagtaacggcggctgggacacgacacagccagacgacgagaacttcgcagacagaaatcacgacatacactttttccaagaggcgcctcaggctacccctccaggtgggtaggacccgacccctgatcaactcccctgaaccgaatatacccagctagtaaactacgcaaattcctttccttaccctttcgcttacagaaccaagcacccttggtactttcactttctcagccatcaacaaccactcacaattgagccttatccacatctttcatgtccacaagacaccacaaccaccacacacaaacaccacacaaacaacccaacacacaccacaaccacccacacacaccacaaacacaagaaccccccacaccacaacacccaccacaccaacccc

SEQ ID NO: 569170 - DNA, 125 bp, Homo sapiens
catggcaagagcctctgagccagtgcagattcttcagtcccccagccctgcctaaacagtgcatgccagcaccttctgggcccaccccacgctgcctcccaatgcacttgaatcctgcaatgcac

SEQ ID NO: 569171 - DNA, 598 bp, Homo sapiens
  misc_feature (335)..(335): n is a, c, g, or t
  misc_feature (398)..(398): n is a, c, g, or t
  misc_feature (403)..(403): n is a, c, g, or t
  misc_feature (442)..(442): n is a, c, g, or t
  misc_feature (456)..(457): n is a, c, g, or t
  misc_feature (496)..(496): n is a, c, g, or t
  misc_feature (509)..(509): n is a, c, g, or t
  misc_feature (577)..(577): n is a, c, g, or t
gagtcgggaaaatggctgcgagtacctccatggtcccggtggctgtgacggcggcagtggcgcctgtcctgtccataaacagcgatttctcagatttgcgggaaattaaaaagcaactgctgcttattgcgggccttacccgggagcggggcctactacacagtagcaaatggtcggcggagttggctttctctctccctgcattgcctctggccgagctgcaaccgcctccggctattacagaggaagatgcccaggatatggatgcctataccctggccaaggcctactttgacgttaaagagtatgatcgggcagcacatttcctgcatggntgcaatagcaggaaagcctattttctgtatatgttattccagatatctgtctggggaaaaaanacggngggcgatgaaacagttgattgcttaggccccctgggaancggacaagtgaaanntggggcgcttggggggttgtgggtggggctcagcaaaanacaccaagctcgngaacttgatgggtttgggctttctctgtctggtgtggtgcttcgaaaactgggcttggttaacgaggnaattgatgtgtttgtggaagc

SEQ ID NO: 569172 - DNA, 434 bp, Homo sapiens
tgggtccgtccaagggcactttccagtacacttaccaggttacgactggtctcctctatataaagtgcgtaggggttataagtcaaagtgtccttggaagtatactggaggagggtgaggggcgggtgtgtacgcgctacagggcccgtgttccaactaagcactctactctcagttaacggtgcgtaaactcccacctattcagacccttataagttccaataaggggctatactcgagaatagagttaccggtggggataagaacatatgtgtcgcccatatttcgtgtgcgcacctctcaggtgggcatacactcgtgtgaccctaaagggtgtcttaaccggtgggggtaactgaggggcgtatacttgtggtgacgctcttaaataacaggggtatggggtgagaaagatgggggggtaataatcaggg

SEQ ID NO: 569173 - DNA, 1091 bp, Homo sapiens
ggggagtacgacattgcgcgctgagctgtcgggcgctgctgctgtgtgggccgccgtctgcggcctttgctgcgtgtgcgcctggcgctggctggccgtgcctgggaggaaaaccaattcttgtgtcctcggaggaccacagcccagttgggccccagtgcgaaacccagcctggatgcttgcagtcgcatggacgactgttcagcactgcagacctgctgaggacaattgaggaacccctgcactcgattatcacgcagcacatgagatgctgtgcagtggttcccactataccaagacatgagttccaggcctgagacacaagaagcttttggacattgtatgcccgggtccctgtactcagcaaaaagacggtgtctgaataccgggacgctgatctccaatgccagcgatgccttggaacaaacttgcgtcaccacaatgctggtgtctgacggccaagcacgtgccagaacagtggacgattcacttgcaggacgcaatgcccgagaaacggcaccatcaccattccaggatactggtatcgggatgaccacagggaacgagctggtgtccaacctggggacggattgcccagatcggggtcacacggccttcctggatgctctgcactacccaggctgagggccagcaagcacgatcatcggcccagcacattggcagtgggtatctctactcagcctttccccattgcgttggcttgacaagcagggtggcagcgttctaattgccgcgcatcggcgcaggacgccggtcggcaagacctggggttacccacgttgccattccaggcatggatcgctggaaggactgtaacggcagagtcccgcctgaaaacgcgacatcgggggaaggtatacgacacccgtgcggaagcagcgcacagcacgagttcaatcacccagccgtgcaccagttccgacctgtgcacagtgcggacgtttgcccaagccgtagtggaccccggtgctgcccgacgactggtgtgcatacagcaagctaacacggccacgcttgcgtcacaggtatacgccatagaacgctttgcaatgatagcgacgaatgaacgc

SEQ ID NO: 569174 - DNA, 1029 bp, Homo sapiens
ggcatggaagcgcagctgtgcgtggtgtacgggcaatgtgtgatgtgttggtgaaacaactctcttcaatatccattgtcgtttgtcgcacatgtggatttggggtctgccttgactgtggaccggctcaatgataaaagcctgggcacgcatcgagacagaagacatgggtgatgaagaagttgctcctggttgatgtgtgcaaggggactagtccctactgaatcagagaatctctatgcccgacacaatattattcctgcgctacagctcttctacaattattcgtgccgtacgatggtacatgctgaccggggcaagtggtggaatttaatcgctagctgcccttgtatcagtcgactgaaccaatctgtttgtgagcacctgcacgtctatccaagtgtggcatgtcgcctaggcttcgctagctatgaagccctagtgcctcttctggaaacggaaactacctctctctaggggtggcaggaggcaccgaggcactcggtatatcatagtccagagcccggacctatgttcccaaatgccgagagcgcggacatcagatctgtagagcctctgaaaactgacagttcggcatcatattagcaatagttgaacttgaaaggccatcaggcctccttgccctgtgggcggccccacccctcctccgcacctgactcgcttggcagatttggaactgggagagggtataggaagaaaccacagacatgcagggccccgaagacggaacgcacaaagaacgcgtacatgacaggcattggcatgggaccatccaagctccaggcaagggacgcgccggacccacaggttcaaacggaagtgcggtggcccccgtgtccgagagaccagaggggtagtctgaaccctatcacggggagaaatgttaacacccgagaaggagatcacgggtttctatctcgaggagcgagagcacgacgcaaggacacacagcaggggagataaacaacacacaacacaggaagtccacaagagaacgaagggacacat

SEQ ID NO: 569175 - DNA, 115 bp, Homo sapiens
gatggatggatggatggatggatggataaatggatggatggatggatgaagggtggttggatgggtggatgcatccatgaagaggggcctctttgtccctagggaattcccccct

SEQ ID NO: 569176 - DNA, 448 bp, Homo sapiens
ggaggttgaggctacagtgagctgtgattgcaccactgcactccagcctgagtgatggggcaagaccctgtctcaatttaaaaagaaaaagaggccgggcactggtggctcacacctgtaatcccagcactttggtgtaggctgagagtgggttggatcaccatgaggttgaaggaagtttccggaggcaccaagccccttgggccaaacaatagttgaaacaccgtctctactaacaaatacaaaacaattagccatggctgctgggttgagcatgggaagcactgtaaatcacacagacataacataccagagtgaatggccttgaatggggacacattgggaatggaaaaaatttcaaagggtgttttgggaaaaagcagcgccgggaggggaagggggcacaggaaaagggtttggacaaggttgaaggcaaggaatgaatttg

SEQ ID NO: 569177 - DNA, 810 bp, Homo sapiens
ggcccctcggacggccacgagactcggacatctttccaggaacagcgtgaggaggacagaagcatccaacaggactgctcgaagcccaccctgcgaacactgctgctaccatgcccaagagaaaggcacacaaggagatgctagaggtgataaagcacaggtgcacaggatgagccacagaggagatcagctcggtgtgtctgttaagaccagctcctccaaaaccagagcccaggcctaaaagaggcctctgcaaagaagggagagaagcttccccaagggggagacacggggggaaagcagatgctggaaaggatggaaacaacccttgaaaaaaccgagatgcctctacactccagttcccagaaggcggaggggcactggggaatgccagtgtgacaatgtacattttgagagctctgtactttatagtgactctactgtttgaaatactatttttttaaatcaaggttttataaaagtgtaggaattgtgggtttttaagtaatgtgtgtagcacacaggacacttcccttgtgtctttggcgaacagggcacgtaccactaataggggtgtatctcagacaactgacttgaacataagggaaaactaggatttcctggtcgggttgtggcacgattggtcttgattccctggattccccaggagagatttctgacattaacgtggtcagccacattggacggaagccttacaggggggaacccaacacttggtgttctctttccggatggcacagtatatgggtccttaacggagagttgtgtggctggacctaaacggtggtg

SEQ ID NO: 569178 - DNA, 142 bp, Homo sapiens
tcattacatacaaatagcaagaaaatagctgggcaatgttgtgggtgctctgtaatcccagctgcttaggaggctgaagcaggagaatcccttgaacccgggaggtggaggttgcggtgagctgtgattgtgccattgcact

SEQ ID NO: 569179 - DNA, 170 bp, Homo sapiens
cggggagtgccgagagaatggcatcacgctgcggacgatgcgggacttgggaaagaagaagtgaggctccggtggggcaggctgaagggcaggtagtggtatgtatcctggggctcccgggtgaagaatctgtcctggaagagctcgtctatgatgctggacgcgcggct

SEQ ID NO: 569180 - DNA, 316 bp, Homo sapiens
  misc_feature (30)..(30): n is a, c, g, or t
  misc_feature (32)..(32): n is a, c, g, or t
agccactgcgccccaccccatttcggtgtnanctcagctcacttcaacctacccctcccaagttcaagtgattctcctacctcagcctcttgagtagctgggattacaggggtctgccaccacgctgggtgattttcctatttttagttgacactgcatttcaccaggttggccaggctggtgttgaactcctgacctcagctgatccacccgtctcggggtcccaaagtgttgggattacaggtgtgagccaccacaccaggcccatattttcttttagacatgcaggcaatgttggtgggtttgtctgttaaga

SEQ ID NO: 569181 - DNA, 232 bp, Homo sapiens
tgttacctgatccccaagcgcgtttgatgctggcgcggatggtcggccacattacctacctgtccgacgactccatgggcgagaaatacggccgtggcctcaagagcgagaagctcaactacgacttccacagcgtctaaattcccaggtggaaaagctaccctgcgttaccaggggcgacggagttctcgcgggcgtattcgacgccaaataaccttaccttgcttgatga

SEQ ID NO: 569182 - DNA, 440 bp, Homo sapiens
gggcctctgagctgctcagctgggtctcctgtcctagagggaaggtggcccagagtctttggtggagcggaatctgtagatgaggttaagggactccagttgccaaggttgatctgaaacaggcagggagctaagctcatcagaacaccaacagattcatgttctcgtcttagctttcatctattctggtctcaatggcttcgggaaacacacatatacacatacaccatgcccttgagaccagaacagattcatgttctcgtcttagctttcatctattctggtctcaatggcttcgggaaacacacatatacacatacaccatgcccttgaactcaaagcaaactacgctctcagggaaatacaaatatcacgttctcatagtcttctataaatagctaagctatactttacagctataagaatcgcgagcggccgct

SEQ ID NO: 569183 - DNA, 138 bp, Homo sapiens
ttcgaagctgacatcatgggaaaagtaccgtaaatgaatggtatcggataaacaataacgggagttcgaggtaatcccgtttaacaaaaaagtaacaaaatttcagtcgtggatttagagggaccggttttttttttt

SEQ ID NO: 569184 - DNA, 106 bp, Homo sapiens
gggaaaacaacactggggggttcctcagccatttccttgacccttctcctcctcaagcctctgctcttgactgtcacaaacctctttttacctccgtattgttctt

SEQ ID NO: 569185 - DNA, 203 bp, Homo sapiens
  misc_feature (138)..(138): n is a, c, g, or t
  misc_feature (174)..(174): n is a, c, g, or t
atctagaggatcccgttactgtggtgtaccgtcagttcagccactgttgaggctccaccaccagagatgtggctggcagcaagaaggaaccagctacctcccctctgccctccaatctgccagcagcgccccccatgngcagaaaggaaaaccagctagggtgggaacgtgagngaaggtgtttgcagacttcagcaccctgt

SEQ ID NO: 569186 - DNA, 102 bp, Homo sapiens
tcggcacgggatttgggagtgtgtacgggggggctgtaacactcggggggggtgcgatgaatagcgaggtgcgatgaatagcgaggtgccgatgaatagcga

SEQ ID NO: 569187 - DNA, 141 bp, Homo sapiens
cagagggaggcggcactggtctcgacgtggggcggccagcgatgaggccgccagtttcaattacaaacaggtagtttgactcatcagatgaggagcctattgaggatgacagactccaattcatatatcatggctatcttt

SEQ ID NO: 569188 - DNA, 910 bp, Homo sapiens
ccacgcgtcggacccacgcgtcgcggacgcgtgggtcgacccacgcgtccgccggctccagctccgccgccagctccagccttgctccccctcccaaagtccccgtccccggagcggagggacctagggtccctctccgtccccccagcccagtacgcgtcagaccaggggcctcgggtgggcattgcccccgcatagaacttgacttccctcccacgctcagcgcctgtctcagtgttcccctagctcatgacatctctttcccgattcctggagaagacctactacccaaacttcaatcgacacatcactcattgcatacttgttcaaaaactcataggaagttcgccgcatcagttgacccgagaacttctcagggacagacgccacgtgtcctgttttgcatgtgagtgtatcacctgtcccgatattctggaacctcattcgagcaaactacattctcaactctacacacacgtgtgtatagaaggtggttctacaatagaccatgcatgccgttccacacacggtctgggtagatattatagcaagttcacacagctaacttacgatgggaaccatgacacgtatcagagtgggagtcctggtcgtgacaccaaagcattttctgacgtttccgggtgtcaatcatgaattcaaccccttcatggagcatccatcagggaacttatctcccatgagtaccctgggagtacaagtgacccatcattgtccgcacgtgtccaggtgaagaagaaccgtcgaagagaatacaacaacaggccacaacatgaaagcacaagagagttaacgacacgcaacaatcataaaccggagatatggagcaacatataagaggggctcaacgaacaacaatagcacatggggaaggctggcaaaagtctccggc

SEQ ID NO: 569189 - DNA, 904 bp, Homo sapiens
  misc_feature (303)..(305): n is a, c, g, or t
  misc_feature (332)..(332): n is a, c, g, or t
  misc_feature (335)..(335): n is a, c, g, or t
  misc_feature (346)..(346): n is a, c, g, or t
  misc_feature (350)..(350): n is a, c, g, or t
  misc_feature (361)..(361): n is a, c, g, or t
  misc_feature (373)..(373): n is a, c, g, or t
  misc_feature (378)..(378): n is a, c, g, or t
  misc_feature (392)..(392): n is a, c, g, or t
  misc_feature (493)..(493): n is a, c, g, or t
ctaacatgccctacttggaaagatctaagatctgaatcttatcctttgccatcttctgttaccatatggtgtgaatgcaagtttaattaccatggagatgttttacaaacttttgatgtggtcaagttcagttttagaacaagggagtctgttccagatcagggccagaactgtgcccagtgcccaaaggagacaactaactaaagtagtgagatagattctaagggcacacatttatccaagtcttgccatatttcaagcaaagaggtgcccaggcctgaggtactcacataaatgcttgtnnngctggtgatttaaccagtgcttggaanaantcttgcttggntatntctgcatcatntcttaaggctgncttcntctctgagtacgtngccctctgtgctatcaatcatcttatcatcaattattagacaaatcccactggcctacagctcttgcttctgcagcacccactctagtctcctacggtagngatgaatcacgttgctggtaccaaccagggacgcgcagctacccacccccaacatcaactgcccaacacgaggacccaggaaccgttctgttataccctacaggaccggcacaacacacgtacggccgcgcaaacgcgacacacggcggcagcagcgcctcccaccccacacccggaacaaccggccatttcaaaatgacaaagggcctgaagccacaagccacaacaccgcagcgcgcccaccacacactgcagcacccaacaaaccaccggtcagagacacccaaaccaacacaaaccaaacgcacagcgcgaccgaacagaggacaaaccgcaaacaccacacaacgcacaacaagaagaagcaacgacgcacaaacacaacacgccaccgaaccccacacacacgag

SEQ ID NO: 569190 - DNA, 385 bp, Homo sapiens
gcacgagattagctcttagtaagattacacatgcaagcatccccattccagtaagttcaccttctaattcaccaggatcaaaagggacaagcatcaagcacgcagcattccagttcaaaacgtttagcctagccacacctcacggaaacagcagtaattacctttagcataacgaaagtttaactaagttatcactaccccagggttggtcatttcgtgccaccaaccggggtcacacgtttacccaagtcatagaaccggcgtaagagtttttagatcacccctcccattaagttaaactcacctgagttgtaaaactccagttgacaaaaatagcttcgaaggtggctttacatttttaccaaaaattgctagcccacctgga

SEQ ID NO: 569191 - DNA, 109 bp, Homo sapiens
acctgtgttgaaaatgggaagtgtcttgcatgtagaaagccgtatcctgaggacccagccgttcataacccagtgtcccaggcagtcttgcaaaggtttccgggtgaga

SEQ ID NO: 569192 - DNA, 230 bp, Homo sapiens
gtcaagtctatcccttcttacgtgggaatgttggggcatccgggtgcacaatctgtgcaagcagggcactgtgtccagaagggccccaagcttggtttaatgctcttatgttgccattttcaaattctttttcttttttcttttcttttttttttttttttggagacagagtttggctcttgtggcccagggttgagtaccattggtgtgatcacagctcattgtgggga

SEQ ID NO: 569193 - DNA, 119 bp, Homo sapiens
caggagggagggcgtgggtggaacagccaccttttcgggtcggcccagctctggcacgggagcctggttccccatctcgatgagctgctctttctccaggcgggaggctgatgattttt

SEQ ID NO: 569194 - DNA, 155 bp, Homo sapiens
ttgctacactaggtcagagcattgtgctaagtacgtacttacatatattttcctatttaaagaagtgtatggagtggcttaatgggcattatgtgatttgatgggttacaactcatcaaattgtaagcatttgccacaaatgaatcgaattcatc

SEQ ID NO: 569195 - DNA, 731 bp, Homo sapiens
  misc_feature (75)..(75): n is a, c, g, or t
  misc_feature (91)..(91): n is a, c, g, or t
  misc_feature (103)..(103): n is a, c, g, or t
  misc_feature (200)..(200): n is a, c, g, or t
  misc_feature (350)..(350): n is a, c, g, or t
  misc_feature (570)..(570): n is a, c, g, or t
tcactgagctcaccaacacagccaggaaaagaacagaagtgtgagaaggctacattcctgagaccctgagaaaangtacctgcataagacngagatgaaattncctactctagttatgattgaaatcccaaaaagaaaagaggaaaaaataatggagcaaaagaaatatatttcaaaataactgccaaaaatattctaanagaagtgacagaaaatcaaacttcagatataggaaactcagagaatgtcaaatagaacaaaaagaaataagaattccgtcttgaaaaatctttaaaaaatcaagtctaaattttatatcttgctccaaatatatagagatataaataggntatcatcaagatatggagaaagccatatcatggaaacactaaaataaggctgtggaaggactacattgatattagacacaacagagttcggaacaagaaatagtatcagagatgagagataatagataatagaataatcaattctcaagaagatgtaaacatcctactaattagggtatgcagctaacaacagagcctccaaatacgtgaggtaaaacangaaagaaatcaaaggtgaactagaaaaatccaaaattatatttgcagacttcaacacttttgtcttagtaatggaaagactaggcacaaactcagtaatcatgtggaagataagaacaacagtatcaccaacaagacatccaatcttcaatggcagatact

SEQ ID NO: 569196 - DNA, 216 bp, Homo sapiens
caaagtgggggattacagtgcgtagccgcgtgccagcaaggcgggtcttgctgtgtttcccagactagactggtcttgaattccaggctcaagagatctcccacctcagcctcccacagtgctgggattacaggcgtgagccgccacacccagcctattcaaaatttttttttcttagagacagggtctttgttgcccaggctgggcttgcagtgg

SEQ ID NO: 569197 - DNA, 221 bp, Homo sapiens
  misc_feature (214)..(214): n is a, c, g, or t
caaaagcggcgcaacgccagatccttaatccactgagcaaggccagggatcgaacccgccacctcatggctcctagtcggattcattaaccactgtgccacaacgggaactcctgttttgtctctttagggccgggccgtacccatggcacatggaagttcctgggctaggggtcgaatcagagcaatgccagaccccgcttttgtgttccggngatcctc

SEQ ID NO: 569198 - DNA, 616 bp, Homo sapiens
tagccattactgtctgtttcttgtaactcaggttaggtttggtctctcttgctccactgcaaaaaaaaaaaaaaaaaaaaaaaaaaaaaaaagccggacaaaaggatgcaaatgaggaggacacgacaccgtcaccaccccgaaatcgcgggggttgaggaggagagaggaaattgtctttctttccccctggagaggggcgaaacaaaggctatctcttccatgggggcaccaatttaaaggtccccccaaactgaggggggcgctcaccatctgcggacaggtcgccctctcaacgaatacacttaacccgtaccttttccacccccgcgggggggtggacaggcaggggccaacaatctttccgggcggggccagggcacagggtcatactcccataatcttcaacaggggacacattgggggggcgggccatatctaggcacacgagagcgggcggccacgggtttaaccccgtgtggattggggtggtccccgggcactctggacgaaacccaacatcgggggggcgcacgttctcaccaatactcgtgtaccactttcaagcggccccattaagcacttgacgctggtcccccaaaacaaaaaataacca

SEQ ID NO: 569199 - DNA, 260 bp, Homo sapiens
  misc_feature (58)..(58): n is a, c, g, or t
  misc_feature (87)..(87): n is a, c, g, or t
  misc_feature (109)..(109): n is a, c, g, or t
  misc_feature (152)..(152): n is a, c, g, or t
  misc_feature (194)..(194): n is a, c, g, or t
  misc_feature (222)..(222): n is a, c, g, or t
  misc_feature (251)..(251): n is a, c, g, or t
gggcactgccatgcgtggtcacgtcttgatgccttcaggggctcagtagctatcaaanaggcctggagggcctgggcaggcttgacnatgcctgaccgagtcggtgganagtttgcgttttacacccagcgatgcttggggatggcaaaaanatggatggataatgagtacaactgcaaacagcactgtacacntgtggtgagccaagaggctgggacggangttaggccaatgttgctgctgactcatanacccacagc

SEQ ID NO: 569200 - DNA, 737 bp, Homo sapiens
acctgttgatcccacattctacctaccagtattcttaagagtcttccagatacctggagtccatcaggtttatatacggaagccttaggggagaagagcagcctgggcctggacgcagagaggccttggacctgtcagagaactccctcgagttctcgggaacccccgggacccgtcacctctctggcccactttccccggcctcctattctcagcccgagttttcttggtgtgaccctccggagttctacaagtgtgccaccacacacggaagggttctcttttctgttcagggcggcccccttcacgggaagcaccccgctcacccctcacggcaatttcggactggaggggcccccagaaggtcagccacttactcttaaacgagttgtttcggagtcatattgagtctcgttccgcttgttcctcttgtggtcccttccctgtagtggacttgagatccattttgagttctaatttgtaacgtgtttctttgcgtgaggcaccccgccactgtctgttgcgttttcctcggcacgcgtgtagggcttcacgcttcctgggttttcacccctcctcgccggccctcttggggtcctgagggcccatgggtccctttcacctttttctgcatgatggtccgataactgatttgttttggcattcacttcccgattaattttccctgtttgaagtaattgcaaatgtgctttaccgaataaaacatttgaatttta

SEQ ID NO: 569201 - DNA, 385 bp, Homo sapiens
aggagcgtatagggatggcgcgttgtcagggcaggcgggctgataggtggagtcagtgggtatgtggtagagtgagacgcatgtatatagcagagatatatccgtttacaagccaagtcactttctcatatacagcatgttaggaagcatgatttgtttttctatcatctattcctccaagcatgtttaattgaagaaagtattaatatctctttagataagctggtatggacctaattgggtttatgatgtgtcagagctaattcatgttcagggtgagcgtggtacctaccaacaaatttccgggtggggtatgcaaatggttattttctttttactgttgttaaatgggactttctgttaatgaaaagcactattcccaaga

SEQ ID NO: 569202 - DNA, 786 bp, Homo sapiens
  misc_feature (138)..(138): n is a, c, g, or t
  misc_feature (147)..(147): n is a, c, g, or t
tttcgcgtctgccagcctggctggcagtcctgtctgtccatcccgccgcgccggggcagtctagtgctggagcgggggctcaggcggcggcggcctcgacgcgagtgagtgtcgtggttggggtgctggacccagagntagcctacncgctctgccgtgcctgtggcctctagtttcacatctgcacatgggggtgacatccctgccctgctgctgccaggagcgctgtgagtcttcaggcgtggatcagcctgggggaagcataggcgcttcacaggcctggcttcacatgcgggagggagacgcatctgagaggagttctccatcatcccctgctttgtcttcgtggagtcggtgctgctggcttgtgatctgcttgcttacgctgagtccggacccttccctgtgccacccaggattcttctgctatgacagtacctacgccaagccctacccaggcctgaggctgccagccgagtgcctcctgctcttgtctacgcactggtcactgccgggccaccctcacgatcctgctgggagagctggcgcgtgccctttttccctgcaccaccttcagccgtcccagtcatcggggagagcaccatcgtgtctggggcctgctgccgcttcagccccccagtgcgggaggctgtcaagcttcctgggggtctactcccttcgggcctcttcaccacgaccatcttcggcaacgcggggcaggtggtgaccggaatcccagcccactttcttgtccgtttgcgcccaattacggcctggtgcttccac

SEQ ID NO: 569203 - DNA, 122 bp, Homo sapiens
gggtttttggggctttaaaaaaaaggtttttccggcggccctttttggggggggtttgaaggcctttttaaaaaaccaattttttggggttttgggggggggcccggaaagggcccctttta

SEQ ID NO: 569204 - DNA, 1031 bp, Homo sapiens
agcggagaaaccggttggccgcgcaggattggacggactccctatccgcaaaccgcgcactcgtgccgtgccgcgccgatttgatttgtatccattgtctagcaacactgctcacttaacgacttatctgggatccaggaccctagtgcgagctgctacactgatactcttgagtgaagaacggagagctctaatttatgcgtatgtccttgtcgggatgtgaccaatagctagacttctggtgttgccgccgaactgatgcttctgatgtgactgactggtctgttcttcatggaaactctcgagtagagtctatgagcgagcgactgaccgaagtgacggtctgcatggtcccctcgagcatgattgtccgcagggtagtacgatcaatgtaggtccttcgctcaagattgaacgttcttctcatattcctggtgcataggctatgggtgcggcgctgcgcaatctgagcatccgtcgcttccaaggctgcagtggcatacacgcatggcgattgtgttcatatagctcacgcatctagagattccgctaaattatcaacttgtggcccgagattatggaagtttatagtatcaaagtagcctgcttgcgcttgaactatgtactacaatgccaccctaattcggaactcgttatctgtttgacgatccgctgtgctagagcaaagaatgcgcaacaattcgatgaggactatgggaaagcaacgggtggtcccaaccttttgggtcgcacttgatgacttggaagggcgttgcaagcccagctttcggtcacggcttggtcgtaatctcgagtaaccctggatgtgacaagtagcccagcgaaaacagtggtatgcccttgcgttcggagatggcgttacgaacctcttgggttgcagacgccccggggagaaacctttgttccatccagaggcccatacattcaatgcttcttgggaagtgccagcgttgaatgtgaacctaaggggaacctgcctgggttcctttaagggggaaagtgcgaacaag

SEQ ID NO: 569205 - DNA, 136 bp, Homo sapiens
tgatccctttatgaacctggtgatagatgaatgtgtggagattggactagtggacaacagaacaatattggaatggtggtaatacgagggaatatgtattattatgttagaagccttggtgtagatactgtaggtg

SEQ ID NO: 569206 - DNA, 91 bp, Homo sapiens
taatgcagggatgaagtagttttaattgactcgagttgtcttttagaaacactagaaacatatctgcgaaaacacaggttttgcactgatt

SEQ ID NO: 569207 - DNA, 160 bp, Homo sapiens
agagtagcaatctgtcacctcccttacccaacacataatactacacttaccttctatgtcaattgttttcatcacatttcccaaactgatcgcatatctatgtgactcacattgaatatagacgagaggggcccatcacgtacgccaagttatcaatact

SEQ ID NO: 569208 - DNA, 100 bp, Homo sapiens
cgatcttgacatttcatataagtattaaggcctatctaaatccagtcacagatctgtcgagtgagcacccctaagcggcttgctactactcccaaggcac

SEQ ID NO: 569209 - DNA, 718 bp, Homo sapiens
gcagctgaccgaagtgtctaaggaaagagagcgaggggagcaggagaggcgagcgggctgaacgcaggaaaggttgaaacaagagagagagctggtgttaacgtgagctgagccagggtcctgtgccgtggagctgatggaacgcgtgcatgataggatgttttgtgaggtgatacacctgctcccaggagttgcaacgacatgcagtagagacagaccacgagggtccgtgtggcccgttgctgtgaggatgtctagtgcccacttagtggacttgtttctcagtggcaggcaaatcttccagactgcaacacaggcagaccctccaggagcttcagtgcttctgcaagtatctacagcggtggagcggaagctgtcacatgcccgcaatgaaactgaggcgccaaatgcgtggctttccctgctgcgccctgctgctgtggacgtgatgcgaccggctgagggcagctggcgcccagcgtcagatgtgccccattgctgaaggagaacctggccaggggcctcctggacctgggccatgcagggcagattgggcatctcctgcaccagtgttaaggcggctcagaaacaagacagctcaccagatgacggttcagcacttctaccagcagctgctgagtgatgtggcatgggcgtctctggactgccatcctcgtggatgagcacctcctgggaggcaggagcatgtgttaggaac

SEQ ID NO: 569210 - DNA, 140 bp, Homo sapiens
cacgaggggattgtgagaatgggagagtccatgattacatatgcagaggttgatcggcaggtgatcccaatcattgtgaagtgcctggatggaatactaaaagcagccgaatcaattgatcagaaaaatgattcacagct

SEQ ID NO: 569211 - DNA, 695 bp, Homo sapiens
catcggcatgccaacttcgctgagcagattggctgtgtaggagttgcaccagcgtgcccgggagtacatactacctgcattaatgaatcggcactgcccggaacacaactacaaccatacatctagcaacgccacacaactagatacacactattacaatcacaacaacaccaacaacccaatatccccccacaccatataccaccaactatataaaccacttacacaccaactacaaatacaacacacacaatcactcacacacaacacacacacctagacagcaccttagacaaaccatacaagtcactactttcttatccctaactatacactcaaacccacacgacacaataacacgccacacgcctgctaatatcaatatctaatatatcaactctacacacccatcaacacccaatacataaattgcactcaacaaccacccctcaccacacaacaccgacatacagccaaccacacgagcacacaaaaccaaaaacactcacaaccaccacccacacccacaccacaccatcacacatcaccccacacacctcacctaccaaactcccaacccccgcccactccacactatcataaccccaccacccaccaacattacccacccccactaactacaatccaacactccataaatactacaatccccacaatcatcataccccacacac

SEQ ID NO: 569212 - DNA, 142 bp, Homo sapiens
gttatagaggatcccccctgaagctgctgacgttaaagtagaatattggtgagtattaagaggggggcagcacattggaagcctcatgagtgcagggccgccaattgtccagagggcacgatgtggggatgtacttgacccc

SEQ ID NO: 569213 - DNA, 322 bp, Homo sapiens
cgacttagtagatcccccagatattttctatgagaaacataactggccacctatttcttaatatcaaaatgggtaagtccgtgccttcctcttcctcctgattatatacaacatatctcctttcaagactatgatttccatcatgcttattccttcacaaatctaaaccttgaggtgatatgaaggaaaccaacatcaagaaaagaaaactcaattcacaaatgaagaaaactggcaggtatacaatacacccccagagcatctcaatatccctggcacagtacaattcaatgtactgctacagcccatagaaaatattctg

SEQ ID NO: 569214 - DNA, 236 bp, Homo sapiens
tcaggtgtgagacggttcgtcaccgcggtgtgtgtgagcaataccgggtgattagtgtcaaggtgcaagccagtcgaatcggttgatctatcgcccattttatacagacagtggtacagcagttatacagcgaatcgatagctcggggtgatgcacgaagtatggcgcgtgaaccttgcagttggcggtcgggctgatcggttatggtacactatagatgatctctgattcatcag

SEQ ID NO: 569215 - DNA, 314 bp, Homo sapiens
gtaaaaaggatcttattctgttgcccaggctagggcgcagtggcacaatctcagctcattgcagcctcaatattccaggctccaggccaaacaatcctcccaccctctgcctcccaagtaaaggcgctcgccaccacacctggctaatttttctattttttgtagagatgtggtctcactatattacccaggagttcaaggctgcagtgagctatgattgtgcttatgaatagccactgcactccagtctgggcaatagtgagtcggtcaacccccctttccccctccgccccatacctcttcaaatgtttaaa

SEQ ID NO: 569216 - DNA, 388 bp, Homo sapiens
aaccggcttcatttactaccgagtagctgggaccataggcattaacacatgccagccaatttttgcacccctagtagagatgaggttcaccgtattggccaggctgttcccaaactcctgacctcaagtgatccacccaccgtccttcatcatacctacctcagctatttcacttgtaaagtggactcatgatacctgctcctgggaacttgttttcctcactccaaagcaaaactggaaatatgctttgtaaatttttttagtaaaaagtgtgtttatataaagcactgaggacgctctaatttttttttttttttttttttttggaaaaggagtctaactctgtggcccaggtggaagtgcagtccccggggaggatatgatgaag

SEQ ID NO: 569217 - DNA, 162 bp, Homo sapiens
  misc_feature (14)..(14): n is a, c, g, or t
gcattttttagtanagatgggggtttctccttgttggtcaggctggtctcgaactcccgacctcaggtgatccacctgcctcggcctcccaaagtgttgggattacaggcataagctgatgtttgtaaagcgctttgtaaataaacgtgctctctgaatgcc

SEQ ID NO: 569218 - DNA, 161 bp, Homo sapiens
tttcctcttgtgtcaaattgggaaaacactacctacccatccgtctgctgcgaggtgtcgaagggattatgctggaaagctggctcacacagagaaggtgggcattaagaggtcatacctcagtttctctactctctcacaagtaaaatctgagtagacag

SEQ ID NO: 569219 - DNA, 118 bp, Homo sapiens
gtaaaaaggcaaagcccctgataggccggggactcgtgtcagtgagcgtcttcgtggagccgggctgagactcaatggggcaaaccacactcctgtcatatcctgcccatcaaactgc

SEQ ID NO: 569220 - DNA, 241 bp, Homo sapiens
tccaatgaggcttgggacttgggacttttgagttaatgccagaatgagttaagatttggggggcctattggaaaggcatgattgtagttggcaatgtgagaaggacatgagatttggagaggccagaggtggaatggtatagttcagatatttgacccagcccaaatctctggtggaatggtaatccccaatgctggaggtggggccttccttgtatgatgtgtttggaacagattgcagt

SEQ ID NO: 569221 - DNA, 942 bp, Homo sapiens
aggacccgttcgccatgggccgtgttgatccgtggacagagtgaagggcgccgggtctgtgttccagcgcgcacgtgaagcaccgtaaaggcgcctgcgccgccatgaactaccgcctgtggattgcgctgagacggcacggtacatcaagggcatcgtcaaggacatcatccacgatccgggccgcgtgcgcccctcgccaaggtggtcttccgggatccgtatcggtttagaaagcggacggagctgtacattgccgccgagggctttcacacgggccacttctgtgtattgcggctagagaggcccatgctccaacattggcaatgtgctccctgtgggcaccatgcctgataggtacaactcgtgtgctgctggaaggagaagcctggtagaccgtgggaagctggtccggtgcatcagggaattatgccagccgttatctcccagaacctgagaccaagaagacccgtgtgaactctgccctccgagttccaagaaggttatctcctcagcaatagagctgtgcttggtgtggtggctggaacgtggccgacttgacaatacccatcttgaacgtggcgtggcgtgaccataattataccgcaatgaggaactggtggccactaagtacggggtgtggcatgaatcttgtggagcatccttttggatggtggtaaccaccaggacattggaagccgccacatcgtagaaatgcccctgtggccgcacgtgggtttcattgtgccgcgactgacgtctcgggagcaacggggggcaaagactcggctcggctcaaaagttggttgccaacaccaaggggggtcaattcctcgggccagttcgcccgtctggagggccagggctaaaaggcggcacgggggacccggttgggacctggaggcccaaggaagagggcggggtaaaacacaaaataccaca

SEQ ID NO: 569222 - DNA, 168 bp, Homo sapiens
gactctagagtctcccccttaaacgtgttatcctgtaccatctactgtggaggctgagacaggataagtcacttgaactatgggaggtggaggctgtactgagctgagactgcaccactgcacttgcactccagcctgggccagacaaagcaagactctatctcaaag

SEQ ID NO: 569223 - DNA, 665 bp, Homo sapiens
ctcacttacatccgcaagcgatctgtgtccacgcaaaggttcacaaacagacaacaggagtcagcagctccaaacccggttacccctgaaaccccctcatggggattcaacaacaaaacgggcacgggtgggagaccagcaaacaccagccgtgtaatggagaatctcacacaagaggccgttgccttccagacacgtatacagaccccctcaccccaagattcgggagacccgctgtgttacaagcacccctctaggcaggaagtccaaaacgagccacccacgcgccataaaaatgggagcacccgtcctcacgcggcacgaccacacactggggcctccctgacaccacggtatggccaacgggctcatattgcgcccacacattacagaaggtatatcaatagagagcccaggtatgctacttgccctgggcaacacgtgattgaaagaatgatggcaaagataattccgtcgaagcaagtccccccctcagatgggtcaccagaagcgtgttcttggtccccacagaaccgttacagaaaacacacaggggggttaaagtgcgccttcatcaaagctgcctcgtcaaacagtgctagttgtcttccaactctcttcagccccccaaaaaaaaaaacaccaaaaaaacttttaacataaca

SEQ ID NO: 569224 - DNA, 328 bp, Homo sapiens
agatggcggaggtgcaggtcctaggtgcttaaaaagtcgaggccatctactaggcccgcctggcgcattaagtggctaaaaaggaactgctgggccgaaggtgggtggtcgaacgctgtaaggaataaaatttcttggaatttcaaaaaaaacagttaagaacctggctttcctccaaggcggtaaaaccacccttccaggccctaccacttcgggcccagccgaatttttggagaccatgcaggaatattccaaaaaaaagaggaagccttttgacctatagatttagaatcaccgtatgaaaaaaagggatgatgtcatctccaaa

SEQ ID NO: 569225 - DNA, 160 bp, Homo sapiens
cttatcttcccacaggcagctgctcttgggtatagacgcaggtcacgagtggcatcacaacaaaccccagtacagtccagcccggccacagccggcctccttgtgtttctgtagtcttccctgctgctggccacatccttaaccctcctggtgcctctgg

SEQ ID NO: 569226 - DNA, 340 bp, Homo sapiens
gctggattacagatgcataccactatagctagtctttaatttatttttctttttagagatggggtctttctatattgtccaggatggtcttgaacgccaggcctcaagtgattctcctactgcagtcacccaaaagtgctgggattacaggtgtaagccctgcctgacctacagccatgttctttactattgggtaaatggttaaaaaaaaaaccacactacagtccaaagtagagcacagaacagtttatgaatgctgacatttatccagtttatattggtggagcacagtgtttttaatgaattcccattcaagtaaagcacaagaactagccttaat

SEQ ID NO: 569227 - DNA, 536 bp, Homo sapiens
  misc_feature (14)..(14): n is a, c, g, or t
  misc_feature (39)..(39): n is a, c, g, or t
  misc_feature (65)..(65): n is a, c, g, or t
acttccaccagacntccagttaggatcctgctgttaaanggaaactaccaagagaaggacatccnccccaaaaccccatctgtcgtcaccatcatcaaaggccaaaggtagatgaaccccaaagatggggagaaaccagagcagaaaaactgaaaattctaaaaatcagagcacctcttctcctccaaaggaatgcagctccctgctagcaatggaacaaagctggacggagaatgactttgacgagctgacagaagtaggcttcagatgatcgctaataacaaacttctctgagctaaaggatgaggttcaaacccatcgcaaagaagctaaaaaccttgaaaaaagattagatgagtggctaactagaataaacagcatagagaagaccttaaatgacctgatggagctgaaaccatggcacaagaactacgtcacacatgcacaagcttcagtagccgatttgatcaagtggaagaaagggtatcagtgattcaagatcaaatgaatgaaatgaagcaagaagagaagtttag

SEQ ID NO: 569228 - DNA, 187 bp, Homo sapiens
atgtaaaaaaacttttttaaaattcctttgatcaccttcccagattttctccaattggaagtttgctctttttcctttttgaaaattagtaatgaaattgtcatggggaaggtaacttgaagaattacgtaaaattcttaattccttcggccagggtacaagtggctttccccctgctactcccagc

SEQ ID NO: 569229 - DNA, 235 bp, Homo sapiens
ccacctcagccttccgagtagctagtactacaggcgcatgctaccatacccagctaattttggtatttttagtagagacagggtttcgccatgttggccaggctggtcttgaactcctgaactcaggtgatctgcctgcctcggcctcccaaaatgctgggattacaggcgtgagccagcacacccggtgggttgtctttttatagttgagttgtaagcatgctttttaatattc

SEQ ID NO: 569230 - DNA, 152 bp, Homo sapiens
gcagcgtcatgtggagtgtctccagacttgacattgaggtgggagtgggagagtagtagagtgagatggtcggcaaagtgagaaatgatcaggtcatgaggcagactgtgagtgcgcccattgagatgcctagtgatataggcactgacgta

SEQ ID NO: 569231 - DNA, 697 bp, Homo sapiens
ggctgcttagtgtgtatgtgtggcgaaagtaatattgcgcggctgattcgcaattgcacgactatggcgacccatacgagtatccagctggggcactgtgccttgcggcaaaacctcttccgtttgcggaatccacatgaagatgtcttgagtgctgctgccatgatccctttgacgaggtggctcaagaagctacagggaactccgaggtccttcataactggcttctctttcaaacagcacaagctctcctctaaccctcccctctcccttcccttctggtcagtcgtcatagagactaccgtatttgctaggacaagagtcctcagtcactgtgcaatatgccccctggatcccaggagggtctgcaggaaacactgggctatcagaacctacctgatgccctgagtggcgcttagggaaccatctctcctggctctccttgggatgatggcatggctagtcaggctctgcagtgtcttccttggactgcaatggcagagttgacccatgatcgtgcacagactactagctgattcctcgtaagcgcgacgacgagttacactcagaagccacatctttggtcactgataagtattctccacatggtgctcatgagccaccttgtggagaaaggttgctgtctagctcagtacaatccaagataagacgtacaacttgtgcaatattatactgg

SEQ ID NO: 569232 - DNA, 326 bp, Homo sapiens
ctccctgtccaccagccacaccatggctaatttgttgtattttatagttagatgttggaggtttcacccatgttggtccagtgctggtctaggaactccgtgacctcaggatgatccacactgccttggctctcacacaagtgcgtgggattacaaggtgtgagccacatgctcccgtgccttagttttttgacgtggcgaagaactctagttgttcagagctggagccactagatgtcatagcctgcagtgtttgtgctgaagttcgggatggatgcagagaagccgtcgttaaccagtttctcttgtctctcatggcctgcgag

SEQ ID NO: 569233 - DNA, 856 bp, Homo sapiens
cgatgcgatactggataggtggagctggtgccaatcggacgaaggagtacggccatgtggaggatgttgtggtctggcttctccatggcctcgacacgtcctaacttgtgggccagctctggttcccggctctgggctaacctgctccatggctaccctgaaccagatgcaccgctggggcccccaagcggcgctcggaagctggccccacggaaggcctggccgagctaagggtgtggtcctgtgcacgtttacccgcaagccgaaaagcccaactcagcaatcgcaagtgctgtcgagtgcggctcagcactggacgcgaggcgtctgcttcatccctggggagggccacaccctgcaggagcagcagattgtccttgtggagggcgggccgcaccaggacctgccaggcgtcaagctcaccgttgtgcgttgcatgtacgactgtgtgccacgtccagaagaagtacggctgggggcacaggtgggctggggcgcccttaagaacatgaaccttccgctcctggcttgcaacaagggtcctccggatctggcctttgcgcctctagaggcagccactcatggattcaagtcctgctccgctcttccatcaggaccactattaggcataggagtctgggggtgcaagggtgccctctgttcaacacccttggctccatgtgtttagaggtggtgcctaaggaccctttctgctggacaaggacacttgtacttgcctctgctggaaggcgtttactaaaacacgacccttgcgcttgtgatgtagaaacaacaaacgaaacagcaaaaagagcaaacaaccacacaacacgcgaccttagggcgaggaaaaaca

SEQ ID NO: 569234 - DNA, 760 bp, Homo sapiens
tacacgctctaattcacttaattttcttgtataaaaaccctatgttgtagccacagctggagcctgagtccgctgcacggaaactcgggggtgggtgtcttgacgaggtggtgtcagtgaactcctgatagggagactggtgttgaatacagtgtctccttccagatggtcgggggtcaggtagctgtagtgtctataaaaagtgcatcaaatggggtgccttgtgcgaatgttgcccatgggtgggcagagacagccccgggctgatgtgtgatacgacatgatcattcagaataaccaagccatcattggagcagtttactatatggcaacatgtgttgctgtgaagacagatttgccatgtgccccttgggttggcagggattagaggcgtgtaccaagacaacagaagccagaaagctggccttgtcacacttgacaaagtggggaaacaagatggtatgggcgatgctattgcacagatcttcattgtgtacacaccccaacaaggataagagccattcgtgtgggtgaccatggggggaggacccatatgttgcagaagaactcctctttgggcgcccaagagggaactgaagtgtgcccaccaaagcggagaaatatggtgacagtgttgggaccaaacccatccctttgtgtagatagtcacatttttaacaaaacccccaaaagaaaccctgacacagttgtggccccatctttgggatgaggactccccgtgaaactcagtcgaacaaaa

SEQ ID NO: 569235 - DNA, 218 bp, Homo sapiens
gagtagtggctgcacacgcgagcctccatacacacacacacacacacacagtatctgggggtggggcaagaggcaccacgtgccaaagggtaaaagtgtcagccaatggtgagtctggcagggccaagaggatatgcgaattttaattatcagcaacaagttgctgaatgtaatttttaaaagacagcatatcctagtatgggtcctcggcgtgtgca

SEQ ID NO: 569236 - DNA, 230 bp, Homo sapiens
ggcttgtctttcacatcattgtcaccaccgttgaaacacaccacccaccacctcactgtgctcacatccacagtttggtctccataaacattcaggaagtgttgatggatgtcattgggtgctattttttccatgtggaggaatgcagtgacacacctttgcttcatatgcacttctgtgtcaggtaccgttctgtcagactggccctccgttgccatacgcgccaggcg

SEQ ID NO: 569237 - DNA, 941 bp, Homo sapiens
tttgcaaacgtggtgccttcctctctttaatgtgcgcttttcacaacagggggtcgctttcttttatgggccctcgacctgttttttcgccacggtggccctacgtgccttccattggcgagcccgcatttggtcgtgttagaagcccctccggcaggtcacaacaggtgtgttagcgcccgcctggacaccttctctttggggataccgaagcggcctttttttgggggtacctctcccccctaatccccggcggtttttaacaaaaaaagaatttgtgtgtccacaccactttggtacgccccacccctctcgtccccacaaatggttctcccctcctttaaagtctttgtgaagaaaaatccgcttgagtgggcagaatcggtcttctcggtgtttgactgggaaaacctttttctcccgcgcggtctaattcccggcctcccctcccctgggtgtcttataaattggacagacgggccctccacagaagattctctcccctttcgggagtatgtctttaagaacgaagttgttgacctcttctctcgctggggatttaaccaagtcggtctgtaggtaggtcaccaccccggagagctataagtccactccccaagagaactgcgttaccttagaacaaacaacttcttacatacgagtaagaattttttatcccaccattgtacttctcatatctggctctcattccatcacatttacacacagtgtctatcttcactacatagcaacaaattgttctacaccaccatatgtatattgttgccaccacgttatcccccacacacattgtgaattgtctactctcccttcctagcaagaccatcccaagcatcgtacaacatcgaaattaaaaacatattgtaaatgatttgccatttcaaaaccaaaaaaaaatcttgggattcttcccacaaaac

SEQ ID NO: 569238 - DNA, 201 bp, Homo sapiens
cccctagtccagctcatccacctgtcggacttgctcctttagaagggatttgaacagcccctcatcgaagtctgccgccaagtaaatacgctcctcacgttggccttggcgactacccagatcagcgatcaccaaccatgaatgcttcatcagcacatcgctttcggtaaacatggctgcacggccatttgcgagacggta

SEQ ID NO: 569239 - DNA, 313 bp, Homo sapiens
ggattgggccacttgggatcaagagttggggatattgggaagttgcctgtggggagcacggggtgagggtgctggcgtcacctctgaggggtaggttcgttatgcttgtcgcgggcgcgcttgatcatgcgagagcggtcgattcgaatgtatggacgtgagatcttcatcccagtcagggagactcggctgaagatgtcatgatctctagccacccaagccccagtactcattgactgagccatagtttctcagaaactgagccttactcaggccggacacacctccaaagtagccagcatggcgatgccgg

SEQ ID NO: 569240 - DNA, 286 bp, Homo sapiens
atctgcaacatgccaggcacagcagccaccaggaatgaagcagtggctgggtgcagtggctcatgcctatagtcccagcattttgggaggctgaggcaggtggatctcttgtgcccgggagtttgagaccagccggtacaacatggcgaaaccccatctctacaaaaaatacaaaagttagccaggcgtgtgggatctcatatgtagaaaacaatcattattattttgctggagaggaatcgagcagtggatatgacataggccacgacacactctgaggtgaagc

SEQ ID NO: 569241 - DNA, 888 bp, Homo sapiens
  misc_feature (395)..(396): n is a, c, g, or t
  misc_feature (464)..(464): n is a, c, g, or t
atgacccaccaatcacatgcctatcatatagtaaaacccatgcccatgcccccgtaacaggggtcctctcaggccctcctaatgactccgccctagccatgtgatttcacttccactccataacgctcctcatactaggcctactaaccaacacactaaccatataccacatggatgtgccgcgatgtaacacttagaaatgcacataccaaggccaccaatacctactgtccaaaaaggccttcgatacgggataatcctatttataacctcagaaagtttattcttcgcaggattgatctgagccttgttaccaagtcaaggcgatagcctgctacccaccctaaattagcgagtgggcacttggacccacaaccagggcgatcacccgcgtnnttaatatcctcctagtaagttccgcatgtctcgtaagactacagttcgcaggctcaatttttaaaccntttccccaggggggcgcaaaattttttcccacaaaaaggggggggggaaacaccctggtggccgggtgtacattaatcaagcggttttttttcccgaataattatacccacaccgttttttgttttgcgcccccaattaaagaagatcgcgccccactccctcccctaccatttttttttgtcggggaggacaaaaaaaacatataagtggggggtgtcggtcccctcagcagatgagtgtagtattttatatccccccaacccgtcataaacaacaatcagcggtctcgtcggtctcccccggccgtcacataatacttacagatatcagtccgcgtcctatcttcgtttatatacaaacagcacacgtcaccgcgtcatggagagtgcacggcacgatctagagtttttctattttatacag

SEQ ID NO: 569242 - DNA, 1194 bp, Homo sapiens
gggctcccttgaggggaataaagtgggcgggtgttctacgggcgcggtgttgagagctctcccggggctgttggacccgcctttgtttgttaatgggggggggagtattgaggtggggtgccttggagggggggcgcggcgcggtgcccctgttcgcgggaggcttttgttggttgtctatttcgcgggaacctttttcttcctcggcatttgttgccgtttgttgggtgttaattgggaggaaggggggcctggctggaggatgtatgcctgtgggcccctgtgggccggtttttgccccagggaggggcggggggtttaggtgccccccccccccttaggggcccggtaagtgcccacttgtgtgaggccgtttttgtcgcggagcggccctcctgtgaggggtctagtctcgccccctggccgccctctttcgtttgtgaaactcacagtggggcactcgaaaatgtcccccctgtgccccgaggcttattggagccgcgaaggttcccgaaagcccacgagccacgcgtggaaaaggagagaattgagacacccctcggcttttttgggcactctcgagactggttttgcgacacacggggggacccaaagtgaatatatggagaagccaccacgccacagtttcactatgagaaacccctctgagatttgggcccaaaataagccacaccacagaatattttctctctgtgccacaacaccacacattgggttaagaaatgagttttgaaagagtttgagtgaccacatctcgtataagccctggagagaaatcttgtaaagagaatgaaagaccactttgagagagaaacactaatgtacgccaagagatcccaccttctggtgagattaaagtataaatggagatgttctcgcgtgaatggcgttctaccacggttatatttatattgttaccacatccctctttccacagagacacctcgtaagaatgctaatataatataaaaatatgcgctcggttggtgaaccacatagtttcacacttgttccaaagctgtgtaatcgctgggggttaactatttcacaactgcttttgtaattcacttgtaatacaaagagaattctgtttaaacacaccccttattctttcttcttcggggttaagaaaacgtttattgtaacccgtaattataatgctgccttaattga

SEQ ID NO: 569243 - DNA, 476 bp, Homo sapiens
  misc_feature (66)..(66): n is a, c, g, or t
  misc_feature (94)..(94): n is a, c, g, or t
  misc_feature (413)..(413): n is a, c, g, or t
  misc_feature (422)..(422): n is a, c, g, or t
  misc_feature (464)..(464): n is a, c, g, or t
  misc_feature (473)..(473): n is a, c, g, or t
taaaaaagccaagttaggccaaggcgtggcgactcccgcctgtaatcccagcatcttgggagggcngaggtgggaggactgattgagctttagnagtttgagaccagcctggacaacacagtgagactcctgtctctacaaaataattcaaaaattagccaggtgtcacgctgcatacctgtggtcccagctactcaggaggctgtgctgagagaaccacttgagcccgggaggtagaggctgctgtgagtagtaacggcgccactgtacttcagcatgggcccacggagaggctgccttttgtttttgagatggggtcttgctctgtatctttttttttttttttgagacggagtctccctctgttgcccaggagagtgcagtggtgcgatctcggctcactgtaagtccgnctgccaagntcacgctattctcctgcctcagcctcccaagtagctgagacnacaggcggncgc

SEQ ID NO: 569244 - DNA, 388 bp, Homo sapiens
  misc_feature (164)..(164): n is a, c, g, or t
cattggggattaggtttccaaacacaaagaaacttcggaggacacatttcaagccgtagcattcttccttgactccccaaaatccatgtccttctcatgtctaaaatagattaattccatcccaatagccccaaagtcttgactcgttccagcaccaactcaanaattccaaagtccagagtcccatttgaatcagacaggagagactccaggtgcaattcatcctgaggcaaatttctctccagatgttagcctatgaaaatagcaaattactttcttccaaaatacaatggtgggacaggcataggatagacattcccattccaaaagggagaaataagcaagaagaaaggggtaactggtcccaagtaagtccaaaatccaacag

SEQ ID NO: 569245 - DNA, 496 bp, Homo sapiens
ggagatgctcgcagctctagaagcgagtcatgtcgtaccaaaatcagcatatggcttgtatggaaacacaggcaacatctgatagcgaagagggcattaagattggacttaaccaaaatggcctgacaacgaaaaagtcatttcatcattctgctgggccactgtagtcttcagaaatcaactgtgatacaaagcaggaaataactgttaaaattttagcaactcctaaaaggctggaaggtgggtttaacagtttattaggatttatcagctgtcattttaaaaacagtcgatttaaaccatgtagaaataagtatgcaaaaagtctgcaaaacaaaacatactttaaacatgtttaagtagatagattatctgaaattctggatttttcagtcacttcattgttatgctatggcagccaagtaatccttaacttcagtaggagtaagcctcctaaatccagcttcattgcagactccaacttctatgttatcct

SEQ ID NO: 569246 - DNA, 1190 bp, Homo sapiens
actcttgttcttctttttgttgatgtgtggagaaagcaagggaaaggaaggaagaaaaagaggggcgagacgaagtagggtcgtcagtggagtttgttagcaatagtgtgtggtgttagtagtcattccttgtctatgttgtgtagagtgtatttgtgctcggtgttaacaaaggcgggttctacagggtaatcccccacttcgccgtttttgtggcagaaagctcctgtggatgactgcccccccgttgtgttaaaaatggtcgcggcccctcccttctggcgcgcccgcgcgggaaaaagagggttctcggggataaatcctcgtgccccctcgtgtgtcctcgtaatgggggtgataaaaaggccgtcggtcccctggcttcttgagggaaggaaaatgggattaaatgtgggcacaggccctttggttcttgtgccaccatggtccacaaggacccccttctggcgtcacactggcgccacagagggagccccctttgtggtttggaagggaaatttttaggccgcccaacgtatctccccaattgagggaacaacacctttttcttgtgggcccacgtgccccataattttttggggagccacactctgtgattaaagggagccggcctgtggttccctcgggggtaaagctccacaggtattcggccttgtccctcgaaggagacttcacctccggaacccttctactgagcctgcacaatttctactcacctgtgagaatggttccacgcgagccttggagaccacacctgtaaggagagaaatgccctctctgcccacggtggtcactcctcttgttggagaacccacccaatatgcacggctccacatttttgtgaggttttgtggttctttctcgagggccacgggaagcttgcctctttcgccgtgagatccacgaatggcacgggtggactatacgacgtcaataacaccactggcggaaaaactggagtcctcggcacgcgaaggaggaaccccagaacgcctcggtttcgagagagtactttttcctcgggagagggggcctttccacgcaagtgggccaaaccttcacatcacgggcacagattttcaaatgaacattttttgccctcaccctagctgcctgcacctgccctttcagggagatgggggtcctttaagggaactggacccttggaa

SEQ ID NO: 569247 - DNA, 405 bp, Homo sapiens
ggggtcaggaggagcccttcctccaggttttccttctttcctcctcagcagagaaactggagaaaggccattaatttcagtgcagtcgatttgagtgctgaaatatttccagaatcaatggtggtgctggggtgtgtccaaaaaaaaacatttttaatagtggagttggtttgtttttaataacatcacaaaaatgcagtgcccttggggaagggaccagccccttggcctgccactttccaggtgtcctttatcactttgacgggactctttggtctgcagaaaatgctctgtcttggcatgcttctagactgtaagatttgggttttgttttgtattttatgttttgctgcatcttatatttccctaaacctttattttttgttgaaattttaaaaaaaaaaa

SEQ ID NO: 569248 - DNA, 351 bp, Homo sapiens
tgtttgcgactgctgcgcgaacggactgactggctgtgatgagactgaacgaagacgatagatctattatgttctgacgcatgacagccttcaaccatggacatctgaggctcctcgtcagcctgggcgtaactctgcagggtctagacacgccgcaagagattcctcacagtcctgagaggcgccctcatgctcactgctttcttcttgagtcaaagactgcactgcctgtacagattccagacccagctcactatgaggaacctcttcctcctcttttaattcgattaactcttccttagtgtgggagtcttcttcgtggtcgtactcagacccagccatctgctctga

SEQ ID NO: 569249 - DNA, 210 bp, Homo sapiens
gggagcgggctttgtctgttggtctcctggactgaagagagggagatagaggccaagactaagattctcaaaatggtttattaccagaactctttgtctgggcaagtcaagaaccatttccaaacaaggacatggggggaaggcttcctaaggggaggcttcctctcccaaaggaggtcaaccccagaggacgttgagcaaacgttctcc

SEQ ID NO: 569250 - DNA, 274 bp, Homo sapiens
tgggggcgagcggtgtgaggacaaaaaaaaaaagccctttccaatgtttcccctcgccaaaaccccgaatgaatttggcattaaacggttttttaaaggtttgggtggacaagtccggggaaagccttataaaaaggaaaatggctgaatgcgggggtgccaaaccctgagggcatattggaaacccggggggccttcaaaaaatatcgaggtttttccccatttccatgttttgccttctacactggagagaccaaccgccgggattttgaaa

SEQ ID NO: 569251 - DNA, 745 bp, Homo sapiens
  misc_feature (581)..(581): n is a, c, g, or t
ggcgaaattgccaactcacacaccgaggccccccccctattgtatggggtgctttaaaacaaagacacagtggtttcgtactctatctgtcgtgttgtacaagcctatacccacccaactctcgcgctctcacaccagtggtctctattttctatcgcacagagcttccctccccctgttttctacttcgccaaaaagaagagcagttctattaaagtttcaagctgttgtctcttctgcaactacaaagatataatgaacccctattctttggtcacccagaaattggttgtggctctccccccgatgcgaggatctacgcctcacccaccgtgtgttgttcgccaacgaagggagatcactcctttaaactgccccctctgggaggcagaagacactccattatattttcacaggatttctccgtatctgtccacccaacagactcggagttcttgcttcgcaccgaaaatttcttggccttctctcgcggagctgactatgtgcgcgccccctcttttttcatgtgcgccctctctcttggctcgttaaaatacttctttcttcctcttctataacanggcaccctctctgagaaattctcttttcccacacattagtatagtaattctgaaaatgttccacttcttgcgaaaaggggataaacactctattctttctatcatcaaagcccccggaatttctaacatctcgtgcctcccgcaaccgcccaatcattaaacaa

SEQ ID NO: 569252 - DNA, 383 bp, Homo sapiens
  misc_feature (14)..(14): n is a, c, g, or t
  misc_feature (117)..(117): n is a, c, g, or t
  misc_feature (139)..(139): n is a, c, g, or t
  misc_feature (167)..(168): n is a, c, g, or t
  misc_feature (178)..(178): n is a, c, g, or t
  misc_feature (183)..(183): n is a, c, g, or t
  misc_feature (225)..(225): n is a, c, g, or t
  misc_feature (232)..(233): n is a, c, g, or t
  misc_feature (248)..(249): n is a, c, g, or t
  misc_feature (251)..(252): n is a, c, g, or t
  misc_feature (254)..(254): n is a, c, g, or t
tcatcttcagaccntcatccccagatttctcgggtgggggcttgtagatgttttcttttctggcgggctttccggttcctcattcttcttctttgggagaaggagtcttttcctttnatgcctttaaggctgtggggcnacccatctttccctttgcctttaactgnncttggcgtcnctgangccttaggtctgggtttgggatttttcttttcttttctttanggtttgnncttcttaaccattcnntnngnttttttttttcgaactgccatagtcactatcgtcatcatcttccattaggaaatcttcatcgctgccggaatctttctcctggaatggtgcctcatcctccccttctgtcgtcttctcgcaaacgtata

SEQ ID NO: 569253 - DNA, 893 bp, Homo sapiens
  misc_feature (14)..(14): n is a, c, g, or t
  misc_feature (117)..(117): n is a, c, g, or t
  misc_feature (139)..(139): n is a, c, g, or t
  misc_feature (167)..(168): n is a, c, g, or t
  misc_feature (178)..(178): n is a, c, g, or t
  misc_feature (183)..(183): n is a, c, g, or t
  misc_feature (225)..(225): n is a, c, g, or t
  misc_feature (232)..(233): n is a, c, g, or t
  misc_feature (248)..(249): n is a, c, g, or t
  misc_feature (251)..(252): n is a, c, g, or t
  misc_feature (254)..(254): n is a, c, g, or t
  misc_feature (383)..(383): n is a, c, g, or t
  misc_feature (425)..(425): n is a, c, g, or t
  misc_feature (484)..(484): n is a, c, g, or t
  misc_feature (569)..(569): n is a, c, g, or t
  misc_feature (577)..(577): n is a, c, g, or t
  misc_feature (587)..(587): n is a, c, g, or t
  misc_feature (592)..(592): n is a, c, g, or t
  misc_feature (599)..(600): n is a, c, g, or t
  misc_feature (603)..(603): n is a, c, g, or t
  misc_feature (619)..(619): n is a, c, g, or t
  misc_feature (632)..(632): n is a, c, g, or t
  misc_feature (635)..(635): n is a, c, g, or t
  misc_feature (677)..(677): n is a, c, g, or t
tcatcttcagaccntcatccccagatttctcgggtgggggcttgtagatgttttcttttctggcgggctttccggttcctcattcttcttctttgggagaaggagtcttttcctttnatgcctttaaggctgtggggcnacccatctttccctttgcctttaactgnncttggcgtcnctgangccttaggtctgggtttgggatttttcttttcttttctttanggtttgnncttcttaaccattcnntnngnttttttttttcgaactgccatagtcactatcgtcatcatcttccattaggaaatcttcatcgctgccggaatctttctcctggaatggtgcctcatcctccccttcttgttcttcctcactgcccactnttccatgagcatctctctctgtttagaagctgctttagatgncgcctgccgttgttggcgcacatttttatgatcttctttttcatcttcactatcctctnctgagtgagaatcatccttcttggtcttcacatctttgtcttctgagtcctcactatcttcctgtgaattctttccagatcgctnttattttntgcttctcgnggagntgatcgnnttntcttagtgggagggcncgaatctcttccntantcttcatctgcatcatcagattcctgaaactgtgagtaatcnacaaccttcctatttctgacaggccgcgacatgttcgctgtcgaaacaggaccgagtcgagaagccaaagaccaggaccccccccaccccgcgcgctcggcgccccaccccccccgaacttcagccgatgggaccgctgctgccgaaccccgagctgctggcttctcaaactccgctgctctttggttcagggctcctggaacagacgagcccccc

SEQ ID NO: 569254 - DNA, 94 bp, Homo sapiens
cactggcgtggaaagactgggacacaaatgaagggcccccctcggaacccgcagcccagcaaggccgctgaaaactaggactcggaggaggaac

SEQ ID NO: 569255 - DNA, 106 bp, Homo sapiens
gggcgtgtggatatgcagagaaaacgtggaaggtgaagggttagctaacagacaccacaccagaggaattaaaagaccacttgatggagatgagctgcttccaaac

SEQ ID NO: 569256 - DNA, 473 bp, Homo sapiens
catagaggatccccctccataatgtgtgccaggctagagtgcagtggcatgatctcagcccagtgtaacctccacctcccaggtgcaagtgattctcctacctcagccacccaagtatcagggattacaggtgtgcaccaccacgcccagctaatttttttatttttagtagcgatggggtttcatcatgttggccaggctggtcttgaatgcctgacctcaagtgatccacccgcgttggcctcccaaagtgctgggattacaggtgtgagtcaccacgcccagccataaataactattttgagttatactagtactactactaccactaaggcatagtttctgagagtgtgacaaatacatctagaagcttaagggttttttctttaaaccaactagagagttcatcagtctttcttttcatgtctttccaatctaggaagaaccaaggtactttttttgtaggcaaagga

SEQ ID NO: 569257 - DNA, 1046 bp, Homo sapiens
cccgggaggggtggcgggagcggtactggaaatactctgtcctctgtcgccgggaactggcgaggtagttcctatcgaggtggagagacctggaatggccacactatcaaggtgaagttcaaagcttatgaaactggatgatgattcagcatcatagaaggagtaagcgaccaagtactctgtggcagctcgtggctcagtttcgctatctgattgctaccctggatatctgcacttttcagaaatgtacatcaaacaccattcacccagcaaaaccaggagctagcacagggtactatcgagaacagcttcccacagaacaggatgcaactgctgccacatcgacagaagctactacactgacatgtactgcacccatactgcctgcaccaagcctccttcccggtggagaccaactgtggacatctacacacgtcggtaaccttactcctaccagctatacagagtgaagatgatcagactcaggatgtacctgagactgcctcacggatctcaatgtatactaaacggagcataccacagggaccaccccagaactctactcatgcgcgagcaactcacggcacctaccccaccctcctgagcagcatgcaacccaggccacacacgacgaccacacgagcgagactcaactgcgaccgctaccccgccatcaccgctatcctccctctcgaccccacatgccgcagcattctcaacatactactataatcacctactagaattcagacaccctgaaagcccatgcacaggaaccttctagggaataccttaccaatcataccaactcgacactcacgagcaataggaccacttcactgacgatatctcaaagacgtggctctccgccgccagctcgaatcagcacaaacagggcccagctcgcaacgcggaacacaggcagcccacgcccgtcccatacactaggaaacatagcagaaccgagcgaagccaacccccacaacgaggaacaggacacgactacaaccactgcaaaccaccagtcagatgacaacaccacctca

SEQ ID NO: 569258 - DNA, 671 bp, Homo sapiens
taagataaaaattttgttttatttgaatttttacaataatcattgtaggcagaccccctgaaactattgctacggaataaaagatgaaatgctcctgattattgtgaatacaaagttgcatgcaggattgtgtaaagacaatgccaggttggactgccagaatgagccaacagcgtgtgatgtgcttccccctgcagagagcctatgaccagacatgcagtcagggaggtttcacataaccaagattcctatgccagaaatgcagattttcatagctctgggaatggaatgcaacccttgtggagagcctataaatggacgcatgtgggggcacctgtccatatggataagatagggctgtaaatgccctcatcttgccacagctcttctagccctctttacggttaaggcatactcccttctgagaatttctggtctaactgattgtctagcttcacctcctgtttctatggattgtttgtaaccagcttttgctgcaactgttactgctgattaatatcttgctaatcataggttatggaaagactgtgtttctgttttaaggctctgctagaaattactgatgcacacactatattggaaattcttatctctgtatactggacttctgcatacagatgtatggttaagaattacttcatccccatgtg

SEQ ID NO: 569259 - DNA, 336 bp, Homo sapiens
ggctcggcacctgaacattcgtgtccagcattgaagacgaacgcaactgaatgacgaatcagatgatggccatttctaaataaggaatttcctcccaatgtcatggatatgagggtggttatatgattaacgggttgatattaataagatgtggctatgtcttccgatgtgtcaagaatcctcacctcctttcataacgcatctcccaacaattaattctcgacctatattacaatttatgagtgtgataaatattatcaactttggtaatcaactcgaagattgtctttagctgcctcgcctttgcgtgtgacgtcacacatgcccacgacagcc

SEQ ID NO: 569260 - DNA, 294 bp, Homo sapiens
ttttttttaaagcatctctggaaaagtttctcgtaaagcctcagctcttagagccaggccaacaacctttgatatgcaaatgcaggccattagaaaatgggtccacccaaacatggagattgcctcagccttcttgccctttccccacaagttcctggcaacatggcctcccccacatatccccacgtgtgtagaacatcatagcgcccctgcatttgcatattaaaaggccagggtgggagggtcagctttttcacgggctacgcgaatgatttgttgagtcaaaccaatccc

SEQ ID NO: 569261 - DNA, 374 bp, Homo sapiens
gttgtggctatataatccattccccacccaaatacatcattttaatatgcacatcacaggcaggcagcactggtcacgaaatggagccccagcagcatgcagtccccactgtggtgaacatggatggctgacctagccaccagacctcggccatcttggctatccagcaagatggatacccagcaagaggcctggcaccatgagtgccaagtgtctactgtgtcatgctgcttgtacctcgggaagccaaccatccaggcagcagtggtggccccgtatcctgcttctgtccacaccactcatactcctcaaagcggttgaggtactcatgctcaatgtccgcaggaatcatcctcagcacatgcagggagtat

SEQ ID NO: 569262 - DNA, 515 bp, Homo sapiens
gccctagacgagaagctgctcaacattcatcgacctgcagtccctgcatggctactacgagctacccttcctcatcctgttgagaccaaccagacctggcctgggcgcgtgccgtgcggcaggacacgtgctccattgtggccatctaactgaacatcacgaagaagttgaaccccttattctggtccttaacagcttggcctttgaactgaaccaaggttttgctgtgccaaagccattagttggggtgttgtgttttgcgttaaactcgttgttttaccgaaacaagagcttcccccgttatggcttggttctcaaaagcttaacacaggaaacacgggctttcccgtttcgcaccaggggggtgtgcggatcacctgggactgcgcccaggccaccttcatctcctacgacaagatggtcatctccctcaagggcggcgagatctacgtgctgaccctcatcaccgacggcatgcgcagtgtccgcgcgttccactttgacaaggcggcccc

SEQ ID NO: 569263 - DNA, 198 bp, Homo sapiens
gattaaggattcaacggagctgaggaagagtataggacagcagaaggttggagagagcgggagtgagggcagctgcacctaggacaggtaaccgggggatttgagtagagaagcggctgggaaggacctgaagcgcaccaagggcctgctgggagtatgccagctcatgctggacgacgtgaagaacagtgctccgag

SEQ ID NO: 569264 - DNA, 664 bp, Homo sapiens
ataataggtaaagctcatgctgatatagtacatgtgcctgctcgaccttccagagtgctcaacaaatcatttcccaaccaaaaatgggccttaaaggaagatctttcaggaatagctgaaatgttcaagaccccagtgaaggagcaaccgcagttgacaagcacatgtcacatcgctatttcaaattcagagaatttgcttggaaaacagtttcaaggaactgattcaggagaagaacctctgctccccacctcagagagttttggaggaaatgtgttcttcagtgcacagaatgcagcaaaacagccatgtgataaatgctctgcaagccctcccttaagacggcagtgtattagagaaaatggaaacgtagcaaaaacgcccaggaacacctacaaaatgacttctgtggagacaaaaacttcagatcctgagacagagccttcaggaccagtatccttctgcaaacaggtcaggaaggtaggcagagttcaggaatattcagaaggggcgtgtgcaaagtaagggtgaagcaacgaaaacagtaattgttgagtgcatctgtgaaaagaggtcaggaggccactttatttcttcaaaggagagaaggagagattaaggaaataggaagcccttttgagacagataaggaagatagtgcatt

SEQ ID NO: 569265 - DNA, 407 bp, Homo sapiens
  misc_feature (1)..(1): n is a, c, g, or t
  misc_feature (95)..(95): n is a, c, g, or t
  misc_feature (296)..(296): n is a, c, g, or t
  misc_feature (330)..(330): n is a, c, g, or t
ntattcctttttattgctaagtagtagtccatggtatggatggaccacggtttgtttaatcccatccgaggacctttttaaaatacttgtgcccnagatgcagtggctcactcctgtaatcccggcacttggtgaggtcaaggcgggaggattgcttgaccccaggaattcgagaccatactgggcaacatggcaaaaccctgtctctacccaaaatacaaaaattagctgggcgtggtggtgcacacctgtagtcccagctacttgggagactgagatcagaggatggtttgagnctgggaggcagaggttgcagtaagctgagattgngccactgcactccagcctgggcaacagagccaggccttgtctcaacaatcaatcaatcgatcgtgtgttcctgatat

SEQ ID NO: 569266 - DNA, 283 bp, Homo sapiens
ggccgctgttgcacaatataagctctcagaaggcgggtctccatccagggctgtgtttttttcacattgagagacagaaaaaggatatgctaagagaagcaaattgctttaactgagggatgtcatgattcattcattcgactgtcatccagactttactggacacctccgtgcatgaagtgtgtctttagggaacgtactgcctacaacacacattttgtggcattgtgaagaagggaaaataatttcttggaaagggaggccttggcctctggttgtgatc

SEQ ID NO: 569267 - DNA, 643 bp, Homo sapiens
gcaaccttatgcggcgcgctcgaggatggtgcgccccattctgattcttgctcttactagcatatggagttgccgaactctctggagagagggagcgcaagggtcgtgtcactcgccacttgctcctcttctcagctgggctgatgcaatccaaaccgtggcctgaggccaggtcatgggcctgacacggcatgatgctgtgtcctagatacaggaggccacgcacgtccaacaatgtgagcacttgagaaatctggaagtccatatcatcatacaattcatctgtgccatacagcgcatggtaccgtgagcacaaccatcgtagtatttgaggcgtgctgcactcatagcggaacagatgggatcgagtgtgcgtgcctgctcagttgcgatcacgacactgcatagcatggtattttcctgtacaacacaccatagagaggctcggggtggacgagccatctggccgaagggttactggaggtagtgactacagcaggtgctagtgtcacatgtgtcagtggagtggcagttgtactcgttctgtaggaactaacgatcgcggctagtcctcgtgaacgaccccgacacctacaagcctgatctttcaggctccaggccaagaataaaacctctatctcca

SEQ ID NO: 569268 - DNA, 242 bp, Homo sapiens
ccatgtgcctggcatggtctacattggggcaaagggaaacaccgctgcacagactgcccagatactttctttcaataaaagtggcaggtggtggagacatccaccagggcttccagatctcttactcaccgaacagtgaacaacgactggcacgcagatacttgcttaaggatggccaacaggctactttggggaaacagtcttgtgatttcctctcaatcttatagagattcctgccaaaa

SEQ ID NO: 569269 - DNA, 355 bp, Homo sapiens
gccccatcccacaggagatcagatattatgagcttagcaacatttggttacacatattcaaaacttttcagtcaggtcgggcgcggtggctcacgcctgtaatcccatcaccctgggaggccgaggagggtggatcacgaggccaggagttcaagaccagcctaacaaacatggtgaaaccccatctctactaaaaatacaaaaactagccgagcgtagtgacgggtgcccgtaatcccagctactcaggaggctgagacaggagaatcacctggaccccagaggcagaggttgcagtgagctgagatcacgccattgtactccagcctgggcaacaagagcaaaactccgtctc

SEQ ID NO: 569270 - DNA, 852 bp, Homo sapiens
  misc_feature (611)..(611): n is a, c, g, or t
tttttgttaccatccattctagatacagtattgtcaactatatctcctatatgctagaatgataatatatcgctgtcatatagttatctcataaacctcaaaaccaatccctcttagccaatattgtgcctattggcatactagtctttgccgcctgcgaagcagcggtgggcctagccctactagtctcaatctccaacacatatggcctagactacgtacataacctaaacctactccaatgctaaaactaatcgtcccaacaattatattactaccactgacatgactttccaaaaaacacataatttgaatcaacaaacacccacagctaattattagcatcatccctctactattttttaaaccaaatcaacaacaactatttaggctgttccccaacttttcctccgacccctaaaaccccctcctaatactaactactgatcctaccctcacaattcatggcaagcaagccatttatcagtgaacatatcacgaaaaaaatctacctctctatactaatcttccctacaaattccttaatataacattcacggcagcagactcatcatattgaaatcttattcgaaaccaattatcccacttgntatcatcaccgatgaggaccagcagacggccgacgcggactattctatttacactataggtccctcctatcacgcatgattatccaaacccaggtccaagattaaactcacacggcagagtaatccggccacatcttgacactcaacctttgcagccttggcctgcatcaaaaaaaaacgggcgcgatactggggcgagagagagagtcacacgctcatcctcccacaccacgccctcgcc

SEQ ID NO: 569271 - DNA, 1419 bp, Homo sapiens
  misc_feature (28)..(28): n is a, c, g, or t
  misc_feature (81)..(81): n is a, c, g, or t
  misc_feature (84)..(84): n is a, c, g, or t
  misc_feature (89)..(89): n is a, c, g, or t
  misc_feature (98)..(98): n is a, c, g, or t
  misc_feature (326)..(326): n is a, c, g, or t
  misc_feature (344)..(344): n is a, c, g, or t
  misc_feature (354)..(354): n is a, c, g, or t
  misc_feature (423)..(423): n is a, c, g, or t
  misc_feature (905)..(905): n is a, c, g, or t
  misc_feature (915)..(915): n is a, c, g, or t
  misc_feature (1419)..(1419): n is a, c, g, or t
ttcccttgccccacgtgtgtggtgtttntgtgtctgtgcctggccaagggagtgcccaacactgggcttgccacagccccnagnagagnaatttgggncctaggaaccgagggcacacgggactctagcctcatccccaggacccccttggctcagagtgtggtgctagaaactgtccccacccagccccagtactgccacctttacacctacccctgcaagtccccagagggctgcccacgatagaagctgccaagcagggagaacctgtgccaactgtggagtggggaggttgggcctggaccctcaacccctgcaaccttccntagccccctcgaatagantgagcaggtncaggctgtggcccttacctcacccgcagttctcgcccagtgctgcagccggctcacctctctccgcttnttgcacatcactggcctgtgtgtgctgcttgctcctgttctgttcgcttgctcccgttccgttcggcttttgctttgcgttagggtgaagaccctagcgtccagctcccctcatacgctatattttgacactaaaaaagaaggtttctaaattgtaggagcaggatggaaatactttgctgcccttgccatcttttaggattgggcccccaggagactgaggtcttcctgggccctcattgctgcttatcgtaccccccatcacctgcacatgggacagaccgggctggagggtgaccttggctgtgtacgtcccagcaaaagagctctggcccgcatctcgctgtgccctgaagggggatgaagggcgatgcctcgcccgaggctttgggctgctgcactgcatgctgggactgctcctactctctgtcccacccctcacccagctgtggtccggctttgggagagtggtgaattgcgctngcccgaactncggagcgggagcaggggtaggggaccggggttacgggcttggaataaaaccctttaattaccccaggcggagttgggacgcaaaaaaaaaaaaacacatcacaaactcataacacacacactgtgtgtcggcgccggagtctggcgagccctttggagaaacaccgttttctgaacacaccaactgtggatggcagccgcggggggcacccaagtagtagtacagtgcgaacatggtggcacaaaaagcggttagtccacaaagagaaacacccgggggcacaagcaacacaggagggcaggggaatttctccaccccaaataaaaaaaaaaaacgcgcacgggggggggacacaccagaggaggcggtgtcttgaacaaaaactccccagagagggaggggcccggagggggcgaaaacaagggggggcccatacaagaaggggagctcgtccaagggagagcgcccaggaataaaatccgcggacgacagggaggggggggn

SEQ ID NO: 569272 - DNA, 267 bp, Homo sapiens
gacgtattatccttcaagcccgatgacggaaacagtagttatgtccagtctaagccagatatccagtacgcgccacgttcggagcaggagcctacaacattggagagaatcatctctaagccaaatgtcctatctgactcagtgagaagttcacacgcgcccaggaattacattgaagatggagaaagtgatggctttttaagatgcctctctcttaactctgggtggattttaactacaactcttgtcctctcggtggtggtatag

SEQ ID NO: 569273 - DNA, 152 bp, Homo sapiens
caaaatgtgtgagcttctgtaaattgtaaagcactatagggttgctttttattttaaagaaatgctcggattagaggtgtgagccagaggttgcagtgagccaagatgcaccattgcactccagcctgggcaaccattcaagactctgtctc

SEQ ID NO: 569274 - DNA, 361 bp, Homo sapiens
gttggtagagccctcagaaccatttaagagactctttatttttctctttctcccttttttttttttaaaagttttatttttacgtagaagctttgggacaacagctctggttctccttccccatttccactgtatatttttaaaggaattcccttcagggattccctgtccccaacaggaatttttaaaccaaaacaccccaactgggcagttttttttgggggggacagacggccggccggacctttgagcacatagggtcctgcccaccttaccagttcttcaagccttgccgggcacatgcccgggggacgcctgccctgcccagggggcctcctggcccgccctcacctctgataga

SEQ ID NO: 569275 - DNA, 225 bp, Homo sapiens
acgcgtgatactcgtagcaccgtgacatcgagatgaccacagtatcccgtgtataaccatttatatgtgagggacttgtaactttcaagaactttggtctaacaatctgcttggtaacgacttaaatatagaagcataagatgtaattcctattacgagccaaaagccagatgaatgacataaaaattattcagtgaaaattgctatattgtacattttcagagg

SEQ ID NO: 569276 - DNA, 1342 bp, Homo sapiens
tagatcgcgagtggactgccctattattattttttttttttaaatgcacatgatccaggatgagatttaaaaacacagagagacgacacacaaagacaacagaccagtggcacgagcaacaaagacgatcacgaagcaccgggcacagacacaaacaaacaacaacggaaaccaacagaagaaaaaacaaccaaaaacaacacagacagaggaagcaacacaaaagacggcaaatacaccacgagaaaaaatcaaataagaagagtgagacccaaagaaacaaaagacacagcgagagagaagagaaagaatacaagcacgacaaaagaccgaaataaaaacacagacacgtataaacgaatcacacagagacaacaggacagaaaaaaaagaggacaaaaagataaaagaagaaaacagacagacagggagcaagaaaagataagagaggaaagaaacaggaaaaacagagacaaaagaaaaagacacagcaaagcaagaaaaaagaaaagaaaaagcagaaaaaaaggaagagaaaaaaagcagaagagaaaaaaagaaaggacgaagaacaagaaaaagaaagacaagaaaggaggagaaaggaaaaaaagaaagagaagaaaacagaagagagcagaagacaaagaaacgagaaaacgaaaaaaaagaaagaacagaacgaaaagacagagaaacagagaagaaaaagaaaaggcccgagagcaaacgcgacagcaccgaaggcgaagcagaacgaagagagagagaaaagacaaggaaggaacacacaagagagaacaagagaagaagcaaggacgaggagagagagcaagcgagacgcgaagacgaagagaaggaaggcaagagcgagaaggcaagaggggacggaaaacaccaacaggagcagccaggaaagaaacaaagagaaaaagaaggaggaagagaacaagtaaggggcgagaggcagagagcaagaagacaagcaagacgaggagacgagagagaagaacagagaacagagagagaaaaaaagaaaagaaggaaagaaaaaggaaggagaagaacgcggagggaacaaagaacaaaagaaaaacaaaaaaaggagaagagagagcaagacgagagagaagggaaaacgaaaaggggacagaagcgacaaaggcaaggagacacagacaagcgcagagaagagggagaagagcaaaacagaggagggcgagaagaaaaggaggtaaaaagaagaagcgcgggcaacgggggcagaagaagaaagcgagcagagcgggaagaagagaaaaagagaaaaaagaggagagaaggaggacaaggtccagacggc

SEQ ID NO: 569277 - DNA, 450 bp, Homo sapiens
ccatcccaatccatctacatgtatgcacacttatttggaaagcaggtttgaggtaaaaacaaagaccttcactatattttgctttgacagaaggaaagaggaagagtttctattaaaatctatcatatgaatagtgtgacttaagtcctgtttcaggagataaaaatagctttctggactggttaaagtcccccagaaacaatacagttaatttaatttatttttttgagacagagtctccctctgtcgcccgggctggagtacaggggtgcgatctcagctcactgcaacctctgcttcccaggttcaagtgattctcatgccccagctcctggggaggctgaggtgggaggattgcttgacctcaggagtttgagcttgcaatgagctttcatggcttcactgcactccagcctgggcaacagagggagaccttgtctctaaaaacac

SEQ ID NO: 569278 - DNA, 431 bp, Homo sapiens
  misc_feature (193)..(193): n is a, c, g, or t
  misc_feature (195)..(195): n is a, c, g, or t
  misc_feature (198)..(198): n is a, c, g, or t
  misc_feature (207)..(207): n is a, c, g, or t
  misc_feature (235)..(235): n is a, c, g, or t
  misc_feature (244)..(244): n is a, c, g, or t
  misc_feature (251)..(251): n is a, c, g, or t
  misc_feature (277)..(277): n is a, c, g, or t
  misc_feature (280)..(281): n is a, c, g, or t
  misc_feature (303)..(303): n is a, c, g, or t
  misc_feature (318)..(318): n is a, c, g, or t
  misc_feature (320)..(320): n is a, c, g, or t
  misc_feature (325)..(325): n is a, c, g, or t
  misc_feature (327)..(327): n is a, c, g, or t
ggttctttccagtttgtttttggctccccaagcatcatctcacgaggagaactttacacctagcacagcttggtgccaagagatgtcctaaggacattggccacctgggtccactccagcgacagacccctgacaagagcaggtctctggaggctgagttgcatggggcctagtaacacaagccagttagctntnatnctacttcgncctggggctcccaggccttggcaacttngctgcactngcaaagnagaagggtagtttgagtgtacacagnttnntcagaagtttaggggtctgttntcatctcatggcatntnacagntnactgacacgactctctattagagcactgtgtttagagagcacctctttctctctctgttcgtaagcagggcaaaatggagaattaccagtcagctctttggtat

SEQ ID NO: 569279 - DNA, 128 bp, Homo sapiens
ccaattaggtgcatgagtaggtggcctgcagtaatgttagcggttaggcgtacggccagtgctattggtatgaatagacgtaggctgcatggtttcaggtcaataactcagtcatggggatacagggg

SEQ ID NO: 569280 - DNA, 118 bp, Homo sapiens
aacgcatctgaccaatatttatttattttttacagtcagcgtcctgccatatcgcccaagttggagtgtagtggcatgatcacagttcactgcagcctcggcgacagggcgagactcc

SEQ ID NO: 569281 - DNA, 372 bp, Homo sapiens
attcacatgctcaagatcttcttgtggctgggcacggcgacccccctgtaatcccaccactttgggaggccgaggcaggtggatcacgaggtcaggagattgagaccatcctggctaacacggtgaaaccccgtctctgctaaaaatacaaaaatcagccgagcgacttggcaggcacctgtagtcccaggtactcaggagttttgagacgggagaatggcgtgaacccggaaggcggagcttgaagtgagccgagattgcgccgcttcagtccagcctggacgacagagtgagactctgtctctaaaattttttttaatgtacagttgagtagtatttaatacattcacattgttgtgtacccagtttccg

SEQ ID NO: 569282 - DNA, 827 bp, Homo sapiens
tagtttttgaaaaagagtgaaaaattggaatcttggacatatttagagtcatgtaagacctcgtgcactattgtcgctgcccgtgaacaaattcgccccttcgaaatgggtaaacccccgtttcaacggggtttaccggtcttataatgtccgtccttgcatcttgtgaatctggcgcttttttgacgccgtcatagactttgtcctgagacagcccgcatggttcctggcgcccttggcttcctatgaatcaatacagcggctccaacattttatggcctctgtgagaatacagcccccgttgatctcctccgccccaatattcgtgccaggtattggggctcaccccacaagttgtcaaacaaagacattcttgtggcttttcggtaacaccccttactcgggtgcaaaacaccgcgttcttatttacatcaaaaaggaaaaagcgcccatttatacgaccgcgagtcgatcttacgcgcaccgttgtttctccctggagacccgccttattattattacaaaagggatttatacaagtgatcccctcaactgctccgctctgtgttttactattgcaagcaccccagctatcgattacatatcttggagttgagcttatactaaaaaaaacattaggtgggtggcacacggaagtgcacaaacacaaggatgtgagtggtttaaatatagaagcagtttggttttcttagaacatgaaaatgagaccccattatctgaccatcgtagaaatgtttgggagcacacagcaaacaggacagatactattttcctcagtataaaaacccccttttcccccacataaa

SEQ ID NO: 569283 - DNA, 1371 bp, Homo sapiens
  misc_feature (1073)..(1073): n is a, c, g, or t
gggagaagcgtgagcagtattgatgtggagatcgactctctgtcctcactggctggcatgacatgaccaagaatgatcctattcaataggcccgggctgtcatctggatatgtgcccccgaccagtggagcagctcgcatgtcagttgcccaagtcgcagtaccaagcctgcagccgggggcacagtcacccctggcctccttggcacagtccccttcgcaggctcccagcctctgccccaggttccggctccgggctcagtagccagagacagtgccactgttcatgctcccagtgcccagcttcctagagctctcaggtcccaactccatgtccagtcccaggacgccagcctgtgtgctttggctagcacccagccccgagggggccccaggcactcatctccggttccagcccctaagtttactccagtgactcctaagtttactcctgtggcttccaagttcatgtccttaggagaccccgaggtggatcgtgggatctacgaaccgaaatcaatagaatgggggcaccccgaagctctttctgctggcacaggctcccctcaatctcccagtttcacctatgcccagcagagggagaagccccgagtgcaggagaagcagcaccccgtgcccccaccggctcagaaccaaaaccaggtgcgctcccctggggccccagggcccctgactctgaaggaggtggaggagctggagcagctgacccagcagctaatgcaggacatggagcatcctcagaggcagaatgtggctgtcaacgaactctgcggccgatgccatcaacccctggcccgggcgcagccagccgtccgcgctctagggcagctgttccacatcgcctgcttcacctgccaccagtgtgcgcagcagctccagggccagcagttctacagtctggagggggcgccgtactgcgagggctgttacactgacaccctggagaagtgtaacacctgcggggagcccatcactgaccgcatgctgagggccacgggccagggctatcacccgcactgcttcacctgtgtggtctgcgcccgccccctgggnggcacctccttcatcgctggaccaggccacccggccccactgctctccccgactaccacccgccgtccgccccgacgctgctccgtctgctctgcccccctcatgcctgagcctgccccccctccccctgcgcccccgcgccgccccggcacccccccctccccctgccccgtacccccctctgcggccctgccccccccccctccccctcgcggccgcctccccctgcctgctaccccatgccccgcccccctgccccgccccccctccccacgcccccccccccccccccctccgc

SEQ ID NO: 569284 - DNA, 213 bp, Homo sapiens
  misc_feature (15)..(15): n is a, c, g, or t
  misc_feature (73)..(73): n is a, c, g, or t
cgggagcgacatctnggatgtgacttcttctccgcattatctgcgactctcttcttcatctctgcagtcatgngtcacgtagctgtcccgcgcagtttttacacactcttggccggtctctcgttgggttgatagcaggaagcgcgactctcgggcagaaggcagcacgatgcactgcagcagggccgggatgaagatgatgctcagcagcag

SEQ ID NO: 569285 - DNA, 535 bp, Homo sapiens
  misc_feature (237)..(237): n is a, c, g, or t
caccatgcaaccaacggggtggtgcacctcatcaataaggtcatctccaccatcaccaacaacatccagcagttctacagtctggagggggcgccgtactgcgagggctgttacactgacaccctggagaagtgtaacacctgcggggagcccatcactgaccgcatgctgagggccacgggccagggctatcacccgcactgcttcacctgtgtggtctgcgcccgccccctgggnggcacctccttcatcgctggaccaggccacccggccccactgctctccccgactaccacccgccgtccgccccgacgctgctccgtctgctctgcccccctcatgcctgagcctgccccccctccccctgcgcccccgcgccgccccggcacccccccctccccctgccccgtacccccctctgcggccctgccccccccccctccccctcgcggccgcctccccctgcctgctaccccatgccccgcccccctgccccgccccccctccccacgcccccccccccccccccctccgc

SEQ ID NO: 569286 - DNA, 388 bp, Homo sapiens
  misc_feature (45)..(45): n is a, c, g, or t
  misc_feature (49)..(49): n is a, c, g, or t
  misc_feature (184)..(184): n is a, c, g, or t
  misc_feature (357)..(357): n is a, c, g, or t
  misc_feature (384)..(384): n is a, c, g, or t
tgagattgagtcttgctctgtcgcccaggttggagtgcagtggcngatnctcagctcactgcaacctcctcctcccaggttcaagcaattctcctgcctcagtctcccaagtagctgacactacagttgtgtgccaccacacctggggtaattttttgtgtttttagtaggagactggggtttnaccgtgttaggccagaatgggtcttctatcttctggactttatggatccacccgactccacctcccgggggtgctgaggattacagggagtgaggccactgtgccgggggctgttttttgtttctttaaacaaaaagttataggagattctatggagtatttgtaccgatctnaaatcacattgagtatataatcattgngcgg

SEQ ID NO: 569287 - DNA, 422 bp, Homo sapiens
gtaaacaggccccgtgaatgggttgaactgtgtgatgatgaaatatacggcatgggggatttgtatgcgagatatacggggggggcgaaagaaatgcggggtgagttggcaggggagaaagaagaagttgtgtaagacatttgcgggtgacttgccaaggtattaaaactacgagattattagggatacttacgtgcagagggttacgctgataaaataaggggcacagaaattaggaggggtatgaagcggcggggtggcaatatacttagtaaaggggaaggcatgactaccggctccacctatgtcttacatgatttgctagtatcccgcctacgccacccgccgatctaacgctttgccgcaataccctacagcactctagacttcgatcccacattctgtaggcaatcctgatggag

SEQ ID NO: 569288 - DNA, 881 bp, Homo sapiens
  misc_feature (583)..(583): n is a, c, g, or t
ctcggggttggcgggggtagggggacgagggagaagctttaagggtcaagcctgagcatctgggacacgagctgggagctaagcctcatcggaagaagccgggtaggctggcctgggaaggttcttggaggcagcagccctctagagtgtgaggaaaatgttgggattgcaggtgcgctcccctggggccccagggcccctgactctgaaggaggtggaggagctggagcagctgacccagcagctaatgcaggacatggagcatcctcagaggcagaatgtggctgtcaacgaactctgcggccgatgccatcaacccctggcccgggcgcagccagccgtccgcgctctagggcagctgttccacatcgcctgcttcacctgccaccagtgtgcgcagcagctccagggccagcagttctacagtctggagggggcgccgtactgcgagggctgttacactgacaccctggagaagtgtaacacctgcggggagcccatcactgaccgcatgctgagggccacgggccagggctatcacccgcactgcttcacctgtgtggtctgcgcccgccccctgggnggcacctccttcatcgctggaccaggccacccggccccactgctctccccgactaccacccgccgtccgccccgacgctgctccgtctgctctgcccccctcatgcctgagcctgccccccctccccctgcgcccccgcgccgccccggcacccccccctccccctgccccgtacccccctctgcggccctgccccccccccctccccctcgcggccgcctccccctgcctgctaccccatgccccgcccccctgccccgccccccctccccacgcccccccccccccccccctccgc

SEQ ID NO: 569289 - DNA, 1801 bp, Homo sapiens
  misc_feature (1230)..(1230): n is a, c, g, or t
  misc_feature (1276)..(1276): n is a, c, g, or t
  misc_feature (1296)..(1296): n is a, c, g, or t
  misc_feature (1436)..(1437): n is a, c, g, or t
  misc_feature (1444)..(1445): n is a, c, g, or t
  misc_feature (1481)..(1481): n is a, c, g, or t
  misc_feature (1485)..(1485): n is a, c, g, or t
  misc_feature (1505)..(1505): n is a, c, g, or t
  misc_feature (1533)..(1533): n is a, c, g, or t
  misc_feature (1536)..(1536): n is a, c, g, or t
  misc_feature (1548)..(1548): n is a, c, g, or t
  misc_feature (1573)..(1573): n is a, c, g, or t
  misc_feature (1714)..(1714): n is a, c, g, or t
  misc_feature (1724)..(1724): n is a, c, g, or t
  misc_feature (1755)..(1755): n is a, c, g, or t
  misc_feature (1801)..(1801): n is a, c, g, or t
gggagaagcgtgagcagtattgatgtggagatcgactctctgtcctcactggctggcatgacatgaccaagaatgatcctattcaataggcccgggctgtcatctggatatgtgcccccgaccagtggagcagctcgcatgtcagttgcccaagtcgcagtaccaagcctgcagccgggggcacagtcacccctggcctccttggcacagtccccttcgcaggctcccagcctctgccccaggttccggctccgggctcagtagccagagacagtgccactgttcatgctcccagtgcccagcttcctagagctctcaggtcccaactccatgtccagtcccaggacgccagcctgtgtgctttggctagcacccagccccgagggggccccaggcactcatctccggttccagcccctaagtttactccagtgactcctaagtttactcctgtggcttccaagttcatgtccttaggagaccccgaggtggatcgtgggatctacgaaccgaaatcaatagaatgggggcaccccgaagctctttctgctggcacaggctcccctcaatctcccagtttcacctatgcccagcagagggagaagccccgagtgcaggagaagcagcaccccgtgcccccaccggctcagaaccaaaaccaggtgcgctcccctggggccccagggcccctgactctgaaggaggtggaggagctggagcagctgacccagcagctaatgcaggacatggagcatcctcagaggcagaatgtggctgtcaacgaactctgcggccgatgccatcaacccctggcccgggcgcagccagccgtccgcgctctagggcagctgttccacatcgcctgcttcacctgccaccagtgtgcgcagcagctccagggccagcgagttctacatgtctgtgatggggtgcgcctgtactgctcagggcgtgttacgactgtgagatcggcgctgtgcgtgggcatgtgcgtgggcgtgtcgctggtgcaggtctgggccactgcgaagtcttgcatgtggtggtgccgtgttccactgtccacaccgtcctacctgtacgtgcctcctctagggacatcgcctggcagaaatgctgtaagcaacactggcggtgagaggccgcagtacagctgaaccgtcgaatgcctagaacggcagccacctgggtccaacgggcacttaattcgacgcgcaggcgagcttgtcnattcgaactcatgatgttagtgatcttagcaggcctcggcaacccnctatggaatgagtgcagccntcgcgtatcaatacgtaggtagccagggcgcaaactcgggtgcacacacttggtgttccgcacgatcgtaaaccacgaaggctagatagcagcacgcgcgaagtgtagcatcgcgatacttggctactggatgccgcatnnctatgcnnctgagtccgtagtgccggaggattgaagcacgtggntgcngcagtctgggtacggcctcntgagaaaccaagaaaacgtatcgcgacnatngcacaggtgctntatcacaggttgttgacgagaactngccgagagagagcaccacatggtccgaattggacgagcagcattgacgaactgcgcatgactatcgccgccttgtgacagtgttccacggatggctactgatacgcgaaaagatagccaccacgttggcttagtacgcccncaagaaaccntgaaggttgagtgtgactagtgacccgtcantacaggaacccgaagctcacaattgcctccgatatgttggactcgn

SEQ ID NO: 569290 - DNA, 194 bp, Homo sapiens
atgcctttccccggttcccccccatttttttttaaggggggggggggcccggttaaattttaaaaaaaaaaggtgggattaaatttttccggggttggggggggaaaccaaaccagggcctggttttaaaaccacccccaaggaaacccttttgaaaggggggttaaattggtttaaaaaaaaacttggtttga

SEQ ID NO: 569291 - DNA, 1007 bp, Homo sapiens
gcttcttcaagaagggagatgtggtcattgtgctgaccggatggcgccctggctccggcttcaccaacaccatgcgtgttgttcctgtgccgtgatggaccccagagcccctcctccagcccctgtcccaccccttcccccagccatccattaggccagcaagcttgtagaactcactctgggctgtaacgtggcactggtaggttgggacaccaggaagaagatcaacgcctcactgaaacatggctgtgtttgcagcctgctctagatgggacagcccagagacctggactgaccatcatgtggagccccacccaatcaagggaagaaggaggaatgctggacatggaggccccggagccagatggcaagagggtgacagcaattcctttcctgtgtgtactctgatccagttactgataaggaaaaaatggaatgacccgagaggactcccaaaacctggacttggggtcaagaacacagccagcgaagagttaggggcctcagggcactgggctgttgatacaatagaagcacgacctctggacactgggccacttaattgctttctctagcttcatctaggacatcgtccaggtaagacactgtacccacagctcacacatcagcagtcgatgcaagcaaaacagtccagctacaaactacacatttaacgcctactacatgagacctcaggcgtgtagaataatagctaacactgttggtcaataacaaaggttaagcaagaaccaaatacggtacagacataacaaacatgggcatatgaggatctattcgagggcaactaagaaacacggaatattataagtgggccttatgaagtactatgagacgggcgatgaaatacagtgtataacgcccggattaaagatcatcgagggcatcgacctacaatatatgcagaacatcagtaaggtcaacagcggcgatgaatatcattggtatagctcaccaaaccacagcattgaagaacaatgaacgacgac

SEQ ID NO: 569292 - DNA, 185 bp, Homo sapiens
agcccccccttttttgaaccccatttttcagggggcaggggggcccactcctgtaacccagctacccagggggttggggcaggaaaaaagctttaccctgggaggggggggttccagtaagttaaaagggcatccctgccctactttttgtcacccggggggacaaaaggcccaattttgtccca

SEQ ID NO: 569293 - DNA, 510 bp, Homo sapiens
  misc_feature (67)..(67): n is a, c, g, or t
  misc_feature (78)..(78): n is a, c, g, or t
  misc_feature (197)..(197): n is a, c, g, or t
  misc_feature (200)..(200): n is a, c, g, or t
  misc_feature (232)..(232): n is a, c, g, or t
  misc_feature (269)..(269): n is a, c, g, or t
  misc_feature (293)..(293): n is a, c, g, or t
  misc_feature (329)..(329): n is a, c, g, or t
  misc_feature (356)..(356): n is a, c, g, or t
  misc_feature (375)..(375): n is a, c, g, or t
  misc_feature (381)..(381): n is a, c, g, or t
  misc_feature (413)..(413): n is a, c, g, or t
  misc_feature (458)..(458): n is a, c, g, or t
  misc_feature (482)..(482): n is a, c, g, or t
ggaccggcgctgagcctgccgcggctaaccggtccgatctggacgaacgcgaggcttcttgcgagangaaattcgcgntgaacgggatcgtgcacgatgtggacgtgctgggcgcgggcatccggctggtgaccctgctggtggatcgggacgggctgtacaagatgaaccgcctgtacctcacccccgacggcttnttnttccgagtccacatgttagccctggacttctncagctgcaataagccgtgtccagagtttaaacctggnattgaaactgacctggaatgacgntgcatatgtactttataccaccgttttgttaacgtnggttgccacagcccggggtttagggtngcccaagcctttttttttngggagncgattggggaaacaattgacatgaaatggggnttttagacgacaggcaggcaggtatattgttgatggggccacatnttacccttaagagacgggcagttncctacagttttgttccaggtgctgagaa

SEQ ID NO: 569294 - DNA, 500 bp, Homo sapiens
  misc_feature (428)..(428): n is a, c, g, or t
caggctctctacctaagagtccagactctcattatctgggggagcactggagagtgggagttctggcgcatcacacagggatagttaataacggaactttacacatgttctcttttttaattccttacaaccggcttatgtgggaataggccttttcttcattttacagttaagtctcagggggagtaacagactggcctgagatcacagatctaaaggatccagctgggggccagagcccaggcctgggctgacttcagagtctagtgggactcttcccacccaggatgtaacccgggtcgtcgacatcctcctgagtacacccacgggcctgagaagagcggaggggtctcacaatttagtcacctacaccaatttctagccacttacatttttcacctatcctttctggccaaccaagcacaganacattcactcccccagcaggtagtgaggagcagaggacggaaaagagggggtgccctctcggcacagcctcc

SEQ ID NO: 569295 - DNA, 754 bp, Homo sapiens
cttgccagttaagcatgttttatatcagaggaccaaatttttaagaagagaatttgtacatttcttgagcttccccatgtgaagcttgggttcagtactatcctattactatccatcttcataatgagtgaagcaaactgaaagggaattcataatcttttttcttatctgaacagaaaaactaatgaaaatcaacaataaatctttattttaattttcattcaacagctgaaaaaccatgtctgttgaccacattggaccattgcctagttaaaatccataaaattccctataaaccaatgaaaagaaacttgtctggcaataatctccaacattctaaattctaatttttagttacaaagaaaaggatagaatgaggcttttcaaggaattctcgctcatcccttcaattatttggcaggtaaaacagttctagaattcagcttcctttatggtttattactattaaatagatactttcatataaatggaaacacttttccttataacattaatttcatactccttatattaaggaatatagcaccatattcttgatactccctatgtgtaactttttcctgatgaatgtgatattttcaattaattgactatctgctggtgttgtgccaatagaattgtgatatcttgcgatgtgctatgcataggtgaatatataatatctatatatttctttctttcccaattaattacctttgtggattgttttatattccacactttgtttggccgc

SEQ ID NO: 569296 - DNA, 111 bp, Homo sapiens
gctgcggacacggccgtgtattactgtgccagggatagaccgacgtactatggttcggggacttctaaagtctcttcccataagtgggacttcgatctctggggccatggc

SEQ ID NO: 569297 - DNA, 436 bp, Homo sapiens
  misc_feature (81)..(81): n is a, c, g, or t
  misc_feature (259)..(259): n is a, c, g, or t
aggcttgtaccaggagaaacactaaagaggagggaagcggacaagcctatcacactggcagcaccagttagtaagggtagncagcacacattgttgattcgaacgtgaattgtcttgcagagcaatttaacaatagctaataaagctgggcgtggtggctcacacctgtaatcccagcactttgggaggccaaggtgggtggatcgtttgagcccaggagttcaagaccagcctgggcaacatggcaaaaccccgcctntactaaaagtacaaaaattagctgggtgtggtagcacacgcctgtagtcccagctacttgtggggctgaggcaggaggatcacctgagccttggaaggttgaggctgcagtaagccatgatcgggccacagcactcctgcctgggtgacacagtaaaaccttgtctcaaaaaaaaaa

SEQ ID NO: 569298 - DNA, 415 bp, Homo sapiens
cagatgatgcacataactgctgaaatgagtatctagagaatcttatatacatatctacaacactctggcccaaggcaggcacggtggcgtcaggcccataatcccagcataatcggaggctgaggcggacaggtcacttgaggccaagagcttgagatcagccatggccaacacggtgaaattccacctctactaaaaaatacaaaaaattagccaggtgtggtggtgcatgcgcatatgctccagccacccaggaggcgtgaggcagtagaatcacctgatacccaggaggtagaggctgcagtgagccaagagtcacgccactgcactcctgccgggcaacagagtgagactctgtctccgggggatcaaatcaaaacaaactgaaagcataactgccccgaaaccgttctaa

SEQ ID NO: 569299 - DNA, 116 bp, Homo sapiens
ccccgcgggtagggaaagccctcgccaattttcaggtccatataaggatgcgggtcccctttttaaaaacaaaaaaaggttttaaaaaattttgccccaatcccccgggggcccca

SEQ ID NO: 569300 - DNA, 280 bp, Homo sapiens
gctgctctagaggaccccgctaattacgcagtaaactattagagctcatcagtgaattccagcaaagtggcagtactcaaaattaatacgcagtaatctcttgcattcctatacatcaatgacaaaagatcagaaaaaagaattagggaaacaattccatttaccattacatcaaaaacaataaaatacctaagaataaatctacctaaggagggaaaagacctgtactctgaaaactgtaagacacttaagaaatcaaagatgacacagacatatggaa

SEQ ID NO: 569301 - DNA, 435 bp, Homo sapiens
  misc_feature (13)..(13): n is a, c, g, or t
tatgagcgttctngaggatccccggaggcagacggcaacagagaacttccctgagacggggtaatttataaagcaaagaggtttaattgactcacagttccacatggctggggaggcctcaggaaacttacagttgtggcggaaggctaaggaggcatgtcttacatggcagcaggcaagagagagcatgtgaaaaaggaactgtcgaatgcttataaaactgtcagatctgggtgtgaactctctcactattacaagacagcatgggaggaaccaccctcatgatccaatcacctcccaccaagtccttccttcgacacatggggattatggggattacaatttgagatgagattgggttggggacacagagtcaaactatatcaaagaaagtgatgcaacaggtaatatattacctgttgcagtgtgcttccg

SEQ ID NO: 569302 - DNA, 1293 bp, Homo sapiens
tgttggtgatcccccctcttgtttttggtagtgtctcgctcctgtggggggtgggtgctgtggtgtttcgccgcttcggaggtggggtctcactcgtgccttggccccccattgtgttttagtgtgtgatatgacagtcgtgggggcccctggtgtgagagttgtcagtgtcgttttgctgatggggtgtgcacgtgtttctgtgcagcggggggccggggtgcactgtttgggcgcctccccatgtgggctccatatgggggaaatttagggcctcttttctcgtgaaaaagattaaggacaccttgaaatgttaaaatgccttgtgtgaatatgtctataggggaaagggctcctttttgggggttacctgttctgaggtaaatatattgaaggcgccgaaatgtgtcaggggtaatatagggccttgtggagttataaggtggattatggaaaataatgtgtgttttaagggtataaaggggaaaggtgtagaaaatgaaggtggggaaaaggcgatcttgtagggaattgagagcctttttattgtgtatagaaatgcccgggaatatgtttcccaagaattgtttagaaaattaaagagggggtaaaaggtgtggattttaatgttggttgaacccacgcggtaaagagactattgtggcgcacactgtaaatgaagagcactgttattatagggtaattgcaaaccgtgtaaaaccgatgtcacccccgcgtgtaacgtccaaagggggggtatagagcttataatataacaggggtatgcccgcgatgaggcgtatattttagggtaaacactagattgagaaatagaacatgtttttatggagatttttcttgtttggccccgacgagagcgtgttataatgtggcacgaatataggttaaagatttggtgtcccactatgggttaaatagggttagctcccctttgtgtgtgaatatatgttaagtgtgttgtttctttatatttttgtttggtgggggaacacataaatatatggggtaataataagtgttaaggcgcaattctgggcatatatttggaaaacacggcactacccataaggtgaataaattgaacctgccattgacatccacgggtgaaattatggtgaggccacttacttgtgaaccacatttattcttttgaacacaacacaacttccatttaaggccacttttaggttatttttaagaggccacccattaaagttgctattgactgcatggttatttttgtgggtattaaaatttaaaaataaagttaaa

SEQ ID NO: 569303 - DNA, 940 bp, Homo sapiens
  misc_feature (41)..(41): n is a, c, g, or t
  misc_feature (62)..(62): n is a, c, g, or t
  misc_feature (80)..(80): n is a, c, g, or t
  misc_feature (82)..(83): n is a, c, g, or t
  misc_feature (98)..(98): n is a, c, g, or t
  misc_feature (147)..(147): n is a, c, g, or t
  misc_feature (631)..(631): n is a, c, g, or t
  misc_feature (924)..(924): n is a, c, g, or t
ctggaaagagataaattattagatttatatagtctccaatnttgcttgagctagggtgagtnatagatcctgtctctttngnntcagtgagctacggngcaagtctccggcccgtgcgctctgctcccatgtcttccctcttaaatntccacacactcataacacctccttcctttaccttatccccagacctagtgccaggattctttcctcccacctcctagattattctgaatgccaagtgccacgcaatccgggatgcccagattctggagaagcagcagatacaaaaggaattggatgaagaggagaggcggttggatcacatgatggaaatagaccggcgggaatccctccaaaggcaggaggatcgggaaaggaaaaggagggaggagagagtacggtaggtaaaggtgggcttttgccatttcccccataagccctttctgagtatcttcaggtccacgtagcctaagcaaagagggaagaagtgagacgcagttgtgaggcaccaatatctctcgtccctgacagaatgatgcagggaatcatacaacctgcaagcttatttccaaggttgtaataggcgtgtctctgtatactctaattcagtgtcctttcttggtgcctnctgtcatccactctacatcttcccccagcatctataaagtctttataagcagacccaaggaaggaacactctgcctcattaggcagctcggatctttatgttgactgaactcaaacccgctctctgggccactctatctgctcctgctaaatctctcctgtcacacgaagcattcaagtaccctatccgaatatgagcttaacattgctgcttggctgctgcctttgccttgtctactcccattctgccagcctttactcatgccaaagctttatttagatgcttccaagttnccgataactctggggt

SEQ ID NO: 569304 - DNA, 364 bp, Homo sapiens
  misc_feature (15)..(15): n is a, c, g, or t
  misc_feature (25)..(25): n is a, c, g, or t
  misc_feature (94)..(94): n is a, c, g, or t
  misc_feature (123)..(123): n is a, c, g, or t
  misc_feature (176)..(176): n is a, c, g, or t
  misc_feature (190)..(191): n is a, c, g, or t
  misc_feature (203)..(203): n is a, c, g, or t
  misc_feature (320)..(320): n is a, c, g, or t
  misc_feature (347)..(347): n is a, c, g, or t
atattcacacatatntacacatacnttcgtacacctacagacacatataggcgcatgcctgcacacatacatgtacattcacacacatatatgncaggcctcatgagcccaagcgaagccatnatatgccctgagacctgcacatatacatccagatggcctgaagtaaccgaaanatcacgaaagaagnnaaaatggcttgntcctgccttaagcgatgactttaccttgagaaattccctctcctggctcatcctggctcaatgagcaccttgtgtcacctgccccctgccagccagagaacaaccccctttgattgnttttccactatgtaccctcctatcggncccgcccgttctccctg

SEQ ID NO: 569305 - DNA, 847 bp, Homo sapiens
  misc_feature (1)..(1): n is a, c, g, or t
  misc_feature (84)..(84): n is a, c, g, or t
ngtgcgatgatatccaggacgcacccaggtgtgtgtaacggcgtccaaaacgacccgccgttgagaaagtaccccacacgtttntgtaaggttagtcttacgcgaaaatctgtcatggaataagtgttactgcctcgagcggtagtggacctcccgcgcaatgtccgctgtgtgaaaagtctttcgacggaacacttgggtgtggtactccgctcccacgcgctccttcgcgacacgcgctaaaagaaactttgctgtttgctgtcgccgccggtcgagacagcagaatgggtcatcacacagtggcaggggtcacacacccccgcgtctgtgggggtctctcgctgccccccagcccctcgcgtctctctctcgtctcttgtggggggcgcctcctcgttccgccccctctctcattaccggtgagctgtttttgggtagccccaccaaaatggggcccgcacacttgttgcggagaagagtgttctctcaccgccggaggtcgcacgtggggaggctctcaatttatgtggctcacccaccgcactctcgatgtttgcgccgcccttaagcacgccctcgcgcttgaagagctgtcgcaaatgtgtgttcagcaacgcgcactatcatgagtggcgcccccctctgtggctcaacacttctgcgcaccaacaagtttgccaacacgtgggaaaattcaactagcaccgtttgtgcagactacgccgaagcaccgcacccacgtttcttgtctcgcacccacctcgtgttcgccccctctccgccgcgttgtcttcactcgttttcttcgccccctttattagcttgaaagatcctcttgcgaaca

SEQ ID NO: 569306 - DNA, 1446 bp, Homo sapiens
  misc_feature (191)..(191): n is a, c, g, or t
  misc_feature (266)..(266): n is a, c, g, or t
cattatgaatcacactattagaatccttacaattatagaacaactagttgaagatggaaaacaagtgtctacatatcctccaccaggctgcgattgtactgtatgatacactatatactcatgaactgacaaccattatatcttgaatgatggaccgagacagaccttggatactttattatgtctttatntcttatctcatgcgtatgtctgtgaatcccatgctaccacatttattttgatgacgctgaacttgacatacacangcaactattccgtgactctatcctagttagttatcaataaaagttacttgagatgcttgtaagacgtaattacaataagttcgcgtttccgtgtttaccacttgaacgtggtatatactacaggttggatcgaaagtctatcatcgcgagtcattagttatggccccaaagactaaggggtttgaagaagcactaaataccattccagaaagccaggtaatttcatactagcgataactcaggctaatattttctactaatattgcgaatacagttggttatacacacccaacctttgttgcgccgctacaacaaaagtgtggcttccattggccaaccggtatcttccttgtccctagcttaactttctccgcacggacagggaagcttttctcccacttaatggactgggggtaaccccgaacctagttttattgtagggcttcctttgttaagtctcgctttatgggtcattttcctatgcccctctaattgtggtgttctcccaaaacacggacagcttcttataaggccccaccctccaagagttgtgggccccctacgcgacttttttttttatgacgcggtgttgacatccctaatcccaaaactccttgggaacagttttgcgcttgcgcctaaacgacgccaccagcggcttcatattacactttaagcaccttgggggaatgcccttttttagacactctttccacaacaggttaattagttttgctccggcactcgcaattattccatgaacgtcagggtttagacccaattttctcgacaccttctttccgaagtggacacccgtaagctgggcgtggacgcaccctttcccttaactagtaaccccgggtacctccgcgggattaacactagcaacgggcaacgcagctcttcattcacaaggcagaaaccagttcccttgttggctcccaacacacttttgtccacccctcccaaacaacaggtgcttaccctttccccaattgccaggcaacacacttcccaacgtgcggcaattctctacaaacgcccagtttacactcccccaaagatttgacgagccttcgcactccaacttttggcacaggacccaaacaccgtgttcacccacaccaagctccactgacaacggcgcactactcggggacaatgtggcgacaaccagtgc

SEQ ID NO: 569307 - DNA, 233 bp, Homo sapiens
aggtatcaacattctatctctacttccatgcactcagctatactaggataccacatactagtgatatcatgtggtattctttctgtgcctgagctaataacactataatacaagatcctccaaccatcacattatctatgtctgttccaacatgacacggatttcttacctttagtaacggctaaatcagtattcccattgtattataccatacccatattcatctttcattt

SEQ ID NO: 569308 - DNA, 147 bp, Homo sapiens
gtactaaggaagcctggttggcactctcgctgagggctgtgtatcaggactgtccaccggcgtctgcgtgtgaagcgggtatcaaactggctcacgtcctcctctgaggcgtcgttacggagggttaccgacgctcgaatttcgtaa

SEQ ID NO: 569309 - DNA, 292 bp, Homo sapiens
tggaatttcacaaggcttttaggaacccttttttttggggtaaaccaggctgaggaggagggaacttttttaaaaacagggtctggccccaccaaaggggttttttttaaatgggccccggccctacctattaattggagggggccaacctaaaaaaataccccaggggggttgggtttcagggacatggggggggaaccaaaacaaaatttggcggacggccagtcaaggggaccaggggggattttttaagggttggaggcctttggaggaaaaccccacggtttaaaaa

SEQ ID NO: 569310 - DNA, 1025 bp, Homo sapiens
tctcttccttgacaccctagcaaagatgctttgtggagtgcaaacctttcataaatatactttccaggctgggtgcagtggctcaagcttgtaatcccagcactttgggaggccaaggcgggtggatcacttgcggtcgggagttcgagaccagcctggccaacatagtgaaatcccgtctctaccaaaaaatacaaaaaaaaaaaaacaaaaaaatattcagccagtgtgtgtgggtgggtgggtgtccccgggtattccccagtctaactccaggaggtctggaggtggggagaattggtttggaccctggggcaggcaaagtgttggccgtagaaccggagaatcaccccattggtactcccagttgggagggcgacagaattggagacccggttctcaaaaaaaacacaaaggtggtggttgtggtgtggttcttattatacgtgctatatcatttcatgtcttcaccaatcccacaccacaagcttttcctaataaacagccgtgggtatataccccgcccttgtacggtatcctgctgctggggattacagcccccatatatattggcgggtataagtagaaccacagaataaagacatctcgggcgaaaagcacactctgagaatccgggcgtgactattcaatcacaaacgggtacgacaactggcggtgaagtgttgtctacaccctagccccaaatataaaagcggttcaagcaagacaacagcggagaacgaagacagtcaggcgacagggggaactgctctaaaacccgcgagcgcgtacccagcggcgggccccggtgcgactaaagacgagcgtggtcgccggttacacgagataagtatcgcaacgcgggggcgccagaacgcgcgcacaccaccgctggggccgaaacgagtgggctacaacacgcctcggcacgagtcacggtcacacagcacgccatggcccgaaccacgacagcatctacccaccaccgtggtcgccagaagcaagcaaacgcaacacctcaacgg

SEQ ID NO: 569311 - DNA, 210 bp, Homo sapiens
gcacgtctgacgaattcacgcaatatctcatgggtactccattacacatgtattgccacgatttagtcaccctgactgattactctgatgactctggtcgagaagaaccaacctcttgcaggaccagcagaggaagcattcctcctccagaggagttgagagtcgggaacacaatgacggtaatgctggcaacccaaccaggaagtcatg

SEQ ID NO: 569312 - DNA, 1202 bp, Homo sapiens
gcttcatagggacagccggccctgtgtgcactactacgcctcggtattctccatgcccttccccagtccaggtcgtggcacctacggctatggggctgatgctatgcacgtcatgggaagggatgaggaccgatagccggagtctaacgacccgtgggggcagcgtgaccctcgaggagaggcatccgcagcatttatgagactgcctagctgaaggagaattgcgccggtctgaacgtgaagaaaatgcgagggataaatgatgttagggggacgcgttttcggagagtatgtcctcatggatgaggaacgtcggacacaaggcttccggacagataggcaagagggagtctagtgcaaggacaatcgagcttgcatcccaacacaagccttcatcgcacatcgctatgcggctacctttcggacaccaccatgagcgtgagcgtcactagggacaaggacttcatacatgtcacatgcatctgccgaaagatccgtgacattgctcgcagttgacaaggctcagatagcagtgccagtaaggcgtccgatcgcagtaggtactctccttctgagagttctagacagtgggtgctacgtcctgaggagctaggaattcaacgagagagcagaaggcatgccaatgcgatggcgctggggccccatggcccgtgaggacgggacactgatgctgcacctgcagcgcctggagacacgctgagtgtgtgtgccgaggagccggagcacagtcagctcttcaccaccttgggccgcatggcctggagttcaaccgactggcatccaagtgcacaaaatgaagcagggcactccattctgcagaacctgtgtgagccagtcggaaggagagaacgaggtctgaaggccacgtgggatcagggggcggaacacggggggatcaaggatgccgaaaggctgcgggctggaccacttggcgcacaagaaaagtagaagccaagcgaaccaccaagggtacctaagcagagcagagcacgaaactggagcgcaggcaaaacacacagagtaaaacacaacgtacagcgaggcggaaagcccaacagtgcaagaaccgcaaacagctagaacacaacaccaacaatgtaagaaagagcacaacgcccaaacatcacaaccggcacaacgaaacaaagagcacggaagacgcacccgaaagaagagcaaca

SEQ ID NO: 569313 - DNA, 402 bp, Homo sapiens
  misc_feature (7)..(7): n is a, c, g, or t
  misc_feature (146)..(146): n is a, c, g, or t
  misc_feature (290)..(290): n is a, c, g, or t
  misc_feature (357)..(357): n is a, c, g, or t
  misc_feature (378)..(378): n is a, c, g, or t
gacgttnaggtgggaggttcgtttgagcaacatagtgagaccccgtctctacacaaaaacaaaaaaaataaaaaattatctgagcatagtggagcatggctatggtccaagctacgtgggaggctgaggtgggaggattgcttgcntccaggagttcaaggctgcagtaagcagtaatggtgctacttcgcttcagcctgggcgacagagcaagaccctgtctcgaaaaaataaataaagtaaataaagttgagaattttgtattttggtacagaaggtctatgcctttnaaatgctccatttggacacgcttagggcaggacgctctgaaactgggaagcctggggccctgtacantcttggctgtcccctgtacantctcctaactctagagggctggtt

SEQ ID NO: 569314 - DNA, 455 bp, Homo sapiens
ctggacatggacacgctatggcagcaaataagccaacggagtaggacatgcccatagagctccgcggtggggacaaggaagagtcacagcgaaaggtacacagatcacatatggtgaagcaactatagcagaactttagatgccatctggacagctaagagtgacttactagtacgatgcaggcagatggatctctttggacttgagagaagccaaaccttctggaaggaggatctccaaaatcaaagccagaggttgactagtaggctgtagccacatcaacacaatgcccgttgctgcacacctttccatctgcacattttagttccaggaagaaccattcccttatgttcatcatcgttggaatagaacatcttgcaaggattattttgtccaggtgaattatcttagcagtataaccaggcacatattacatcttctggtgcacatggaat

SEQ ID NO: 569315 - DNA, 905 bp, Homo sapiens
tctcatatttgaatgcagtacaaatggagacgggttcgagaatgggaaatgcagtcgtaccagaacaatatgattatgtaggcagagtcctaaaaccaggagaagaaccatcagagtatacagtatggaggtaagatagccacaggcatcacgaatataagcaggattgaacttcgtaaacaaatcaaagtcaggggccttcagaactgcaagtcttactccctttacacagactgtccggcagtcttggggttgattcagctgctgcgaaaaacattcagcagatgtgtacaagatgaatctcaatctcactatgaggatgtgctggtaactgagacattattgtatgctgccacaaggtcagttgtcgcagtagtggtagatgtctagtggggcttcatcatcctggaaaagaaggagacgggatactaaaagagcaagagagtcacaatattgactttcttatccttgcatttggccttcgtccttcttctttctctttctctctttttacgatatattgaagacgaccaagatatgtgtttgctcactcaagtgtacagatctcctcaagaaaggtccatggtactcctgtgtcacatagtgggtgattataaaacatgggtgaggaggcgacctgatccagggcggtgggggtaccttgattgagtgtccggctactgaaacattaactgtgattgccacatttctatggtgccagcaaagaaatcttattacgaacttggaatctaggcacgaataggggtccagccacagtgcacgacgattgaaccattgtcctcttctctacaaagaaaaaaggcataaacaaccatgggactcaagaaacaacgagagaagacacacacggagaaatagaatcaatccaacttaccatcgtgtat

SEQ ID NO: 569316 - DNA, 1357 bp, Homo sapiens
cgtctttcatttggatgtggtgagtggtgagggtgggaggggggtggggagactacgacgcgtctcttggtggtcgcgtggttgatgcatatacatccaacatgccgggtgtgtttttgttttcactaggtggaggtgttggtgtactgttgtggtggtcctcctcatcccactactagcagcctgtatgattatttatccaacctaccaggagatgtgtgttttatgtccgtcactggcaagggcaatctcttgttctgagtgagtaagactgatcttttggggcttggattgtattagttttagcgagcatgagtagatcgccgcgagaggcgatttttatttcgtcggtgtgcgggggggggggccaaccaccaaccaccttttcgttgtctggttcttctgcgtgcgactgcgaccgcatcatttatcatagtatgatataagcagaagtatgtgtgagtgtcgacaaccatgcagaaggtataattatgcggttttgtgtgtcgccgtcgtccacatcaggaggaggggcagcagcagcgcgtgctgagtaagagtggcgccgcgcctgcggtggttgttcatacagcagcgttggtctcatctgcgcagcagagagcagtgtagtagagagtggtgttgtgctcagcggcgctgctgcggacacgacatacacactactgctcttctcttctgcgctaataagtgtatcgcccgtcgaagagatgatatatatatcatctctatagtagtaggtgtagactctcatctcatctcttctcgtcgtgggttgttgagagaggagagagcatcatcctcgtggtagagcatctcacacactcgtcgtctcgagcagcgcttatagtagagggcacacacgcgcgctcgtattccacgcgcgtcgtgtgatgagagagtgtgtgagagacacacagcgcggggggtgtgcgcgacgagagcggagagagagacgccacgcgtgtgtgtgtgatagcgcgcgagagagagatatgtgccctcacctaacatatatatatatgtgagcacacacgcgcgcgccccaccagcgcgggtggtgagagagatatggacggccactctctgtagagacacagcactctctcccgcgcgcgggccccgcgcgcgctgctcgcgcgagcgggggcgatcttttttgtgtggggggcgctttttagtgtggggagagacacacacatatgttatacaaaaggaggggcggggcggcgggggtgtgtgggaccacccccccccccccccctccctcgcctctttgtggtcttttatccccgtgagcaaaaggggcgcccccccttaatattttttgtgtgggaga

SEQ ID NO: 569317 - DNA, 335 bp, Homo sapiens
aaaaaaaaaaggtgtcgatggggaagccagaccccttgcgggattccgggacttacgaccaaaaggaggagccgctggagcgggacttcgaccgcttcattggagccactgccaacttcaaccgcttcaccctgtggggtttggagaccatccctggcccggatgccaaagtgggtggggccttaacttggcccacccttgcggcagcgattcacgcacaggggcccgaggattgagaaccagagcttgaaattcaaagctgcgatcccttcccagcagtaaaccagctttttggaaccgattccatccccccaataaaggagcttttcccagca

SEQ ID NO: 569318 - DNA, 378 bp, Homo sapiens
  misc_feature (304)..(305): n is a, c, g, or t
  misc_feature (347)..(347): n is a, c, g, or t
  misc_feature (358)..(358): n is a, c, g, or t
gggtcgtgtcctgtgtcgtggtctgtgtcgtggttctaactcccctgtaaatttaactgttagtccaaagtggaacagctctttggacactaggaaaaaaccttgtagagagagtaaaaaatttaacacccatagtaggcctaaaagcagccaccaattaagaaagcgttcaagctcagacacccacgatacctaaaaaatcccaagacatatacactgaactcctacacacccacattggaccaactctatcaccgctatagacagaactaactgttacgtatacagtacacagtgaaaacannttctcctcctgcataagccttgcgtcagaattaaaaacacgntgaactgacanattaacacgcccacatatct

SEQ ID NO: 569319 - DNA, 389 bp, Homo sapiens
gtagcagtgtaacaggtaaggctggaccgagtacagctcccacctctatataggaggagctaggagtcacctgcttcttctcagtggaagctacagcagagctggaggagggaaagacttcagtgagggtaaccaaagaacagtgtggaccgatctgagggagcccacagctgcaccggaacaaacacacccacatggactttctggacctgcagaacagaccgcagggtgtaccagaatgccaacccctacaacgcagcccctcagaggatcagccggcgccaggtgggagctagcaagcctcctcttctcccctgagccctgtatgaaccctctgctgtggcccccaggcacagaacccagtgtggagagctaggctcctcccttcc

SEQ ID NO: 569320 - DNA, 1197 bp, Homo sapiens
agcgggaagtaagagccgagggccggcggtgtgtgccggccatgtagggagcagcaggtcccgcggcggctgcctgtgttgccgtggcgcgcgagccacctgccagcatgcagcggcagggacgaggagcgaccgccatggtcgcgccggtcatgccgagtggagtcagaacctacgctaacgactgcgtagcagtgcgacgagccccgggccgatacatggtcgggaacatgctccatacacggggagctcgcagggaagggtcgcacggatcccgagagcgctcgcgtcaggaagccctagcgtcggcagtgactcatgagacaccgaggacgtccgggacgtccagtcccctccgtcggactagagctgatcgattggcgggctttgcaccctggtttcgctcggccgcggcaacctcgccactgtgttgcgagtgcggccccgaagaggacgggcctgcgtattctggcgtacccctttgccaagtgggttggaaagcaaacgggctccgccactggatccccagggacaccagcgtgttccatctccagtatacctctttgtcacgcgttctacgcaggttccccagcagtttgtgcgtccgcaataacgtctacttccgttcagggagaaagcgtcatttagcgctatcactgtgaaggacgtaatccgagagccttgcctaagctggttccacaaaatccccgctactccattgggaatatccccacttgctttaagcacagcaatccagaccttggaaccttggccagggactgcgaagtagcacattcggcacgtcagtggaacccccaaggcaacgtactcgttgtagaagcccttctctttgtgaaagcatgcttttgccatgtactccagaagggaaaagttagtccctgattcgataagtggctacttcggaagttaccctgtattatcaggccagcggggcaatgacgacttctgaggaaacccaagttgggatcccgaaggtccttcgaaccgtggcagttatctatgagggctccctgtgcatccttcattgcgcaactaggcatttagactctacgcgattttttctattccagaggcaaagcctatggtcacagggaagcaaaagttgtaggttaaagacttttgctaatgggaacacgcaaccgttgttttgtcaccaacaatttttggttctcccag

SEQ ID NO: 569321 - DNA, 161 bp, Homo sapiens
ctgaaatctttatcaggtattgtaaagataccccaaagatatgtttattaaaattgaaataatgtaaaacacaatgaataatttgcaaaacccaagatcccagtaccccatatgcactttggtaccttaatttttttttataaataataaaagtgaatatt

SEQ ID NO: 569322 - DNA, 208 bp, Homo sapiens
aggagacagcagtgaacacttatcaccagatgctttatatatgcaaggcacttaatcccctatagcttctgcattatgcaattaactagaaatgcctttgcaatgagagccgacgctcacacccccgtaaacctgactatcgtaccctaagaacagctaacagagcacacccgctcttatttggcataatagtgggaagattgatagg

SEQ ID NO: 569323 - DNA, 823 bp, Homo sapiens
  misc_feature (294)..(294): n is a, c, g, or t
  misc_feature (347)..(347): n is a, c, g, or t
  misc_feature (386)..(386): n is a, c, g, or t
tactcttgaacaaagaatatttagtttttcaaacagtttgttgggcagctaatagtgtgaaccaggtcatttttgtattgagtaaaaaaatcaaactttgagaaacttggcattttaacaagtaatgacaatgcttcaggttagtattatttgtaatttgaatcatttacatctaatgagaatgttagttgagaatgttttcttaaagttttatatcctataaataacggaataaaaaaattgtaaaatgaaacaacaaacatgcaaaattcctatttacttttattacataanagtaattttagtgcttacctaataaatcttgaatggttatttaataaattatnagatgggtgatgtgtttcaaaagatacttgctatttttngaagaaataaggatttccagtcattaaacaaaactaaacaatcttattagatgggtgatgtgtttcaaaggatacttgctattttttgaagaaataaggatttccagtcattaaacaaaactaaacaatcaaatgttctatattaggaatctcaagtatggctttttttaaagtaacttttaaaaaagccatacttgagattcctaatataggaacatttgatgtgtttagatttgtcattattcttggcctttaaaaattttacactcatcaaagtgaagattagaacatacaattctcgaacacatgtagaatagtattgattctgtccctggtaatagaatctcagtggaagtttattgcaaaactaactatggaatctcatctgatttattaatttcttaaatttagattttatgaggtacctcactagatgc

SEQ ID NO: 569324 - DNA, 732 bp, Homo sapiens
gaccatcaccctaacacccagcgcagagacagatgtatccctgtgtctacctgtggcttcatctacccaatgctgcctggagtggccatgtgtggaccagtgtgcttgagtgatgtggcctgtgtggacgcgggcccagcgcctacacgtccttgccctggatgtgccctgtgtgccctgacactgtgatgaacatggagtgagtgtgtgtgtgcgcttgtggttgtgctcatcagtgagaatgtgagactgctgtgctgtgctgcagctgccctgtggtctgctctgcctcttccctctgcctgtgtgctgtggaccacaatgtattgcatgtagatgatccatgtggccatgctcaactggctctgtgcatgtgccctgtggcacatgctgagctaactacttgcttgtgtgtgatctgtgacttgtgttgttgccatgtgatggtgcatgctgagatctccttcttcttcctggagccctacctgctcgtcgtcctgcacctcctattcttcctgcctggtgcttgcttggcagaccagggctgtggctggtgcctgaccatgtgccaccttgccaccttgcgccagggctgtgagcccattgctgggggattgaccggtgcttggtgtggtccctgcttgggtgcttggttgcctaccctcttgccactctgctgatggagcatctgtggacttgccacgcctgcacccatggaccccttctgtgagt

SEQ ID NO: 569325 - DNA, 777 bp, Homo sapiens
tcgctattgcggcattctccctcggtctccggtaggtacggggcaactcttctcttcctgtctgggaaaaagaccatagctcaaaaggaaggccgagggagaagttagaaagggatgatgaacgaaggcgtatagaggggactgcaatctgcccgcggcaataccccgctcctgagctgcgtcgcactaccgcctcggtcagctgtcatggtcgccgggtctacgtgactccgggtagggaccgtcctggtattccggtcaccactggtactgtatgtctcggttctgccgactccctcttgttctcgctttgtggactccgatgatattgccttcattccctgtaggagaatgatgagaccgaatctgagaaattggagaacacattgggaaaatgagccatgtggtcaataggaaccagttagaagccaagctcgctgttgtcttatatgatgatggggtagtccacgtgggccttctgcttacagataaatatgcaatgagtggaggtcattccaagggcaaagactctgtgaaagtggttaccggattgagctgtgatccagagtttgatgagcaattgccgcaaaattcatatttctaagttttagaaggctaataaaatccttaggatgagtctagccaagaacgcaagttaagataatatgaacattcagttggcctgatgattgcacggacacgtttcagtgccaaagaagatgtggtcgatgattcccaaggcattcatggagaatggcaacaaattgttaaaatggg

SEQ ID NO: 569326 - DNA, 629 bp, Homo sapiens
tggaagtgacatcgtctttaaaccctgcgtggcattccctgacgcaccgccgtgatgcccagggaagacagggcgacctgggaatgctccatctacttccttaagatcatccaactattggatgattatccgaaatgtttcattgtgggagcacgacaagtgtgggctccaagcacatgctgcacatccgcatgtcccttcgcggtgaacggctgtgtgtgctgcatgggcaagaacaccatgcatgcgctaatggccatcctgagggcacctggaaacagcaacccatgctctgtgcatgaaatctgtctgcctcagtatccggggcgaatgtgcggcttctgtgttacaccaaggtagtgacctcactgagatcagggtacatgttgcatggccaataaggtgccagctgctgcccgtgctggtgcctattgccccatgtgaagtcacgtgtgccagcccagaacacttggtctcgggcccgagaagaccactcctttttccaggcttaggtatcaccacgtaaaatctccaggggcaccattgcaaatcctgcagtgatgtgcagctgatcaagactggagacaaagttgggagccagcgaagccacgctgctgaatcatgctcaa

SEQ ID NO: 569327 - DNA, 323 bp, Homo sapiens
ccgcagtctggggcttggcagagactgtcttcgacaccatcaacgctgagacagaccggtctggaggctcgtcaagtaaagccaagaacaagcagctgggccatgaggaagactacgccctgggcaaggactgcatcatgcatggctacatatccaagatgggcaatcccttcctgacccagtggccgcggcggtacttctaccgtgttcccccaccgccctctagtcgcggggcgagggccgaggccccgacagacgcctgtctgaccactggagggagactccagatccggtggaccgcacaccgcgactcaagggagcgc

SEQ ID NO: 569328 - DNA, 792 bp, Homo sapiens
tataagactacagtttatttacaattagtttgtaccaaaaatgaggactagagagaaaaatggtgctccaaagcttatcatacattgtgtcattactgtcctagtctcattaattgtttgcaagcttttgggcctacattttagactaaccctgtttattcctgtgattcaaagatagtgatctcctgctagcttgtgcatagaaatatactacagggatggtgtacatgtaaaatgtctggaccaatatactggttctgggcaattagtcctgcaaattctgccaggtacataaaagtgatgtaggggtgccctaactagatccggaagtttcttgtgtgtaggaagatatagaaagagtagggggaggaactttcatagaactcccctcagaaggcgaattctatatccttgacaagtaaaatttgagatggaaattgtctataatacacaacttatggaatttggtatgcttcactctattggtttgagaaagggttgtactacatgtagctagccttctaatctgaatgtattagacatgagttgcctattgcggtcgtatttttgcttagtttatttatccttataagcagggataaatagttactaacaaaaaaggaagcatgaaagttttactatcactgagcctggtaggactttgattggggttaggggatgcagtttaaatgaaaaatgccgttgggattaataactttagtagggaaatttccgatactttaaaattcatcaaattttgggaggtcggaaatgccgttggcctgggggtca

SEQ ID NO: 569329 - DNA, 934 bp, Homo sapiens
gaccacgcgtgcgcggacgcgtgtgtcgagccacggcgtccggacctgactctctgaggctcatttagacagcttgttgaaattgtccccgtagttttcaatcatgtctgaaccaatcagagtccttgtgatctggatcagtctggtcaaattgcatattcactgctgttacagtattggaaatggatctgtctttggtaaagatcagcctatacattcttgtgctgcttggatatcacccccatggatgggtgtcctgtgacggtgtcctaatggaactgcatagtactgttgcccttccccgtccatgaaagatgtcatctgctaacagataaagaagacgttgccattcaagagacctggatgtggccattcttgtgggctcctttgccaagaaggcgtaaggcagttggccatgagtaagaacgaattttactgagaggcaaatgtgagaatcttcaaattcccagggatgccgaggccttaaccataaatacgtccaacgaacgtcacttaccaggtctattgtgtgtgggtaatccatcgctaataccaactgcctgagtgtcttccatgtcagctccttccatccccaaggagtatcttcagttgcttgactcgtttcggatcacaacccgagctaaagtctcatattggctctttaaaccttgtgtgttgactggctaatgatgtggcatgcaatgtctttaatctggggcaaacccattcctcgacctcccgtatccacgattgtcaacccatgccaatgttgcaccattgcaggaacacgaactcgggggttcatgaacgcctggaaggatgaccagcgggcttcacggacaatttgtccgctttcgtcccctgtgcgcgctttccataggcccaaactttcctgcagtttgtgcaagcccctggccgctctggacccgttgtc

SEQ ID NO: 569330 - DNA, 1112 bp, Homo sapiens
gctcgcagtctgttcttccgaccgcctcctcacgtctgcgttttctctgccggtcgcaatgcaagaagagatcgccgtgactggtcattgacaatactggtctcctgggatgtgctaagctggtttatagctggggacgatgctcccacgaaccgtgtttcctatccatacgtcggtgcgctcccagtactagccagggctgtctagggttgggctattggagcctagaacggtactaccttacgttgtggcgcactgaggtcctcatcacgtctagatgcgtaggtcatcgctgaaccactgaattcatcctcattagtagatcattggcgatcggtcacccagaacatggtgaggactattggtacgacagaatcttgatatccacggaggcattcttatcaaagcggatgctcgtcgtcgcttggtccccgagtatggaggcatcccatgtggcttggttgaaccgatgtgacccgctcgtgtaatcctccaaaggacctagagcgagagacgacaggaaagaccttcacgactttactttgtgtttgaagaacctttcagactagtccacgagcacattgatactgtgtggcgcgatgccaaggccagttgcgtgttcccatctagacgcctcttgtggcagcgaccacttgagcatttgtgcatgggactccgttggaagagcggggtcacccaacactgtgtgcccattctacgaagggctaccgccctcccccacgtcattccttgcgtctgggagccttggcttggccggggaacttgacctgaatacctcatgaagattctcactgagcgaggctacagcttccaccaccacgggcgagcgggaacatcgtgcgcgacgatcgagggagaaagctggtgctacgttgccctggacttcgagcaggagattggcacccgcgcatcttccttctttctctgggagcaagagctacgagcttgcccgattggcccgggtcattcaccatttggcgcaagtgagcgggttcccgggtgtccgggaggccgcttgttccacgctttccttccctgggctacttggactccttgcgggatccacgagaccaccttttactccatctttg

SEQ ID NO: 569331 - DNA, 335 bp, Homo sapiens
  misc_feature (44)..(44): n is a, c, g, or t
  misc_feature (75)..(75): n is a, c, g, or t
  misc_feature (87)..(87): n is a, c, g, or t
  misc_feature (245)..(245): n is a, c, g, or t
ggcacgagcatctacaccaaaaaacttctctcgtgagaaaatcngcctagcaacggcggtcaacctgggatgggngtcatcctggtnatggatctgggtagccaagaataattacctcaaagtaatttggtaatcctcgtcattggtccttaaaaactggttttcctttactcctctgaatatgtacatagtggactatagcacaggcattcccatggcaaggccctattcccaaatacagatcncttccttttagagagcctctctccattggtcatttaaatgaacagacttacctcgcaaaaacagaaagaaacggcggggattccagaata

SEQ ID NO: 569332 - DNA, 192 bp, Homo sapiens
ttatcccagccctacgagaagcttatcagttctgtgccattgacgagcattggacaactagaccaaaggatatgtttgatcccatggctggtctgaggacatcctactatgaggcattagccaagggccagaaaattgagatggacaaattggaaaagggcaaaaaggagcgaaacaaaaattgagtttgtg

SEQ ID NO: 569333 - DNA, 295 bp, Homo sapiens
ggtgtcggccatgcgacgactgacgctggtccgtcgtatcacaagggtcgatgactgttgttcaccctgtccagttctcacctggtaagcccgggattcaaaacagcaaaattgagcccccaaaaaagcagcagagagagagagacgcagccattgttcccagcagcccccgctgcacaggcaaaagcacctctggtgccatttccacgacaaaacaagacacagttgaaccttctattttgacacatggtggatctcttttcctaagacttggctagggggccacaggagggcg

SEQ ID NO: 569334 - DNA, 206 bp, Homo sapiens
tcactgttcaaaaaatacacttaatggagtatttggcatcagcaacctttcctgatgaaagcagacttttggccaaaaaacaatctgtaatcagaagatactcttccatccttctcttcctgaagcaaactgaagtgtccaacttcctctaagctatctatcaaaagctgctgtaattaaactatcgttatagggagtagtttttt

SEQ ID NO: 569335 - DNA, 261 bp, Homo sapiens
ttcatatcaggcttcatcccccatttccagtctgattatacaagtgctaagtggcatgaaagcgctcgacatgattcatgtcgagtcctttcatgccagctcacaccccgaagaaccttgagctgatgcaactcaacacctcgcatggtgccgtcccaacagagccttccattggcccccacccccttcgaaagccctttcccaacaactcatacactagcacctggggatgaaaggactggacatgacgggtaccgagct

SEQ ID NO: 569336 - DNA, 111 bp, Homo sapiens
tcaatcgacacatgtgttcagactcacatggacacatcatgctcactctcacccatgtgctcacacacggatactcgtgctcactctcacccatgtgctcacgtactctcg

SEQ ID NO: 569337 - DNA, 141 bp, Homo sapiens
ttatacatggcatgaccgagcatggacacatcgggtgtggtcctctgatatgcagtagaggctatttagcactgcacaccagcctgggtgacagagtaagactctgtctcaaaaaacaaaacataataaaaaatatccccg

SEQ ID NO: 569338 - DNA, 725 bp, Homo sapiens
  misc_feature (9)..(9): n is a, c, g, or t
tttaatatngttattaaaactttaagtatcctatcttgaacattggtgttagtataaaattacttggcaatgctgacattgaaatgaacatttttctatgtttgaaaaaaaaaaaaaaaaaaaaaaaagaaaaaaaaaaaaaaaaaaaaaaaaaaaaaaaaaaaaaaaaaaaaaaaaacaaaaaaaaggggggcccggccgccactaagatcgacccatgcggaggcccagaacacaagtcacacccacattctagcagaaagaacgaggcgcgccacgccaacgtcgcccaggcgactataaaaacagacaacgaacaagcggactctacaaaacagaaactcgagcacagggagaaacacaccgaagatccagaagacgcactagatgagaagcacagacaaccaggggcagcgagacaaacacgacggacaaacgcaaacacacaacaagagcactaaaacccacagctgaggcatacaagaaaaaaacacagcaaacagcaaaagcacctgggataccaccacaacaaaccaaaccattacaggaggaccaacaaaacaaacgacactagaaccaaagagagaaataaggagaacaaccatggaacacacagcgaacggcaagcagggacagaaagaacgacaccggaaaacagaccacgaaacaaccagcgcgaaacgaaaagcacaaaaccgaacaacaaaaccgaaaaaacacgaaca

SEQ ID NO: 569339 - DNA, 226 bp, Homo sapiens
gactaatattttgttgtaatccattaagtaatgtaacgcatgtaagatgcattagggtgcctggccaggactccgtggtctcctgttgtgacagtaataatggttataataattacaatgataaaatggccatcattctatttgtatccaaaagtataaatttgggctattggcatgaaaagtgtcctcttgactgcaataccacgcgagatgtatacctagatcg

SEQ ID NO: 569340 - DNA, 141 bp, Homo sapiens
actatgttgcccaggttggtttcgaactcctgagctcaagaatcctccagcctcccgaagtgctgggattacaggtgtgagccacccatgcctaaccctcacattttgttaagggaattttagaagggcaactttgctagg

SEQ ID NO: 569341 - DNA, 432 bp, Homo sapiens
tatttaaaaaaactaaggcgaggcttttggagagtagaagaattggagggcttaatatagtagcttagttggaaaactgtgacgggctttcggtacgggagtaattcccagatccagaggttaataaccccacttaatggtttttggctttggacctttgggtcaagattatattttaaatccctggaggactagcattaaattgacagctgacccaggtgctacacagaggtggattcaggttgatctaggaagacagcagccgacaggattccagggaaccagtgtatgatgaacgctaggactgaggagcaagcgaacaagcagcagttcgtggggacagataggaaacagaagtccaggagccagtgcgatttgggtgaaggaagctagtaagaagggcacggagcgctaacgatttggtagtgaagc

SEQ ID NO: 569342 - DNA, 1225 bp, Homo sapiens
  misc_feature (1225)..(1225): n is a, c, g, or t
ccacgcgtcgcgaggagcaccccgtgctgctgaccgaggcccccctgaaccccaaggccaaccgcgagaagatgacccagtatcatgtttagaagagcactgtcaacagcccccacgtccactgtaccgttgctatccatgggcgtgtagctaatcgcgctgtagcgcctcatggacctgtaccagctggacatcgtggatggactccggtgacggggtcaactctcacactgttgcccatcatacgcaggggtatgccgctcacctccattgccagtccgtgcgatctggatcctggcttggccatggacctgactgactacctcatgaatgtatcctcaaccgaggcgtcgggctaacagactgtacagcctaggtcaccgggcccgtaagacgggcgtaaaagatccgatgacgattgaccactttaaccggacgacgagtcttaggtggcgctaacgggctccaggcctcctttggagaaacggtgttcgacggccgaaggacgacgtgggctcatccggactgcgatctccatggcttcctgtcacctggtaggtaagagagcgctacccgagcgtgccctgacggcggccatcggtcactcagccattaggccacctgatagcggttcctgtctgcccttgagggcccgtcttcccagcgctttcgcttccctggcgctatggcagctcctggtggccaatccagagagaactacgcttcaaggtcccatcagtgcaagtggtgacgtggcacaatccggccaaagaccgtgtacgccaacaacagtgctggtctggcggggaccaccaatgttacctggcattgccgacaggatgccgacggagatcaccggcctgggaccacgcacaacggcgaatccggagcaatgagccgctccggaagcgccaaataccccgggagggcaccgacggggtgaaactgggcctcgagagcaaccttcccacgaatgatgaacacacaccagacggatatcaacgaccgggcccccacatgcgcccggaacgagcacaggggagaccacacaataatgcagcaaaccaaatgtgcaacgacacaaccagcgaacaggacgtgcggcagcacaggagtacagggtatataggagtcagaaacaaacgcgaggaagagagcacacaagacagtcacgcagagaggacatcaaaaaaaagtaccacaggcccaggcacacgccgagagn

SEQ ID NO: 569343 - DNA, 320 bp, Homo sapiens
tatcgagctcggtacctgttgctaggtggagtgagtggtatgatcatatcactacagcctcaaactcccaggctcaagcgatcctctcaccccagcctcccaagcagctgagaccacaggcacacacaaccacaccaggctaatttttttggtttttttaatagcggtgaggtctcactttgttccccagactggtatcaaactccgggcctcaagtgatcctccaaccttggcctcccaaaatgctgggaatacaggcgtgagccactgtgtccactctggcatactcttttttttttttttttttttttttttttttt

SEQ ID NO: 569344 - DNA, 241 bp, Homo sapiens
cctgttggccttcgcatcgtcccagcaggaacatgccctgaagaggccaggactccaagcgtcttgagcaggcgtgctgtgatatgtcctagtggtcccagcctccccaccctggccctgccccagcctgtgtagctcttcctgcgtgtgtatgctgcatgctctggtctggggcttggatcttgcacttgccccactgccctgtcccttctggtacaatagatgaactcttaatgcccca

SEQ ID NO: 569345 - DNA, 474 bp, Homo sapiens
  misc_feature (116)..(116): n is a, c, g, or t
  misc_feature (119)..(119): n is a, c, g, or t
  misc_feature (233)..(233): n is a, c, g, or t
  misc_feature (258)..(258): n is a, c, g, or t
  misc_feature (341)..(341): n is a, c, g, or t
  misc_feature (357)..(357): n is a, c, g, or t
attacgactcgagctagtacccaggcagcagctggtcagagactagtcccagattcaagacagtgttaccttcagcaacaaccactgtttcaacctctgccacttctctctctgcnacngtaatggtctctaaattcacttctccagcaactagttccatggaagcaacttctatcagggaaccatcaacaaccatcctcacaacagagaccacgaatggcccaggttctatngctgtggcttctaccaacatcccanttggaaagggctacattactgaaggaagattggacacaagccatctgcccattggaaccacagcttcctctgagacatctatngattttaccatggccnaagaaagtgtctcaatgtcagtatctccatctcagtccatggatgctgctggctcaagcactccaggaaggacaagccaattcgttgacacattttctgatgatgtctatcatttaa

SEQ ID NO: 569346 - DNA, 382 bp, Homo sapiens
tttttttgtttttcatgccccaagcccctggaagggaattaatgttttgtgacttccctgtgacctttgcaggactccttatcctgggtttggtttccaggggtcccctttttgccgggttcctaacattttgattcctgttttgaaaaaagcccctgctgcattgtaagcccagggatgtggcacctgcaacgggcttggctttgtgaaaaaatgagtggggtccccgaatgtggcaactgcagcaggcttggctttgtgaggaaccgagggtgtccagggatgtggcagctgcagcgggcttggctttgtgaggaaccgagggggtccccaaacttgaaacccccgtttttatttgcccaaaaaaaatgctatttttgga

SEQ ID NO: 569347 - DNA, 514 bp, Homo sapiens
gtccctaacatctcttcagcaacatcagattattttgtcattagaagccagcaacatttcttactaaagtcattgaatataatggccttttaacccatctccttgcttccatggtggctcaccttcaatctactctgcaaactagagtgatcttttaaaaagacaaatagaattataccatttctttatttaaaacctttgacagaaattaggtttctggttcaacatgaaaagagcttggaactccatcactcctgtcctacaataagaaaaaaagctagacaaattgaaaatcaatgacttttcttggccccatcaaagaaatgaggtcataaggcaaactgacatcctgaaatctggagagacaaggacgtccagagagttatattaatagcatctgagcttgcttacctggagtagaagccgaagggctccattaattaattacacaataattaaattgtacatatgtttaaagcaagattcagtattgagcaaaattgacagaaatata

SEQ ID NO: 569348 - DNA, 118 bp, Homo sapiens
cgcgtgtttcaccactgcggtggttgcctccctgtacacgttccgtcgccccgtgagcaccgtgctgccctcccaatactcgttccgctggcgcctggtcgcctctcgcggctcctcc

SEQ ID NO: 569349 - DNA, 428 bp, Homo sapiens
  misc_feature (30)..(30): n is a, c, g, or t
  misc_feature (61)..(61): n is a, c, g, or t
  misc_feature (178)..(178): n is a, c, g, or t
  misc_feature (423)..(424): n is a, c, g, or t
acccttcctgaccccctcaaaactcaacantaagaaggcaatcaatccccaattagaaaantgggcaaaaaggcatgaaagagatattttacccaaagaggatatacggatggcaaataggcacatgaagagatgttcctacatcaatagctgttaaggaaatgcaagctcagcatgngtgcacgcctgtaatcccagtggtttgggagcccaaggcacaagaattgcttcaggcaggaagttcaagatcagcctgcgcaacatagtgagaccccatctctatgggcatggtggtgcgtacctatagtcctagctacttgggaggctgagatgggaggactgctgagcccaggagtccaaggctgcagtgagctataatcatgccactgcactccagcctggacaacagagcaaaaccctgannctaa

SEQ ID NO: 569350 - DNA, 334 bp, Homo sapiens
  misc_feature (3)..(3): n is a, c, g, or t
  misc_feature (235)..(235): n is a, c, g, or t
  misc_feature (278)..(278): n is a, c, g, or t
  misc_feature (299)..(299): n is a, c, g, or t
  misc_feature (303)..(303): n is a, c, g, or t
canggaattcggaacgagcctgggatttttgatgttaaaattagagctaattattaatgaactagaatcttttattacttaaatttcttcatagcatactaggtaaataaagatttgcttctaaattaataccagggcttaagcttactgtgttaactgttgcaaagagaaaagcctgtataaaatgttggcactaccacagtgctagaattagaaagaaaaggctgagcacggnggctcacaactgtaatcccagcactttgggaggctgaggcagnagaatcgtttgaaccaaagtnggtngaggttgcagtgagccaagatcatgccactg

SEQ ID NO: 569351 - DNA, 1603 bp, Homo sapiens
  misc_feature (4)..(4): n is a, c, g, or t
  misc_feature (25)..(25): n is a, c, g, or t
  misc_feature (110)..(110): n is a, c, g, or t
  misc_feature (432)..(432): n is a, c, g, or t
  misc_feature (530)..(530): n is a, c, g, or t
  misc_feature (871)..(871): n is a, c, g, or t
tatntgtctgctgtgagtgagaagnactctcgacaacgtagtgatgtatagtatacccacctctctcgtgcgagtgcgtacctcacctatgatatgaggtatgtctgggnggtcgctgtccactacgcagtagcgacatcagagcttattgtgtcgtgctgctcttctgttgtatcgtatagtgaaccacagtccccgcttgtattggtagcaaacgatactatcgtacactacacagtggactagttgtcatactaacatcgaatcgcaaatcaacagtcttcacgccgtacgagaccaacctaggatgggttggtggctgtattttgtccaaattcgaaatcgtgatctacacaccctccgtattggtaagtatattttcacgcacccctcggtcttgtcgtgttgtctcgtctccttcaaatccatagntacctacgttactagaagtgacagttttgttttctgtctcgttgcgatgtaaccccctgtgtggtgtaggggtcggcccaacaactctatgagttggngctgttctgtgattcgtctgttcgtcatcgtctcgtctctctccccacttctgtatgtttagtttaagtgctgtggtcgtcgcaccacaccgctgtgttgcttcgctccatccctcgcggtcgcccgggcggtgatgtatgttgattctcgcccagctgtatcttggatcacacactcatgtcggcggcgactaatcatatctgggtcgctgcctgcttctacgtctctgtgtctagattcaataacatgtattgacaatacacgtacgacatcctatattgtttgttatacacaccacacagcatgttttgatcaagctatgtgtcccccacaatacgcnggtctattgtaaccttacattgtgactgccggaaccgccaaaaaaaggtttttagtgacctgatcaccctcggcttgcttgatccaccttcgtgaccttgaatattgttttgtcgtattctatcctgcggaggacgaatgtagtgagaagccccccccctcggttgtcttctccctgcgtgttcgcgagttgtcttgttgtatgcggctacttactgtgggcgttccttatcctcgccgttgtggtgtgtccctctttacttcttcctttggttcttgtgtgtgatacgtctcccggcgttgggctctctttgtggggagtcctcgctattttctttctggtctactctcacactttagtgtgctggccgcataatttggcgcggccacacccccagtgcgtttggtgcgtcagatctggtgttgcttcgtggttccctccccgtggtgagactcgtgtggtctccaaatgcgtgggttatgtgtgtgcctgcttcgtgtaatgcctgccctgggtgttcggtgccccccactccgttgccgtgtagcgttgttccactcctccctagttcccggccccggcgttgttctctccccagttctttttggccacgaggggttttcccataattttcccccgtgtttttgttccacacagggcccttttttcaaccccccccccctgggtgttttgaatttattggtttttttttaataaaagttttcactccca

SEQ ID NO: 569352 - DNA, 241 bp, Homo sapiens
tctagaggatccgggtcatgtggtggatgctagtgatccagttctagcagcatctttcacttgctaggttaggcgagcagtgatctccacaagagtactggccagtgtcctccacacaaagtgcagcagaagtgtttcttcaagcacaaaagcaaagacgctacagtgaccatggtaagttttggagtatcccagtgccttctcttagagtccagacaagaaccacagggtaccgagctcg

SEQ ID NO: 569353 - DNA, 619 bp, Homo sapiens
gggcttaagtaacacccctctaagcatttgttttcagtacttcctaggagtggttgcatttgggaatggaattgttcttaaactcttctttctcatatattcttcttctctgctttgcgtcactctcaccttccctataatcttgttcatctgatcctttcctctctttattcttatttggttcctctcttccatttttctcttccgttccttactctctactctatctttttctcatctatatatctaatctcatacccgttacctactgctgtagcctatcgcttatcctctatctctctcccatcctgattacatcctgtctctccttatctcttgttcaatcgtattgtctttcttcttctttcgttctcctgtttatcgtttctctatattgtataatttgtctcctactctcctctccatcctttcgtgcttctctttttctcatttacctctattccttccattgtactgtcttttatcctcttccttctccatctcttgtccctctctttttaatttctttctctttactttctcccttcctttattgctctccttttctcctctcttctcttcatttctaccttccttctcttcatcttttctctttccc

SEQ ID NO: 569354 - DNA, 353 bp, Homo sapiens
  misc_feature (133)..(133): n is a, c, g, or t
  misc_feature (187)..(187): n is a, c, g, or t
tttcactgtggtagccaggatggtctcgatctctactcaaaatacaaaaagttagccgggcacgtggcgggcgctgtagtcccagctacttgggaggctgaggcaggagaatggcgtgaacccaggaggcggnttggcagtgagccgagatcacgccgctgcactccagcctggggcagcagagcangagtctgtctcgaaaataaataaataagtaaataaattaaataaattaaattaaatgttaaattaaattaaatagatttaaaatgggaaaacttaaaaaaaagttaaattattttaaaaaatttaattaattaaacgttggcccggcccgttcacggtggcttcac

SEQ ID NO: 569355 - DNA, 133 bp, Homo sapiens
aaaggaggtaggaaacggatcacactgtttcaaatctcggatatcgccggggacccatttatagggcactcagaggaatgagctaatatgtgaggcagagctgtgctaagcgagggcactttcacttgattca

SEQ ID NO: 569356 - DNA, 386 bp, Homo sapiens
gaccccaggctcaatggagtgcagtggtgtgatcatggctcactgcagcctcaaactcctaggtacaagtgatcttcttgcctcagcctcctaaagagctaggactataggcacatgcttctatgcctattaaatttttttttggccagacacggtggctcatgcctgtggtcctagcactttgggaggccgaggcgggcagatcacgaggtcaggagattgagactatcctagccaacatgatgaaaccccgtttctactaaaaatacacacaaaaattagctgggcatggtggcatggtgcctgtggtcccggctgttcgggaggctgagacgggagaatcgcttgaacctgggaggtggaggttgcagtgagccaagatcgtg

SEQ ID NO: 569357 - DNA, 297 bp, Homo sapiens
cctagttttatggccagggccagggttattattgttattgctactgggttaaatatttttgtaatggtccattggccagaatataggaggttgctgatgatggctattattagtatcatggaggctgtggcttgtgttaggaaatatttggtggctgcttctgtggctcgtgggttaaaattttttattaatactgggataatggctaataggttaattgcgaatccgattcagatgagtagtcagggtgagctgattattactagtagggtaccggatattacgtaattaggggga

SEQ ID NO: 569358 - DNA, 319 bp, Homo sapiens
cccaagctttatcggcatgagaagaggcttgcaatgctgaatcaccaccacaaatttaccactattaatataaggagatacattggaagatggaattagaccatctcggaccaccaggttcacaattccacctgcagatacgtgcaaaacgtattgtcacaatacttatgtcacgttattgccgtttgaggtcaccaccaactaagcttatgattgatgtgtgatcgatttggtccatgtcaccagcgtagcatactaacaaaaactagggttgcatagtcgaatgcctattaggcagaacgtaaggcggtcaaagctt

SEQ ID NO: 569359 - DNA, 197 bp, Homo sapiens
taattctgcctctgataaaactgagtagaaatgctattccaagttagagccaagagaaagtaagaactaggatttcagaaaatataaaactcatcttcttaaacacactattactcattgtcatggtaagaaagaagactggtatgctggctacattccttgggaagggattaacgcgggtaaccgagcttcgaatt

SEQ ID NO: 569360 - DNA, 145 bp, Homo sapiens
accgagagggttgaggacgcagcaccctaggtcccagcctttgcaggagcctccttgtgcttagctagacttagatcttcggtggcctcatgtaaacgtggcagctagcctcttctagaacctaggccagggactgagcagaagg

SEQ ID NO: 569361 - DNA, 946 bp, Homo sapiens
  misc_feature (359)..(359): n is a, c, g, or t
gagattatgctttgccactgccggggatgatgcagtttgaatgaggcccttgagatctccttgtaacatcagggtacctttggaagaccatcactcagtgtacgccctgcttagctcatcttatatactagagagccagcaccctgcatgtccctggggtggctaggcaggagtggctgtggggccaatacccagactcgcgcattcatgggcactcgagacccctggcctgtgccattcgcaatccccattagccatttcttggttggtgccccttttcgcaagatacaaggcgtgcagatgtggtagctaagaagtgtattacgaggtcaggatctggtactgtggccacatcgagnaagctgggttcgccccatcctccattgtctgaggtctgattttcgctgtgatgcctggtgtttgctgggatcgtacgtgggtaggtgcatggtcagcccaatgactgacgaagtaaaccggaaagaggtcaaatcagaggacgctcgtgggtcaacaattgggagtggtccgaatagtacgcatttacaatggagttggctgtacgagggccaccatgtgaccctggggtggaatcttgtgcgactggtgtagcactagttccccttcccatggccttgagactgttgatggggtcgcatctcacaggggaccgcaaaaggtgactgcgtgaacgggtacatggagggcgctattacctcttagttggcggccgcagccagggggtacgcatgtagcactatgaccgggccaaccgctcaatccgctctaacactaacaacgggacattgaaagcgccattcaagccaggacacgcccacggcctccacgcaccacatgaaggaccaacgtccaacacgaaaggcccacaatttgctaacacaccacacacgcaataggagcacttagctggccaacacaaggagcg

SEQ ID NO: 569362 - DNA, 705 bp, Homo sapiens
ggtaatactatgaacattcgcttcgtagtagaattaaagtcaattaagaaatagaacttgggtcactaattctgttacaaagcttcataatttgtcccgaagcatatggtggagcatgctgagaaatgtgctttctgtgtgtttgacattcctgaattgtgtggagtccgttcgagcgtgaattatctattacttttagaacgttgacgacaggcagggtaatgcataacgtgaccttagtttgcatggtaaaacatgggacgatcagtgatgcgctatttaaaaaagtattagtatctacaccgttctcccctgatggcttggggagtgtgttcagccgcgtgcagttgtctctgcgtcatggacggtcgttgttgggatctgtgctgggcggctgagcatttagatgtgagccagtgacccatgaacttgccgctctgtgagggccagaggtcagggccatgtcactggtaatgggcctgaaggctacttcctagaaccttttatgtctctcgtgagccatctgttaggaacgttcttcttggtgtggtttgtaggcctacctgtcgctattctgggaaaccttcttgagtgctatgcaaatgtgttcacaggcaatgggggtggtcctgagcctttggggtgggcacctggtcagtgagtgtcttgcccttccccagctgggcatacagtaccttgctcttt

SEQ ID NO: 569363 - DNA, 693 bp, Homo sapiens
tgtatgtaatggtctagggtgtagactgagaatagtgggaaatcagtgaatgaatgcctcctatgatggcaaatacagctcctattgataggacatagtggaatgtgagctacaactgtagtactgtgtcgtgtagtactgatgtctattgatgagtttgctaaatacaatgccatgtcagtgccacctacgtgctgaaaagaaagatgaatcctagggctcagagccactgcagcagatcatttcatattgcttccgtggagtgtggctgagtcatgctaaatcacttttgacgcctggtgtgcggataagcgactgattataggttagctgtgagtgttgcacaatattgctctgtgttgtctactgttctattcctacttgtaacatagtataggttgtgctcaccctgatcaaacccttaggaatgccaattgatatcattacgtctcatgactcataccctattgtaatccagaatggtgcatataattatcactggagttatgtatagttacaaatatagggagatatattccgaaagcctaggtaggactaagaatataaacttcatgggttgaccgaataatcagaataggtgttggtatagaatgggtgtctcctcctccgagcggggtcgaagaacgtgtgtgcgaggttgcatacctgttataatatactatgcagcactag

SEQ ID NO: 569364 - DNA, 246 bp, Homo sapiens
gcagtcagccttcacgtttggcctcagtccccgtgtcagtgccgctttgggtgtgggtgtgggggtgtgtgagcctctacacatatatatacgtacaaagccttaaaccacattgtggcggtgccgttttaactgtaacgggtggctttgtttccagtttttgtacccgtgtccttgtttcccctcctcccccatttggggatgtgtttgtgttcccccccttgaaataaacagacacatacgtga

SEQ ID NO: 569365 - DNA, 443 bp, Homo sapiens
agccttctatcaggatgtcgataatagctagtggatcacggccatactcatgagtactatgatatacagcacgagtcccaaaacttggagacataccatacgacatgggcttgattgaaaagagggactataataacacattgtgcatttcgtcagaagccttttggatgacttacaatagctctgatgaagataccaccccagcgtcagtccaataggtcagtgagtttcaacaggcatccatccctcccatgaagggattctggtgatgggaagtttctgtcatgacaggaaagcattgaccctcattgattgtcaactttggtattagccatgaaagacaggatgctcattgggtgtactgtagagtgaggactgctgcctattccctcccagaacgtctgacccaggggtgtgtgttgaggagccctgggggaaatggc

SEQ ID NO: 569366 - DNA, 294 bp, Homo sapiens
ggcacctgtttacgaggaatgctgagtgcgggagagtcgcttgagcccgggaggcagaggttgcagtgagccgatatcacaccactgcactccagcctgggcaacagagcgagactctgtctcaaaaaaaaaaaagaaaaaaaaactgattgtgacatctgcagatctcagctttcctcgcaacactagtagcaagaaatagttgaggaggcagaagcataaagatccagagagcattataattctatcacaaagttctcaaactgtctctacagtcacaggaaaaaacaggta

SEQ ID NO: 569367 - DNA, 998 bp, Homo sapiens
  misc_feature (8)..(8): n is a, c, g, or t
  misc_feature (296)..(296): n is a, c, g, or t
  misc_feature (600)..(600): n is a, c, g, or t
  misc_feature (629)..(629): n is a, c, g, or t
  misc_feature (673)..(673): n is a, c, g, or t
  misc_feature (703)..(703): n is a, c, g, or t
  misc_feature (714)..(714): n is a, c, g, or t
  misc_feature (752)..(752): n is a, c, g, or t
  misc_feature (758)..(758): n is a, c, g, or t
  misc_feature (798)..(798): n is a, c, g, or t
  misc_feature (865)..(865): n is a, c, g, or t
  misc_feature (880)..(880): n is a, c, g, or t
  misc_feature (907)..(907): n is a, c, g, or t
  misc_feature (923)..(923): n is a, c, g, or t
  misc_feature (953)..(953): n is a, c, g, or t
ctggaaantcttaagaacacagtttcgcaggctgggtggagccgtccccccatggagcacaggcagacagaagttcccgccccagctgtgtggcctcaagccagctttccgctccttgaagctggtctccacacagtgctggttccgtcaccccctcccagggaagcaggtctgagcagcttgtcctggctgtgtccatgtaagagcaacggcccaagtctgggtctgggggggaaggtgtaatggagccccctaggattcccagtaatccttgtcctcgtctacctgtggctgcngcggtggcggcagaggagggatggagtttgaaaagcgggcaaaggctcctccgggcccctcaccagccccaggtcctttcccagagatgcccttgtgcctaaagaccagcttgtagaagagatccgacatcaagtgcccaccttggctcgtggctctaacttgctcctgctccttctgctgcttcttctccagctttcgctccttcatgctgcgcacttggccttgccgatgcccccagcttggcggatggactctagcagagtggcccagccaccggaggggtcgaccacttccctgggagcnccctggactgaaggagaagtgctgctgcngctgttgttctgcctggcgccttggcctacaggggccgcggttnagggtgggagttggggggcactggccagcncctcaggagcngggggtggtggggggggcggtggggggtggtgttagtnccccancttgtaggtcttagtttggaaggtgggcagttctggaatngtgccagggggcagagggggcaatgccggggcccaggtcggcaatgtacatgagggcgttggcaatnctgggcaggtcaggnaggtaggatggaacaacaattttaggnaccttggccaggtctngcacaaagaagttgttctttgggacctgcngttccagccgcccttttttgctgaaggacaagggggcatcaaaca

SEQ ID NO: 569368 - DNA, 135 bp, Homo sapiens
gagctgcggcttgggttcgatcaactcaccgtccaacatgcgccctggctgtgaggttgagatgggacatgtctgttacagagaccctggtccatctgtgagtgcttaatgctccaggagtgaataccaatcctg

SEQ ID NO: 569369 - DNA, 327 bp, Homo sapiens
ctcgttatctgttgtgtatccctgtgctggtgcatacagcctcatacactgatgttttaataagcctgcaccatatgtatgtcaatagctatcctgcgcattctctatccatcaccagaatcactttaactttccttgttcctttactcttccatagtaaattgtatattcaaccatcaggtgccaggaaaaagcctgtgagtcatgtgtcattggcacttacatggcaatctagtggcattttgaaaaaacagcatatttttatggcagtcttcctattcataaaaatagtatgtctccatttcacttatgtctttacgtgtatct

SEQ ID NO: 569370 - DNA, 630 bp, Homo sapiens
cttaagacaattcgttgcctaggttgagtagaaggtagtctctatagctgatggaatctcactgctggttttctccagcacctgtaaccttttctggtttgattgaaataaggaggaaaactactcaggagtgagacaggcttccatgccataaaactgttgctggcactaccattgttttcatttgagataatttctagtaactgtgtcaaactggactgtttttccctctttccctctgtttgttcttttaaagcttatctcaactgcagtgaagagatgaggacctctcacgtttttagttattgatgcaatgaaaatgatgcagcttggtttgaaattaaaaagttcatataaaaatgagatattgcaaatcatttagcttaatattaaaaaaatttaagttgttattttctgtgacacttcatccatttattgtctagatggttggttacattttgttattttgaagggataaaagacaccagaagcactggatttggtgtttcctaaaaggagagagagtttctgttgcgactcttctagcaaaagggatgcataggtgtggccatagccactattttggctgggtgacccggtgttaacagctatgagaactgaacagttggg

SEQ ID NO: 569371 - DNA, 909 bp, Homo sapiens
  misc_feature (2)..(2): n is a, c, g, or t
  misc_feature (27)..(27): n is a, c, g, or t
  misc_feature (29)..(30): n is a, c, g, or t
  misc_feature (34)..(35): n is a, c, g, or t
  misc_feature (206)..(206): n is a, c, g, or t
  misc_feature (230)..(230): n is a, c, g, or t
  misc_feature (248)..(248): n is a, c, g, or t
  misc_feature (316)..(316): n is a, c, g, or t
  misc_feature (336)..(337): n is a, c, g, or t
  misc_feature (347)..(347): n is a, c, g, or t
  misc_feature (369)..(369): n is a, c, g, or t
  misc_feature (383)..(383): n is a, c, g, or t
  misc_feature (396)..(397): n is a, c, g, or t
  misc_feature (400)..(400): n is a, c, g, or t
  misc_feature (407)..(407): n is a, c, g, or t
  misc_feature (415)..(415): n is a, c, g, or t
  misc_feature (434)..(434): n is a, c, g, or t
  misc_feature (439)..(439): n is a, c, g, or t
  misc_feature (447)..(447): n is a, c, g, or t
  misc_feature (449)..(449): n is a, c, g, or t
  misc_feature (452)..(452): n is a, c, g, or t
  misc_feature (455)..(455): n is a, c, g, or t
  misc_feature (463)..(463): n is a, c, g, or t
  misc_feature (478)..(480): n is a, c, g, or t
  misc_feature (482)..(483): n is a, c, g, or t
  misc_feature (486)..(487): n is a, c, g, or t
  misc_feature (495)..(495): n is a, c, g, or t
  misc_feature (519)..(519): n is a, c, g, or t
  misc_feature (573)..(573): n is a, c, g, or t
  misc_feature (579)..(579): n is a, c, g, or t
  misc_feature (581)..(581): n is a, c, g, or t
  misc_feature (620)..(620): n is a, c, g, or t
  misc_feature (626)..(626): n is a, c, g, or t
  misc_feature (628)..(628): n is a, c, g, or t
  misc_feature (630)..(630): n is a, c, g, or t
  misc_feature (633)..(633): n is a, c, g, or t
  misc_feature (635)..(635): n is a, c, g, or t
  misc_feature (637)..(637): n is a, c, g, or t
  misc_feature (640)..(640): n is a, c, g, or t
  misc_feature (655)..(655): n is a, c, g, or t
  misc_feature (658)..(658): n is a, c, g, or t
  misc_feature (660)..(660): n is a, c, g, or t
  misc_feature (692)..(692): n is a, c, g, or t
  misc_feature (807)..(807): n is a, c, g, or t
tnttaatttgacattcttaattttttntnnaagnncttggtatatatgcctttatttgaagcaaacctacaggtgtttcttaatatgacagaatcatgaagacttgcagttaatcagtgtttcctaatgattaaaacaatgttcaaataattacaaagttacttcatcaaaatacttagaagaatattctgaggagtgtttgaaancactgtttataaatagtgattganacatttatcatgtatttngtgctgaagataaacactttttacataaaacattgttttaatatactgctctactaatgccgctagtnattagatatactgtattttnncactaaagantaaagctttatcttcgtatttntcttatttataggnctcttatcaatgnnganctttgtntccaacantaataaactggcaaattgnaagtnacgttttntnggngangcaaaaangactggctgcgacgnnngnnagnngataactncattatacatgcttcgtacaaacngtccattctgaatggtacaattaaatgcagtccaaatccttttaaatgtttgtntgcctngntggcaattacaatctccagcacactaaaaagaaaaagancaatancncngancncngtnttcttaatgattatngcncntttaacaccttcagccatccactgggttttcngatcatattggcaactgaaatttcacatccacatgtgcttgcttcgctaaggtcactatttcagagagctttacaaccattctagcagcttcatccaagtcatcacaagcaagtnttttaagtccactgtccgctatcagtgccttagcatcatcgactcgtgtaccttgtaaccgtaccacaacaggtattttaatttccaagtcttttactgcca

SEQ ID NO: 569372 - DNA, 181 bp, Homo sapiens
ttgcccccaccccagtattcgcctagtttcccaagttgtggtttaggggaaagttggcttcctgcctttttcctttaaaatagcaagtttgggaaatcctggggtgagtggggtcaccccattcccagtttttggcagggattggggttaaagcattacttaataaacccccccggcccca

SEQ ID NO: 569373 - DNA, 283 bp, Homo sapiens
cggtagacctccagatatttatttcatataactgaaacttggtaccctttaaccaacacctccccattaccgtctcccctaacgcctggcaaccaccattctactctgtgcttcatgtgtttgcctatttagattccacatgtaagtgagatcacgtagcatgtgtctttctgtgtctggcttatttcatgtagcataaagttctgcaggaccatccatgttgttgtaattggcaggatttccatctttctaagggctgagtagtacagttagctttcgcatc

SEQ ID NO: 569374 - DNA, 892 bp, Homo sapiens
cccacgcgtgcggtccggagtaggttcgctggtggtgggttcttggtctcgcgacttcaggaatgaagccgcagaccttcgctgtgagtgttacagctcttaaagatggtgtgtccggagtttcttccttccagtgggttcgtggtctcgctgacttcaagaatgaagccgcagaccttcacagcaagtgttaccagctcttaaaggtggtgcggacccaaagagtgagcagcagcaagatttatggtgaagaccgaaagaacaaagcttccacagtgtggaagggggacctgagcgggttgccactgctggctagggtggccagcttttattcccttattgtccctgcccatgtctgctgatggtccattttacagagtgctgatcggtgcgtttttacagagtgctgattggtgcatttacaatccgtgtagctagacacagagcgctgattggtgcgtttttacagaatgctgattggtgcatttacaaatcctctagctagacacagagcgctgatgggtgcaagtatccacccgaccagaagcccagctgggcttcacctcccactagtatcttctttgttaatgtggtataggtgtatctaggatacacgtatagtagcttgtaagttccctgatacctgggaaagcatttcatttgctccccagctggggagcatccacaagtagaaccaatgactgggtcatgcaagtgggttaagtgggttctatcattacagggcaaagttctccctggtggactgagaaatacttattataaagttctatgacactagactagcttcaagtgtcacagtttgggtgtcaacagtgtttttgcccaagaaacccagataactttaatgaaagagacctacacaagggggcaa

SEQ ID NO: 569375 - DNA, 317 bp, Homo sapiens
gtcccttgggcgtgcttgttgccaggctggagtgcaatggcgtgatctcagctcaccgcagcctctgcctcccgggttcaagcaattctcctgcctcagcctcccgagtagctgggattacagatatgcgccaccatacccagctaattttgtgtttttagtagagacgaggtttcaccatgttggtcaggctggtcttgaactcccgacctcaggtgatccgcctgcttctgcctcccaaagtactgagattacaggagtgagctaccgcacctggcccctcctacatcttttatctcacaacaagcactccaaca

SEQ ID NO: 569376 - DNA, 215 bp, Homo sapiens
  misc_feature (12)..(12): n is a, c, g, or t
  misc_feature (39)..(39): n is a, c, g, or t
  misc_feature (153)..(153): n is a, c, g, or t
cagatccaaatnaaagtagggtctcaagtaacccaaggntggccgggtacggtggctcacgcctgtggtcctagcagtttgggaggcagaggtgggcggattgcctgagctcaggagtttgagaccagcctgggcaacatggtgaaccctgtntctactgaaatgcaaaagaaattagccaggtgtggcggcatacccctgtggtcacggctgct

SEQ ID NO: 569377 - DNA, 217 bp, Homo sapiens
  misc_feature (179)..(179): n is a, c, g, or t
taattgagctgctacgattagcggtcaccgttggggatatcagtccagagtggagaaccacctcccaacggtgacgggagaccctgtccctcacctgcgcagtttatggtgaacgattcaatggatacttcttgatatggattcgccagacaccacgcgggtgcgcctgtgagtggatntggggatatcatgtccgcagtggcagaaacctacctcc

SEQ ID NO: 569378 - DNA, 109 bp, Homo sapiens
aagttgacaagcgccggttgtactagcatccagccgcttagcccgacctgtcttcttcttcttcttctcctgttatggccaccttaggagtctgacctctcacttttcc

SEQ ID NO: 569379 - DNA, 422 bp, Homo sapiens
  misc_feature (12)..(12): n is a, c, g, or t
gcaaagggaggntgacttgagaccagcaacatagggagaccccatcactacaaaaaaagaaaaaaattaactattttagtctatttgtgtcaatcctatgttttatattaattattggatatgtaatatgtatctgattaaacataacactgtaacaactaagatataacagtactcggccttgaggctccaagatggccaaataggaacagctccagtctacagctccctgcatgagcaatgcagaagatgggtgatttctgcatttccaactgaggtaccaggttcatctcactggggcttggcagacagtgggtgcagcccatggagcagggcggggcattgcctcacttgggaagtgcaaggggtcggggaattccctttcctagtcaagggaagccgtgaaagatggtatctggaaa

SEQ ID NO: 569380 - DNA, 437 bp, Homo sapiens
tagctggtcttggagatgaggtccactgaatacgctcactttttcgaagtctttggcatggtactctctagtctcactcagccaattgggtaggcgcgctggcctgaggccctatcaccgccgcgactatggggtagcgttccagggcaggccgcacctcactcatgtacatgaacatgtgcgacgggagaagaatgcatgaatgtcatcagtgtcaaaaagccttcaccacgagcgcgtccctcgtcacggcacaggtagatatccacagcggggagaagccttacgagtgcagtgactgcggtaaagccttcaacgagccttcagcccttaggagccacgcaagaactcatctcaaagagaagccctttgactgcagtcagtgtggaaatgcattccgtatcctctcggacctgaatatccacatgcgagttcac

SEQ ID NO: 569381 - DNA, 301 bp, Homo sapiens
  misc_feature (26)..(26): n is a, c, g, or t
tccgtgattcaattcctccaccctgnggtccctcccataacatgtgggaattctgggagatagaattcaagctgagatttgggtgtggtcacagccaaaccatatcaccaaatatggagagactgtggatcaacaagatcatctcaaactaatacaggaggtgagagtttaaattagaacaaccactttggaaagcaatttggattatcttataagtttgagcattctcatatgttatggcaaagtaattcctctaccataggccctggagaaactcttgcccatatgtaccagaggtagt

SEQ ID NO: 569382 - DNA, 795 bp, Homo sapiens
  misc_feature (21)..(21): n is a, c, g, or t
  misc_feature (39)..(39): n is a, c, g, or t
  misc_feature (56)..(56): n is a, c, g, or t
  misc_feature (58)..(58): n is a, c, g, or t
  misc_feature (60)..(60): n is a, c, g, or t
  misc_feature (125)..(125): n is a, c, g, or t
  misc_feature (133)..(133): n is a, c, g, or t
  misc_feature (147)..(147): n is a, c, g, or t
  misc_feature (265)..(266): n is a, c, g, or t
  misc_feature (268)..(268): n is a, c, g, or t
  misc_feature (270)..(270): n is a, c, g, or t
  misc_feature (274)..(274): n is a, c, g, or t
  misc_feature (279)..(279): n is a, c, g, or t
  misc_feature (284)..(284): n is a, c, g, or t
  misc_feature (287)..(287): n is a, c, g, or t
ggcctcccgcacgccccgcangtagcgccccgcccgcgnccagagtgcgctcgccngnancagctcccggataaacggcgcgcgcggagatgacagccgaggagatgaaggcgacgaagcgggcncagtcggnccgctgcccatggngggagtggacatcagccccaaacaggacgaaggcgtgctgaaggtcatcaagagagagggcacaggtacagagatgcccatgattggggaccgagtctttgtccactacactggctgnntntnagtngcacnaagtntgnctccagtctgggatcgcagggacaaatttctcctattgacctgtggaacaaggggaggtcactcaaggcttgggacattggccatagccacccatgaaggtgggggaaggtggtgccacatcacacctgccaaaccagaatatgcctaccggttcaagccaggacagtcctccaaagattccccccaaatgccacgcttgtataatgaggtgcgagcttgtactgagttcaacgggagaacgatcgtgccgcggaacgaggaagatggggggaaatcatttcgcagaacataaccagacttcgcgggtagaagggctatgctaagccccaatgaggggtgctactcgtggcaggttgcacttggacagggtactacaaaggcacaagctctttgaacacgcgggagctccggtttgcacatagggagggggagaccctgggattgctccatggtctggcgaggccctcagcgcttggcgacagggaacatacgtgggtactaaggacc

SEQ ID NO: 569383 - DNA, 179 bp, Homo sapiens
tgtcggtaccgtcactgtcgataagagtgatagtctttaaaaaaaatacagcatcatgtctggtttatggtattgataatactgaagattcatgattataaagagccaaggtttttaacacaactgtaatttcattcttcaattttagtcctttttttttcaattccattttatttctt

SEQ ID NO: 569384 - DNA, 228 bp, Homo sapiens
caggcatgcactttgtatactggccggcgttgacaacgtgcgtggctgcaagcccgcttttcgcagtactttgggaccgctgaggcgtacggatcacctgaggtcgggagtttgagaccagcctgaccaacatgaagacaccctgtctctactgaaaatacaaaattaactgggcgtgttggtgcatgcctgtaatcccagtcctcaggagtctgcaggcagtctgga

SEQ ID NO: 569385 - DNA, 879 bp, Homo sapiens
  misc_feature (74)..(75): n is a, c, g, or t
  misc_feature (93)..(93): n is a, c, g, or t
  misc_feature (115)..(115): n is a, c, g, or t
  misc_feature (160)..(160): n is a, c, g, or t
  misc_feature (167)..(167): n is a, c, g, or t
  misc_feature (169)..(169): n is a, c, g, or t
  misc_feature (176)..(176): n is a, c, g, or t
  misc_feature (181)..(181): n is a, c, g, or t
  misc_feature (185)..(185): n is a, c, g, or t
  misc_feature (198)..(198): n is a, c, g, or t
  misc_feature (205)..(207): n is a, c, g, or t
  misc_feature (209)..(209): n is a, c, g, or t
  misc_feature (222)..(225): n is a, c, g, or t
  misc_feature (252)..(254): n is a, c, g, or t
  misc_feature (266)..(266): n is a, c, g, or t
  misc_feature (273)..(273): n is a, c, g, or t
  misc_feature (288)..(288): n is a, c, g, or t
  misc_feature (301)..(301): n is a, c, g, or t
tgaatacacatctctgtcagtgtgaaaattcagcggcagtgtgtccatcatattaaaaatatacaagctacagnngtccagatcactgaattngaacttttctcctgcatgtgtntatatgtcaaattgtcagcatgacaaaagtgacagatgttatttngtatttnanaaaacanttggntgtntataaagtttttnatttctnnngngcagatcactttnnnnactcacataggtaggtatcttatagtnnntagactatggantgtcagngttcagccaaacagnatgatggaacagngaaagtcaattcagtgatggcaacactgaaggaacagttaccctgttgtgccctcaaaagtgtcatcaattgtaatttagtataactctgtaaaagtgtctgtaggtacgataatatatataaggacaagaccaaaaatcaactataaagcttaaaaattgtgggaaaggggggattagtacaagcacattggttacagtaatgaactgattttattaactggttttggccatataaaatgctgatattaatgaactagccaagtttcacggatatgacttacagggaccagagtgatacttgcacgaaatataatgtgccggcactcgggggtgttcctgacaaacgggtgtctccaaaattatttactttacctttaaagaaatcgagggtcccctgcagtggggcttgggacacgaggtgggacacaaggcgagtccaaaggcaaaatgtggccctctgagggagtattgtcacatccggcacacagtaagataacactgcttgtaaccacctgtgcaattgcgcaattgccaaccacaaaaattggtcgaccgtgttcaccagaaacacaaatg

SEQ ID NO: 569386 - DNA, 404 bp, Homo sapiens
tgcaggaattcggcacgagatgagagagatagtgatagataaaaattaattcaagaaattatgggggatgaacttaatgattgatatgtaaaccctattgattgagtaatggtagatctagcctacctagtctaaaatgatgattaatccttaaaatgttctttaagtactcaactatatgagagcattttaattatgcttattagattaacaagtttaagtgagaaatacaggtgttatctatttataatatcaaagttaatattgactttcgaatagcatgaaacagatggggaaatatgccattttctaatgtagatgctaatatcttatctgtatgagttcattgaattctatggttaaatcttattttgtatttaattaaattatctttccatatggtc

SEQ ID NO: 569387 - DNA, 423 bp, Homo sapiens
ttcatcagcaaaccttaattgaattcaatacacaagttcaaatacttttcttcacaggtcattcttttatatacataatattattaacatatcatacccactttcaataagtttcttaaaacctctacaaaaattgtagttaacacttacggaacttacttgttgcactaaactaaaagcacattctaatattttacactctccaatgatactcaaatagctcacaaattttctttgattaaattctaacgcttttccacaaaaggtttaaattcttccaactcttatggcaaaacattcattatagatctacaaacgcacagcacttctctagagtggttggggatgtcttggcaaatatcaaacacacccgccatatatattcaggatgccttgataaatatatttccttgatcacacatt

SEQ ID NO: 569388 - DNA, 465 bp, Homo sapiens
  misc_feature (155)..(155): n is a, c, g, or t
  misc_feature (168)..(168): n is a, c, g, or t
  misc_feature (207)..(207): n is a, c, g, or t
  misc_feature (228)..(228): n is a, c, g, or t
  misc_feature (269)..(269): n is a, c, g, or t
  misc_feature (292)..(292): n is a, c, g, or t
  misc_feature (338)..(338): n is a, c, g, or t
  misc_feature (347)..(347): n is a, c, g, or t
  misc_feature (355)..(355): n is a, c, g, or t
  misc_feature (404)..(404): n is a, c, g, or t
  misc_feature (448)..(448): n is a, c, g, or t
gctacatttcctaatcaagaagttggcgtgcagctgggagagctagactaagttggtcatgatgcagaagctactcaaatgcagtcggcttgtcctggctcttgccctcatcctggttctggaatcctcagttcaagttatcctacgcggagaanccaggtaccaatnggtgcgctgcaatccagacagtaattctgcaaaatgccntgaagaagaccaatgtttcgnactacttccagtgaatccaaccaagatccccgtctgaggantgacctttttccaaagacgagantccaggacttgaatcgtaacttcccactttctgaggatatctggantaaggttcngctccggntccgctctggatcaggatttgggatggcttctaacggaaatggacaggntaccactagtagacgaaatggatgctttccatgacaccttaggnctcttgacggttgcctc

SEQ ID NO: 569389 - DNA, 988 bp, Homo sapiens
aggatgcgcggtgtggggctctgaagcatggagggggtgttgtcaccaagtggaccaactatctcacaggctggcagcctcgttggtttgttttagcataatggaatcttatcctactatgattccacaagcatgcatgtttgccaacagggcagcacacaggcacagccatcacacagcatggccagttttgtgccacacattcacacagttccattccagccagcacaaccaccaagcacattggcacattcaatccattccatgtgcagcagccagccattttctcaccattgcaagtgccatgttgcacattgccatgcttgcacacagccacagcagtgttggcttggtctgcatcttgtgggtgcagctctccaaacagccattgttatgcacttggatcacaagggcactcaacacaacagcaacacaagcaacatcaatgttgacacagccgagtgcaatcgcgtgcaacacacccaacaatggtctgcacactttctggccctcttcacttgtggaacctctttcaaattgccaggcacaagttccatattgcatccactgcgacattttgtatccaaccaatgcatgacggacactctactttcaattctccttcgttgccagcagaaacaattgacatgcaaggcctcctttctcttgcgtttaggtggcccaacgttgttacgaccattgccttccaacacacgacttggccggacattggtggtgccagcattagccacatggccacaggtcttaaacgctggagcattggtttccaagtcggcagccaattcgggcaatacccatatacgttatgcctcacttggttggtcacacatatcatacctgtggttcagaatgactcgcaaggcgatctgggcaaagcaaccattgggttcgtatgcacggatcaacacagggaatacggcaacgtataatattgagcaccctgtcagcattaaccttaacccgaacc

SEQ ID NO: 569390 - DNA, 788 bp, Homo sapiens
agcggataaggaaaggaacctcctccctggctgggatggctgccctgggcgcgggaggagggccggggacccggtgagggaggaccgtaggggcccgtgggggcttcactgcctgtgcagtgctgtgactggctaggcctccctccctgtacatggagagtaacctgtctggcctggtgcctgctgccgggctggtgcctgctgctgcaactgctgtgaccctggtggctgacagcatgcctacacacaccctgtatgccctgcatcttcttctccgtcatatgcccagactctggctggtgcattctgtatgggcacaagcgtctcagcatatcagacaggatgtatccctgtgccctctgtctgcctctggagccgacctatgcgatacacaaccgtcttctccgttcatacattccgaagatactcccccgaagacaaaagcgacatggaggccctttgccactttctgggcttactcatacatgcatgcacccgatacttgccattgcaagattcctttcaacacttgcaccgccttcatgcaacctcgtacattttgacccagggtgggtgatacacaaggacaaacggtgcacgcagatcgaggacagaggagcaatgaacaccacgagggccatcggcattcagcgtggtcccgacaagggcgcccattaacgacagaaagaggccatcagactggacaaccacaccctggatgggatgaaacagtcggaaagtagaggcctcgcggcacctcagcccataaggacacccggcgagacaaa

SEQ ID NO: 569391 - DNA, 350 bp, Homo sapiens
taggagtgattttttaaattttaaattaaaatttgtttttttgagacagagtctcactctgttgcccaggcaggagtgcagtggcatggttttggcttactgcagcctccatctcctgtgttcaaacaattctcatgcctcagcctcctgagtaactaggactacaggtgcacaccaccacacccagctagtttttgtatttatagagatggggtttcatcatgtttggccacgctcggtcttgtaactcctattctcaagcattccacccaccttggggcttccaaattgctgggattacagacgtgagctaccatgcctggcccaattttaattttttagagaaagaa

SEQ ID NO: 569392 - DNA, 157 bp, Homo sapiens
gcgcggaaggtatctggaagccactcagcaccactaccacaccctgaaggatcttccccagctcctctgggccagcgcggggtcgtctgggctcggtgccttctccgtcggggttttgcctgtcacgtgcccgcctgtgctcgcggcaagtggactg

SEQ ID NO: 569393 - DNA, 404 bp, Homo sapiens
tctctccctgacatcattaaaaaaaaaaaaaagggacagagcgactatatttaagtctgtaaaacgacttttaatagcaccaaatagaatgaacagctggcttgctttttgcaagggtgcattgatgtcgtcagaagaaactaaataaaaatgctgatacagttgtccaggttggggtttggccagcacaagaatattttattcattcagccttctctaagttcaaaagattggtgttgactttgatgaaaagatacaatgatacatttttagaatgaccgacctttcacatttaaatcttaaaattgtgctgctgcagctggatttttctcagggatgccattcaaacaaaatgttacattgtcatctcatatagcttttctatctgtaatgataggatgtta

SEQ ID NO: 569394 - DNA, 224 bp, Homo sapiens
gcttatctctgatctgctcataagtctgtgggtcagtatgcactcaggtgcgtctccagactccaggtttctagttgccatttggttcactcaggataccacctgaaagcccaaacacttcctgaagaagtccccttcccatgggggaggtaagaagctcccagatgagggcgaaacagtacgtgatgattcttcaaggcttccgcgccccggattcataccct

SEQ ID NO: 569395 - DNA, 812 bp, Homo sapiens
gatgttcgattagacacatgcgtgcgcacgtgaaccgttgcaggcctcgacagatagcacctatccgcgcgccagtcctcaaatcccggaaggtgtgtatcgtgagcgataatgccggagagacaagatgagatcacgtggtggaacgaatggggcattatctacttgaaagaatcgggtgtaatgctgggagacttccgtgtgagtgtggcataggctggtttggctgacaggaaattgtactttaatacgaagtgatttaagtcataatggagatgcgtaatgtgtagtgacctgagatattgtctagcatttagtttaacgaggagcatgttgctgtcagaagagcaatcgttgtcgatgggtacagcatccggttaagagactgtgaaagtcaccgtgctgattctactttcgagaaccagggtgacgaacgtccggcttcgatgttagtaccagcgtgggacgctgcttccgtcgaagggtgggaagatatgaatcgtctgatcgccgtgtggactggttggatacagaggtcagggtcatcgctgccataaaggtgcatgctcagtataaaatgtattatcacaaaaaaaaacacagtggggagcgcacaaggccttctggaaagttttggcaccccaaaagttgggaacagcggcccatggggcccggggaccggtgggaacggccccgggaaaccgggggccagagaagcgtggatctcccagggtggaaacccccggggaaacagggcggggaacaccgttggacacaccgaggggggcgggaacgggcaacacgatcagcag

SEQ ID NO: 569396 - DNA, 209 bp, Homo sapiens
ctacaccgctgcagagcactcagaaagagtctgagtgagtgtgggctcccgtggtcctcgcgccggaatggcctggagatcctcatacaaggccatgtgcaggcaattgcagaggtcgagacgtatgctgacgttctgacaccacgccttcacccaaaaggccaatctcaacaagcaccagcacaatcagcaccagcacgaattccctt

SEQ ID NO: 569397 - DNA, 953 bp, Homo sapiens
cgttccccccctgctctgggggccccggcccggggcctcggccttttggtgctgctgctgctcggcctggtttcgtccgcccccccgctctggcgcgcggccgtaaaagggccccgcggcctaatgcgcagcttctccagccttgggctgagtactggcgcttcctcgccgcttccggcggtcagtgccccgatgcttacgacggccgggggacggtgcaggagctgggccgcgggcgctggcgcatctgctggaggccgaacgtcaggagcgggcgtggccgagggcgcaggaggctgaggattcagcaggcgcgcgtccgtggctgcagactagcttgcagcgatctaggggcagccaccccgcaactcatgatcctggctctgggcctggagcgacgaccccgacgcagcctgacagcagcagcttcgctcgcgctcgtgactccgcgcccgccttgaccctgccgccctagcagcccagcgtttgtccccacgcgcccgtaccccagccgcggcgctccagacccaccggcgccaccaggtctacagacgacggccaccgacgggccacggatgcttgagagaggcaggcgatcgagacacccagacagtggacccccgagcatgttgaggtacttgctggggacggatatcttgcgggaagcagcaggactcctgacgggggtggcagcccccgcaccgctccgccgtgccgctcgaccacgatgtgggctctgagctgcctcctgagggcgtgctgggggcgctgctgcgtgtgaaacgcctagagaccccggcgccccaggtgcctgcacgccgcctcttgccaacctgagcactgcccggatcccgtgcacctgggacccagaagtgccccgccatcccgccaccaggactgctccccgccagcacgtccagagcaacgtaactacgccaggggccctctcaccc

SEQ ID NO: 569398 - DNA, 393 bp, Homo sapiens
cttttggggtctttgctgggtttccacccctgatcaggggcctctcagggacacatgtgctatgcccggcatgcaccctggcatgaagccgggtatgaagacaacctgggccatcaggctgtctcctgccacctccggtaccactgcacagtgctgatggggaccgcgagggctctgccgtttcccacacgaacagccactcatgctcatggaaaaggcatggagcaaaggcagtctgtgaacagtgccctgtgccagcatcctccctcccatagcaactggggccagagccctcaccatgctgccaaatggatgacctgcccggctcacattgcaaccagaggggccatcacctggcagacagccagctatccatgacaccacagtgtcctg

SEQ ID NO: 569399 - DNA, 124 bp, Homo sapiens
cgcactgttcttcaagatgctcggggtctgaagactgtcttcctatctgcttcttgcggctgaggagaggagccgttcagctttacaaaacaagtgcgaattaccaaactcaagagcttatttt

SEQ ID NO: 569400 - DNA, 409 bp, Homo sapiens
tatgatataaaaaaaaggcctacaaattcaggaatcattatagccaggtgcagaggtacatgcctgtagtcccacctagttggaaggtagaaggcaggaggataggttgagtccaggagtaagaggctatagtgtgttgactatatctgtgaatagccactgcactccagcctgtgccaagcatcttcaaacaaccagattcgtcatctcactgtttctagagggtcagatatccagtacacagcgtagctgtaagactggctcagggtctctcgtgaggctgcacgccaacagtgacatgtcacctgaaggcttgactggctgtagggtccacattctgagctcacctacatggctgttggctggaggcctcagatacctcacctctcaatcgggctgctaaggatat

SEQ ID NO: 569401 - DNA, 392 bp, Homo sapiens
  misc_feature (156)..(156): n is a, c, g, or t
tgatgtgcaggacctgctgcttgccggaagcctttgctggcagactgcatggagtgttacagcagactgggaacacctcagccccttcagcacagcaggagcttaacctcaaggggccagagaaaaaaggctgtgggcctggtcccaggtccccanggttagagcacacagcctaggaatgctaagctgagccttggccccctgcaatcatccagacatgaagccaatcaatttatacccagcttataccactgtcaaaccctcaagggcatcaaagaatgtaaaaagcaaaaagccctatatgaaggacagcaactttaaagattaaagaaacatcatctcacacagatgagaaagaaccagtgcaaaaatctggcaattcaaaaagccag

SEQ ID NO: 569402 - DNA, 289 bp, Homo sapiens
ctactacataagggatcaagtgtcacatatgcaattttaaattttctagtagccgtattttaaaaagtcaaacagttaaaattaattgtaataatacattttatttaacccaatatatctaaaatatcatctcaacatataatcaacttttaagattattgagatactattctttcatacttgaaatctggtatgtattttattcttataatacatctgatttaaaactattacatttcaggtgctcagtagccacatgggtgttggatgcacaagtctgtaggatgaa

SEQ ID NO: 569403 - DNA, 1456 bp, Homo sapiens
  misc_feature (287)..(287): n is a, c, g, or t
ggacaagcgacatttcatgcatccttttcacccgccgtggaaccccgggagctcgtgggcccgcgtctagccggcctgttagcatggaccaatggccgtgtaccaatggtgcgggaatcctccgcgtataagctggacggcaaccgcaatctggaccgtgagacctctagccgaaccttgaattgtaggtcgcctgcgctgcaaggatgctggcgtgaccgcattctcacagagggccccaccactcgcgtgggactcgtgctcttgttacatagaacctgatctanactctagccgttctggcatttcttgttggaccttcaccgacacctgtgatgtaatgtcttagaaccgtgtagtgtaagtaacatatgactagcactcaggctggccatgcagcatcttctgggccgttactggatacaaaccctacgcagtgcaaccatggtagtcatcgctcaacaacaatgactggatcaccgtatgtccgtgctcacggcatttgcatcacgactcaaatgacagcctggaacgttggatattggcacgcttgcatatgggagtaaagcgcactctcatgggagttccgtgttgcctggaccatacggttgagtccaggctgcactgcctctgggactgacgaatgccacgcttgttaaccttaggtgttgcaatagcaacgggtgtttaccacgtgatcatttgaacgtgtcccggtgtcacgcgtcattgcatccagggaagccggagcaagcaagtgcccagtcggggcgcgccttgagaccaggttagcaaagcggtagaacgcgtcacgtacgcaaggtaactcgtgtgggaagggcctccaggccacattacgaaggacatcaaagggacaccgggctccaaggaaaggcagggtgaaaacattgggcgagataccgcggtcgggaagcaaacttgcggcggcaccacaatggtatggggcaggacaagcacagagccagaaacatgcgacaaggtttcttgagactagtccccatacaacaagagatgtaggcccccgcaagtcgcgaaacggggcggaacacagtgcaggacaccttgtgcagaacgggtgtgcccactcagggacacacgaggccgcccggaaagaaggccccaagaaggctacgtttgatctcgccgtgttatccacacggcgaaaaaaccacctcgtaattacaccaagtgactgggggaacaaagatatctactcggagagacggtgaaccggcaacaaacaagcaaggagtgagtgtcgcgtacatcagtcggtaacaataaggccgcgtagcgagtgagaagcagcaccgaacgtaataatgagacatttagcacgtaaaacagtttactctatacttcacagcagttatataactaagactcagatctcaaataatttatatcatttagagacgccgtgtcagttataaca

SEQ ID NO: 569404 - DNA, 389 bp, Homo sapiens
  misc_feature (380)..(380): n is a, c, g, or t
taagcactttctcaggatgggtcgaggcattccctaccaggatagagaaagcccaagaagtaaccagactgttgctaaaagacattattcctaggtttggactgcctctaactttaggatcagataatggcccagcattcatggctgaagtagttcagcagctgtcgcagctgctaaagactaagtggaaactgcacatagtctaccacccacagagctcaggaaaggtacaatggatgaaccagacactaaaacatctgctgaagttttgtcaagaacctcatcttaggtgggatcaggtcttgcccatggcctttctccaagtcaggtgtacccttaccaaattgactgggctttcaccctgtgaaattgtgctcggngggcgcaag

SEQ ID NO: 569405 - DNA, 117 bp, Homo sapiens
gggcaagccatcccttgcttctcggggctgacgccaccgttgtgtccaagcccaccctcccctgcttcctcagcagaaccccttcatctgttaaccttacctgtcctcagaaaagaa

SEQ ID NO: 569406 - DNA, 354 bp, Homo sapiens
agtcatagaaaaaaacggtgatcgcgaatgtatcttagagaagaagttaccttttatcttacacttctccgattcgcaaaagcatgtttgtttctaataaataagctaccttccatagatcagctttctttacagatcatgggtggggaggcagtgcgacagcatattttgtcatgtagcattcatggttggcatcaattaaacaagatagactcatccagtaattgtttctgttgttttcatcttccatcaccttcctacaaatttgctcatcattcccaggtcactttatttacagagagtaggtggggaggagttgtgcagcacattttatatgtagattatggttggcat

SEQ ID NO: 569407 - DNA, 997 bp, Homo sapiens
acgaggatgtgcaaagattatctaagcagcaaagcattcaagatgtggccttctgctactaacagcctgtgctcagatgtgggggcaaatgaatgacttaaatttggaacttacatttaaacaggaagcagagcctaaaagttgggaaattttgcagcctagccaggtggtaaaaaaaaaaaccattttctccaaggaattcaagcaggctgtggagcaaccacttgctgatatttgcataactgaaagggatccaagtggtaatatccaatgacaagtggggaaaaggcctcaaaggcatttcagagacctatggggcagcccctcctgtcataggccctgaagccaaggaagactgaatattttcctgggctgagcccaggccctgttgccctgtgcagcctcagaacactgctccctgccatccagatggctccaactccagcaggggctcaaaggggcctaggtacagcttgggctgttactttggagggcataagccatagccttcacagcttccattaggtggtaagcctgcaggcacacagaatgcaaaaatggtgaattcttggtagcctctgcctggatttcagaggatgtatggaaaagcctgggtgtccaagccagaaccctgctgcaggagcagagccctcacagagagcctctatagggcagcgtgaggtggaactgtgggttaaaggcccacgcaaagtcctactggggcatgcctagtggagctgtggagaagaggtactgtacccagaatgggagagccactggcagttgtaccccgcctcttgaaagagcccgactaaccagttggtgatgaggggtctggagtttggagactgcaagctgggacaactataagtggcaaggacaggtctgggagtctagtatgacccgggataatgtggctacccttagtacaatgataccctgctatgaaagcaaagacagaataaaacagatagcccttgagaggcaccgagagaat

SEQ ID NO: 569408 - DNA, 770 bp, Homo sapiens
  misc_feature (2)..(2): n is a, c, g, or t
  misc_feature (70)..(70): n is a, c, g, or t
  misc_feature (269)..(269): n is a, c, g, or t
  misc_feature (322)..(322): n is a, c, g, or t
  misc_feature (361)..(361): n is a, c, g, or t
  misc_feature (370)..(370): n is a, c, g, or t
  misc_feature (383)..(383): n is a, c, g, or t
  misc_feature (392)..(392): n is a, c, g, or t
  misc_feature (407)..(411): n is a, c, g, or t
  misc_feature (434)..(434): n is a, c, g, or t
  misc_feature (442)..(442): n is a, c, g, or t
  misc_feature (446)..(446): n is a, c, g, or t
  misc_feature (461)..(461): n is a, c, g, or t
  misc_feature (473)..(473): n is a, c, g, or t
  misc_feature (503)..(505): n is a, c, g, or t
  misc_feature (521)..(521): n is a, c, g, or t
  misc_feature (553)..(554): n is a, c, g, or t
  misc_feature (572)..(572): n is a, c, g, or t
  misc_feature (584)..(584): n is a, c, g, or t
  misc_feature (596)..(596): n is a, c, g, or t
  misc_feature (601)..(601): n is a, c, g, or t
  misc_feature (604)..(604): n is a, c, g, or t
  misc_feature (606)..(606): n is a, c, g, or t
  misc_feature (610)..(610): n is a, c, g, or t
  misc_feature (613)..(613): n is a, c, g, or t
  misc_feature (759)..(759): n is a, c, g, or t
gngggttaggtcagcatggtggtggggggtacagttcatattccactcatactgtacaccagtaaaagcnaatattcaaagggttctctaagtttcaagattaaaaaccataatgccttgactgaatatcatgattacaaaacaggtattaagaactgtgaaggtatatgctcacaacatatcccttctcccattctcactttattccaaaatctcatttatttcactgacaatttgtttatactttcaaaaatccttttataattttnatagatataactcaaaatgactgcttgggtctttaaaaaattaacagattaanaagcaatacaagtgcacttaacactgatcaaagtctganatgccaaanagcaaaataaaantcctctganatatatatgtatttnnnnntatagaaaaactccaccaatagnagaaacanagtntgtttaatggttgcnttgggaaggggnggtgggcacctcatgccagggagatttacnnntgagacttttcaagcnagcactgcctatagcatagtctcatatcttgnnaatttaaacctaattttnattatatatacngggccggtttgncgggntcncncccnccngtgaaaaactggtaatctgtttacaaagtgcagcgtcagtacagcaaactcatctcaacaaaagattatgtgtggtttctcgggctttaaaactcccctggtttccatttaaatgctttaacattgtgtcatcctgcatacatganaagcctgtgta

SEQ ID NO: 569409 - DNA, 231 bp, Homo sapiens
ccaggtagattcacggcgattccataacacttataagtatacaaaatatatataaagacaggttctcaaactcaagatacaatatggcaagtggtcaccaaagtcttgtatatggttagcaaaacacaaatccagagtataaaatctatctgaaattatctaagccaacatcaaattatttaaatatgactcagctagtataaagagaaaattaaaatcttccttacatac

SEQ ID NO: 569410 - DNA, 491 bp, Homo sapiens
ggacagggagatcatgcaggtttgatatagaaatcggttcttatttctaatatattaagtgcttgctgtaaatttcataatccagaacgattgttctagtggtccctggatctaggagataagcacgccactgacttgctctccttggttgtccatgaaggccaccctatgaataacaacaaacccttgatttctttagtccacgtgtgtgtgtctgtgtctgtgttgtactgtcttgcgtgcatttcggtcctcacctgatgaagacaagtgagacactctgtctactctgtgggtacaaggtgtctcagagttgatgaaatgcatctgtgcttttccttgatcatctttgatgttcaaaacggtatgagaatcttcgtctagttgacaattatgtaaactaagcttcataacagtttagtgatttgcctaagttctcctagttagtaaagattggaaccaagtactggggtaaacttgaattatcgtga

SEQ ID NO: 569411 - DNA, 371 bp, Homo sapiens
ttaaaaaaaacaactgctggccaggcctggtggctcacgcctgtaatcccagcactttgggaggctgaggcgggcggatcacctgaggtcagcagcctgaccaacatggagaaaccccgtctccactaagaatgcaacattggccgggcatggtggcgcatgcctgtggttttagctgctcaggctgaggaagaagaagtggtagaaccccggcagtgagccgagatcacgccattgcactccagcctgggcaataagagtgaaaatctgtctcaaaaaaaagaattgctttatggaagaaagtaagtatacacagggagaaagggatttgatgacccttggagtccccggcatcctgagaaccttccaga

SEQ ID NO: 569412 - DNA, 138 bp, Homo sapiens
ccttgctccacatattcctattcatctctccagttatcctactctagatatcatctcatgctgataccacttcaacagtatctatgtctccctacattaccaaatcccagtgtcatttcattcagattacaatagggc

SEQ ID NO: 569413 - DNA, 1621 bp, Homo sapiens
  misc_feature (131)..(131): n is a, c, g, or t
  misc_feature (136)..(136): n is a, c, g, or t
cgtctgccacgtatagtctctgagatttgtcattctgctctccacaacgagagtctgagacgagatgcatggatccagggagcactctgcttggcagcccatcccgcacctgccacttcgcgcagtaagcncgtgntacacgtcgtatggagaatcgtcctgggtacacattcgttcttacgagatcaatcttgccttggactttctggtggacctggtccaagcatgctgttgcttagtagcgtatatagcttcgcatgtgcctatgcgcgatacgtcataatcccattgggaagcttggctatgtattgtcagttcgacataatttgcattacgcaacggcggatcgcttgggatgtgcacatgctcggttcagtacgcatgcgcttgcggttcgaaagtactttgtgccaccatagcacagtgcatttgcacattacacaacctcttacagctatcaccttcttgagggatcgtctccgtacttatgcacagaatccgcgtccggacttggcaaatttggtcgtgagcttcctcgaggaaaagggtggctgttcggaaggtcgcaaaccttttttccatataccccggtccgttatagctttggggggacacggaaggcgcatgcaaagggacagtcctgtaaggagtgccattaaacccggaaaggaccaggtttgcggattcgcatgggcatacatcgcatctggcgccaggagcaacagcgctaattgggcgggattggaaggcttgaggcccaccagaagctgtccctcccaatggccaatattccgccagggcgttacaactattaacggatactggcaagattgttcaacccaggccccttagaaaggaagaaattgggtacagctctggcgctgagatggatagtgttaccacaccccttacgcaaaacagcgcttccctttttggattcaacggaccgtggttcccttacttggagggcaacacaatcggcgtaaaaggaggaaaaaacacaacggcttggtggaggaccaccagacggaagacaactcttggttttggtgtggggcgaattcccttttccccattgtggacaccgccgctagtagaggaatatttgcaatagggtctggcccccgcatatggctggtgcaaatcgccaacacgggcaagctgttcaagtttcccttgagttggcaacccgggtttggccggcttcagagttgaggaagaaccgtccaagacgttttaacttcagttagggtaggttggagccgagggtatggaatttgaaaaacaacgaacccttgtcccattagcgatatcagaagaccttggcaactctcgagcgaagttggttcacaccccacttgacccatgtggtgggacccctgaatgagccatgaccaacaaacttacagccgtttggttgaggtggaattgccagcaagccgcgacggaaaagcccgcgactggggcggtgtctcatttgtcgaacgccagataccgtgtgatgtaccaatgcctttcggcacgatgaaaagcgggccccatttaaaccgttctatcccccacggagcaagcaagaactttttaaaacgtgagggcgccgtatcacatgcaagattcacac

SEQ ID NO: 569414 - DNA, 893 bp, Homo sapiens
ttggtgtctctgccgtttattagggctcgcccgttccccgttggtgtgcctcgtttcgggggtcgactatgcctagtgctctccccatgtgggggtgtttgacccgggccttcagtcacccttaatcggccctgtggctgtcgccttattgtctgcgcagtcttccctgggggggatgcatcgcctctggtaacatggcggttctctgccctgacattccgattttctgggcgcccgcttcgcacaccccattggggggcgcagcagggtgtgcgcgacccactgggttccccagggaatttttttctgagcgcggggtgtccaccggactacagggtgtttcgcgccgttttttttgtatgtggcccactcaccggtcgccagtccgttagcgtccggaccccagcggggccccaaactggcgcccagccgccggtgcctactgggggacgccccgcccccctggcgatgtctgtgcgtgttacccgggttcttcccccgtggatggtacagtacttggctgtccgcgggccacccacttaggggtctgagcgaaattcggacccacaccggcggtgctgcccccgtattcaaaatatgtggacgtgacccgatgcattggtcaatagtagcctctatgttcgacgcccggcttttaccacgaccgtttttatggcggcgtgtaccaaagtgcccgagcaagaggtagtcttgccccggagggttgctcacgcagccggaggctttcatgaaagattgctgcagggacaagtcagtcttgctctcccctcgtcacaataagaatagagtttggatagtacatataccactgctacaccaagtggtgggggcttttctccgacggcaaaaaggttagtcacaacaacaatcac

SEQ ID NO: 569415 - DNA, 470 bp, Homo sapiens
  misc_feature (456)..(456): n is a, c, g, or t
gggtcaaagccaccatatcagataaacagtttcagaaaggaaaactagtctgtttctgagtgtaattggtaaaaatataaaggattttaatggttttctaaaaagggaaaaaggggcagatacaatggccaagttcttgaacttaagtacaatcttaaaagaatattagttacaagtaactaacaaaaagatttttaaaaggacactaaaattactttctacactattcaaacatctgatacgagctgtgcatcagttaaccactgctctatagcaaacttaccacaaactcagtggcttacaacaaccatggatgatttacacatctctacaggtcagccagtgggtgattcaggtaaccctggccgacctagacttgctcaggagacagcacacagctgacaggtcagatggcattggctggtctatgatgaaatcggcaagcacaaacctggncccctccactgggc

SEQ ID NO: 569416 - DNA, 349 bp, Homo sapiens
ctctatccttaatctataaacacagcactgcattctgcctagtgtcacagaattgtcaattcctctgacccacagtgccagatgtccagtggaattgacaggacatcatacatttcaattagttccactctccattgctgtggagggtgaggtgctacctcaccttcacggggaagacccaatgttccaaggatgtgcagcgcgggagggccccgaaccattcagaccatactcatgttaaggcccatgcaacggtggggtgtgctcaagggcggaaaatagccctgtgtgctttgaaggcaagtgtgtgcaaacatacccaataacagacatgttttgtgtatgatac

SEQ ID NO: 569417 - DNA, 177 bp, Homo sapiens
aggattctgcaacggttggacacaaagagttcatgatcttcccagaaaaattcatgtgcacagatatggaaccaatggactgttgagataaacatgggagctcagtgatgcccttggaatcagtattgcttggaggaagaggaagtcccttagtgagatatcccctgtatttatttg

SEQ ID NO: 569418 - DNA, 87 bp, Homo sapiens
cagcaggaggactcggccgtgtatctctgtgccagcagctttccttcttttatggtgacgggacagacaaacactgaagctttcttt

SEQ ID NO: 569419 - DNA, 571 bp, Homo sapiens
  misc_feature (561)..(561): n is a, c, g, or t
  misc_feature (564)..(565): n is a, c, g, or t
atatggcagatataacagcacgtaatttccaaggcaaggtcataaaagacattgtagcttctgccttgtcccttcctcttggatctcttgctatggagtagcagccccatgaagacacccgtggtggaagatcactgaggactcctgccaacagccacccagtgactgaggcctcttgcagaaatccatatgagtgggccagctgacaagaaaatcttccagctctagtcaagccttcagaacaccagctcttagtgccaggaactgccaggtaagaattctgactacactgaggccaccatgctctgaggaagtcaagccagatggaaagatcacagcaggagaactggtcagcagtcatactcttgaactcatcccaacccagactccagacatgtgaattgacaagtcttcagatgattccagcacaaagccattgagtcacctccagccattgagtgtccccagccgagacaccagtcaccatcaagcagagccagtatgcctgttatgcctgtccaaattcttgacccactaaattctatgaaattaataaatggntgnntaagtt

SEQ ID NO: 569420 - DNA, 142 bp, Homo sapiens
  misc_feature (128)..(128): n is a, c, g, or t
gtatcccatacagagtacgagatggagaagggcgggtgccgatttagactgtgtggttcgggaccggcctctctgcaggacgcattacctttgacgcaatgcatttataaatgctctgctgcaagatngtgtggcgacatgc

SEQ ID NO: 569421 - DNA, 605 bp, Homo sapiens
  misc_feature (1)..(1): n is a, c, g, or t
  misc_feature (5)..(5): n is a, c, g, or t
  misc_feature (118)..(119): n is a, c, g, or t
  misc_feature (204)..(204): n is a, c, g, or t
  misc_feature (284)..(284): n is a, c, g, or t
  misc_feature (295)..(295): n is a, c, g, or t
  misc_feature (529)..(529): n is a, c, g, or t
ngccncctcctcgcgaggagaagagctgcaggatgaaagtgtctcagctcctgctggctgatggaggccaacccactcatcgtccttcttctgattgacagagcagaagcttcgtgcnntttgagggtagtataatgggcacgtgcacttgtcacacactgacagtcactggaggaacagagaaagtccgtcttctctgagctntctggccgtgatattgggctgtgatcctctagagccgcttggactcacatcattctatggggttgagacaactcattccntctgaggagcnttgtacatacagccttttatttataacttattttgtattgaaacttttaaacatactgaagaaaaaaaaacttttccgacatctgttcttggtcttttgtgacacaggttgaagggggaggaatagaaaaagacaaactgccttggaggagataaaccaattttatgtctatcatgttatacaaaaatctagaaataatagatttgtacagaaaaaaatgataataaatgagancacaaaacatataatttctagatttttgtataacatgatagacataaaattggtttatctcctccaaaaaaaaaaa

SEQ ID NO: 569422 - DNA, 401 bp, Homo sapiens
cctttttcaccagagccacagcatagtagaaggtctttggattctcttttgacccatagaactctgctactacaggcttcagtttgttgggagtcaggccggcctcatgcaccagacccgcgtccagtgtacacggcgtccgcttcgtgtgccgcgatggccttgatgcagtccaggtaggaggccttcttcacacagatgatacgggggccatcctcttgaaggacttttttcatactgtcccggaagttggcgcacttgctggcctcgtgatcattcacggcgcaccatcgcacggtcttctccgtgacggccagacacaccccagggcggcgcaggccagcaggcgcgcggcgagcctcatcttgtagctcaggggtggtggcgaggagcggcgagcg

SEQ ID NO: 569423 - DNA, 217 bp, Homo sapiens
caagtgtgtcccatgcctgaccttcataattggtttgggggacaggggagtcacagcccctgatatttaggtgatgtctcttaggacttcagtgccttattgccttccccgccccccccttctgggtttcacattttttttttgcatgccttaggttttgctctttggttttttcttcagtttccagtaatacccccctttttgagcaaggccaata

SEQ ID NO: 569424 - DNA, 891 bp, Homo sapiens
aaaagccaccaggattggcggattaggcagctctgcagtatctggaggcagcgcagttggcatgatcacagagaccatcattgaaactgataaaccaaaagtggcagctgcaccagccagggccttccaggcgcccagcaaggctttaaaacttggagccaaaggagaaggaagtagataactttgtggacgaattaaaatctgaaggtgaaatccatcatgttctctagtatgggcaagagtacttgtgaagcaaacaaaatgcatgcgtcctacccgattaatatggaaaagtgtacatatgaagattgaaggaataagataagattaagctgtggacgagacggaggatgactagaatatggagttgatggcatgaatcatggttaggatcgtcagtatgacaagtatggccgaagttcgtcctttccagtgtggaagaatgatagataagaaaggggtgcagctaaagacccatgcaaatgtgggtataaaaaatcttttcactggagagtctctagagttgggcgttgaagaatccagagaagtcatttgcagtcaacgagtgacgtagaggggtgctagagtggagactacaaagcatagaggaatcttttatttccactgacaaggtaatttgctggccctcgtgagagtggaaatggctgtgatgtctacatagaatatgagctacaagaagataattctgaactgtaggtgatgtggtttagcacatcccagtcccgtctggtgtcgggcgcctggtatcggtgagaaccacggggcgtatcgcttgaccgttgccgaaattaccttggatgcgctgccggggtgctgcccataagtgcccgtgttttttgcgcccgggcttccggcactggtccaaattgg

SEQ ID NO: 569425 - DNA, 215 bp, Homo sapiens
acgctagggggttgaggctataccatccatggggcaagacaggaagaacggactaaggcatcgagcattccgggaggcagaagatgtctaataacaaagacgttgctcccaaggctgacttcctgcatccacacgtcttcattatgacattgcaaagagattggaactatttacaccggattgggcccaccggggcgcccgggaaaaacagggct

SEQ ID NO: 569426 - DNA, 786 bp, Homo sapiens
  misc_feature (16)..(16): n is a, c, g, or t
  misc_feature (26)..(26): n is a, c, g, or t
  misc_feature (44)..(44): n is a, c, g, or t
  misc_feature (428)..(429): n is a, c, g, or t
  misc_feature (436)..(436): n is a, c, g, or t
  misc_feature (439)..(439): n is a, c, g, or t
  misc_feature (456)..(456): n is a, c, g, or t
  misc_feature (767)..(768): n is a, c, g, or t
cacttgttacagacanctttagcaanccatttacccaattaagnttagggcgattgaaattgaaccttggggccatataattttggcccccgagggggaagagtgaaaatttttttcccccccctttttttggggggggctaaccccccttcccctctttctgaaaaaaaaaaaaacaaaaaaaaaatttttcggggggggaggcaaatatttttaacccccccaaaaaaaaggggggtgtttttttaaaaaggtgtttaagcgcccccccccccttttttttttaaaaaaaagggggggggagaatttattttggggggggggggcccccccccccccccccgcccggggggtgttgtgtgtcccccaaaaaaaaaattttttttttcttttttttttttcttttaggcccgccccaaaaaaaaaannggtgggnctntttttatatttttcccncagaaaaaaaaagaaaaaattattttttttttttttttaaaaaaaaattaagtgggggggggggggaaaaaaaaaaacaacatcctccccgccgcgcggtggggggcggccccccccccccaacaaaagggggggggcgggggggccccccccccccccccataataaaaaaaaaaaatattaaatttttttctcccccccccccgccgcgtgggtggcccttttttttaaaaaaacgaaagagggggggggggggaaaaaaactacttcttcttcttctccccccggcgggggggggaaaattttttttnntttttttttttttttttc

SEQ ID NO: 569427 - DNA, 145 bp, Homo sapiens
tgacacgacgtgccagactgtggtggccgacacctgttatcccagcgctttgggaggccgagggattacaggcatgagccactgtgcctggcctcttgtttcttttttctcaaatatttgtgatctgagattggtggtggtatag

SEQ ID NO: 569428 - DNA, 298 bp, Homo sapiens
  misc_feature (25)..(25): n is a, c, g, or t
agcgggaacaatcacttgaggtagnagttcaagaccagtctaaccaacgcggtaaaatcccgactctactaaaaatgcaacaattagccgggcgtggtggtgcatacctgtaatcccagctactcgggaggctgaggcagaagaatcgcttgaatccgggaggtggaagtggcactgagccgagatcatgccactgcactccagccggggtaacagagcaagactccatctcaaaagaagaaaaaatggtaagtgatggttccccgctaagtgagtgttcccggcggggtacggagct

SEQ ID NO: 569429 - DNA, 363 bp, Homo sapiens
tagaggtcccttatgtgcccagaacaagttttattttgttgtcgttacacaggagggggcagtcagaagagtacagctcaccccagcagtggaggggttaaatctcagtggacaacgttggggcacgtggggacagccactcctgacctatggggtgtaccttcaagtagcaaggctggacagtgatgtctagaagggtctccacttctgcctgagttttggcaaaaccagtggtctatagggatgtgtgcaaaagaatgagctaccgcagtgtgattatcagtgttttctaaaataaagagcacgggtttggctttaaaataattcacatcaacgggatatgggagaacatgtagctggcat

SEQ ID NO: 569430 - DNA, 872 bp, Homo sapiens
  misc_feature (70)..(71): n is a, c, g, or t
  misc_feature (74)..(74): n is a, c, g, or t
  misc_feature (76)..(76): n is a, c, g, or t
catgcactgacctgggcagggacacacaaccaacagctctgtcgggaacttaggagcctgctcgcctacnnaantnataagagagatctaaagaaaacaagctaaaccttttgagggacatactgaagccagataacccaaggtattcacagcaagatacagtgagtcttaaagttaagcaccgtgcaattagctttgcttccttgggtttttgaaacatgcatctgtataaacctgcctgtgcagacatcccgagccccaagctgggtctgccaaaatccagtgaatcggctctaaaatgtagatggcacctagcagtgaccaagactcagcctcaggcggcctgcaaacctgtgaggcccagtggagcagccgaacagaacatatgtggacaaagtttctacgtgttcatggaatttcgttgcaggaaaccaccagagcagagacgggcatggcatacaggtactgctgattgcaaagtcatccaaccaggcactgcactgatgtcaaaggttgtcattcaaacgacaataaggactgaacatagcaagacaaaaccctgtacgaacacagacggaaacaatgcagtgagccctcttcattgggttgcattcttgtcttcaggattacgcacatttagcgtttaaccagttcctatttgacttcaagaagggattaacacgcacaacgaacccggagcaaagtgttcaaatcgtcgtggagcaaatcccataaacacagtgttcatcccagaagaacaagggtatccttgcgagactccgcacaatcacgcagaagctcgatattcggagcaggtccacaaattgtcagaagttaggacaacccatattacacgttacaggggaatcaca

SEQ ID NO: 569431 - DNA, 314 bp, Homo sapiens
  misc_feature (18)..(18): n is a, c, g, or t
  misc_feature (111)..(111): n is a, c, g, or t
gatggaaaacttatgtanaattgtagacttaaaaaggtttgggaggccgggcgcggtggcttcatgcctgtaattcccagccactttgggaggccgaggcgggcagatcanggaggtaggagatcgagacccatcctggctaacacggtgaaaccccgtctctactagaaatacaaaaattagctgggcgtagtggtgggtgcctgtagtcccagctactcaggaggctgaggcaggagaatggcgtgaacctaagaggcggagctggcagtgagctgagattgcgccactgcactccagcctgggcgacagag

SEQ ID NO: 569432 - DNA, 256 bp, Homo sapiens
  misc_feature (212)..(212): n is a, c, g, or t
tcttcgcagcagaaaacacgccaccaagcagagtgccacgcctattttacacctaaccccacggtgcgttggcccaacggccacgcaccgtgttgggccacgcaccgtgttgggtaacgcaccgtgttgggccaacgcaccgtgtcaggatgcaggcagatcgctgcagaagtgtctagcattcacactcgtcttctggagggacgtcgatngtattaggataaaagcaccaggtgaccccactaagggtgcgttg

SEQ ID NO: 569433 - DNA, 321 bp, Homo sapiens
aaacgcctgcgctgttttgttagactggtgctgaaacaaaaggttaaggctaggttgaagtttagaatgaaagaaatttgaatccatgtcattcataaccccttgatttgtagtgtcatgggtgctcccgcaggcagggagtaagctgggggtgcctgaagccttccattcttgccccgcctcaccccaaatggtccctgtttttcaggctttttttaacttcctcaccccttaaccaaaaaggggggtttttttttgggcaaaaagccatttttaaaaatcagtgatgtaaacctcactttattaaaaaattatccagca

SEQ ID NO: 569434 - DNA, 368 bp, Homo sapiens
catctggtatcacagtgtttgtatttatagtttgtcgtgagatatttaacatctgcgaaggacatactctcacttgttggacgattataacgatcttgactgtgaggaccctgtcgctccaccacagttctacctaaccaggtagctaagccttagacttctctttagattctagggatcccaccatccttttggttttctttccttcttctcttctcccatatctactcactgagtcaagcccattgttttctctgaattagtctgaggtcaggctgtatcctctgtggctactgccactctttgattgattagtccaaggatttccaaagactgatcttctagttcatattatccccccatcaggt

SEQ ID NO: 569435 - DNA, 324 bp, Homo sapiens
ttttacttaaagtccggttcccccctttttttgggtggaatttcccttggtttacctttgccaatagtttttccattgccccggtgttttggtttaattttcccaggcttattttaaaggcctttgggttccctttgaacccattttccaattggaattgttgtttctttccccttccatttcttatttttggccaatttgaaaacccttttccaatatgggttttttattttttttaattaaaagttccccttttcttaggttcttatttttttgaccggaaggaattcgggcctttttaaaaattaacttggctttacccca

SEQ ID NO: 569436 - DNA, 127 bp, Homo sapiens
  misc_feature (13)..(13): n is a, c, g, or t
gaggctgcagtgngctgagcacaggacgtgtgggcccgctgtcaaacggagactcgccggcggtacgggtcacagaaagaaccccgcgggactactggaagaaagtcccggcagcgtgtcgtgtttc

SEQ ID NO: 569437 - DNA, 214 bp, Homo sapiens
taatgaccatgcatttactagaaaagatgtcagtatattaatgcttaaatactaaaatatgctgtaggctttacaaatttaaactgtatctgtgttattttaaactgagattttatgagcaatctgtacttccctttgattcattctatcactgttgaatttttgtccccataattctcaggtctaccatcatccttttcagatgatttttttt

SEQ ID NO: 569438 - DNA, 559 bp, Homo sapiens
  misc_feature (510)..(510): n is a, c, g, or t
gctgcgcctactactaccatctcaggcatcacttctatagaagtgagagatagggggatgtgggcattgttagtgaaggcctgatgtgagtcaggctggaagagtgcctataacggatcctaattgaagtagcgattatccaggcttgtatcctgggggctgatgaggagtagggtttctggacaacttaaacagatccagagttagtcgatcctaatctcaataatgggagaaagggagtacagttgatattctgtaactgacagcagtttgcggcaacgcacgttatttttctccgccaatcttataccgtaggtagggatctctttcctacatgacagtattaatacccagggaaactggtcatcaggcgaactgaggtgttttgctggcaaaacatagcttcggttatgtcaatggctattggattggtccatgaagcgaaaaataacttactgcgtcactcgtaccgataaccgcatcaggtcttctaggtaagtagcctatggncattgaggcatgatagttcagggaattcggccaattagagctgtaactt

SEQ ID NO: 569439 - DNA, 282 bp, Homo sapiens
gctctacaggatctcccatgccagtgtgtctgctggctgacccaggactcagcagtgataactaacggccgcccttcaggatcacagatgtcgttgtggtggtggcaaagcatggcacttgtttcggtgatgagaagcagcacacggcaagggtgaggcctttatcagcaggcctccgtagagcgtgtctgcattgtcagctgccaatgcgctgagtggctagccttacccactcagtccaagagaggaaggaaacagcagtagcagctcatgaatggcaag

SEQ ID NO: 569440 - DNA, 1402 bp, Homo sapiens
ccgatggggggttcaaatccgttggaactcgcggtcgtattcccaaaagttgcttgagtgttttacacgttgtggggaggtggggggccgcgcctccgatgactaaattatctccgcgcgccactgctcatgcggcggcgaagacattatcttatatacatcacttggcgtggaaccccacacagggttcttaataagtatattgcttgcagtggtgggttatcgtgtgatcgccgcctctcgccgcctcccgccctttctcggataatgaggggcgttcgctcccccacgggagggctctctccccgcgctacttttttttcgctaggtgttgcccccgggggtaattagttgggggggcctcccccatatattctgtgctcagttgtttgttgccacctacacatatactaggggggaccttgtccccgaatgtccccgtcttgtgactccccccccccgcggggttcccccgggcgggtagtagctgtgggcgccctgatcccccggagatttttctgggcgcaaacgggagattctgtggtaagatgtgggcacgggccccccccccgttggggcccacacccctcacagcgggggacaccgaggcgtttatttttagagggggcgcttctcacccacaggggtgttaacccctcttttaaacttactcacacacttctcttatagatgagagccacgacgtctgctctcacgcccgccctgcccccctgtgagagaggagagagagagaaatcctctcccacataacccccctctctcactatagagagagtattttcgcgccgcccctccgcaccctctcttgttccacatggcccaccgcttgtcttctttctctttgtagagaattttgaactctcttggaggagtatatctcgtgtttacaccaccttgggcgcggggacgcggggctctgtgggggttttttctctcttttgtttgtgttgttcccctctctcgtcttgtttccctctctttgttttgtttttttgtgtgtggcgctcttgtgcgctctatgagagatgtgctctctgtaattctgacacacattgtgagacacatgtgaacaccacacagtttgtgctatgaatgcttcttgtgttgagacttccacgccacgaatgtggaatgtggggagaaacaccacgccacgctttcttgtgtaaaggtcctcttggtaaataaataaggtttgagatttttttaatttcgaggaggaatctttcacattttcctaatgtaatgcttttttccctttttgcccacgtttccctaatcaccctgctgtaagagatggcttatattttgcacattcacatgcagagctaatgttgccaatctgtttcatttagtaaactggaaattattgcttaatcca

SEQ ID NO: 569441 - DNA, 834 bp, Homo sapiens
agtataatcgtgactgatatgtgaaacagggcaggtgtaatcggacgaggtctccccggagcgggttgtgcgtggcggggctgctgggcccgctgagagtctccggtgcaggtggtcattgctccgctggggccctggcgctggccaacggcttcccaagtgcgcacgaggccctgaagagcgcacccagctccttcgctgcccgctgggaagtccctctgcttccgccctgtgccctggccctgcccatgcacagctgggccctgtcatgatgcttcccctggtgcccctgtgcatgcccaactggcgcccatgtgactggctgcctgcgcagaactccctgcccctggccccatgtggcatcacctgtgcgagttctgttgggcctgctgtgcttcctcgtgatgtgatgtgctgctgcatgggatggccctgcgtgaagcttggtggcttgctcagtggagagttctgtgagggtgcctgcgctggtgctccagtccaccctgtttctccccaccctgaagagagggtgaaagagtcgctgcacccaggagctgtaatggtctaaaatggaagttgacagcggtgagcccctgccctctgtggcacatcggaggtctagagtgtgcctggctggggcctcctggcttgagcactgcaccgcaaagctccagccacctggcacagagaactcttcccttaaaggaatctggccgagggcttgtctcccttttcccaatgaactgagagagagagaattaactgttagacccataggtttccgtgatgtgtaaatgccatctaaagggggtagggaggagtaggactggtctg

SEQ ID NO: 569442 - DNA, 356 bp, Homo sapiens
gctagtgggggtctttgtgtgcttggtgtggagtcactgagaaccatccgtggtttgagatcccaccggggctggacactgcttggagcactgtggagggcaagtgtaacctttgccccgggacccaggcagctatgcagccagcatagggtgtgtggtccttgcaggtctaggcgcacggctggctctccctgttctgttctgttgttatttctgtctggacgggagtgcttcagatgggttttcttttgctgagggtcacacacatcagtttctgagcagttagcgtctcagccgactcgtcctatggaaagcttgctgttttcaataaatcttagtttgctatcgtttttaaa

SEQ ID NO: 569443 - DNA, 406 bp, Homo sapiens
  misc_feature (11)..(11): n is a, c, g, or t
  misc_feature (25)..(25): n is a, c, g, or t
  misc_feature (59)..(59): n is a, c, g, or t
  misc_feature (65)..(65): n is a, c, g, or t
tgtttagtgtncactcatacttttnctggtgttaatctaggtgatttacaagtattatncccagncttgtattattatccccattttatgtatgtggaaactaggactataaaaatgaaaaaagggggccaggtgcagtgctcacgcctcacgcccagcactctgggaatccgaggtgggcggatcacttgtggccatgagtttgagaccagcctggctaacatggcgaaaccccgtctctactaaaaatacaaaaatcagccaggcatgtcagtggacgcctgtaatcaatcccagctacttgggaagctgggcacaagaattgcttaaatctgggaggcggaggttgcagtgggccaagattgcaccgctgcacactccagcagacagagtgagactttgtctc

SEQ ID NO: 569444 - DNA, 905 bp, Homo sapiens
ggcgagaacgagccccggacacgaccaatagcccgtcgtcgccgatgcaatcccgtcggtcagctaccttacgtcccgcatgccggtcgccgccgtgcatctatgcccaagagaaaggctgtaagggagtatgcttaatcgtgagattagaagcgtgacggatgaaagcgaccgaaccacagaaggaagatccgtcggatggtttggtcctgctagaaccatgctccttcctactatgcctggaagacccgaggccgcgtagagaatggccccatgtgactaccgggtagattcagggtacccgattatgggcatatcacacgggaagaacgcttggtagcatggtcaaagtgacctggagaatagagccgcttcgccatgaacaaatggtcgtgatgtgcgcacaaatatcgagcacccaggcgcgaacatgatacatggcttgtaaaagcgttgctttgccatacttgcaccagagcgttgagcatgtggtgcgctgcagttggctctggacctaaatccgtgttggttgaccctgtcgtggggttgaaatccttgttgagcaagactggttggagagactcaaccttagtggtctttgtctgaatgcgaatgtgtttgtgtaagtttcactgagagttagcccaagcacacacttaatgaggatctcatggtaacagtggtccgttataataatctcctcaatgtgtataagacatcaacgcgccgcgaaacttgttgtcgcctttggaagctgggacgattcccaacaaaagcccgccgtaatgcaacgcgcggtggttatgttaaacttaggcgtgagcccgaatatgggggggcacgcattttgtgtttggttctgcccgttcacaaactcacggctagacttgggtctttccccggga

SEQ ID NO: 569445 - DNA, 299 bp, Homo sapiens
tggaggtgaaatggcatgcaccaaggctgctgtcactacctgtctgctacccaaactgcaacaaagcgcccactcaacgggaaaaggcccagaccgaacccacgcctgcccctgcctggccccgatcgtttgatagctacgcaaccctaccagtgaaatttccatgcctggaagcctgaacaggcccacgaacaacatgcagtacgccaatgcgcccgcgagatctaccgccgtgaaatgctagcctccacccatgcgcgacacaaggcgccgtggtataacgtgacgatgtggcgcaa

SEQ ID NO: 569446 - DNA, 360 bp, Homo sapiens
gggtggcgatgaggaggtacctattgtgttgagtaacggtgataattttatacgctattctgagccaatgtcaagattcttctggtcacagttgagcaacttggaacgtgccaaacgcttttccaggactggcacgttcaaaggacctacgtgctacgtgaattgacattcacaccggagtaatcctagttcgtaactatgtacttcaaattcctgcgtgacctaaaggtctggacaagtaaggcctgctttacaaagcgccttcccgcgtataagattgcatctcaacttacgctcataccgagacccacccaacaagagggtctgttaaaacaatataactctagactccttgtcgat

SEQ ID NO: 569447 - DNA, 634 bp, Homo sapiens
cccaaaaaaaaccgtatgttaccaatccaaatccaaagtgactttccaggaatttacgcctaaagatttggtcccacaattttaaaactgtttaattgctcacaggttttacatacacatcagccatcaactaaagttgtacttaaaaaattctcccatatggacatttttaaagccaacccctggggcttttggcttaaatccccggatgttcctgccccccttaaatttggagttaatccttttttctctagagtagaggtataattgtgtgatatttcagaaatccagataaatgattcaaaaagtcccagttaaggagaatcatgtttctttgatcatgaataactgattagtaagtcttgcctatattttcctgatagcatatgccaaatgtttctaaggtaccaagatgagaccagataaagattgtgtggtgttttggatttggagagaaatattttaatttttaaatgcagttacaaattataatgtattcatatttggactttctgttaaaatgcatgattgcagaattgtttagattttgggtttattcttgatgaaaagctttgtttgttcttgtttttaagtttgcactcaaatcttaagaaataaatccacccatgttatc

SEQ ID NO: 569448 - DNA, 242 bp, Homo sapiens
  misc_feature (1)..(1): n is a, c, g, or t
ntggggctccgctcctaagtgcaggaagatggtggccgcaccgaagagaattagtcgctggaggcgatcaactctaggctccaactcgttatgaaaagtgcagaagtacgtccatggggtacaagcagcactctgcaagatgatcagcacaagtgcacagcgacaattgtgtcattctcgactaacaacatgcccagcctttgacggacatctgaaactagagtactatcgctcataatggt

SEQ ID NO: 569449 - DNA, 160 bp, Homo sapiens
tacttggtatctgtagcagagatggggttgcaccatgttggcctgacctcagatgatccacccgcctcggacctcccaaagtgctgggattacaggtgtgagccctcacgccaggcgaatagacttttctttccccactgaaatgtcttggcatccttga

SEQ ID NO: 569450 - DNA, 157 bp, Homo sapiens
tgggcaaaggttaacatccaattagggggaaaaggtaaacccggcccaaatgaggggcagtggcgggaccaaaactgcttaaaaaaatcttcagctgggggaaattacgggcaggtcatttccacatcctttggaggtccagagcatcaaaaggacc

SEQ ID NO: 569451 - DNA, 130 bp, Homo sapiens
gcccgcgagcggacgcggcagcgctctgtctcgcttttcttatttttcccccctttccccttcttatattctttcttttctcccctccacttacatacgtggaggttcccaggcggacaggcaaccaagg

SEQ ID NO: 569452 - DNA, 359 bp, Homo sapiens
aggctggagcactatggcgcaatctcggctcactgcaacctccgtctcctgggttcaagcgattctcctgcctcagcctcctgagtatctgggattacaggtgcccaccaccacacccagcaaatctatgtattgttagtagagatgaggtttcaccatgttggccaggctggtctcaaactcctgtacctctagtgaaccacccgccttggactcccaagatgctgggattacaggcgtgagccactgcccccggcctagtatgtacttctcaaccatgtggttttaaccctgtctgcccttttagaaaccatcatttgtgcttggcgatgggaactaatgatggaaagcctgaattg

SEQ ID NO: 569453 - DNA, 1428 bp, Homo sapiens
  misc_feature (1428)..(1428): n is a, c, g, or t
gatgacccctaagtacgcaataattaatccgccctaatataagattaaattaaaccagctcactcagtcgaaccatccccgaccccagtccaaacagtctctcgcatgactgaagaactatcaggcgtcacgtgccttggccagccatgccttgtatccttctcgaaatcgaccacaagagtacttaattccatagacctatgctgactaactccaccgagtacagccgtcgaaccagcccattgtgtcatccaagtcgcgccactatctactacgagagcagtgataattgtatgtgcattgaatgcaatacgcggactagccattacgaccggccatatgcgacggccttcaccatatctcttttattcattgccgcgtctttccgtactaacattcaggagccgcagcgccataatagttcactggcactcactctatctcctaccctcacgcaacaccctgatacaccactcgagtacatgattccgtcactgactttggcatatcttactacgccacatcaagtcccttcattacgtgccatacttgatcatctcacacgtatgaggtgtcctaaaaccaacttccactctccattgcatgaggagcccaacacatgcatacacatttaatcactaaacgctcttagcataatattctccgggcacagtcacccaatttaccaagttttgcgagtaacatgaacctcataagggtttcaacagttgcacatgttccttgcacgggcaagcgccgtcaccgctacaaggaaaaaggtatccacgggtccacacaaacatcacagtttgcacacaacgccgaagtgccctaatacagccccctttgttatccaaccgtgtacacgactccttatgtgcccccccttgtgcatatctaatattagtcacacgcagcccgattagtgccacagaacaagtatcccaacaccatttccacttcaatataccatttgtgcacatgcagaacacactggggtggcaatctcctcgaaacccaatatacacccaccatttagtggacacaatttccagccctttaccgcccaactaattcccgcgaatgtccataaacatattccacacgcccgttagtccccaaccccatttttatccttcaaccacacataagtacccaaagacacaaacgagccccccctattccagggatatttttaaccgttcaccatcacatcttcccctattctcattccattccaccatcttatacaccttgagtacccagttttaaaccacaagcattaaactatctacattatcacccaaaagaactacatgacctatatgggtggaaaccccccacagtacacgaaacatctacataatgccacccctatgtagccaccaacaccacaccgcttataatcgaccacccccttctccatan

SEQ ID NO: 569454 - DNA, 1047 bp, Homo sapiens
  misc_feature (968)..(969): n is a, c, g, or t
  misc_feature (999)..(999): n is a, c, g, or t
  misc_feature (1002)..(1002): n is a, c, g, or t
  misc_feature (1004)..(1004): n is a, c, g, or t
  misc_feature (1011)..(1015): n is a, c, g, or t
tggttcacgaataacaaaagcttaaccttcactagctaatattaaaggggtgtaggtgagaccgcagaagttcaccatgtgggtgaactaggattacattgaaagaaagcgaattccagcgtgatttgttctacactacgcgatgttccgcatagggtccctaggcgtagccttttcatgttgaatggaccgttcagcatagtataggttgccgcatgggccctgcaatgccgagctgagctaacaggccctgcaagaattggcagaataggactcggctagagattgctcatgggcctagagatcagtaggtcactgtccaggttagcaagagcccctaggcaaacttgcagcacattggcacatatgtactgatttagtgggattggtatgacatggagtgctcggggtccatgcaccctgccgggatatctctgtcggcgttctgtgccctgaatgctagctgtccccaagggctctttcgtgacttatggcagggagctggggattggtcctactttctcttctctggaaaggaaatgcctccatacgatctccatgctgtcttgggcaagcttgagaaggcgttcagcacctacagcctagcaggcagaccttgaagcctcacctttagtctatctgacagaggtattcagttcctcggcacatgagggactaggggcatgtagagtatatgaggaggcagtatggtctgtgcaggagccttcatttgcagcttcaagttaatagggaagaatgtctactgatagctcgtatagatgctgaaaaggtatttcgtaagagtttaaaatccatcccgtctattgaaaactcgttagtgaaattaacgtctggaatagaaacacgccataatcgtagataaaggtctgtttcagaaactcaacagtgatggcattctaaagagtcagacgccacaggcattcccattaaagtcagaaactagcaanncaagctattattcagcagtgtcccggcacnacnanccctgcnnnnngccagatgagaacctacagggagaattataat

SEQ ID NO: 569455 - DNA, 960 bp, Homo sapiens
aaatattatactagcatttaccatgctcactgtctaggaatactaggtatatcgctcacacctcatatcctccctgactatgcctagaaggaataatactatcgcgtgttccattatagctactctcataagccctcaagcacccactccctcttagccaatattgtgcctatgccatactagtctttgccgacctgcgaagcagcggtgggcctagccctcactagctgcgtcaattctccgaatcgatcgatatggcctagaactgacgtaccataaacctaaagcgctactcgcaatagcttgaaaagctattatcgtctccaacaaaatgtatatgtactaccactgacatgaacttatgccaaaaatacacatagatttgaagtgcaacgcaaccacccacaggctaatatattacgccatcgatccctcctactattcttgaaatcctaaatcaacaacgaacctattctagctggtgcccgcaattcttgttcgctccgagacccgctaacgaatacccacacttccttgaagactaatctacgcatgagttcacttatcccgtcatcgaattccagtaggcgtagcctagggccacattaatgagttgagaccacatatcatcgaatgaagaggtctatcgtgctactataactgaatacatgcctataagatctccttagtgatgaccacttcaccaggcctgaggatagctatatccatattttatgattcctgctttcggaagagcaattcttaatccccacttgggggtattcatcaccccgatggagcgcaagcaggcaagaaaggactgaaacgccgtggacattggtgtgctaatttctaaaaacccttaggaagattcaccttttcccctagatacttcggccctagttgcaacctccacacaaccgagggggcgcctagaggttctactacacactctccagg

SEQ ID NO: 569456 - DNA, 232 bp, Homo sapiens
gacaatcacactcgggaccaaaagtgactcttctatattaccccgagatggagtctagctctgtcgcccaggctggaatgcagtggcgcgatctcggatcactgcaactcctgcctcccgggttcaagccatactcctgcctcagcctcccaaatagctaggattacaggcacctgccaccgtgcccagctaatttttgtatttttagtagatatagaagagtgcacttttg

SEQ ID NO: 569457 - DNA, 238 bp, Homo sapiens
acatagcgcattctgacccacagaaatatataagatgtttgttgttttaagctgttaaatttcgggtgagtttagttatagcacgcaataactaatacatgacacaatacaaaaaagcaatccttttatttttatttatttatgaaacagactctcactctgtcaccctggctggagtgcagtggcttgatctcagttcaatgcagcctccgcctctcaagttcaagcgatccaccca

SEQ ID NO: 569458 - DNA, 208 bp, Homo sapiens
gcctaacgcgcatatggtgtcttgcacatcagcacacagctttccgcgaagggacatgctggctctgctgcatctgctgggtgcccacattgtctgctcccacaatgaaacattacggataatcatccaatagttggatgatcttaaggaagtagtcggacttccaggtcgccctgtcttccctgggcatcacggcggcgcgtagggg

SEQ ID NO: 569459 - DNA, 283 bp, Homo sapiens
gagtcctcgtgggctccacctgttcaactctttaatgagatgtatctaccatagtagtgtcacgcagacataggttcgctgtcccaacagtcatctgcgctccacctgttcacctcttcaatgagatgtatctaccattgtcgtgtctcgcccacatcgggggcgccgtcccacacagctgctctgcgcgtccaaccaggataccagaccgaagagatccatcgtagacgctcacctgcatggcaagcacagcgtagggcgctggccgccgagatacacgcag

SEQ ID NO: 569460 - DNA, 199 bp, Homo sapiens
tgaaacgcggctgattttcgtctcctgcgctagaccattgctcactcccgacagcttctgttctgtgacgggagcgtcagaaacacagtcgagcaaaggtttcacgacgtcggttccgaagtagccggttacgggcctgaacggcacggggttggcagccgggggagggatggggcttgaacccggtttgggatgaatg

SEQ ID NO: 569461 - DNA, 476 bp, Homo sapiens
tgagaggatcccgccaacacacatacacatttatttatgtttctattacatgtctttaaaaatatttatctggtcgagtgtggttgctcatgcctgtaatcccagcactttgaggggcaggcagatcacttgaggttatgagttcgagaccagcctggccaacatggtgaaaccccatctctactaaaaatacaaaaattagccggatgtagtgatgcatgtctgtggtcccagctactcgggaggctgaggtgggagagtcccttgaacctgggaagcagaggttgcagtgagccaagattgcatcactgcactccagcctgggtgacagagtgagaccctgtctccaaaaaaaaaaaaaaatttttctgagggaaattttgggtttaaaagacggcagatgagaggcaatttcttttctaaatgactacttaaggtgtgttcgagtgccactaatgcagatgggaacctgagag

SEQ ID NO: 569462 - DNA, 731 bp, Homo sapiens
cttgaaatgtaatccccgttgttggaggttgggtctgaggggagtgtgtttgggtcattggagtgcatccctcattaatggcctggtgctgtcctcataatagtgagtgtgctcttcatgagatctggttgtttgaaagtatgtagccaggcatggtagctcatgcctgtaatcccggcagtttgggaggccaaggcgtttgagcttgaccttgaacttgagctcaggagtttgagaccagccttggcaacatggagaaatccatctgtacaaaaaaaatacaaaaattaattggatgtgttggcatacacctgtagtctcagctattcaggaggctgaggtggggaagatggcttgaacctgggaggcggaatttgcagtgagctgagatcacgccattgcactccagcctggacaacaaagccagaccctgtctcaaaaaataaataaataaataaaacttaaaatataaataaataaagtatatgacacctctccccattctcttgctcctctcaccatatgacatgtctgctcccacttcacctaccatcatgatgtgagcttcctgaggccctcaccagaagctgagcagatgctggcaccacgctttctgtatagccggcagaaccatgagccaattaaacttcttttctctataaattaaaaacacaaatataacttgaaaaacacaaattacaaaaaaaggggggggccctaaaaaaaaaccc

SEQ ID NO: 569463 - DNA, 103 bp, Homo sapiens
cgtgtccgtacgtacccagcctctccccccaaccatcgccctgcagtgagaagccatgtgaatgcaggcacagtggtacagaacccagcatggcttcagatgc

SEQ ID NO: 569464 - DNA, 801 bp, Homo sapiens
atcggcacgaggcagtacagcgagggcacgctgtcccgagaggcatccagcgggagctgtactgcctgcagaagcattgctgagcctgctggaccagtatcctgtggcgcaatgctgggacctgtaccagacgctctacgtgtgacgctgtgacgaggatgtgagatcatccatgtactgttggtggtgcaccctgcatgcccaatgctcaatgctgttatccttgctgccaccccctgcccaatgaccctgtgatgcatgctcatccatgatgtgtgtgcatggatgtgtgcatgtgatgaccttggatgcatgtgctgtgcctgatgcctggcctgtgcccccacctccctgtgtggatgtgattgagtgctggatgatccctcactgctcctgccccacaagcatgctgatggtcctgttgtgccatagttgacctgtgatcccatgccactgaagtagtgaggtgtgcagtccctgtgatggccctccaagacttagcccagacatagcattccagtgccttgtgtgcttattgccacaccatgtgacttttttgatgctaggtgtgcttgcactcccttgccatgtggtgaatgcccctgtgtccatgcttgtgtgttgcctccctctgatgctcctgtggctgtgactctgcacactactctgttgtcactccatgattgtagatgcacctgtcaccccatggcggcaaaatgatgcccttcccccctctgccagtggccttccagccctatcacccctccctccgtctgtcttttccggcctggacccccaccc

SEQ ID NO: 569465 - DNA, 466 bp, Homo sapiens
  misc_feature (44)..(44): n is a, c, g, or t
  misc_feature (234)..(234): n is a, c, g, or t
  misc_feature (239)..(239): n is a, c, g, or t
  misc_feature (255)..(256): n is a, c, g, or t
  misc_feature (269)..(269): n is a, c, g, or t
  misc_feature (296)..(296): n is a, c, g, or t
  misc_feature (299)..(299): n is a, c, g, or t
  misc_feature (309)..(309): n is a, c, g, or t
  misc_feature (315)..(315): n is a, c, g, or t
  misc_feature (341)..(341): n is a, c, g, or t
  misc_feature (344)..(344): n is a, c, g, or t
  misc_feature (378)..(378): n is a, c, g, or t
  misc_feature (389)..(389): n is a, c, g, or t
  misc_feature (391)..(391): n is a, c, g, or t
  misc_feature (396)..(396): n is a, c, g, or t
  misc_feature (427)..(427): n is a, c, g, or t
  misc_feature (450)..(450): n is a, c, g, or t
gccaagaaggctatgaggagcatatctcttaaggacttaagttngggcattctagaatgtatgctttatggatttaccttataaatatataacattaactaatacacacagaaaatatatttcagagtaacatagatgacagaacttgaaatacgtgacattctaccgcagtctatcattattttctaacttatcaaaagactcagaggatctttttttgtattgataaatttntaacnagagccctatttactnntgtcttgaaaaanagtatttgcaaatatgtctgaagaggnaanagaaagaaantgattncaaaaaagctgataacattaagacanctntttatagaagatgtaaatttgcaaccattaaaancttataggagntncacanaatgtgaagaaaaataaatgaaaccaaaccnctacaagaaataaccaaactaanaagacagcaagagagg

SEQ ID NO: 569466 - DNA, 302 bp, Homo sapiens
tgacgtctcctatcaacgccctcagcagctagtctgccagcggagctaagagacctcgtgctagccggcagcagcttctccggagctggactcaagaggctctctacgaagtcactactcgtaccgtacgcgtcccccgacgcgcctggcaggctccctgcttggtctccaagaaccacgaccccgaggagggcttccccgcgggctgggggcctgcaacactgctgggtccccgcggcactccccctccacctcgccccgcgccagcgtcaactgaggagagctggctgggtgcccgctcc

SEQ ID NO: 569467 - DNA, 844 bp, Homo sapiens
  misc_feature (643)..(643): n is a, c, g, or t
  misc_feature (689)..(689): n is a, c, g, or t
  misc_feature (691)..(691): n is a, c, g, or t
  misc_feature (701)..(702): n is a, c, g, or t
  misc_feature (780)..(780): n is a, c, g, or t
  misc_feature (793)..(793): n is a, c, g, or t
cgtcgtgcagggacggattcggggtggcggtgcctggccgggcgtaggcaagagcaaacgagcggctccttgcaggctgtgtgcgcccggctttcagcatgggggatcaggctttgagctttcttaaggacttcctggcaggtggcatcgccgccgccgtctccaagacggcggtcgccccgatcgagagggtcaaactgctgctgcaggtccagcatgccagcaaacagatcagtgcagagaagcagtacaaaggcatcattgattgtgtcgtgagaatccccaaggagcagggctttctctctttctggaggggtaacctggccaacgtgatccggtacttccccactcaagccctgaacttcgccttcaaagacaagtacaagcagatcttcctgggaggcgtggatcgccataagcagttctggcgctactttgctggtaacctggcctctggtggggcagctggggcacctccctctgcttcgtctacccgctggactttgctaggaccaggctggctgccgacgtgggcaagggatcttcccagcgagaattcaatgggctgggcgactgtctcaccaagatcttcaagtcggacggctgaagggtctctaccaggtttcagtgtctctgtccaggncatcatcatctacagagctgcctacttcggagtctatgacactgcnanggggatgctnncagacccaagaatgtgcacattatcgtgagctggatgattgcccagagtgtgacagcggtggcgggggctggtgtccnatcgttgaactgntcgtcgtaggatgatgatgcagtctggccggaaaggggctgatattatgta

SEQ ID NO: 569468 - DNA, 275 bp, Homo sapiens
acccacgcgtcgagctatctttcctgcctcagcctcccaaagtggtgggattacaggcacaagccactgtgcctgacctcttttaaccatttttaactgcacacttcattctactaaaaatacaaaaatgagccagcacagtggcgtgcgtgtaatcccagctacttgggaggctgaagtgggaggatcgcttcagcccgggaggtggaggctgcagtgagcagtgagggcaccattgtattcccagcctgggtgacacagcaagatcctgtctc

SEQ ID NO: 569469 - DNA, 1084 bp, Homo sapiens
taatttttttgtattttagtagagacggagtttcaccatgtttgccaggatggtctcgatctcctgaccttgtgattcacccacctcgtgctcccaaagtgtcgggattacaggcatgagccactgcgcccggcccaggacttatcagttttcaacgacaagtgtttattggccttgttgagatatatgttagactacctatgtgactagtatgaacggacttgcaagatttagatgcttttattttacatgcctttactgtcttttctttcaaacttaacaactaaactattactgagtttaactagttgccttagctattaacatacttcctttgagctgaacaatttttctttgctattcagcgtaaatttcctttaaactaaactaattccacttaccaaattaccctaagatttcgttctcaggctgacaccatggatttcaaaattagattgcttagaaagtccctttgcaacacttacatagtgcacttaacgtcgtgcactatttcattgcgtataattcggtctttgggttcccttatgtcactccccggcgggttaaacgtcagccttatgcttgacttaccatctagggtagcttctggtatgtatgtggcctttaaaccttctctctgcacttactccaaacttatcccctgacttgcagcaagaatttcctctggtctttgtgcggccttcgaaggacgggcccctgggggggcttacccctggtgttcccgccccttgtgcaggccgacctggaccggtatccctgagcagcgagttttagccacccggccccacgggtaaacccgcgcttcacaaacaacaaacaacccaccaggagaaggcgcgtatacaccccacggctcgtcgaaattcacaccgcgcaacttacaagcaagacccccccgggaggagttccaaaaaaaactcgccccattacgcgcaacatccttttcatgttttctttctttctcttttctccccccccccccaccacaccccaccacccctccccccccccaccacccccccacccacctccctcccccccccctccacccacccccccccca

SEQ ID NO: 569470 - DNA, 737 bp, Homo sapiens
tgccgctcatttacataaatattatactagcatgagccatctcacttctaggcaatactaggtatatcgctcacacctcatatcctccctactatgcctagaaggaataatactatcgctgttcattatagctactctcataaccctcaacatccactccctctgagccaatatcgtgcctattgcccagtactagtctttgcccgccgtgcgaagcaggggtgggcctagcccgtactagtctcaatctccaacactatatggcctagactacgtacataaacataagaccctactccaatgctaaaactaatcgtcccagagcaattatattactaccactgacaatgactttccaataacataccacataatttgaatcaacatcaagcaacccacagcctagttattagcatcatccctctactatttttgaaccaccatcaagcgaagaagctatactagctgttccccaaccttgtccggtcggatcccctaaaaacgcgcgcgtccttagatactaacttagctgaatgccgtaccccctcacccctgggggcaagccaaagccacttatccaagtgaagcgaggatcaggaaggaaaagtgctactctctatataaatatccctaccaattgttcgttatgatgacatgcagggcggagaactaatcatcccatatctttgggaaccgttttcccacttgttaatcccgatgaggggcgcaaagccggc

SEQ ID NO: 569471 - DNA, 1739 bp, Homo sapiens
  misc_feature (486)..(486): n is a, c, g, or t
  misc_feature (573)..(573): n is a, c, g, or t
  misc_feature (595)..(595): n is a, c, g, or t
acattggtgcagaaggaagatcttcgaggaagccaggaagaaggcatctggaagctgtggggtccaaagagagggtgtgtcagtgtgaggagtggtcagcggggaggtgttgctggaggaggttcactctggctggggcatcgcaggtcctagtcgcgctgtgtgatggaccgctatccttgctgggcgctctctgcgtgccaggcccctgcactccggcgcacgcagaatcataagtgtgaacatacgaccacagacgggaagggggaccagagctattgtagtacgcgcgaactggtagcctagcaagtgcaacaggggggaaagcgagtgcaagtggttcctgcgtttggaagtcgtcgacgtcgtgcatcacgtccaccatgggcctccccacgctagcatgaaaaggtacacgttggcctgcctcctggggaggggatgggcgctggacacttttctgaacaaacccggggatgtgccatncggttggcgctgaccaagattgtagcgcttgcattgggggtaggtaaacggcccaaacaagcaagagcgaacgggggaagtatcgcncagtccctcgggagttccaacntctcgctataggaagactccagggtgtgaagggcacatagcgcagctgggaagataatccggtacagttgccaagcaagttcgaaggggtatccagatcggtcctgtgggacaatcgcttggtgatggaaatgcacctcgggagagaatcgcgaaagccagacacttagccgaaggggtacagtacgtaaccaacgggaataggaacccccaaggcggaggcggccaatggacgaaaacagtggacccccccaaaaaaaaacgcgcacatgggaaacaagtggacttcccaggagtgaattcaaggagggttgtcacacacacgctatacccgggggggtggccccttaggtccgcaatagcggtagagtccgcaaagccgcttccccaacgggaattcggggaccacaacgatctcccaaatcacagagaaagccgttacccctagtgtggaagggtcttcttctcgcaattgggtaaacccactcggaggagcggcaaagaagaccggctggcggcagacaatgggagttggggactgtgtggagagggccccgggtaaattatggagcatatcccgctagggagacgcaaaaccacggctttacaacatatgaggagaacttggaaaagtacccacagagcaagggctatactctacacgcaagagacaccccaagtacgagcggtgcgcactccaagttccctcgtagccacgggacgccaaatcaaaggacacatctgcgaggagcacatacaaccacaagtggacatcgggcggcacagtggggcgcaacaaaaacaaaacaaaggggccggggcgacgagaacaatcggtccgaacaccagcggtgggttacacacaccatccacgggaccacgaccccatcacaggtgcgacacatcgatcacgccacgatggatgaataggaagaacaacccagagacaacaagacggaaagagacaaaaaagcacagctgcagacaccagcgaacacaggattcacaccggcagcggacacccgacacacaagacatcgacggagcaacaacaagtgaataacacaacaagacgagacgaaaacagaccacgataccaaacgaaacgacacatacgagcggacccaccaaacgaacgaacacaa

SEQ ID NO: 569472 - DNA, 189 bp, Homo sapiens
cgcatgcagcggattgcattcgcacggtggcagtctgcgcgcacgcgcgatcagtggaggacaggcatgctcaataggctcgtcgcctaaactggctggagagacatgctagacaggcgtgccggacgcacgttgcggcgcaaacccaaccggcagcgccgaacatcgtttcggcattatggaaaaagg

SEQ ID NO: 569473 - DNA, 345 bp, Homo sapiens
  misc_feature (80)..(80): n is a, c, g, or t
  misc_feature (86)..(86): n is a, c, g, or t
  misc_feature (88)..(88): n is a, c, g, or t
  misc_feature (97)..(97): n is a, c, g, or t
  misc_feature (105)..(105): n is a, c, g, or t
  misc_feature (111)..(111): n is a, c, g, or t
  misc_feature (122)..(122): n is a, c, g, or t
  misc_feature (128)..(128): n is a, c, g, or t
  misc_feature (152)..(152): n is a, c, g, or t
  misc_feature (163)..(163): n is a, c, g, or t
  misc_feature (175)..(175): n is a, c, g, or t
  misc_feature (193)..(193): n is a, c, g, or t
  misc_feature (203)..(203): n is a, c, g, or t
  misc_feature (208)..(208): n is a, c, g, or t
  misc_feature (219)..(219): n is a, c, g, or t
  misc_feature (244)..(244): n is a, c, g, or t
  misc_feature (248)..(248): n is a, c, g, or t
  misc_feature (251)..(251): n is a, c, g, or t
  misc_feature (311)..(311): n is a, c, g, or t
  misc_feature (313)..(313): n is a, c, g, or t
ggggggggcgggggcccccattttcccccaaaagcccaaaggggtaaataaattttttcccctaaccccccccccccccntttttncnggggggggngggggggncccaancggtttttttncttggncccctttatttttgggggaaaaangggggtttttnaacccccccccnggtaccccccccaagggnagggggaagnttttngggcccccctnggtttttttttttgggggggggggntttnagntttttgttttttaaacccggcctttttttgggggcccccctgcccccaaattttgccccnantttttggccccccttaaaaggttttttgggga

SEQ ID NO: 569474 - DNA, 447 bp, Homo sapiens
  misc_feature (37)..(37): n is a, c, g, or t
  misc_feature (46)..(46): n is a, c, g, or t
  misc_feature (151)..(151): n is a, c, g, or t
  misc_feature (219)..(219): n is a, c, g, or t
  misc_feature (267)..(267): n is a, c, g, or t
aaaaaattacttaggttcgggcccggtgtcacgcctntacccacangggagccgagtgggaggatccgttgagctcaggagttcgagaccagcttggccaacatggtgaaccccatctttaccaaaatataaaaattagctgggcgtggtncatgcatccataacccagttactggggaggctgaggcatgagaatcgcttgaaccggggaggcagatnttgcagtgaccgagacggcgccactggactccagcctggacaacatgntgaaaccccatctgcaccaaaaatataaaaattagctgggcgtggtggcatgcatccacaatcccagctactggggaggctgaggcatgagaatcgcttgaaccggggaggcagatgttgcagtgagccgagacggcgccactgcactccagcctggactacagagcgagactctatctc

SEQ ID NO: 569475 - DNA, 188 bp, Homo sapiens
  misc_feature (38)..(38): n is a, c, g, or t
  misc_feature (114)..(114): n is a, c, g, or t
  misc_feature (133)..(133): n is a, c, g, or t
  misc_feature (160)..(160): n is a, c, g, or t
gggcgacatagcaagaccccatttctacaaaaaatttnaaaattgtcatggtggtgcacgcctgtggtcccagctactcaggaggctgaggcaggtggatcacatgagcctganaggtcgaggctacagtaanctgtgtgatttcatcattgcactctancctgggtgatagagtgagactttgtctc

SEQ ID NO: 569476 - DNA, 998 bp, Homo sapiens
tttcgtcttgggccaaaaaaagtcatcgaaatttctgagccccttacatgggaaaaaatgaaagagcccccctgttaagaagaggctcaagtatggtaatttcccgactcaattgaaattaattgggggttcgaagcctcgcgaggtgtagttcaaatcaactaagtggcaaatcccctactgataaaaagcacatatcagtacataagggtggataagcgcctataagacaagcagaattgattcttatttgacgttaggtacgtaatgaagggcataggtacggtaaaattcaattcactgtctacataggttatcgtaagtagcgcaaattcagaccctaccttgtttgacttgggccttttgtatatagatgggccctactatagcctacgggtaattccttagggctagccttctcgacagatagctcagagtagagtatagtccctgcacaaaggtagcctatgcatgggacaatgcgggtacattcgagtcctgacatacgctctacagatgcttggagatctctgtacaaagtctgagagtgcaacgttgggatactagatgtgagtacccgccgtcccctaacatctcctagaaagaggaatattagagctacccgttgtatgtctcagcctctgtgagactggataagcagagaatctacgctgagaccatggaatccagtacgtcagggccctacagtagaagcgtgaaagcagtaatatcgatatattgttttatgacacatagatctgtggtaacttctatacagccccaaaagatatgctaataacaggcaataatggaaacacctttactgtctttcagcgaacatctgcctgacttcagactgggtcaaaccatgggggaattccagaatcttgaatatttcaaggtctactgcccttgcagaatcagacagtaacaagtgacaactatcgtagttaagtgtgaaaacagtatggtcagataccgcgctagggtatgttaga

SEQ ID NO: 569477 - DNA, 1191 bp, Homo sapiens
agtactacagaccggaggactgccgatccatgaagctaatgtacaaggagtcagtgtgtgtttgaatggcatccccacctatacgcttcgtggctcccaaaaccctgtttgccaacgggtccatctacccacccaacgaaggcttctgaccgtgcctaggagtctaggaattcagaacgtcagcacctagcaggttcagttgtccccacttgtttactctacccatcctacacttacctcaactgccgacccgtgttctggcagcaagcggtgactaggcctgctaccctcaaccaggaggcacacatccttgtccctggcacatccacccggtcacgggaatccccatgacctgctctgtgacaactgcagctgagcctctacatgcacctctgtacgcaggccattggacaccactggcacacattgagccctgtggtcctgccgctgctctggctttgcagagagcaggcgccactgcacggcggcagactcttcacacatatctacacatacagctacgtgtcgatgcccacaggtgcactgcactaatgacacagtaccgtcctcctggcgcctggcactgagatccttgatgcctacggtccctagttcatcttgacacactcccgtgagcccccgacacacactgccaatctatcctctggcactaaccacactaacacagggcttcaacagcggatcacgcgcgggcctctgtcctcgggcttacatagcctaaatatcccgctggctggacctccatgctatccaacatgggcctctctgttcgcatgaccagacagcacaaactagaaagggtccctatgatgaccacacgtgatagcaatacaagcgcctccgcacgcatgggcctatagcaccgggcgcccacagaggcgcaaccactacaagacccgcacctatgccaccggaacaactcccaggccgactgtgacgcagactccccagcggcccccaactcaccccttgcccctgcccctatctgcgcaaccgactcaaaccgcgaacgtaatagacgcatacccactagcccctggtcgacagacgcagcgacccgactgcgcacactggcatttcgactcgtactcacacctgcatcacgacacgctccgggcggtcgcggctacagacgcgtagtcacacaacaactgaggacaagaacgtaga

SEQ ID NO: 569478 - DNA, 126 bp, Homo sapiens
gagaagacgaaaaaggcgctgggagtcgatcaactctaggctgccaactgcgttatgaaaagtggaagtacgtcctggggtacaagcagactgtgaagatgatcagacaaggcaaagcgaaatgtg

SEQ ID NO: 569479 - DNA, 361 bp, Homo sapiens
gatctagaggatcccttagaagacgacagaagggcatctggagcagattcagactgtgccttccagtccatggtgacaggactatccagtgtgcgtgtgctcctcttggcaggtgtagacttctccctggtgtggggtcatttccaagatcagcaggatctgtaaagtcagtctcctttacggatcaggttgttggtgcacgatcgctagtctgtttactcctgtccattcaggaaccatcggacttgaatgcttgctgggtagaaatccgtcacgtggcagacaagcaggttgtggtgctgcaaggagcccttcttggagggggaaacattcaccctagggtggactcggcgctgcaggg

SEQ ID NO: 569480 - DNA, 368 bp, Homo sapiens
catgggccaggtgttcagtaaatctttttttgaatggacaaattgtgaagtaccacagttgcaaccacgtacacgttttcctcattcccaatgtccaaaaattcccttgtgtccaatgataactcccagtgacgggatgcctgctatgtgcctgtgtgtgtccatatccatatactgttttgttgttagtttttatatgcaattttatgtttttcccctatgcaattttatgtttttccagacatggagaatattactccatgtctggaatttatggacatccaagattttggcatactgtattacatgaatgatataatgttgttttccctataaaaccactttaaaatcatatatgtgtgatgaga

SEQ ID NO: 569481 - DNA, 193 bp, Homo sapiens
  misc_feature (45)..(45): n is a, c, g, or t
atccattgctgcctcagcccccttcaaagacccaggcccaacacngcaccagctccttggacactgcccatcttcccagggagagtctcgtgctcagagaggctataaatatacgccggacagtcaagagtttccgtcgccaacagaagagctgagcaaaaggtgaaataaacatcccgtggctgcaaattaa

SEQ ID NO: 569482 - DNA, 112 bp, Homo sapiens
agatggggtctcgctttgtccccccgggtaaagagtgcagtggcatgattttccctccctgcagggtccgcctcccgggttgaagcccttttgctgcctttgctccctttga

SEQ ID NO: 569483 - DNA, 156 bp, Homo sapiens
  misc_feature (23)..(23): n is a, c, g, or t
  misc_feature (50)..(50): n is a, c, g, or t
  misc_feature (94)..(94): n is a, c, g, or t
  misc_feature (111)..(111): n is a, c, g, or t
agaaaaggaagtttccagaaaanaagttaacatgaactcttgaagtcacnccagggcaactcttgaaagaaatatatttgcatattgaaaagcncagaggatttctttagngtcattgccgattttggctataacagtgtctttctagccataata

SEQ ID NO: 569484 - DNA, 648 bp, Homo sapiens
  misc_feature (2)..(2): n is a, c, g, or t
  misc_feature (110)..(110): n is a, c, g, or t
  misc_feature (119)..(119): n is a, c, g, or t
  misc_feature (122)..(122): n is a, c, g, or t
  misc_feature (126)..(126): n is a, c, g, or t
  misc_feature (143)..(143): n is a, c, g, or t
  misc_feature (160)..(160): n is a, c, g, or t
  misc_feature (170)..(170): n is a, c, g, or t
  misc_feature (210)..(210): n is a, c, g, or t
  misc_feature (216)..(216): n is a, c, g, or t
  misc_feature (225)..(225): n is a, c, g, or t
  misc_feature (260)..(260): n is a, c, g, or t
  misc_feature (349)..(349): n is a, c, g, or t
  misc_feature (352)..(352): n is a, c, g, or t
  misc_feature (367)..(367): n is a, c, g, or t
  misc_feature (375)..(375): n is a, c, g, or t
  misc_feature (381)..(381): n is a, c, g, or t
  misc_feature (401)..(401): n is a, c, g, or t
  misc_feature (439)..(439): n is a, c, g, or t
  misc_feature (475)..(475): n is a, c, g, or t
  misc_feature (509)..(509): n is a, c, g, or t
  misc_feature (557)..(557): n is a, c, g, or t
  misc_feature (560)..(562): n is a, c, g, or t
  misc_feature (566)..(567): n is a, c, g, or t
  misc_feature (620)..(620): n is a, c, g, or t
tnggctagtttaaatccacaaaagtaaacaataaacattttcccaaaacaatttttaagtaacatctcattaacctacgtccttaagaactgcataagcctgtattaaanaaataaaanacntgtnaaaaacaagagtatgcnaagagtagaggtactcnggttaatgancaaaatggtgttcccagaggaaaagcaagcactattaaanattaangcaaatccnatcaacacaaatagagccattaaaaaaaaaaagcnagtccaaaaaaggttcccattccataaagattaaatcatttccaaatcacagtgaaaggaacctgagtaattaaccaattttgttttcnacnaagtgcctcagaganaccccacnaaaatnttgtatctaaaaaaacagantaacatttgcagaatgtaataatgtagtgacagtcctnaggttgaatgtaacagactataaaatggttacatcntaattgtttaaacagaacatggtccaataacatnaaaatagagaacagcatccggaaatttatcttatttaatgttcggagnttnnngagnnaaacatcctttccattattttctgcagttagttcttgttcacaatcaaatctnatggcaaccactttctggcattttcccc

SEQ ID NO: 569485 - DNA, 93 bp, Homo sapiens
  misc_feature (60)..(60): n is a, c, g, or t
tcatgagggggtaggcagaaaggatgagaggaaaaagatgctcatttacttaattttcanatgtatttctatttagcaacaattctggttttt

SEQ ID NO: 569486 - DNA, 382 bp, Homo sapiens
gcattaaaaacaataaaattcttaggaataaaattcacaaaagaagtacaagaattgaacactgaaaactacaacacattgaaaattttaaaactcttaaatagacagaaagacatctcatgttcatggattggaaaatagcattaagaaaacaatggtcccaaattgatttatagattcaatacagtttctagaaatattcccagctgccttctttttttttaaatggagaaattagaaagctgattctaaaatttatatggtggccaggtctggtggcttgtgcttatcttccagcactttgggaggctgagatgggagtattgcttgaggccaggagtttgagaccagcctaggtaatgtagcgaaaccctgtctctgc

SEQ ID NO: 569487 - DNA, 244 bp, Homo sapiens
actctggacactgatgtctttgcctaagccaatatctagaagggtttttccaactgttatcctctagaattgttagtttcagatcttagatttaagtctgtgatctactttgagttgatttttgtataaggtgagagacgaggatccagtttcattcctctacatgtgacttgccaattctcccagcactatttgttgaatagggtgttctttccccacttcatgttcttgcttgtcctgtgcg

SEQ ID NO: 569488 - DNA, 161 bp, Homo sapiens
gcttgaatgctaatagaaggtggagacggaagaccacaagacgcgagaacaaggacgaaagaatcagtgtagtttgagaagggagctacgaacaggtctgtcactggtagagacatagttaacaagtggcacatggggtgagaagcaggtaatggtatctg

SEQ ID NO: 569489 - DNA, 1019 bp, Homo sapiens
agcggggggcgaggccaggtagggtgagcggcctccgaagcggagcggggctctgaggagacactttttttttcctccgtccttccctcctctcctccgtcccttcccttccgccgtctcctccccgtcatctcctccttccccacacatcggatccagccgagagcctgctggggtcgagcggtgaggtattgcagagcgcttgcatctcacggggccgtccggacgagggtagcttggacgggggcggaacggagcgccgcgaaacccggcgaactggcagacctacagaaagacgacgagacgagaagagagagggaaggagcggacgagacctcagaggggaccacaggacgtcgacaggatccagggagggagaaaggacagaacataatccgacgagagctgcttctacagggcgacggagacagaagaaatggagacacggcacagcgcgcgaaacggcggaccataccagcagcgctccggcgaaccacacacagtccactgaggcctgaggtcaggtggagcaaagcaacatagctgaggcaacgagctgggacgactcgagactgtatgattctaccattccagcagaccacattccccgatcccattacccgcgttcacaaatccgcaggacagagagccacgcagagccaagacagagcacacgaggagcggagacattggcacgcagcaggacttaaacacaccaggagataggacaagagcaaaaaagggcccgggaaaagacacatggaggccacggcccaaaccgagggcttccaccgaggcggggcctcggaagcgccaaggcagggaaaaggagccgctgaagaatccacccccgtaggcagcacaaggggcgcgaccaatagcaccggcacaggaacaaacgcgagccccagaagcgcaccagcgaggcaaaactcacatcaccatagagcagagatatgtgcccagcgtcacggcagaagaacactcccggcgacaaacacgtccgctcaccaagctac

SEQ ID NO: 569490 - DNA, 560 bp, Homo sapiens
agcggggaacaatcacttcaacacctttagtgttgaactcattgggctatgggggatcacggcattgtctaataccaaaagaactttgagaggcagtcccttattggcaaggtacttccttagggaacaaagcattgatggaaccaatcaagataaagggttctcattgtccagactttcttttgtaaaatgaaaagactggcagctggtgtttatcttttccttccaaggctcaggggttagcagctttatagataagggcagtcctaatcataaacccaaactgcatttgcacacaatggtacaattctatccttctatcccttcttgccttaaatcctggggcttgcttcattactaattaatgttccttgtggcattttttccagaataaggcccttttgtccacattaaaaacctattcagggccaggcgcggtggctcacacctgtaatccccagcactttgggagtccagacgggcggatcacttgaagtcaggagttcgagaccagccttggccaacatggtgaaaccctgtctctactaaaaatacaaaaa

SEQ ID NO: 569491 - DNA, 241 bp, Homo sapiens
  misc_feature (7)..(7): n is a, c, g, or t
gtgcacnaatagtctagagggtttttgtacgttatgtagctgagcattccatttggtctttggagcctgggggaagaggacctttaatgaggacaagaagataggaaagtgcaaaaatacaaatggagggactctatctagatggatgctgtttttaagagttcctcaagtttatgtgtgtaaactgaggcagaaatgttaattatattctctaccaaagccacatagtaaagctattgtg

SEQ ID NO: 569492 - DNA, 113 bp, Homo sapiens
cttcaaccagaagtcaggccacacaagacatcagagaacacacacagggaaaactctatgtatgtcacggatgtgggaaggaccttctataagaattcagacctcattagaaa

SEQ ID NO: 569493 - DNA, 884 bp, Homo sapiens
gcaggtagtagcacgccaaccgcactcctggctcgctaggattcccttcatgtcccgaagcgcatcgcaccccctagatagaatgtactagtgccgcgtgaaagatcagtggaccttgggagcacctaatcatactaagctgcgcgcgacggatgcggaattaagttgttgtaacgaggcctggatatatccagggacttaaacactagtaagacttcgggcgtagtgtgtggactctatcaattatgcttggccagtctgagtcgccttgcgtttgaggcgcgacggataccaagattgttcgtatggtagtgacctccgtctgcaaaggagctgatcccggtagaatggtcccaatcatgccgttgtgcgaatggtcaataacgctaggaggagaagtctggcgtatcggagcgtggaggaagtgagctggggtatgatttcgtcagtatgtgaatcttcagttcagagtgttcccattggtgcgcacatcaagaatgcctgctagggagtcgaactcttgttcacctttataggttgctaggttcacaagaggaggaaccagcttctgtttgaccctcctgtcgcattctaatcttgtgacgaggcagtacgtttgttgactctaggcgatctgttggccgtagtctatatggctgcgccgtttgtgccaacagcaggtcgaagacgacggtcccgctcttagccttgctaatcgcgctagttattcgcgtgtgctcctcaaaggcgattggggtcatctattgacccgtagttaggactgttcgcggtatgaatagctttgggtccgtcccttgggttggccttgtcggttgaccctgtctaagttttctccagggctgggcccgtagcatgttcctgtg

SEQ ID NO: 569494 - DNA, 1378 bp, Homo sapiens
  misc_feature (661)..(661): n is a, c, g, or t
gaggaggggccctgtcccctgagccaagagggccatagaagccagtaagaggagtcagagatgtagtgacggagggatctgaaagtgaggagtgaggccccgtggcatgggtacaactgaagacccagtgtaaacggccgtctgacagagaaattcttcctaggtcagtagctgcgctcgagccctcgtgtcgcaagtgggacccactgtgtgaacaggggctacgcctcgagtcaaccgccacgtgtgggaagggcatggggggcctgtacgctctcgcgctatgagcctaatgggcaaggcgaaggccgaagacggatggacctcagtagagcagacatgctcgaaggacgtcactcgtgagcagggaggacggcagagcggccagcgttgtcgaaggcctcgtggcgttcatgggcagagacggcctcgaggagaaaaaggctcttctagggtctggtagacattgcctccagcaccgcgtgaccaagggcatgtcgcccgccagggaagaatggtacgcatgtgcccatgacgtcgcctcctggtgacacgtgacagggcgcctgcaatgtttcgccaagtggaccagggtcctgcggagaacgcgggagcagggcagcgacgtcggacaggagtcaggacaagctgcaggacagtngcgagcagctggacggcacggcacgggcgagcccttgcgtaccaagtgccgaaagggccttcgaggacggaagcgtgtcgcgcccgaaggttccagacggccgcctccgggggcccgtggcccataggggagtccgcccgaggacacacgggggcttggcgccaagcaacgtcactaggaaaaaactaggggggcacttgtcaagcccgcgccgcaggggtcccagggtggggggcacacgccagcgcagcggcagtgcaccttccaagcaccaggcagacacgtcgaaggacagtccaggaccagtggaccagacgtacgggcaccttgtgcaggccaatgtaaatgcgaacgcgtccaacggcaaacggtccttgggcggaaacatcccttccgaagggggcctaagatcctcaagacagtttctaatgggtaccttgtgccaataggggggcgcccccccttctatgatgatggcgtagctggcgtctatgttattccagtgtaccacaggatacacaggggtatgaacgaaagacgccatctgcatgctcacactctgtcaagaccctagctgcagcggcgcagctacggtgtactcgtctgcgacacactgtgacgtacgcacaacatagcagataaatggtacgcttatctgtaagcgaccagtcttaagaaatactttcaatgaaacagtgtacgccacctagtaaacaa

SEQ ID NO: 569495 - DNA, 126 bp, Homo sapiens
cacagcagtcctacttctcctatctctcccagtcctagctgctggcatcaccatactactaataggccgcatacaaaccataaaagcatcactgggatttaaggagaattgagagaatgtacccac

SEQ ID NO: 569496 - DNA, 344 bp, Homo sapiens
agcggataggggtggggtgggtaaggatcagataagccagaagcaggtgattttagttggaattgtaaactttattcagcccccacacgcgtgcgtggggaatgtggaatgttctagactctgagatgtttactgagaaaagagaattcaaactaagccgatacgtgcagctcctatcgtatgaatccttcattatccagtttaatcaggagtttcttggtctgttattaacttggtctcacagaaggaattcaagtcctagatgactgaatccctcaatttgttgttccctgaagtatggaattgaagttgggccagtatcaaatctctggatgccagagagg

SEQ ID NO: 569497 - DNA, 969 bp, Homo sapiens
gggctgactgcacgcgggcggctcggccaccccgacaggtgcttccaggcgcgcagtggccctgctccctactcagtggcggggctgatggacgaggctctcgctgggccttgtgcctcccagaaaatcccctgtggaaggcccagtgcccggaggtcaaggtggggcaccggtgaactgagtgcagctgaggatggtgggcagcggacatttctgggtgcctgggggctcggaaccccatctctacgcccggtggccgcggagctggagcagacgcggtaccgctttgggcgggggcccaaaagcccaggttcactcgggacccccgggcgccaagccaggtggatcccgcgtccattccggccagggagaacccccgcgaagatacagctcagagatagccagacgataccaaggagtgggggccgaggacggcacatgagggccagagaaaacacggaggagacgaagaggacgaagagcgagccgaggacaacaacaacacaaaagggaaggaagccaacgaccaccaaagaagacagagaaccagaaacaaaggagagacccacatacacgaacaagcaacagcgaaccaaacaagaaggagccaagcagacgcaaagcgccacccagcgaacagaccgagcacccgagagaacacacaaaggcgcacgaaaacacgagaaacacgaaacgcagcaggccgccaccgagaccagacgcaaaacgcggagacgcaccccgggcagggcgagacgcgcacgaccaacaggggaaagaggacgacgaaagcgcagagcacgaagcacagcagcatgggaacgggaaacaagcgcacgaacgagcacgacaaaccacaccgcccaagatacaccggcgaacaaacaaggcgtagccaagccaaggccgaacagagaaggaacagcagaaccagcagaggagaagaagcaccccgcgcggacacagagg

SEQ ID NO: 569498 - DNA, 314 bp, Homo sapiens
cttagaggactcctcgaatcgacggtttcccattctgagtgcactgcttgtgttgctcagaagcgctgctcacatctatgacatcagtgcattgagctccactgtatctgcgctgtgaccgagtaacacggcttgagttcctgcctttcactttctccttggctacagcttgtgagttgtccatggaagctcagggaaactgcgtggaaagcccttggggatgaccaccttctccttttaggacccccaggcagaggggaaatacaggagtggcaaatcagggactggggttcatttctcttcttggtctttct

SEQ ID NO: 569499 - DNA, 282 bp, Homo sapiens
agtatgtgttcagtatacagagagttctcagtcttgaccgcgatcagatcttctgagatccatgtatagccactgagcagaacatgaacgccaatgacgtgagcgctgggagcaagcgaccgagaatactatacgaaggcatgggatgccattgactccatgggaccaatgcggagtgatgcatacacatctgtgctcacattctacggagtgagtcttgacacactaggagaatacactgtgtgccaatgactacaccatgcgttatcgtttgtactggcg

SEQ ID NO: 569500 - DNA, 294 bp, Homo sapiens
taaattaagcggccgctcgaccttttgctgtttaaaagctctttagtttggtcccacttttctatttctgtttccattgcaattgcttttggagattttatcatgaaatgtttgccaaggcctaggtccagaatggtatttccaaggtattttgctagagtttttatagtgataggtcttacgtttaagtctttaatccattttgagttgatctttgaatacggtataaaaaaggggtccagtttcaattctctgcatatggctagccagttatcccagaaccatttgtcgacg

SEQ ID NO: 569501 - DNA, 398 bp, Homo sapiens
gtcatgttgccagtggatcagcatcatgaccgagcgtgtagcgtgccccacctccagaaagtattcgataggtacaagagttacagcccttatgacatgttggaaggcatcaggaaagaggttccaggagacctggaagatgctttcctgaacctggttcagtcgcattcagaacaagcccctgtatatactgctgaacggctgtatgactccatgaagggcaagggggacgcgagataaggtccttgatcagaatcatggtctccctgcagtgaagtggaaccatgttgcaaaattcaggtctagaattccaagagcaaagtaccggccaagtcccatggtactatttatatccctgccaagcacactaaaggggcgactaaccagcaaaagcgcct

SEQ ID NO: 569502 - DNA, 628 bp, Homo sapiens
  misc_feature (21)..(21): n is a, c, g, or t
  misc_feature (23)..(23): n is a, c, g, or t
  misc_feature (25)..(25): n is a, c, g, or t
  misc_feature (31)..(31): n is a, c, g, or t
  misc_feature (34)..(34): n is a, c, g, or t
  misc_feature (51)..(51): n is a, c, g, or t
  misc_feature (56)..(56): n is a, c, g, or t
  misc_feature (66)..(66): n is a, c, g, or t
  misc_feature (68)..(72): n is a, c, g, or t
  misc_feature (75)..(75): n is a, c, g, or t
  misc_feature (93)..(93): n is a, c, g, or t
  misc_feature (102)..(102): n is a, c, g, or t
  misc_feature (109)..(110): n is a, c, g, or t
  misc_feature (115)..(115): n is a, c, g, or t
  misc_feature (134)..(134): n is a, c, g, or t
  misc_feature (137)..(137): n is a, c, g, or t
  misc_feature (139)..(139): n is a, c, g, or t
  misc_feature (194)..(194): n is a, c, g, or t
  misc_feature (204)..(204): n is a, c, g, or t
  misc_feature (207)..(207): n is a, c, g, or t
  misc_feature (209)..(209): n is a, c, g, or t
  misc_feature (233)..(233): n is a, c, g, or t
  misc_feature (237)..(237): n is a, c, g, or t
  misc_feature (244)..(244): n is a, c, g, or t
  misc_feature (250)..(250): n is a, c, g, or t
  misc_feature (266)..(266): n is a, c, g, or t
  misc_feature (269)..(269): n is a, c, g, or t
  misc_feature (274)..(274): n is a, c, g, or t
  misc_feature (276)..(276): n is a, c, g, or t
  misc_feature (296)..(297): n is a, c, g, or t
  misc_feature (309)..(309): n is a, c, g, or t
  misc_feature (312)..(312): n is a, c, g, or t
  misc_feature (327)..(327): n is a, c, g, or t
  misc_feature (332)..(333): n is a, c, g, or t
  misc_feature (337)..(337): n is a, c, g, or t
  misc_feature (345)..(345): n is a, c, g, or t
  misc_feature (347)..(347): n is a, c, g, or t
  misc_feature (361)..(361): n is a, c, g, or t
  misc_feature (365)..(365): n is a, c, g, or t
  misc_feature (411)..(411): n is a, c, g, or t
  misc_feature (420)..(420): n is a, c, g, or t
  misc_feature (423)..(423): n is a, c, g, or t
  misc_feature (431)..(431): n is a, c, g, or t
  misc_feature (448)..(448): n is a, c, g, or t
  misc_feature (462)..(462): n is a, c, g, or t
  misc_feature (467)..(467): n is a, c, g, or t
  misc_feature (491)..(491): n is a, c, g, or t
  misc_feature (494)..(494): n is a, c, g, or t
  misc_feature (497)..(500): n is a, c, g, or t
  misc_feature (503)..(503): n is a, c, g, or t
  misc_feature (508)..(508): n is a, c, g, or t
  misc_feature (516)..(516): n is a, c, g, or t
  misc_feature (530)..(530): n is a, c, g, or t
  misc_feature (532)..(532): n is a, c, g, or t
  misc_feature (628)..(628): n is a, c, g, or t
tcatattttaataaacataanantngttttnttnattacatacaattttanctatnttaatatatntnnnnnccnttaagaattaaaaataanttacttttnttttttnnccaanaataatctaagttatggcngcntnttcaatgaaaggtaagtccggcccaatttttctttttctttttctcagataatcnggaacatcanccnanctttacattacgataccataatgncccncagaacncaagtnccattaagtagaaatnaancctcntnttttttcttttttaggaaanncccccccttttnttntttagccatcccccnaatanncttnctctactntncaaataacttttcncccncaagagctgcctcaagtaactttctttttggaaagctttcaaggcntgagccagngtngcaaaatncccctctggcctttgcntcttggggtttcanttttnctttaggttttagaccccagtttntanttnnnnccnaatcnttcccccntttttttccttttntnggaaagccttgctgtttcccctgttaacacaaagatagaaaatgtcaaatagtttaagcaagtttttggcagaccacagacatgaaacagtgccgn

SEQ ID NO: 569503 - DNA, 253 bp, Homo sapiens
acgctgtgactagagacttgataccgaagtctacaacgcactataccctacgataaagctctaaatcgcagaaccctcaaccctcggactcgagcaaatcctaaattcttcctcattgttttttttacctggtgtcccgaaaccggggagcactcagacgcagacagagcctgcgtctgtgtgctcttcagcctcatgggcttgactcagtgacacaaaaggattcttttgtgctcgccgagaagatccagaa

SEQ ID NO: 569504 - DNA, 313 bp, Homo sapiens
aaaggctctctgactgctccttcccagatcttctcagcttagcagctgaagactgatgctgcctgatcgccttggaagccccctggaccattacggatgctgagctttggataactcttacagtagaggattcccaactatatgaagacaccctagctggacgatcagttcttattaagaacctgacccctcaaactctacaacctcgatggactggaccctacttagtcatctatagtaccccaactgccgtccgcctgcaggatcctccccactgggttcaccgttccagaataaagctgtgcccatcgga

SEQ ID NO: 569505 - DNA, 610 bp, Homo sapiens
  misc_feature (47)..(48): n is a, c, g, or t
  misc_feature (115)..(115): n is a, c, g, or t
  misc_feature (485)..(485): n is a, c, g, or t
aagctcgtacccctcacggattactcaagaaaatcacagtgggtgannaagatacataaaccaataataatagtactttacaatagacaaaaccatgagaatgaaagaaaggccncttttaactagcggacagatgagaaggtttcacaaataaagtgaaatctgaactgagctataaaaaaaacgaagaaattttgcctggtgaaaataagggtgagggaattatagagttgcaacaataagaatatatatttggtctttgtctccacttccaaacagagagcttctaaaacctatggtattcctaagtgacaggaatatcttttgttacttgtaacaagcctattcccaagtgacaggaatatcttttgttacttgtaacaagcctattcccaagtgacaggaatatcttttgttacttgtaacaagcccctttcaaccacactagagtttatgctaatgaggtgactagtggtgagtccccngacacttcaggatggacactggttgctagaggaaccaaccatgtgactagcgggttggtaccttcagttccacctctgggaatctagagaggggatgggggttggagattgacgtatccgtgagg

SEQ ID NO: 569506 - DNA, 1426 bp, Homo sapiens
  misc_feature (321)..(321): n is a, c, g, or t
gtgaagttgacgcggcggtacgaaataatggcggccgctacgaggggatcctggactctcgtaaactgcagtttgccccttttagctacgatgccttggcactgttgaggttttcggcatgagttgacccataagaacgtctgaacgaagatatcgcgtctggatgtaacgctcccatagtgactttaacgggttattactacaagggtgactctgttggcgctgtcaactcgctataagcattgtgatgttcagatgcttgattagacattgagtgctcccatcccgcagtgccgttatgcatgtcccagcttattatgngatagcacatgttataacgaccaactactactatcgagctcattctcaacgacgtgctggataacgcacatcatcctgtttcttgggcacacacagcagccaatgtgacgatactggcgaagtgctattaaaaatcggtggcaccgtgcctcctttggacaaaaacccctttggtcacctcccttctgatctatagctatcacgtcactactgtatgcacctacgttatggccattgcaatctagataagtaaaggatggcgccaacccttgcgtatgctacctatgggggaccaacgcttattttccataggcgccatcccgtggttgcttatccccactgaaaaggcacggtttggaccaccttccgttcacatctactaagagtgcgacctaatggtgagcggctttttgggacttcgaggagaagcgcgttgttactagcatcatagagacctcacgcatctgaataggctacctaagacatgtttgttgccaattaacttgcatataaatcccgtatttggtaacaaaaatcgccacgacataggggacaccgtgcacccaaggaatgcatgtgcgcctcttaagctattgactttagaccagtcacgaaacggtaaattggaagtggaagcgcaaaaacaagtgggggttgcccatgggaggttgtttcccttttggcccttgttcaacaaccgcacgttaaccccgcgttgagaacttaacatctatccaccaacaagggcttccccatacgagtggcgaccggcacaggaaagttcctatcgccgcaaattttcggcggtctgcggtaagttgacctcgggaatcacccgcacatggggttagaaccttttacgggcacccacaggttcaacaccccctctgagaactgtgggcccgcctcgtctggagaaggaggcacatgtgcattcatacagacgaagtctcctctcacccacaagagcccgccaaccgacggaaatcaggcgaacgttaaactgcacagtcctaacccccaagcattccctcaggatcagacaacacgttgtcgctgctgtgcgcgttataccctgtctacgattcaccggacaaacaactag

SEQ ID NO: 569507 - DNA, 495 bp, Homo sapiens
atgatacgactcgagctcggacccggttcgcatgtgtccgggtctttgagtagcacgtcacaatctggggctgatcaccccacacttgcttactttagaatatgtaaatggtgaacgtgactcctctaccttttgccgagctgcccatctaagatatgttcaaggtcactgcttcaagtagctatgcgctatggctgccatcatgcgaggatcagtaattatggggagatggttcttaaggtctgaggaaagaggccaaggttagtgtatgaaaggtaaagagataagtaacagtcacatctgagtatggagttaagtaactgaaaatccgtacatgttgtgaatccagctctgctctgacctatcgagaactgagagcgagaggagaccaggtgtgagattgctatcggccattcttttgtacctcctgcctttgtcaggccagatgcctcgtcttctaattagtgacgcgcatgaatggatgaaggagattcc

SEQ ID NO: 569508 - DNA, 526 bp, Homo sapiens
aaccaccaggcggtccggaaccgtgagcggctgccaggggctctgggagggctgccggcagccccgtccccctcccgcccttggttttagcagaacgggtaaactctgtttcctttgtccgtcctgttgtgagtaactgaagcctaggccccgtccccacctcaaatcacacacaccccctccccaccacagagacaccattacatacacagacacacacagaaagacacacacagacacaaaatcacacacacaccctccccgccacagagacaccattacatacacagacacacacagaaagacacagacacaaaatcacacacacaccctccccgccacagagacacaccattacatacacagacacgcaatcgcagatacgcccttccggccacagaaacacaccattacacacacatacacagaaagacacacacagacacacaatcacacgcagcccctccccgccacagagacacaccattacatacacagacacacacagaaagacacacacagacaa

SEQ ID NO: 569509 - DNA, 1632 bp, Homo sapiens
gcgttgtgtttgatgaaggatcgtgcttagttgtgctcgcacttctattttgtatttttcttctcatctgacattctcgttctgtgtgttgtgtctccgtccatgttctcctgccaggttgttatagtgtggttgtggatagctttcgtaccagttcgctgttgtcccacctcgtttgggtgagactacttttgttgttgttgttgggttgggaccggtttgttgttcgtggtttcctgtctgcttacatctatgggcgcgtgtggggttcgtccactgactctttatgggggccgtccaccatctttgttttttgtgggccccgacttttttctctttactcctgcgtactaccacaggcggtggtgctactgaggggggggggtctggcccccccagattgtggccagctccacacagctgtgtttgttatcaacacccagggggggtcgactttgttttcttccgtgttccagcgaagtgctgccttgtggctgccttcatttggggggggcacgacccagccccttggtggcttcctctggcttcgtccccgcgagggggggttgtttcccccctcttatctgcctttttttttcttgttgtgggcgagccaaaccagagccgactcttgtgtgcgctgctctccgctctcttgggggggtgtttgtggacggaaacacatataattgttgtgtgttgtttgtgagtgatttcccgctgtcttcatcttagttttgtgtcacacaggggggtggcgccctccacaatgtgtccctctgtgggagccaacaacaaccatctagaggtgtgtgcttccttggtgggtgtattttcgcgcgtttaattccctggctagtttgtgtgtttgttcacgcactatttgttacgtctctttttttcccccctcgctcgtcactcatgattggagggcgcccgcccgttttacacactgggtggtcttctgctcccctttgccgccctggttctctcaataacacacctactcctgttgtttttctcgttttccttggtcccccccccacacagcggtttttttggggtcccccacagtgtttgttctctgcgtgtgtgtgtccccgcacaagtactccttctgtggcaccgcgctgttggtttgttgtttttttttgtgtttctacaggggtgccccacacgtgtgttttgagacacacgctcgcgggctcgttttgtgcttctgttgtgttcactcgcgggcccacacaggtttgtcttctctctcttttgtgccctctcttgttgttgcgcgcccccgagtctcccctctctccccacgactatattctcttttgtgtgggaatagagagagggctcttggcgcacctggcaccgaccgtggtgggtgcccgcatatacccccgtctccacacgagaagaagtgggcccctcccccataggagatgtgcaacccacagagtgaacaaacggggcccccaatcgagaccacacaaagggttaaggggcacacaccccccccccgttttttttgggagagaggggtacccccatttttccccccccggggctcccctcttcggttttctatttcccctttactttgtattacaaaaaatatattcctttttggga

SEQ ID NO: 569510 - DNA, 221 bp, Homo sapiens
aggaggatccccctctctccacactggtccagctaattttgtatctttgtagagacggggttcgccatgtgcccaggctagtcttgaactcctgacctcaggtgatccaccagccccggcctcccaaagtgcttggattacaggtgtgagccaccgtacttggccacgccattttctctttggtaaaatagagaaaatagagtcaaccagtgtggagagag

SEQ ID NO: 569511 - DNA, 158 bp, Homo sapiens
  misc_feature (116)..(116): n is a, c, g, or t
ctccccatcaggcggtgcgggcggccagacaggcggctgacttcgctctgaaggtggaagtggaatgcagctcgcccctgagttgcagctcgcccctgagttagcagctcgccccntagttagcagctcgccctgagtcagcagctcgcccctgagtt

SEQ ID NO: 569512 - DNA, 843 bp, Homo sapiens
tcacgttctaggaatcctagtatatcgctcacacctcatatctccctactatgcctagaaggaatcatactatcgctgtcattatagctagtctcataaccctcaaacccatccctcttagccaactatgtgtgcctatgtgccatagctagtcttgtgcccgcctgcgaacacaccgggtgacgccatacgcccatacctaggtctcacactcttccaagcacattatgggcctagactctacgttagagtaacccctaacacctacccgccagtgctaacaacacataaattcggctccccaaacaactttctagtaactaacccacgtgaccattgcctcttccaccacacaacacaccttaatttctgaactccaccacacacaaccacaccagcagccttaaatttataacgcactcattccctcatccaatttatatcaacccaaaatcgacggacaaccttacttcagctcggcccccaaaccctttacttcgcgaaccacaataacaagccccctcgttaaataccatactaccctgatcttctacccccctacaaatacttgtccactccacaccgcgcacttccttcccggtggataacccccgtaatcgaaggaaaaacaaatatcctaaccttcacttctacttcatcttccctacagaattttcctttcattcattcaccattcaccacgccacagaactcgtaaatatttagtattatctatgaaaacacacttatcccagggtggtaatcaaccgcccgattgagcacaccgtcgaatgtctcacgcgggcattcgtcaattctccactcgcgcgccttcctacatgg

SEQ ID NO: 569513 - DNA, 221 bp, Homo sapiens
acacctctgcctctttgcattcccactcagatgtctaggagtaactcaagcttaacatgtccaaaatagaacccctgaactttccctcgcctttaagtttgctccacccccccctctcccctcagtgactggcatcactgctcactgttgggccggcccaggcctcacagttaacctttgtctcatctttttttcatatttcccctccgctaccataatca

SEQ ID NO: 569514 - DNA, 454 bp, Homo sapiens
gctcggtaccccagttactgcttcggatgcaagagcatgtcaaccgcgtgctgtggtacctcaaagtctgcataccgtcgccctttttcatcggcaaggatgcctttgggggaatgatggaccacgctggcaaaacagagtccgtctggaggcaaaaccttgtttctccagacatgggccaattccttggtgacaaccttccccaggcataacacctttctgagcccacttgttatctctcgcctggattggatgacacttgttccttgttacggccttcttttgtggtgctatcttgtgcctttccctataatcattgctcggttcccatgtcatctgttcccgagttaccacattagtctccccgatgctgacaacttaccgtgcctcgttttgaccaaaaattacagatggggttccgctctgctaccagactaaactgcacttcttcaac

SEQ ID NO: 569515 - DNA, 379 bp, Homo sapiens
  misc_feature (279)..(279): n is a, c, g, or t
tttactggctgcatgtgctgtgaatatcccaaggaactggctgtggaatgggtgtttgggtcagtttgtgccctttcagtagaccctggagctgctctgtcccttaaaaggccccgtgccccaggcatggcaagggcctgcctttccccttccggtggtcacacgcccacgccgtgccacccgatgcaggactcccctttgtgccttgctgctcctgaggcccaagggcagccatggtgttttgtactgctcgggccgcccaggtcccagagcctgagntttgtagccaaagcagcctgatgaccccccccccaaggaagaaagcagaataaacatttttgccctgcctgaaaaaccccgggggtcaggggtgagccta

SEQ ID NO: 569516 - DNA, 177 bp, Homo sapiens
gtctgggcagcaatgtgcagatcaagtggtgcatgaaagcatcctgctctatggtctcctcagtggtctattattcgtgtgtggtttttattttatatatttttcactggctcacacctattttacccccatactaaccagcaattagtcaccatttagacctttctgatcaacatg

SEQ ID NO: 569517 - DNA, 356 bp, Homo sapiens
  misc_feature (1)..(1): n is a, c, g, or t
  misc_feature (42)..(42): n is a, c, g, or t
  misc_feature (48)..(48): n is a, c, g, or t
  misc_feature (55)..(55): n is a, c, g, or t
  misc_feature (124)..(124): n is a, c, g, or t
  misc_feature (126)..(126): n is a, c, g, or t
  misc_feature (165)..(165): n is a, c, g, or t
  misc_feature (296)..(296): n is a, c, g, or t
  misc_feature (304)..(304): n is a, c, g, or t
ngggaggcatctctgacaccaatcagatcttcggcctgagcnagacgnaacctgnctccttcctgtattatgctctcttcacactcaacctggggaccagctaccccagtattagcacctcttntntacacacctcattgacaacaacaggaaccagagcctggnttttcaggacctcttctgtgtttacctaacactcgagtaccagactgggagagagccaccgtggagatctttgtggggattaactcttatagacactgcatgaacgaactggccacctgctaccctcaagncttacagncaaataaccacacccagaattatcatgagcccagagcacacagcctgatttg

SEQ ID NO: 569518 - DNA, 282 bp, Homo sapiens
cagtagtagctaggaattcggttagcggcgccctaaaaaaaggggggcggggcggtaggggacagggtctcactctatatgcccaggctagaatagcagtggtagcaatcatagttcactagcagcctcgaactcctgggctcaggtaatcctacccaccttaacctacccaagtatactagggactacaggcatacaccaccacactatggtaaatattatagtataattaggtaagagattggggtatagccatgtagcccaggctgttctcaaactacc

SEQ ID NO: 569519 - DNA, 110 bp, Homo sapiens
ggcttttaatctgaagtgaagtatgcatatagcagcatcttaagggccattttagagttgcttacctactctaactcattaaatgtaatcatagttagttttgtatatat

SEQ ID NO: 569520 - DNA, 100 bp, Homo sapiens
  misc_feature (83)..(83): n is a, c, g, or t
cccgaagggttagggaaggaccgcgctggaggccgctgaaagtgaggatccgccccgacagtgcactctggaagcctggaagngttgcccatcggagctt

SEQ ID NO: 569521 - DNA, 511 bp, Homo sapiens
tcatcagatgatcagagaaccgggaggcagaggtgcagtgacgccgagaccacactgcactccagcctgggtgacagagtgagacgatgtctcaaaaaaaaattagccgagcatggtggcatgtgcctgtaatcccagatacctgggaggctgaggcaggagaatcacttgaaccgggaggtagaggttatagtgagccgaggtcgcaccactgcactccagcctgggcgacagagcgagattccatctcagggaaaaaaaaaaaaaaaaggaagaagggaaatctcgtgccggggtgccagggatggaagagctcaggtctagggggcggggaagccttccagaacaggtgaggggggtctccggcctgcctcccagtgcctcgggttagactcacatccggcggggggctctgctgacggaaccctgtttggattgggttacttgtatctgtcacctttcgggctctgtgtgggggtttccaggcccccgacaaaggggggggttctct

SEQ ID NO: 569522 - DNA, 153 bp, Homo sapiens
gtcggcccttgttgattgagcagcaggggtacgctgactgggggctgctgcaccggtaattagattggaagaaaacaggacaggtattttcacagtgcttttctatacaatgtctataatctatagatacataaccgttgagatcaggcatgt

SEQ ID NO: 569523 - DNA, 489 bp, Homo sapiens
  misc_feature (125)..(125): n is a, c, g, or t
tgctgctacccattcactgcaactcgggggggacgcgcaggtcgcgagcctaccaactcccccaacgaccctccatattggaccccaggaagccccctgctcccggccatatctcatcaccacgngacaccttccaactccaggcccgaacttcccttcaccccgtcttctcccccacgcctcagcctcatcaacgtcacctccacccaccaaccccttccttccattccccggactccgcctctcgcccccgaccccgcaccagctggccaccggaaccaccactactccagccgtctcatcacgctccggccaccacccggtccaactcgccctccccgggagcccacctcgccccacctctcgccagcccctaacggtcagccgagaccgcgcacggacctacaccatgctatgcctccacagtcccccgcactcgaggtcgtccaccactccctacccccctccattcagcagcaaccattcgcg

SEQ ID NO: 569524 - DNA, 167 bp, Homo sapiens
ccaccgattccagcctgggctacaagagcaaaactccatctcataaaaaaagatgtgtctcattgtatctttgtataatcaaactgtgagttatgacacccatataaatgaataatacagagtggctgtggcacagttggctacacgacctgtacattccacgcaca

SEQ ID NO: 569525 - DNA, 386 bp, Homo sapiens
gggcacagttgaccagatatgtgcagtattcattaccacaatgacaagaagtgatctctgcaagagttcatggtgtgagcaggcaggcaggaggccctcaccatataggatggatagggagcacacttctcaggcggaactaggtccgttaaatgatagaaaactttctcctcttgacccttcttcgcatacactcttgacaaactttaaccaaacactactacacagacacgacactttttactgtaccaaacgactctattaggcagacacgttttcgttactttactgactacacaaacaactggcacaaccccccctaacactgctcaactggcacctgtctacacccactactacagctgactgagggctgctgctgcgcg

SEQ ID NO: 569526 - DNA, 129 bp, Homo sapiens
ttcaatggaagacagattttactcacttaaacataaagggtataaaactagagctgcaggatttttagctatttgtgaaaacacttatccccactgcacagtaacaattactcgcttaataagaaaagg

SEQ ID NO: 569527 - DNA, 487 bp, Homo sapiens
ggtcgacagagggctggcctctctttgcaaaggtgtaattcagatggaagatacttcagtaatgggtagaaacaaattacttagaggctgtctgtatatcaaggttcttcattttatccttttcatcccattactgagtagctgcattataacttattggtgaaacacttgggttcagaggtcagacagaatggaattctagtccaggtgccactgcttgctgtgtgtgtgtctgggcaagtcatttagcttctctgggcggccccaccccagtgtatagaaagtgagaattataagtttcgacctagaccgggtgtggtggcgaatgcttataatcccaggtactttgagaggccagggtggggcggtcacttaagcagaacccctttagcagatgtttgaacagaagaagaagtttttgcctatcagtgaggggataagaggtcgtcacggccggaattgtagaagaggagtccagcgcggattc

SEQ ID NO: 569528 - DNA, 593 bp, Homo sapiens
  misc_feature (1)..(1): n is a, c, g, or t
  misc_feature (72)..(72): n is a, c, g, or t
  misc_feature (80)..(80): n is a, c, g, or t
  misc_feature (82)..(82): n is a, c, g, or t
  misc_feature (87)..(87): n is a, c, g, or t
  misc_feature (183)..(183): n is a, c, g, or t
  misc_feature (187)..(187): n is a, c, g, or t
  misc_feature (231)..(231): n is a, c, g, or t
  misc_feature (256)..(256): n is a, c, g, or t
  misc_feature (263)..(263): n is a, c, g, or t
  misc_feature (270)..(270): n is a, c, g, or t
  misc_feature (273)..(273): n is a, c, g, or t
  misc_feature (278)..(278): n is a, c, g, or t
  misc_feature (319)..(319): n is a, c, g, or t
  misc_feature (328)..(329): n is a, c, g, or t
  misc_feature (336)..(337): n is a, c, g, or t
  misc_feature (358)..(358): n is a, c, g, or t
  misc_feature (400)..(400): n is a, c, g, or t
  misc_feature (416)..(416): n is a, c, g, or t
  misc_feature (471)..(471): n is a, c, g, or t
  misc_feature (475)..(475): n is a, c, g, or t
  misc_feature (502)..(502): n is a, c, g, or t
  misc_feature (510)..(511): n is a, c, g, or t
  misc_feature (525)..(526): n is a, c, g, or t
  misc_feature (542)..(542): n is a, c, g, or t
  misc_feature (583)..(583): n is a, c, g, or t
nttcttacaaatttcaaaatctgcaccattggatatataagccagaaatcgtacatacaaaatctgaaactnacactgtntnttctntactttgcacacgtgaagtgtcagaatattttcctcagtagtacaggtgtatttatcactaaaattcacaattagggaaaagaataagtgaatcantganttgtggttctcttaaaacttgtgtcattaaataagttagcaganaacacaaagttctgttttgatgtgngcttttngtctcgntgnccaanaccaaacccaactgatatgtactatattcttaaattataanataagatannttataanngttaaccataatgaataagangctggggttatctgctataagataaatgatcagccttccctnaagataaatcacctgnaccacaattcacaaatgtgtttattattcttccctgcttctataacatttataanaggnatttgtgctcagttgtggtctattttngtgttaanntaggtaaatgagtnngacatcctattgccgnacatgatgcctttattgctgggatatccaaaggcattccanatattaacac

SEQ ID NO: 569529 - DNA, 637 bp, Homo sapiens
  misc_feature (492)..(492): n is a, c, g, or t
taacaacacaacctacggctaggtacaggctcgggtttaaactcgtgcacgatggatttctctccaggtgaagcagacaggtgccgacttcctggctgacggagtgtggaaaatggtaggcatccgttgtggcagcaagaagggtgtgaaccttcctggggctgctgtggacttgcctgctgtgtcggagaagtgacatccaggatctgaatgttatgtgggtctgatgcagtgatgttgatatggtgttttgcgtcattcatcctgcaaggcatcttgatgtccatgaagtttggaatggtccttggtgatgatgaatggtgaacatgtacaccagtacaacgcactttaaattccatgccaaacattccgaagcacattccattgcatgagtgtgtgctatctgtgaagtggcttctcgactcgcacatagtcccatgtgcacgtgccaaggctgcattggggactccataggctggtctcgtgtgctgnatactaaggggcaacttgcagcaattccatggcaatgaggcaaagggtactatccgtatgcctccacgaaaggattgactggacattgggatccgagctggcacaacccgagtcctggggtaacgcctgtcaatcttgtgtctaa

SEQ ID NO: 569530 - DNA, 85 bp, Homo sapiens
tggacagatcagcccattgctagctgtgtcctttgccacttgttgtgctgttccgggagttaccattctgatgttggagcggccc

SEQ ID NO: 569531 - DNA, 507 bp, Homo sapiens
tcgatctagaggatccgggggttctcgaggccactcacatttagcacgggtcaggacgttctatggcaaaagagaaaccttctcatttctctatctatctatctatctatctatctatctatctatctatctatatatctatctatcatcggtcagtcatctacctatctatcgataatctatcattatatcagtagggatgcagggatttctctttttgcccaaggggaatggggaatttatttaatttttttctcaattatctggtaatttatttctctcaattatttggctctcagactgggctcaggtggggccggggggagccccttcaggcgggctctaggtgtgggcaatatacctctattttttttttttttttttaaggacgggggtctcattcggggccacgccgggggggctgggggggggcacgagactggggtcagggcgaacctgggcgtcgggggtccaaggaattctcgggcctcagcctccggagtcccg

SEQ ID NO: 569532 - DNA, 853 bp, Homo sapiens
gaattctaagatgccctgatggctgggcctgaacatgtgtttattatatattcttatcttcttatttatcttgtattattttttttttattttattatttattagagagagagagagagagagagagagagagagagagagagcagagagagagagagagagagagagagaggagagagagagagagagagagatcttctcttatatatatagagacacgagcgacgcgacgagagagagaagagacgagcgcgcgcgagagagagagagtatttcacacacgacagagcgagagtgcgtgtgcgcgcgagagacgagcgacgcgcgacgcgacaaacgacgagagagacgcgacgcgggaagagagagaagtcgaacgcgcgcggcgcgacgacacacactcctccacaacaacaacacaacacacgcaccgcagcggcggagacaaaaaaacaaaacaagcgaggcgcggcgacacagtgcaggcgacgagacaacacaacaaaaaagaagagcgggtcgcgtcgacgagagacaccgaagcatagccgaggaggagaggaggacgagcagcaggggcgctgcacatagaagaagaggcagatgctgctggtgccccccgccgacgaggaggacgagaagcagaagaggcggaggaggaagcggagataaggaggagctagtggtggtggtggtgtttttatgattataataatcatactcgtatgatatgtgggaaatgataagaatgagaagaagaggaggaagaactgaagaagaagaaggagtagaagagcagatggaaaacatataatgtatggagaagaaggtgaagaaagaagaaaagagagat

SEQ ID NO: 569533 - DNA, 103 bp, Homo sapiens
gaggatccccccagcctgcgcgactgagtgagactcagtctcaaaaaataaataaataaataaaattgtagcatatatattcattttctgcttgttctttgct

SEQ ID NO: 569534 - DNA, 156 bp, Homo sapiens
tagtacagtgacatcgacgtgtctgtgccaatacagccacgtcgggctggagtctccttcggggcccgagatgctgttcttgaagctgcaactcgtactgcatcgtgaaggcatggagagttctgtagattttcccttggcctgcatcatttctgc

SEQ ID NO: 569535 - DNA, 264 bp, Homo sapiens
agcctgaccctctagctccaaagtgctgggattacaggtgtgagccagcaccggccggccaccctatctcttaagaaaaaaaaaaaaacaccaaccaaaaacattagttgggtgtagtggctcatgtttatactcccaggtactccgaaagctgatgcaggaggatcgcttgagctcaggaattgaaggctgtagtgagctatgatcactccactgcactccagcctaggcaacagagtgaaaccctgtctctaaaagggaaac

SEQ ID NO: 569536 - DNA, 677 bp, Homo sapiens
ggtttctctttcgttgtttccctttctttttcctttttattttatttatttttttggtgggcttggcgtaaggatgctcgtgatcggacattggacatgaacacaagagtggctaaatgctctgttggacttccagcagaggggagtgggggaaacacagcagttctgggtaaagctccttggtaataatagttggatttcttattatttcgagagaatctttcatttccctatgtatgctttttccctttttggcccagtttccttatcactggctgtagagtggctatatttgggcattcatggcagactatgtggcaagtctggttcatctagtaaactggaaaattatggcttaatcaaactggccgttggtctttaatatttaagggccttcccccccccttccttatgagttctaacttagtaattccaaatggtgacctttaatatctaagaccagtatagtaaacttagcccacaggggcaaataaggagtaatatggtaatatgtcccagttggcacctcagtatgttaaacgggtaaggtaagaagtcctcgtgaaaggtcagcaagataagtctcggaaacacatcaggcatgagataggaataaaacccaagttcccaataacgtagataactaaggctgcataaaaatgtgaaagtgtaaccca

SEQ ID NO: 569537 - DNA, 461 bp, Homo sapiens
aagcagttcgatgcatgggtaggcaacaacgaccaccagcgggcgctatggcctggcatcatgaccctatcggatgaatacttctcggaactgcgggccagtgcagttcctctcgacaatcgcgctttgttggccctgaaaggttccgcgctggcgctcgatgtgtatgcctggctcgctcaccggttgcaccgcatccacggccggggcgtcacgttgtattgggccaacctgcgcgagcagttcgcccaggagtacaaaggcaaagacccggacaaggactttaagaaggagttcgtgccgacgctcaagaaggttctggccgtctacccgcaagccaaggtcaagccagtcaccggaggcgtactgctgctggggtcgccgccacccatcccctacaagggcggcccaactgtttagctaaactccgttagatcgcccccccccgacgaagcggccgc

SEQ ID NO: 569538 - DNA, 105 bp, Homo sapiens
tcattactcgatagaataaaggactcaaataaacaccaaccaaacatatacactaaagctacactatatagacacataaaacaaagtaaggataagagcagcaaa

SEQ ID NO: 569539 - DNA, 1125 bp, Homo sapiens
  misc_feature (301)..(301): n is a, c, g, or t
cacaacgtgtgttcactagcaacctcaaacagacaccagtggtgcatctgactcctgaggagaagtctgccgttactgccctgtggagcaaggtgaacgtggtatagaatgtaggtggtagagtgccctgggtcgaggctgactggatgagtctacccttgcgaacccagtcggttcattgtagatgtccgtttggggagtctgtccacacgtccgtgatgcttgttatagggcaatcccgtaagggtgacaggctcactggcaaagaaagtgcttcaggtgccgtatatagctgatggcnctggcttcaagcctggacatacctcaacgtgcacactcttgctcacacgtgagatgaagctggtcatcgtgtgatcaacgctgcgagcgttggatatccatgagcaaactgtctaggcatccatgtggcacatgctgcatggatctggtgctgctaggcccagtacactttggcaatataaattcacccaccaccagtgtgcaggcgtgcgctatcacgaaagttggtggcttggtgttggctaatgcccatggacccatcaacgttagtcatctaacgctcgactttgcattgcatgtccagaattatcgtattagaaggattccgtttggttccctaagatccaatttactaaacatggggtgatattagtgacagggccttgaagcgatcgtggaaattcctgcgctcaatactaaacacaattctacttcttcaattgccaaaactaacgaggcccacatataaaacacagagaaggtgggggcagcgatagcaagacactattccacaagaagagggcgccaaaagggatataccgtcggagaaacaccaccagtgttcacaagggggatcgaacaaagaggggagggtcacacgaggatacgaggaggcgggaggccactacgagtatggaagacgacgtgaaggggccacacgtgagccccagtacgtgtatgaaagaacaaccggcagacagagcaacgtgcggagatacagcggcctgaacgctagcgggaaagacccagcgggaaagcgaagcccacgagctcctggcgggtgaggcccaccaatggtggacagaaagaatctgcactctacgc

SEQ ID NO: 569540 - DNA, 699 bp, Homo sapiens
gggggcgccccggcggtcgcagtgaagggggagaggggagctgaggcgcggtggggcgccgggagagcgcctccgcggtgggacggagccggactgggccgagcgagggaggctcctgagcctcggaggaccccggggttggctttgggagctgaaagtttcctttggacccctcggaagccccgtgacatcagaggccgggcctggcaggggcaggcaggaaacgtgtctggaggctactgccctctccgcgtgaccttgggcgagcagcctcctcctggggctcagtgggtgtgattttgtaacatttcccagcgctgcgacaggcgcgtcctcgccctgtccaacgctggagcccgaagaattactaagaaaccgacggtctgaaggagggaagaggtgacgggctcgaggccacacggtggtgccatgggctgtggcccggactgcacagaccggctacctgggtgcccaaaaagggacacaacacaaccatttacccatttgggcaaagcggggacacaacaatttaccccagaccggaagcgcaagagggaagccacgattatcctgaaaaggcgatattagtatatccgcccaccgttttgggagtataacccccaatgggatgtgggcatgggggtttaaggacagtttggcgcaaccggagggggacaacatttagggcccagatatacg

SEQ ID NO: 569541 - DNA, 326 bp, Homo sapiens
cgaggacgtcgggttccgttgtctacgctgtattgctgcattactcagcattatcttacaagacatccaactttctttttatttatttatttagagacagagtctcactctgtacccaggctggagtgcagcagcgcaatgcgagcttggtcactgcaacctctgtctcctagattcaagcgatcttcttgccacagcctccctagtagctaggactacaaacaggcgccctgatgcctggctaattttggtatttttagtagagatggggtttcaccatgtcggtcaggctgtcctcaaactctggacctcaggtgatccaccca

SEQ ID NO: 569542 - DNA, 246 bp, Homo sapiens
ggcccaggagggtgcaggctccctcattgatgagctgagattgtgtgagaaagtaagaaaggcctctttggctattgtccctgagaaagggcagagccacggttacttctggccaagcaggctccccagaaggtgggtctcaggctggggaagctttggtagaaggaagcggctggtatggcaagggccccagggctgtggtggacttctgagcaagacaagctcgctgccctggaaaggcaggct

SEQ ID NO: 569543 - DNA, 989 bp, Homo sapiens
gagcgggatggggtctgattgcgagagctgcaggaggaggaggcatgagtgaggcgggcgaggccatccggtatcaccaccaccgagcgctcctcgagtgtctcctagcggacggcggaccgccaggcagctccgatagactcggacatctagatgagttcgtctgacatcgagcatgatccatcctatacttggtcacaattggttcactcgtgctagcaaagttggtgttggtgcacttcacctagaatccgctcactgacatgttacttatacagtgtttcttgtgcctcctaagctgctccagtctctcgggccacttcgccgaccacggagcagaatatccttcctgcgccgtctttctgtaaattgtgcagatatcggggttgatcgccgtcagaactggtgcggcttgcccggagctcaccggttgtggtcgcccgtacacgtcagccataactgacgacctggtgcctcaggccatgagtcgtagtattccttcaatggaagacctcatgtgacagaccgtcctaccttccctcgcacaccatgtcgtgtacaattcgccgtcagcaaagaaactttggctctaaactattggaaacacgctatacccgttgacagaaattccaccctatggaaaactctaacgttcttgagacaactcgaaccccagtgcccttgtacactagcgaccgcgccacgcccaccctgcgacgggcaagtgtgcatacttcacagctacgccttatcccagccactacgcacgcgaatatcttcgcgccatcctcccacctccaatcgccgccgagccacttagataagatccacgagtatcacttcggcaccagaccccagcccggtcatcaggatcacaaacctcggcttcgcacgacgcgacacacgacccacacgcccaggtcgcggccccatctcccggcccacaacctcacctcatccacggctgcatatcaccacgacacccacct

SEQ ID NO: 569544 - DNA, 232 bp, Homo sapiens
aaatgtctggcacactctcaaagacattggtctgggcaaaatttattgaataataccccacaagcacaggcaaccaaagcaaaaatgcacaaatgggatcacattaagttaaaaagcttctgcaaggccaggcgtggtggctcatgcctgtaatcccaacactttgggaggccaagacgggcggatcacctgaggtcgggaatttgaccaacatgaagaacagagtgcttgg

SEQ ID NO: 569545 - DNA, 129 bp, Homo sapiens
tgtgttgatgaggtccggtagataactcatgatggtcgattgaatcggagacgacgacggcgctagcttagtagcgagaccatgaaactcggaggcgagcagcggtgctagccggagtcggggccatgg

SEQ ID NO: 569546 - DNA, 426 bp, Homo sapiens
cgttcgagaagtggcagcagatcatcgacgtcaccttcaatggggtattccactgcatccaggccgcacttcccgacatgctcgaggccggctggggccgcatcgtgaacatctcgtcctcgagcacacattcgggtcagcccttcatgtcgccctatgtcgcggcgaaatccgcggtgaacggcttgacgaagagcctggcgctggaactcggcccgagcggaatcacggtcaacgccgtcccgccgggcttcatcgacacgcccatgctgcgcaaggccgagggcaagggcttcctcggtgacaccgacaagcagatcgagcagacgccggtgcggcggatgggcaagccagaggacatcgccgccgcctgcgccttcttcgtctgccgaggaagccggctacatcaccggccagattctcggc

SEQ ID NO: 569547 - DNA, 331 bp, Homo sapiens
gactatggattgtgtgggttgatataaatgctaacaatcaaataattaggctttttctttcatgttgataactccagatttacgtcttttggcagtactattacagctaggacagttttacacactgttacagtcttgtccactttactaacatggttccgacaatactgaccttgacgacgtttctgactatgacactacctcacgtcacactttgctacactgtgtctactaaaacctacttggttaacctgacgtatcatgcttttagatacaggggaaccaatttctgtgatacgtgttctgatcatttaaaatccttaacatttaa

SEQ ID NO: 569548 - DNA, 397 bp, Homo sapiens
tgtcgcccaggctggagtgaaactccatcccaaaaaccaacgacaacaacaacaacacaacaacaaacgcagcaattccattcctaggtgtacacccaaaaaaattgaaaacaggtattcaaccaaatatttgtacacaaatgttcactgaagcattattcacaatagccaaaagaaggaaccaacccaaatcatcaacagataccggataaccaaaatatgatatccatacaatggaatattatttagccataaaaaggaataaagtactgatacatgctataatgttggttaaacttgaaaatatgatgatgtcccggtgtggtagctcacacctataatcccagcaccccgggaggccgagacagttggatcacccgaggtcagctcaggacca

SEQ ID NO: 569549 - DNA, 795 bp, Homo sapiens
  misc_feature (76)..(76): n is a, c, g, or t
  misc_feature (79)..(79): n is a, c, g, or t
  misc_feature (107)..(107): n is a, c, g, or t
  misc_feature (257)..(257): n is a, c, g, or t
ccctaggatctacaagaaatcttgcactctgaagcctgacagtttggtgcaaacctccgagggctcaccacttcantanaacatgggtaagggggagttctctctanacaaattgtatctggacaaataagaaggtgcagtgatctgcttaggccatatatatgctttaataagagggaaccaggacaaggatgatgtcaccaacagcatcgacatccaagctttggagcttgaagaaacggggggggtgatgctcnataactgaaagagtttactacacaaacgtcttggactcattggactcattaaccttcagattcaactcccagctctttccttcaataccagttttcatattaatgcttcccttttttcatttaggcattcccctttgaagaagccgatctccagaccctaaaacagctgatctttcctattgactctccacagatgggtcaggggggtctacaggaacaacactaacaaaggcctctggagaaccttcttggatcccgctccaccttctaagggaggggatgatcacctggggggggggtagcagtgagacactcggcttgaacaaaaggggagtggcgatggtggacttttcccggagtgtggggctccttgaaggggggagcagttatgaaagcccgccccccgggccttttggggcaggagggtagctcccggggacgcgctggcgtggggctggagggggggtggtggcctcctgggcgggagtccggggggtcgcggagggggggctgggggtggtgggtaaacccccgggcg

SEQ ID NO: 569550 - DNA, 167 bp, Homo sapiens
  misc_feature (56)..(56): n is a, c, g, or t
cattcttgttgaattctgggcagaaacactaaggagagatctgaattgaaactatnttatgggtaggggggtgttatcttcaatctgggcatggcacacacaggaacattctggcctgatgctgctcaagctctccctctttggataaataaatggcttcagttttc

SEQ ID NO: 569551 - DNA, 623 bp, Homo sapiens
ctctggcccgacgcccaatggcgttcctgggccccgtagcccagccctttcccacctcctctcgattaaggccagcccctgccctggcattgggggcccacctagatagccacctgggagaccccctggcgttgccgctggaccctcgaggacctgggccccgggtcggatggacacaccagccacgaccgttgacccgtcacgtagtccccaacgcctcggggcccccaccgcccctccggaacccgccagagctggggacactggcaatgccctgcaactcagtcaccccgagggctgagccagaattcctggatgtgatggacccgctcagcgtgtcccccagaccccatcccttctccttttcccttgtggccctaacaccttctgcatcagggagccccctctgcctcttgagtacccgacctcatgggacccagaccccttgggacaacctggcaccatgggacctctgttgtacattcccggttggcgggatgtagcgcttgtctaatttaattactaatattattgaatgccttagaggaggcccggcgagccccgtgtttctgaagacctgtggcccccccgagcctctgcccgtaaagttttgctccccccca

SEQ ID NO: 569552 - DNA, 713 bp, Homo sapiens
  misc_feature (35)..(35): n is a, c, g, or t
  misc_feature (75)..(75): n is a, c, g, or t
  misc_feature (79)..(79): n is a, c, g, or t
  misc_feature (82)..(82): n is a, c, g, or t
  misc_feature (90)..(90): n is a, c, g, or t
  misc_feature (106)..(107): n is a, c, g, or t
  misc_feature (116)..(116): n is a, c, g, or t
  misc_feature (130)..(130): n is a, c, g, or t
  misc_feature (137)..(137): n is a, c, g, or t
  misc_feature (140)..(140): n is a, c, g, or t
  misc_feature (162)..(162): n is a, c, g, or t
  misc_feature (261)..(261): n is a, c, g, or t
  misc_feature (329)..(329): n is a, c, g, or t
  misc_feature (350)..(350): n is a, c, g, or t
  misc_feature (358)..(358): n is a, c, g, or t
  misc_feature (414)..(414): n is a, c, g, or t
  misc_feature (428)..(428): n is a, c, g, or t
  misc_feature (458)..(458): n is a, c, g, or t
  misc_feature (575)..(575): n is a, c, g, or t
  misc_feature (685)..(685): n is a, c, g, or t
cgcacaccggggctatgataagcaagaaggaagtngggagggcagacccttgctgagcaacaaaggccgcctgcngccnccnctgtgtgngtgggggggggggggnnggggggggnttgcgcgcgaaggngaggggncancgagtgcgaggggtgggaatanagggaggtggggaggtgtgcataagaagtgataggcacaggccagcccggtacagacccctaggcgtcctgacaggtggatttcgacaaggtcattgtnccctgccaaggcacagcgtagatctggaaagagcagaatgctttccttttcagatgtggctggtcatngaaggggcagttgttcaagtngggctggntcttggtacacgtggtttggcccagctccacgtccaagaagtagttcaccccagcnacgatctgcttgcnggcgcgcaccacctgcagcgcgcggctgtngtacatgttgttgctggctttgttgttctcgccgacggcaaagtccagttcacgccgcacaccctcctcctccacgctggcgttcatggggcctcccaccaggagcggcggcttgcngggactagagcaggcagcagggctcacggccagggccacggccaggatggcagcaggagcagcggggcgcgcaggggcccggccatggtcggctaggacgcgggaagggngagttgggcgcaggcgagaagctggagc

SEQ ID NO: 569553 - DNA, 995 bp, Homo sapiens
gcccaggctgtggctcagctctcagagggaattgagcacccggcatgcggtctcacggccaagccccctgctcatggatggtcagcgagttcaagaagaagctcttctggagggcagtggtggccgagttcctggccaggaccctctttgtcttcatcagcatcgtgttcttgctcctgtggcgttcaaatacccaggtggggaacaatcctagtacggaggatccaggtacatacgtgataggtgtcagcgtgtgcccttcgggcttgatcatctgccactgcgtggcgcagaggtgtgggccacgagtcagcgggtcgctctcgaccatcgaacgccggcttgtcagcacgttgggtgctgctgtcgtcgaggctgccgagtagtctaggtcactcttcccgctgcacctctatgatacttgtcattccgtcctcgaaggtgctgattgcgtgggcgcagtctggtcgaccaaccggacagtccgtctcgaggccattcaccgtccttccgctgcacttggtgaactcgtcttgtgcccgcaaatgtacgctgggttagataggttgtcgaacatcggagagcgcaggggctcgtggtgcgatcggacgcattcgatcggcgcgaccctcacagcgtaggtggcataatgcggtcgctggcatacgtacgcgaccggaatggccgcctccggtgaacgcgtttgggtatggggatccaatgccccccgcctttgccgattcggggcacttcttctggtcagccccctttggggacgtaccttcccgttgggctcatttgacattaccatcttgggcttggtgggcgatgtaaaccccgttgctcagggtccgttttgggctccggctgggtggatcaacacaccaagcttgcaggcgaaccaactgggaatttctgggcgtggggcgcagatcactcaggaggagaagcccctgggctgtacctcatctacgaactttcatgcctgggcccca

SEQ ID NO: 569554 - DNA, 118 bp, Homo sapiens
taaaaacacccccacccctctctttttgggggttgaaaaaattcccggttattgaaaaccgcggggggagtttttttcccccccccccaatttgagggggggggggaacccaccccct

SEQ ID NO: 569555 - DNA, 107 bp, Homo sapiens
  misc_feature (101)..(101): n is a, c, g, or t
gcgccagcagtggaaaatgcggcaccagatggaacatgcctcgtccacgttacaagagttattgggcgagtgacttgtggtgatcttgttgaatgaatgtngaccta

SEQ ID NO: 569556 - DNA, 159 bp, Homo sapiens
gaggatccccttcgtatcgctataagaatatggcgaaggggcctgcggcgtattcgactgttaaccgcctgagactagttcggactccccttcggcaggtcgagagtggtacggtctggtctcctgctagtgctggagatcacatcattattatggcgc

SEQ ID NO: 569557 - DNA, 885 bp, Homo sapiens
gaaatgcaaagcttactccagatcctgccatcattagttcgctgaacctggttgaatttttacagaaggtctgaagtagtctttttctcttttacatgtgcaaacacacaagcacttttagaaatactttttatttttcttatttcatcttgatgataactttgtgaaaaaggcaaggcaagaaatttgcccattttataaatgcaaggaagccagagctcagagagtttgttcaactttttattgtggttaaaggccccaggttcaaaaccttgtctggtccgcctttttcagtggtccattttctaaacgtctgtcagctcctgattttctcagaactagattaattagtatgtccaataggcaaccttagttatgtgggcccaaaaaaaggggttgaacttgaaaggaactttcagaggccacacttagaatttcgttgtcttcgaaacaacttttcacgaatttggcttggggcgcaatggttcaattgccctgtaaattcccccaggcactttgtgggaggggccaagggtgggggcgtgggaatccaatctggaaggggtcccagggaggtttttccaggaacccaggcctgtgagttcacaccattggcgtggaaaaacccccccggtgcttttttacctgtgaacacttacgcaacgacacgacacaacaacatacaaatacaaagtaaacacaccacacacctgttgtttgcgcgcgcgcgcctcggcgcccccctgacaaaaaaaggcttttctgtatacacccaaacttctgtttttgggaggcggggcgggggccccccactgcatgcgtgtgttattgctctgaccagcgggcgcctactatgcgcgggtttccccataggagagagacagc

SEQ ID NO: 569558 - DNA, 244 bp, Homo sapiens
tgactttctggaagacgtggatcttcagcgaagacactatattggctggaacaccttggattttccccggtagatgtgggattgactggtaatgacctgagattcggtgtaatgacgtagatttcctcggaagctatcgatttcagggaagacgaggattttctgtaagacatggattgtctgtaagacattgctttgttgtaagacgtggggttgttaaattgttttgtccagtctagaattg

SEQ ID NO: 569559 - DNA, 720 bp, Homo sapiens
aggaacgagtgagagaggaaggtcaccgggtggaggagctggaaagggaggaaggagagagcaaggagtagagaaaggatggggtgaaagacgatgagggagggtagagggggcgcggaagattaagagtcagggcgtaggaatagatggtaaggcaggttagcgaatgatggggcagaaaaatgctggaaaaaatggtgtaagcttgaggcctatggggggtcttaaagataggagcagacgtctgagaggggacatctagggaaaggaagtgagacgttattcaggagtgtgacgtggaagatgaggtgaagagggtacaggtagtgctgcggaactatgggagtagatagggttgaagctattctgtagagtggtataatattggtagagagatttgaagcaggagcgtgacagagcaatctgcatgaggtgtagggtagccaagagagagatggggcaataggacatgttgtactagggcataaattgtcgaaacatagtagagtcggcatcagcaagaaggcaactagtggtagagagctagcagttgatcagtaccgagttgggcgttgcagtgaaataggacaatcgaagactggtctcagcaggcaggcggtttactgtcataggctgtctgactctctctctctgtctctctctctctctctctctctctctctctctctctctctctctctctctctctctctcctcgtg

SEQ ID NO: 569560 - DNA, 179 bp, Homo sapiens
tagtataaaaaacattaaatcagctgtctgaaatctgctcaaaaagctaaaagaaatgatgaataaagagttaaaggatacgaggagaacaatgtctcaacaaatgcagaacatcaacaaagaaatagaaaatattatagacaggtgaggggcagtggctcatgcctgtaattccagca

SEQ ID NO: 569561 - DNA, 254 bp, Homo sapiens
gaatcgcccagtcgcaccggagcaataggataatatgtggagagaagatcagcaggtaaacacgtgaacaaatgtctctgcatcataaacaaggggaagaaaaaagtgctgtgcttttgatgtgcatatacagaaacatctcaatgccttaaagagcagtattgctgccagcatgtcccacctccagtcctaaggcggttttctcctatctcagtagatggaatatacaatcgggctttacaccgagacattcc

SEQ ID NO: 569562 - DNA, 991 bp, Homo sapiens
gatccggaaaggcgtctgcgatgccaacgatgaggctgctgtcatttgctggtgttggctctatttgctgtcactcacgcagaggaaggagccaggctttcggcttccaaatcacctgctgaacagatacgccgtgaagggacgagacctgaccttgcagttacaacatctacaatgtaggcctcaagtgctgcattacgacgtggcactatctgatgattccttccctccagaagacttcgcgccatcgtgtctggaactgctcaactgtccacatgggaccggatatgcccctgcttagcaactgtacatcccaccactgtaacaccatgacgccactcttcaacggctgcgtcaatttcaacctatcacacatccggcacaccactttcactttaacttggccccaagagagggaatgagtgccccagtccgctgcatcgggcctcctaaccaagatgcaccttgagaaccacgcgacggacatccatgtacatacaccagcgaagctcatagaccaagggcgactactcccgcctccaacatgcacctgggaactgtgtgccatcaccttatcggaaggccccacgcaccccattttccacgtacaaaatacgagccagtacacaccattgcctaactcagttgagatacaatccaagcgcttagccggtatacttattgaacactctcatcaaaacacgatacgaacgaccttgccttctcgcgcactatacgacaaacagacgcataaccaatcgatccccaaagaaagcacccccaaggactcccacatccacaaagcacaacaccaagggaggcactaccaaagaacacccaaagagggctaaacatcacaacgcaacaaccccaatactaccaaagaccatctgaaccaaagtatccaccatcaaactcccggacacaggcagagaagcaatcggtccagacacacaggcccaaacgaacataaaaacagcacacctgagaa

SEQ ID NO: 569563 - DNA, 332 bp, Homo sapiens
gatacgctctagacggagtgttacgagttaggctcttctcgtcatggccgggatggctgtttttttggtatgttctttcagctttcactcatactgtctactcaaggtttcttaaaatttcatttttttttaaatagagatgggctggctatgtggcccaggcaagtctcaaactcctcaagtgatcctccggcctcacctcccaaacggcggggattgcgggagtgagccaccacactgggcctcattcagcctggtttttttttttttttttccggaaacagtttggctcggccacccggggggggtggcaggggggggatccgggtccg

SEQ ID NO: 569564 - DNA, 216 bp, Homo sapiens
tcggtctcgctactctatgatgtatcccttcgctgtggactcacgaggtaacgcacttctgccgaacgtgccatcatcctggctggggaataagaaggacctgcggcaagacgatgcacagcaggagacgagctggcaagatgaagcaggagcccgttcggtctgaggaagtgcgggacatggcgaaccggatcagtgcctttgggtacccttgag

SEQ ID NO: 569565 - DNA, 113 bp, Homo sapiens
ttgacacggcagtgaatcgagctcggtaccatctcgtgaccggcgataattgctaggatgacgatggatagtaataaggcaaggacgcctcctattttgttagggacggatcg

SEQ ID NO: 569566 - DNA, 181 bp, Homo sapiens
  misc_feature (28)..(28): n is a, c, g, or t
agtttatgtagcttacctcctcggagcnatacactgagcatgttttagacggcctcacatcaccccataagcaaataggtttgttcctagcctttctattagctcttagtaagattacacatgcgagcatcccccttccagtgagttcaccctttgagatcaccccagtcagaagggacag

SEQ ID NO: 569567 - DNA, 205 bp, Homo sapiens
atccagattacttataatataactgataaacagttaatttagccaaaaatatttcatttattctggacacagttaaacataatccttcttagaagtaaactataaatctcagtgaactaccttatttccaactttttagggatcatatacttgtatccatatccctccaatgtcttaatgcatatattctatgatgtctaatagg

SEQ ID NO: 569568 - DNA, 931 bp, Homo sapiens
  misc_feature (91)..(91): n is a, c, g, or t
  misc_feature (131)..(131): n is a, c, g, or t
  misc_feature (775)..(775): n is a, c, g, or t
cattctctagtcgcccgagggtcgcagccggctttcaggggtcctgctgaccggactcaggcttatcccgcctgtgccgaaccacttatanacccgcatgacccacttcctaaagcagagtttctctttgncagactcacaacgatgcagatgcaagcctgaatcagaaactgaaaaccttatacaaacgcctgagacagcacgcttattttatttcttatggcggaacatgctcgtataaacaaacacattaatggtgtccctaacgctgcccacaaacacgatgaggactcgccaacgacacctacctatcgcgcccctgcttatgggccgacggggatgagccagacccgggagtcaggcgttctgcgacggcccatccgttgccggcccggatagtcgcggattccgacgtctctctcacacggcccgcccaggacccacaggacgcccaatgcacagatagtcggggagccggtcggcaaacaggggccagtcgccgcgctcgagtcagcgtcgcaaccgtgcagtgcgccccctcacgtggtgcgtgaccgggcgcccagggtgagctgactcgcagttcccgccgcgccggctcggtccatttgtagttcgtatgaccaccccccgcgttgtggtgttgaggctggcgaacgaggcagcttgtgtcgagtagacgccctcggcccgacccgctcgcggactgacgcacggggtcgtacgcgaaccggaccgcgatgtgcagagggctgaccgtagtgacacaaacggntcgccgcgcgctcgatgctacaagctatccaaggcccatccgagagcggagcgccgaggtcggacctgtacgtagcgcagatcgccctgtgagccggaacgccgtatagaatgcaacggccatcgtgtcggcacgtcacgcccgcgaccgcaccgc

SEQ ID NO: 569569 - DNA, 592 bp, Homo sapiens
ctcccagatggtgggcagctgggcaaaggcgctcctcacctcccagactgggcggccaggcagaggtgctcctcgcctcccacatggggtggccgggcagaggcgctcctcacctcctagatggggtggccgggcagaggcgctcctcacctcccagacggggagaccaggaagaggcgctcctcacctcccagatggggcgggctggcagaggcgctcctcacctcccagatgatgggcagctgggcaaaggcgctcctcacctcccagactgggcggccaggcagaggcgctcctcgcctcccacatggggtggctgggcagaggcgctcctcacctcctagatggggtggccgggcagcggcgctcctcacctcccagacggggagaccaggaagaggtgctcctcacttcccagatggggcagccaggcagaggcgctcctcactttccagatggtgtgtcatccgtgaagaggcgcttctcaccttccagatgattggcagccagagaaagaggcgctcctcaccttccagatgatgggcagcaggagaaaggcttacagatggaggaacgtacccttgaagttcag

SEQ ID NO: 569570 - DNA, 904 bp, Homo sapiens
  misc_feature (148)..(148): n is a, c, g, or t
  misc_feature (205)..(205): n is a, c, g, or t
  misc_feature (221)..(221): n is a, c, g, or t
  misc_feature (250)..(250): n is a, c, g, or t
  misc_feature (252)..(252): n is a, c, g, or t
  misc_feature (255)..(255): n is a, c, g, or t
  misc_feature (264)..(264): n is a, c, g, or t
  misc_feature (276)..(276): n is a, c, g, or t
  misc_feature (285)..(285): n is a, c, g, or t
  misc_feature (287)..(287): n is a, c, g, or t
  misc_feature (303)..(303): n is a, c, g, or t
  misc_feature (317)..(318): n is a, c, g, or t
  misc_feature (325)..(325): n is a, c, g, or t
  misc_feature (328)..(328): n is a, c, g, or t
  misc_feature (332)..(332): n is a, c, g, or t
  misc_feature (339)..(339): n is a, c, g, or t
  misc_feature (344)..(345): n is a, c, g, or t
  misc_feature (355)..(356): n is a, c, g, or t
  misc_feature (360)..(361): n is a, c, g, or t
  misc_feature (363)..(363): n is a, c, g, or t
  misc_feature (365)..(366): n is a, c, g, or t
  misc_feature (391)..(391): n is a, c, g, or t
  misc_feature (397)..(398): n is a, c, g, or t
  misc_feature (401)..(401): n is a, c, g, or t
  misc_feature (419)..(419): n is a, c, g, or t
  misc_feature (424)..(425): n is a, c, g, or t
  misc_feature (462)..(462): n is a, c, g, or t
  misc_feature (490)..(490): n is a, c, g, or t
  misc_feature (492)..(492): n is a, c, g, or t
  misc_feature (494)..(494): n is a, c, g, or t
  misc_feature (496)..(496): n is a, c, g, or t
  misc_feature (536)..(536): n is a, c, g, or t
  misc_feature (544)..(544): n is a, c, g, or t
  misc_feature (614)..(614): n is a, c, g, or t
  misc_feature (616)..(616): n is a, c, g, or t
  misc_feature (644)..(644): n is a, c, g, or t
  misc_feature (660)..(660): n is a, c, g, or t
  misc_feature (666)..(666): n is a, c, g, or t
  misc_feature (710)..(710): n is a, c, g, or t
  misc_feature (716)..(716): n is a, c, g, or t
  misc_feature (736)..(736): n is a, c, g, or t
  misc_feature (745)..(745): n is a, c, g, or t
  misc_feature (749)..(749): n is a, c, g, or t
  misc_feature (752)..(752): n is a, c, g, or t
  misc_feature (755)..(755): n is a, c, g, or t
  misc_feature (762)..(762): n is a, c, g, or t
  misc_feature (767)..(768): n is a, c, g, or t
  misc_feature (776)..(776): n is a, c, g, or t
  misc_feature (785)..(785): n is a, c, g, or t
  misc_feature (796)..(796): n is a, c, g, or t
  misc_feature (807)..(807): n is a, c, g, or t
  misc_feature (810)..(810): n is a, c, g, or t
  misc_feature (818)..(818): n is a, c, g, or t
  misc_feature (841)..(841): n is a, c, g, or t
  misc_feature (844)..(844): n is a, c, g, or t
  misc_feature (858)..(858): n is a, c, g, or t
aggctggagttctccgggagcgccggtcggaggcggtcggcggaggtgtctaccccgccggtgatggcgttgaacgccactggcttcccggccttccgtccgctgcctccgtccgattctgcgtctgcttgctgaggaggcggattangggggcgcggagtctcttcccttgagtgcataggtcccggttggtaaagggtttgantccgcatcgccaaaantgaaagctgcgagggaataaaaaaaaaananatntttaaaaanaaattgcaaaantgaaaaagnanttgccgacgctaaaantcttgttgaaaaannaaaaaanaanaaanatgcagnaaaanntctgattgannaaannananntctcaaaaaacgagtagaagccatnaaaaannatnaggaaaaaattcaaaaanttaannaaatcgcgagacatcggccacggtccacgttagttangggaatccagcaaaaaaaaaaaaaaatnanananttgcaaaaaaaaaaaaaaaaattacgtacatctctggaanaaaataantcggccttggaacttataatgagcaagtaccgagaacaaatgtttagattgctaatggctagcaaaaaanangatccgggtataataatgaagttaaaanagcagcactccaaggnactgcnagcacatgttgaccagataactgaaatggcagcagtaatgaggnaagccnttgaaattgacgagcaacanggttgcaangaanaanaangaatatntcaanntgaacaanaaaacaaangcttgagaganatccttcaaanaantcgagaancatttttgaacctaaggaaagangangcgtcggaaagtanttctttgtcagcattagtgaccacagtgatttgagtctgagggaga

SEQ ID NO: 569571 - DNA, 106 bp, Homo sapiens
gccagatcagtgtggaggtggattcctgctccgggacctgatctcgccagatcctgagtgacatgcgacgccaatatgaggtcatggccgagcagaaccgaaagga

SEQ ID NO: 569572 - DNA, 952 bp, Homo sapiens
tgggcttttttttggttggtttttttttctttggacattgcaaccgaaggtcataaggccgttactccgttgggacaaaggtttgaaaaaacctaagcggttcggtgccttctccctggtctcaaaccatcgtctctgacgtgaaaggctttgggtacctcaccatctgagaatatctaatctagaacctagaatcctaggagtctttatcaggttctaggaggtcctttaggaagatctctcaagggcaaatccttgatcccccgccccacctttagccctgccctctcaccagagcaaaatccactggggacttttcccaccaacatggaatatctgtccatcggaataaccctctgttttccattcaaatgtagggggaggggatggaacatttccagtgatggtaaaagatcggttatgaacaggaaaacaacccccggtgttaataactgggtctgaaatctgtttttatgagcggggcccctgtggcctctagtatacttgtttttgagtctcatagttaccctttaagttttcactgtgtctgcgaaattttgcaatgggtggaaaatcctgggggggtccattctctttcaataatttccacgcggtttcttgaagctggtgtggtatcagttaactccgtgtatttcacccctatgagggtcaccacccttcccgccttcatcacactcctcggacgcaattctcggtttcccctcggaccacaacgggaatcacactcggctttcggcccacacaaaacacacacaaggggcgcgccaagatatcaccaagggacacttccaccacttcttgacagggccaccaagacgcaacaaatcaccacgcgacaaaatcctgcacccccagctcgtacgaacctcttgtgcgtcagcacccacacaccggcaaaccccagcacccctgggatcagtaactaaccacg

SEQ ID NO: 569573 - DNA, 186 bp, Homo sapiens
agatcacccccatgcacaatcattgtacacccacagtcacacccctacacctcaaacccagtcagcccacacaaacataacatacagaatcaacacaaaccacaatcaaccgagacgcacatcacacacccacccaagcatacaattaccccacacagtcacatccacacacaatcaccccacaca

SEQ ID NO: 569574 - DNA, 123 bp, Homo sapiens
tgtaggagttcgatacagtctggccaacattgtgagagccatctctactaaaactacaaaattaaccaggtgtggtgatacacctgtagtctcggctactcaggaggctgggctgaggcagaa

SEQ ID NO: 569575 - DNA, 1922 bp, Homo sapiens
gcccagaggggcaggtgcccctcgccaagcagcccagctcaccctccggcacagggagcatggtggaacaactttcaccacaggggggtgagcaacgacactggcctggaccggacgagcaacccctttgcgaggctgcactgacagcagccaacttctcagcggcaaaactgcgagaatcttcgacccctttttcaaccataacccgtaacccagcccactcgagcaaagttgccctggccaagttacttacccccgtgcatcagcccatttctcctccttcccagtgcttcttcccacacgcaaactgcgccacaagcacccacgctgcacgcccgcgctctatggggcactgcccaacaccattgcgcctctcacgcacgccacacacttgcacgcccgcaccccgagcatttccccgagcaaaacaggggcacgcggcccaacttgccccttgccgcctggcacaccccggctacagcctcctattcatcgcttatactctcttctgccgccacaaccttcacgccttcgcaccaccttggcaagctcttccgctcttcttcaccccaccttggcggcccccttactgcccatcccgtaggcctaactttggcggccacagtgcctcacctttttccgcaactttccttatcttagtggccgagaataggagccccttggtcacttcctgatcccccgaaagcacctagcgtcgacacaccgcacaaacctttacgggcgcgactacgaacaaacataccccgcccgaagtccttaaacccctaacaggatggatggcacaccccctctaaacctttgcgcccaacctctttcgcgccccaatttacacacttattcttagggtcacttgcgccgggcccttcgtctgggcaatccaacgcccataacagacgtctttgggccgctctaatctcgcaaatggtctgatcatcccaccccactttggcgctgtcagtcacacacccctacccggctagtgcgtacttattgggacgatttcccaccgctgccagccaataacccagtcgtaccattactgtcgcctcctaaaatcgcaggactaaaacgcccctcaacattcggtgcataaaacaggcacctcttttaaacaacctcaccgcagctcgtccattcggcgcccgacgcacctccactcaccctacttattgatcccaccccattcttcgagcgaaacaccaagccgcacgtcgtatctccctaggcgtccaactactttgctggttcgtccccccccctggtcgtgtcgtcctcccgcaccgccattttaacccacctcttttgtgccggtcgctcccctcacctcattcgggtcgcgcggcgccccccacacatgagcgtgcgcgccgtctgtcgtctgcccgccgtcacgccgtcgccgccctccgtcttgtgggcgctcttatggtcgacttctttcgcgatccgcccgccgtttacatatcgccagtccccccgtagctgatcgatacgcgcttcgcttgttatcgcgcccctgctgccgtgggtcttctatccccgtcgcgcgaccttctccgtccgactctacaccgcaggacaatctacccgctattaaacagccccaccccctacaatcgtcaccacgcagtgcgtaaaacaatgctggcgcactactagtggtcacaacaaactgcgtcactgtcgcgcgcattcactacacactttttccccaccacgcaatgacactcgctaccccccacaacaatcaactaccatgcgctcccactacatccctcgctacacgaccgcttcctctctccacgcggccactctaccccgcatcaattactctattgacctccacggcatctacatgatccccaccaccatcgtccatcgaatcaaccgcccctacaaac

SEQ ID NO: 569576 - DNA, 459 bp, Homo sapiens
gttggtctactagtagtgcacatcttgagtattactttcttcatccttagtataaaggggaggaggggtggccaaatgaacatgattcagatacagattttaaaaagaagaccccagcttaaatgtcacctagtgtgctaaactttttctaaatatccaacagcagttttatcaggagcaagggaataggtgggcattcaacatctacatctgaggctgggtgtggtggctcacacctgtaatcccagcacttggggaggctgaagcaggcagattacttgaggccaggaatttgagaccagcctggccaacatggtgaaacccgtctctactaaaactacaaaaattagccagcatggtagtatatgcctgtaatcccacctaatcgggaggctgagggaggagaatcgttggaacctgggaggcagaagtggcagtgagctgagattgtgccattgc

SEQ ID NO: 569577 - DNA, 307 bp, Homo sapiens
  misc_feature (52)..(52): n is a, c, g, or t
tttggggggggggggggcccccccccttgttcccgctcccccctggccgggnttttgttttgggccttctgtcaaaaccctgggggggggggatggggccccccttaaacccggaggaaacggggggttgcctggggtttcggaaaaccccttatgggggggggccgccccccccccctgtttcaagggggatgggggggggggggcaagcaaagcatccccccccctgagcaaaaacttttttttgttttttaacccccccggccccctttccccttggaaaaaaggggggttttgaaacccggga

SEQ ID NO: 569578 - DNA, 170 bp, Homo sapiens
gagagaatgtctgaagcgttgtcttacatttttaaggataaacttatcagagataatatacttgttacacagataattcccgtcctaccatatccttctttcccccactgagtcttattttttcagcaaactcactcctgacagcagagtctgtcccgccacctcacatt

SEQ ID NO: 569579 - DNA, 466 bp, Homo sapiens
  misc_feature (302)..(302): n is a, c, g, or t
  misc_feature (332)..(333): n is a, c, g, or t
aaccgatttagaacagttcttctaagctttcgctggacttgacgtggggtgtctaatgttctgaccactccacaccagcctgaagacccaagcagtcacgaattgaaagactataagcaccgatcagaaagaggagaaaccaaggctatcgttagtggctgcatatgccatacgcaccagtcacgctttctgagcctgccagatcgcagcctctcctgctcgcagaggttgtcagacaccccgggctggctcagtcctgcttcccagttgaatcaaaaaaaaaaaaaaaaaaaaaaaaaaantttttttttttccctttttttccccccaannaagaggagagagagagagaaccaaacactgtaaggagtatgaccttctccagcaagacagcaaaggtgcaaaggagagaaggatgctacatagcccggtttgtttttaagaaatgcaaatattaaacgagaaa

SEQ ID NO: 569580 - DNA, 449 bp, Homo sapiens
  misc_feature (10)..(10): n is a, c, g, or t
ctttgtttcntgcttaggaccacaaggctcgtggtaccccagggactcttggaatcctgtctaggcagcttggagggctgtctacgtggcttcttggacctgaaccctaactggacctgtgcatggttttgcagcccagatgtgaaacagggatcatccacctcaccagcaatcccccttgttttaaactgcagttaataactggctgggctgagggagccccctttatcatagtttacgtgcagcctaccccctggaatctgataaggtctttgggtgctggcagtaccaatttttatccattattttttctattacggataattcctttccacactggagtcacccagaggttggcttgagcccagccacatgaagataagtgccagtggttttgccgggtcccgggtgccctctgtttcattaaagcaacatattcgggatatata

SEQ ID NO: 569581 - DNA, 836 bp, Homo sapiens
ataaagggatggaggaatatttaccaagcaaatggaaaggaaaagaaaaaaagcaggggttgcaatcctagtctctcataaaacagactttaaaccaacaaagataaaaaaagacaaagaagggcattacataatggtaaagggatgaatgcaacaagcagagctaactattctacatatatatgcacccaatacaggagcacccagattcataaagcaagttcttagagacctacaaagagacttagactctcacacaataataatgggagactttgacactccactgtcaatattagacagaacaatgagacagaaaattaacaagaatattcaggacttaaactcagctctggaccaagcagacctacagaactcagaacttgaactcagctttggaccaagcagacatctacacaactctccacttcaaatcaacagaatatacattcttagcagcaccacatcgcacttattctaaaattgaccacataattggaagtaaaacactacacaccgaatgcaaaagaacggaaatcacaacagtctctcagaccacagtgcaatcaaattagaactcaggattaagaaacttactcaaaaccgcacaactacatggaaactgaacaacctgctcctgtaatgactactgcggtaaataacgaaattaaggcagaaataattaagtatattgaaacctatgagaacaagacacaatgtaccagaatctgtgggacacaggtaaagcatgtttggagagaactgtatcgcactaaatgcccacggagaacgcacggaagatctaagtcaacaccctacactccaattaaaagaac

SEQ ID NO: 569582 - DNA, 124 bp, Homo sapiens
tcccatcccacgactctacgcccgcactccgtcctccagttaccaacgtccccatcccgtcgtcccacctccgccttaccagggactcctccctgagttcgtcctccagaagtgcgcctgggtg

SEQ ID NO: 569583 - DNA, 1185 bp, Homo sapiens
tcacaattgggcaacacagatttattggggaaaaaaacctgcggaaaggggtgtaccagctagtgtgccagaagccccctttccgcggcttacgaggcgtggaccagtttacagttcccgggcaggaagaaggctcgtgggaatgtgtgtggtgaaaagtggggtgtgggaggcggtgtgtgttgggcgtgcgtgataattagaaggaatttaagtgtcgcacgccaggcggcttagcgccgtgggacctgtgcctgacgaggattgtttcctcacacgtctcaggcccgtggcggagaatttaccacttcttgaccaggttgtgtaaacgtggtcagcgggcctgacacacaaatagcgtgccagcttgggcgcctaaccatctctatattttcctatacctctcagtattacaaccgggaaaagagggcccctcgtgcgactcatcctggtctgcctccccctgtcgcgcaaagcgcggccgatggcggcaccaaggggccccgggaccacgccgcagccctccccgcaagggcaccccctccgaaaggaccaccggcaaacccacaccgtcgcccaaacggtccaacacctaccacccatccacgcggcgcaccgcgcccaccccagcccccgcgaaccacacccaactcacccccccgcggcaccacacacccggcccacaccacggccacacaccaccccgcggcccccagcgcacaccagcccgcgcgcacgccagcaaaccacccacgccgctcccacccaccgcccgcacaccccccgcgctcaccatccccaaccgccctcaaccccccccccccagcacctccgccccctttctcttcccccctccccgccccccctcaccacccctacccgacccccaccaacacatcccccactactcatccccacgcacccacaccccccccggcgccccaatccgctgccccccccaccacacggagtccaagctccccgccacccgccccggacaccacccgcgtgactaaccacagccgccaaccctccccgaagcgccacccacccgcccaccgggcgcccccacagccagcctcacgcgcaccccacccacccccccacgcacgcccccccccaccgaacacccataacaccaggcccagcccccaggacccgcggctccaacacgagcatacaccc

SEQ ID NO: 569584 - DNA, 881 bp, Homo sapiens
cacaccgtgtgtggggaattctccatgggggtgtcccgtttcaatgtttgtcccgtggccccttgggggttcggccgattatttgtccccctcccccgcgccatgggtcatgctcccggagcgcccgcccgactttttttaggggcctgatggagggctttgagaccctgaggtcttgcgcccagccgtcccagagacgtgaggctttgctagcgccttggacgccccaacgtggttgtcccgccatagtttgggcgcccagagataggccccccttacaccagacaatgcaccccgggggcccatacccccaggccaccgctgggggactcccagaccttagaagaggactgtgccccaagaaagaggggcctccctcggagagtgggaatttttagggcccccaaagaggggcccagagaatatcgctgcttggatatctttctagagcaaaatatcttctggggagaaagtgtttctctttggattccaataagaagattcccctcttagatttctttcccacgccataccccacttagccttagtagtgcctgctcacccaccccgcgtctgtataaagttaaggagtgaacaaagttgattcttttgcttccttttagaaacaataaaggatgttttctcttgcttaatagagtcaatttcttagaaagcgcccattacttaaaggtgataataattatttttttcccaaatagcttattttttttcgtggcccaccttgataattatcccgccagctttgatttctgtataaggaatcacttttcagctttgggccgaacccgaggccggggtcccccccaaattggaaaacccaaagtgggtttggggtcccggaacttttttttttttgttta

SEQ ID NO: 569585 - DNA, 312 bp, Homo sapiens
actctcgactttcgtatcataggaaaatcatctcttgaattgtagaagcccccttgtctctttttggctaacatcaactaacacaatatgtaaagaagtctgcgaaaaaagcaggagatcggtatggaccagctgaggttgctcacattttaagaaaagcagctgaagaagcatggcatgctgatttacaaggaataactatctatgttgcacaagaccgaacagctgacaattctgatgacattgataaacagagtgctaccatgacttctgataatgcagatgacaaagctgctattatcctagatcctg

SEQ ID NO: 569586 - DNA, 105 bp, Homo sapiens
tagctcatcactgattttttaaaaatctatttgcatctttctctctcactggcaaacctttacttatgtgctcatgaagaagctccttgtctatttgttcctgat

SEQ ID NO: 569587 - DNA, 1314 bp, Homo sapiens
aaacattgctactactcagctctcactgcccaagtaactatcaatactctcgtgagtccaacaacttaaatatgactagtgttactacaattgagcgtttgatagtaatacgataccgtcttgtacggtactccaacgtatgatgacatcccgtaagaagccgcatgtctgaatgtcccccgatcgctgggatcatatcagtagcttgccgcagtatcgtctttagatagactagagtcgtgcctatgtggtatcaactagcggcgctactatcatcgttcgatatacttctaagcctcctctgtaactatagatacaacatagtccttaccacctttccttgttacgatccgctatgaggcatactttattaacaagcttccactctgcctgcgaagtaagagactcgtaaagatcagcatcagttgctatacgtccttcgaactaccaagcacaacaaatacgaccccttctggtaaggtaatcgaggtcgcgattgtcttcactaccaaatatcccacccatgtaaagcgtatctaaccgggtcgcatgttcactatctacataaatcctgcccgacggtacctgtgaactgttcgctgcgatctacttaatacgcgtagcccataggcacaacatacgaacatcgttacggaaagcggccacacacaacgaaggatgccgcataattcagtacagtccctgctttcgtgcaatggcaactttctaggaacttcctaacgttcccgcaacttatagtaggctttattgggcctggcacacttttccttagcacaaatggtgcacttgcggtcattcagaacaacattcgaacctttttatcacactcctcgcaagctaaatttgaatccccttcaccctgggaagcaacaaacactctttcttgattgaccttatcttgaaactctaacctgatgtacactcccctgggaatctcacccaatttattcaaacttcccttcaccttacatcataccatggatatcttcaacaccaattaacttaatgtcccacaatgcagccccatattatgctaccgccttacttaacaactaaatttgcaacacccccacagtaactaaacatgttggacggacttccatcgatccacgcacagaccaagccagttaatctatacacaattacaataagcccttacagatttcatcaactgtaagaacacaacctcaccgcgtccatctgattttactttaccagtccctatatattcccccccaataatcgtcccatcgcatatacccttataaacccccgaacacatacaattaaccg

SEQ ID NO: 569588 - DNA, 1265 bp, Homo sapiens
aagataggcgtgtccccttgcacccaagttgatgtcacaggcctcgattgcatacacagtcaactgatccgaggaatgactcgtgggtaaaacataatctcaacacgtgtgtcttaagaggtgaggttgggcatgcaaaacaattacattcgatgtacaggtgtgtttgggacgctgggctctggtgtcgtgtgcatatgactaatcgtcgaggcagttgacgcctagggagtcgctggaacatgtcacttcgtaggatcgtcactgagactactgggacatcagaggtagtaaatgctcgtggtgctgggaagacattgtgcgaggtctgctttataccttctactaactatggtaagaaatttgttggcaagtagtatctgacattactattgatggattcgtacttatcacattgtatggaggaaggttagtaagccttggtgaaaacctgatgactttattgcccagtgagagctgtacgttcaagaaaaactaattacttagttattgcctaaaactagaaattggtccaaagtggtggccaattacaagtacatcacttttacttaaacacctactaaactagggtgcaaacgctacctatgccacccctgtatactttggccatatcaaatgccacgtccgtaagtgattactctctggacctttctagggcgagctacccatggacattggacggctccactagcttaaacccccatccgtgaatgccttcccatgctgggcataccacacctggttcactcaacccgtggcttcagtaccttcgcactccctggtggcgctccttgttaggcacctgctgccattgccctacgccttccaaactcggtcccagacctttcccccctcacaatttagccctcgcgggctcccttcctttcgcccttatttcccactcccctctcagcacacacccctagcactcaaaacgggcgccacttgcccccacgcaccctctcgcacaccagcgtcaacctcccctcttgcccgcaaaaccggcgccccccacccagaatgacccctcagaccgcccgccctcacccccccccgcccctcctccccaccggacccgccccaccgcccgcgtcccccccccccctatcaccagccccccccttcctccgccccctctccagcacagccctccaccgccccctctccgtctcccccccgcctccactctcccacccccccacccccccccgcccctcccccccctccccgcccacccctccgcc

SEQ ID NO: 569589 - DNA, 657 bp, Homo sapiens
  misc_feature (1)..(1): n is a, c, g, or t
  misc_feature (70)..(70): n is a, c, g, or t
  misc_feature (118)..(118): n is a, c, g, or t
  misc_feature (133)..(133): n is a, c, g, or t
  misc_feature (157)..(157): n is a, c, g, or t
  misc_feature (179)..(179): n is a, c, g, or t
  misc_feature (186)..(186): n is a, c, g, or t
  misc_feature (203)..(203): n is a, c, g, or t
  misc_feature (207)..(207): n is a, c, g, or t
  misc_feature (218)..(218): n is a, c, g, or t
  misc_feature (224)..(224): n is a, c, g, or t
  misc_feature (231)..(231): n is a, c, g, or t
  misc_feature (263)..(263): n is a, c, g, or t
  misc_feature (267)..(267): n is a, c, g, or t
  misc_feature (291)..(291): n is a, c, g, or t
  misc_feature (305)..(305): n is a, c, g, or t
  misc_feature (332)..(332): n is a, c, g, or t
  misc_feature (348)..(348): n is a, c, g, or t
  misc_feature (352)..(352): n is a, c, g, or t
  misc_feature (354)..(354): n is a, c, g, or t
  misc_feature (398)..(398): n is a, c, g, or t
  misc_feature (414)..(414): n is a, c, g, or t
  misc_feature (479)..(479): n is a, c, g, or t
  misc_feature (503)..(503): n is a, c, g, or t
  misc_feature (505)..(505): n is a, c, g, or t
  misc_feature (507)..(507): n is a, c, g, or t
  misc_feature (509)..(509): n is a, c, g, or t
  misc_feature (514)..(514): n is a, c, g, or t
  misc_feature (516)..(516): n is a, c, g, or t
  misc_feature (521)..(521): n is a, c, g, or t
  misc_feature (527)..(527): n is a, c, g, or t
  misc_feature (530)..(530): n is a, c, g, or t
  misc_feature (549)..(549): n is a, c, g, or t
  misc_feature (595)..(595): n is a, c, g, or t
ntggttctggtgccatactttgccttccacgttggcacggggctcaccgtggggtttggtagcccgggcntggtgggggccctccaggtgggggttgtggtggggtgctcccaaagcnaggttgttgtttttnggccacacagcaccccgccagttngggggatcatagctatgaattnagctggncataaaaggagctggangctnctagaggagcntaaacnaaagggnatccagagataaaggatgtcggctagaatgtncagnaggggcccaaagcgggttgaagtngggtacagcagtcnaagcaacaagaggaaaaagactgaaanaaaaaaaaacaacaanaaantncagttgaggttggggccgacccaccacccgaacgagcccctganggggcctgggcttcanctgtactgcttttgtgtggttcccaaagtctgcaaagactcctagctctggggcccagtgcgggnatccaggctctctgctgcctccantnangnaccantnggccnactcancanctacctcagcctcacccanatgctctgccagccgcgtcacacacgggcacccagtgccacccaanatcgcaggtccaggtgccgctcggttactgaagggtgtgaagcccgggggtagtcatccagc

SEQ ID NO: 569590 - DNA, 187 bp, Homo sapiens
gaaggaagaagaaagtaagaagaaggagaagacggtgacgaaggaagaagaaggagaaggaagaaggagaagaactaagaagaagaaaggagggggagaagaaagaactaaggagaagaagatgaaggaggaagaagaaaaggaaagaggaagaagaaagaagaaggaggaagaactaagaagaaga

SEQ ID NO: 569591 - DNA, 245 bp, Homo sapiens
tctacaggatctttgcggcatggtctgtacagacgggagtatcaccgtggcgggagtgcagcgtgctgactggtgaacggctgctggagggatggcactgggcccgtgaccgcggaggacagtggccgctctgggcggccgtagtttcttgacatccaggtctgcgtagtcacaccttggtctatgtctggattcgattatccatttcgcccgattgacgggatggctacataggccccttgctg

SEQ ID NO: 569592 - DNA, 175 bp, Homo sapiens
agctccggcacgactgaattcaggaggtgagtcatcgtctcgctcatctgggagcctggcttgaccatgccgtggcactgggctgttcaagtctggccttagggccggtcttttcctcggctagccacggctacgacaccttggactacttcactatcgaccctcggctaggcga

SEQ ID NO: 569593 - DNA, 589 bp, Homo sapiens
  misc_feature (12)..(12): n is a, c, g, or t
  misc_feature (41)..(42): n is a, c, g, or t
  misc_feature (101)..(101): n is a, c, g, or t
  misc_feature (106)..(106): n is a, c, g, or t
  misc_feature (108)..(109): n is a, c, g, or t
  misc_feature (113)..(113): n is a, c, g, or t
  misc_feature (115)..(115): n is a, c, g, or t
  misc_feature (126)..(126): n is a, c, g, or t
  misc_feature (144)..(144): n is a, c, g, or t
  misc_feature (147)..(148): n is a, c, g, or t
  misc_feature (150)..(155): n is a, c, g, or t
  misc_feature (158)..(158): n is a, c, g, or t
  misc_feature (161)..(161): n is a, c, g, or t
  misc_feature (172)..(172): n is a, c, g, or t
  misc_feature (175)..(176): n is a, c, g, or t
  misc_feature (180)..(180): n is a, c, g, or t
  misc_feature (183)..(184): n is a, c, g, or t
  misc_feature (188)..(189): n is a, c, g, or t
  misc_feature (200)..(200): n is a, c, g, or t
  misc_feature (208)..(210): n is a, c, g, or t
  misc_feature (226)..(226): n is a, c, g, or t
  misc_feature (234)..(234): n is a, c, g, or t
  misc_feature (468)..(468): n is a, c, g, or t
  misc_feature (517)..(517): n is a, c, g, or t
  misc_feature (519)..(519): n is a, c, g, or t
  misc_feature (549)..(549): n is a, c, g, or t
  misc_feature (578)..(579): n is a, c, g, or t
  misc_feature (586)..(586): n is a, c, g, or t
  misc_feature (589)..(589): n is a, c, g, or t
ttttcctgaaangtaatcattgatgcttgaatgatagaatnntagtactgtaaacaggctttagccattaatgtgagagacttagaaaaaacgcttagagnggacnannaaangngcctaaatgantttcgcagtaactggtantcnngnnnnnnccnacntaatacacagnaanncagnacnngtannctattatgagnttagcagnnnttgggagtgaccagcnactttgangtttgcactaagattttatttggaatgcaagagaggttgaaagaggattcagtagtacacatacaactaatttatttgaactatatgttgaagacatctaccagtttctccaaatgccttttttaaaactcatcacagaagattggtgaaaatgctgagtatgacacttttcttcttgcatgcatgccagctacataaacagttttgtacaatgaaaattactaatttgtttgncattccatgttaaactagggtcatgttcagcttcattgcatgtaatgtngncctagtccatcagatcatgtgttctggggngtgttctttattcaataaagttttatttnngtataancan

SEQ ID NO: 569594 - DNA, 371 bp, Homo sapiens
  misc_feature (55)..(57): n is a, c, g, or t
  misc_feature (250)..(250): n is a, c, g, or t
  misc_feature (299)..(299): n is a, c, g, or t
  misc_feature (301)..(301): n is a, c, g, or t
  misc_feature (331)..(331): n is a, c, g, or t
  misc_feature (360)..(361): n is a, c, g, or t
  misc_feature (368)..(368): n is a, c, g, or t
  misc_feature (371)..(371): n is a, c, g, or t
gaaaaataaaactttattaaatcaaaaaaaaaaaaaaaaaaaaaaaaaaaaaaannntcgggattcagtagtacacatacaactaatttatttgaactatatgttgaagacatctaccagtttctccaaatgccttttttaaaactcatcacagaagattggtgaaaatgctgagtatgacacttttcttcttgcatgcatgccagctacataaacagttttgtacaatgaaaattactaatttgtttgncattccatgttaaactagggtcatgttcagcttcattgcatgtaatgtngncctagtccatcagatcatgtgttctggggngtgttctttattcaataaagttttatttnngtataancan

SEQ ID NO: 569595 - DNA, 925 bp, Homo sapiens
atgcactgaccaataaagtgctctgctttgggtgtgatgcgagcacgtactgtggctgtcatgagtgatcctcatgcggcccatcctaagtggacctacagtttctagagactgctgatatgtaacatggcggatatccaataacaagatctcatggtcctcatgtctcagtatccaactatcattgagccagatggtaccatgtcatgacgacgaggtcgcatgtcgccgagtacctggcaaaggaacatgcaagatcagccctgaacgaaatcagaggggttctcatcatggggatgaccacgattgatttaccgtcagaagaagtctttcgacgaacacagtgagtagagctggcgtgcttctttctaatgtcgagggcgtagagatatacacgaaaaagaattcgggatgtcatgaacggaagcaagggttcaggcagaggaagcggctggtgagtataactaggaagctggtgagttctggagaggataagcttaatgaaggaaatgaaatggtggttgatattgcgaatggtgtcttaaagaaaaagatagtagtactccaagaggagtgtgaggaaggggatagtgtgcgaacttgctacaagagctcagagagtggtgtagctcaaaaccgttccctgggcaatttgtgtgctgtcattggtttgcatgccaggagtctcaaagggatgagaaagtgataattgcgtgcacctgttattatagagatataggggcaagactattgataaagtgaagctcagttggtccttaggcgaaggctgggatggcagtttgtttgtgtaagcaagaaagaaaatcttcagaggaggtagaagataaaaaagatgagtgggttcagggaaagttccaaggtaggtggcgtgagagaaggtaacaaatcaaaagtaggaaaaggg

SEQ ID NO: 569596 - DNA, 712 bp, Homo sapiens
cagttccttgaccccagtgtactccaacaagtagatgacatacgtcaaatttacctctccaggggactcacaaaacgggagattgttgccgtggccaagccgcaaagttttctactcgctacatcgttgcgtggcccctaagcaaaatttggctctatgacacggcaggtatctgcgcctcttacaacttaaaaggtccttgtcagcttaaggcgatgccgcatgtatcaaggtaatatcagaccgctgaatctccatgctctatcctgaaatctgctcataacttaaaaaccgtcaatcccactacagtgtcaggagcaattgattctgtcccccccccgtaccaatggtgatacacccccgtttcaaacatgctagacagtcgatctgtgatttagcaatctccagctcctactgttatgatcaagggcattccatagaatatgtagtttagttcccatcctcacatctttccattcaagcaagattccataagcatccgaacgccaataaggagcgatgttcaggcctatgcacgaaaacatcagcaaatatgcatacacaggcacactaggcttcagagcggcaaagcatacagccagtaaaatcccggcctgtaagtatgggacctgtgtccatcgcacaaaagtgattaaggcattatgcttgcgatccacctcctgcgtggatgtggtaaataaaaagtgatatt

SEQ ID NO: 569597 - DNA, 349 bp, Homo sapiens
ttttggcaaaggttcagggactgggaaatgggaaacgaaaggccaaggccccccctcggtttcccccggattttaagtcaaaacaactgctgctggaaacggaacggctgctgggaaaggcatcatcgaattggagccaggcaaaaagggtgctgcaggaggtcagggagtttaaaaacctgtacaaacaaatggacctgcagaccccggtctccccccttagacaaacccccccgcccagtcagtaccggaaaagcctaatttaagggcagggtggggtttggaacttttcgggttggacaaatttttatttccgtgttgctggataaagcttttttttttcccccca

SEQ ID NO: 569598 - DNA, 781 bp, Homo sapiens
tttttttggaaacaaagtcttgctcttgtcacccaggctggaatgaagtgggtatgactctcaggtgaattgcaaccctccacctcctaggttcaagcgatctctcatgcctcagcctcctgtagcagtgtgtggacatatatggcgcttgctaccatgccaggctaatttttatattttaattaagagacggggtgttgccatgttggccaggcaggtctcaaactcctgtgcctcagatgatctgcccacctgtagcctcccaaagtgctgggattacatggtatgacgccactccacccagcccagagtttccattggtcccttaaaataattaaggctggaaaggcaaggcacaattatgagcacaactgtagctcaagttgagaagaccctcaaaaaagtcaagtttagcacctctcggattcccatagaagagcaaaacgatcctaggttcagggtacagagagccagatctgaagagtacctcgcagggggaaagtgtgctgttacaactggaggtctatagaccactttctcggggggggaactttttgttgactgacccatgcaccccacatgggtgccttagcagaaacttgcagaaggactagatcctttaaaccaatcaacattcttgtgccaattctctgtcactgtgtgtgacccctggcagatttgacctttggacctcggggggaatcgctggcccccttggggtggcccctctctcttggtgtaccacggaattggcgattgttggcgcaagttcaccggttgc

SEQ ID NO: 569599 - DNA, 175 bp, Homo sapiens
  misc_feature (43)..(44): n is a, c, g, or t
gacaacatgagtagcacagcaactcattgatgacaccgacgannccggatcctgagaggcgcgcaccagcatctcgatcgccatgctggacgtgcattccaggcgcggggcgtaggaactggccagtgctggcggtgaatcaactgagtcccgtcgggcatgtggtcgcccactt

SEQ ID NO: 569600 - DNA, 334 bp, Homo sapiens
  misc_feature (128)..(128): n is a, c, g, or t
  misc_feature (216)..(216): n is a, c, g, or t
tgagacaagatttggctctgtcacccaggctgcagtgcagtgggcgtgactgcagctcactacagcctcaacttcctgggctccaacaatcctcccacttcaacctcccatgtagctggggccacagngcgtgccacctatgcccaacttatttttcatttttaaaatttttttggagaaggagtctagctctgttgcccaggccggagtgcagtnggcgtgatctcgggctcaccacaacctccgcctcccaagtgtcaagcaattctcctgcctcagcctcccaagtaagctgagactacaggtgcacaccaccaatggcccgggctaattt

SEQ ID NO: 569601 - DNA, 274 bp, Homo sapiens
tttttaaaaaaaagtttttttttttgggcccccccccaaacatgggggggggcccggggaaacacgggagacctttgtttttttttaaaaatgccccccaaaaaccggggccaaaaagaaaaccaaggggtcgggggttgtttttcccccccttttttttccccccccaggaaaaaatttttggggaaacccccttttttttttttttaaaaaaaaaaagctcccccccgccagtttacaaagaaaggcggggcccaaaaaagggttttcccca

SEQ ID NO: 569602 - DNA, 409 bp, Homo sapiens
tggaggtcttgccaggtcttggccaggctggtcttgaactcccggactcaagcgactctcctgacttggcctcccaaagtgttggaattacaggcatgagccactgcagtagccctgattgttttatatagaagaaggtctttagacaaactcaaccaattgtcaaccagaaaatgttggaagttccctcctaccccgcccgcctttgagttgtccggcctttctggacctaaccaatgtatttcttaaatatatttgattgatgtctcatggctctttaaatgtataaaagcaagttgtgccccaaccccggccaccttgggcacatgttctcaggacctcctgaggactgtgtccacaggccatggtcacttatattaggctcagaataaatcttttaaaatatttt

SEQ ID NO: 569603 - DNA, 903 bp, Homo sapiens
cacagtggctcatgcctgtaatcccagcactttgggaggccgaagcgggtggatcatgaggtcaagagatcgagaccagcgtggccaacatgtatacatatgtaactaatctgcacattgtgtacacgtaccctagaacttaaaagtatatatatgacaaagaagtcagaggtactcttgaaaggaaagaattcagtattgcatattgtatgccacaccttgtgaaacataggtcgtgttaatcatattctagcaactgaaagtgctctaccgttgctttacctacttaatcctactcatcaaaataaggatcctgatgaatacgatatttaaggctaacgaatgtggtagagtacttctatcatttggggagaagaaatgctctatgaactaagagccaggaaagtatacagtgaagcatgaacagcactgactacacaaatgttggaccacttctggaccacaaaaaagcaaagtaagaatctcacagggacattagttaacggaacaactactattcattaacatataacagatctgtcttttcccagttagtggctaaacgatcttgcacctgaaggaaacccagatacctcaggactcattgcctctacacaagggtagccaaacttaagcttcattctctactcgtattaggtctctgttcggtggacacacattatttcctgaagaaaactgatcatcacctggactccttaaccctctcaattggtttcacaacaacaacaggagtctagccacttgaagtcctatattttgggaaccgtgcgcccttaatcaataagatcccctaagtacgtctcctaattcctaacatgcaagagccacagcactgcacatgggcaccaaccatacacacatggtttcatcgacatgagtcac

SEQ ID NO: 569604 - DNA, 1161 bp, Homo sapiens
  misc_feature (503)..(503): n is a, c, g, or t
  misc_feature (519)..(519): n is a, c, g, or t
  misc_feature (522)..(522): n is a, c, g, or t
  misc_feature (571)..(571): n is a, c, g, or t
  misc_feature (581)..(581): n is a, c, g, or t
  misc_feature (773)..(773): n is a, c, g, or t
  misc_feature (775)..(775): n is a, c, g, or t
  misc_feature (894)..(894): n is a, c, g, or t
  misc_feature (896)..(896): n is a, c, g, or t
  misc_feature (1032)..(1032): n is a, c, g, or t
  misc_feature (1037)..(1037): n is a, c, g, or t
  misc_feature (1043)..(1043): n is a, c, g, or t
  misc_feature (1066)..(1066): n is a, c, g, or t
  misc_feature (1081)..(1081): n is a, c, g, or t
  misc_feature (1117)..(1117): n is a, c, g, or t
gatatgatattatcttttaccattgcacttctagtgactgactagctatgtcgcgcatgacctcgtatcctccgtagaactgcctagaacgagaatactacttatcgcagctatcactatataagtctgagcattcgtactatatacccatcatagtatccacttgccgcgtgcatgtcaggcacaaatgttggtgctctcattgccacatactaagtagctattgcgcgatgctgcctatagcgcaggggaagggctgctgagtgcctgactgaggtctacaatctccatgcatgatgatggggctcatactgaaggtgacatcatggcataaacacatcactaccatatgtgtagaaaacttgattggtcctccataatacactgtgatggtaatcgttaggcgacttgtgctgtttaccatctctacacggaaagaaacccatccaatcatagtatgtagtacaatcgagaaccaactagattcgactccgcgaccagancataagagttgatctnagnctagtcttagtcccgtcgtcacgtgatgtctctatttagaccccacaantgctagaacnagatcaaaccgtagtcctctagcctgatgttacaccacatagcgctctttcgcggtcccggaagccaacgaacatccacatttttcccctacgcgtcaatttaacgtgataatcaaccctgcattatataaatttctcccatggggggaacatcccaattgttgaaaaaagtcccaattgagggcctagacntntggatgtccacagacggttggaatatcacaaggaatacctttgtggcccgaaccaaaccaccggatcggttcgaataggcccaatagatagcataaagtatcaatacgtcttctgttcntngcataaaccaaatttaggctttcctacaaccgttaatgatcgtgtccgctccagcgctattctgttcctctcatatgtggtcgaagccattggagaatcccaacatacccccaaaaagctaaagtgggtctggatntaccnttgacnttataaccttgggcccgggcaanggaggccaacctatncttaaactattaataaagtctccgtcttggacaaanggttgtgggctggttgtttggataatttatttcattcatagcag

SEQ ID NO: 569605 - DNA, 465 bp, Homo sapiens
agctactacctgacacagctgaccacctcacccggctgacgacccacacagcctcctggcctgggtcctcctgcgccagcattgtgtgtcaagtgtgtgtgtggctggcattcctgtgtgccgcgtgcagagcctgcaggacgcccttcggttcccaggatgccccaccacagagggggactggtccccccgagggtcctgggaagccctgttccaaccacatgccacataggtcctgttacgtgagttagaggggtgcgtgtgcttctcaagatgagctttcatcaagttcttcctccacgcgacgttggtccaattggccggtggggagtacagtgctaggtgagggtctccgctggggagcttgacacagcggggcgcaaataaagccgtcaccaatccaaacccgttctgcactgatacctcgtacaatagcaataaaaatgtgtcagcaagaacgccaaa

SEQ ID NO: 569606 - DNA, 164 bp, Homo sapiens
aatgaggtctcctcgatatgtctgtgggtctgtctgtacagtacatgctgtctcggtatgtactcctgtaatataatttgaagttggatagcatgatgcctccagctatgttctttttttttttgggctaaaaatggcctgggcaaataaggctctttaagggt

SEQ ID NO: 569607 - DNA, 812 bp, Homo sapiens
cggagatggtgtgcagccataatctcaggatgggtccacccgagacgcccattgagtcaccaaccctagtcccccgcgcggaccccattacttcgcatccggacaagactgaacagacaacaagtcatgaaaccaggaaacagactcgcccaacagcctggcaggcacaaggtgcgcacttggatgggaagaggaactgcgtcgacaaggacacagaacggaaggctgggtccactacgaagcaggccgacgaggcagcactggacagaagaaaacgattcagattcgtccctgtaaagaaagcttagagggctaaagacacatatcttcatgggatagttgtggaaagaagggctgaaaaataatgatattacaaaagcccaaagggggaaacaaaggatgaagtccgagcgatgtgtagctcgaaagccgcggtaaaaaggtgtcaaggggcaaatcagtcttggggaaggcaggaaatcgaacctgtatgccaacccatgtattaacaaggggacccagtaggcctgggagaagcacaaaacagcacggcctggaaccagaaacacaagtggcataaacccacaggccaatcgtgcaccaagcacaagccgtggggggatgaccgggcagctgacgctcctcggacccttacgagtcgtgaacacgcgcaagcacacattggtgcccggagcaggcctatcttggggacccccaacacccaacaagacctggtggaggcacttgcgccccacaacgccaaccccgaaccgtggggcccctaacaatgaggagcacgcaccgggaagcgt

SEQ ID NO: 569608 - DNA, 495 bp, Homo sapiens
tgtccagagtatccccatcaaccctaaatttattatggagcaaactaagcttcacaagtgaaggagaaataaaatcctttacagacaagcaatgctgagagattttggtcaccaccaggcctgccttataagagctcctgaaggaagcactaaacatggaaaggaaaaactggtaccagccactgtaaaaacatgccaaattgtaaagaccatcggcactatgaagaaactgcatcaactaacaggcaaaataaccagctagcatcataatgatgggatcaaattcacacatgacaatattaaccttaaatgtaaatgggctaaatgcaccaattaaaagacacagactggcaaattggataaagagtcaaggcccatcagtgtgctgtattcaggaaccccatctcacaggcaaagacacatgtaggctcaaaataaagggatggaggaatatttaccaagcaaatgacaaacataataaatttagggttgatg

SEQ ID NO: 569609 - DNA, 521 bp, Homo sapiens
atcaaatcaaaatggattagacttaaatgtaagacctcaaaccatgaagttactaaaagataacattggtgaaactctccaggacattggcctgggcaaagatctcttgagtaataccccacaagtacaggcaaccaatgcaaaagtggacaaattgcattatattgagtttaaaagcttctgctcagcaaaggaaacccctaagtgaagagacaacccccagaatgattgaaaatatttgcaaactgagaagggaatgtgaattccctatttttatttgacaggggattatttactggaatacacccttgacccaaaacactcctttttaaaaaaatctaacaggcccatttaaaaatgggccaaacatcttaaatgacatttcttaaaagaacctaccaattggtaacaggtttatgaaaaggggctttaacatcctccttctttaaaaaaattgcctgaaaaaaccttccaccgggccctttctttaccctcggctttaacccgggttttaaaccact

SEQ ID NO: 569610 - DNA, 241 bp, Homo sapiens
gtttgtaaacagccatctgcattcacaatgtatggttctctacaatcatcgttagacgtcatgagatcacatgattgagactcagtgtcatccgtattgtaatgggtgtgctctcactcatcgtagtgtacccctagaaggacgtccacagcgcacaaggtgttcgccaagcggtcgtcacgtcaccatgtaggatcatgtgggcataccactctatagctggctcgttagtgcagttcat

SEQ ID NO: 569611 - DNA, 151 bp, Homo sapiens
cagagcctctagagaagaaggaaatatgagggacaaaagcaaaactttaatacttcatctaaaatggggtcttttatgatccagttcggccggaaattcgagaaccctggttatacatgctgggagaaatcggattaaggtttgggatcca

SEQ ID NO: 569612 - DNA, 246 bp, Homo sapiens
cgcgcgatcgctcgacatcgatacgactgtttagaaggtcaacttgatcctgattcaactttggtacctggtatctgtccagaaatttgtctatttcgtccaggttttacagttttgttgagtatagccttttgtagaaggatctgatggtgttttggatttcttcaggatctgttgttatgcctcccttttcagttctatttttgttaattaggattttggtcgacgcggccgcgaatttagtag

SEQ ID NO: 569613 - DNA, 596 bp, Homo sapiens
tgagtcaagtacctagggacggaggctctgtgcttcctggaaggccgagtactagtgctcttcctcctaccctccagaagcaattccatcactcctctccttcagaaccacccttgaacaccagcgccccctgctgacatcttcacctctccgctgaagtctcagccagggtgacctgaacaagtctgcacgtcctgtccccactttgtccttgcctcgccctattcttgcaacctccaaggacttgcattccgattccaggtaaggcctcagcagagtccccactcacctcctgacagctctccttctaaactgtcttactatcaacgaacacgcgatagatagcaccaagcacataaaccaatataaagcttagtgggttaccataagagaaacacctttgacttccacgcaggtcaagaatagcactttcccagccaacccaaatgccccatgaacctggcccagctgttgcctccgatcccggcaactgtgagcccctccctgatatgaagccagctcttccttttgcttacttggtgatctttgcacccaagccccactgctgcccctaagcctctttccatggatatccc

SEQ ID NO: 569614 - DNA, 601 bp, Homo sapiens
  misc_feature (514)..(514): n is a, c, g, or t
  misc_feature (585)..(585): n is a, c, g, or t
ttactgcagtattaaaggcaaattatccttggtttaactgattcttctcttaatttttagttagaaatcctgggttctgtcaacattctccagttaatattcatggccttaggactggccaggatcatccactggccctggctggaatgtaacttttaaaatccttaaataaactcctttttaattataaaggtaattcatattcactgtccaaggcttgggacggccaggcagaagtaatagcctaatagtcacccataatcccaccatggggagataccatggttagggttttaatgcctgtgttttatccaaccagtttggatataactgtgtgcaccattttgaatcctgattttttggttttaaggttgaatcataaacattttatcatgttaataaagggcctttataaccatgactcctaaggtttaattgatccaaattattcttcaggtgcatgtttcagaccatcctctaattcctaaattatggaatttccatggttgccagngttgaatgatttttcatactggagaatataggtttatgcattggtactggctctgaagttgggaactattngggattcaattacggt

SEQ ID NO: 569615 - DNA, 182 bp, Homo sapiens
tgcacacagtgcacacacacaagcgcacagacacacaaacgcacagcaacacacacacacacagcacacacacgagcacacagcacacaaacgcacagcacacgcacacacatgcacacacagcacacacactagcacacagcacacacacaaagacacagtacacatggaatgcacacaca

SEQ ID NO: 569616 - DNA, 491 bp, Homo sapiens
tcgcggctctgccctgcgttcccgggatttctgctcctgcctgggccccctcccggcccctagccctgggttgcacctggatctgggctcaggaaggtgactttctgcccagggtcagctcttcatgtcttgtgagccctgtgaccttgaccgaggggcctccatctgcatgtcggcgtgcacatctgtgaaacggagctgcagctcaggcagggtaaggacgtctcgccattgactcacctggtgcaggtcttgtctgctgcctcctcctgctgggacttcactccagcctctagtgtttctaggccccagcatggcagaggacagagccttgggctcagggattgctgacgcggcgatggtgccgcctgttaaaacgaggttcctgcacctgcctggacacctgaatgcacctgctcacaccgtgcccttgccaggggtcatgagagctggggcagcctttgctgggcttctcctttagcttgggggtg

SEQ ID NO: 569617 - DNA, 420 bp, Homo sapiens
tcgcggctctgccctgcgttcccgggatttctgctcctgcctgggccccctcccggcccctagccctgggttgcacctggatctgggctcaggaaggtgactttctgcccagggtcagctcttcatgtcttgtgagccctgtgaccttgaccgaggggcctccatctgcatgtcggcgtgcacatctgtgaaacggagctgcagctcaggcaggggccaagattcacagagatttgcctctgcatgctccctggaaatggggtcagcaaggaccaagatacagaccccagggaagatggcgacctccaggtccaaaaggaagagcagaaaattcatctccatggcaacgccttaggaagctgcagcctcaagattataacttcccaagcaatgaagacaataaatggatttttcacaaaa

SEQ ID NO: 569618 - DNA, 106 bp, Homo sapiens
aggatttccggcagaaggtcctgtgtgtcctggacctttaggatctgagagtgacttcgtaccttcttgtgctaaggcctacagcctacgagcatctactgttccg

SEQ ID NO: 569619 - DNA, 124 bp, Homo sapiens
aatgtgtcgaaccattgtgaaggctaagacagcaagctgcagaagcaaataagaatgcgagtattcttttaaaggactcgatcttgaaagtcaagagagagagcagaaagcaggctcttcttct

SEQ ID NO: 569620 - DNA, 254 bp, Homo sapiens
aatacaggactgatgcattctactgggtcactatcgctgtcacaagacacagacaatcagaccaaagtattgctgtaataactaagaaaaaagaagaaaaaccacttgactataaatacagatatcttcgtcgtgtccctatacaagaagcagatcagagtcttcatgtggggctacagctatgttccagcggtcaccagcaggttcaacaaactcatctggatacatcattctagtcacatggccactcacta

SEQ ID NO: 569621 - DNA, 474 bp, Homo sapiens
ctaccgggaagccagtcttcacagggatgtaggagaaggatgatgcggattttgtacatagagtagaagaggattggaatcgagactagaatggggacgagtggctcgcatagggtcctggatcttctctccctcagcatctgtgcccatggccaggtcctgctccactcgggagagtttgtctacggtgccatggtaatgcttcatacagtcctcagcaaggggcagagtgggtggagtacgtgctgagctctttctggtactgaggcatcttcgttcagcatcggggacaggtcccgcatggtggtcttctctccagtattcattctcttgctagaagaaaaatctttcagagaccgggtgacttcctgggacacctctgcgatgtgcttgtggcgcagtgctatccacaggtcgtcgtcctcgtccaggagcacctccttcacccgtgccccccctatacagcgaccaggg

SEQ ID NO: 569622 - DNA, 148 bp, Homo sapiens
  misc_feature (61)..(62): n is a, c, g, or t
  misc_feature (69)..(69): n is a, c, g, or t
  misc_feature (82)..(82): n is a, c, g, or t
actctacaagatcccctggtagcgctcgggttagcgaggcttgctagaagtcatcaaaaannctattantgggagtagagtntgaatgtccttgagcacaggcattatgatcgcgactcgtcgcagtagcagtacgtatttcgaatcc

SEQ ID NO: 569623 - DNA, 220 bp, Homo sapiens
aagttggcgtgcactgggagagctagactagttggtcatgatgcagagctactcaaatgcagtcggctgttctgggctctgccctaatccggttctggattctaagttcaaggtattctacgcgagagccaggtaccaataggtgcgctgcatccagacagtaattctgcaaactgccttgagaaaaaggaccattgttcgaactacttacggtaattcc

SEQ ID NO: 569624 - DNA, 186 bp, Homo sapiens
ttgacatggttgggactctgaaccagcacgttccgagacggccggtccctgtgtacgaaccggacatcctccaggtagctcatccccttagcaatctggattctccagttcagcaggtcctgggaacccatgcgtacgcggttttccgggccatggtctaagaggcagccctagggcataagctga

SEQ ID NO: 569625 - DNA, 832 bp, Homo sapiens
  misc_feature (649)..(649): n is a, c, g, or t
gtagaattctggtctaattgatggtcgcctcaccatctgtacagtctcctgttgtctttgccatagtgtgcttgatttgggattatatgcacccctttccagagtccagacccgtttggctttgtgtgtcatatcctatttagtgctgatggggattctgaccatttatacctcatatgaggagaagagcatctttctcgtgtgccctataggtatagatcctacgaggcaatggatcctgcactgcatatttgggtagtctgtctctccattcttaccaaggtttgatgacgggatactaccttggagctgaccttcatcgagtggtgagaacaaatgcagcagtcggggaagccgtgttcccaaagtccatcgcgtgaggtttttatgaccactgagtggtacattggtcgatggcatgcatatgagccttgtagatagtccaggctcgcatgacagtctagccatcagaaagagaactttacgtatctatgtctatgagtagccctctttctcctggcatctatgctgaataagtaggctgggggggtagggggagatacaaacgaaggttaaaagtgggtcacagtcaggcaaatcgttccaatagtccctgtgtggtcctgaaattctagtctatgctgggtcncgtaggattgcctgaccatcatatgagaacgcggtagctctgatgtctagctggagttccttgatcggtgatgggctattaatggcttactgggaaagcagtttggctaacagctgtacagacttttccttgtacctagcagtaccttatatagtaaagtttggggccgttacatttaagaat

SEQ ID NO: 569626 - DNA, 857 bp, Homo sapiens
  misc_feature (152)..(152): n is a, c, g, or t
  misc_feature (409)..(409): n is a, c, g, or t
  misc_feature (627)..(627): n is a, c, g, or t
  misc_feature (698)..(698): n is a, c, g, or t
  misc_feature (700)..(700): n is a, c, g, or t
  misc_feature (707)..(707): n is a, c, g, or t
  misc_feature (714)..(714): n is a, c, g, or t
  misc_feature (717)..(717): n is a, c, g, or t
  misc_feature (719)..(719): n is a, c, g, or t
  misc_feature (734)..(734): n is a, c, g, or t
ggtgcagcttcaagcttaggaccacccaccatgcctatccaggtgctgaagggcctgaccatcactcattaagaacagaggaggctgcctgttactcctggtgttgcatccctccagacactctgctgtttcctgcctaggcgtggctgcangccatggctaggaaagcgctgccacccaacccacctgggccagagctggttctgctcctgctgcagtggacactgagctggctatctcggcgcttcgggcaagaactgcaacaggctctcctgggtcctgcaaggtgtacagccgggcccctgccttgttgcctcagctctcgagagtctgctgctgccgggtgacctgatctcaacctgataaggtgccatcttcaggctaccactgcaatggccctgagggcaancagcagcacggcactgcccacccggctgctgatggcctggtgccagctgggagtcctcccggcacttcgaggccactgagccagcccttccatgccccagcccaccatggacaggggtatccagcttcctcctcaaactcgtcctctgcccctgagcctagtgacgcccaaggtacatgcctgttacccaggtcctgtaccagcactagctggtcaanggcatgacagtgctggaggccagtcttggagatccaggccatcactggcagcaggctgctctccatggtgncnggggccncaggcancangntcatgctgggacccnaccagtgcacaaggacttggctgcttgagccacacacccgggagaacggtggataacgtggggcttaccaagggcttccttgcagataaggggacgagcacccccgatcccctattgtgacca

SEQ ID NO: 569627 - DNA, 429 bp, Homo sapiens
  misc_feature (11)..(11): n is a, c, g, or t
  misc_feature (17)..(17): n is a, c, g, or t
  misc_feature (38)..(38): n is a, c, g, or t
  misc_feature (63)..(63): n is a, c, g, or t
  misc_feature (103)..(103): n is a, c, g, or t
  misc_feature (176)..(176): n is a, c, g, or t
  misc_feature (226)..(226): n is a, c, g, or t
  misc_feature (240)..(240): n is a, c, g, or t
caagcctccanccccgncccatggacccctctgaaaanctcccatctccctaggaattgctanactctgacacaaacatttactgctggatcgacccacaaancagatgtggcttccttaggttcctctgggagctgctcctgtgggttgatggaacgtccctgaaagcccccagncctggggatggggaaggacatggagcctgagccagagaaccagctctgantcctgaggagacanaggcctggggacaggaagggatgggggtccctgctgaatatatagagacctcaacagactccccgggctctgggtggccaaggcgaagcttcccatcaccacagaagtggggcttgcagggaaaagtgaacgtatggccacccggggtcacctggaaaggatctgaataaagggaaacttcctctcaaa

SEQ ID NO: 569628 - DNA, 1681 bp, Homo sapiens
cgggtggggcttaccgtggttgttcgctcgtgtggtggctcgtgggcttggttgggcgcgcctgcggtcgacctcgccgcttcgttgccgtctcctcacgcgtcgtctctctgtgtctcgggggctggcgggtggggcgttgtcccttgagcctggcccctccgtggtgtggcggtgctgtgttcttctctcgctttttggcacctcctccgccgtcggtttacggcatggtgtctcttgcgctgtcgtccctcctcttcgcttctttctgtcgtccggcgggctacgtggtggatttgccgctcgcttcggtctctgagttcgccccgcccccgcgcagtcgttgtccggtgagctctctgcgtcctcccctcggcgtccgtcggccctcgatggtggggggtgcgtgcgtggcttcccggtcgtcgctctgcctgcctccttcgaggggggtcgggtccgctccgccctcccgcgtccgccggccggtgggtggggtggcgctcgcgtggggggtcgcgtgtctgcctcggcctgccgggcggtgggctcctccccccgctggcgtctgtgtggtgggtgtgctgtcgtgctctctgcctcgttgccttgtgcgccgcctgtgtcttgtggttgggcgggtgtcgtgtgcgctctctcgctccctgcgtgtctcgctctctcgctcccctcttccgcgcttgccgccgcgcccgcgcgcgctcggcgtcgctgcgcggtagtagaggtaatgcctcccgctgcactcgtcggtgggtcgctggtgcctcggtgtcctgggagcgccggctctctgtggtccgttctgtctccccgctctcctccttctctctcgtctctcgcgcttctcgcgctcgcgcgcgctgcgcgggctctcgtctgccttcgcgcgcgccccccgcgtcgctcttgttgcggcgcgtcgttctccctctcccgtctctcttggtgcttctcgtgtctctcgtgctgttggtgtcgcgggtgtgtgtggtggttggtggctcgtcgcgcgtggttggctgttgcgtcttgttgtgtcgtgtgtgtgtgtgtgtgcttttgggtcctgtttgtgtgttggttgagtgagtgcggtgcttctgttcgcggggcgcgcgctctcgctctctcctcgtcggctgtggggggtgtggtgggttgttgttcttcgctctctctccgtcgccgcggcgcgcgcgcgcctgcgtggtgtgtgtgtggggtgtgttgtgtgtgtgtgtggcgcgcgcgccggccgcgacgtggtgctgtctctcgctctcgccgcgtgtgtgtgtgtgttgctgctcccgctcggttcgtcgtcgtcgggcgcgccgcacgcccgcccctgctccgctctcccctctccctccctccgctcgttcttcctgtgttgtgttggggtcgcgccccctgcgcctcgcttctctttctcccgccccctcgccgctgtgttgtcctctctcgctctctccctctcgcgcggtgggggtggctctccccctcctcttgttgttgttgtgtgttgtgtgtgtgctgttgctgtgtgaagaataataggatatacaaactaagatgtaaataaaaaataaagaataaaaataatattaataaaataataataagaaatgaagaaagataaagaaagagagga

SEQ ID NO: 569629 - DNA, 676 bp, Homo sapiens
  misc_feature (152)..(152): n is a, c, g, or t
  misc_feature (409)..(409): n is a, c, g, or t
ggtgcagcttcaagcttaggaccacccaccatgcctatccaggtgctgaagggcctgaccatcactcattaagaacagaggaggctgcctgttactcctggtgttgcatccctccagacactctgctgtttcctgcctaggcgtggctgcangccatggctaggaaagcgctgccacccaacccacctgggccagagctggttctgctcctgctgcagtggacactgagctggctatctcggcgcttcgggcaagaactgcaacaggctctcctgggtcctgcaaggtgtacagccgggcccctgccttgttgcctcagctctcgagagtctgctgctgccgggtgacctgatctcaacctgataaggtgccatcttcaggctaccactgcaatggccctgagggcaancagcagcacggcactgcccacccggctgctgatggcctggtgccagctgggagtcctcccggcacttcgaggccactgagccagcccttccatgccccagcccaccatggacaggggtatccagcttcctcctcaaactcagtacatctgacccctgaaagacatatgaacacccaaggaccatgcctgtatacacagagtccttgtcacaacactagctgggtcacgggcatgaaagtgctgataagcagtctggcacatccaggc

SEQ ID NO: 569630 - DNA, 1383 bp, Homo sapiens
  misc_feature (338)..(338): n is a, c, g, or t
ggagtgccgagtgtcatgcacgaacacattgaggatcgctggcgcctccgctctcatgagtacgtgactcgtaagccgggcattcctatggtgcatttggagcacagcaatgaaggaggcctctctagtgtgtacctgttaggtcgtatcgatgtgtcgcacgatggcgtacagaaacgtgtgcagactgtgcgtgtactgtctgttgtctaatgactggttggtgctgttcaacctagagggtatcttatcagaaggagcgttcgagaccatggtggactgtgtacctggaaccctcaacaagatagttgcctgatatagagctggatactgttgantcgtgagtcgcgtgagaagcgttgtacattgagtagatggcgatgtggagcctgaaggggagtgtccatggaagctagaggccggctggccatctgatgatacagcgttgccaatacaagtttgggaccaagcggggtttgttaaactcgagggatactggtacaatgcccatgcatacgggtttggcatcagcgatctgcgcagcttctccctgtaggtttgccaagcgccttaaatacgagtaatgccaccagtgagcctaaactgtggaggcgtggacgcgcacggttattgagaaacgcccagcagaaacttgtgcttgaaacctgaaaggaaaccactgtgagacccacggggcatagaacttaacgttggcctttcccaggttgtgatgggacgaaccgggggttgtggtgtcttgggagatggcgcgtgggtgagttttgaccgattacaacttcccgggcgagaaaaaaccttgggaactccggtagacgccgctgaaatggacattcaccagcgatgggcacttggagaatgtggaaagaatttaattggcaccattggtcgcccagagtgtacacgttttaactgtatgcttaagggccggtacatacggtgagtgtaccacacggcaagagacagtgtcggtgttgatgatttgtgggatgatacacgacgcaaacaccccttgcaacttgaagttaccaaacagtgtgctaggtggactaggacacacataatgacgaccaaagaaggtgtggtctatgaggacacactattcggcacaccctgggaacgcggcatgtgcacttggaacacttcgtgtggagccacagggcgctagtgagttcccgttgattgcgacaacgcttggcaggaaccgattgagttttgggccaccacaccggggggaaaagatcgtttgcgcgccaatgggttgcattcgacgggcagacacgttgaaaacgacatcctgttgatacccctttccctagaaggaagtgatcggaaacagacggaacactttatccgcggaaaggg

SEQ ID NO: 569631 - DNA, 182 bp, Homo sapiens
  misc_feature (98)..(98): n is a, c, g, or t
  misc_feature (128)..(128): n is a, c, g, or t
  misc_feature (152)..(152): n is a, c, g, or t
aaaaaaaaaaaagaacccccccccggggggggggggggccccccccccccccggggcgcccccccctccctttttaaaaaaacccctttttaaaaaantccctttaaaacctccctaaaaaatttaanaaagcccggggggggttctttggncgagaaagaacgacacgaagggaagctgac

SEQ ID NO: 569632 - DNA, 660 bp, Homo sapiens
tccaggagacgctgagctgtggggaggatctgagggagaaagagacggaggcaggcagaacacggcctaggtgaacccatggatggcctgggcactaagcaggaaggcgtgttatgcgtgcctggccgcggagctaagttgcagagaggggtgtgcacgacctacacccaccgtgctagagggagctcacgtgatgaggtactagagcaaactttgtgcagcgtggtcccctctgtagccagggacagggagctctgagactggggctcgcagagcagacgtgcagagagcgttgtggtatgctggaagagacagatgtgccactgacgtgtggtgcaccgatttggccccatgccccacagtgtacagctgcatggaagtgacccgtgcagcggtcaaacatcacagccacgttgtaggcccctttaggagggaccatctgaggtggcaccactgtagcactcaggtggaaccctatctgcaatgggtccttcacagcccgcatgcggaagagctgatcccctcgctgaaactcatccgcactgacattggccaggcacgaatacagccgaatgtcctcttcattctcagggaagctccaaaaagcaattcggagctgtagctgctcaggcactggtgggtaactttctccacacttca

SEQ ID NO: 569633 - DNA, 379 bp, Homo sapiens
  misc_feature (46)..(46): n is a, c, g, or t
  misc_feature (130)..(130): n is a, c, g, or t
  misc_feature (140)..(140): n is a, c, g, or t
  misc_feature (148)..(148): n is a, c, g, or t
  misc_feature (223)..(223): n is a, c, g, or t
  misc_feature (254)..(254): n is a, c, g, or t
  misc_feature (345)..(345): n is a, c, g, or t
  misc_feature (365)..(365): n is a, c, g, or t
aggccttgcttttttcaccacgtgaggacacacctaaaaggtgtcnttctatgaaccaggaaaggggcctgaaccagacactgagtcttctggcaccttgatcttggacttccaagcctccaggagtgtnaagaattaantttctgtngttttaaagatacccagtctatgatactatgttacagcagcctgaaacttgcacttttaaacaaacatagcaatnacaaaatctatcctctgacttctggctttancttctgcttcagtacatcctctcctcccaaactccgctactgcttcttcaaaaacacttggggcaaggcaaaccaactttgccccacagcntactccccaattccataacnattatggtaatttc

SEQ ID NO: 569634 - DNA, 250 bp, Homo sapiens
cacctacaactgagaagttagaaacagccctgtccagccagagatggctagtgcttcatccagccaaagaggtcgacgtggtactggaaactttggtggtggtcgtggaggtggtttcggtgggaatgacaacttcggtcgtagaggaaacttcagttggtcgtggtaggctttggtaggcagccgtggtagatggtggatactggaggcagtggggatggctataactaggattaagccgaggtggaga

SEQ ID NO: 569635 - DNA, 950 bp, Homo sapiens
ggccggaggggctctgctttcctgtagtggcgctgttgggcccgtggggattgtaagctgtggtttgcggtgggaagagcggcgagagggtcgcatgtgcgtcgggatccccgcgacggatgaggtgtctgccaaagaagtctcacccgtgtggggtgaggtgttgcagtctcccacaggatgagatctggggatctagcaatttggggaggcagcagacctgaggcgtcgcttgcaagaggaggaacaagcaggcagtcctgggagacttactgggtgctgggacaagaaactgagcaatactggtccgcctagttggctacgcgaagacttcaccagatcaccctctcacttcggaaccgggacaactcgcaccgcggacacttcacctgaatagcctgggcgtctcgatatcaccgcaaacgttcttgcgcgggcacacttagtccaggccggctcaccggcgcaccgcttggcggaactgggccttcaggagcaggtcagaagaacccgttggatggaagcaagtgttgatcggtggcgctgcagcatgctcgcttgatgcaccgcatgatgaataccgacctgggtcctggacaggctcccggcatgaattctggacccccgatacacgtctatgagcacaggatgacatccggtggcagaacactccaaggctggtgagccgcctgattgagtggaggcatcccaatacagcagcagagtgcaaaatgcgcttataacggtgcagtgggcactccagggttcattagtcccaagagggctggcttggttttcaaagcgaccctgttgttcaggcacgggagcaggttatggaccacacatggatatatttaaaagggcgttagctataacgccgtggtcaacgcgggtaacattgcgcgcggaacatgccgcgcggtatcagaatctcgactgtttagcacacc

SEQ ID NO: 569636 - DNA, 237 bp, Homo sapiens
ctctagaggatctccttcgaggtgtactgtgtagaaagaaatagacatgggagactccattttgttatgtactaagaaaaattcttctgccttgagtattctgtgaccttacccccaaatcacgctgatgctcgcatgataacatgtgctgtgtctaactcaggttacattggattaggggcggagccagctgtgctttgtaactctagatgcttcaaggcagcttgctccttaaga

SEQ ID NO: 569637 - DNA, 197 bp, Homo sapiens
gcggcgggcgggctggacggcacagagtggagggagcgagcgagcagtgagtaagccagcaagggctggtcgggtcccgaggtcagccgagatttctcagtgtccctccgtgccccctccctgtgagtccacagcgcctaccgtgtgtccagaggatcggacacggccctggccctggccatggcctcgttgcttga

SEQ ID NO: 569638 - DNA, 437 bp, Homo sapiens
  misc_feature (219)..(219): n is a, c, g, or t
  misc_feature (295)..(295): n is a, c, g, or t
agtcagagacgcaaattaacgagtccaggcgtctgttattattgcctatgcaaatcggccaggccgcttgacatagtcgtatatacacgggacgcacaaagccaatgctcggtaaaaacctacccctttcagaactagtccacgatcccagcatcaattcgatagctctcggaccatttggtacagtcggcgacatccatgccgatacagtgatcatgnctggacggcaatggtcttgatcatcgtagggtgtgcttcggtatccagcaatctggtagtccagggcgcaggcggncccgggcaggcaatacttgagagtctttacactttcgtagctgatattgcaaagggcgcgattggcgaacacagatacaagacctatctgcccctgctctgcgctatgtttacatttatactcggctccaaccttctcggta

SEQ ID NO: 569639 - DNA, 505 bp, Homo sapiens
  misc_feature (9)..(9): n is a, c, g, or t
cattgaatnccaatcgcatcgggtcgcgcgccatcgcgttgagacctcggaattcggccattatggccgggggctcaaagaggaacttgaacatttccactctagacactggttgccagaaactgattgaacaggccaaataacgcaatctacgaactttcaatgagaagcgcatggtcacgaacgaagctgactgagctatgggaggaaaatgcaagggatatgtggcactaagcagatggacgcaactacagacacggtttccgcactaaacaaggacgtgttgacccatggcagcgaaaggctgatactgaatgagggcaaactgtgagacaaaccaatgagaactgtccaaagaaatataaaattggctcgtgaatgcattgtcaaggctgatctgagcgaactacttggttattgtggacagatggatattcctggactgactgattctacactgcctcgacgtcttggatccagacgagcttgcagcatacttggcttt

SEQ ID NO: 569640 - DNA, 875 bp, Homo sapiens
tgtggtgactcacgcctgtaatcccagcaccttgggaggccaaggcgggtggatcacttgaggtcaggagttcgagaccagcccggcaacatggcaaaaccccgtctctactaaaagtacaaaaattagtcgagtgtgggtggcgcatgcctgtaatcccagctactcggaaggctgaggcaggagaattggcttaagcccgggaggtggaggttgcagtgagctgagatcgtgacactgcactccagcctgggcaacagaccgagaccccatgtcaaaaaaaaaaaaaaaaaaaaaaaaaatttgtggggggcctgggcctggaaaaagtttctagaaaaacattcgcggtgggggcgcggccggccccgagtagggttaggtgtgacaccgggcacaagagcgggtgccagaggaagaaccggcccgggacatacggggggctgggttcctccacccaaaaaaaaaagcggccgggggcgacacgggggggtgtcgaaccaatcccgagaggggctcgcgagggcactcacgggggtccaccaccagggaggtccaggggaagctcgatttaatagccgcccccggagggggtaacaacgtaccaagagcacgacagaaaccacagaaaccgcgaccaaacaccccctaccggcggggaccctgtcactgacacaccaacgcgacaaagagcaaacagcgcaaacaccgaccagcaagacaaaagacgcagccgcacgaacaaaagccgaagaacagcagcacgattacagcaacgaacagacagaagtcacacacgacaacacagccaataacacggccgcaggacaaccaacaagacagacaaacaaccaacagaagcaccgcaaaccagc

SEQ ID NO: 569641 - DNA, 409 bp, Homo sapiens
gagtcatgtgcggagacacagagcaggcttccgggcgtggtaatcctagacttgaaagtgggccagtactgaaaacttcaaagctgaatattttgttattggctaagtatttaaatgttctaacagatcagaacatgaaatgccctcctaaatgtcagctgttgtcacacagtagctccaacacttggagcatttttacgggagtggcctcatttcactagagacaaatctttaagaatagttctaaaattgggcttgtgatttccatttctgatgtctccagattggcacccctttctagttcagtgcctcacgagattggccaggggcatccaaggcaaacaatcccaatctttctatatagaatgtattcaagcaaacatcaaataaatttctgtgcccatttcaa

SEQ ID NO: 569642 - DNA, 804 bp, Homo sapiens
  misc_feature (4)..(4): n is a, c, g, or t
  misc_feature (68)..(68): n is a, c, g, or t
  misc_feature (86)..(86): n is a, c, g, or t
  misc_feature (140)..(140): n is a, c, g, or t
  misc_feature (170)..(170): n is a, c, g, or t
  misc_feature (194)..(194): n is a, c, g, or t
  misc_feature (234)..(234): n is a, c, g, or t
  misc_feature (239)..(239): n is a, c, g, or t
  misc_feature (254)..(254): n is a, c, g, or t
  misc_feature (302)..(302): n is a, c, g, or t
  misc_feature (344)..(344): n is a, c, g, or t
  misc_feature (349)..(349): n is a, c, g, or t
  misc_feature (353)..(353): n is a, c, g, or t
  misc_feature (496)..(496): n is a, c, g, or t
  misc_feature (502)..(502): n is a, c, g, or t
  misc_feature (517)..(517): n is a, c, g, or t
  misc_feature (531)..(531): n is a, c, g, or t
  misc_feature (608)..(608): n is a, c, g, or t
  misc_feature (610)..(610): n is a, c, g, or t
  misc_feature (612)..(612): n is a, c, g, or t
  misc_feature (614)..(614): n is a, c, g, or t
  misc_feature (616)..(616): n is a, c, g, or t
  misc_feature (637)..(637): n is a, c, g, or t
  misc_feature (642)..(642): n is a, c, g, or t
  misc_feature (650)..(650): n is a, c, g, or t
  misc_feature (660)..(660): n is a, c, g, or t
  misc_feature (723)..(723): n is a, c, g, or t
  misc_feature (741)..(741): n is a, c, g, or t
  misc_feature (764)..(764): n is a, c, g, or t
gggnaggaagagaaatctccctgctagcaacagcgactcagggagaaactctgggcccatagctagcnggaggcagggtgacattnctcccaccaatgggccatcttcttagctacacctttgtagctgtggtgccaggnagaggaaccacctggaaactgagctaaggnaggttccttcttccaacagaaganacagctgggcagggactgtgcagactcaacagggccaggncagcnagtggccagtaagtnttcatgttttttaccagtgcctggagggtccccagccaaggacagaantggtcagttcctgccagcagcttgagctggaatgccctgggngggtnagtngagggtggtcacttgaggagcttcacagagaggcggatgtcaacatcgcagaggaagatgttcatgaggtcatggcctgcctcctgtgctatctgggagatcacgtggcccttcggaccaatcaggagtttcacataagattntttggntaccagaagcttctnttggataaccagcnccccacctggtccttcctcccacactgctgttttctgctgtacattgtaaggcacctcctggggcaggtgttctagnancntntntaaaaaaaaaacccccccccnctctnctggtgtntggctagttngggttggtttgtggttcttccaggggcctgggtgggcctgttttagaaggtattgcttttgtnttttcacgttctcctggnttagggctgataacatgaagatnttcttgaagtggggccagcaaatctctaaggatttccaca

SEQ ID NO: 569643 - DNA, 341 bp, Homo sapiens
gacccacaagtcctccccgaattggcctctggctatttcttcagtttcatttcatgtcactcttcctcttgtgcaaataaactgatttttgctccagttcttttgtggcttgtgacacaaggagctagaactttaaaagacttgacatgacagtttggagaagatgtggagcaactgaaactcctctacatggattatgggaggattaattggtactaaagttaaagatgtgcttgttctgtggtccaccagtcctactcctgggtgtttgtccaatagaaatgagtgctcatggtcacttaaatatgtatgtaagaatgctcagaatagctttgtaatag

SEQ ID NO: 569644 - DNA, 559 bp, Homo sapiens
  misc_feature (57)..(57): n is a, c, g, or t
  misc_feature (82)..(82): n is a, c, g, or t
cagccgcaggctacccagtggtggatgaatggtcagaggcctcccctatgactcacnggttgcagctgtcccaaacccaacnggaccctctttatatttggtgtcacaaagtatattgcaggcccctatgaatgtgaaatacggaaccccagtgagtgccagccgcagtgacccagtcaccctgaatctcctccgctcttattaatgactgccacaacagaaacactgagaaaaagaggcaaccatgaaaacgtggaaagttctgacgacagaaaatagcaatcagcctttctcacatcccaaagctttaaaaaatatatgagtgcagcatggccagtatggaattgaccaaaaactaatcatcaagctagaaacgtggtgagagaaaaaaaaagggcaagaatatctttggcttatcacctcccacttttgcctactaatctgatgctgaaaagaaatgctcactgaagcattttagattttgaatctttcagatttgggatgctaaaccagtaagcatatgacaaatatttcagaataaaaaaatgtcagaaatcca

SEQ ID NO: 569645 - DNA, 972 bp, Homo sapiens
  misc_feature (19)..(19): n is a, c, g, or t
  misc_feature (164)..(164): n is a, c, g, or t
  misc_feature (174)..(174): n is a, c, g, or t
  misc_feature (200)..(200): n is a, c, g, or t
  misc_feature (204)..(204): n is a, c, g, or t
  misc_feature (212)..(212): n is a, c, g, or t
  misc_feature (230)..(230): n is a, c, g, or t
  misc_feature (283)..(283): n is a, c, g, or t
  misc_feature (294)..(294): n is a, c, g, or t
  misc_feature (300)..(300): n is a, c, g, or t
  misc_feature (306)..(306): n is a, c, g, or t
  misc_feature (336)..(336): n is a, c, g, or t
  misc_feature (377)..(377): n is a, c, g, or t
  misc_feature (422)..(422): n is a, c, g, or t
  misc_feature (439)..(439): n is a, c, g, or t
  misc_feature (441)..(441): n is a, c, g, or t
  misc_feature (465)..(465): n is a, c, g, or t
  misc_feature (473)..(474): n is a, c, g, or t
  misc_feature (480)..(480): n is a, c, g, or t
  misc_feature (641)..(641): n is a, c, g, or t
  misc_feature (715)..(715): n is a, c, g, or t
  misc_feature (824)..(824): n is a, c, g, or t
  misc_feature (866)..(866): n is a, c, g, or t
  misc_feature (949)..(949): n is a, c, g, or t
tctgctgggactgcatgtncctggatgggctcccccaggcctaagctccaggtttcctctggccttccgaagattttgtgggttacgaccaattgatcaaagatgattttttcctggcgcttgctcagctgcaaaagctttatggtgttttgcaacttcttttnttgttcaaanaattttttatgtagtttggtgaactntgcnttaatttntccaatttgctcaaagtnaagggggcactggccatcctcggggagttagatttttcagagaagcttaagcngcttgtaggcnttttcnagggtnagcttggccgttctcaaactgctcaaaaanttgctcagtggtgctgggtgtggaccctttgttcccagctnttgatttgtggagctgggagctttttgggtttgaatgttaatttnagaaaggagcttttgtncntggttgatatgtttgagaagggcnttatagtnntaaatnaggaaaaggaaatgggggcaatttttgctggcacaaaggtggtggccagttacaaggagggaaataaaaggagtttagttgcagaaatgaaaatgtagaaggagagggagtacgtgtaattaacagagagtggaggagtatatgaaattgattttggtgtnactgcctgggaggaatcaaacagatcaaatgaattatcactttccatgggatatttgtcaccatcgtgtttgtnaggctgaaggggcacctcagggatggacacggcttggacagccagagttagggctccttcctgttccttctctgccccccttgccagctgttccttgagcctgccctgngagtgctgctggtttcgatgctcctttctagttgcaagcgcngagcctggatctccatcaggaggctgttcaggtcctgaaagaatcctgccccttccagccttctcccgacgcctctttcagtntcctgttctcttcatccagcttt

SEQ ID NO: 569646 - DNA, 712 bp, Homo sapiens
  misc_feature (436)..(436): n is a, c, g, or t
  misc_feature (445)..(445): n is a, c, g, or t
  misc_feature (505)..(505): n is a, c, g, or t
  misc_feature (534)..(535): n is a, c, g, or t
  misc_feature (567)..(567): n is a, c, g, or t
aacatggtagaatgcttctgtctaggtttgatatgaagatatacccgtttcgaaggaaggccacaaagtggtccaaatatccacttgcagattctacaaaaagagtgtttgaaagctgaactatgaaagcaaggttcaactctgtgagttgaatgcaaacatcacaaagaagtttctcagaatgcttccgtgtagttctgggaagtttatcccgtttccaacgaaatcctcagagaggtccaaatatccacttgcagattctacagaaagtgtgtttggaatctgcgccatccaaaggaatgttcagctctgttagttcaatgcaatgatcactaagaattgtctgtgaatgcttcgtttggtttttagatgaagttatttcctttactacagtaggcctcaaagcagtccaaatctccaatcgcagattctacanaaagattgnttacaacctgctctatctataggaatgttcaactctgtgagtcgaatgcaatcatcacanagtagtttctgagaatgcttccatctagnntttatgtgaagattttccttttccaccacagncctcaaagccctccaaatgtccacttgcagattctagaaaaagagggttcagagctgctctgtcaagaggaaagttcaattcttgaagtggaacacaaacagtcgacgcggccgcgaatttagtagtagtagtaggcggccgctc

SEQ ID NO: 569647 - DNA, 186 bp, Homo sapiens
agcgctgatagcctcacgccgatactccctgtctgcacttggcagcccatacaaggatgaagttccgtgaaaggaaaatgacttttatttccaagctaagagtggcaagcttactcctcttagaaactggttccgacttagaggctcgggaagaaggtcttcaaacatgggacttggactcgggaa

SEQ ID NO: 569648 - DNA, 412 bp, Homo sapiens
cacgccgcaccgcgcgtacaaaggggggttgtctctggtcgggtcagagtcggggtcataagagtgccacgtaggggagcttttgagccaggatgagccaggagaaggagttccatgaagacaatgtctatcagttaaggcaggaacaggccattttcgctactttggtggtgtaatgtcatcagttaaggcacgaaccggccatctggatgtgtacgtgcaggtcacagggagatatgatggcttagcttgggctcagatggcctgacattcctgtcttcttatattactaagagaaatacactgacaataggggtaaagtgtctgggacatgctaaaattttcgggggtggtatggcgagataatggctgatgtctctcaaggctgctttgaaccggtggtgcgccgtgt

SEQ ID NO: 569649 - DNA, 368 bp, Homo sapiens
  misc_feature (125)..(125): n is a, c, g, or t
  misc_feature (127)..(127): n is a, c, g, or t
  misc_feature (191)..(191): n is a, c, g, or t
  misc_feature (204)..(204): n is a, c, g, or t
tagcaccgaatgtgactgacgcgtgatagaatccaacttgagcgaacttctcaaccgccgcctggccctgctcggcaagcgcgaacacctctccctgctagagcaatgcttgcacggcatcgagngngaatgcctgcgcgtcaccaacgaaggtcgactggcgcaaacgccgcaccccgaagccctgggcnccgcgctgaccantgaacagatcaccaccgactactcggaatcgctgctggagttcatcacccctgccctgccgaacccggccgatactctgagcagcctggacaagatccatcgctttgcctacaccaagctgggcagcgaatacctgtggagcccctcgaacattcggtgctcaa

SEQ ID NO: 569650 - DNA, 122 bp, Homo sapiens
cggggaggccgcagcaccttctggaagacttggcctttttcttcctcgctctgacgcagggccgaggtgggcagttccaggccgagagccggcggccctgaaggtgagtgaggccctcggca

SEQ ID NO: 569651 - DNA, 443 bp, Homo sapiens
gatattaacgtgtcgacgtggtgaaaaccccgtgacgggccttacacagatacacaccccagtccccaactgctggactaaaaccacgaataccacggaaaaaagctaaagacagaggacaacagtgaagtcaagacagcaaagagtggtgtggacgacccaaaagccagactcacgcattccatgcaaaaagataacgatgacaaccacagcaataataataatcataataaaacaaaggtacaggtgaaaagcagcgcttggggtgtgcagctgcaagctggggaaggcgcgtgatcaacttggatgggacacaccctagtctatcttcaagtccctaaattcaaagagcttcaaacgtacttgcaccgtcaggccttccttcagactctaggacctgatgttactaagtagccgggtgacacaggatctgtctttcttca

SEQ ID NO: 569652 - DNA, 304 bp, Homo sapiens
actgctcaaacacgcacacagtcacaacacgctcacacactgctctcacattcacactcacaaacgtcactaacacactcacacatcccccgttcacacacatctcacactcacacacgctcacattctacacacactctacgctctcacattcacattcacacactctcacacagtcgcacacacgttcacacatgcacttattcacacacattcactcaacattcacacattcacactcgctcaaacaagctcacgtttactcacattcacacacacgcccaggtaggtataaagaaggacg

SEQ ID NO: 569653 - DNA, 1188 bp, Homo sapiens
  misc_feature (17)..(17): n is a, c, g, or t
  misc_feature (50)..(50): n is a, c, g, or t
  misc_feature (53)..(53): n is a, c, g, or t
  misc_feature (55)..(55): n is a, c, g, or t
  misc_feature (63)..(63): n is a, c, g, or t
  misc_feature (68)..(68): n is a, c, g, or t
  misc_feature (81)..(81): n is a, c, g, or t
  misc_feature (95)..(95): n is a, c, g, or t
  misc_feature (136)..(136): n is a, c, g, or t
  misc_feature (198)..(198): n is a, c, g, or t
  misc_feature (244)..(244): n is a, c, g, or t
  misc_feature (246)..(246): n is a, c, g, or t
  misc_feature (260)..(260): n is a, c, g, or t
  misc_feature (397)..(397): n is a, c, g, or t
  misc_feature (454)..(454): n is a, c, g, or t
  misc_feature (464)..(464): n is a, c, g, or t
  misc_feature (468)..(468): n is a, c, g, or t
  misc_feature (494)..(494): n is a, c, g, or t
  misc_feature (523)..(523): n is a, c, g, or t
  misc_feature (572)..(572): n is a, c, g, or t
aagtaaggttccgcacngttcacccggatgatggatatcggtgatcgctnggngncagctagncttcncgtagcgctgccngaacccagaatagncaaccccgagcggtcggtcatagggtgatggacaccaactntggcgccgaccgctccatagagacccgcgcagcgttatcgaaaggaggtatatcctgactcncacggttgcttcccgaagcggcacagaaggtctcacccgacgtcgncnatagtttcgtgccnccagcggcggacgcatcgcccgaccgcacagatattgtcgcggcgaaccctctcccccgagaggatgggcacatgggtggaaacaaggcacggacgcacggccggcacgaatgcgtgccacaaggtgaaagcacgtnacgcacgtccggaacgcacgctgattctgaacgtctgtaggaggcctagatcctctnctccggaggntagnacagaacgtggcggcgcacgaggacngaacaccctgcggcggacccacaatatanggcaggtcgccaaacgcagatggtgccaggagttacacgaaaactgggnccacgttctgcgccggaagcagaaaaatgggcggcgcgcaaaaacacccgctggaagggcggcctatcatgcaccgcgtcttacagcaccagtcccaacgagcggggccgacgttgcgccaccaacctggtccgctcacgagagtcgtctaatcagaaaccctccaaggtgtcccttcacgagcggtcgcacgaagacgccagagacgggatcacacaagggatcttttctatggaacaaagatatagggtacacgaaggagccctaaccaagtgggaagaattaacccggtcatagaacacgcgagaatgccccctgagacctgcgttctcaccattggggagaccccaccggcgatgagttcaacacggtctttctcggcaccctgaggggcttcagctgatatctctccgcacagcgcccgtgcctaacattgcgccccacggggtcgtaaaagacgactttcagctctgggcgaaagcgagtatcatcaagtcccccccgcagcaaaacccccaacaggttaaatcccctccgtgcacgagtttgggcagctagtttgcggagtaatttttccccccaatggggctcccgttaattccaccccaacataacg

SEQ ID NO: 569654 - DNA, 160 bp, Homo sapiens
agaggatcccgtacagccgctgcgtggtagaagcagcaggtgccattgctactgacagtgctcagcttcccccggccgggtcaggccgtgggagccgtattatctagcgtctctgccaaagactcgtggggggcatcacactgcgctgtgcagcggagcc

SEQ ID NO: 569655 - DNA, 112 bp, Homo sapiens
tcacgtggtcgtggaccttagcccctggaatcactgagaatagccccggaggagaagaagtagggggagaggagaggactcagcgggcgcccgtctcgtatactgcagactg

SEQ ID NO: 569656 - DNA, 87 bp, Homo sapiens
gggttttttttgcggggggggttgcttttttctggggtctttaagctccaaaaaaaaaacacttcctttgagggagagcccccctta

SEQ ID NO: 569657 - DNA, 99 bp, Homo sapiens
tcaagcttctaacgatgtacggggacatgttaaaatcacttttcatggaaagagctctatgtaacagcataataaaactgcctacctagcaacaaaaaa

SEQ ID NO: 569658 - DNA, 390 bp, Homo sapiens
ttgaggatccccacactatgtaatactatgctacttgatgcatctgtgtgtttgagtattttatatacctcatataagtggtatcatgcattatttgtcctgtgactggctttcacttagcatagtgtttcagggttcatccatgttgtcacatgtggcaggatttccttttttaaaacttaatattccattgtatgtgtatactatattttctcactaattcatccggtgatgtacatttaggttgtttccacatcttggccattgtgaataatgctacaatgaacgtaggaatgaaaatacccctcaagatcctgatttcagatcttttggataaatatccagaagtgagattagtggatcatgtcatatgttttccatagcagctgc

SEQ ID NO: 569659 - DNA, 193 bp, Homo sapiens
tgacacctgcagcaaggcggaagcgacacttaggttgatgggccgcggcgagaccacgtgaggtcccagtgtgtaggtggctgtgtgcatgccgaggaggggtctgctggagaaatcatccctgctggcgcaatgatgctgggttttcatccaacacagatgtgagaaaataaaaggcgctttgtagacggca

SEQ ID NO: 569660 - DNA, 754 bp, Homo sapiens
  misc_feature (51)..(51): n is a, c, g, or t
  misc_feature (192)..(192): n is a, c, g, or t
  misc_feature (291)..(291): n is a, c, g, or t
  misc_feature (438)..(438): n is a, c, g, or t
  misc_feature (441)..(441): n is a, c, g, or t
  misc_feature (479)..(479): n is a, c, g, or t
  misc_feature (605)..(605): n is a, c, g, or t
ccctgaaggggcacggcgcctctcggtgttgccagatgcgtgaaacagtcncttggggcatgctgacctgacgccctccaagcgaccaagggcccttcatctccacagggagattgctgaaggtggagagccttggcacgtcagcaagggaccatgggccattgcagacgagaaaaaggcaaaggcagtgcnacttccccccaggaggggcaaacggttgttacgcgagggggcatgtgaaggaggctgctgccaagtactcgatgccattgcctgcctcaagaacctgangatgaaggaacagctgtggtcccctgaatggatccagctggacaagcagatcacgccgcttctgctcaactactgccagtgcaagctggtggtcgaggagtactacgaggtgctggacccctgcttttccatcctcaacaagttcgncgncaacgtcaaggccttcttcaaacggggcaaggcccccncggccgtgtggaatgcccaggaggcccaggcttacttttccaaagtgctggagctggacccagccctggcgcctgtggttaacccaaaacttcgggccctggaggcccggatccggcaaaaggacnaaaaggacaaagcccggttccgggggattttttccccttgacaggagcccttggccctgcctttcctgccaagccccctgctgcagctgccagcccccctgcccgtgttgggtcatgcttttgtgtatataaaggcctttttttttcca

SEQ ID NO: 569661 - DNA, 203 bp, Homo sapiens
agcaggttaggtctcaatctcttgactcatgatccgccacctctgcctcccaaagtgctgggattacaggggtgagccaccacgccggcctgtctaggtttgaacggagtggcttatgaaatatatagagcagaatttaagaacttatcatttttcaagagatgagaccatagatagttcattatgtagctgtgtcttctgag

SEQ ID NO: 569662 - DNA, 190 bp, Homo sapiens
aaggactgaaaaatgtagtatacagaggttatggattgtcattgatgctatcgtgtgacagtgtacatttgatttcggaacgagtatttaataaaccttcattgtatgcattatagtcattattgagcttcgtctaaaaagcactaccttatcctcgtgtataaggatctattagtttggttatgctcta

SEQ ID NO: 569663 - DNA, 496 bp, Homo sapiens
catcactctcgagtggagccgagtgagcacattgtagaattgtcaaggcaaagatccaagacaaggaaggcatccctacctgagcagcagaggttgatcttctgctgggaaacagctggaatatggactgcaccctgtctgactacaagatccagaaagagtccagcctgcatctggtgttccgcctcagaggtgggatgcaaatctgcgcgaagaccctgactggtaagatccatcatcctcgaggttgcagccccagtgagagcatcgagaatgtcaaggccaagatccaagatcaggccggcatccctcctgatcaggagaggttgaccattgctgggaaacaggtggaagatggacgcagcctgtctgactacaacatccagaaagagtccactctgcacttggccctgcgcttgagggggggtgtctacgttgccgcttagaaggtatcaacaaatttgcattgcactttcctttcaataaagttgtggca

SEQ ID NO: 569664 - DNA, 328 bp, Homo sapiens
tgactttgtacgagaaaatggattgtcatttgttcatacaaaactatatatagacaattatacgaatatcaccattctttacctgaactccagggtcctctaaagtaaaataagtgggaccagtctatgttatttccgatactcatatttatgtattgaaggattggtccacatcccgtacaagtacttatagtttagaaaactacgacctgggttctctccttttcaacatcgatttacaactaaatgaatattgatctgcagatacactcttttatatacatatgtatatatactatacgtcttcagtgaaaaaaatagtccgaaa

SEQ ID NO: 569665 - DNA, 195 bp, Homo sapiens
gccaggttccaggcgaaccctgtactatcaaatgagtggagatgacacccagcatatccagcaattctatgatctcctgacttgcttcatggaggatcattccggggcttggcagaggaagatcccttgcttcgcagaactgcccaaagccgacccaagaacctctttttggattagcttcttaggactgtgttg

SEQ ID NO: 569666 - DNA, 130 bp, Homo sapiens
atacatagactcatcatcgacaagcctgtctgcttcgtagggaggctggaaaagattcatcccaccggaaaaatgtttattctttcagatggaggaggaaaaaaaggaaccatcgagttgatggaacccc

SEQ ID NO: 569667 - DNA, 357 bp, Homo sapiens
agatgccgagggtgactctagaggatttcaccacggcacccccttctctgcgcgcgtacttctgctttcttcttggatggctttggcttcttctcacggaaggttgatagttgtgagggaccttcttaaagcggactttgagattgccctggcctgagctgagagtcgtgggggaaggcctcgtaggataagcagctcttggtccacagtgcaccagcagggtagggcctggctctggcgggctgcccagcggccaaccagcagacacctacctttgacgagggggcagcttcccctctgggcgggggtacccgaggctcgaaattcggtaatccatgggtcataagcttgttttcc

SEQ ID NO: 569668 - DNA, 177 bp, Homo sapiens
tggctgcttctctcctcgcccaaagacatgtgatgcaactgctaattgaaaagcagtaatacagccgctttaggctatagcagtttcaactccactctgaggtgaagattccatttacattcgatgacttaagttctttcatattttttcctcaacaagaagttcctagagtcctag

SEQ ID NO: 569669 - DNA, 425 bp, Homo sapiens
agcctggcggtcaagagtgttgatgactgtggagaccctggcgctacaggcacgcgccaccgcgcccggcctcaggcatcagtagggcaacagacacagccattgcctccagctccaccacagactgaccagctttcagtccagcaacaggcagctcagacaacccgcttgggtagcacctcggaaccgtggcagtgggttcggacatacattggggtggatggtaatggagtaggacagtcctcaggctggctctggatctactccttcagaaccccacccagtgtcggacaagctccggtccactactaactataaacccacagattttgcctggacatctgaaacatggacgggtttccatcattcacagctaccctgacgacgatatccaccgtccattaactatcatattggtgcacaca

SEQ ID NO: 569670 - DNA, 189 bp, Homo sapiens
  misc_feature (12)..(12): n is a, c, g, or t
  misc_feature (25)..(25): n is a, c, g, or t
ccactctagatnatcccctactttngctttttaatcccccaaagcatctaagcattgaagtgaatacaaaggaagaacttaatagatgcctgatttaaaactggccaagttggtaaaatcggaatgttttcaacaattatgtgatcaaaataattatgaaaaagtgacgaccaatacatatgtctctcc

SEQ ID NO: 569671 - DNA, 460 bp, Homo sapiens
gtgggtgtgggtataatactaagttgagatgatatcatttacggggtgaaggctgctattgtgaagtatgccttatattctacttgtcctttcgtacagggaaggaatttgaatgaagatagaaaccgacctgtgattactcctggtctgaactctagatcactgtagtgaccttaatcagttgaacaacactgaacctattaatagacggctgcaccatctgggatgtccatgatccaacatctgaggtcgtaaacccatattgtttgatatgcgactcatacaatagtgatctgcgctgttatccgctaggtgtcaccttgttcctgttggtcacagttatctggatcaatttgagtatagatagttcgctactgacatggtgacagtcttacgcatagtacttgctcaggagtgtctgggttcttgctcctgaggtctgcccaatcaaccatagttg

SEQ ID NO: 569672 - DNA, 243 bp, Homo sapiens
agtgtggccggtcgccctctcaggccggctacccgtcgtcgccttggtgagccattacctcaccaacaagctgataggccgcgggctcatccttcaccgccggagctttccaacctccaagatgccttggaggctcgtatccggtattagaccccgtttccagggcttgtcccagagtgaagggcagattgcccacgtgttactcacccgttcgccactaatcccctcccgaaggaggttcat

SEQ ID NO: 569673 - DNA, 145 bp, Homo sapiens
ggcacgaggggcccctggtgctgcgcgggcacaccgtcgaagagcgtgcggttacgcccgaacatcctcctcaggcgtagactaggtcctgcctgactacggtctggaacgtgctctctgaactaaatggacctggacgaggggc

SEQ ID NO: 569674 - DNA, 300 bp, Homo sapiens
ggggctttccccccccgggggtttttttcccttttttccaaaaattgggtgcccggcccggggcccgggccctcttcttttttttttttaagtggggggggtttccgccccccaaattccccccgcccgttttttaaacattttcccgattccaaatttatttttcctcttcccccccggtttttggcccgttggcccaacccccctttttccccccaagggccccccccttttttttttgtggggggcccttttccgggtttgcccccatttatttttgggacccccccggaaaaaaaa

SEQ ID NO: 569675 - DNA, 210 bp, Homo sapiens
cttcctccagtggggcgcaggtaactatgctggtcctcattctgagagcctccatctatcggaactcgatcacatactcttggagtataagcatgggagaagttcatcacaaggtccattggcaatacaaatggcatgacccattgggtaatgcattatattcctcccgttgaactgtccattgagatgctgctgtgctctcactacagg

SEQ ID NO: 569676 - DNA, 349 bp, Homo sapiens
gagacagggcctcactctgttgcccaggctgtagtgcagtggctcaatcatggctcgctgcagcctcaactttctgggttcaagcaatccttccgcctcagactcctgagtggctgagactacaggtgcacccccctacgcctggctagtttttgtattttttgtagagatggggtgtcactatgttgcccaggctggtctccaactcctggactcaggagatttgcctgcctcagcctctcaaagggctgggataacagatgtaagcccctgcatctggcctccaatgagttgttatgtgaaaagaacgtgattgtaggtgcttaataaatgcttgctgttataaacc

SEQ ID NO: 569677 - DNA, 630 bp, Homo sapiens
atgtgttattggatattgtctgtcttcatgacatgtctgtgcaacatactatcaacaagtcaaaattgtgtcatatatcgttgtaagcattctttatatagtatataacacaacattcttcatctgatatatgtgtaactaaatagtttctcaaaaccagatagtgagtatagctatcccatttcctcacccatgatctatggaatatacaagtaaaaatgttgatgcctggacaacaaagaggccccatctctacacaaacatacaaaacttagctgggtgtggtgtcatgcacctgtggtcccatctactaggaaagctggcgaaaaagaatcatttgagtctgggaggtcaaggctgcatagagcgtagtgaccacaccactgcactccagtctctgggcatacaggaacgaaactctgtctacaaataaataagtaaattaaaattatgtgactgtggcctcttctctctctctctctctccaagtagcttatagtaccgtactgctgtgtaactagaaccaggcaaggtgaccccgtgcataagaggggacggatgcgtatacatataacctatacagcgaatgtgactaatgataacaaggcaccaactgtcactgcatgcaac

SEQ ID NO: 569678 - DNA, 986 bp, Homo sapiens
gggtttctccaggaggcaggggccggggagaaagttgaagcggtaacctaagctggcagtggcgtgatccggcaccaaatcggaccgcggtgcggtgcggataactccatgaggccctggtacatgaacaagctgagtggaggcggcgtggctgcatggactcggtgtggaaggtgggccagcttgggggcgacgggatgtgtgacccgtcgcatcgggatgcttgtgttaataagcccacgcggggctggctgcatcccaatggacaatagtcatggagagccggggatttccgtacgttggttcggtacactggtgttgtgtggaggtcctccaggtcatatgcgtgccctggatcttcaacacactcggactcagagtcacacagggaggtcatcagttctggtgtgtgaagggctgtgcacggagtgcctaaggggggtcggacaaaggcaggggaggaaaagcgcgtgtcagccggcccgttggcaagggatcctaattcctggagcgtatgggagtaaaatccctcgtaagaccgcttgccttgtgaaattgcgcagaatgctactgctacagctcgatcgtccccctcatcgataccttgaaccaatctgtggactgcatgaactgccaagggcagagtcatggatgtacgaccaaatgcaattctaatctgcatttgccatcccggcgggatgataccgtgacagaagaccgagagatgtcgcttagtgtgaccaacagacactgtgtgcaagtccatagagcatgcacaattctggagtgtcccgaaggggtttggcccggcatgtctccaacaccattgggccaggcttcacagttggcactgaagcaaaccttcagaaaccaaccaaaatggggccacctcatgacaggatggatggcttgacggcaacttggagagacggaaagaaaaccaccgagcaacgatcaacagagcacggcacatgacatgttagtgt

SEQ ID NO: 569679 - DNA, 263 bp, Homo sapiens
ttccatgggcactaaaccacctcccaggctgatgctgaggcagcctccaggcaggaaggaccctgtgctccccgccccccatacctgacatcctgttcttttgcacttccctgtgctgtgaatgtaacagtgggccttccggcgcgcactctgatttgcatttcatttgtgtttgtttacacatcatgcactgcctgtagcatgcagattgtcacagcttcgacttttggatggtagagtgtgtgcactgactgtgagatcga

SEQ ID NO: 569680 - DNA, 266 bp, Homo sapiens
  misc_feature (165)..(165): n is a, c, g, or t
cttgagctaaaataaaaagaaaaaattaaaaagaaggacaaagaaacacaaaataggataagacagcacaagatagcacaagaaaacacaagaagtgaaaaggcttgtggctgcagctagctgcagactgctgtgaccccttgcagcacattgcagctgccacanaccacattcagcacagtgaagatgccggtggcatgcgccagatgccgaagacacgagagaatatgacgcgaagaacatgggtaccgatgctcgagattcgt

SEQ ID NO: 569681 - DNA, 864 bp, Homo sapiens
cacaggctcccctctgcgtcttcagcctatttccctgggcagttaccaaacagttaattctagtgtcatgttttacttttatgggtatttagaaactcaggtgcttaaaaaatatgtcaaaaaacagatcttcaaatagcaagtttcaaattttacttgagctgttaaagactgatactttaagtactgcttttatggcagtttataatataggaacaaatttgtactgtggggatgggtaaagatgggtgagtaaatgacatttttgggttgtgaacatggggttattggattattttgattttaataaggcatattcttagagaaaatacgagttctaaggaaagagtgtgatccttatgagggagatgctgatcatataaaacaatctggggtaaactaaaagcctgtcataacctcatagtatgcaaccaaagaatactaattcattttatcactttcatgggtaaaacttttaaaattcaaaactgaaaaatcatgagggaaaatgattacctctgagatactattatgtgactgacattaaaggggaaaagtcctaaattaactttaaataagtgaaatgatttaagcttcatagggtatttcttgaagcatttaaattgctagtgtgatcaaataattgctatacgtaaaaaattggccagttttatgtgacagatttaaggctttgttattgggctgacaagtttaaacttagtggtccaaatgtaaactacattcagtttcactggggttatatggggaaaattggtatggtttacatgtgtaaacaagtcatattatgatttctttttatatcaacgggtgtgttaaacgacacaatgtacaggtatcttggag

SEQ ID NO: 569682 - DNA, 93 bp, Homo sapiens
aaacttatgaattatagactgcagtttcctcgcatacattaccatcaatgcccggcctgtgagtgtgtgtcggggaggggcgagaccggccgc

SEQ ID NO: 569683 - DNA, 1753 bp, Homo sapiens
  misc_feature (267)..(267): n is a, c, g, or t
  misc_feature (401)..(401): n is a, c, g, or t
  misc_feature (410)..(410): n is a, c, g, or t
  misc_feature (502)..(502): n is a, c, g, or t
  misc_feature (522)..(522): n is a, c, g, or t
  misc_feature (526)..(526): n is a, c, g, or t
  misc_feature (613)..(613): n is a, c, g, or t
  misc_feature (677)..(677): n is a, c, g, or t
  misc_feature (689)..(689): n is a, c, g, or t
  misc_feature (710)..(710): n is a, c, g, or t
  misc_feature (719)..(719): n is a, c, g, or t
  misc_feature (822)..(822): n is a, c, g, or t
  misc_feature (950)..(950): n is a, c, g, or t
  misc_feature (1022)..(1022): n is a, c, g, or t
  misc_feature (1325)..(1325): n is a, c, g, or t
  misc_feature (1459)..(1459): n is a, c, g, or t
  misc_feature (1597)..(1597): n is a, c, g, or t
  misc_feature (1600)..(1600): n is a, c, g, or t
  misc_feature (1628)..(1628): n is a, c, g, or t
  misc_feature (1638)..(1638): n is a, c, g, or t
  misc_feature (1753)..(1753): n is a, c, g, or t
gcgtgagtgcacatggtgagccagcgctgacgggagaggatggtgtatggacctgttctccgtgctactggtctcgtgtcagactgggcgacggaagcccgtcatatgtagacaatggtggcgagacaagtgaaaggctggttcaggtccccaggaagagacagtgggtacagcgtgtcatgacgaaaacacccatggcgggtgggtgaatcacaggccctgaccatactacggggagcccagcgtaaaatcaatgtcggcgcacgntctgagagggcatcgctgacatagcatcgaagccgaatcgaaccatctcattggacaaataattcacacacttgagaacggtagtgaacgtaggatggtatatcgactgatgttcttacctatctacatatacncgtcagagnggtatactatggggcaaaggaatccttcccgagcaaacagcgagccctgtcacttgcaacgcggcatcgtacatagatcactcagaaacgcnaagtcaggtatttcacacantatnccacaatgacagagacaattacactccctagtatatgaaagtccaccccctcataaaatcagtccaccgtgttgtcttacttggacnctcaacattgagccacttgtggcccaatagacgcccacactaaattgtgatgctttctacctgngaggcaacagangtgcgcggcgtactagtatgnttcgctagnggtggcatatttgatacccactattcaagatacgcaataggtaggcacgtgccgttcgatgcattcgtcaaacactcgatacatttcgtgcgctacgcccacntgtgtcttttggtttatactcgtatcggcatatttcgccttctccgccttacattccaaatatgaggcgacccgccgttcaccagacacaatgccccagctgttagtggtgaggccaccaaaggcaantggtatgcgatcctttggtccagcataggagcttggacatatgtgccaaccttgcgagaggaaacacctggntgtcaccccgtgaaccatttgtatatgcacaaacacagccggatgagagatcgagaagcggccgtactagccggccattggtcagttattgcccgggttagattgacctaacgatacattggatttccaccctggttataaacctacctatcaacggtaccaaacaacacttcagagtgcttaactggggctgtggaaacacgggcacgcccggcacatcagggtgacccatgaagcctccttatcagtgcgcacagtcaacacccttgacaggtgaatatctggtgtcgctcattaaagttngggcaccacgagtaaaggcaggtatgtaacagggtgctgcttccatagggggcctgcagaagacacgtacagtgggaagcaatgcgcataggactccaacaatgtaatggacctaaggatcaaggtagagcacnggagaagagtaaacaccggtcgtgtgacgtatattaccggacgcattatcaacaacgcggagcgacacaactatcagtgacaactaggagtatcacgtcctgagactctttactaacaagatatagtcctactcgcancgnctgactacgaacatagcagcatcgaaangtagctactncagacagtaacatgcatagccgcgtacgagagctgagcaacgagcagtaagctaaacgagagaaacagagcagcgcactgactggataagtaagcaggaccgatgcgagtagagn

SEQ ID NO: 569684 - DNA, 103 bp, Homo sapiens
tctagatgctgctgttatcttctgcctcagacagacattatacgtggtctggtttctaagattcctaccaccagttactttgggccaagtctccacatcccct

SEQ ID NO: 569685 - DNA, 549 bp, Homo sapiens
agcggaatcatgggttcaatgactttacctgacagaatggatagaataaattcttcaagctcctttctttggacccagatggattagtgagcgttttgatagccatcggaagggatagggctggtgtcttcagcgtcagacgaggtcctctatgatggtgtgcacaggggagagcacgaaagtggccgcatcagtactccagcgggagtgacagcgactttgcaggcgaagctaatagagggacaacaactatgatggcaccagtcagccagcactatgtgttcatcaagacgaatgagacatgaccgtattgagtaaacatatgtacaacctgagagagataggcacgacagttccagaagatgggtgacagatagcgcctcgtacgagtatatataagaaggtgcaattgatagataaatacagagtgtgaagaatagaatctgctagtatagaagagcacaacacaaggtatactgttgagaggagatacaacaagataaattgttaagtaaagagcggattatattaatatgcatgggtgtttaa

SEQ ID NO: 569686 - DNA, 357 bp, Homo sapiens
ctgcttgtctgctctgcttgtcctgcctctgcttgtcctgcctctgcctctgagtttcaatctcagcgggattacttgtatcttttccaaatctgaaactctgcttgtcctgcctctgcttgtcctgcctctgcttgtcctgcctctgcctctgagtcactgggattagaggcatgagccatcatgcctggctaattttagtatttttagtagagacagaatatcaccatgttggccaggctggtctcgaactcctgacctcaagtgatccgcccacctcagcctcccaaaatgctgggattacaggcgtgagccgacacgcacggacgcattatcatttcttaagataccagttgt

SEQ ID NO: 569687 - DNA, 310 bp, Homo sapiens
cgcagcctgtcaataaaggacgatacacaaattgtttccatccaaagtccagtcgtagtggctaaaatcaattctttctcttcttcttcttcttcttcttcttcctcttcttcttcttcttcttcttcttcttcgtcgtcgtcgtcgtcgtcgtcgtcgtcatcgtagaaacgatcagggaatatgtactgtgcaatatggtcgaaaatcgagatccactctctctgcatgggtaattgttgcttccgagttaacgacatagcacgtaatgaattcgatgaaatacatggaaatttgagcctagccagcc

SEQ ID NO: 569688 - DNA, 1050 bp, Homo sapiens
ggtcaccaggcgagccacatcgctcagacatcatggaagaagagtgacggtcggagtcaagaggatagaggtcgtatggggcgcctggtcaccacgtctgctgtgaactctggtaaagtggatatggtcgccagcaatgaccccttcattgaactcaaggtacaatggtgtaatagatgtgtccaaatatgagttccacgccactggagaagagttccacctaagtgtggcgaccagtctagaggcttgagaacgggaagctgtgtctttgcacatgtgagaatcgccatgcgaccagtcttaccaggagtcgagatccctccaataatcaagtggggcgatgctggtgctgagtacgtctgctgcgagtccactgtcgatcttcaggcaccaatggaagaagcgctcggggcttcactattgtcacgcggtgtggacgccaaagagggtcatcatctcatgcctcgcatcgtgctgtatgccccccatgttccgtcagttggggtgtgaaccctatgtgagaagtatgagaaaaaggctcaagatcgatcgagctgattgcctcgctgtgaccacctaaattgcttagtacaccctggcaaggtcatccatgacaactttggtatcgtggaaggactcattgaccacagtccatgccatcactgcacccagaaggactgtggatggccctccgggaaactgtggtgtgatggcgcggggtctccagaacatcatccctggccttctatggcgctgcaaggctgttgggcaaggtcatccctgacctgaaacgggaagctcactgacatggccttcggggtccccaactgcaggtgtcagtggtggacctgaacctggccttacagagaactgcaatttaatgactcagagtggtgcccggttgaaggccccacaagggttcggcgaccgcgcctcggctcctgattcacgacacatctcaatatacggggtacccacctctccgtcttcgtaatgtccacgggtctgcagcagaccaccacgagaaacggtccccccccacagcgcata

SEQ ID NO: 569689 - DNA, 329 bp, Homo sapiens
  misc_feature (19)..(19): n is a, c, g, or t
  misc_feature (71)..(71): n is a, c, g, or t
  misc_feature (220)..(220): n is a, c, g, or t
  misc_feature (234)..(234): n is a, c, g, or t
aatattttataagtaattnctgtgtgcactgtgtgtactgtgtgtggatttgggcagttgtccctattgtnactcatataagcaatgatgtgtatctcctcatgaagctaggctatctgtgcccaccacataggtagcatgtctgaagatgaccaaggttagaacatagtatatccagtgagtcatcacagaatttaaatcaaggttgcacattattttncagataaacaatgncacgcataattttccatatgtatttcacatgtaatgagaagagttcatataaatagaaaaatatgtttatgacagtatggcctagtgggaaagag

SEQ ID NO: 569690 - DNA, 351 bp, Homo sapiens
gtcatagctgactctagaggatacacgatggcgccgcgaacgcctatgagttcccttagtatttattgatcattcgagggtgtttctctgagagggggatgtgtcacggtcacaagacaatagtggggagagggtcagcagacaaacaggtgaacaaaggtctttgcatcatagacaaggtaaagaatcaagtgctgtgcttttagatatgcatacacataaacatctcaatgctttacaaagcagtattgctgcctgcatgtcccacctccagccctaaggcgttttcttcctatctcagtagatggaacgtacaatcgggttttataccgagacattccattgcccagg

SEQ ID NO: 569691 - DNA, 1440 bp, Homo sapiens
gagttacaccgaaccaggacagaaatcgtgatcttagccaccagaacagagaatgttcttggtgagaagaggtccgtgcgagtcctccgggaactgactgcgtggtagttcaagaagaggtttggctttccagaagggcagcgtagaactatcttatgcctcggaatataggtggccagtacgcaggtcttgtggtagcctatgtgcccgaggcgaaggagtctctcgctgcttaataagacgtcctaagagtggcttcgctggtgctgtgagggacctgcatatgagtgtgcttgcaggttcatcaatggatgaagctggggtcggctaaagagctgcgtgacggacttgtgtgactgtcatgcgagagaactcacagcagggacagagaaggagccttaaagtcactagtgaagcttctggtgcgcagtggcacgtgaagtgattccctaggagcgaggggacccgtgttcaaactaacagtaacgatctgaccatgtttgctgctgacgccacggggtgttatgcgatccaaggacacgcgggctgtttgcgtgggggacgaatccaaaggatgaagcccgtactccgacgtggcgtggcgccgtggttggcacacccaagcatgggtgtaagtacctcggtcgcccgtaccaggaaatgtgcccctttgcctctgtggagtcgaaccggttgaatggcaccgtctggcgttgggcatagcgccgagaataacgaaattgaacggaagtaacgtggaactcaagacgggggcacccaccgagatcattcgaagataaggcagcacacagggcgaggatagaggtgaaaaggcccgagaggaaagcacaccggctcgtgtggcaccaattgttggctcccgaatgcttcctaggttcacacacgaggcttagaaacacgtacagcgcaggggacttaatcacctggtttgggggatataggggcgtggtgtaaattgccttgggggagagttccatgcgcaattgtttaagggggatgcttacatatattaaggaacctgttaattagaatataaccaattttgtatggtatgccaaggcagcggaagtcaaaacattggcgaggagaatgggtacaaaaaatagattcctgttgggagggggtacccatttaacaaagattcattggctgggggcactgcgaggtaaatacagaacacgaaaaggggccatccgtcacacacagggtggcaaacgcgggtgttatcacatgtaaagcctttgggtccctacccttgaaaaccctgggggcttctacaacgttgggttacccactggggtgggatgggatatttcctgcgccgcacttacacccatgtaagtctggacaacactcaataatcaaacattacgacatacaaaacagccacggcgtgtatacccgggcacatgtttgaag

SEQ ID NO: 569692 - DNA, 140 bp, Homo sapiens
aagaactttcatatgccagacaaaaacaactttcatatgtggccagaaaaaaatatatattttagagtgggacacccgattaagagaagagacagcattggattcttgagtaatagaaagcaagctattacattcaggta

SEQ ID NO: 569693 - DNA, 276 bp, Homo sapiens
ccaagtgacagaataactcctccgacctctccctggggcacgtgacccgggcactgtgccgaggcattgttctgaaccatgcactccatggctatccgattcagcagctccaggagtggggcgtggatgagggtgatgggcatgtgggagtgcgctgtccaggaatgacgtgctgaagcaggaggtagcaagagggctgaccctttgcccatatccttagggcaggatgtggatgcagctgtcgagtggcagctcgggtcatagcttccgttcgaa

SEQ ID NO: 569694 - DNA, 497 bp, Homo sapiens
tggtaatttaacctagtggcactcaaactttgctgcatgttagaatcacctggcaagactttaaaattcctgctgcacagtctctactacacatcagttaaataaaataattctgggagtaatactcagacacaggaatttttacatcacccttgacaagtgatcaaagtctacagccaagttttgacttctgttcattaactgtaaaatgggagaatttatagtttccatctctccatggagttaaaggattgaaagcaataataatgcaagtaaagcatttatgaaagtgcctggcacattctaagcacctgatgcagttttgctctaattctctagaatataacagtaaaattatccaacatatctctgctttttagaaaattcaatgattgtctactgctgcagttctcttctggacttcatttgtattctctgtgccctggatcatttgtcacagttttcctgtataataaaattgtattatgtgtgtaaaa

SEQ ID NO: 569695 - DNA, 677 bp, Homo sapiens
ggtgctgcagaggtccatggacatgcgctacgccagttggttgatgaccctgttcctgtctgccaagcttctggccctctttgccccccgtgtaccctattccatacctgccaccccttgtagaaagtgccacatgaaaaacagccagcaatcaaccttattgtggctttgcggccgtccattcgagagtttgaggaccctcgagctgcccctcctccaactcgtgctgaaacccgagaggagcgcatggatcagtgaaacgacggtgacaatgattgagtcggcgacagcaaagtaggtggagacagagcttacaatgtgggaccctcacaatgatcccaatgctcagaggggatgccttcaagactctcttcgtggcgagagtgaattatgacacaacagaatccaagctccggagagagtaagaggtgtacggacctatcaaaagataacacatggtctacagtaagcggtcaggaaagccccgtggctatgcctttcatcgagtacgaacaacgagcgagacatgcactccaccacgcaagctgagttgcagctgatgctaacgctcccattacaacacctcagtgtatggtaggaataagggtacgtatcatgggtaagatcactcagcaccgaaaccagcccagttaccaggcaatcaggacagggagcgc

SEQ ID NO: 569696 - DNA, 431 bp, Homo sapiens
ggcattcagactacctactaacaatatcgtggttaaaacatcaggcgtgggaccaactaatcttcgaatcgaataccaagagcgggaaaattcagaatggggactcctttcatatgtggtggtcacaatccacagcttaacacaattgtggacaggtggtgggtctcatcgtggatcgacactactagtgtgttcagaagtgtgtgcagagggaataagcgcggaacagggtccacgaaagcccccgcgggaagcgggcacgtggttcaccttttatcttgaccacaaccggcctctaccagcgttctagccacccatcttctgtggcgagcatcttcgtggtgagggctcacccattaacaaaagtggtcccgggtgccactcgtggggacgggctttaccaacaagactaaaagattactgggagaatt

SEQ ID NO: 569697 - DNA, 302 bp, Homo sapiens
gcgatctagaggatccgtgatgtgatccccaacacaccaccgcatatcctgttcaattcccctgatccctcactttagcacatatgggatcactaccaagtaaacttctgctcattagccttgttctagaccaggggatgtccactcttttggcttccctgggccacgtggaagaattgtcttgggccacacataaaatacactaacactactgatagctgataagctaaaaaataaaaataaattttaaaaaatctcataatgttttaagaaagtttaggaattggtgttgggcgataaca

SEQ ID NO: 569698 - DNA, 359 bp, Homo sapiens
gtgacttccagtaacttataattctgtctttaactataatatcattttagcaaatggatccttagattttcgtaaacttgatcaggtgttttagtgtaagtattccaaaactctctaccatgtttatctgacccaggttttcctctaaatatgatatacattgggtcttaactcatccaaagaaaatctctgcatgcaaacatcctgtagcgaagttgttttacccacacagatcacttcctggaaatcttctaggtaaatgactatatcccagagtagagaacttaaatacttactagcataggttcacccgtctatcttatggcccctcttcagcagtgtattgtttctcctcaaca

SEQ ID NO: 569699 - DNA, 508 bp, Homo sapiens
gtgttaaatatggtattgtgatagacggggggtcaagtcaagtttttttttgacaactagatcgactttttcaagatcacagtagaaaagctggttattaggttcacatccatcatacaaagttaccaataagtatctcccacaatcagacacttctccttgaatattccaagtaggttgatccggtcgttccaggcacaaaatatcatctgactgtagtgtacccagacgatggtacatgagcttctgatcagtattagtagttgtttcagtaccatctgctttaccttcatgctgagggtacatacagtaaaaaacacctttctcatcctttgtccgcgaaattgaactgaatttgacatgttgcaaaacatctggaagatcttcgcccgattcacaggttttaaatttaagttcacaccaatcagaaccaccaaaactaagaccataacaacagtaagttccttccactgatcccgcatccatcacaatacgatatcaagcttat

SEQ ID NO: 569700 - DNA, 88 bp, Homo sapiens
gccagcgccgacgatgcccagaatccagaactttgcctatcactctccccaacaacctagacgcgaaaacagaataaacttcacccag

SEQ ID NO: 569701 - DNA, 399 bp, Homo sapiens
ggctggaggaataccgtacgaggacaccttattgagggccatagacggttgactatatgtgggggcccgaatacaaacacggagcaccctctaacagagacccatgtggatgatgtgaatgcaaagagctattgttatctaagcttgcaaaccctgttgtacgagggagaggacgccttattcatatggcggatacgtaacataccggaggatgaaccgatcactgtatttgcactggttttgcaccacgattgcatatacttcattgacagccgagttgatgcccgccaactgagcctcatctctcataacccgaccatcaatgctttgggataatccacaccttatggcagacagcagaggctcttatagcttttacgccttgtgtctcatatgtgc

SEQ ID NO: 569702 - DNA, 305 bp, Homo sapiens
atcgatacatctgtgatgtggcgatcgtctggagatattctgggctgctcgaatcttgacgaagtatgatgtaccaggatacttgctcagtgcttctccaagcatcttggcagcactcggactcaccctcggcctgcacaattttctgccgctgttcctgctttgctttttctaccaagaattgggcccgctgggcctcctgctgggccacttgtttggcttctacagcagctgtgtactctcggctaaagctcagctctgtgatggccacatcatccaggatgaggctgaaatccctgggctgg

SEQ ID NO: 569703 - DNA, 451 bp, Homo sapiens
tcattgttcagctcctacttatgagtgagaacatacagtgtttggttttctgttgctgtgttagtttgctgtggatagtgacttccagctccagttccatccatgtgcctgcaagggacatgatccatttatcacaaacctacagccaatatcatactgcttgatgattttaaaccaaacacataggattaaagttcaggatagagatgagggctaaagataaccattttaacattctcttaatagacatgacagttgaacctatggaagtggaaaggattcatgatagagaacagtgtgcacgagaagataagattaaaagcagaaattagtaatgccagttgttttattggctctgattcctcacctaccctcgcatccacacccttgtagaatttgaagttccatgcacaaaaaggggagagtacgtgatacgctgccccctgatgtt

SEQ ID NO: 569704 - DNA, 261 bp, Homo sapiens
acggtcgatctgtacatacctaaagaacaccttcctatattacgcatgcacaattctccacgtaacaggtcttctcacatttaaatttctgtgacccagctctgacgtccctacttggcgcttatcatggtccacagacaaggaggggagcaaatgaccaggcctggtcacgctctatatggtggtctcagcggctgataccaacacgacttccagaagcaccccatctctgatatgacgctgacggctcatgatggagac

SEQ ID NO: 569705 - DNA, 528 bp, Homo sapiens
  misc_feature (121)..(121): n is a, c, g, or t
  misc_feature (462)..(463): n is a, c, g, or t
atcgtgccgcgagttgaagccgaattcagttcgtgatgtgcgcctgtggaccgcatgattgaacatgcgttcagcgccgccgtgatgtcggccggcgtgttggccgtgtagaagaagccgngcgaggcgcagttctgcagactggccggaatgttggggatgttccagttggcgtaatcatcctcgtcattggcaaacgaggcattgaccggattgatcggctggtacgggatgtagagcacggagatgatgatgccgcggttcttcagcggcgtgcaggacgtcgccggattgatcgtggtagcatggttgctgccggaccatgatccgttcgcacgcccttgactgcggatcctgcgcgccatcggtgacgaggaagacgtaaggcagcgtgttgttccacggctgccgtgccgacgctcgatatcagcgtattcatgctcgacagcgccgtgtcgatanngtgccgcccgagccgagattggtgttgatgttggtgtcgagcagggtcgcgaggttcgcggccgc

SEQ ID NO: 569706 - DNA, 480 bp, Homo sapiens
  misc_feature (205)..(205): n is a, c, g, or t
ctggtgtctgtcttttacctttcttaacactgtctttcagagagcagaagttttaattttttttcaatggccagtttacttgagatggagtctcactctgttgcccaggctggagtgagccaagatcatgccattatactccagcctgggtgacagaatgagaccctgtcacacacacacaaaaagttgaatgctgggccagtcnagtggctcacacctgtaatcccagcactttgggaggccaaggcaggaggatcacttgagcctgggagtttgagaccagcctgggcaacatagcgagaccttatctctacaaataataaaaaaaaaattagctgggcctgacggctcatgcctcaggtcccagccactcgagaggctgaggtgggaggatcatttgagcccagggagtcgaggctgcagtgagctgtgatcacaccactgcgctcccgcctgggtgacatagtgacaccctacctg

SEQ ID NO: 569707 - DNA, 636 bp, Homo sapiens
acagaaggttggtgtgccggaaagggtcgttgggcacccgttcttacagtggtgactagggttctcacgaggagttcggggcgaaatgcttggggcgcccaaggtgtggggggcccacaaggaaagagaggtagaattataatgagttgctccccctcgcctgcagagagatgctgttgagagatagtaacattgacactgatacccgcgtgtacgtttttgagagagggtgattactcccgcgggggggcagctcctgcagtaggaacatttttgtttatgtccagacagtagttttggtgaaaatttcactaggctcgcgggcccacacccgcgagagaagattatttcgcagaattttatgttaggaccacactgtagttgtttcactccgctagtgtaggtcattctgtactttcttgtcagattgacggattgcgccactcctaccccaagcttcagacctccctcccgcaaatctttcttgttctatccccgtttgttgccctttatacatcatttgaggagaagccccatggaagattacataaggagggcataacataataacatcaaaagagatagaagtgaggagaggagtatctttattccccaacccccaccaatagacagaac

SEQ ID NO: 569708 - DNA, 135 bp, Homo sapiens
ccctaattattatgtaaactggtactttgtgtcaaaagcataactataatttggtttctttcttcataacacggacaatttaacatatttctccgtgatggtcttgacggttatcacctgttatgacgtagtggc

SEQ ID NO: 569709 - DNA, 91 bp, Homo sapiens
  misc_feature (76)..(76): n is a, c, g, or t
accatggacaactaccctaagctggaggagatgatgctgctgagaacggggctccccagttcctcggcgccgcggnccccagaggaagcgg

SEQ ID NO: 569710 - DNA, 109 bp, Homo sapiens
ggggcggctgcggcgcgcggttcgctagtgcgtagctctggagctatggtggtggtggcagccgcgctctgaaaccggccgacgggaccctaaagttctgcttctgtcg

SEQ ID NO: 569711 - DNA, 1013 bp, Homo sapiens
  misc_feature (93)..(93): n is a, c, g, or t
  misc_feature (398)..(398): n is a, c, g, or t
atgcagaattggagatgtcagccagggaaagaccttaatcgggataaaagagaccaatagatgataattctgtgagtatctgccaatttcagnatctgctgtgcagccagagtagagcagtgagggcgtcattcactggtctgctgtattgtgtgttcattcggaatcaagccccaaaaggtatcgcgattgaatatgtattggagctcttacactattatcagactcaccaaatcatctttcaattgccaatttacaaaatcgatgtgtgacaactatcattcgtctctagctatttggattgggcgaggcgagtcgataaatagataccaagggatggttcgataaacggttgaggaggagtactagaatacgatgctaggtaaaaggtaattgtncaataatggaggtcgtctatcgacatagtaaagaggcacaatttcatcgagatatcttcgtttgacattggtctatagtatggtataaggtatagatcattgcgatagaggcgcgtcacgaaaagacatgctggaggggacaattgtcgatactacgatgtggcgttggttggaaactcgaacctgtcgtatcgtttggatgggccctatgctcattggaggcatttatcaatttggagagatgtgcagtacatcttttcgatcattgtgaagacttttcgggttcgggattccaaggaagatgtaattcgaagttcatggaaaccaatgtatgcgtcacgaataaaaattttggtaccaatggtaactgcacaaggaataagaaagactggaaaacaggggttgtgtcttcgttaaaataattgacttaaaggaaatatttgccaacgaaggttggaattgccaatatgaaattgaattctgaaactaaaggtcaatgtgggttacatgggttaaacaattgcaagtataaacactattcagcaaagtgaattgataaagaccattgagcactttctttatgaaagccaggtggttgaggcaatgaagaatgga

SEQ ID NO: 569712 - DNA, 219 bp, Homo sapiens
tctcatctagatgaatccatagctgtagtggccttcgagagtttatactaaagttagcaaaccaagaactctatgatgacgtactatgtatttattagccacagacaattctatttactacaaagacaaaggccagcatttaactgtaatataacacttttccaaatgggaccctaagaggagctgtcagcgtgtagtatcttccttcacagtatcatg

SEQ ID NO: 569713 - DNA, 1303 bp, Homo sapiens
atacaattatagatccgtgagacggcccttccgttgggaatgcttcctgaaaatagattgtctgctatgctttgtatgatgctaagctttgacaacaacatcagaatccagacacaagaagagttgcatgttatattattctgtgggcaccagacactagcacctcctgacaaagtaaaatgatctatgcaagctccaaggatgcacattacaaaagaaatttcacaggcataacaacatgaatgtcaagcaaatggaccagacacgatctcactcgcggcttgtattgctgcacaacagttaggtggcatccttaattgtagcctcttgaaggatgccctgctgtagattattcagatgccacaaattgaaagcttccatgtctaatgtacatcctctctcctatcataaataaagcaacatatcattaaggccagggctctcaatgaggggacagctgtctcgtccatctttctacgagtcacacctcattctactacacaatatgccacacagccctcaacataaacatctacaacgtctcaacagtacacatagaaagtcaacactcaaactactacactcggcacacaagtgcccctgctccacgaatcgacctcgcatcccactaacacgcatacaccggcccaagactacacagagatcaccacaccattcccacaaagactcaaacaaacacaatacaagggccacatgctgacgcacaactcatctcactccttcactcacaccatcaaacaatatacatcagcggatcccacacatacgcctacacaaaaacctgagatcaattaaaaccatgacttaatacaatacacgcatacaacacacccctcaaactcactccacctctacgcctcaccgcaaacaaacccagtgcaaacttcaaaacctgcattaaaaatacataaacacacaaccaaataccaccaccactcctcaacaaaaccatagcaccaacccataaccaccaactcgcgaacaaaggaagaaagcgaaacaaaacaacactcaccaacacaacaccaccaacaactcatcacgcggacacacaggacaagcacgcaaccgagaaaaagcgacacggcacgagagccacgaccacaaagaacaaacaaagaaagcaaaatcaaggacaactacaaaacgcaaagcacgaacacatacaccacaatcaagcaaataaagaaacatacaaaacacactgaacaaaccacgacacagatgaaaaaaaacacgacagaaggcacaaacgccaggaaccatcataaacaccacccaa

SEQ ID NO: 569714 - DNA, 1109 bp, Homo sapiens
  misc_feature (429)..(429): n is a, c, g, or t
aattgacctgcccgtgaagaggcgggcgatgcacactaggacaagacagtagaagaccctatggagctttaatttattaatgcatgaactgtatcctatagcaaatcccacaggtcctaaactctagcaatacccttgcacttaacacaagtttctggttggggcgacgctcggagcatgaactccaactcttccgatgcatgtacactgctaagacgttcagccagtcaagagcagaagcgtatctatactactaatttggcatcccgagattagagctttgcaccaatccggtaacgatagttaagccttagcgtgcactaaccatgcggcacatcctacttctatgagtcctatatcaagcaataggtgtttacgacctcgatgcttggatccaggtacaatccacggatcggtggcagccagctnatttagtagtgttcggtttagttcgaacggatttgacaatgtcctatacgtgatctgaagttcaagaaccaggcagttaatccgagggctcggtttgctcattctatctttcagaattacctcgcactgtcacggaccaggaacatagcagtatagataaggggccctatcgttcacaaaatggcgcctttcagcgccgttaacagtggatcatccatgcttcaatctttatggtatttattgatccccattatatcccactccacaagaaacctaggggtttttcgtgtgacatggaaggcggttttggaagccccggtgggcctggttgcgacaggggtcccaggtcgtaatttgattggctgaaagcccctggatacgagggcggcggtcccaagtaaaaattaacccctggaagacacaggggcctcttgaaagaaaccgcttttccgtgttacaccacatttgtccccttgggaatggggattcccccaacatttgaacagttgctccaatttaaaaaagcctcaagaatccacgggcgggcgtgtcccaacaacacgctagcgcggacattgtgagacaaccaccagggcggagcggcggcaacatgttgattcacagcaacgactcgcaccactgtgggggggaggcccacccaatgctggacatatcacacc

SEQ ID NO: 569715 - DNA, 206 bp, Homo sapiens
cagtggtacactactctctgggaagccgcattgtaatagagtcatgaggttagattaagggatgatgttttagctattttttttgagagatggggtctcgctcctgtagcctaggtggaagtacaggggggtgatgatagctcactgtagcctcaaactcccggactcaagcgatcctcctacttcagccttcctagaaacgggga

SEQ ID NO: 569716 - DNA, 394 bp, Homo sapiens
gacaggatagaatcgagccggtacccgaactgtatgggtgggtagtcccgatttgcatggctaggttagtcatggcaaaacaaatatatccagtacactacagctactaggacgaagcctgatctcttatactagtatcctttgtcatttttattgccacaaataacctcctcggactcctgtgtgactcatttatcccaaacacccaactatctataaacctagccatggccatccccttatgagcgggcgcagtgattataggctttcgctctaagattaaaaatgccctagcccacttcttaccacaaggcacacctacaccccttatccccatactagttattatcgaaaccatcagcctactcattcaaccaatagccctggccgtaca

SEQ ID NO: 569717 - DNA, 213 bp, Homo sapiens
  misc_feature (5)..(5): n is a, c, g, or t
ggttntgaagagatgcgagaaatggaaccttatgcctatgtatggctacagactctttaagacacaaaatattaaagtaaaagagaatcatatacaaccaaaaaatggtgggctatattaatatcagacaacatagatttcaggacaaagaaaaacaggaggactcaagaaggtgcatgtcgtaacataaaagggatcagtctatcaagaaaa

SEQ ID NO: 569718 - DNA, 141 bp, Homo sapiens
agtgcatggagctgtgagtgtatcagcatgtgtgtgtgtgcagagcatgttgctgtgagtgtgattgtgtgtgtgtgtgtgcggtgcatggtgctgtgtgagatgtgcgtcgtgtgcagtgcatggtgctgtgtgagattg

SEQ ID NO: 569719 - DNA, 1387 bp, Homo sapiens
  misc_feature (902)..(902): n is a, c, g, or t
gcaaggacaacggtccaggccggtggcacgtgtagtcaccatcgacgaaggcgacgggcaagatctccaaggctgggccgctccttcactagcggcgcccgtcgacgtacgacgcgtatgggtcgtcccagaccaagttcgtgcagtgacccatgatggtggagctccagaaacgcaaggaggtggtgcacaccgtgtcgcctggacgagatctgacgtctagtcaagctctcgcctagcgcgcagggcatttcctggctgctcttcatcatgggatgagcacagcggggagatcaaacgtcacgacaggtcccgtgaggcacgtagtcagatgccagagggtgtgattgaagttggccgcgaaggaagcgtgccaagggcgggagagttcatcaccgtggaagctggctgataccaatacgagcgattggtccaacaattgctaggcaacatcagacggaagctatctgtccatttccgtacaacatccggggcccctctggacgcaggatgaacactgggcagctcctgtgtcctgtgtgggtcaactcgcgcgcgacacaatccgggtgtgctatttcaacagcagaaaactgctggggtgtcacccatgctctgaccaagaatgctcggcgtccaccgtgcaaatcccctcaataacgaaccctcgcctcggccacccgggccatggcgtccacttcgggtcaatcccgacccgacccgccccgtaaccaacggcgcagcaaacacgaacgaccgcaaagcgcagcattccttcgcgacacctcccgggggtgcagacgggaaaagaagcgaatgctgcgaccggcactcgcaaggctgcacctggacccgccccttaccaccgggcttggtcttggaacccgcgtacgaagtccgcnggagcatgggaaagcaaaccggtcaaccgagcccacctaaacgaccatcggttcaaagaccttcggagatcgacacgggcacttgcacccaaaccactggcgactggttgccccggcgacaattcgtcggaaagggctgatcaccacggcaaaggtgcccagggcgtagcaactgacccagctcgagaccgcgcagaccctgaacaatcaagcgcaacaaccgtggccaacgcaacatacacgcccccaccggccaagcaacaccacgacaaacgccacgacacacaagcggaccgccccatacccggcacacaacaccggaaacccccaaaaggggcgacgcacccacgtgtacacgcccatcaggaaactgggacagctcggagcaaccacggagaaaccaacacgggcgagatatcgcaacagaaagcatccggacaccgtctacgacacgcgcatcaacaacgcggtggggacacacgctc

SEQ ID NO: 569720 - DNA, 279 bp, Homo sapiens
ggggggggccccccccccccccccccccccttttggggccccccccgggcccccttttggggttttttttttggggcccctgggccggggggggcccccccccggggacccggccccccggggttcccccaaggggggtttttcccccggggggtttttaaacccccccccccccccccccccgggggggggggggggagtttgggggtttttttcctttttttttcccctttttcccggcccccttttttttttttgttttttttttgggggggggga

SEQ ID NO: 569721 - DNA, 273 bp, Homo sapiens
accaagtctgaacctgcggtcctctcgtactgagcaggattaccatggcaacaacacatcatcagtctcagtcctgtacactgacagacagccgcatacagtctcaccaatcattctcataatcataatcacgcagagtctcatacgccgactcataaccaccctgtggtccaacacggcggcacagctgcatgttgtgctcacaaacggagggtccgcgatggtggagggtcaggtgctgcattctgaatactggtgccacctcatcatcca

SEQ ID NO: 569722 - DNA, 173 bp, Homo sapiens
ctagaaaggtatacatagtaatgtctatttatttacatactgaagtcctaaatttatattagaacaatgtaaataatcgggggtaaacattttgaagatttattcttttcgtgtgctggggtgtcatacatttatgtcttgtgacatacactggtggtgtccttcttacaaaa

SEQ ID NO: 569723 - DNA, 107 bp, Homo sapiens
gaaccgcatctgcagcgagcaactgagaagccaagactgagccggcggccgcgggcagcgaacgagcagtgaccgtgctcctacccagctctgcttcacagcgccca

SEQ ID NO: 569724 - DNA, 98 bp, Homo sapiens
catggatttgctggtgcagtacaactaggcttaatagggacatgccagtgcactccggcctgggagacagagcaagactctgtctcaaaatagtaaaa

SEQ ID NO: 569725 - DNA, 188 bp, Homo sapiens
ggaaacttagccgacgttcgtttccactgagctgtgatgggaactcctgagatggatgaattgtagacgttattctatacttgcactgttcaatgtgacgatttacgttaataaattaaaattcagaagtattaaatttttttctctcagtcgcactagttacatttcaaatgctcaacactcacatg

SEQ ID NO: 569726 - DNA, 777 bp, Homo sapiens
ccaggtttcctcctgtcccgtcccatgttccctccacaggtagtgtgacgaggatgggggaagcactgtgggaagaccagccaatagactggtctaggacagctgggagtacgagcacgttgtgaacgcatccctagactctcgctcgtctagatgggttccacgcacttagaagacatgacccctctgtacagggtggattgtggtagagtgagaaatcaaggcctacctatgtgtgttgtctcactctcgaatgcacagttgggcagtacgggcaagatattgactcggcgacgcccatgtgtcaagcggttccttgtaagcctgggccctcgtcacttgtgcactagtagcagttagcgtcctcgtctgtcagggtgatcttggtcccactcggggatcctggtttgcaataggttcgtcattgacatgcttgcaaggccctctgcttagttgttactggaattcttcagggtagccctctgtggcccttttgctttgcgtgctgttgtcccttgtcccatgagggctggcaccggtgtgtaatttctgttttccctggtcgcatcttgtgttgggattgcattactggctggagtaaaggaccacgtggccgttcgagctctagggtgggcctccagtctgcgttatagaggtactccgtctctgcgtagtgagctggaagccctactggccggggggtgcccgttcctttgtaaccttggttttggggcctttaatttttctctgcaaattgggggccccgcctgttttcgc

SEQ ID NO: 569727 - DNA, 322 bp, Homo sapiens
  misc_feature (295)..(295): n is a, c, g, or t
  misc_feature (309)..(309): n is a, c, g, or t
tttatttcttcggctacagacaaaaaagaaattcctttactcggccaggcgcggtggctcacacttgtaatcccagcactttggcaggccgaggagggtggatcacgagggcaggagatcgagaccctcttggctaacatggtgaaaccccgtctctactaaaaatacaaaaaataagctaggcgtggtggcgggcacctgtggtcccagctactcgggaggcagaggcaggagaatggcgtgaacctgggaggcagagcttgcagtgagccgagatcgcgccactgcactccancctgggcggcacgngtagctccgtctc

SEQ ID NO: 569728 - DNA, 113 bp, Homo sapiens
tggtgtgtggtgctctgacggatcccctgtgaggtgtggcaggagctgttctgtatcgataaaccccgatcaactcaccactcttgctcagtctatataccgccatctacaag

SEQ ID NO: 569729 - DNA, 117 bp, Homo sapiens
tttgatgaggtcagatacactttggcggatccaaatggagctgcaattttaagagtcttctgatgtcatatcatttcactgtctaggctacaacacggaatctgaggaggcagagat

SEQ ID NO: 569730 - DNA, 685 bp, Homo sapiens
ccttatgagcatgcctgtgttgggttgacagtgagggtaataatgacttgttggttgattgtagatattgggctggtagtttggatcaactttttgccaagaaattatcctgaggtagcaataaagtcgtgttgaattttataataaattcaaattttatttcaacaccgagattaaaatttccacaaaattatgggatattccctttaagacccacaatttagaggttccttatttcaaagtttaaattaaccttagaaccctatcttaaatcgcgcggcccggttttgggactacctttggtgcgggaaatctacccccctttacctcccccagattttttcctttttccttgcacaggagcatttcctctcttgggtccaaaattttataaaattcaaccgggcgctttcaaggaggtttcttggcggtccaaataaaaaacgttaaaaaaaaaacatttctttctttacaacaacccgcgttttctcacaaaggccttggttttttttaaaattatttcttcaaaaaagaaatagtgtctcgctcctctttttttcaagagggaaaaaaggcccctgtcgaacaaacttgtgggccaacttttttaagaggcattctcttgtcattcttttaactggatcacaaagccccacagggtataaataacatctattaacacacc

SEQ ID NO: 569731 - DNA, 117 bp, Homo sapiens
agcagttcagccagtcacagctggacagttctctccagatcagcaaggacagcagcagttcagccagttcacagatggacagcagctctaccagatccagcaagtcaccatgcctgc

SEQ ID NO: 569732 - DNA, 1167 bp, Homo sapiens
acccaatgagagcagagagatgaaaggataaaaaagaggaaagcgtatgtgtattgtgcacgcatagggttgattgtgttgttgagttcgcgtgtcaggttgtttatgatacatgtctctactcgtgggggtgataatacatattcgtttgtgacagcgacttctttttgaaaaaagttgctctgtggatggagcaacccccccgctctctgtagagaagtagttgacgtgacccctctttttaaagggtccccgcttaaaagggggcctctttttaaagtcgcaaattttccttctcgacccccttttaatccctcgtgatcaaaaaggttatttggaaaaccgaggcgtagagtgtgattttggggcgcgaccccagtgttgtcgtgtgcccccccaaaataggggaaagtcctttggggtttatccccgcccagtgatgttattttaagaagaggtaagttttaagagaccttttaggcacacttcccagagttaaaatagggtgccaattgccccaattggcccatcttcaagaaaaaatgggttcatttcgaagcgtgttccagaaactgaccttagagggtccacttataggaaacacataggttggaaaaggaatcacgtccccaggatccaattgtagaatggaatttgattggccccattattggcaccacttggacctaattggtaaaccccccgtttggttttggttttttaaaccgaagattttgccaccccggattagtttttttgttttggccttttttgccttattaattcacacagttttttttttttttcttccccctgggggagattgtcttcccaaagtttaactacgtttaaataaataaaaattgaattttattgttcatttatataaaatctgatacccttgatgtaatttccaccaataaccagttcccaatttttatggccttttataaattcaccaatgataattttctttctataataaaatcccaagtaaacatttaaattgtagaactgatatttttcatttatatgaagtataagcctctactgggtctatattgtgaatcatcctgcctttcaaatttgtttcataattgttagatgaaaactatttttttggagatgttactgaagttgattgagccataaaagtttacttaatta

SEQ ID NO: 569733 - DNA, 92 bp, Homo sapiens
  misc_feature (5)..(5): n is a, c, g, or t
gtggnacgcaagggaaaacaaatttgtaaatattttcttgaaaggaaatgtattaagggagaccagtgtaaatttgatcatgatgcagagat

SEQ ID NO: 569734 - DNA, 129 bp, Homo sapiens
aggcctacacttgctgcaggtgaaccatggtagccctccttctcacactcatcctgtgcaccctgctccagctcaagggttcacatgtacatctacccattcccttagccccttctgggatggaagcat

SEQ ID NO: 569735 - DNA, 150 bp, Homo sapiens
cactcacttcataccaggaggcagaagctgcagtcagccgaggtggcaccactgcacttcagcctgggcaagactggagactgcctcaaaaaaagaaaaaaaatgttggtacttagagtataccatgacggcaacctccccacccccacc

SEQ ID NO: 569736 - DNA, 95 bp, Homo sapiens
  misc_feature (53)..(53): n is a, c, g, or t
gggtcgacacggccgtgtattactgtgcgagagggggggagtgggagctaacngtagactactggggccagggagccctggtcaccgtctcctca

SEQ ID NO: 569737 - DNA, 239 bp, Homo sapiens
cctatttctcgagttcttaaagtgctggcgattacagtgtcgtacacatgccagccttaggatgctatttggagcccctcagctgagatgcaagtggggcacatgtaactgagactccatctgccctgggacagcttttcttttttctttttttcctctttttctaatccagtatgactggtagtacctgggcagcttttctgagccttggggtaccagcctgccatgaatccgaggct

SEQ ID NO: 569738 - DNA, 463 bp, Homo sapiens
tccctgccggtagtggtagtctctgagcccaagctaagccaccatatcccctgtgaccggcacgtacacatccagatggccttaactgatgacattccttcacaaaagaagtgaaaatggcctgttcctgccttaactgatgacattcccttgtgaaattccttctccttgctcatcctggctcaaaagctcccctgctgatcaccttgtgacccctgccacctgcacgccagagaacaatcccctttgactataactttcctttacctacccaaatcctataaaacggccgcatgcaagttagggtaatgtcaggtctctgagcccaagctaagccaccatatcccctgtgaccggcacgtacacatccagatggccttaactgatgacattccttcacaaaagaagtgaaaatggcctgttcctgccttaactgatgacattcccttgtgaaattccttct

SEQ ID NO: 569739 - DNA, 807 bp, Homo sapiens
tttttttttttgggcattgtacttttggttttggtaataaaggaaaacagaacaaatgggaatgttttatgatgttgtatagcaatcggctttttacctttcaaagttccgggtaacacatgtgttcatatctggagtatgggttgggttcttttaaggcactacatctggtcttcactaattggttaatttctggttggaacccttcattaaatttctcaatagatttaagtaacacagattgttttttggcgcgagtgcactgtgtctattttaacaatcctcctgcatcggtatttaatagttcagcctttggaccaccgtgggtgccacgctatatagggaataaaggtggattcatatcaactttagaactccagtcccaaacttatttctgtcgggctccacgtggtacataaataacctaggaaatattttccagtctacaattgggtgctatgtgcaggtaccctaaatagtactcttaccagaggagaaattatattaacgaagccggttaataattccttatctaagtaattgggtcctgggcacatttaaaaaagcgccgttaggagaaagcaaaacgttggtggattctctattatattcagagtttatgtttctgaaatggagcgggaggatctggcatttggcgtgcatccctcgaatggtggtgtggtccaacagtttacagtgagtaagtgtcgatgtcggggggtaacatattggaggatatggaagtgtataagatccgttttggggccttttgtaagaagtttagtaggggaaaaaggaagagtggag

SEQ ID NO: 569740 - DNA, 210 bp, Homo sapiens
tgtactacgagctgcatcattggtatatggtttgtgtgttggttagtaatgctagtatgaagagcgttatggagtggaagtgaaatcacattgctagtgctggaggtcattaggagggctgagaggtgccctgtataggggtcatgggctgggttttactatattgataggcatgtgatatggtgggtcatatatgttgcttgtcgtgca

SEQ ID NO: 569741 - DNA, 493 bp, Homo sapiens
gggctctggtggggcttcctcattcttcctgggatcacaggcagtgcttcctgtgtggggaaaagcaagagagatcagatgtcacgtgtctgtgtagaaagaagtagacataggagactccatattgttatgtactaagaaaaattcttctgccttgagattctgtgaccttacccccaaccccgtgctctctgaaacatgtgtagtcaactcagagttgaatggattacgggcagtgcaagatgtgcttagttcaacagatgcttgaaggcagcatgctccttaagagtcatcaccactccctaatctcaagtacccaggtacacaaaaactgcggaaggccgcagggacctctgcctaggaaagccaggtattgtcccaggtttctccccatgtgatagtctgaaatatggcctcgtgggaagggaaagacctgactgtcccccagcccgacacccgtaaagggtctgtgctgaggaggattagtacaaga

SEQ ID NO: 569742 - DNA, 476 bp, Homo sapiens
gacatcacgctataatctgtcacaaactagtgaagaatgtggagactatggcagccattattgtgccagcctcctgccgatcctttgtaatcggtcacatatattattatgtgactattggtgtgatcatgtgaaactgcatgttattaaactattctgtaatattaagagcgtgttcttcttactgacattttgtaatcaagaaaagtgatctataagatatgtaatgcaaactagtatacagtagtctgattatggtaatatggtcactgtgaatcacttctggatttataaaccactcacaccacacgtttgtcatcagtacatgatgattctctggtgaacatacatggccatgggaagattatctaaattatcagtgaaaaattccgatatattttcaatcgcagagaccataagcgccgagtatagttgctttactagtatgttgcaatacctcctttaatacgtttaag

SEQ ID NO: 569743 - DNA, 147 bp, Homo sapiens
tctcacggtcccttcgattggcgggcccttatgcacgcttactatcttaacaggcttgagtgcagagattgaagagtcaaatctgaccaagatgttggtgttggctaagagaattctctgctccccacctctaagttgcccgccaat

SEQ ID NO: 569744 - DNA, 657 bp, Homo sapiens
gcagtggtcacacctgcagtcccagctacttgggaggctgaggcaggagaatggcatgaaaccgggaggcagagctgcagtgaagccgtgattgcatcattgactccagctggcataagagaccctgtttcaacaccacagacacacaaccccttatacccctgttattcaagtgtaccaactgcgcacgttggtatgactgtagcggagatggagaaaacacccaagcgggaaacacagacacaatctccagttcctatcaagtggcttgtgccgaccctgcgtttttaggaaaacaacttatccacggtacaccggtcccttgacaaattcctggttcaccttgaaagtggggggagaatgtcaaccgaaatggtgtgcgccgggccccacaactcccaaatacaatgcccttaactgtgaaaaccttccaattcttccacgtcaagggcctttggagaaattctttacccccctctcatgatacaacaactacagaacacgcaacgagttacaccaagtgggccttctggtaggtcaccatgacctggacagggagacggtggtcccaaggaaggtgaccaaagacatcgtggactgttcacaccttgatgtgctttaaaaccctttcatactaagtgttataatcgaacaaaa

SEQ ID NO: 569745 - DNA, 375 bp, Homo sapiens
cagaggagcaaatcatcagcatcacatgactcccaggctcagcgaatcctcctgactcagagtaactagtactacaggcgtgtgccaccatacccggcatttaaagtattattagtagagatggtgatttcgccatgtccaggctaggtcttgaactcctgacctcaagcaatctgacctcctcggactcccaaagtactggcattacaggcatgaaccactacccctcaccatttcttttacatgtaaccttagttcataagtataacaaatctttgaagagtgtttaggtaattaatagacattatactatagagtgcagctaataatttatactgttgcttaatctattttactacttaattctcagctaca

SEQ ID NO: 569746 - DNA, 437 bp, Homo sapiens
cacaaacacacacacgatgataagcagactcactctaggtcaggcaggggttggtcgaagtcatggaactcgtcggggagggtgatggcgttgtaggcagcctctctgttctcctctggcagatctaccacacctgaaaaaacacaagaacaagaagaaccgtcagcatactggttggctaggcaaggatgtttctgcaggtgacattagggctgggttttgccaggtacctcacaattcaatttgattctttaggtcttgattcgatattgatccaattgcttcgatatcgattcaataatacgtgcacatgacagaaatacctaaatattatttagaattaaccatttcaaaatgaattaaccatttcattgtgctttaactagcaaaaagggaatacaccattgtatactattgttcctgagctaaacttgcag

SEQ ID NO: 569747 - DNA, 171 bp, Homo sapiens
ataggtgaagagatgccctagagaggaccgagtgggtcgaggtgaatgagtgaggaagagcagagtatgtggatacccggaaacacacacacacacatcatcattatcatcatcatcatggtcgtcgtcatcatctggctgagtcatcatcatcatcaccaccagaatctt

SEQ ID NO: 569748 - DNA, 105 bp, Homo sapiens
ggtcactttctacacatcatcctttgtaaccctaaccccttcccaattgcagtaagctctgagataagttcttacctacgcattattgacctaggcctgtgctca

SEQ ID NO: 569749 - DNA, 329 bp, Homo sapiens
ccgggcccaaaatttgggcccggggggtttttttccaaccgttttttccccccccttggggggggttttacaaacccccctttccctccccccgggggtttttgggaaccccccttttccctccgcctggtttgatggttcccatttttaaaggtttaggggggccccccaaaaaaggaaaaagggcccccaagtttcccttccccttccgtttaaatttatttaaccccccccccccccccatttaatttaattaaaaaaacccatttaattaattttttgttgggcccccctttaaaaaatcccaatttaaattttatttgggccca

SEQ ID NO: 569750 - DNA, 152 bp, Homo sapiens
tgggtaccggtaacaaggtcagcatcggcctgacccgcagcgaataccagagccgctacaactttggctacgtagacccctactggaccgccgatggcgtgagcctgggctacaacgccttctatcgcaccactgactacaaagacctcgac

SEQ ID NO: 569751 - DNA, 855 bp, Homo sapiens
cacacgaaaggttaaattagattgcacagttaataatcacgttgatatttatggtactatgtatgtgggtgatgcctttctcttttggtgcccagtacatatattatgcctgtctaggttctgaactggggctgtattgcagctagtggtagaatcatggagtatgttaggttttgatagcgtagatgtttaattgtgggatctgcgcagttgtggttctggcacaagagtcattgacaaaccatctgagtaatggtcaaatattataagaaagatattcttcctgtaggggaagtacagtttttagtcaaagtggccgttatatcctcttgttgaattgtacataatacagatgttgtgagaaagtagttggggtgtagtatgccaatgaaaatactgttttatgggtgcctatattggtaactaagttattgtactaagtgcgatatgtatttttgaaggtaacggtacaagtttaacatgttgtgtcacctgctgtgtgtcctgaaacacgaagttagcagtgttataatcatctgtagaagtgctgacagaatagctttttgcaatcatgttatgggttcacaggaatattttgtaaaagtaaagcacaaattggattaactgattattggaacgtgactaagataagtgcttccaaatacaagggtatgttaagagatataggtatcgccggtaagatgtctagtgaacatatcagggtaagggttggaataatataattttcaggagaaaacagaaaaagagaattgggcgggcgagatacacatcgtgggggcaaggaaaaggatagatacaaacggcatgtgtcaaaacgggggcaagagggtgttg

SEQ ID NO: 569752 - DNA, 241 bp, Homo sapiens
  misc_feature (124)..(124): n is a, c, g, or t
acaggtcaactggttggtctggcaggtaccacctgtgcagcatgaacgtcactgtgggtgtcagaacggcagctgacttctggatcagttttatgagaaaaggagactctcattgtgtccacanccacaggccggaaatctcctttaccgtgctcccagctaggaatgctgcaagcaagcacagtgtggcccttgatctttcgacacactcaccgtgggtggagcatggtggggtgtgttc

SEQ ID NO: 569753 - DNA, 464 bp, Homo sapiens
  misc_feature (16)..(16): n is a, c, g, or t
  misc_feature (57)..(57): n is a, c, g, or t
  misc_feature (113)..(113): n is a, c, g, or t
  misc_feature (192)..(192): n is a, c, g, or t
  misc_feature (272)..(272): n is a, c, g, or t
  misc_feature (279)..(279): n is a, c, g, or t
  misc_feature (334)..(334): n is a, c, g, or t
ataaccccccaaaggncaaaggttatgtgaaactcactctggcttgtacggtcctangggtctgggcaagtgtacaaatggtacgtgtctactgttagagtatcatatagaanagtttcgctgccctaagaatcctctgtgctctgcctgttcatccctccctccaccccccagcccctggcaaccactganctttttgctgtctccatagtttagccttttctagaataaatgccgtattattggaaccatacagtttgtagccttttcanactggcntctttcacttagcaatatgcatctaagtttcctccatgtctcttcatggcttgancatttcctctggcactgagtaatgttcccttttctggatgcaccacactttatttacccactcacctattgcagaacatcttggttgcttctgagttcaggccattatgaataaagctgctataaacatc

SEQ ID NO: 569754 - DNA, 205 bp, Homo sapiens
ctctagagtatccccgcgcggcaccggacgcggtcgccctccgtgatgattttaataggtcgtccccaggctctccctggcaccacaattttctcctccatcttccaatctgtatgggctccagcgcgtccgccacggtccgacgctcccacttctccaggtactctatgatgctgaccttgtctgcggaactcctcgcccatct

SEQ ID NO: 569755 - DNA, 817 bp, Homo sapiens
taagctgagtcaacaagtctttatgggtcatcaggcaaggaaccttggggaagggactgaagcagggggctgaggctggaaaggccggaaatctgtggggcagatcggggcggctggcctccccttgcctctctgggtgtgggccggccggggtgtacgctcgatgtcctccaccgggtgcgtgtctgggtgagacctggctcgcggagagagaagctagaccttggccatcctgggaccttccttccacaatggtgtaccgcacctagacgcggtgggtcacccgcggtgtccttttcccctgcgtgacctgcgaacgtccagggtgggggacattccctatctgcctctccccaagacagtgtggccggggcggcgtcagcgtgcggggacacaatccctccctctgcgcctccccccagaccccgacagttccttctcagctatttcccacgaccagcgatttctctggtgaatatccccctggggtactctgccgtttgtagcgtccctactctctcccgggccaaggcgacgaaaccagcttgtcgtgatgccccaaaagactattcgatgcatcacttcttcacaaaacacggcgtatcgccgaccacaaattccaatagcccccccccaggtggggaccctcctcggtggcgagcacacacaccgctttttgccgacccccgccaacaagaaataaacggccggggcgataccctctcactagagatgcctttcccgggccactaaaggcgatttgtgcgccctctcccccaggggggggacattgcctctttccacaagatcgcgctag

SEQ ID NO: 569756 - DNA, 1581 bp, Homo sapiens
  misc_feature (1165)..(1165): n is a, c, g, or t
gctcccagccgaggctttctacaacctgcgtcaataaaatggccgcacaccagactccgacaccacgtcagccccgacagccctagccgagacaccccgggctgcagctgagcgggcgcagacgggccgaggcgggcagccgggcagcgcagtggaccgagggaccgagatgcaccccatgagcgcacgtgggccgggcaggtccgaaagcccggctagagagcgcgccatgcggcaggcgggctgcaaggggctctgcctgtcgctgttacgactacaagaccgacaagtatgtcatcgccaataacaagaaggtgggcctgctgtaccgagatgactgcaaagcctaccatccctaggcgtaccttggtcgctattgacggtcgtatcctgactacaagaacagggtataccaacagaacgatcgaccacctaccactgacaccagatgctatgtacaatacaaccaaagtacaaagggacgatgaaccctacaacccaaacccaccctacggaaatccagagagccaagcggcattcatggggcagatgctcgcaccgaaacaacagatacactacccagccacacagagcaaagacgaaaacgatactacaacaagatcggatcatccaaaacacccagaatacggctgacccccccaacaaccacatgaggggcgacacgacaaccgatccttgcctggcctggacccacaacatgcacagctggccactaaccccatggacaagcgaacgaccgcctggccaccacaaaagaggacaccagggccgaaccagccccacaccgaccatagcgtggaacaacgacgctcgttaacacgacgctaggacaaaccaccggacagcgcaacaacgaacccacggaacccgcaactgcaccacataggcccacagaaccaaggagaggaaaccataggggcgcccacagcgggcacgcacaccccagtaccgaacgactaccctatcgcgcacccatcgagactagccaccgaatctcgcaccacacacgcagcctcccaagcggccagtccgacgagcgagcgcacacatcaccactcgacagaggaccagcacaccgagaacaacactcaccacccaactttatccaccaaagcaagcataacacccacccgtacacaagagnaccgacccccagcagacacttaccactactcacacagaataggcagacaactgcacaatgacgcagatcaagagaagccaagagcatctcgcacttagagtcgagccaataattgacaacaagagaacacaataaatgtcctcactattctcaacagtcactcacctagctcaactcagcgtcagcaacaccatccatcacgtatatactcacacacataagcactaacacaactacataaccatagcaatcgtcttcactacacccacccctatccatcacactaacgtcgcccaacaacaaaacaaaatcacgaacaaaacaacacaaacaacaaacagaaagaaacttatacagaaaacaaatcactaaaaccatatctaactataagtaacataacaaatataactatattt

SEQ ID NO: 569757 - DNA, 1038 bp, Homo sapiens
tacgcctgcggagtactgcacaagatgctgtccgtgacgcgttgctgcggccgtggatccgcgcccttcctcggcagggccggactggtctccagaaatgctttgggttcatctttcattagctgcaaggaactatccatgcctctaacactcatcttccaacaagcactgggcactgctcgcagcatgtcctctattcttgcaagcagcgtcattcttggagctgatacctctgtcagatcttgaagcacacactgggcgtgtcttaagtattaggtgatcggtcatttgcccagccgtaccatggctctgcaggacatgtatcaagctagcaagcaacatggtcagcagtatttcatatccaggcgttcaacagggtcatgtccattgaaactattggaacctgcacaatgttagagtagtatgtccgatgcatacagggcacaactgcataacacacctcacatctcacagtgcacaggcagcatacttcagcttagcacagcaggccacaggtagccccatatgctggcacggttccacagtatggatcgcaaggcagcctagtaaccggacgtacagctagtacaggattaggaatagacccacttatgggtgtcaagtaggcttaatctcgcactggggcacacatggtgtccccacaagtataggctctggcgccacaaggcaacagccggatcacagcagcacacctactcggctcactatgaacaagagcaccccacagagaatcatacacatatacgcatacccgacagaacttagacaccacagatggacgatagagcaaaaccccaaaagtggagcagaacaccatggcgccgattccacagcgcggaccacggccggcgaatcacgacctgctgggatagccacccgaacagcgagaacccgtccgcagccacccaagccggatggaaacaccatggacctaactatgcggggcatggaacccccggaccacatgccaaacgagggtgggcaaactcgaaagcaccagtacacaaaagatgtggc

SEQ ID NO: 569758 - DNA, 1086 bp, Homo sapiens
gcggatggactccgtccagaggcagaccaaggtggtagattctaggtgacggacggcaagtcccaggactgatgtgcacactgctgcccgtgtcctcaaggacctgggctgtgaacgtctatcgctgtgggtgtgaagaacgccgatagaggctgagctgagtgctcctggcgtccccgccgagggacatcacctgtccacagctgtgctaggacttcactgcacgcatctggctgcgctgtgcttggcctgactcatgccgtctcactcttgccaagagtgctccatgggttggagatgccctgcgtgcatgggcaccaggcaaggcacgctgtgctaccaaggccctggagaaccaacacgctccacttgcaccaccgacacaatgtccctgtgatcgcgtatgatgcacacgagatgacacctcactaccgagccgattccctgcacttagtccatgtgaccatccctagggtacccccaccgaggatcgaacacacccccatacaaaggctacatcatggacctccgcataaagggagcagcaagacacattcttagctagatgctgggaacaaaccactcacgaagggtcaacgcgctgagctcgcgctgcgccaagatgtgggtcccccgtgatccgggcactttacacaaccggggcaacgcacagggaccaacaaacaacacctggggcatccataccacacgacgcaccaagccacgatcacacccaaggcgatccatccccgcacgagataacccacacacatcctaatgcacgcgcgcacgcgcgggcacgcggaccgcaaaccgccaccctgccaggacgcaccccgcgacccggacgaccaaccaaaacgccgaaccagtgcagtagccgaaaccagacacacccaagggagccacaggcatggaaaccaactagcaagcaccagcccacgataagacccccacccacacgaaaacccaggtcccagacagcccaaaccacacaggagagcaagcaccacaacaagggacacacgaggatagacaacaaaccaacaaatacagcccaaggcatcgcgacaactcagtcgccag

SEQ ID NO: 569759 - DNA, 439 bp, Homo sapiens
cgactcagaccaaccgcactgtctattgatgtctaagcactagtgatgggtaagtatatgatgtacacatcgtttagcttatatggggacaatgtccactataatccattgtatatgattctttctgcgggaggggatggcttattaactagttcatattaaatggtggtatttaaaataatctttgaatataccacttacataaattcttaaataagcacagttttcatagttggacatctctcactatctgatgattcacagcatgactgtagaagtttaaactaacacatactgactggaatttggactcaagggaaacaatggtgagaataaaaatattggactcccttatacaaaggcaatcatttaacctttataggttaattcctaatatatatccttttccttcttaattaggatgagaatgcggtgtttg

SEQ ID NO: 569760 - DNA, 130 bp, Homo sapiens
  misc_feature (128)..(128): n is a, c, g, or t
gtaaattgacaaattatagttgtatatatttatggggtacaaagcaatgttttggtttattaatacaatgtggaagaattaaatctaggttgatattaaatcaataaaattgacatccatcacataanaa

SEQ ID NO: 569761 - DNA, 344 bp, Homo sapiens
accctttacgacgaagcgtagaaactggtgaaagtggcaggcagacgtacccaatggacccccacaggcacccctgtgctgggaggcggggtccagtaaaacaggacagcaccagagtaaccagtgtcctcggtaaccatggacaactgaccttacgtactgagcctaaaaggcgaggggcaggatgccctaattagggcattgcaaatgattgggcagcggggaatgcagatccccaataaataggcaccccaataaataggcagagagatactgccctgaccctcataacttttcaaccctggagccatagctgggccttggtagcagggaggggctctgag

SEQ ID NO: 569762 - DNA, 1183 bp, Homo sapiens
cggaccagagatctttcttaaatccctgctactgctcccttctcacaggcattcacagaacccttctgattcgtaagcggttacgacaactcactgcttcttctccagctccccatgtggctttctgctctggagcactaacggctccccagctaagccgggcagcggcacgcactccacactcacgacaccactgcagcatcagcgacgccctcctgcgccacacacctgcggctgcctcactcacgacaccgccgctggactctcctcctcttcactggccacgcaactgcctccttgcgcacctcgcgctctcctccagcgcctggattcctccgatctccacatccctctcttctcacgcggcgctctactcttaatatacactcttgaccctctaggacttcctactacgcctgacacgcaccaacgccattttcaacgcaacacgcagttttaccctgcgcactccacgcccactgcctccacgcctgctcgaccacccttgacactaccacttgctcatacctttcacttcttccaacctgcacaccccaccgtcagcttcctggtgcttcccacggccccaccccacgcactctctcatcaaccacctgcctgcgcactctcctcaacctactccacaacacacgcactcaactgcctctgcacccaacttacaacaccctctccaccccctactccaccacccccccaccacacccacacaccttaacacaccctacctccagacgcaccacaaccccactcacacctcttacaccacggcacacactccacaccgcggcgcacagccaacctacataacccccccgcaccccacaaccccacacactcccggacccacacccgcgcaccccaacgcacacgacacccccacaccctgcccacacacactggcaacacccacacccgtcacaacctcgcgccacaaccaccccacgcaaccactcacaccccataactcgcacaccaccacacgcgccgagccacaccggcgacacccacccgagcacgcccaccccacgacacctcacccccaacgcacgagcacacccgcaccaccaccaacacgccaccctcggcgccacacacacgacacgcccacgacccaccacccacggcgcccaccacatacacaccaccacctcacccacaccgc

SEQ ID NO: 569763 - DNA, 413 bp, Homo sapiens
ctggcatcaagactttgcctactcatattttttattatttaaaatagtctataggatccaaagatgccatgtctttttatctaggttcttctagtcagtatttctggacataaggccgttattacctttctacgagttttgtctctgacacgcacgcacacacacacacacacacacacacacacacacacacccctaatctatttatttaatggaattgtaaataaaggagaaaaagcacatgtgcaatttctggtttaaggctgggcatagtggctcacccttataatcccagcactttgaggggctgaggtgggtggatttcttgagcccaggagtttgagatcaatctgggcaacatagaaagaccgtgtctctactgaaaacttctgggcatggtggtgtgcatctat

SEQ ID NO: 569764 - DNA, 259 bp, Homo sapiens
cgatttctgtggaaaatatcattggaattttgacagggattgcactgaatctttagatcactttggttagtatggacattgtagcaatattaagtcttccaatctatgaatgtgggatatttttgcatttatttgtgactttaatttcttatgtcactgttttacagttttcagtgtagagatattttaccttcttggttaaatttattcctaagtatattatatttcgtgacactactgcttgttgtatattgatatg

SEQ ID NO: 569765 - DNA, 197 bp, Homo sapiens
  misc_feature (12)..(12): n is a, c, g, or t
  misc_feature (166)..(166): n is a, c, g, or t
  misc_feature (175)..(175): n is a, c, g, or t
ctctagaggatnttccccgatagccgacagcctcgcctgtgtggaggcttaggacgggcgggtgcaatcctcgaaggggggtctcagcgaccatgggggacaccatccacatgcaggcggtagttggggcctcggcagtgcctcatacggggtgccgggggtcacntgttgcccnctcagtgccctgttcgggctag

SEQ ID NO: 569766 - DNA, 172 bp, Homo sapiens
ggactgtaagggactggtgttaactcatagagttggaaagggattattatataaattctgcctcttgaggagctgacatagtttggatcaagtttgtgggataagagattttttagcacactcaacatcagggacttgggtaatccaaaacttgcctgcaccaaactaatgg

SEQ ID NO: 569767 - DNA, 1372 bp, Homo sapiens
ggtactacttaccttacaaaaacataatgaccagtataagaattgctttcgctcttgtcaaaaaactagaatagaccccagtgtcgggcaggtagtgtgagcagagccatgacatactgcacccgttacacataatcccacatcgtctctaatgatcagacattggctcgacctctgaccagagaccccagacaacagatgagcggaagatgcagaattgtcaacatgacctgctagggggcaggctacagtacagggcaggtcacaagccgcataatggagttggtagggctaggccgcagcagcaagcagaagaagttggtagaagataattaggtagtaggcaaccactgtgagcacgcaagatagtaacgcagacaagagctgtgcacgagaagataaaatccaaaaagagagaggagaaagaacgaaaacgaaacaaaaaaaagagaacaagaagaaaacaaaagaaaaaaaagaacaaagaaaaaaaagacagaaaaagggcaaaccacaaacgagaccaaagacaagaaaacaagaagaaacgaaacaagcaccaagaaacgagaaaaaaaaatcaacaaacagagagaaaaacacaagacaagaactacaaaaaaaacacagaaagaaagacaacaaaaagcagcccaccaagaaaagacacaacaccagaaccaaacacgaacaagacgatcgacagaagccaaccgacaacaaacagagagaaaacgacaaaaaacaacacaccaaaaaagacaaacgagaaaaaaaaaaagagcacagaaaagaaagacaaaaaaaacaacgaaaagagaaacaaaaaaaagaaaacaagaaaaaaacaaagaacaagagaaagaaacaaaacacaaaagacaaaacaagaaaccacacccaaaccagaacaacacggcaacagataaaacaaacaaacacagaagacaaggacaagaaaacaacaaaaagacaaaaagaagacaagaaaaaagcaaggagcagagaccacgaaaacacgaagaacaaagcaaatgaagaaccacacgtggaaaagagagcacaagacacacagcgacacaacagcgaacgaaagaaaacagacgtaaaaagagccaaaccaacacataggcacgacaacgccaccacaaaaaagaaaacacagagagaaaacaacacaaaggagaaaacaagcaacaaagaggcgagaaagacaaaaatacgacaaacgaaacaacaacagcaaggagaccagacgaaaacaacgaacagcagacaaaaagaaacacaagcacagagaacaagaagagagacaaaacgaagaagagagcacaacaacagcaaacaaaacgcagaaccgagacaagacaat

SEQ ID NO: 569768 - DNA, 112 bp, Homo sapiens
tacctgtcccattttggcggacatcagcttttctgctgcgatagcggtccactgcccaacgccgaagcggatcgacagatctggcggtgtcgctcagtgtaattgcgggggt

SEQ ID NO: 569769 - DNA, 1116 bp, Homo sapiens
ggctctgcgggctcccgggctacagcggctgcggtagaaatgcccctccgtggctagtgagcgacggcgccgggcccgctatactcgtcaccaccgtccccacctccccgctgcagaacagcgctgttggaccgccggctccgcggcgatggcgctctataacccctaccgccacgacatggtcgctagttctaggggagatcatgatggactagccgcatcctgtaaggtcctcagggaccagatgaggagggatccgtgagggtgcccatgatcctgcaggagcgtccccgagatttcgagatcctaactctcgaccttggagcatagtcgtcctagagccttgccagagaagggctctccgtcgcgtcgacgagtatcatccgtatcctgcgatgttgaacagtggtctccccagatacccgatgaacctatgcgcttcgtgcgatgatgaggagctacgcgtactgtgattacagcgtgttagccgggcatggttgctcagattagtgcttcatagatgcctgtctgggagatgccccatcaaatatacctggcaggggagatcgtggtgacctggtccgacggctgtccagaagtgctcttgtgcattgtgcattctcctgtggtgcctactatgggatccgactcctgactttgggcgctcaggagcctggcatcggtggcctgggtctcgctagcttggattcccatgggggccggtgtcggacaccggggctgtaaagtgccccatgttgtcctctaagcctggtacctagtagaggctggcctgctggaggactcctggtcccatgaaggggcatcatgcgcgagaggaagactgtgcctgttcacaaggtagccaaccccattgcagccgttccgagggcttttggcgccttgtagcgctttcctgcaggcccagctgggggtacctggactgtaggcttctccccaatacccctggtttctcgttgggagcgcagagggggctcccctttggatgttacccctttgcttccttctacttttgcaacccgtggacccgttgtgtccacgcattgatctgcaatttggtcataacccccgtgtctgattgcctttattgaggaaccc

SEQ ID NO: 569770 - DNA, 293 bp, Homo sapiens
  misc_feature (153)..(153): n is a, c, g, or t
  misc_feature (155)..(155): n is a, c, g, or t
  misc_feature (157)..(159): n is a, c, g, or t
  misc_feature (164)..(164): n is a, c, g, or t
taaacgctaaggaaaaaaaacaaacacaggactgtttcaagtactcaagactgacttacagaccaaccaaccaccttgctggacccttgctagcagcattcttataaaagaactttcgacccctatatgctgaaactcactgtgctccagacnanannntcctnacctatgcaagggatttttaattaatttttcctaatttaaggcccccggctttttttggttccagggtatgatggaggggaataaaaaaaaggtttcttggggaaaccaataccggtaggttatttgaa

SEQ ID NO: 569771 - DNA, 132 bp, Homo sapiens
atgagcatcatcaggcaaggcagcatctggaacacagggccatttcatttcattctcccacatggccacattccactggcaggcattttcacatcatggggcacatcaaggcacatttagctttgcagcatt

SEQ ID NO: 569772 - DNA, 846 bp, Homo sapiens
ggtgcctgtgaacatggcggcgcccgttgtcacggccccgggcagagctctgctgcgggcgggcgctggacggtgcttcggggaggcgtccaggagctactgcggacgtgacatgaagggaacgcccctgacctggcctgcaacttcagcctttctcaaaatcggggcagggtcatcgtggagcgctggtgcgaaggtaccgctggccgtgtagtggccggaagccgcgcctgaccgggacatcgcgtctataagctggtggaggacaccgaagcatcggcccaaagaaaaccctggagctctatcctgacgcagtcggtgggcgaactgtccgcaggtccggggtgaccgtggtctcagtgaagaactctttagggccggaatcgactcccttcctcagggacttggctgtatttgcatccccctgtaaaacaagaagctgtttgacagaggacgaaacttgttgagacaatgaaggaaacctacgacgaagatccagaccacggccaggtgaggcgaccagtgaaattttctaaaagtgctgtctgcctgggaggtatgggatcatgcaccaaatgtccacactggggacgttgaaccctgaaatagttgccgccacttctttagaatcttggtgttgtggttgccccaccttacattaagttcccagagagcctatcaccggtggggcgagtatggtgtaggtgacggagcaagcagatcggaccgggcgcaatgtgcaccccgatttcatccagttgccatagaatttagaattggacacagagcggtacagtggacccattccctatgtcccgggcgacgccaaacacgttgttaatgccc

SEQ ID NO: 569773 - DNA, 424 bp, Homo sapiens
gagctcggtaccccacatggccagagtaggagagagacagagagcagggaggtttaaacaatcagatctcatgagaactcactaactatatagtagcaaggggagatggggctaaaccattcatgagaactccactcctatgatccaatcacgttccaccaggcccctcctccaacactggggattacaattaaatgtaagatttgggcagggacacaaacacaaaccatatcagagtatgttgaaccatccttgcatccctgggatgaatcccacttgattacaatgaatgatcttttaaatatgtagttgaatttggtttaaggattttgcatctctgttcaaagatactggcctgtagttttctttttttgttgcgtctttgtctggttttgtaccagggaaatactggccctgtgaagta

SEQ ID NO: 569774 - DNA, 155 bp, Homo sapiens
gagctcgcgcgaacttagcataaagtctttaagatgcatccatgtttccagtgttttgggtttttttagaaaaactcataaggtgaatttcaagccgggatgggtgggctaacgcctctaatcccagggactttggaggccaagaaggccggtca

SEQ ID NO: 569775 - DNA, 502 bp, Homo sapiens
  misc_feature (491)..(491): n is a, c, g, or t
cggtgaacctattcagaaaatcctcgggtggggaaagaccccacaccttctttaaggatcattggtctcgccatcacaggatctgggaattgtttcctagggtgtgtacaaataagccgggggggaatgaagcacatttgtctggcaaccaaacttgagtccctcagagaacagatgcagagagacctgctctggctggcccggttacaggggccacggtggagtcacagggaggctgtgaccggccataagcccaggagagcccgtggcagctgtgccgaggcgccaggacctctaaggggaagcttcccaagctaggatgggagcaacacggcaagtgatttgtgtccaccaagttcatggtccctccggggcgcttataaagctcagatgtatagtgaggtagggacaaatacaaaaaagcatttttaagaaaggagaggcatgagtcttccccttttggataaaaagcagccggtgatgaggtcggnagcacaagaga

SEQ ID NO: 569776 - DNA, 178 bp, Homo sapiens
gctatgccaatatcattggttcgagatacagacgatcctaatgctgagtcatagtgcggacttacatcgaccagatctgcctcttcactgcttagtgtgtccattcgagggcggatcctctctggcgtggtgaccaagatgaagatgcagaggaccattgtcatccgacgagtgcaat

SEQ ID NO: 569777 - DNA, 133 bp, Homo sapiens
  misc_feature (96)..(96): n is a, c, g, or t
  misc_feature (129)..(129): n is a, c, g, or t
agccactagcgcagctcgagcgatggcctatgtccccgcaccgggcataccagccacctacaacccgacgctgccttactaccagcccatcccggncgggcatcaacgtgggaatgtctgtttaacatnggaa

SEQ ID NO: 569778 - DNA, 260 bp, Homo sapiens
tcttacaggctactaattttatcgcacattcaacttcaaaagagagcagtgtaaccattaccactaatcactgaatgccatgaagccatggagtgaagcaggagctttcaccttttatgtgaatttccaatggtactgtggaggctgaggaaattttcttcaggctaacccagatatactaaagcccaagttcaccagtctacacctgccaaactaaaaaaacaagcagccacttgcacaataaaccgccaggcccattg

SEQ ID NO: 569779 - DNA, 108 bp, Homo sapiens
cccaggttcacagcaggctggcctgaatcgtgagtgtgacggcgtgagtttgtgctcgtgtgggtgtctgtgatggttgcgcagagtgttggcgttactgtgtgtatg

SEQ ID NO: 569780 - DNA, 915 bp, Homo sapiens
  misc_feature (915)..(915): n is a, c, g, or t
gtctcgcgacgtcaggccaagattccagaatgactactatctttgattacccctttaaaaatcttcccatgcatcaaaatgggccctcagattttccataagacctctgagctgttcctcccagttacgagctgcccagtgtgtccagaccaaaaggaagaagatgttagccaaacccaatatacggcatgtgtgtgcgtgtggatggtgtcgcactccattttgctgtcgtggcacttcatataaagaactgatgcccacatgatttgctagagcagcgctcagggggttgttgcatcggaccagtgtccttaaggaagtagtggattatatcatcttcggtacaagttattccaggaaagtgacaacacacacgcaattgtgggctagagagtgctgcctttggagcttggtttctctgaccaagatccttgctcacactgtcaaccatggtgtgtatctctgcacaaccaagccatgaccaccaggtttgttggcttgatttgcttctggccaggtgtgatgtgatcgtggcaagggcgtgttgagttgaatgtccgatgtaccttattcgtcaactcccagaacatgagaaactggatagtttgatctcaattacaggcaattttatgggccaggattgtcttaatctttaatccgaatgattcttaggactgagtcccggggtattgggttcaacagtggactggcatctgagaccgatggccgtgcttgctgttctggtgacagtgataggatggtcaaaggtcagcaaaaggaggagagatctttgtgtggactcaatcggacgaagccaagatggcggctctggaagcaaacgtagcaggaggggacttgagggaagatagacacggttactaatattgcaaaaacggcatctggtgtgagtatagn

SEQ ID NO: 569781 - DNA, 292 bp, Homo sapiens
catagtctttgtgttttagcagattatcggttgtcagtgcgatgcccaaggccaaggcataaacccggtagcatgaagtttgtctacagtgtcaaccgaaagcgtctgaaccggaatgctcgacggaaggcagcgcggggattcgaatgctcccacatccgacatgcctgggaccacgctaaatcggtacggcagaaccgggccgagatggggttggctgtggaccccaacagggcggtgcgctccgtaaaagaaaggtgaaggccgtggaggtggacatagaggagaggcc

SEQ ID NO: 569782 - DNA, 127 bp, Homo sapiens
gtgcggagacttgaggatgagatcagttgagctgcatgcatttgaaaggcatgtgcctgtctcctcacttgagtgcaatgttccatcgaccaaagccctgttctgatcattactcatgtactgccgg

SEQ ID NO: 569783 - DNA, 835 bp, Homo sapiens
gaaaggtggaattttaagtatgactctttactgacagttaatgtggactgttgttactggagtgatggtattgataggaaattgtggtcggaacagcgtagtaattggtacataaagtcttgtatggctgtggtatgctggaaagtaatgactgggcctcagatggagtaagctaaggtatttctttaatgtatccttttaaaagctaatggagagtaactgactttgttcattgtggcccatttgagagaaacatatatctttctcaaatactttacacaaaggtcgatcacactgtgtaactgtttgccaagtcgtactacacaacgaacaactagaactcagaatcattacactaactttgctgacagtttcacatggtttctaaatggcagggtcaggatcgaactatggggactgactctgaagtctatgtgttctcatagctatgctacagagtaacatattttccagaactttcgatagagtacctaaactttatgcttgacgcgtggcggttcacggcaaaattgtcgacatccaaccgaattggtgcgctctctctcgtaaacgcgaccgaacacgtgcctcactacttcttattcggccacatcctggtagctcctcccgtttgggtctcttcttgctggcacactggagcaacagccccacaggcaacacttgaacgacgcctatgcccattggtggttcctcctaactcttgttcttcaagcttctggtcattgggctcagctttttcccatcctcagaggctcttgccctctttggtctctcacactctgggctcggccttgccccaggacagaacacccta

SEQ ID NO: 569784 - DNA, 407 bp, Homo sapiens
acattcatcctgggtgacccaccagctcagcaccgtgttcagctaaccctggggacaaacagccgtctggctcgagtgggagggtccaaacctgcttttctcatctccccccaagtctgtgccgtcagagcttctggctgctcctgaatggtggaatgctgtgtcctctcttctgtgtcccgcggcctgtagggtttggggctctctcgcgcgtgctttctgggggcccagacgcaaggccccgattgggccaacatcagagccctgctgccagaactcaaccctcatggtccaacccacccctggccccttttctttttctctttctctctccccttctttggttttccttcctttttaaaaggagatgggttcccctttatattatggtttttttcttaggcctt

SEQ ID NO: 569785 - DNA, 453 bp, Homo sapiens
ctgggtagaggtgtctggatccagggggtggatcactaatgggttggtgctgtggtgacagtgagttctcacgagagctggttgtttaaaagtgtgtagaacctcccctcccctctttctcgctcttgctttttgcatgtgatatgcctgctcccccttcaccttctgccatgattataagcttcctgagaccccccagaagctgagcagatatcagcaccatgcttcctgtaaagcctgcagaactgtgggccaattaaacctcttttttctttcttcttctttttttttttttagatggaatctcgctctgtcgcccaggttggaatgtgcaggggtgaaatttgggctcactggaacctccacctcccaaggttcaagcggattctcagcctggggtctccaaggggtcccggagctcggaattcggtaatctatggctcatacgctgtg

SEQ ID NO: 569786 - DNA, 530 bp, Homo sapiens
ctgaggatcccctgatatgcgttctcaggagcaacaggaaataacgcggagatctgtgtcctgcacttagactatggaccctgccgggccctaacttctccgtatactactacgacaggtacacgcagagctgtcggcagttcctgtacgggggcggcgagggctacgccaactatttcgacacctggaaggctagcgaagatgcttgttggaggatagaaaaagttcgtaaagtatgacggtgtgcaagtgagtgtggagggaacagtgtgcaggggtccagagagacagtgatttcttgaatctaagttctatgacatgtgagaaattcttttccggtgggtgtcacgggaacgggattgagaacaggtgtccagatcaagctacttgtgtgggcttctgcgcaccaaagaacattccatcattgggctacagtccataagatgagggactgtgctctgccaatgtgactcgctatcattggaatccaagatacagaacctgtgatgctttcacctatactggccggg

SEQ ID NO: 569787 - DNA, 312 bp, Homo sapiens
gaggatcccctctatccactatgggcaggccacggcgtccaggcgggcccagtcagtctgttggtctagagaggagcctggctcggtatccggcgctgcttcgtatgactgaccccggcctctggctgaggacatgtcagcggctcctacatgttagagatccctgtggctgaggtgggcctctctacctctgtccccactcactccagagagcactggcgttggtcacgtcttgactggaagaacctgttcgttgttcccttgccctggtggtgggggggccagaccacatccgtactggcccggggtacc

SEQ ID NO: 569788 - DNA, 132 bp, Homo sapiens
aacaagttgatattactcaaaaacagctggaagaagaaatttctagattacccaaagaaatagatcagtttgagaaaatacaaaacaattcaaagctctttaggataaagcttttcaactttaaaatgagct

SEQ ID NO: 569789 - DNA, 648 bp, Homo sapiens
  misc_feature (573)..(573): n is a, c, g, or t
ccgggctgcaggaattgggaccgggctgctgtcagaggttctatgcagatgatggcagttctagcaacggtcccaggagtctgttccctgttctagatccgcacatcctataggtaggcccagatactgtgcgttgaggctctagtgagggaacagtggatactgactgtgcgtcagaacgtttactaccgatgagcctaccttgggtttgcggacccagtctaatacgaccttcatgtgttctccatgctctcaagcgagccatgtgcccatggactgagagtcacgcctgaccagagccagctcatctcacagccatatgccactaacggactatgcgggatcggagctcacactgttccagatcccgctacttgcatagccaggcctacagcgaggtccagtagccttgatgcatgatgtacacctgagcttccagctagatctgctcgagctggagagacctgagagcctgaaccagagtgtggtcctgagctgctgacggctgacagatatgtggagcctacagggaccaagtgtgagagaggccgcaggtgtgagaccaacggtacnggttgacacagatctgagacatgtcgcggacagcgagacgtgcactgagggactgttggacctgtggtggcctgt

SEQ ID NO: 569790 - DNA, 902 bp, Homo sapiens
ggctgcagtcccccatagacctgcattattgaatcgtgcatatatgacgccagcctcacgcccctcgagttccaaggctacaatctgtctgccaacaagcagtattctcctgaccaacaatggccattcagtgaagctgaacctgcacctcggacatgcacatccagggcctccagtctcgctacagtgccacgcagactgcacctgcactgggaggaacccgaatgacccagacggtcatgagcacaccgtcagcgtgacagaagttcgaccgacgagactgcacattgtccattataactcagacctttatcctgacgccagacactggcagacaacaagtcagaaggacctcgactgtactggctgtatctacattgagatgggatccatatacaatccgtcctatgacagatcttcagtcaccttcaacatgtagagtacaacaggccaggaagcatacgtcccgggattcaacattgaagagctgcttccggagaggaccgcatgaatattaccggtaccgggagtacctgagcacaaccaacttgcaagcgccacatggagctctaggacaggaaaccagaaataccgatgcaaaattacacgaggaagcaggatagtaggactaagagagaacaagccctgatactgcaacagacaatggactaaacatatccaccaagagaaatactgactctacacaagaataccgcgagcaggggtcacaagaaaagataccgaagtgaagagggcatgggtaaaagaagccttccctttctatcccaaggatgggaaggacatggtaactgacggataaggactagaagatgtaggggcaacagttccatcgattcacataggccacatgagatgggaatacattgaggaatcaagaactg

SEQ ID NO: 569791 - DNA, 344 bp, Homo sapiens
ggtaccaaacgaaaggcatgaggtgatttcgttaaatttcactagcggcactgccatggaaggttatgaaggggaacttgtggcagggaccagccttatcatactggtgcatctggttgccggggcagagtgttcacggcctgtttgtggggatgttgaggcacaaggaaaatacaaagttttaaaaaatgtactatcactaatttgccttgaaattccctgaatcctttaggatagatttttgcttttgtttttgagacagagtcttgctctgtcaccgaggctagagtgtagcggcacgatctgggctgactgcaacctctgccgtctgggctcaagcgatc

SEQ ID NO: 569792 - DNA, 92 bp, Homo sapiens
cgtgacggggctccactgtgtcggggacacctaccccagcaacgaccggtgctgccacgagtgcaggccaggcaacgggatggtgagccgct

SEQ ID NO: 569793 - DNA, 292 bp, Homo sapiens
ttggttcgtctctgaggatccctcagagaagagacgagatgaaggaataaagaaagacaagagagagaaagaaagagaaaggagaggagaggagaggagaaagaacatttcataaagagaaactggattatcccactaggctcagtcctgatgagatgtggtcctgtcttcctctatctcgatctctctctatactgctgagacgcgggagacttgggggccacggaacaggaggagtgtgagcagttagcaagacagttgctcagaactccgaccacccatggtgacttct

SEQ ID NO: 569794 - DNA, 454 bp, Homo sapiens
ctgaaggtttttaaagcagggtggaagcccttgccctttcctttctacctttaaaaccttcactctcattgcatataggccgaacctaattagacacctaggatgaagaaggactgctccagtcctctttctgtggtagtggtggtgagaggtggctgattcccagcaatatgccattgacgtggcgttaaaaggttcttacaacggtagaacaggaaaaggggcaagggcttccaccccatgctttaaaaattgattcagttctaattctctgcttgataatatgctatgctgccgcacggaggtatcgggaatataaaccagagccaaggttgcctgacacacgcatgaaaatagtgcgcccacccgatctcacgatgcactactcttatcgtacttatatccagcagacattcaggtgcagctggtcacagtaatcacactctcacacata

SEQ ID NO: 569795 - DNA, 125 bp, Homo sapiens
attcgcggccgcgtcgaccgtgaggctaaggttttaacatgagacagggttcttgtagagagcctagatgaggtcaatgctctttaagctgggcaatagagcgagattgtcctctaactgggact

SEQ ID NO: 569796 - DNA, 1361 bp, Homo sapiens
  misc_feature (1137)..(1137): n is a, c, g, or t
tctgtgatttctcttctctcttgtgcaccgctgttcctcttgtttgcttgtgctttcttctttagctttcgctgctttggcttttcgctgacttgcggcttgctcgctcttcacttcgttctgcatgcttgtcgtctgcttcgtctcctctgtttcccttttcagtcttcctcatctgccgcgtgtctgtctggttgctgtcgttctcgctgtcctcgttctactctttcgtttgtggttctctcgcctggcgtttttctagctctgcgtatctgtctgcaatgttgtgctcgcggttctactcctttcctcgctgttctggatatcccgatctgtgatctttcgtatagtttctagtatgcgctgtctcacgtattgtgtctcagtgtggtgtcacgtgagtggtcgttcttcaaagcagaagtactcacacgagtacatcggataaggacaggaaggaaactgcaagcgggcgacagaggcaaatttcgtcgttgtcccccgcccctcgtttgctctgtcgtcgttggaaactatctcgcccctcgcgataatctcttcgcctatttataaccccgcacagagggtgcccaaattaacggcgcggttgaacacttttcgccacgggcggccaatctctgctactcccgcaaggggcaggggcacaagttaccagggtcacaaattctctcgacagtcaccagatgttatctctctctgcgtgaggaccacagtgccgtttctcctccagaggagttaggctgtgggctttctataataaaaaggtcggcgggttgttccgccaacccccccgttcgatgggtcgctaaatctcaaagactcccgtgttattttttcttccgcccccaggatcgcacgccggttcttaaacggcctccgagtgtctccacttctgcccaaaaggaaagctcggtctgccccctctcagggagagcctctctctccgcaagaaaggtagcccaatctccgtctgaaaagaaatgcggccggtggacctctcctcgatcttcgcccccgccttatgtggtgaagaaagtaattttgtggctgtacgacctatattatatataagggagagttgtgggaaagagtcgcttataaaagggtgtttccacntctgtgggaagaggaatatttcgtccacgcccctctctctgacatcaccaaatggggtctcttcggagagtatcctatattgtaaattccccccccgtaaaataaatataaaaatttttttgtaaaaatataccacccatatatgggtcttctaaaaattgtgggtttttattttgcgcccacacactttaaaaaaaaattttttctcaccccacaaaaaaata

SEQ ID NO: 569797 - DNA, 80 bp, Homo sapiens
cctttaaggatttacttaaatacttgtacatttacatatgtgtattcatagaaaatgcacagtattgtttgtgtagagtt

SEQ ID NO: 569798 - DNA, 292 bp, Homo sapiens
tcgatctagaggatcaattgagtatagtagtacgcttggactgggtgaagtcttagcatgtactggctcggaggtggggttctgctccgaggtcgccccaaccgaaattttaaatggcagtgttgggaagttataggacctggtgggtttggttaaggtactggtttggctattatataaatctaaagtctccataagggtctccttcgttcattgcttgttgtcattgccctgccttctttcactggcgcaggttcaattttcactgtggtttaaaagttacagagaacag

SEQ ID NO: 569799 - DNA, 207 bp, Homo sapiens
aagagagacaaaagagaacccgtgcactatgtacataagtagcatactttgttgtagtaaatagatgaggcatgcctgggaaatgctcacttggatacatagcactcaattataaattaagtaaacaggtgtaccacataaacaagaatttacatgcatacggtaaacaaaggaccaggacacgtgagattcctgcaaggagttctt

SEQ ID NO: 569800 - DNA, 249 bp, Homo sapiens
ggccctggatttgtttttccccctggaaaagggttttaactctgggattttaaaagggtagaatattttttcaaaagaacagtgggactcaaaaaaatgaaaggtgggccccaccttttttggattcatcccttaaaattttttatttttccgagaactacaagtaacattttaaccaagctgctgttggaccttaaacaaaaactcagtgataacccggatttagtttattaaaaatgctctttttta

SEQ ID NO: 569801 - DNA, 713 bp, Homo sapiens
  misc_feature (43)..(43): n is a, c, g, or t
  misc_feature (77)..(77): n is a, c, g, or t
  misc_feature (100)..(100): n is a, c, g, or t
  misc_feature (104)..(104): n is a, c, g, or t
  misc_feature (110)..(110): n is a, c, g, or t
  misc_feature (132)..(132): n is a, c, g, or t
  misc_feature (147)..(147): n is a, c, g, or t
  misc_feature (169)..(169): n is a, c, g, or t
  misc_feature (177)..(177): n is a, c, g, or t
  misc_feature (180)..(180): n is a, c, g, or t
  misc_feature (217)..(217): n is a, c, g, or t
  misc_feature (225)..(225): n is a, c, g, or t
  misc_feature (394)..(394): n is a, c, g, or t
  misc_feature (414)..(414): n is a, c, g, or t
  misc_feature (416)..(416): n is a, c, g, or t
  misc_feature (441)..(441): n is a, c, g, or t
  misc_feature (445)..(445): n is a, c, g, or t
  misc_feature (452)..(452): n is a, c, g, or t
  misc_feature (456)..(456): n is a, c, g, or t
  misc_feature (462)..(462): n is a, c, g, or t
  misc_feature (485)..(485): n is a, c, g, or t
  misc_feature (543)..(543): n is a, c, g, or t
  misc_feature (546)..(549): n is a, c, g, or t
  misc_feature (554)..(556): n is a, c, g, or t
  misc_feature (561)..(561): n is a, c, g, or t
  misc_feature (564)..(564): n is a, c, g, or t
  misc_feature (567)..(567): n is a, c, g, or t
  misc_feature (570)..(570): n is a, c, g, or t
  misc_feature (582)..(582): n is a, c, g, or t
  misc_feature (595)..(595): n is a, c, g, or t
  misc_feature (610)..(610): n is a, c, g, or t
  misc_feature (613)..(613): n is a, c, g, or t
  misc_feature (616)..(616): n is a, c, g, or t
  misc_feature (623)..(623): n is a, c, g, or t
  misc_feature (633)..(633): n is a, c, g, or t
  misc_feature (635)..(636): n is a, c, g, or t
  misc_feature (642)..(642): n is a, c, g, or t
  misc_feature (646)..(646): n is a, c, g, or t
  misc_feature (693)..(693): n is a, c, g, or t
gtaataaatgaatacttgatgtattcatacaggcaagaatccnatcatcccagagaagctctgtctgcgctgcaaancctatggctgcagacatcagggnaagntggtgnagttctagtctggcctcctcgnatttccctgccagcngtcttcctctctttcattcttntggccctntgnagaaccagggaggccaactgacttccacccatatggntttggtgnaggagcagaccaaaggtatctcccaattagaaggctaagaagtcctttgggctaatgtttagtgtcacgaagttcctttaaaaagagaggaaagcataccagaagtccctatggattagttaaagtagttccattcagggcacccatctgcaaacccagaccttctgcnaggacacagcttttgtttcntntccctctaaggcttgaacatacagnagtnctctccnatgnccttgnagtgtaactgtatggaaaagtanagttccttggagagcagtcctggtgaccttttttgtgagagtggttttgtccttcccncannnnaaatnnntgccnacntanctnctgggatcttcnacatctagccagncatgtcctgctccantgnttngagatgnccccgccctncnncgaccncccnccggggttcctttggtcctgctgtggatagcgccgctgcgcctttgnatctccctgtggcttctctt

SEQ ID NO: 569802 - DNA, 356 bp, Homo sapiens
  misc_feature (7)..(7): n is a, c, g, or t
  misc_feature (74)..(74): n is a, c, g, or t
  misc_feature (170)..(170): n is a, c, g, or t
  misc_feature (354)..(354): n is a, c, g, or t
agtctgnacagcatagtgagacccccccatctcttcaaaaaaaaattttttttttttgagaagtagcccaggcntggtggtgtgttcctgtggtcctagatgcttgagaggctgaggtgggaggactgcttcagcccagtatttcaaggctcccagtgaactgtggtcanacccactgcactccagcctggatgacagcaagatcctgtttaaagcaacaacaacaacaaaaaccaagtagacacatgggataacagatgatgttgcatgatgtggtaaattgtatcattagccccaattctgcactcctttctatatgcataccctttctcgtgttactttgcagttcctccnac

SEQ ID NO: 569803 - DNA, 155 bp, Homo sapiens
ctgtggccactgcatggccgcacatcggcagttgggggaggaggaacccactgtatctggtggctcaggccaacagcctgtgcaagcagggcgagtggaatgttgtgtggcgaatctgtgccgatctgtattaaagggatccctcttggtgggca

SEQ ID NO: 569804 - DNA, 552 bp, Homo sapiens
  misc_feature (183)..(183): n is a, c, g, or t
gcgacagagtgaggctgcgtctcaaaaaaaaaaaaaaaaaaaattgccccttcttaagtttgcatttagatctcttctcctttgaccacttttaatttatcttcacttctgatatgacatttaatttttcattcattttctgtctattattgttccttttttaacttaaaaaaaaattctgtnctttatgaatttctgtttcaaggtgtttttcccatctccaaatgcttatttgaaaatgtttcctttcctcttggttcatttcttctggtgtgtgtgtgcggcgcccgcgtgcatgtgtgtactcgggtctcattttctgctttcttcctgcagtacctcgtttatgggagatgcacttcgcttttcttatttttttagtagagagggggtttcactggtttagccagaacagtctcgatctcctgacctcgtgatcccgccacctcgggctcccaaagtgctgggattccaggagtgagccaccgcgcccggccgtccactttgcttcttgcagaggctgatggtttgagtaatttccgagattcatag

SEQ ID NO: 569805 - DNA, 402 bp, Homo sapiens
atttcgaaatcaccacgtcatctgcctaattcatgctcgtaatgaggatcatttgtcctacttcacttttattggaagagttgctgcatctggccgtcatttcataagaagctctatagatggtttcttcattagaccatattacacgatgatgttgggaaagcagataaccctaaatgacatggaatctgtggatcgtgaatattacaactctttgaaatggatcctggagaatgaccctactgagctggacctcatgttctgcatagacgaagaaaactttggacagacatatcaagtggatttgaagcccaatgggtcagaaataatggtcacaaatgaaaacaaaagggaatatatcgacttagtcatccagtggagatttgtgaacagggtccagaa

SEQ ID NO: 569806 - DNA, 227 bp, Homo sapiens
atggccggggcactggcatcacacctgtgttctcagcactagggaagcccaggtgggcagatcacaaggtcaggagtttgagaccagcctggccaacatgatgaaatcctgtctctactaaaagtacaaaaattagctgggcatagtggtggacacctgtaatcccagctactcagaagactgaggcaggagaatcgcttgaaactgggcagtggaggttgcagtga

SEQ ID NO: 569807 - DNA, 759 bp, Homo sapiens
  misc_feature (19)..(19): n is a, c, g, or t
  misc_feature (62)..(62): n is a, c, g, or t
  misc_feature (93)..(93): n is a, c, g, or t
  misc_feature (236)..(236): n is a, c, g, or t
  misc_feature (396)..(396): n is a, c, g, or t
  misc_feature (437)..(437): n is a, c, g, or t
  misc_feature (510)..(510): n is a, c, g, or t
  misc_feature (542)..(542): n is a, c, g, or t
  misc_feature (610)..(610): n is a, c, g, or t
  misc_feature (619)..(619): n is a, c, g, or t
  misc_feature (621)..(621): n is a, c, g, or t
  misc_feature (624)..(624): n is a, c, g, or t
  misc_feature (627)..(627): n is a, c, g, or t
  misc_feature (633)..(633): n is a, c, g, or t
  misc_feature (674)..(674): n is a, c, g, or t
  misc_feature (683)..(683): n is a, c, g, or t
  misc_feature (704)..(704): n is a, c, g, or t
  misc_feature (716)..(716): n is a, c, g, or t
caggtggcacagaaaagangtaggagggggtaaggacactgaggatcaggtctccagcaggnctgtccagtttgccttttctaattctgagtnttctacttctttctcagtgtccatctggcacagccagaccaggtctccccaaagcagttactcctcacagcaagggcattggccctctaggggcagaagctgccctggttcttcctcgcaagaaactcctctgccaggcagancacatgggcccttagcaggccagccagggtgggggcaacacaagcggcccctcttcatcctggatggtctgggcgcacaggcgcagcagcaggcccctggatccccctggcctggctcaggctccgcgctcaccaaacgcgcgcacctgcgcggcgcctngcgcggccggggcctggggcggtggaggcccgaagccagangcacgttcggcggcggcgggcacggaagacgtcctggcggaggtctgggcgcacccagcgcacttgcagcgcngaggtgagcacagggcggtgcgcgcacatgtncccacgcccaggttgaaacgaaggctgtttctctcgcagcgaggcccacgtgcgctaggggccgaggngtgcgggtncngcnaanccactnaaaccgaaggcggccacggaggacgggaagccgtgcacgangagcaccanctcccagggccctcgcccgcnggtccgccaggncccgccttttttgcggccccattgtgctgctggacccgacgag

SEQ ID NO: 569808 - DNA, 2619 bp, Homo sapiens
  misc_feature (11)..(11): n is a, c, g, or t
agccattgtgnatgagaagatcttctgttgtcatggaggattgtcaccagacctgcaatctatggagcagattcggagaattatgagacctactgatgtccctgatacaggtttgctctgtgatttgctatggtctgatccagataaggatgtgcaaggctggggagaaaatgatcgtggtgtttcctttacttttggagctgatgtagtcagtaaatttctgaatcgtcatgatttagatttgatttgtcgagctcatcaggtggtggaagatggatatgaattttttgctaaacgacagttggtaaccttattttcagccccaaattactgtggcgagtttgataatgctggtggaatgatgagtgtggatgaaactttgatgtgttcatttcagatattgaaaccatctgaaaagaaagctaaataccagtatggtggactgaattctggacgtcctgtcactccacctcgaacagctaatccgccgaagaaaaggtgaagaaaggaattctgtaaagaaaccatcagatttgttaaggacatacttcataatatataagtgtgcactgtaaaaccatccagccatttgacaccctttatgatgtcacacctttaacttaaggagacgggtaaaggatcttaaatttttttctaatagaaagatgtgctacactgtattgtaataagtatactctgttatagtcaacaaagttaaatccaaattcaaaattatccattaaagttacatcttcatgtatcacaatttttaaagttgaaaagcatcccagttaaactagatgtgatagttaaaccagatgaaagcatgatgatccatctgtgtaatgtggttttagtgttgcttggttgtttaattattttgagcttgttttgtttttgtttgttttcactagaataatggcaaatacttctaatttttttccctaaacatttttaaaagtgaaatatgggaagagctttacagacattcaccaactattattttcccttgtttatctacttagatatctgtttaatcttactaagaaaactttcgcctcattacattaaaaaggaattttagagattgattgttttaaaaaaaaatacgcacattgtccaatccagtgattttaatcatacagtttgactgggcaaactttacagctgatagtgaatattttgctttatacaggaattgacactgatttggatttgtgcactctaatttttaacttattgatgctctattgtgcagtagcatttcatttaagataaggctcatatagtattacccaactagttggtaatgtgattatgtggtaccttggctttaggttttcattcgcacggaacaccttttggcatgcttaacttcctggtaacaccttcacctgcattggttttctttttcttttttctttctttttttttttttttttttttttgagttgttgtttgtttttagatccacagtacatgagaatccttttttgacaagccttggaaagctgacactgtctctttttcctccctctatacgaaggatgtatttaaatgaatgctggtcagtgggacattttgtcaactatgggtattgggtgcttaactgtctaatattgccatgtgaatgttgtatacgattgtaaggcttatgtcactaaagatttttattctgattttttcataatcaaaggtcatatgatactgtatagacaagctttgtagtgaagtatagtagcaataatttctgtacctgatcaagtttattgcagcctttcttttcctatttcttttttttaagggttagtattaacaaatggcaatgagtagaaaagttaacatgaagattttagaaggagagaacttacaggacacagatttgtgattctttgactgtgacactattggatgtgattctaaaagcttttattgagcattgtcaaatttgtaagcttcatagggatggacatcatatctataatgcccttctatatgtgctaccatagatgtgacatttttgaccttaatatcgtctttgaaaatgttaaattgagaaacctgttaacttacattttatgaattggcacattgtattacttactgcaagagatatttcattttcagcacagtgcaaaagttctttaaaatgcatatgtctttttttctaattccgttttgttttaaagcacattttaaatgtagttttctcatttagtaaaagttgtctaattgaaaaaaaaaaaaaaaaaaaaaaaaaaaaaaaaaaaaaaaaaaaaaaaaaaaaaaaaaaaaaaaaaaaacaaaaaaaaaaaaaaaaaaagagcaaaaaaacaacaaaaaaacaacaagagggcggggggggcacaaacgaaacaacccggagggggcgacaaaaacaagcaccacaacctcgtagaataaacgggggctccccaagaaaaagaggaacaaaaaaagacggcgggccgccagacaacccgccggaggacgacaaccagacaggacgataagtggaagaccaccatgagggggacatgagaaccacaacaaaaagcggcgagcacacaagcgaatgacaaccacacacgcgacaacgcgcagtaaaaatgcgcagat

SEQ ID NO: 569809 - DNA, 2045 bp, Homo sapiens
  misc_feature (11)..(11): n is a, c, g, or t
agccattgtgnatgagaagatcttctgttgtcatggaggattgtcaccagacctgcaatctatggagcagattcggagaattatgagacctactgatgtccctgatacaggtttgctctgtgatttgctatggtctgatccagataaggatgtgcaaggctggggagaaaatgatcgtggtgtttcctttacttttggagctgatgtagtcagtaaatttctgaatcgtcatgatttagatttgatttgtcgagctcatcaggtggtggaagatggatatgaattttttgctaaacgacagttggtaaccttattttcagccccaaattactgtggcgagtttgataatgctggtggaatgatgagtgtggatgaaactttgatgtgttcatttcagatattgaaaccatctgaaaagaaagctaaataccagtatggtggactgaattctggacgtcctgtcactccacctcgaacagctaatccgccgaagaaaaggtgaagaaaggaattctgtaaagaaaccatcagatttgttaaggacatacttcataatatataagtgtgcactgtaaaaccatccagccatttgacaccctttatgatgtcacacctttaacttaaggagacgggtaaaggatcttaaatttttttctaatagaaagatgtgctacactgtattgtaataagtatactctgttatagtcaacaaagttaaatccaaattcaaaattatccattaaagttacatcttcatgtatcacaatttttaaagttgaaaagcatcccagttaaactagatgtgatagttaaaccagatgaaagcatgatgatccatctgtgtaatgtggttttagtgttgcttggttgtttaattattttgagcttgttttgtttttgtttgttttcactagaataatggcaaatacttctaatttttttccctaaacatttttaaaagtgaaatatgggaagagctttacagacattcaccaactattattttcccttgtttatctacttagatatctgtttaatcttactaagaaaactttcgcctcattacattaaaaaggaattttagagattgattgttttaaaaaaaaatacgcacattgtccaatccagtgattttaatcatacagtttgactgggcaaactttacagctgatagtgaatattttgctttatacaggaattgacactgatttggatttgtgcactctaatttttaacttattgatgctctattgtgcagtagcatttcatttaagataaggctcatatagtattacccaactagttggtaatgtgattatgtggtaccttggctttaggttttcattcgcacggaacaccttttggcatgcttaacttcctggtaacaccttcacctgcattggttttctttttcttttttctttctttttttttttttttttttttttgagttgttgtttgtttttagatccacagtacatgagaatccttttttgacaagccttggaaagctgacactgtctctttttcctccctctatacgaaggatgtatttaaatgaatgctggtcagtgggacattttgtcaactatgggtattgggtgcttaactgtctaatattgccatgtgaatgttgtatacgattgtaaggcttatgtcactaaagatttttattctgattttttcataatcaaaggtcatatgatactgtatagacaagctttgtagtgaagtatagtagcaataatttctgtacctgatcaagtttattgcagcctttcttttcctatttcttttttttaagggttagtattaacaaatggcaatgagtagaaaagttaacatgaagattttagaaggagagaacttacaggacacagatttgtgattctttgactgtgacactattggatgtgattctaaaagcttttattgagcattgtcaaatttgtaagcttcatccctatgaagcttacaatttgacatgctcaataaaagattttagaaggagagaacttacaggacacagatttgtgattctttga

SEQ ID NO: 569810 - DNA, 208 bp, Homo sapiens
gcgcgcgtgctagcgtgcccagaagattccgattagctgtggaatcccgtggagtagcccttccagcttagcaggggcactgggtctctgaatttcaaagacttgctgtcttggttttacccctcaccgtaccacctgcatcagaaactcttggggtgctcattaaaaatgtaaaccattgggtccctctgtcgccggcaaaaacaat

SEQ ID NO: 569811 - DNA, 314 bp, Homo sapiens
caggtggatcacgtgaggtcagaagttcgacaagcctggacaacatggtgaaaccctgtctctactaacaatacaaatattagccagctgtggtggcgcacgcctgtaatccaagctacttggaaggttgaggcaggagaatcacttgaagctgggaggtggaggttgcagtgagtggagatcacaccactgcactccagcctgggtgacaaagcaagactccatcacaaacaaacaaacaaaaaagtatgctgaagaagaatcatctactccagtgcagcttttccaaaactagttctgtgaaactcagtttc

SEQ ID NO: 569812 - DNA, 222 bp, Homo sapiens
tgttgatcttctccttgaagaacagcacggtcgaggcgaaggcaaaaagcatttccacctgcgccagcgccttgaccacggcggcctgctgcaaggtcatcgcggtgaaccagccgaaagacgccgtggcgcccacgaaaccgacagcaagcgacggtttccacgcctttgcgatgcgccgcagctcgtccctctgccgccaaacgatccacaagaacatcg

SEQ ID NO: 569813 - DNA, 267 bp, Homo sapiens
  misc_feature (8)..(8): n is a, c, g, or t
  misc_feature (61)..(61): n is a, c, g, or t
gcttttcncccccttccccccaaaaaaaaatcccttccaaatttttaaattttctggtccncccttttccaaaggaaaagggcaaaaaatggcctgggcttttttggggggcgtgttcccgggcggaaaaaaaaaaaagggaaaaacctccccccggggctttttttttttgttttagggccccccccccccccccctataaaatttggaaccacccccaaaaagggtttgattccggcctttttttgggttccttttgttttttta

SEQ ID NO: 569814 - DNA, 2344 bp, Homo sapiens
attctacataatcagacttagcacatatctctttcactctaatgaccacaaaccaccatttcaacatgcagctcttgcaccgaacaatgacgatatcttccttgccactaaagtaaatgccaagagatcatgttacattttcagccacagtgcaaatgaaatatctcttgtattacttactgcaagagatatttcattttcagcacagtgcaaaagttctttaaaatgcatatgtctttttttctaattccgttttgttttaaagcacattttaaatgtagttttctcatttagtaaaagttgtctaattgatatgaagcctgactgattttttttttccttacagtgagacatttaagcacacattttattcacatagatactatgtccttgacatattgaaatgattcttttctgaaagtattcatgatctgcatatgatgtattaggttaggtcacaaaggttttatctgaggtgatttaaataacttcctgattggagtgtgtaagctgagcgatttctaataaaattttagttgtacacttttagtagtcatagtgaagcaggtctagaaaataagcctttggcagggaaaaagggcaatgttgattaatctcagtattaaaccacattaatctgtatcccattgtctggcttttgtaaattcatccaggtcaagactaagtatgttggttaataggaatccttttttttttttttaaagactaaatgtgaaaaaataatcactacttaagctaattaatattggtcattaaatttaaaggatggaaatttatcatgtttaaaaattattcaagcactcttaaaaccacttaaacagcctccagtcataaaaatgtgttctttacaaatatttgcttggcaacacgacttgaaataaataaaactttgtttcttaggagaaaatgattctgtaattccagtgtcactaatttatattgttctttcctctgatttttttcaggttagtgatttttttgtatacaatttaatccaaatgttatgacattcagaaatcatgaaacacagtagatatctgttataatgtggtgtatcacatggattataaagcaaagttatggtcgatttctattcttgaaagaatcaactacagtgaatcctttgcatttgaagccttaacatgcattgctttaattttgcccagggacaaattttaataatcagcaagactggtttgtgcaaagcgttgagtcatcaggtatttagagcctagccagctacccagtatccatgctgccatatcccttcattgtaaaaagtacctaaacattcgtgaaatgattttttttagctgaaaaatgctggcaagaagaattttaaagcttaaaataggtggtaaatttgaagtatgagtgtgttcacgagaaacataggcttttcaaaaaaatttttattcaaggcaaagcaaggaacatcttgagatatgtctcaagaatataaagatgtattattttaagccaaggagctgaaatatatctcagtttataaattcaggtatattctttttgtctccatggcaaccataacttttgaaccaaaaaaaattgtttttacatctttatgctgaaaatgtgtttagattaggaatatggtcgggctgaatttgctgttgctccctaaccaaatccacctcttgttttccttgtgagtccatggctaaatcaaagctgcccctgagaagagacttaatccaagcctgattgtactagtggcatcacttagaagtaggctttccctcttcctagtagatctcaatgttttataattccttaaaacagctgaaaattgggacaacatactttacgcaatgaacagtagttaaataggaaataaactagttccatgtaagtatacacctagagttttaattacctttataatgtttcttaaaagtgaaacttagatacaattgtgattggatacttagatactaagtgaaacttagtgtaacaattttgatctgttaaattggattttacatgtacatttgaatgccagaatttctaaataaatcccctggttaggaaattttaaaagtcaaagcttgttttcttcaaccactaccttctacattggttgacttagaccgtaagctttttaagtttctcattgtaatttaccttctcatgcagattgctgatgttttattaaaccttatttttacaaaaatgaaaaaaaaaaaaagaaaattgggcggcggcccaaaaatttaaaatgtgggggggccagtatgaagggtaggcagagaaggggaaggggggtcacaaaagaggggggggaaaaagggggggtggaaaagag

SEQ ID NO: 569815 - DNA, 1416 bp, Homo sapiens
  misc_feature (11)..(11): n is a, c, g, or t
agccattgtgnatgagaagatcttctgttgtcatggaggattgtcaccagacctgcaatctatggagcagattcggagaattatgagacctactgatgtccctgatacaggtttgctctgtgatttgctatggtctgatccagataaggatgtgcaaggctggggagaaaatgatcgtggtgtttcctttacttttggagctgatgtagtcagtaaatttctgaatcgtcatgatttagatttgatttgtcgagctcatcaggtggtggaagatggatatgaattttttgctaaacgacagttggtaaccttattttcagccccaaattactgtggcgagtttgataatgctggtggaatgatgagtgtggatgaaactttgatgtgttcatttcagatattgaaaccatctgaaaagaaagctaaataccagtatggtggactgaattctggacgtcctgtcactccacctcgaacagctaatccgccgaagaaaaggtgaagaaaggaattctgtaaagaaaccatcagatttgttaaggacatacttcataatatataagtgtgcactgtaaaaccatccagccatttgacaccctttatgatgtcacacctttaacttaaggagacgggtaaaggatcttaaatttttttctaatagaaagatgtgctacactgtattgtaataagtatactctgttatagtcaacaaagttaaatccaaattcaaaattatccattaaagttacatcttcatgtatcacaatttttaaagttgaaaagcatcccagttaaactagatgtgatagttaaaccagatgaaagcatgatgatccatctgtgtaatgtggttttagtgttgcttggttgtttaattattttgagcttgttttgtttttgtttgttttcactagaataatggcaaatacttctaatttttttccctaaacatttttaaaagtgaaatatgggaagagctttacagacattcaccaactattattttcccttgtttatctacttagatatctgtttaatcttactaagaaaactttcgcctcattacattaaaaaggaattttagagattgattgttttaaaaaaaaatacgcacattgtccaatccagtgattttaatcatacagtttgactgggcaaactttacagctgatagtgaatattttgctttatacaggaattgacactgatttggatttgtgcactctaatttttaacttattgatgctctattgtgcagtagcatttcatttaagataaggctcatatagtattacccaactagttggtaatgtgattatgtggtaccttggctttaggttttcattcgcacggaacaccttttggattgcgtactgcctggacaacaaatcgcgatgccgggtccttagtaacaga

SEQ ID NO: 569816 - DNA, 966 bp, Homo sapiens
  misc_feature (25)..(25): n is a, c, g, or t
tggcgttctagaggatcccagtgtncatgtatacataggcttttcaaaaaaatttttattcaaggcaaagcaaggaacatcttgagatatgtctcaagaatataaagatgtattattttaagccaaggagctgaaatatatctcagtttataaattcaggtatattctttttgtctccatggcaaccataacttttgaaccaaaaaaaattgtttttacatctttatgctgaaaatgtgtttagattaggaatatggtcgggctgaatttgctgttgctccctaaccaaatccacctcttgttttccttgtgagtccatggctaaatcaaagctgcccctgagaagagacttaatccaagcctgattgtactagtggcatcacttagaagtaggctttccctcttcctagtagatctcaatgttttataattccttaaaacagctgaaaattgggacaacatactttacgcaatgaacagtagttaaataggaaataaactagttccatgtaagtatacacctagagttttaattacctttataatgtttcttaaaagtgaaacttagatacaattgtgattggatacttagatactaagtgaaacttagtgtaacaattttgatctgttaaattggattttacatgtacatttgaatgccagaatttctaaataaatcccctggttaggaaattttaaaagtcaaagcttgttttcttcaaccactaccttctacattggttgacttagaccgtaagctttttaagtttctcattgtaatttaccttctcatgcagattgctgatgttttattaaaccttatttttacaaaaatgaaaaaaaaaaaaagaaaattgggcggcggcccaaaaatttaaaatgtgggggggccagtatgaagggtaggcagagaaggggaaggggggtcacaaaagaggggggggaaaaagggggggtggaaaagag

SEQ ID NO: 569817 - DNA, 492 bp, Homo sapiens
ctagagatctgtgcatggtcatgctgtatagtagtttttgggagtcaaggcaggcagatcacttgacgacaggagttcgagaccagcccagccttcacggcaaaacctagtctgtactaaaaatacaaaaattagtagggtgtggtgatgcgctcctataatcccaactactcgggaggttgaggtgggagaattgttggaacccaggaggcagaagttgcagtgaatggaggttgtgatgagctgggattgcaccattgtactccagcctgagcagcagagcaagactctgtctcaaaaaaaaaaaagaaaagaaaggaaagatcagtatcacccatttttgtcccggaatttaacagacaattttttaatagggaattaaaacggagtaagaacctcaagattcgtaagacagaaatgctattgaatttagacctccctacagtcaatctacgggttacctattataatttacgagtcagtttatcaaag

SEQ ID NO: 569818 - DNA, 1262 bp, Homo sapiens
  misc_feature (11)..(11): n is a, c, g, or t
  misc_feature (1070)..(1070): n is a, c, g, or t
  misc_feature (1073)..(1074): n is a, c, g, or t
  misc_feature (1079)..(1079): n is a, c, g, or t
agccattgtgnatgagaagatcttctgttgtcatggaggattgtcaccagacctgcaatctatggagcagattcggagaattatgagacctactgatgtccctgatacaggtttgctctgtgatttgctatggtctgatccagataaggatgtgcaaggctggggagaaaatgatcgtggtgtttcctttacttttggagctgatgtagtcagtaaatttctgaatcgtcatgatttagatttgatttgtcgagctcatcaggtggtggaagatggatatgaattttttgctaaacgacagttggtaaccttattttcagccccaaattactgtggcgagtttgataatgctggtggaatgatgagtgtggatgaaactttgatgtgttcatttcagatattgaaaccatctgaaaagaaagctaaataccagtatggtggactgaattctggacgtcctgtcactccacctcgaacagctaatccgccgaagaaaaggtgaagaaaggaattctgtaaagaaaccatcagatttgttaaggacatacttcataatatataagtgtgcactgtaaaaccatccagccatttgacaccctttatgatgtcacacctttaacttaaggagacgggtaaaggatcttaaatttttttctaatagaaagatgtgctacactgtattgtaataagtatactctgttatagtcaacaaagttaaatccaaattcaaaattatccattaaagttacatcttcatgtatcacaatttttaaagttgaaaagcatcccagttaaactagatgtgatagttaaaccagatgaaagcatgatgatccatctgtgtaatgtggttttagtgttgcttggttgtttaattattttgagcttgttttgtttttgtttgttttcactagaataatggcaaatacttctaatttttttccctaaacatttttaaaagtgaaatatgggaagagctttacagacattcaccaactattattttcccttgtttatctacttagatatctgtttaatcttactaagaaaactttcgcctcattaccttnggnntttanagattgattgtttagctgatgtgaatatgcgtcaaaggattgacggattggttggcactaattaacataggcgctaagtagagatactaaagaggatatgtatcctatggttgttttttagtggtgattattagaacattgtttatgtaacaagagtttaatattgggtgtagtacaaggggt

SEQ ID NO: 569819 - DNA, 226 bp, Homo sapiens
gatacccccagttcctgcttcgttgaaatcaattccatgatattagatactcctgaagttggggatgtctgctagagagccgcagtttcttgtggatcgagatgtatcaatctttttgccatgcactgtttacctagatccccaactacgggaaattattgctcgcatctggtttcagaaagccaggaacggggggtaccgacgctcgatcttcgtgctctgttgt

SEQ ID NO: 569820 - DNA, 543 bp, Homo sapiens
  misc_feature (6)..(6): n is a, c, g, or t
  misc_feature (9)..(9): n is a, c, g, or t
atcctnttnaatccaagcagtcggtcaccagacctgcaatctatggagcagattcggagaattatgagacctactgatgtccctgatacaggtttgctctgtgatttgctatggtctgatccagataaggatgtgcaaggctggggagaaaatgatcgtggtgtttcctttacttttggagctgatgtagtcagtaaatttctgaatcgtcatgatttagatttgatttgtcgagctcatcaggtggtggaagatggatatgaattttttgctaaacgacagttggtaaccttattttcagccccaaattactgtggcgagtttgataatgctggtggaatgatgagtgtggatgaaactttgatgtgttcatttcagatattgaaaccatctgaaaagaaagctaaataccagtatggtggactgaattctggacgtcctgtcactccacctcgaacagctaatccgccgaagaaaaggtgaagaagtgaatttgaaggtttttttttttgttgcgagttttgttgggtgaggaaaagcgaa

SEQ ID NO: 569821 - DNA, 696 bp, Homo sapiens
  misc_feature (56)..(56): n is a, c, g, or t
ggatagtctgtacgcctgcaggtaccggtctgtaatttcccgggacctactactantaaattcgcggccgcgtcgacctaccatagatgtgacatttttgaccttaatatcgtctttgaaaatgttaaattgagaaacctgttaacttacattttatgaattggcacattgtattacttactgcaagagatatttcattttcagcacagtgcaaaagttctttaaaatgcatatgtctttttttctaattccgttttgttttaaagcacattttaaatgtagttttctcatttagtaaaagttgtctaattgaaaaaaaaaaaaaaaaaaaaaaaaaaaaaaaaaaaaaaaaaaaaaaaaaaaaaaaaaaaaaaaaaaaacaaaaaaaaaaaaaaaaaaagagcaaaaaaacaacaaaaaaacaacaagagggcggggggggcacaaacgaaacaacccggagggggcgacaaaaacaagcaccacaacctcgtagaataaacgggggctccccaagaaaaagaggaacaaaaaaagacggcgggccgccagacaacccgccggaggacgacaaccagacaggacgataagtggaagaccaccatgagggggacatgagaaccacaacaaaaagcggcgagcacacaagcgaatgacaaccacacacgcgacaacgcgcagtaaaaatgcgcagat

SEQ ID NO: 569822 - DNA, 914 bp, Homo sapiens
gccggcctgaatttttccctggtgctcacgccgttcctgtgaagatggggctgtactcacgggctgttcgtccactgcagtgttggggttccgaagtaagggtcctgtgaccgattgctttgtctgaacaagcggggttctcgaatgtttccaggcgccttatggtgccccgatgtacaatctttgcttaactgaacccttttgtcttccagggtcaggtggccatccgcaggcttagttgtctaggaaggtttggacagagtccgcctggtgattcagacgttcccaggactttggcagcaaggaggagcaaggggaggccaggcgcggtggctcacgttgtaatcccagcactttgggaggccgaggcgggcggatacacgaggtcgaggagttccgagagccagcctggccagcatgggtgaaaccccgtcgtctactagaaatacggagaagcacaattagccgggtgtggtggcacatgccctgtagtcccacctacctgtgggaggctgaggcagggagaattgtttgacctggcaggcggaggcttgcagtgagccgagattgcgccacctgcactccagtctgggcgacagagcgagactctgtctcgagggaggaggagtcacaaagagctaccaggagtgtagtgagaatgggtttccggcgtgggcgtggtggctcacgctgtgaatcccagcacttgggagagctgaggttgggcggatcaccgaggtgcgaggagttgagaccagccttgccaacatagggtgaaacaccgtactactcgtccagggtgtggtggtgagcgcgccgtatgtgtctccgagctagtcaggaatcagaggcactagggtggcttggatcagtggctcgtgtgaggccagaggttactaagtccggttggcgac

SEQ ID NO: 569823 - DNA, 436 bp, Homo sapiens
tccgatagtgaataggtaggtgtaaacatttatagaacaattatcaaagctatattggacttaaatattggtcatgaatgtatgcacaccccataggtagctgccctccttgggcagctttagactcctatgccaaattttaaaataaaggccgtggccaggcgtggtggctcatgcctgtaatcccaacacttcaggagtccaaagcgggcggatcgcgaggtcaggagatcgagaccgtcctggctaacacggtgaaaccctgtctctactaaaaatacaaaaaaaaaattagatgggtgtggtggcatgtgcctgtaatcccagctacgggggagcctaaggcaggagaatcgcttgaaccagggaggtggaggttgcagtgagctgagatggcgccacggcactccagccggggtgacagagactctgtctc

SEQ ID NO: 569824 - DNA, 216 bp, Homo sapiens
agcaggtctggttcccagacttaggatgtcattaggtatagatagatgctctagcatgcgatcatctcgagctccttcatgaactctggctagaaatggtgtataccgaaaatttacttcctctctttcttcttcccactcatcctaaccctactcctaatcacataacctattcccccggaacaactcagtacacagtgtaggtctacctggggc

SEQ ID NO: 569825 - DNA, 348 bp, Homo sapiens
  misc_feature (6)..(6): n is a, c, g, or t
  misc_feature (9)..(9): n is a, c, g, or t
atcctnttnaatccaagcagtcggtcaccagacctgcaatctatggagcagattcggagaattatgagacctactgatgtccctgatacaggtttgctctgtgatttgctatggtctgatccagataaggatgtgcaaggctggggagaaaatgatcgtggtgtttcctttacttttggagctgatgtagtcagtaaatttctgaatcgtcatgatttagatttgatttgtcgagctcatcaggtatgaaatataaaactcttaagctttttcttttttctttcttttttttgggggcagacggaggggcagacagattcttgttctgtcacccaggctggagtgcaa

SEQ ID NO: 569826 - DNA, 359 bp, Homo sapiens
ccagatgtgcagagtataagcgcggttgcagtatactgagaagggtagtgggtgcatgagaagatgtggatggttaatgggtacaaaaaagttattaacagaaagagtgaataaggcccaatatttgatagcacaacagggtgactactgtcagtaataatttaattgtacatttaaaaataactaaaagaggccaggcatggtggctcaggcttgtaatctcagcacttggggaggccgaggcaggcagatcacttgaggtcagtagttcaagaccagcctggccaacatagtgaaaccctgtctctacaaaaatacaaaaattagccaagcgtggtggcgggcacctgtaatcccag

SEQ ID NO: 569827 - DNA, 1065 bp, Homo sapiens
actgtgcagcaccccgagactggagccatctcttcctcatatttcagcagtgcagcctgggggtgcagagaagtggcagtgcagtggtctgattgtggtgtctctttttatccttattcctcccccgacctaattgtctttgttctgtgattatttggggtgacacccggctccctccagacaatgccatgcataaatccatccatccaaaggcagagaaccaaaggggccatggaaggttctctgtgctcctcctacccttccagtgccctaggcctggcgactgccgctgccttttagacccgacctccccttttatacctgcatcttgttctactgagaaaagcctctccagcaatacatgtaatactagtcactaacctccgtctccgggacggagtgcctggacactgtaccgactttgatcgcattctacactgaggttgcattcatatcgcctgagttgcttctacttctctatacaaaatgattttgcagagattaacagaacgtcccttatgttattctcttcctcatccaccgccactggggcctgtacactgatggtggctactggtgtgacgtttgctttgtactgagggtagaagtgaggaagacaatatgtattcattgttccttagcacaagccacgtgaacttgggaccacagctctgtgactacacacttatcacttcatagctccaacaagactggttataacctgcgggtattggaaaccctctctgactaccaatggcagaaggccttattgaaaaggttgacggctgtggcaccatttggggccacgacccggaactacggaccgtactgcgcgacgccaaggcacatcgcggcgagcgagagtcggatgaataccagggggctgcgacgagtgcacaccggacactaacgcaaggaaaagaggaaacaagaacacgagaagagagtaaaagggacaagacacatagagcaatgagcgatagctgacatacccagagagtgagtgaaaagccatataagagcatcgacaaataatgctgccgtcacttgctcgtctcgcggcag

SEQ ID NO: 569828 - DNA, 706 bp, Homo sapiens
  misc_feature (50)..(50): n is a, c, g, or t
  misc_feature (222)..(222): n is a, c, g, or t
  misc_feature (248)..(248): n is a, c, g, or t
  misc_feature (299)..(299): n is a, c, g, or t
  misc_feature (303)..(303): n is a, c, g, or t
  misc_feature (366)..(366): n is a, c, g, or t
  misc_feature (383)..(383): n is a, c, g, or t
  misc_feature (420)..(421): n is a, c, g, or t
  misc_feature (458)..(458): n is a, c, g, or t
  misc_feature (494)..(494): n is a, c, g, or t
atcggcgctgtagagcaggttaacggtaacttgaatcgacgggtccgctngtcacgggtccggtgattacctggacggaaacatacatcaactttaaccacccagatcgtttggtcttgtgtttattggccatcaactctttgcgccaacccccgatttagtatactacacttcaatgataatatccctctccctcccttgttctgggaaagaattgtaggntgtgcccggattacgctattttcaantttcaaatctgactgtggaacttaaccacaacaattcttctatccctaggncttncaccatcaccactaagatccctaacattacgcttaggctaaccattagcaatccgttcgtttntaacatggcatatatcntcatcgctttggccccttcgaagatggccccatcggnnatcatcttcccaacgcagtcgcctattttcacaactnctttgtgccccattttcccgcctctacatcctactnccacatctactcggacccgtcaattcaagaattgccgttaacagctgtatacctactctcaggcggccgcacgtgctagctacatgtgggcccttaacgcccatatgagtgacgataatcttaactcaggccgacgaaaatcttcgacgagtcagggttcttccaggagtttttcttctttttttttttttttttgtttttatctttttctt

SEQ ID NO: 569829 - DNA, 1104 bp, Homo sapiens
agaatagctgattgctgccgtggtgtagtgctgtggggaaaggaggataggattcgtaaaccccggaagcggaaggttctgctataccacgtaagtggcgcatgttcgtgcctatagatcgcgcactgagtgctgacgtcatccagtccggtcagttgttctagaatcagagtacgcagaaccttgcaatctcgagggaacctatgagctggggatatatgaaagggaagagtcgtaactatacttcaaagcatgccaccaagataatagtcgagtaccaaggcataatacaagtagagaatttcgattatgcactagtgagaaattgacaagaaatttgcaagagatatcatagtaattctattggtatatagatgagaatagtgtcacaatgaaatatcaacttgcagtgtatgcatactttctaggacgtgagtcaataggaaagtttggcgtagagtaaactgcaatatctcacaataatgcaatctggcgtaaattagggtatgagtaaacagatacgaaattgttgaatatagagcgattataatccaagagaaaacgagaaggcggggggggtcattctcatacctaggtgttcatgtatattttcctttctttctaattttctcttcttcctctttttcctcctctatatccttggttgtttattcttgtttaaaccaaagttagttcatttttggtaaatgtagggtgttctaaaaaatggaagttgatagatgtggctaccccagtctccttttgaaagcatctggtatgttgaactcctaggtgctcatttatctcattatcagttcgccattcacttggtgctggattcttggggtgatcaacgccgtacgagttcccccttcttattaccctcttactttttcactcttgtaactgtgtgcaccaagataggtcgacctatttatctagggaaaattgccgttgtacaagcgctagtcgggtgctcaagataaagatcgaccggggcaggtgtacactaatttgacttgccaattggccgtaaatgttccatgcctggtaatacacttcaccccccggactgggcttcacggggagaagggaagctcggaa

SEQ ID NO: 569830 - DNA, 250 bp, Homo sapiens
gtatgctgcaggattcagtgcaggtactatgattcggcgctgagagcaggttaacggcaattcaatgaattgccgttaacagctgtatacctactctcaggcggccgcacgtgctagctacatgtgggcccttaacgcccatatgagtgacgataatcttaactcaggccgacgaaaatcttcgacgagtcagggttcttccaggagtttttcttctttttttttttttttttgtttttatctttttctt

SEQ ID NO: 569831 - DNA, 606 bp, Homo sapiens
  misc_feature (13)..(13): n is a, c, g, or t
  misc_feature (18)..(18): n is a, c, g, or t
actcgtcgaaganatcgncggcctgagttaagattaacgtcactcatatgggcgttaagggcccacatgtagctagcacgtgcgaccgcctgagagtaggtatacagctgttaacggcaacttgaattgacgggtccgcttgaattgacgggtccgcggaggcaggctcgtttaagtccttcccaggggaatgatatgcaatgaatttcaaacgaaataagcatttggaattactcagcagaaacccgaggggggagaggcatggcattgcgaaaagtgcagctaagcagcgagcaagtagcaagacccaaaagtacgaggagtaaatgtgggagttcactcaggttcggggtagcaagctagagattacaatcattgtgcattatgtttggcatggtcctttccatacggacccgtcaattcaattgccgttaacagctgtatacctactctcaggcggccgcacgtgctagctacatgtgggcccttaacgcccatatgagtgacgataatcttaactcaggccgacgaaaatcttcgacgagtcagggttcttccaggagtttttcttctttttttttttttttttgtttttatctttttctt

SEQ ID NO: 569832 - DNA, 399 bp, Homo sapiens
  misc_feature (13)..(13): n is a, c, g, or t
  misc_feature (18)..(18): n is a, c, g, or t
  misc_feature (162)..(162): n is a, c, g, or t
  misc_feature (164)..(167): n is a, c, g, or t
  misc_feature (169)..(169): n is a, c, g, or t
  misc_feature (197)..(197): n is a, c, g, or t
actcgtcgaaganatcgncggcctgagttaagattaacgtcactcatatgggcgttaagggcccacatgtagctagcacgtgcgaccgcctgagagtaggtatacagctgttaacggcaacttgaattgacgggtccgcttgaattgacgggtccgcgatangnnnncntgatattataattgatagctaggtccantgtgcattacggacccgtcaattgccgttaacagctgtatacctactctcaggcggccgcacgtgctagctacatgtgggcccttaacgcccatatgagtgacgataatcttaactcaggccgacgaaaatcttcgacgagtcagggttcttccaggagtttttcttctttttttttttttttttgtttttatctttttctt

SEQ ID NO: 569833 - DNA, 442 bp, Homo sapiens
  misc_feature (21)..(21): n is a, c, g, or t
  misc_feature (244)..(244): n is a, c, g, or t
ttggggtttgggggggggagngcgtgggcccccaaccttttccccctttggggcttttttaaaaccccccaagggggcccggggaaagggggtttttttaaccccccccggggaaaaatttgtatttaaagggggttttgggcccccaccccaaacccgggggggggggggggggggtttccccccccccccttttttgggctggggaaagacaccccccctttgggaagggggtcaggtttgnctttccctttcccgggtttttgggggggcccccccccccccccttttttttaaccccctttggtttggttggggggggttttcggggggtttttttgggggggtggggtttttccccccttttttgggtttccaaagaggggggggcccccgcaattttttgatgggcccttttttaaaaatttttttccctttttga

SEQ ID NO: 569834 - DNA, 404 bp, Homo sapiens
  misc_feature (8)..(8): n is a, c, g, or t
  misc_feature (11)..(11): n is a, c, g, or t
  misc_feature (21)..(21): n is a, c, g, or t
ttcggcgnctnagagcaggtnacggcaacttgaattgacgggtcggttgccatgggagcgggcccgggtagttgccgtcgctggagctgtacaaggaggatgaagctttataactttagtgttcaatagttggccgttgaggtgttgggatcctagatgttctgctgaagttctatgggactgacggacccgtcatttattagcggacccgtcatttcaagaattgccgttaacagctgtatacctactctcaggcggccgcacgtgctagctacatgtgggcccttaacgcccatatgagtgacgataatcttaactcaggccgacgaaaatcttcgacgagtcagggttcttccaggagtttttcttctttttttttttttttttgtttttatctttttctt

SEQ ID NO: 569835 - DNA, 182 bp, Homo sapiens
ctatgaatgttactgggactgggacaaccgaattataccagttgaaaagaattctcgcgtagaaccagaaaggtactgattccgtaaaggtaagtagtttacgtacagagaacttaatgactctgttatacttgtacttgttcagttaagatcgagtactcatgacctagtaactatacgga

SEQ ID NO: 569836 - DNA, 1289 bp, Homo sapiens
actcaaagttagggtgcgggtacattacctggagtatcgggaggtgccccagagttcgtcctcgcatattattgaatttccatgtggggtccgaagagccctagttcatgaaagcatcaaaggaagaaagtacgtaggaggtttataggcgcaaaagctgaacgatagcgacatgttcctagttccgtttccatccgtggtagcaaggatgcttgtgtgacacgcatgtggaagagagagtcgctagggccacgagattgatgaccagctaaatgagtgctcaacgtgtcaatggaccgaggtgagaagccttgcgagtttgtcatagtctcatgacgaactgtctcccattattcgtgaggatgcaaagtctcacggatcatgttgtacttaccccctatgtacgctctgaaacgcagggcaacgtcaaacggttcatagtgtaagtggtagaggcccacggtagggggctctgaaggacaccgtaaggtgttcttttgcgattatctttgtccccataagtgggtggataggtagaagattgaaccgtagtttggtcaagtcattattcttagaatcgctgtagacctgtggcatatgagcaagggtaagttaagctctgcagcagtggttaaacctagatgacactacttcaggtccgacaacattggtattgctacctttttatgctgggcttgtaaggacgtacaccagttcttgcataatcgtttgtccagaacatacaatcgtgcacatcttgccttggcttgccccctatacttttcctgtgggcatcccacgttctaaacaagggggctcagtggtggggcaaatacgctaaattgacgaggccatcttactgagccgagaaagaagagcaccgtgggttagccctataaaccttccacgccggttaacattgcggggcacacacagatccggacgtggctgccacaccgcgaggctcacatacgccctgtgaccaccgaatataggctacatagggagccccggaacaacagcacgcgaacccacacgggcgtagaggcacagcctggctggcacacaaggcaagacaacacctagcacgctgaaccaggaagaagacaacggccacagacaccccggcccaaccgcaacacagacacacaccgaaagaccacaccgacgaaccacgcgcggcggcgcgcacacatgaccggcgccgcccaaccgcacacaacacaagcgagcacagacagccacaacacagggcgcaaaaaagaggaggcgcgcgagcaaacaaaccg

SEQ ID NO: 569837 - DNA, 406 bp, Homo sapiens
  misc_feature (8)..(8): n is a, c, g, or t
  misc_feature (11)..(11): n is a, c, g, or t
  misc_feature (21)..(21): n is a, c, g, or t
ttcggcgnctnagagcaggtnacggcaacttgaattgacgggtccgggtccttatgcctgttagagatgtgccggttaaactacactgcccatgtgggcagtatatctttattcccgttagatatctgcctgttagacatactgcccatgtggctttcaatcgttcgatagctgatgctgtagagagcggacccgtcaattcaagcggacccgtcaattcaagaattgccgttaacagctgtatacctactctcaggcggccgcacgtgctagctacatgtgggcccttaacgcccatatgagtgacgataatcttaactcaggccgacgaaaatcttcgacgagtcagggttcttccaggagtttttcttctttttttttttttttttgtttttatctttttctt

SEQ ID NO: 569838 - DNA, 1027 bp, Homo sapiens
agttagtgttgggcccggcggggcggcggtggttccccgggctgcgcgtgtccggggtctgctgtgcagttggtgcgaccggagcagctcccgtctatcggacacctcaggcatctggtcattgttcagtgcgatacatctagttgcctttcccgatggcgcgtgaccgtgatgcctgtcatgcgctgtgacattgctaggccgtgcagagtggtgcttggggactggtcgccgtggatctagtagttctggcctgtgagttgccacgtgacccttggatcgtgtactcgcgctcgacatgcgtagtctcgggtggtcttcaacgcgtgagacttgcctctcattccttaggagcagagccgagcaatcctggaggcgtgttttgccagtgttttctcaggtcacggtgattggcgccttcgcgtgccacgaggttatgggcacttcggatgtttctaccgtcaccctgtgttgtgtgcgtgtgcgtacaaagagaaggcaatgtgaatgtcttacgggaagcctggactggacgagagggtagtgcagggttcaacgactggccccaagagaagaactggggacgatggtgccacttgcggcccaggaaaaagctgcttccgaaaatagttttccccaaaaacattaccgccaaacaagtgaaggctggcatcgaaggcgtgggcaaccaaacggggaagacattggcacctcacagagaccatcaaggcttaacgattcggtgcgaagctaaagacatggttggttgaggggacataacagttcttacatccccgtgcttcacggggctacgtgcaaaagcaacccacggggggttgacaacatgcggggaaaaggtctctaatatcaaaacccataaatattccttggcaaggccaattggccatatggaccgttcccaatttaaacagaatgttattacaagttttgacgattggaccccaacttaaaccatggtccacagataatagcacaggagtgtgttacccttcctagcgggggaaaa

SEQ ID NO: 569839 - DNA, 376 bp, Homo sapiens
  misc_feature (50)..(50): n is a, c, g, or t
atcggcgctgtagagcaggttaacggtaacttgaatcgacgggtccgctngtccctagaacttcagcagatctctaggttcccaacacctcaatcggcaactttgaacacgaaagttataatagcatcatcctccttgtacagctccagcggcggtacctcccgggcccgcgccccggacccgtcaattcaagaattgccgttaacagctgtatacctactctcaggcggccgcacgtgctagctacatgtgggcccttaacgcccatatgagtgacgataatcttaactcaggccgacgaaaatcttcgacgagtcagggttcttccaggagtttttcttctttttttttttttttttgtttttatctttttctt

SEQ ID NO: 569840 - DNA, 114 bp, Homo sapiens
acccaggctcctctacacgggactatgaagcaccgcccggtcctttgagttttaagctgtggctcgtaatgttctggcgagcagtatttgttgatttaactgttgaggtttagg

SEQ ID NO: 569841 - DNA, 326 bp, Homo sapiens
gtaactgacgggtccgcttgatttgacgggtcgaaataggacggttcatcgtcggatacagtacgacaacgttccaccgtcaaacgtacaagtaactagttttctaacaaggctttagctatcgcacacggacccgtcaaatcaattgccgttaacagctgtatacctactctcaggcggccgcacgtgctagctacatgtgggcccttaacgcccatatgagtgacgataatcttaactcaggccgacgaaaatcttcgacgagtcagggttcttccaggagtttttcttctttttttttttttttttgtttttatctttttctt

SEQ ID NO: 569842 - DNA, 1154 bp, Homo sapiens
gcagtaccctctctgaggcagcatagcatcagaagccggagtcgtcggatgtttgtgttgcccgacagcatgagctacacagtgctttgtccaggcatctgaaaacacttatgcatgtcgacatactcggataccagacgctcagcaccagctgtgatatatggatatgtgaactatggaactctggaaacaaatacgaggctacgagggcatatggcatattggatagtggcataatgagacagagagtaacagcacgcaagctatcgaggatatggtataggacaaataagagaaataattgagagaaagtgagataagatacatgacagaaaatgaaaaacaagaagctgcacatacgaggatagacagaccaagaagtacaagaaaatatacacgatatataaaaccaagaaataaagcaaaagaaaagataaagaacaagagacaagggcaacagaaattaaagagaagaaccaggaagatataaatagcagagtgtgaagcgagcatatagagagacaagaaggaccaaaaaaaaaaaaaaaaaaaaaaacaaaacaagaaaaaaaaaaaaaaacaaaggaagacagacaaacagaaaaagaaccaaaagaaaaaaaaagaacaggaactaaacacgaaaaaaacaagaaaccaaacagcaagaaagagaagcaaaacaagaagccaggaaggcacacgaaaaaagaacagaacgaagacacgacacagagcaaagaacaaacgcgactcagaaacaagataagaggacagagacagagacgccagagtagcaagacgacaagcagagacagagcagaaaaagcagcgacaagagaaccagcacgtgagaaagaagagacacacagagacaagacggcgcgaccgaaaaacgacagacaaaaacaaaggaaaagacagagaaacaagagcaagcagcaaagacatgggcagaacaaggaacgaagaagacagccagaagaggagaaaaaaaaaaaagccaggagcaggaagcgaaagaagcagagaaacagagaagaccaccaacaacagggagagaggcaaagacagaggcaaaggacacgaggaaaagagaaagaagagaagcgaacacgggacacgacacgcaacaccgcatgccaaaaagcaaa

SEQ ID NO: 569843 - DNA, 1882 bp, Homo sapiens
  misc_feature (316)..(316): n is a, c, g, or t
  misc_feature (464)..(464): n is a, c, g, or t
  misc_feature (628)..(628): n is a, c, g, or t
  misc_feature (856)..(856): n is a, c, g, or t
taacgctgattagtccctacacactattcatcctttggctgaacctagagggacttacgtcagaggacccttccatgtacctaccatgatagctagcaaatgccatagaacgaggcggtcgtcgagcggatctagtcgtagctggctagtcagttatgtgcgagaaggcatgtgcatggcgtgagtgcacgctcgacagtagttgtggcgacaccaaaatagccaaagactttcccaacacgtctatctgctcgaaaaacattcgaattcccccgatggatatgagctcgagacggtgtgggcctatgctatgccncgaagtatacagctagcttgtgcatgcgcacactctcatccgacagaccactaatgggcgtcttgcatgtttggcagacactctcgacgcaacatcggagatccgatggtaacgcccgcaggcagactcacaagtgcaaagcaatgantcacaggaaggcatttgttggagcaacgtcttatggatgtttgtcaagtctctcaggaccgcttgtagccccacgtaacctgagaaggagtatgtttaaggcacacgcaatcgctttggataggggcgcttagtccccccgtgttaaacaccgcgccacagggntgacctttttcaactacactacaacacggtggccacttcaaaatggttctatcctacgccccatttgtgggccaaggttatcgcatagggcagagccacgtacaatttttccaggcaaacttagacaacccaaacttccatattacgttaaacgagaatggaagggttaaacgccacggtggaggctggagaactctcgcgaattatgtgtaggacttggagaaacgnacattccaaataccactgctatgccgcgagcgagttctgaatggggcgtgggttgcccctttcattcttagagtgcctctccccatacaaattcctcccaagtaaatgtcgacagaaaagaatcccctttcgatgtggaaacaccagcctaattacgctcgctttttctataccttctacattatgtgggaactattcgatcccgcaagggacctaggaagaaggcacactcgcggtatccaacgcttttactcaagaagacgggcccgtagagggtagcacaaagctttattaccattggaacaacctttgcccaataggagaacggcggggacagggtgtgggccgccattaggtttacaacaaggggtcgaccatctccccttggtttggcccgttccaagtgtcttgcgaagaacacgaatttatatatcgccatggattacgtaatcgaacccgcaaagggggttaacaacagggcaagattcgttggagcgctccctatgggaacttgtggaaccccctttattcttggaatttagaggaagaaaccgtttggacaccagaaacgaaagagttcggttgccttggcaagagggcacgaaggaccactattgtgggtcagatggcccgcgatatggtcctcggaaaaggaattcacatctttggcagattcagggccgcgcacacaggaaaagcgcagcaggttggtcttcacaaagtgggggccttctggttacccaagtggattcccgggtggagatacttttttacagggatagacccccttcttggctttcccccaaggaaaacccgcccaaggacaatgttagagacctgcttggttcacgagcgaaccgccacgttttcaagacatgggtcgccgtagaaaacattcaggccacagggattctgcgcgggcatctgtgatggaaacgatataatgcggtatagtgtgttaatacaccacagaacccgcaatctttgtgatagtacaaaacacctgagagtaatgtataaaacagg

SEQ ID NO: 569844 - DNA, 159 bp, Homo sapiens
cccacagagtgtaggatcgtcactgccccccatggtgccatatgtgctactaagtggggtgcacattaaatgctggacaacttgcttaacttatttatatgtggtctgcatggagcacactattcctgcttttagcacagcactcatataatttttttt

SEQ ID NO: 569845 - DNA, 463 bp, Homo sapiens
  misc_feature (13)..(13): n is a, c, g, or t
  misc_feature (18)..(18): n is a, c, g, or t
  misc_feature (460)..(460): n is a, c, g, or t
actcgtcgaaganatcgncggcctgagttaagattaacgtcactcatatgggcgttaagggcccacatgtagctagcacgtgcgaccgcctgagagtaggtatacagctgttaacggcaacttgaattgacgggtccgcttgaattgacgggtccgcggaggcaggctcgtttaagtccttcccaggggaatgatatgcaatgaatttcaaacgaaataagcatttggaattactcagcagaaacccgaggggggagaggcatggcattgcgaaaagtgcagctaagcagcgagcaagtagcaagacccaaaagtacgaggagtaaatgtgggagttcactcaggttcggggtagcaagctagagattacaatcattgtgcattatgtttggcatggtcctttccatacggacccgtcaattcaagttgccgttaacctgctctcagcgccagatcatantac

SEQ ID NO: 569846 - DNA, 390 bp, Homo sapiens
  misc_feature (13)..(13): n is a, c, g, or t
  misc_feature (18)..(18): n is a, c, g, or t
  misc_feature (387)..(387): n is a, c, g, or t
actcgtcgaaganatcgncggcctgagttaagattaacgtcactcatatgggcgttaagggcccacatgtagctagcacgtgcgaccgcctgagagtaggtatacagctgttaacggcaacttgaattgacgggtaccggagaagcgcccacggcggtcaggtgtggccacgggtaccctccacgaccgggcgtgcgcgccggccaactccaactgagcggcctcggcggcaaacgagcgtgcccccgtcacgcgctcgagaatggtcccgtttgtaggagttcatacacagggctgggcgttgctatgatggattcacaggaggtgaaccgatgcggacccgtcaattcaagttgccgttaacctgctctcagcgccagatcatantac

SEQ ID NO: 569847 - DNA, 266 bp, Homo sapiens
tccattaggtgcatgagtaggtggctgcagtactgttagcggttaggcgtacggcagggttattggttgaatgagtaggctgatggtttcgatcataactagtatggggctaaggggtgtaggtgtgccttgtggtaagaagtgggctagggcacataaggcacactgcaaacgtttccggcttcagtcatgcaggcaaggctctggaatagcgtagccctcggttcaaatcccagctctgtaacttataagctttgtgacctcag

SEQ ID NO: 569848 - DNA, 310 bp, Homo sapiens
cagtgaggctgaggcgggagaatctcttgaacctgggaggctgaggttgcggcgagccgggattgtgccactgcagtccagtcctgggtgtcacagtgacactctgtctcaaaaaaaaaaaaaaaaaaaaacccttttaaaattttggtgttttcacaaagccctaatttcccttcctttgacccctttgaatttggacactctgctgcttttatttttttcattccttttactgaagtaccactccaccatatagccccggttttcccttatattcagtgacactggtccagtcgctgtaaagagctct

SEQ ID NO: 569849 - DNA, 156 bp, Homo sapiens
gtaccctacactcctcttatcatctgtgcttcaaatttattcccaaaatataccagcttgtcaatgcactgtgaggtagttaggttgtgcttcatctctgagtgcttaatgtatctcatttcggtagcagaataagcttagggaaaactaaatctc

SEQ ID NO: 569850 - DNA, 1041 bp, Homo sapiens
  misc_feature (90)..(91): n is a, c, g, or t
  misc_feature (103)..(103): n is a, c, g, or t
  misc_feature (109)..(110): n is a, c, g, or t
  misc_feature (114)..(114): n is a, c, g, or t
  misc_feature (121)..(121): n is a, c, g, or t
  misc_feature (127)..(127): n is a, c, g, or t
  misc_feature (134)..(134): n is a, c, g, or t
  misc_feature (142)..(142): n is a, c, g, or t
  misc_feature (150)..(151): n is a, c, g, or t
  misc_feature (159)..(159): n is a, c, g, or t
  misc_feature (199)..(200): n is a, c, g, or t
  misc_feature (213)..(213): n is a, c, g, or t
  misc_feature (215)..(215): n is a, c, g, or t
ctgaccaaagaggaaagattgaatcctaaaggggatccttgcccccatgggaggccccctactagaaggacgtgaaagcagctttggggnnaactgaggcagngggcgnngacngagcagnatgagncctcacnctggctgngggtccanncacaggcngtatctgcagagggtcccagaggaacgctggagccaagannaagccctgggaangnagcgggtgcgggaacgacgatgcatgtgagggatgggacaatgatgtgtaaatgcaccctgtacaacaggagcgcaatggccattgggattcggaaaaggaaaatggaaaactaagaagaaggtcggaccgggccattgggtgagattcatgccatgtaaaaccaacagccagatgagggaggccggaggatgggacgggatcaaacctgaggatcagcgagtacgggacggacaacgtggcaaaacacccaggtctccagctaagcgaaagcggcatgactcatagcaaggaatttacaacaaaatctagcagggcactgcacgcggcagtggagagataaaacccagggctcactcgggaagcgcccacgaacgtggtgagcaatggattgaacccgcggaggtgccaagcaggaggcgagagcgaggacaggcgaaacagacactacacaacagggagaacaaagaagagaccccaactcaacaagacggaaccaaacaagggaaagtacgcacgacggtggaaaatggaagaaagcgagcagacaagaaaacgaacagcatgagcaaacaacagtacagccgagatctgcacggccggaagaaccagaccaagcaacgacgggaagacagcgagagcacgcgagcacgcaacgaaacgcgagaccccccaaggcagccacaagaggacagagacaacgacccggggcaacggaagaacgaaatagaagcagggaaagaagagaaataaaaaaaccaggaagcgaccagaccggaagacaacagacgaactaagtaatacatcgaacgcagcaccagccacga

SEQ ID NO: 569851 - DNA, 353 bp, Homo sapiens
ttgaatcctcctcctcctctccctggtggtaggagagatgagagatggagagaggcaaggaaggggggaaaataacattggtatatattatcttattacatacattgtctcattacagcctcacacaagaatcctatagggagatataacttgtatttgcaaataaaaaaggctcagataaattaaatcactcatctaggcttacacagttaatatggcagagctgaggttgaaatccagttctgcctggcataggttctctccaccccactctagtagtggagaggaggtgaaggaagaagtcaaggagaattatccaagcacctgccacaggctcctccctccatttttag

SEQ ID NO: 569852 - DNA, 663 bp, Homo sapiens
  misc_feature (90)..(91): n is a, c, g, or t
  misc_feature (103)..(103): n is a, c, g, or t
  misc_feature (109)..(110): n is a, c, g, or t
  misc_feature (114)..(114): n is a, c, g, or t
  misc_feature (121)..(121): n is a, c, g, or t
  misc_feature (127)..(127): n is a, c, g, or t
  misc_feature (134)..(134): n is a, c, g, or t
  misc_feature (142)..(142): n is a, c, g, or t
  misc_feature (150)..(151): n is a, c, g, or t
  misc_feature (159)..(159): n is a, c, g, or t
  misc_feature (199)..(200): n is a, c, g, or t
  misc_feature (213)..(213): n is a, c, g, or t
  misc_feature (215)..(215): n is a, c, g, or t
ctgaccaaagaggaaagattgaatcctaaaggggatccttgcccccatgggaggccccctactagaaggacgtgaaagcagctttggggnnaactgaggcagngggcgnngacngagcagnatgagncctcacnctggctgngggtccanncacaggcngtatctgcagagggtcccagaggaacgctggagccaagannaagccctgggaangnagcgggtgagtggcaatcgtaccaatgtcattagtgcacgggattgggctaccgagcttggattgatgattgtgattgacagcctggtaacacaagagatggcggctatggaccaatgaggtctttgtgacaagacggagaatgcgaaacacttagaaggaagggtcggcacgggcgttggtggcttaaagctcgtgtaaccccatgcacgtttggagaaggccgatgtgtggagcgcgatcaacctgacggtcagtgatgttcggcgaccagcgctgggcaagagcaccctcatctcgtactaagtcgaaaagccatctctactaaaattaccaaaattagctgggcatggttgcgcatgcctgtaatcccagctactttggaggctgaggtggggagaactgttgcaactggaggtggcggtgctgtgagccacggcgcgagatgc

SEQ ID NO: 569853 - DNA, 146 bp, Homo sapiens
tcaggtagcactccttcttgttgctggggcgtgctccagctcctctacaagccgtgctggtctctgggctgggagtgaagccgctcatcggcagacacacgcataggaggcctgagggttcttgcagggcccatggggtatgcaca

SEQ ID NO: 569854 - DNA, 430 bp, Homo sapiens
tactggtagagatgccaccaaaaatcttacaatgcacaagacagctccctacaacaaagaattatccaacctcaaaggtcaatagaactgagattgagaaatcatgtgttaaatcaagactgtgatgttgttaagcttctgtataaattctagttgagaaatacctttgtggtaacttttaaaattacaattgtttcaaggaaaacaactaatttaggcttatttactatttcaaaataataacttcttatttgcttagcattttatcgttaaaaaaaattttttttaaatacagacaggacctctctatgctgcccaggctgatattgaactcctgggctcaagtgatcctcctgcctcgggctcccacaatgctgggattataggcatgaaacaccatacctggccttttctttttattttcttttag

SEQ ID NO: 569855 - DNA, 225 bp, Homo sapiens
  misc_feature (212)..(212): n is a, c, g, or t
  misc_feature (220)..(220): n is a, c, g, or t
ccccatcagcttagctcctcttataatgagacatacgatgttggttttccattcctgagttacttcacttagaataatggtctccaaatccatccagggtgctgtgaatgccattatttcgttcctggctgagtagtattccagtggtacgtatagtctacaccacatatttctttatccactgtgtggactgtatgggacgcaacgatggnggggatcnctcta

SEQ ID NO: 569856 - DNA, 372 bp, Homo sapiens
  misc_feature (70)..(70): n is a, c, g, or t
gatggggagagggggtctcaccaggtgggccaggctgggtctcgagctcccaagttggtgatccaccggnctcggcctcccaaggggtggggatgacaggcatgaaggataaggttatttctacccatcaggggcactggcccttaatccgagtcattggggagcccccttctcggtctcggggcctggctaaataagttatatgcatcctggagggctgagaaggagggaagggagagtcggcaaggggatttttagtcttcacccaaggcagaggcagttttgagttctgtggacagcagaagcttcagtgcttggatgtatctatgagtgggccagagttgcagatgaccaggtctggggacagacaga

SEQ ID NO: 569857 - DNA, 537 bp, Homo sapiens
ctccgggatgtgatcaggggtttaaaatagaagtgaattttacagaagatatttggtgcttgatggcaaaatagtttggaaagtccatattctccaggggaagaaaaaggagataaacaaggagaatgaggaagagaagtaaattcgggaactatctatgcccaaataagtgaaaaataataaaactcgggactccaatactaggacatacactaaaagcttatgtgtccagaggaaagctaataaaatcaaacacagaagcaagaacagatgtatgttcggtgaagagctatgtaagttttagatatttacctccggtaatacactactctacggggcacagtaggtgctcaataaatacgggtttggataattataatccaagttttttctctcttatactggagtccttcctggcttatcttggtactagcacggagcctaggggtacttcaatcaatcctggtaaaacagaacaagattggaatcttcttcagaacaagcccaagcagtcacaagcggtatttccagggaatc

SEQ ID NO: 569858 - DNA, 312 bp, Homo sapiens
  misc_feature (6)..(6): n is a, c, g, or t
  misc_feature (57)..(57): n is a, c, g, or t
cacgangacaattatgaaatcctgtgactgaaagtcccctcgatttcactctgtggngcgcatgcgcccgcccacggaaactctggcatggaaacataaactcccgcaaaccagtgctacccagaagcaccaacacgtgtgttctccattccaccaatcacagaccagtatctactccaaacatccagtaacgaaaactatggcatcttcccaggaacagcaaggcaggcttcttactcacgatgaaccagcacgaataaacccagcaaaaagagaactgcatacttaaatttaggatagtcattcatgagg

SEQ ID NO: 569859 - DNA, 193 bp, Homo sapiens
ctcaagcatgcctctgtttgatagctccaagtttaatttcaaattcaaatccagactatggtactttagcatgactcagtatgtgtcattttgcgtgcctgtagtcccagctaccaaggaggctgaggcaggagaatcgcttgaacttggaagatggaggtttacagtgagccaagatcgtgccattgcactc

SEQ ID NO: 569860 - DNA, 950 bp, Homo sapiens
  misc_feature (280)..(280): n is a, c, g, or t
  misc_feature (721)..(721): n is a, c, g, or t
ggctcactcttgctagaaacctactgtgtgacaatgtcttcttggtctatgacggatgatgaggggaaccacaacgaaattgcaccagatgatggccggcatggagagggctcgcttgacgcacccacaggactgtcggagggcgcctccgtattgctctcacatgcacagctagactcatggcttctccggtcgcactatccttggcttgtttaaggcccgagtcagtgtttgctgcggtcgtgtgtctcatctcgcttatgacctgtggcgtgcgttnttgtggtcagctcccagctaccagatagctcgccacgctactaggacgattgcgggtcgccgtgcgcgtgcgctatctcgttgggcacacttggcgatagctccgtcgattggtcgacgcggcccaagcgtcgagttgcttatttgcgcgatacatggagtgcgggtcgttgctccccgttgcgtattgagaccataccttgacaatttagcgtgaggcgggcgctgtgtccctgggtgcacgcgcttcgtctgtagctcgtggtgacttgatgtctccaactgcagggccagcttctgcgactcttcttctcgtagttcacgccccgtgtactcatcgaggccgcttcgtgctgctttacatgacgagttgcccccatagtggtgcgaccgtggttcgcgttgcctttcatgtgtcttgtgcctcggacgttgctcctangtctagagcataatgtgacttggacgtagcgtgccgtcttcgtctcacaggtaccttcggtgccagcccggatggtcgtgtcgctgtccgctctctcattgatcgcctgttccattatggggcgctgtgtgctccacgggcgtgagaccgtcctcactcctgaccagggaatggaagtccgcgttgtccccagggcttgaactgtcgtctggcgttgtcgttgaaccgg

SEQ ID NO: 569861 - DNA, 595 bp, Homo sapiens
gagctgcaggagcttttattttattttatttttccatatcccagtggcacctggaacgccagcgagacagaactgttcactcccctggaaagggggcctgaagccagggagccaagtggtctggctcggcggttcccacccccatggagcccaggaaagtaagatccactggtttgaaattctcgcttccagcacagcagcaatctgagatccacctgggacggtggcgcttggtagggggaggggcgtccgccgttgctgaggcttgagcaggcggttttaccaccacagtgtaagcaaagctgctgggaagttcaaactgggtggagcccattgcagctcagcaaggctgccgtgttcagactgcgagattgctcctccctggacagggcatctctgtaaaaaaggcagcagcccagtcaggcttgtagcagacttaaacgtccctgcctgatggctctgaagacagcagcggatctcccaacacaagatgcgagccttgctaaggccagacttgcttctaaggggatccctgacccctgtgtatactgactgggagacaccttccaattggggcttgacgacaccttatacc

SEQ ID NO: 569862 - DNA, 433 bp, Homo sapiens
acacaaagagctaaaggagaaacagagactcgtcaacacttaattagcagctaagtactcaaaaagagcctcagttctgtctttaaatagcacagtggcccctacacagtgcacaggacaaccctgttgcagacagcttggagtgtgcaggaagcctgcagccgtagtgggcagcagaggggagtgttttaagtacttgcacctggagcttaaaatccgactccaccacttacaatgtagtctcatcctcagttttcttcttaataaaatggggacaataatgaccaactgaccgagataatacacatggaacaatttaccctgtggctggcactgagtggctcactattactatgattcactgttaggaaaccaccaagtcccccgttgcactgcccttgactgtactttgttctacgagagatgatgagta

SEQ ID NO: 569863 - DNA, 207 bp, Homo sapiens
gagagggactgtgacttgggctccgctgtgcccgccctgggctgggcccttcctggctaggactgtggaggaacccaaggccccatggctgctttgtagtccatccagagttgggggctaggggagggggcaccaggatccaggatgcctgagccccctgagttcccaaagggagggtggcagagacagtgggcactaagggtggag

SEQ ID NO: 569864 - DNA, 930 bp, Homo sapiens
aaggaccttcgagaacgagtagaggtgatccaaattcacggtgccaaccacatgattgaagtaaggcatcaccacggagtgtaagctgttgcaacctgatgttcgacctgctccggccaagttccttatgtcacctcattgagcacagcttcgagggcatggcaggcaccttcaaatgccccgtgtgtttcacagtcttcgtccatggccaacaagttgtcagcagcacatcttttgccgtgcacggtcatggaggacaagatctacgatctgctcacagtgccctcagaagttcttcttccagaccgagctgcagaacctacacgatgagcctagcacgcacagtgagggatcgctcaacaggtacacctctccgcagataggcttgctcggagatcgccgtggggtagggcctatttgagacagttactatccatatcagaagtgttcattttgccacccctagtatgtaagaactgcgtaatggatcttggccagtgacggcgctgcgtgatgtatgaagctagcatggataatgaattattacatggccagagacttaagaagtattcctatgctcagctatctttgtattgtgcctgtctacagctacgtgtgctcttctagactttcctgccgcagacttacattatctagatgttagatgaaacctgctcttttaaggctattgtccttttcgttccttgcatcgtatgtatgatctgatagtgttttaacaaagatattagtgtgatcttttttctctttgcttctttttgtttctttcttgtttttcgtcccccccacccccccacccccttccgttaactactttgtaattgcaattctaggtaattgtgcatcgtgatgtgattgcttggctattgtctgaatatttcctttaattttataattacaaggtaatgcttg

SEQ ID NO: 569865 - DNA, 916 bp, Homo sapiens
  misc_feature (462)..(464): n is a, c, g, or t
  misc_feature (539)..(539): n is a, c, g, or t
  misc_feature (544)..(544): n is a, c, g, or t
  misc_feature (569)..(569): n is a, c, g, or t
  misc_feature (575)..(575): n is a, c, g, or t
  misc_feature (588)..(588): n is a, c, g, or t
  misc_feature (590)..(591): n is a, c, g, or t
  misc_feature (697)..(697): n is a, c, g, or t
  misc_feature (701)..(701): n is a, c, g, or t
  misc_feature (703)..(703): n is a, c, g, or t
  misc_feature (707)..(707): n is a, c, g, or t
  misc_feature (721)..(721): n is a, c, g, or t
  misc_feature (733)..(733): n is a, c, g, or t
  misc_feature (743)..(743): n is a, c, g, or t
  misc_feature (751)..(752): n is a, c, g, or t
  misc_feature (756)..(757): n is a, c, g, or t
  misc_feature (763)..(763): n is a, c, g, or t
  misc_feature (816)..(816): n is a, c, g, or t
  misc_feature (836)..(836): n is a, c, g, or t
  misc_feature (842)..(842): n is a, c, g, or t
  misc_feature (844)..(844): n is a, c, g, or t
  misc_feature (853)..(853): n is a, c, g, or t
  misc_feature (855)..(855): n is a, c, g, or t
  misc_feature (858)..(858): n is a, c, g, or t
  misc_feature (861)..(861): n is a, c, g, or t
gcccgggctagcgacagccccacgccggcccgggcggtcgtcgtgcggtcccgccgatccgtccgacggtccacccagtgcttgcggctcgcggcgggccggcctgggctgcaatcaatgcggctttgtctgggacgcccacatcccagaggccattcccgggtcggcaaatcggagcgcggccggggcgcgcgggggtgagataagctggccatgtgatcccacctgggctggaaggggatggggcgccagtgtgagtgctggcgtgcctggctggggcgctggtgctgtgcactgcggggctcctgcagctatggctgtcagcaggaaggactggtcctgcgctgtccagcctttgccctgtgcagaggactctggaggatgaggaggaacatggagcgcgagctgcatggcgggtgcaccgcaacctgaggctccaccactggacgattgaggctcccnnngctcagccagaatggagaccggcaggcctctgttctgagagactaccgagcgtggaagaagcagaggtgcccaangccantgcccccaagcctccaaagatgagngacganggacatccagagnanncctcagaacacgggaggagcggaggcatgaagtgcgggcatggtgggtggaggctgcacatgtgcccccaatcccaagggagaggcttggaggcagaggacggggnaggnancagnttgagccctgtgcnggccacacaganacccctagtntccaaganncganntggaantcccactcgccggagatgagtgggaaagcgggccctgggcctgaggaagaganttgtgggcaggagccaaagngagganangggtccagnanagnccnagttgagaggcccaagcagaagaggccggaagacaggcccgtaagccacttgaag

SEQ ID NO: 569866 - DNA, 371 bp, Homo sapiens
aataaagaggctatgttgtatatatacgtcgaagaatatagtaaactagaccactcttttatagtttctcaacctaccttttatcttctgaagaatgacaacatgcattctactataggagaggtagtgggagaggtcgttaccttggaaatcacgtcctgcatctcatttctgggatccaatgttccatccatcatagcgcaaatctatataacatctgtgctgggttggaatagatgtatatccagtaactacgaacatagcaaatatatattaaaatcacgcatctctcaaagggggcagatcaacagccactaactttattaaatacttattcccaaatactaaaacttttagtttaacaaaaagca

SEQ ID NO: 569867 - DNA, 745 bp, Homo sapiens
gggaggcggtgctggggctgctttcccctggggccgacagcgcggctggtgcggccggggtcttctgcggtgtggcctggcggtagaggacgcggttttggggcggcggcccgcgaggtggaccccttgttcccgtcctgggcgggattcgcccatgtgaggggggtgtcgcgcagcgagatggtgtatttgggcgtgtcctggcggcctctcgtgcacgcgcgctcccgtggtcggctcgtcgcggttctactggtttccgcgggggtggtccctcacgcgggcattttggcggcgtgttcccgcctccggctagtcggaccaccactgtggcggccctcgtcgttgctcgccacggcgggcaatctgccggcgggtcggccccctcctcgtagagcccgcgcctccccatgcgtctatcaccaggtctctctgcgcgcctcggcctgcaccctctttcgccgccacctcccgcgcgcgagataagtaatctttcgtgcggcctcgcactgcggcgcgcaccccacagcttatgtagtgcccctcgtttgtctggggcggcaactctcgtggtaggtgcacagccctggtgttctcccccctgggcggcagtgctgcattctcggtggtgtgatgggctgcgacacttgttgtctcatgagttctcatagccgacgcgctcgctcgctcgcttccactgctgtaactgcaaaagttgtccttctacggcggccccaacaaaaca

SEQ ID NO: 569868 - DNA, 395 bp, Homo sapiens
  misc_feature (30)..(30): n is a, c, g, or t
  misc_feature (96)..(97): n is a, c, g, or t
  misc_feature (99)..(99): n is a, c, g, or t
  misc_feature (112)..(112): n is a, c, g, or t
  misc_feature (161)..(161): n is a, c, g, or t
  misc_feature (186)..(186): n is a, c, g, or t
cgatcaatagtgcgatgtggggacggaaangttagctcagccaactgttggatatgttggttcaagcgtgtagtcgtgctctttaggcaaatccgnngngcttagatgaggngtgataacgagtctgcttgcagacgaagtgagtgataccctgcttccangaaaagccactaagcttcagctatngacgaccgtaccgcaaaccgacactggtgcgcgagatgagtattctaaggcgcttgagagaactctggagaaggaactcggcaaattgacaccgtaacttcggaagaaggtgtgcctttagtaggtgaaccatttagcttggggagcaccaatgaggtcgcagagaatcggtgcctgcaactgtttaatgaatacacagcacccgtctg

SEQ ID NO: 569869 - DNA, 497 bp, Homo sapiens
  misc_feature (16)..(16): n is a, c, g, or t
  misc_feature (45)..(45): n is a, c, g, or t
acctgggcattgtcantgaccctccccctggactgtgctgacccntagtccaacttgcacaggccctgggaacgcagcttccagcctctccggactgtgctcccaccggccactgctttcaatgctttcctttagtagactaattaccttgtacctccaatctctcctaaaaactcgccctgtggattttttctgcacaagccctctatgcttctgtaaaagctacaatcccatctctatatcctgcccatttccaggctcctcctctactatgaaggacaggtctccaaaaggcaacaggctcctctgggctattaataaagaacattacccttgccacaactcaggcacactgatttccatggacctagctgaaaagacaatagccctgaatatgcacaagaatatggggtagcaccttagatcatttttttccctaagttctttgttgctagaagtaaaattctgattattagcttgtgattaaatatattatt

SEQ ID NO: 569870 - DNA, 1291 bp, Homo sapiens
  misc_feature (208)..(208): n is a, c, g, or t
agcggagttatctgtgggtacccgagagcgcggagatctcgccggcttttacggttcacctcggctgtctgcagcatcccatcccgcttcgctctcctgaggctcgactggaggacccagtcttgggctagaagttcaccatgctgcgtattctcacattgatccattggccagggtagtatcttctgcatctctcgccgggaatccncactgtatggacgtgcttcgtatcgtcgtttcacctgcgaaacaggtctcttcagaaggctggctgtgcccactggtgcttcaactggtatctatgtaggccctagcagctccgagtgactaatgactggtgatctcgactattatgggtgccacgtggtgttctcaagaggcgtgtctgagcacatcaattaaaactagttgcgcctgccctggttagcatacgaagctgaccgtcatcagaacattgaagacagattgcacaagactgacttgatcgatgatggatggtaacgagaagaagatcgagatctgaagttatcggatgcgaacgcccatttctggggcgttgctcccttggccgtactagctaaagctgagatgtccgattcgaacaaggggggttacccccctgttaccgatcgacatcgctgcactatgcgtctggcaacgtactgaaagtcaagtcctggtccatgtccccaggcaggttcacattgtctactcgaacttggtcgggcttgctcattgcataggtcaacacaggcatagggcgcatgtcagtggagtttcggatgaatcccatcccccacgtcgggtggccaggccacaatcttcgagggcaaaggccaatggcggccattggaggcgagaagcggttttaacccatcacaacccttggaatgaaattgtccagtccagccggagcaaagtattgggggagaaacgaatgggcaccctacaatcgtgggcgggactcggaactgcgggagtgttggcttccccggagcattcgcttgcgtacggaattaaatgagcgcggggccttgggaaacctaggctggaagaacttggcgtaatgtgggggaaaaggcctagggcttacagcatggagttaagcggcgggtccaatccggcattgggaccgcgtagtccgggcattccgaagttgcttccaagggtccctgggaaaagtactgacccggaacattcgagtcttcccgaatagctccccgcagggtacttttccgccctgaccagctgggttgacccgtgtacaagtcctttattcgaaaggactacc

SEQ ID NO: 569871 - DNA, 1257 bp, Homo sapiens
  misc_feature (71)..(71): n is a, c, g, or t
  misc_feature (560)..(560): n is a, c, g, or t
  misc_feature (1138)..(1138): n is a, c, g, or t
gggcgaccagagctgagaagcggggaccatgtgccgacgcaagttgacggctctcgacttgaccatcgaanccccggcacgggcttacatactgcaaacgaatgaacacaggaagtttataacacattcatcgatttgcgacttgacacgcaccagaatagatcaggcactacaagattgaagacagagggaatttagatgaaacatccacagtcgagcgatcgtggcccaacgttgctttgaaaaggtatctcagagatgttaaatgtcctttcatagattcaagatcgatcaagaacgctattggactggcttgcttggtgttagctgtatagactatgaatatggaggattaatgctgatgaatacgaggatttgagtacctgataattcaaaaactgctgacaatgcaactaagaaatgcagaaccattggatccaattcggcatgtacacataagtcctgagttgccaacggctggtgtgatggctttggctaacctgcttcagattcagcgtcatgatgattacctggtaagtgcttaaggcaattcggattcnggttcaggagcgcctgagacatggatgccgttgctaaggcaaagtcaaacaaaagagggcttacctgttgctttagacgaacatattcttggtgtggacacaggagatgcagttcttaatgaaggtgctcaaattctgcgattgctgcgcatagaggagctcagagaggtagagataaaagattaagaagcatagtagctgtttagggactcctgtgttgatccaatgacagagccacagacgcggaaaagtcgtgagattgaacattggggggttccctgtttcacctacttgttaccttggggaacggtaactctggccgcgtggggagccacaattggcactctcgcgggggagaggcgacaatgggtcttgttccaaatttcaccccccgcgggtgatggatgtgtatctaattaaggtggggggaggaggaccacaaaacaatacacacaatgggctttctttctcggtgggcggagaggaatagtataaaagtacacgtatacttactctacgcgcacctatataaagtatagacggcgccaatcgtggctgtaattcgagaaggacagtantagtagtctataacatactgtctcgtagatacgactaaactagtgacctatcactactcctgccttctttatactctcttctacttctcctatcaatctatcttactaaacagagacac

SEQ ID NO: 569872 - DNA, 450 bp, Homo sapiens
attttgaagatggcgcctaccttcggggtgtggaggtagagacaggagagaagctcaggatgctgctcagaacaacccatggctcagacttcccacctgcaagatgagcagacgggcagaagggtcctctccttgtctgccacccgcatggcgtgctgtgaggagcctgtgagaacctgcccatcaccatgagaagtgcaacaccaacctcaggtggaaggtcttaagagaaaacactgaggtccctcgaagatgaagaaatcctcatgaagatgaatccaaaggtggattcaatttcagctgtctttggactgaagactgcaacatcaacacttcccagggtctccagcctgcccgcctctcccgcaaatttcagatttgcaagtatccacagtcatgagcaattccttaaagtaaatatttctctgtttctttctggaaaaaaaaaaa

SEQ ID NO: 569873 - DNA, 325 bp, Homo sapiens
ggagtacccctagattctcacaggctatgcagtttaggaaaagctatggatctgaagtcaaggtaatctggagtctaggcagacccaggctactcgctgggatcctgatcctggggtaactgcttatccactgtgagcctcactttcctcatcgtgaaaagtggggaggctgagcgaagtggctcacacctgtaatcccaacactttggatcgcttgagcccaggagtttgaggccagcctgggcaacatagcgagaccctgtctctacaaaaaatttaaaaactaaccaggtgtggtggcttatccttgtggtcccagctactc

SEQ ID NO: 569874 - DNA, 801 bp, Homo sapiens
cttgtgtggccgagagagcagcgctggtgggtagactgtacggcgagcaagccggagccatggcctttacccccacgtcggtgtcggccaccctgccgccgtcggctcctcctcctccggcggccaccaagggcacgccccgccgcgcgccatggaatgccgcgccgctggccgcggcggcagcctcgtcgacggctgcattgatggacgcgacgccggtcgcgcacgccgcggcgttctccaaggaggacgtcgccgggtcgttcaccaaggtggtggacacggtggatgcggtgatcggcgtcggcggcaaggtcgccgagcagtcctttgtcgtgctcagggcgctgagcgaggccgtgaagcccgcgctaccggtgctgcagagcgccggcgagcaggccctgaagctcgcctcgccggtggtctccgacgcctccaggcaggccacggaggcgctccagggcgccggcgtcgaccttgcccccttccagtctgctttcaagacggtcgcagatgcggcgcagccggccttcggcgccgcgaagccgatcgcctcggagactgtgcagaccatcgggtccctggaaggcacggactacgtcgtggccgcggagccgcgttcctcgcgtacctgctcctgccgccggcctggtccctgctctcatacggcctgcgcggtacaaaggtgacctgagcccagctcaagctctggacatggtcgcctctcaaaggctaccttatcatcgacgtgcgaaccgagaacgacaaggccaaagccggcgtgccggagtcccctca

SEQ ID NO: 569875 - DNA, 1791 bp, Homo sapiens
  misc_feature (305)..(305): n is a, c, g, or t
  misc_feature (790)..(790): n is a, c, g, or t
  misc_feature (1198)..(1198): n is a, c, g, or t
  misc_feature (1222)..(1222): n is a, c, g, or t
  misc_feature (1791)..(1791): n is a, c, g, or t
taaaaacccccaatttgggttatattatatctctcttggaatgggcgaatgtcatattgtgcgcgttatttaatataaaaaaagaaaactccttggggtttaagaaaccgcgtgtcactcacaagattaccaaataagcatatctctgggcccggggttcccagaagtagagtttgtggagacccatatttctctcacagagaaacaagagaagcgccctctgtgtgtagttcacacatatataattgaaacacaagatattcttatatttgtcggctcacacaaagagatctctgtagaacccncacatattttgtgagagcgcacatctctctctgtgtgtattatatatatatagagaacactctcgagcccgcgtggcaattgtgtgtctcgagtgtgaaatatagagagagagaatcaacgagagataaaatatatgaggaagagtctccgcgatgtgagagagagaggcccgagagagtgtgtgtgtcgcacacaaaatatctcttacaagcgatgtgtagtgtgtgtgtgagaagagtctcacaaaacagcaccaaaaacagcacagcagaggaggaagaaaacaacacagagggcggctgctggcgagcgaccttttattcttcacaactaataatagcagcagggcagcgtcgttgtgttgtagtcctcctgtgtggagaagaaggagtggtggacgtaatcctcgcagggtattataaagaaggggtgctcatcagaggggtgctctactctaataatagaagtaggcgcgcgcgagganactagtaattattatttttcccgccgtcgcacaggaggtggtgtcgtcgtccgtcgtcctgatggagagctagagagtatattactacctcccacacaagaagtggcgcccccccagaggggggcggggcacacaacaaccttatatgcagccgagggacgagcctctcctgcagcggatgtgaccaacactacatgtggcgcggcgcggtggtggacaaacccccgataaaatagaacccacaaaaagaagggggggagtcatgtgtcgtttcctcggcggcgaccagatgaggtgcggtagtagaaacaacgcaactaacaaacagacagagcgccccccctatggtggggtgacatccttgcaggcagacgacaaacgattctaatactttcccaacgaggcggngcgagtatttcttcgttggacccnccccaagtaggaacaccaacgagattctttgtctgccacaacgcacactcagttgtggtgtgtcccccccccaaataaaacacagagggaggaaaggcggcacgttgggttccttgtgacgagcccaagagatgggtgttgtttacaatcaccccacacagctaatgtgtgtcaaaccatccttctcgggggcagcaaacaaagcagggccggcgaacggagggggggatacatctcccaccagaaggagcagtctggtggtgatagcggttcttgcacaccgcccggagaaaaaaccttgctgtggtgggcggctattaaaagggcgagagaaagttttcacccagaaaagagggggcgcccccgcaagatagaaggaacccacaagagctggttgtcccccggggaaaacaaatattggggggagggcaacgatgaataaataatatctctccataaggatcataaacaactgcagagaggagggggcgtcaaaagagatattcaccctccgaggagcgggacgcgagcgaattacagctgaacccacgcgtgtttcgtggtataan

SEQ ID NO: 569876 - DNA, 160 bp, Homo sapiens
gtacatacaaatagtcaagagtactgaatgtacatgactatttctataacctatggtggagatacccccttttttttttttgagaaatatattctcattctatccccaaggtggaataacaggggaaaaatctcggctcatggaaagttctgcccccggg

SEQ ID NO: 569877 - DNA, 246 bp, Homo sapiens
tcctccgccaatctttggccgcgtgccttttctctgtggttacagcagacttcggtatctggaacgtgagcactatcggagctttggccgtgcctgaggagatgactgtcaggcttctccttctgcctcttgcccattctatgagagcagatagatggagagccaagctggtcaagcatagatacagactcccctgagctgatcagaaggcatacaccaaatacatgtctcacatcatgagatttc

SEQ ID NO: 569878 - DNA, 228 bp, Homo sapiens
taagagcttacataatgaaaagcagaatgtgggctaggcattgtggctcacgcctcttatcgcaagcactttgggaggccaaggtcggataggtcaccttagtgtcaagagttcgataccggctctggtcattatggtgaactcgtgttctatactaaaaaatacaaaaattagctgggcatggtgccaggcacctgcaatcccagctcttattgcccaggctggagt

SEQ ID NO: 569879 - DNA, 154 bp, Homo sapiens
agcgggagacactggcagggccagaaaacgcgcgcagcgggggcggaaggtcggtaagctcccgcctgccggacgagccgctgcgatgtgggacaccgcgatgggaggatgatgaagcaggcggagggtttaccactcggaggacagatggcac

SEQ ID NO: 569880 - DNA, 1480 bp, Homo sapiens
ggactgtttaccagcgtggagttcctgtgcgctgcgcgatctggttgcactgcagctgagcatgtgagagcctcaatgctgctccaatggagctcaaactgtgtgctggactgatgatcaagagtgtgcctgtgtcagaaaggcagtgctgctgcgagactggagactgtgcaatctgcacctgtggtgcctgcctaacagaggagcccctgatttgaagcctgtgtgaactgtgctcacacctggcactgtgcttgcacctgcccacctgtcttccatcaccttgccacacgcttgcttggcgcaatgtgagaggccagtcttgcaagccctgtggtgcgctgttgtgggcgcagggcctgcgacctggaagttgtctggtgtgttgattgggcatcccctgaggcggttgctgtgctgcagaggtgcaacaatctgtaccttgaacttgacaacttcttgcgactccgactacatacttacagagacttgaagcgcctgcatgggaacgcaacagggatggacatcggagtccagtcagttgggttgcttgaattctgcgcagtatgagcttgaacttcaacaagattaacaacatatctggggcatgattgacaatggaggaaacaattacagatggggccatttgaatacagcaccatatgggaaaggaattcccaacattacattgagtgacattacacatttgcagcaagctgcatacaatacgatcaaaagcagaccattccaccacaccgcccacgagttatcaaatatccccctttgacaccattctacgttcaccaggacacttcaccagaaggagaggtaccattatttgggagaggaacacaccccaaaatgttgaacgaacgcacggtcacaacggggtcgatagacaggtggtaacaccaaacaaaaatggacaacgacgcattccgtgaagttattaactgtttgggtgtttccgcgatttcgcaagttgggcagtcggttcaccggcgctgccaaggatccgaataatagtcggcgctatacttaacgattaaacgcggtttgccaactgacatttttggcatgtggacacagtcgaaccacatttcgtgatgtggcccgaatagcacccacgaatttaacccgtttgtaggcgagcacaacatattgtagatgacacagactttattgggaagaatgtcaagagaagtgacttttataaacaagtggtacatgttggattgcaaatcacggtgtgggcagagtatattagcacaaaggaatggagagatataacaagtggggatcaacggacatgtagtgaaagtagtagtagtctgggatacaagttgataaggtcgtggaatattgtgaggaaaggaatcaagtaatgtcagagtagttgtataaccgagtgggtaaaaaatggcgcgattatagtagtgtggaatctgggtgaaccgcaatataacagatgtgggtagaa

SEQ ID NO: 569881 - DNA, 911 bp, Homo sapiens
ggaaaaacatcagcaccaaggcagtgggccaagtacaggcggagcagcatatcacctatgagtaacaagtatccagaaggctcgtctgaggagaggcaggtcatggatcatgcctatcctccttctcagtgtctgagagggagcacaggagagacctgtaaaagagaacttgcttcaccatgtcggtagcatagcagatgatgtgctgctgggagactcggttagatggcaccgtgcatttcttaatgcggaaggaccgtctgacctacaggaagtgtcacatcatcttgggctcctttgacacgtacagttgtagcactggcgcagaaggatggggaatcctgtgtgacctgcaaagaggagctcgcagatccatacggtcaaagtatcaggaagtgactcgtgagccttgggactccaagatctacaataaatagtcctggctgatatggagatgatgagccatggcatgagagggttatcagcataagcggaagaggtgaagtcgtaagggaaatcatggctctgaagtattcacgtcttgccggtaccctgagttctctatagagtagccgaacacaggcagaatggcccagtacttgtgtgcaatggtttcttcaagagtaccggcatccctttgactgacgtcaagtactcttgggacagcctgggcatctcctcagtacagactctgaccatgggacgtgcagcctggtgagaccatcaatccccaaataaagtggcccataaaatggaccaggaattatcggtaagttagtccaaccgtgaagaattattgtcgcaagatgtacatcaccggtgagctgttggtggggagccagtggatctggtctaggtggaagacaccagggatataggccacatggggaaaaggaaagacaaacaaggaa

SEQ ID NO: 569882 - DNA, 112 bp, Homo sapiens
tactcttccccccattctgtgagatggatggcaggcacgcgtgacttgtagtgttgcatggcatgtgtgggatatctgcgtttcccctgtgaaagcttgattcctgccatat

SEQ ID NO: 569883 - DNA, 382 bp, Homo sapiens
gtactcatcacgccttgtccgtgctaccgtaacctcactcaggtgtgaagagattctttcataggtggaaactctcgtacctgcactgatgccacaatctcgtcgcaggaatggcatcctgtgaaaagtactcttaatacattaagagtatgcaaatagggtcacagaattgactgtagatccaactgctgctggtgatgttcgtccactaatgcaccatccaccaaaccagatcgatgaccacgacacagtgcaccacgacacagtgcaccacgacacagtgcaccacgacacagtgcaccacgacacagtgcaccacgacacagtcagaccagacacagtgcaccacgaccacagtgcgccacgacacagtgcaccacga

SEQ ID NO: 569884 - DNA, 301 bp, Homo sapiens
tcggcagctttaaaaagagagaaatataaaaaccaagtgctggattggtccctattcattaaaaaaaaagggtacttgtggctcgacacaatcatgaccagacacatgtgcaccacgaccacatgtgcaccacgacacagtgcaccatgacacagtgcaccacgacacagtgcaccacgacacagtgcaccacgacacagtgcaccacgacacagtgcaccacgacacagtgcaccacgacacagtcagaccagacacagtgcaccacgaccacagtgcgccacgacacagtgcaccacga

SEQ ID NO: 569885 - DNA, 254 bp, Homo sapiens
tcgactgtgtgggtacaaatactagatttattcattctatctacccatatttgtacccattaaccagtccctactttccccctgctcccagtctccaccacccttcccagcaccacgacacagtgcaccacgacacagtgcaccacgacacagtgcaccacgacacagtgcaccacgacacagtgcaccacgacacagtcagaccagacacagtgcaccacgaccacagtgcgccacgacacagtgcaccacga

SEQ ID NO: 569886 - DNA, 584 bp, Homo sapiens
aaccgagtatactgcatcctattataagtatactgtcaggagtggactgtgatcagtacttgtcgcattaccatggtaattgttctggggtgacgtgaactgcacccatataaaacagtgaacttaatctgcaaatgtgtgtgttctgactgccctactgactggctagtcccctgtctctcaccgtctccttgggcctctgtattccttgagacacaacaatattgaaactaggccaactaataaccctatgtgtagtggcctctaagtgtccaagtagaaaggaagagtctcttactttaaatcaaaagctagaagtgattaagcttagtgaggaaggcatactgaaaacttaggtggcaagctagatctcttgtgccagtcagctaagttgtgaatgcaaaggaaaagttcttgaaggaaatttaaagtgctactccaatgaacacatgaatgagaagaaagcaaaacagccatattgctgatgcggacaaagtttgagtgggctggataattgatgttggcccaaataaacaaatttcagggtaattgatacaggcttactgggagaagatgccttcaat

SEQ ID NO: 569887 - DNA, 932 bp, Homo sapiens
  misc_feature (232)..(232): n is a, c, g, or t
  misc_feature (839)..(839): n is a, c, g, or t
gtctttaagaaaatccaaaaatgagatgaaaacatcctgaataataatgaaaagataggaaagatgcatggattaacagtatgaagataatgaaaatactatagtacagtaaaaagaatgcatgatggggataagaggagtggggagtaactggaggcagtcctaaaggtggaatcttgccacctgtgtcacagtatgtaaacttcaaggataggaaatattaaaataagancagaaaatattgtacgggtgtggaagctatcaggccgatacgaagggggtttagagtataggtcgctttcatgtactgaagggtcaaagtttcaatgtagatctttaagagaaatccttttcaagagtcggagggcgagtgtggagtagagaaacgaggcatgggaagaatggggtggaaggatgccagaggaagaaaaggaaatgtgcagaagaaaaggaaatgtgcaaaagaaagtgcttccatgggaagactaccaggttagttagaatgcgaaaaacacaaaaaatgctaagtaagaagtataaaaagcacatgaaagaagtagtaaaaaaacgaacaaacaaaaacaggtataaaggggcattctggcccttcaaaacaatgatcttcaacagtaaatgcaagcacaagaaggctccaggcttgggaggccaaggtgggtggatcgcttgaggtcaggagttcgagaccagcctggccaacatggcgaaaccctgtctctacttaaaaagaaaaaaatcagctgggcgtggtggtggatgcctgtaatcccagctacttgggaggctgaggcaggagaattgttgaagtccagaggtgaggntgcagtgagccgagatcgcaccacctacactccagcgtggcgacagagtgacttcttcgtctcaaaaacacaccacccccaccaaacacacag

SEQ ID NO: 569888 - DNA, 237 bp, Homo sapiens
gactgagatcaacaggtccttcaggaagccctctggatcggtgatttctgataaaagaccggccacatcgaggaactctgagaaggtctccactaccacgacacagtgcaccacgacacagtgcaccacgacacagtgcaccacgacacagtgcaccacgacacagtgcaccacgacacagtcagaccagacacagtgcaccacgaccacagtgcgccacgacacagtgcaccacga

SEQ ID NO: 569889 - DNA, 410 bp, Homo sapiens
ggggatcagggaatgtactgcagcaagggaggcatgccaagagcaagagtgtgggtgtgaacgtagagaatcctcctttttgcccaaaaggggcgaagtgtttgatgcaggtcatggaggagaaagcatggtgtgggtaagacacggaaggaatgaaggagaggtgagatgaggccgatcttgtaagggatctgaaaaaaggggtggggattaaggaaaactgactatagtaagcacccataagaaacaggttgaggccgaagatactgacacagggcctaagagtcctatcaggtgggaggactagacgtatcgggtggggaggcattaaaagaacaagtttcccatgcagactggtgtttggggtcagaggtgtgttaaagggcaaatagggaaccgaatgaagtgct

SEQ ID NO: 569890 - DNA, 1417 bp, Homo sapiens
cgcagttttgtttttttgtctggcttctttcgtcgtctatatgctagtttatgagtgggaacgcagcgcacgagcactgcaggcgtaagatcaatataaccacagagcggagcagcacgccggtgcatgcacgggtcgcagcggagtgatacatcatattgtagtcacgtgctttcgctcgcgcgctgacgcatcgctctctcccgtgagatggatcatgccctccatgttgttgtgttgacgcggcggggtcgtgaggacaacacgacagatggtgtgcttgctcgtgaaagatgtatggtccctcctctctcttatattaagtatgtcccctgtggtgggcaaaaagatggtcgccgccgccgtgttgttgtcaccgacatttattgtagtccgcgcgagtatttgtttgccggcgatgagtattgttggcgccgctattaaaggagcgtccctcctactcggggcgagggggttcgtacaataataagggggtgcttgctcttcaccccccctgccgcgctggtggtttgtgtaagtagcagctgttccctcctacgctgggggtgttaaaaacgcggtgttgtttcacaggccgcgctgtgtgtgacgccacaggtggttgctcctgcggccccccctctgtttttgttgcccctcccttgtgggggcgccccctcgctgcttttgggggttctagttataaagtggttcgcctcttcctcccaccccggttttaaatagattatcatcgtttcaaaaaacgtggttttagacgcggttgatcttttaaaaatcactgttgttgttaacccgcgccccttttcctttttaataaaccccggtgttggtcttctccccctctccgtgggtctttatttataacaccccccttgtcaaactccccatctatcccgctgcgggggttacgatcttcgcggcggcctgtatttttgcccccgcccgcgcggtgtgcggggcgctgtcgctcttgtgaggcccggctggctgtgcatcttggcggccgccgttttatttgtggggaggtgtggctcagggggttgtgccccctcctgtgcggtgcagagggctatccgtaggtttcttaacagtgcggggcaatacctcgggcataaccccacacaagtcttctcgcggcctagggcgccaatgtaaacgcgtatataggcgaatatccttggggaaccaattagtaagtgaggttgaccctcgtctcgctcttataagagaggaacaaagtgacgtatagttttaagccccgtgactatttggagcccaaaactagtccccggtttgggccccctacgctttggcgcccacaagcatcgcccaccctttgcagcaaaacttcgggacaaatacaataccacacagaataatcaatagtacagaaaag

SEQ ID NO: 569891 - DNA, 434 bp, Homo sapiens
  misc_feature (411)..(411): n is a, c, g, or t
  misc_feature (416)..(416): n is a, c, g, or t
agttgaacctaagaggagacaggaaagaccagttgctcctccatagaaaagaagaagaaaaatacataggatggatcattatgctgcggaaactcatcaggacaaaatgacaaatcctctgagggaaatcgacaaaatagtggggtaattagtgtctgtacagggtccgatgcagaaaaggggaaggaggaaatcagagttccccaaatggggttttatcagatctcagggaagttggtatcatgcttcttatcaaggccaacccataggattacggtagggaggcaaaatcccaggcttttcagaagtggatccttaggaaaggaaagtagggggaaggtgcctaagtcactcagggtaaatggaggaaatggggcatcactgcacattcagacagcacctgcatggaangtacnggcaggtaaaccttgggg

SEQ ID NO: 569892 - DNA, 3688 bp, Homo sapiens
  misc_feature (3429)..(3429): n is a, c, g, or t
  misc_feature (3443)..(3443): n is a, c, g, or t
  misc_feature (3646)..(3646): n is a, c, g, or t
ttttagagattgtttttttcccttacttttctaagcagtgttcagctcagaaaaagtaagggaaaaaatcaatctccaaaatactaaatgctggaaatggcagagtaaaggccagggagtcaaggtggctgtccacagcagtgattcttatctggggtggggggtgggtttcacccgagggagggctgggggcatggacccccaggcaggcctatccaatcatctgaagggtgagcagtgttcagctcagaaaaagtaaggggaaaaaaaagcaatctctaaaaggaacatagacaatagcaaaagaagaaaccgagcccaaaagatgcttctgataggccgccttggggtcctgcatcctcgggtgagaatcactggtggacacgggaggatggagagccgggcagacatgtggagtgagaggggaagatgcatgtgtggcagggctgatggaggcatcagggtcaagactgtcaggtgttagaacacagttcctgacagaccaggacaaggatgacagcgaacaaatggatgtagctgaaaaggcaatgggaccacggtggtgcagctggggtttccaacgcctcggtcccagactcaaggactcaggtggaggagtgaggcccagagaagggcccagtgactcagaggaagtgggctgtgcgggtgagagcagagagcaggggatctgttgtcacggggaggaaaggcgcaaaggggaatggagacagcgtggaagaagagcgtcttgaagacatcggtgctaaggagggaggaggcaggaggagggtgggactgacaggaggacccaggaggagcggaggagccgggtttcaggcagggcgggagagtcaggttgagactgggtgcgtttgtacccgtgggatgtgggggaagagggtgggcaggtggagtggggacagcagtgagcgctgatgacaaaagtgctgtggtgacaggaagaaggtaggaaattcacaggcgcatgttccccagagtgtttttacacagaatgtgaaagaaaggatgagaagagaatcaggaaggtttaggggagtcagggttgtggggccctggaaaggactcatagcctgggccactgggacgtgagcttggacagcagagcgtgtggattcagtgcagtacgtgtgacacagagaggactgcatctggtggagcagtgggtgcggggccaggtcaagaagggaggacacacctgagaacacgaattaggccagtggcagaatcacaggtggtgctgagagaacgcagcatggtgcaggtgggacagtaccgtgctatgcagtagaggaggaaagcaggagaaacgaccaacctgggcccaggagctgggagctgggagagcagagggtgagtttgcagcatatgggagagcaggacagaggagaggtgttccccaatgggcaagaagaatgagtcggagcaggcaatggagcccagcagctaagagaggagagcttgttgagagcaggagggatgcgctgcagtaaaggaggcatgccaggcgccaagagtgtgggtgtgaacgtagagaatcctcctttttgcccaaaaggggcgaagtgtttgatgcaggtcatggaggagaaagcatggtgtgggtaagacacggaaggaatgaaggacaggagggaggatggcaatagacaaggaggatgtagaagatgctggcaccttggaaaagctgaggcaccacagtgtcaatgaagggcatggcgagactgatgaaatgtcaggtggattgactttgagacaggaaacaattgtctccagcatagtagaaccaaaaatgtaggacggttaagggtgccttaagatagcagatggatccaatgctgcatattgtggataaaaaggatggcaatgttggcagcagcaagggcagggcaggaagggagctgacatcaaggaaatgactgcagagtgcagtcattgacttagaaagtggcagaggagggagtggatgctgaagatgaagctgagggtctctggaaaataacagtagggggatgtgcagtacatattaactagaaaaacagaaactgctctaaagtcctcaaggcatgatgtcagactcaagatgggtccaggaagttgatggacataaaaaaggacagaaggtgcatgatagggggagaatctcatgaatttgagggtctcaacattggtaaaggggccaagtgaatagaggggaggcagaattcagagtcccaaactgaggtgtccgcagatctcaggatacgttggtggtatgcctggtattaagaccagaccacagaggcagaatgaagcaatagctccagcagcctttaggagaaagtgggttaagggccaaagtgattggttaaacaaaggaagctggtcagcactgcacactaacatggcacctgcataaaaaccacagacaggtaactttagggacttcacagtggactcaagcagactgatcccagattgtaggtagaagtgtgtttgcaaaggccagaggagctgttaggacataatgcgatggagacaatttgcaacaatcactgaatccacgtttctgctgtttaagggtggctgaaaggatggaggtatagcttgtaatgcaaaatatacgcagaggttcatagtgaagctgaggaggagggccttcaaaagttaagtgggagatgtttaggtcagtagcaaatgggcccagtgggagagagtatgcccagagtttggagagggtcagggtgtcgggtgctgggatgagggcttcatgtttggaagacgcaaggtagagagcaagagaggaggaaaggtagaacaggatggagggcaagacctgtgtaagaagaagtcttaaactgtaaacatgggtgtagtgagggtagtgtggctaagaggaaatggatccagatgggcttgatggggagcagatgggcaggcacgatggcaggggtgcatcggctcactggggctgcatctgaggtaaatggaaataaaggaggtgaggaaatgaggaagagaaggaagtggcgggactggctgtggagttttgtgggagccttcttgatggaacagaaagaaagaagaggagaacaaggcttgagtggaagaggggaaggaaaaggcagcctaagggaaggcgctggcctgaatcagtggaagatctggaggagcaacagaaaacagttcttgaagagaaggtgggatagagagaggatggaaaagtttgagcggtgagagagcaggtcaaagtagtgagcacatccctatggagaagagatgactgagcccgatgaagcaataggccctgggtggttgagagaaatatgggccacagacaggcaggtaccttcccttggccaaggaagcaaggagaagaaatgtggacgcaaggggaaaggcttcaagaaagaatgtggaagtgggacgatnaggcagcgccaacnggggagtcacctacagaagacagggtggaggggcccccagggaaggatggagggcagaaagcgtggtggaagggagctgggcaggacagccacaggcaggacagccataggtggagtgaggtgaaggggcaggtcccagagtaggaacaaaggaatttggagtgctcagagcagcctgcaaggttcagcatggggcaaggaangtattagaggggggaagtcgacgcggccgcgaatttatagta

SEQ ID NO: 569893 - DNA, 166 bp, Homo sapiens
tgtgtgtctgaggatccactgttgtcatactgcactgttgttcatactgcactgttggtcgcatgtatcggggggggggctgtaacatcgggggagggtatgaacaacagtgcaagtatgaacaacagtgcaggtataaacaacagtgcaggtataaacaacagtg

SEQ ID NO: 569894 - DNA, 792 bp, Homo sapiens
  misc_feature (10)..(10): n is a, c, g, or t
  misc_feature (21)..(21): n is a, c, g, or t
  misc_feature (24)..(24): n is a, c, g, or t
  misc_feature (26)..(26): n is a, c, g, or t
  misc_feature (29)..(29): n is a, c, g, or t
  misc_feature (32)..(32): n is a, c, g, or t
  misc_feature (80)..(80): n is a, c, g, or t
  misc_feature (87)..(88): n is a, c, g, or t
  misc_feature (94)..(94): n is a, c, g, or t
  misc_feature (98)..(98): n is a, c, g, or t
  misc_feature (101)..(101): n is a, c, g, or t
  misc_feature (133)..(133): n is a, c, g, or t
  misc_feature (367)..(367): n is a, c, g, or t
  misc_feature (476)..(476): n is a, c, g, or t
  misc_feature (573)..(573): n is a, c, g, or t
  misc_feature (588)..(588): n is a, c, g, or t
  misc_feature (790)..(790): n is a, c, g, or t
ccatccagcnagcatcttccnccncnccnccnccaccctcccatatatcactttccacctctccaccatcactttcccanatttttnnccaccncccnccnccaccatcccatatatcatcttcccctttctncttctctctcctttatatttcatatttccccttttctctcttctttcttttacttctccttcttactttccatttcttctttacatccttctctccttttcatttctctcccttctcctcctataatctctctctcttccctcctttttcctcctctttctcttatttcaccctttcctccttcttcttctttttccctattttctcccttcctcttttctcctctttcttttnttctacttcactcttctcccttttactcattttcctctctcttcctttttatcatcaacctcttcactccctcaccctcttccaattctccttctttcattattcttantcctcctctccccattcttcatattcatttatcccttaaatcccatatatcacttatataacttattattatctcctttataatttccatcttattnccccttcttaatatnatcattccatccttttttactccatcattacctattatttctctaattctctccatttcaccaacatcaaaaaatttaattatcccttcctaatataactctacatattcttatatattttatccaattcacattatacatcattataataaatttccaaattttaccttccaaacttcaacaataatttattttatcacanca

SEQ ID NO: 569895 - DNA, 787 bp, Homo sapiens
  misc_feature (505)..(505): n is a, c, g, or t
  misc_feature (621)..(621): n is a, c, g, or t
cctaagtgcgtccctcccacccccacccaggtgatactgaatctatgtgaatttgtggagttctcccttccttcccctctggcagaatcaccaggattcagtctagagtacaacattatagatgttttctagcacttttcagctgtccatacgctaatatgtagtcttgggtctttatccgaatggagtcctattatatttgtttcacaccatctgctttccttatttttgtatctttactgaggtatattgaagtacagtaagctagacttgtatgaagtgtgcagttttaatctggtttttcttttttatttctttgtttgtttacatacattttttagagacaaggtctcactatgttgcccaggctggtctcaatctcctgggctcaagcaatcttcctgcctcagcctcctgagtagttgggactataggcgcatgccaccacacccggttaattttttattttttgtagagatgaggctccagtgggcccccaccgggngggcttaaactcctggggctaaagggatcctcctgccctgggccttccaaagggctaggatactacgggtttgagccaccgtgcctggctcgtttttcataacacaccacacaccncatatttgtgaaccagcaccacagcaagaatattcatcacttccaagttacttggctttttgaatggtttcccctcctctaccctttccaggaagcttggagggcagctggacatgctttcagcattatatacggaacggtaggcctatattgccgccgtctcttg

SEQ ID NO: 569896 - DNA, 3690 bp, Homo sapiens
  misc_feature (1545)..(1545): n is a, c, g, or t
  misc_feature (3431)..(3431): n is a, c, g, or t
  misc_feature (3445)..(3445): n is a, c, g, or t
  misc_feature (3648)..(3648): n is a, c, g, or t
ttttagagattgtttttttcccttacttttctaagcagtgttcagctcagaaaaagtaagggaaaaaatcaatctccaaaatactaaatgctggaaatggcagagtaaaggccagggagtcaaggtggctgtccacagcagtgattcttatctggggtggggggtgggtttcacccgagggagggctgggggcatggacccccaggcaggcctatccaatcatctgaagggtgagcagtgttcagctcagaaaaagtaaggggaaaaaaaagcaatctctaaaaggaacatagacaatagcaaaagaagaaaccgagcccaaaagatgcttctgataggccgccttggggtcctgcatcctcgggtgagaatcactggtggacacgggaggatggagagccgggcagacatgtggagtgagaggggaagatgcatgtgtggcagggctgatggaggcatcagggtcaagactgtcaggtgttagaacacagttcctgacagaccaggacaaggatgacagcgaacaaatggatgtagctgaaaaggcaatgggaccacggtggtgcagctggggtttccaacgcctcggtcccagactcaaggactcaggtggaggagtgaggcccagagaagggcccagtgactcagaggaagtgggctgtgcgggtgagagcagagagcaggggatctgttgtcacggggaggaaaggcgcaaaggggaatggagacagcgtggaagaagagcgtcttgaagacatcggtgctaaggagggaggaggcaggaggagggtgggactgacaggaggacccaggaggagcggaggagccgggtttcaggcagggcgggagagtcaggttgagactgggtgcgtttgtacccgtgggatgtgggggaagagggtgggcaggtggagtggggacagcagtgagcgctgatgacaaaagtgctgtggtgacaggaagaaggtaggaaattcacaggcgcatgttccccagagtgtttttacacagaatgtgaaagaaaggatgagaagagaatcaggaaggtttaggggagtcagggttgtggggccctggaaaggactcatagcctgggccactgggacgtgagcttggacagcagagcgtgtggattcagtgcagtacgtgtgacacagagaggactgcatctggtggagcagtgggtgcggggccaggtcaagaagggaggacacacctgagaacacgaattaggccagtggcagaatcacaggtggtgctgagagaacgcagcatggtgcaggtgggacagtaccgtgctatgcagtagaggaggaaagcaggagaaacgaccaacctgggcccaggagctgggagctgggagagcagagggtgagtttgcagcatatgggagagcaggacagaggagaggtgttccccaatgggcaagaagaatgagtcggagcaggcaatggagcccagcagctaagagaggagagcttgttgagagcaggagggatgcgctgcagtaaaggaggcatgccaggcgccaagagggagggagcngatgcagagaatccagggactttaccccagatggggcaaagtgtgtgacgcagttcatggatgacaaagcatagtgtgggtaagataagcaaggaatgaaggacaggagggaggatggcaatagacaaggaggatgtagaagatgctggcaccttggaaaagctgaggcaccacagtgtcaatgaagggcatggcgagactgatgaaatgtcaggtggattgactttgagacaggaaacaattgtctccagcatagtagaaccaaaaatgtaggacggttaagggtgccttaagatagcagatggatccaatgctgcatattgtggataaaaaggatggcaatgttggcagcagcaagggcagggcaggaagggagctgacatcaaggaaatgactgcagagtgcagtcattgacttagaaagtggcagaggagggagtggatgctgaagatgaagctgagggtctctggaaaataacagtagggggatgtgcagtacatattaactagaaaaacagaaactgctctaaagtcctcaaggcatgatgtcagactcaagatgggtccaggaagttgatggacataaaaaaggacagaaggtgcatgatagggggagaatctcatgaatttgagggtctcaacattggtaaaggggccaagtgaatagaggggaggcagaattcagagtcccaaactgaggtgtccgcagatctcaggatacgttggtggtatgcctggtattaagaccagaccacagaggcagaatgaagcaatagctccagcagcctttaggagaaagtgggttaagggccaaagtgattggttaaacaaaggaagctggtcagcactgcacactaacatggcacctgcataaaaaccacagacaggtaactttagggacttcacagtggactcaagcagactgatcccagattgtaggtagaagtgtgtttgcaaaggccagaggagctgttaggacataatgcgatggagacaatttgcaacaatcactgaatccacgtttctgctgtttaagggtggctgaaaggatggaggtatagcttgtaatgcaaaatatacgcagaggttcatagtgaagctgaggaggagggccttcaaaagttaagtgggagatgtttaggtcagtagcaaatgggcccagtgggagagagtatgcccagagtttggagagggtcagggtgtcgggtgctgggatgagggcttcatgtttggaagacgcaaggtagagagcaagagaggaggaaaggtagaacaggatggagggcaagacctgtgtaagaagaagtcttaaactgtaaacatgggtgtagtgagggtagtgtggctaagaggaaatggatccagatgggcttgatggggagcagatgggcaggcacgatggcaggggtgcatcggctcactggggctgcatctgaggtaaatggaaataaaggaggtgaggaaatgaggaagagaaggaagtggcgggactggctgtggagttttgtgggagccttcttgatggaacagaaagaaagaagaggagaacaaggcttgagtggaagaggggaaggaaaaggcagcctaagggaaggcgctggcctgaatcagtggaagatctggaggagcaacagaaaacagttcttgaagagaaggtgggatagagagaggatggaaaagtttgagcggtgagagagcaggtcaaagtagtgagcacatccctatggagaagagatgactgagcccgatgaagcaataggccctgggtggttgagagaaatatgggccacagacaggcaggtaccttcccttggccaaggaagcaaggagaagaaatgtggacgcaaggggaaaggcttcaagaaagaatgtggaagtgggacgatnaggcagcgccaacnggggagtcacctacagaagacagggtggaggggcccccagggaaggatggagggcagaaagcgtggtggaagggagctgggcaggacagccacaggcaggacagccataggtggagtgaggtgaaggggcaggtcccagagtaggaacaaaggaatttggagtgctcagagcagcctgcaaggttcagcatggggcaaggaangtattagaggggggaagtcgacgcggccgcgaatttatagta

SEQ ID NO: 569897 - DNA, 753 bp, Homo sapiens
  misc_feature (351)..(351): n is a, c, g, or t
agataaaatggcgagtgaggctgcggggactcgctgagcacgcggaggggtgagcggtgcaagagccggctgcgtgccctcacagatccggagcccggccgtgccgtgcctgtagggaacatgcacttattccattcccgaaaccgagtcccgctagcggggacagtggcgggtccgcctacgtggcctattacattcacgtgaatggagtcctgcacatgtcgggtgcgctacagccagctcctggggctgctacgagcacgcttcggcaaggagtatggggccaatgtgcttcctgcattccccccaagagtaagcttttctctctgactcctgctgaggtagaacagnaggacgatgatgcgagttacgagaatgtacatgctagctgttcggcaagacccattgcttgggagcagggagactttcaacagtttcctgcgtcgggcactaataggagactagcaggaggtccccacagtaggcaagtgtccttggaagtgctgctcagcagcgggcagaaagtactggtcaacgtgctaacttcagatcagtactgacggatgtcctgggaggctgtaggctgctaagctggatcttccagatgacttgattggatactttagtctattcttagttcgagaaagaagaggatggagccttttctttagtacggaagttgcaagagttggagctgccttatgtgtctgtcaccagccttcggagtcaggagtataagattgtgctaaggaa

SEQ ID NO: 569898 - DNA, 2481 bp, Homo sapiens
  misc_feature (1859)..(1859): n is a, c, g, or t
  misc_feature (2047)..(2047): n is a, c, g, or t
  misc_feature (2458)..(2458): n is a, c, g, or t
  misc_feature (2463)..(2463): n is a, c, g, or t
ttttagagattgtttttttcccttacttttctaagcagtgttcagctcagaaaaagtaagggaaaaaatcaatctccaaaatactaaatgctggaaatggcagagtaaaggccagggagtcaaggtggctgtccacagcagtgattcttatctggggtggggggtgggtttcacccgagggagggctgggggcatggacccccaggcaggcctatccaatcatctgaagggtgagcagtgttcagctcagaaaaagtaaggggaaaaaaaagcaatctctaaaaggaacatagacaatagcaaaagaagaaaccgagcccaaaagatgcttctgataggccgccttggggtcctgcatcctcgggtgagaatcactggtggacacgggaggatggagagccgggcagacatgtggagtgagaggggaagatgcatgtgtggcagggctgatggaggcatcagggtcaagactgtcaggtgttagaacacagttcctgacagaccaggacaaggatgacagcgaacaaatggatgtagctgaaaaggcaatgggaccacggtggtgcagctggggtttccaacgcctcggtcccagactcaaggactcaggtggaggagtgaggcccagagaagggcccagtgactcagaggaagtgggctgtgcgggtgagagcagagagcaggggatctgttgtcacggggaggaaaggcgcaaaggggaatggagacagcgtggaagaagagcgtcttgaagacatcggtgctaaggagggaggaggcaggaggagggtgggactgacaggaggacccaggaggagcggaggagccgggtttcaggcagggcgggagagtcaggttgagactgggtgcgtttgtacccgtgggatgtgggggaagagggtgggcaggtggagtggggacagcagtgagcgctgatgacaaaagtgctgtggtgacaggaagaaggtaggaaattcacaggcgcatgttccccagagtgtttttacacagaatgtgaaagaaaggatgagaagagaatcaggaaggtttaggggagtcagggttgtggggccctggaaaggactcatagcctgggccactgggacgtgagcttggacagcagagcgtgtggattcagtgcagtacgtgtgacacagagaggactgcatctggtggagcagtgggtgcggggccaggtcaagaagggaggacacacctgagaacacgaattaggccagtggcagaatcacaggtggtgctgagagaacgcagcatggtgcaggtgggacagtaccgtgctatgcagtagaggaggaaagcaggagaaacgaccaacctgggcccaggagctgggagctgggagagcagagggtgagtttgcagcatatgggagagcaggacagaggagaggtgttccccaatgggcaagaagaatgagtcggagcaggcaatggagcccagcagctaagagaggagagcttgttgagagcaggagggatgcgctgcagtaaaggaggcatgccaggcgccaagagtgtgggtgtgaacgtagagaatcctcctttttgcccaaaaggggcgaagtgtttgatgcaggtcatggaggagaaagcatggtgtgggtaagacacggaaggaatgaaggacaggagggaggatggcaatagacaaggaggatgtagaagatgctggcaccttggaaaagctgaggcaccacagtgtcaatgaagggcatggcgagactgatgaaaggccagaggacacaacagagagaggaaaccactgttccttagaggcagaactgagaatacaggacggttaggggtgaactgagacagcagatggactcagtacagcangttgaggacatggaagctggcagtggtgtcatcagtgggggcagggcaggaaggggtcagagttcaggaaagattcctgagtctgtggattgacctggcggagacaggcacgcaggactggatgttgaagaggaggtggagcatgtctggaagatgaaagtgggaggaaacagtggtgcaggaattanatgtgaaccttgtgtggaaaaagtgagacattggagtggagcagccacatggaggtggtgtgatgtgagtggggtcagggaagttgatgggaaaagaaagagatttgtggtgcaggaggggaaagaacatcatgaagttgtggggagcttagtgtctgtacagggtccgatgcagaaaaggggaaggaggaaatcagagttccccaaatggggttttatcagatctcagggaagttggtatcatgcttcttatcaaggccaacccataggattacggtagggaggcaaaatcccaggcttttcagaagtggatccttaggaaaggaaagtagggggaaggtgcctaagtcactcagggtaaatggaggaaatggggcatcactgcacattcagacagcacctgcatggaangtacnggcaggtaaaccttgggg

SEQ ID NO: 569899 - DNA, 344 bp, Homo sapiens
ggaggccactgtcagatgtgccggcgaagagaggagacacatagttgtaagaagcagaccatgacagcttccctttctgtgactcgccctcatactcttcctggtccccttcctggggtgcacactaaaaggacctatgtgctcacacacattgaaaccactaggtctgtccccccaagagacctcggtgtgtgtgtgtgagtggttgacctttcttcataccctgtgcctttccttccctttccgaggcacagagagacagggcaggatccacgtgcccattgtggaggcacgaggagaaagtgttttatataccggactctaataatatccctttttttgtt

SEQ ID NO: 569900 - DNA, 474 bp, Homo sapiens
tcaagggcctgcgccgaaaatgtaacggggctcaagccacgagccgaagcttagggtatgcaccgcaaggtgcacgcggtagcggagcgttccgtaagcctgtgaagggacagccgtgaggcatcctggaggtatcggaagtgcgaatgctgacatgagtaacgacaaacagtgtgaaagacactgtcgccgaaaggtccaagggtacctgcgtaaagttaaactgcgcagggtttagcgggcccctaaggcgaggcagaaatgcgtagtcaatgggaaccaggtcaatattcctgggccagtgagaggtgacgggtgcccgccgtagttcagccttaacggattggaagagcagcctaagcgttccaggaaatagcccctcacgcgaaaacgtacctgaaaccgacacaggtggactggtagagcataccatggcgcttgagagaactatgctgaaggaactcgggaatttac

SEQ ID NO: 569901 - DNA, 2665 bp, Homo sapiens
  misc_feature (15)..(15): n is a, c, g, or t
  misc_feature (520)..(520): n is a, c, g, or t
  misc_feature (2406)..(2406): n is a, c, g, or t
  misc_feature (2420)..(2420): n is a, c, g, or t
  misc_feature (2623)..(2623): n is a, c, g, or t
gatccccccgctctncacccaccccaggggagtcagggttgtggggccctggaaaggactcatagcctgggccactgggacgtgagcttggacagcagagcgtgtggattcagtgcagtacgtgtgacacagagaggactgcatctggtggagcagtgggtgcggggccaggtcaagaagggaggacacacctgagaacacgaattaggccagtggcagaatcacaggtggtgctgagagaacgcagcatggtgcaggtgggacagtaccgtgctatgcagtagaggaggaaagcaggagaaacgaccaacctgggcccaggagctgggagctgggagagcagagggtgagtttgcagcatatgggagagcaggacagaggagaggtgttccccaatgggcaagaagaatgagtcggagcaggcaatggagcccagcagctaagagaggagagcttgttgagagcaggagggatgcgctgcagtaaaggaggcatgccaggcgccaagagggagggagcngatgcagagaatccagggactttaccccagatggggcaaagtgtgtgacgcagttcatggatgacaaagcatagtgtgggtaagataagcaaggaatgaaggacaggagggaggatggcaatagacaaggaggatgtagaagatgctggcaccttggaaaagctgaggcaccacagtgtcaatgaagggcatggcgagactgatgaaatgtcaggtggattgactttgagacaggaaacaattgtctccagcatagtagaaccaaaaatgtaggacggttaagggtgccttaagatagcagatggatccaatgctgcatattgtggataaaaaggatggcaatgttggcagcagcaagggcagggcaggaagggagctgacatcaaggaaatgactgcagagtgcagtcattgacttagaaagtggcagaggagggagtggatgctgaagatgaagctgagggtctctggaaaataacagtagggggatgtgcagtacatattaactagaaaaacagaaactgctctaaagtcctcaaggcatgatgtcagactcaagatgggtccaggaagttgatggacataaaaaaggacagaaggtgcatgatagggggagaatctcatgaatttgagggtctcaacattggtaaaggggccaagtgaatagaggggaggcagaattcagagtcccaaactgaggtgtccgcagatctcaggatacgttggtggtatgcctggtattaagaccagaccacagaggcagaatgaagcaatagctccagcagcctttaggagaaagtgggttaagggccaaagtgattggttaaacaaaggaagctggtcagcactgcacactaacatggcacctgcataaaaaccacagacaggtaactttagggacttcacagtggactcaagcagactgatcccagattgtaggtagaagtgtgtttgcaaaggccagaggagctgttaggacataatgcgatggagacaatttgcaacaatcactgaatccacgtttctgctgtttaagggtggctgaaaggatggaggtatagcttgtaatgcaaaatatacgcagaggttcatagtgaagctgaggaggagggccttcaaaagttaagtgggagatgtttaggtcagtagcaaatgggcccagtgggagagagtatgcccagagtttggagagggtcagggtgtcgggtgctgggatgagggcttcatgtttggaagacgcaaggtagagagcaagagaggaggaaaggtagaacaggatggagggcaagacctgtgtaagaagaagtcttaaactgtaaacatgggtgtagtgagggtagtgtggctaagaggaaatggatccagatgggcttgatggggagcagatgggcaggcacgatggcaggggtgcatcggctcactggggctgcatctgaggtaaatggaaataaaggaggtgaggaaatgaggaagagaaggaagtggcgggactggctgtggagttttgtgggagccttcttgatggaacagaaagaaagaagaggagaacaaggcttgagtggaagaggggaaggaaaaggcagcctaagggaaggcgctggcctgaatcagtggaagatctggaggagcaacagaaaacagttcttgaagagaaggtgggatagagagaggatggaaaagtttgagcggtgagagagcaggtcaaagtagtgagcacatccctatggagaagagatgactgagcccgatgaagcaataggccctgggtggttgagagaaatatgggccacagacaggcaggtaccttcccttggccaaggaagcaaggagaagaaatgtggacgcaaggggaaaggcttcaagaaagaatgtggaagtgggacgatnaggcagcgccaacnggggagtcacctacagaagacagggtggaggggcccccagggaaggatggagggcagaaagcgtggtggaagggagctgggcaggacagccacaggcaggacagccataggtggagtgaggtgaaggggcaggtcccagagtaggaacaaaggaatttggagtgctcagagcagcctgcaaggttcagcatggggcaaggaangtattagaggggggaagtcgacgcggccgcgaatttatagta

SEQ ID NO: 569902 - DNA, 1181 bp, Homo sapiens
  misc_feature (124)..(125): n is a, c, g, or t
  misc_feature (168)..(168): n is a, c, g, or t
  misc_feature (194)..(194): n is a, c, g, or t
  misc_feature (922)..(922): n is a, c, g, or t
  misc_feature (936)..(936): n is a, c, g, or t
  misc_feature (1139)..(1139): n is a, c, g, or t
cagttctggtccccactgagtctgaacctctgttgtcaagggagctgagaggatggaggtgtagcttgcaactgaaaatatgcactacacacacttcactacagaggtgcagtgaagtaggaanngggggccttcaaacacaggtagcatcttagatttagtgggagnttaggtcagtagtaaatggcacagtnggcatgcccagaagtttggataggatgaaggtttgggtgctgatacgggggcttcatttttggaaactttttccagagggcagagaggaggaaaggcagaacaggatggatggcaggacctgtgtaagaagaaggtcttaaattctaaacaagggtatagtaaaggtagtgtggccaagagggaaagaagaaatggtggatccagatagcttcaatgggtactgcaagatcaggtgtgatgggcaggggtgcatgggctcactgggaccctatccaaggtaaatggaaataatggagatgaagaaaggaggaagaggaggaagtggcgggactggctgtagagttttgtaggaactcacttcatggaacagaaagaaagaagaggagaacaaggcttgagtggaagaggggaaggaaaaggcagcctaagggaaggcgctggcctgaatcagtggaagatctggaggagcaacagaaaacagttcttgaagagaaggtgggatagagagaggatggaaaagtttgagcggtgagagagcaggtcaaagtagtgagcacatccctatggagaagagatgactgagcccgatgaagcaataggccctgggtggttgagagaaatatgggccacagacaggcaggtaccttcccttggccaaggaagcaaggagaagaaatgtggacgcaaggggaaaggcttcaagaaagaatgtggaagtgggacgatnaggcagcgccaacnggggagtcacctacagaagacagggtggaggggcccccagggaaggatggagggcagaaagcgtggtggaagggagctgggcaggacagccacaggcaggacagccataggtggagtgaggtgaaggggcaggtcccagagtaggaacaaaggaatttggagtgctcagagcagcctgcaaggttcagcatggggcaaggaangtattagaggggggaagtcgacgcggccgcgaatttatagta

SEQ ID NO: 569903 - DNA, 162 bp, Homo sapiens
ccgggagggttctcttgtagggcagcacagccgatcgggacatggatgaagtggtaggaatgtgcacgagtggggcagtgtgggggcttctcagtaatggagaaccagcttggtgaaactccatgttgttaggacctaggcaggtgaaaagtcttgcctcga

SEQ ID NO: 569904 - DNA, 929 bp, Homo sapiens
  misc_feature (62)..(62): n is a, c, g, or t
  misc_feature (66)..(66): n is a, c, g, or t
  misc_feature (70)..(70): n is a, c, g, or t
  misc_feature (77)..(77): n is a, c, g, or t
  misc_feature (90)..(90): n is a, c, g, or t
  misc_feature (155)..(155): n is a, c, g, or t
  misc_feature (182)..(182): n is a, c, g, or t
  misc_feature (189)..(189): n is a, c, g, or t
  misc_feature (196)..(196): n is a, c, g, or t
  misc_feature (205)..(205): n is a, c, g, or t
  misc_feature (211)..(211): n is a, c, g, or t
  misc_feature (227)..(227): n is a, c, g, or t
  misc_feature (229)..(229): n is a, c, g, or t
  misc_feature (249)..(249): n is a, c, g, or t
  misc_feature (265)..(265): n is a, c, g, or t
  misc_feature (284)..(284): n is a, c, g, or t
  misc_feature (291)..(291): n is a, c, g, or t
  misc_feature (300)..(300): n is a, c, g, or t
  misc_feature (312)..(312): n is a, c, g, or t
  misc_feature (326)..(326): n is a, c, g, or t
  misc_feature (341)..(341): n is a, c, g, or t
  misc_feature (371)..(371): n is a, c, g, or t
  misc_feature (376)..(376): n is a, c, g, or t
  misc_feature (414)..(414): n is a, c, g, or t
  misc_feature (433)..(433): n is a, c, g, or t
  misc_feature (457)..(457): n is a, c, g, or t
  misc_feature (463)..(463): n is a, c, g, or t
  misc_feature (509)..(509): n is a, c, g, or t
  misc_feature (552)..(552): n is a, c, g, or t
  misc_feature (616)..(616): n is a, c, g, or t
  misc_feature (696)..(696): n is a, c, g, or t
  misc_feature (709)..(709): n is a, c, g, or t
  misc_feature (723)..(723): n is a, c, g, or t
  misc_feature (774)..(774): n is a, c, g, or t
  misc_feature (784)..(784): n is a, c, g, or t
  misc_feature (830)..(830): n is a, c, g, or t
  misc_feature (905)..(905): n is a, c, g, or t
tgactgaaaaagataatttattccatcagaggcatcacaattacagattacagacatttgcnagtnaatnatatgcngggttagagcgcngcgttttaacatttaacattcatgagttaacagagatggccggggggtaaatatcttgccaaggnggttcctggtattaagccttttgagtnttaagangacaaanccctagggntcaggnggttttcccgcccgancncttgtcaatgagaaaccccncagccccttttgtctngggtctcacagccccagangtgagcngggccagancgaagccatccnagagtccccaaggncagccctcccgtggnccccggctagggcccccagagtctcacccncaggngtgcgccaccctgggcctgcgtgccggcggggtctgcngccacaggtcccgcgagtnccggacacttccaggacgtggtcncctggngagacagcccccccgggtaccagtttcgactcccccgggcagcganaacaaagtcgagtcccgccctccagcttcgcctgccgcgcgcncttgtcctctctcggccgcgccaaccctggggcacagctggctcctcctgggggcgatgcagcntcacagggctccggcccaccccgggccagggcgccgaccctccctgccggaccctctttagaaggccgcgggtttgggtntggctcacccctnaaagattccaagantgggcgcactctgagccccccaaacacaaaatgatgggatccctgcgcgtncccccacgtnacaaagtggtaggggtccaggggcattttaattataaacggggctnaatcacaccccaaaattctaaacgcctccccccctaacctgcaggggcaaacagcccccctatttcattgccggnagcaactttgtactttcgtactga

SEQ ID NO: 569905 - DNA, 1682 bp, Homo sapiens
  misc_feature (1620)..(1620): n is a, c, g, or t
  misc_feature (1644)..(1644): n is a, c, g, or t
ttttagagattgtttttttcccttacttttctaagcagtgttcagctcagaaaaagtaagggaaaaaatcaatctccaaaatactaaatgctggaaatggcagagtaaaggccagggagtcaaggtggctgtccacagcagtgattcttatctggggtggggggtgggtttcacccgagggagggctgggggcatggacccccaggcaggcctatccaatcatctgaagggtgagcagtgttcagctcagaaaaagtaaggggaaaaaaaagcaatctctaaaaggaacatagacaatagcaaaagaagaaaccgagcccaaaagatgcttctgataggccgccttggggtcctgcatcctcgggtgagaatcactggtggacacgggaggatggagagccgggcagacatgtggagtgagaggggaagatgcatgtgtggcagggctgatggaggcatcagggtcaagactgtcaggtgttagaacacagttcctgacagaccaggacaaggatgacagcgaacaaatggatgtagctgaaaaggcaatgggaccacggtggtgcagctggggtttccaacgcctcggtcccagactcaaggactcaggtggaggagtgaggcccagagaagggcccagtgactcagaggaagtgggctgtgcgggtgagagcagagagcaggggatctgttgtcacggggaggaaaggcgcaaaggggaatggagacagcgtggaagaagagcgtcttgaagacatcggtgctaaggagggaggaggcaggaggagggtgggactgacaggaggacccaggaggagcggaggagccgggtttcaggcagggcgggagagtcaggttgagactgggtgcgtttgtacccgtgggatgtgggggaagagggtgggcaggtggagtggggacagcagtgagcgctgatgacaaaagtgctgtggtgacaggaagaaggtaggaaattcacaggcgcatgttccccagagtgtttttacacagaatgtgaaagaaaggatgagaagagaatcaggaaggtttaggggagtcagggttgtggggccctggaaaggactcatagcctgggccactgggacgtgagcttggacagcagagcgtgtggattcagtgcagtacgtgtgacacagagaggactgcatctggtggagcagtgggtgcgggtgagaacagatcccctgctctctgctctcacccgcacagcccacttcctctgtgtcactaggcccttctctaggcctcactcctccaccttgagtctgggaccgaggcattggaaaacccagttccaccaccagtgattctcacccgagaatgcaggaccccaaggcagcctatcagaagcatcttttgggcttggtttcttcttttgctattgtctatgttccttttagagactgctattttttttcccatacttttactgagctgaacactgctcacccctcagatgattggatagccctgcctgggggtccatgtccagagacctccctccacgtgaaattcaccccctaccccagataagaatcactgctatggatgccaccttgactccctgacattactccctcatttcacacctagaccatnctagtgcttgccataggtggcatnctagtacttgccatttaacttcccacttaacacatctc

SEQ ID NO: 569906 - DNA, 209 bp, Homo sapiens
  misc_feature (189)..(189): n is a, c, g, or t
  misc_feature (194)..(194): n is a, c, g, or t
  misc_feature (198)..(198): n is a, c, g, or t
tcggtcctgaactcatgttgaagggggtcgagcccaagcccggagagtacgacgacgcctacctggccagcatcacccgcacagtaagaacacttcgcgctcacggcataatgaccctcttggacgctcaccaggacatgtataatgagaagttcgagggtgagggagcccccgactgggccgttctcnacaangggnaccgagctcca

SEQ ID NO: 569907 - DNA, 995 bp, Homo sapiens
  misc_feature (373)..(373): n is a, c, g, or t
  misc_feature (561)..(561): n is a, c, g, or t
  misc_feature (972)..(972): n is a, c, g, or t
  misc_feature (977)..(977): n is a, c, g, or t
ggggatcagggaatgtactgcagcaagggaggcatgccaagagcaagagtgtgggtgtgaacgtagagaatcctcctttttgcccaaaaggggcgaagtgtttgatgcaggtcatggaggagaaagcatggtgtgggtaagacacggaaggaatgaaggacaggagggaggatggcaatagacaaggaggatgtagaagatgctggcaccttggaaaagctgaggcaccacagtgtcaatgaagggcatggcgagactgatgaaaggccagaggacacaacagagagaggaaaccactgttccttagaggcagaactgagaatacaggacggttaggggtgaactgagacagcagatggactcagtacagcangttgaggacatggaagctggcagtggtgtcatcagtgggggcagggcaggaaggggtcagagttcaggaaagattcctgagtctgtggattgacctggcggagacaggcacgcaggactggatgttgaagaggaggtggagcatgtctggaagatgaaagtgggaggaaacagtggtgcaggaattanatgtgaaccttgtgtggaaaaagtgagacattggagtggagcagccacatggaggtggtgtgatgtgagtggggtcagggaagttgatgggaaaagaaagagatttgtggtgcaggaggggaaagaacatcatgaagttgtggggagcttagtgtctgtacagggtccgatgcagaaaaggggaaggaggaaatcagagttccccaaatggggttttatcagatctcagggaagttggtatcatgcttcttatcaaggccaacccataggattacggtagggaggcaaaatcccaggcttttcagaagtggatccttaggaaaggaaagtagggggaaggtgcctaagtcactcagggtaaatggaggaaatggggcatcactgcacattcagacagcacctgcatggaangtacnggcaggtaaaccttgggg

SEQ ID NO: 569908 - DNA, 120 bp, Homo sapiens
taatgtcctttagaatgtttcggtacatttacacagggatatcgattcacagtctccagtgttcggcacgaccctggaacactcgcccatctccagctgtgacacagtgacaccgaggcc

SEQ ID NO: 569909 - DNA, 297 bp, Homo sapiens
caaacaagggctaccctttgaaaaatgtatgctgcctatggactattggcataggtataaagacatttaaacactaccatgggatggatattggctgggccgaggggttcatgcttatagtccccgtactttggaagcctgaagtggggggattccttgaggctaggagtacaagaccagtttgggcaacatagcaagaccctgtatcagcaaaaaaatttaaaaagatttaaaaaatttacctgtgcatggtggcatgtgcctgtagtcccagctgctagggaggctgaggcaggg

SEQ ID NO: 569910 - DNA, 491 bp, Homo sapiens
  misc_feature (195)..(195): n is a, c, g, or t
  misc_feature (200)..(200): n is a, c, g, or t
  misc_feature (202)..(202): n is a, c, g, or t
  misc_feature (205)..(205): n is a, c, g, or t
  misc_feature (291)..(291): n is a, c, g, or t
gatgaacaagcgcttaacaacaacgtgccggtgatcatcacgactttgacgaggttcgagatcatggtttcagttccctatgggctggaggcgctggggtcctctctcagtaggggatcgtagacctcaacagcgcagggaattatgaaactttgctgggtgacagcatgagttcaggttgccgccttagggcanggcgncnggnttggttgtcaggctttgactggggccgttacaggcgcaacctgctcctgggctcggtcaacgagtagcgaactcaactcgattaantgctgaatgcccagggcgatggcgcgttgggagtcgtcgaggtcgaacgccaaggtggcggccatttcgttggcggatgcgaggattacggcggcattggccaggagggtttcggggtcgatggtcgggtttacgaggaataggttgttgcttgggagttcaacaggcgcagcgtcgtcggatgggggcaagtgatgatg

SEQ ID NO: 569911 - DNA, 142 bp, Homo sapiens
cagcctggggctgctttatactcctgctctgtagcagggacggtttgtgtggcttcgccgggcatttcctttgctggatcctgggaagcaagatccaaatcaagactgaatatgctggctaactgcctacttatcagcttta

SEQ ID NO: 569912 - DNA, 272 bp, Homo sapiens
  misc_feature (17)..(17): n is a, c, g, or t
accgtttgcctgttttnaaatggggaaaaccgggcgggcgcgttatttatttaagggcgcccgtgtgcgcgggggtgggaggccccctttcaaaaaccccagggtttttggttttggggggacagttttgtgggcccggcgaaaaaaaaattttttttttttttaagtcctttcatgtttttgtttggggaaggcaagttagttaaggatcccttatgtggggtgagaccagccctttgtgaaacctttaaattagaagtaaaggccgatga

SEQ ID NO: 569913 - DNA, 348 bp, Homo sapiens
acgtaacgatcaatacggtgtggtgacaagccaccacggaatatcgctgaaccagtccctgaaatgggataaatttcaatgttttcttcacgggaaaattcatgtaagcgcgcaatggctaacttgttacccgtaattgagctcatgaaaccagctgtcaacgctgaatcagatccagccaggaaaacacgcatatactttggtcggaatccaaaatgttcttcatgcaacttgaggtggtctttcaaaatttctggtgcgtgaagttgggtgtcaaaatcctcaaataggggattaatttcattatagggggtgtttttatctgaccgggtaacctcacctgactta

SEQ ID NO: 569914 - DNA, 207 bp, Homo sapiens
tgagctcggtaccccaggctgagtgagtggtctgatctcctggactatgatctgcccgctcggcctcccacagtgctaggattacaggtgtgagccaccgtgcctggcctgtacatagcttttttgaacaacaataatactatgcaaaatttctataagaaacacactcccggtggacgcattgtcaataaagcacagttggctgag

SEQ ID NO: 569915 - DNA, 224 bp, Homo sapiens
gtcgaccaggaggtggaggttacagtgagctgagattgtaccactgcactccagcctgggcgacaaagttgaggctctgtcccccaaaaataaaataaaataaaatttaaaaaataggcgaaataggccgggcatggtggctcatgcctgtaatcccagcactttgggaggctgtggcaggtggatcacctgaggtcaggagtttaagaccattctggtcaaca

SEQ ID NO: 569916 - DNA, 194 bp, Homo sapiens
aggtacagagtgtccccagacacgaggaggtcgagaatccggcgctcaatagacagaaacccggggcctcctgtaaggtggggctagccacagatgagcctggctatcgccggactgtggaggagcctgcagactcctgacgagctggcagctctgacgatggtctgacgggataacttacttggaactgctga

SEQ ID NO: 569917 - DNA, 383 bp, Homo sapiens
gggagacgctccctagtctatttttattcataaaacatcgacagagaccattccatggcctaacacacaggtaagttacacaagtagtccattttacttttcatcagtcttaccctgtatcgaacaagtattattgagaatacttagtcctagtttctgtatagcttacacactgaaaattttgagaagcatctaaaaaaatccacaattagtgcacaaagaggggacaatactttaagtcattccttctataaaacgaattaaggttactaaatgccaatttttaagcaaatatatagtttcctatttgccttctgaaagacagcagatataaaaatagttcaatattaggtttaacaaggtttgaacaacacatgtactat

SEQ ID NO: 569918 - DNA, 133 bp, Homo sapiens
taccgatcatcctaaatttattatgatggctatgagttggacaattgcaagaaactgaagctacactcctttatcaggagtttaatgagacaactagtctaaatcatataactcaaagtgcatgtcaattaaa

SEQ ID NO: 569919 - DNA, 491 bp, Homo sapiens
gacagcccatggggaggccgaggggcgcggacgtggggtggggagtccccggagccccaggtccggccatgggccgcaggagggcaggcgcgggccgggggcggaatggtggcgcctcggcacctcccgacgcgctccctggaggccttcgccgaggaggtcggcgccgcgctgcaggcttccgtggagccagggcggctgacgggaggggggccgggccggttggcgcttgccctgcaagctgtgcatgtgggagttgggccactgagatcgccgcggggctgcacgggccgcaagcgtggccgttctggggctgttgcagctgccctgagccggggccagagattcggcggtctggtgctgagccccgtggtcaaagcagaacagcgtccccgggagacagacaggcttggtggcgcagtcgggggtcgccgacatcgactgttcctgggcatggctggaagagacagcgtgtggaacagatggaggga

SEQ ID NO: 569920 - DNA, 284 bp, Homo sapiens
  misc_feature (27)..(27): n is a, c, g, or t
  misc_feature (113)..(113): n is a, c, g, or t
  misc_feature (138)..(138): n is a, c, g, or t
  misc_feature (202)..(202): n is a, c, g, or t
  misc_feature (244)..(244): n is a, c, g, or t
ctggtcttgaactcctgaactcaagtnatcctcctgcctcagcctcccaaagtgctaggattacagccatgagtcaccacgcctgggctgggctaatttttttttaacctttnatagagatggggatcttggtatgtngcccaggctggcttcaaactcctggcctcaagcgatcttcctgccttggctccctgaagcactnggattacaggcatgagccaccacacctggcccaccctttttnaagtagtctgggcaatgcacaaagcagtccatggtgggcc

SEQ ID NO: 569921 - DNA, 404 bp, Homo sapiens
caagttcgagcagttttcctgcctcagtcttctctgagtaggtgggaccacagtggcacaccaacacaccttgctaatttttcttttaataagagacggtggtctcagccgggcgcaatggctcatgcctgtgatcccagcactttgggaggccgaggcgggtggatcacgaggtcaggagttcgagaccagcctggccaatatggtgaaaccccgcctctactaaaaaaatacaaaagagtagccgggtgtggtggcggtcacctgtggtcctagctactcgggaggccgaggcagaagaatcgctcgaacccaggaggcggaggttgcagtgagccgaggttgtgccactgcactccagcctgggtggcagagcgagactctgtctcaaaaaaaaaaagggc

SEQ ID NO: 569922 - DNA, 248 bp, Homo sapiens
  misc_feature (4)..(4): n is a, c, g, or t
  misc_feature (30)..(31): n is a, c, g, or t
  misc_feature (246)..(246): n is a, c, g, or t
acgnttacggtcactgatagttgatgtgcnnctgaaacccacatccgatcaatctcctcatagagcttcttcttcacctgaggattgcgcaacaggaaggccaggatccatttaccacagaggcgggatctccacgccaaccccaaagatgtcccctatgacgacgagaatgtgattatctgaaagcaacttgatcttgatctgggccagcatgcctcatctgattcatctcgcttccatcaatgngt

SEQ ID NO: 569923 - DNA, 148 bp, Homo sapiens
tatgctgtacaagacggcgagcatatgtggccgaggacgagtagtatctgccactgaggatgaggctgatcctgctcagagaaccatcatgtgccgagaaagaataccatctgctggagagaaagaccatcatgtgaagagactcagc

SEQ ID NO: 569924 - DNA, 682 bp, Homo sapiens
tcagtgttctagcaacagatcagacattttgtaatgatgcctgaaataaacataaccacctcgaaagcaacaggttcaagctcctggcagagatgtgtatccttatggatgacaaatgacacataacaatgtggagctggagaccaagaagaattggtcacctgaacgagaacattgagaacggatatggcatcgagcttaaaggtgtcttcttatacaacaccgaaaataagcttctgtacagcaaagatcagatgctaagattacctttccaggtttgttatacgacatacgtgtggtagtcatccatttaagcaaatccagccgagcttgtgaggaacatgtgacaccctgtggagtgaggcagatgcagcacagagacggctgaaagcttgagcttaggaatccctttggaagaggttcctccagagagaatttactcattttaacaccgaatttcactacaaagctcagtcgtgatggaatcgtggggatgaccattgacaattgggattaccattttggtcggtgacggaagactgtaaccttttgaatcccgggatccaatgagataaaacggctatggtcatgtgtcacaaggacgacttaaaagaactttcttgaaaaaggcaggccaggggttgcaattcaggataacggcatggttcaaattatttgcggg

SEQ ID NO: 569925 - DNA, 178 bp, Homo sapiens
aagaagcgcacaagaggacgagagcgaccctcaatgctgggaagtccctgccacactcagtcccccaccacactgaatctcccctcctccccgttgccttgtagaccccttgacgaggggaggggcctactgagccgcaccttgtcatgtaccatcaataaagttccgttgccgccgt

SEQ ID NO: 569926 - DNA, 112 bp, Homo sapiens
  misc_feature (2)..(2): n is a, c, g, or t
  misc_feature (50)..(50): n is a, c, g, or t
cngaagggcccctgcaaagtaatagggcttctgcctaagcctctccctcnagccaataggcagccttaactatcctaacaagccttggaccaaatggaaataaagctgatac

SEQ ID NO: 569927 - DNA, 1024 bp, Homo sapiens
gtggagtgcatggaaaagaccttgccagaagcctgtgggcacccaagtcagcatggaagagattcagaatgagtcggcctgtggcctagatgtgggagaatgtgaaaacagagcgagagagatgccagggtatggggcgccgggggctccctgaaggtcaccattctgcagagcagtgacagccgggcctttagcactgtacccctgacaccatgtcccccgccccagtgacttccggtctcgcgtccaccgcgtgcggactaccaggcacgtcccctcgtaaagcgaggcccgtccgatgttacttcgtgctagtagtctggcaaaggggcagttgcatccaagccaggcaagggaagttcgcagggaccaccgattggtcgtaaggccctcaggcaccagggcagccggcctaggggggagatccaaggcaggcatgagccaaggcgctgcctccttgtccgctgcgtgccctgtgcccgcgggacggtccttggagacaggacggattgaggaggcctccacccaagggcggcctggttgcaaacacctgccagcgtcgtactacattgggggacctagatccaacaccgcagggacacaggaccacaagattgccaaaacaatccttgcggacccttctgcaccggtttgaaaccgtacttcaaaaagcgcgtcgcaaaggttttgtgggaggcacgtttaagttccccagggggcataaggggacaaaaaggcgcaagggggagctgaaagttctgctttggacgaaaagaaaaatttgcttggccccaagtgattgatggggacgcgctttcccttaacaggctgcgacgcctgtgggagtagcgacccaagggggtgaatgaagaaaaacgggaacagcgagttcatagggctctacaaagaggagtctgcggttgtaggaagaaagtcttcgtaccaggtagggtccgaaaaaatattcggaagaccgaagggtgtgaaaccaaaggcccaatgtatatttgggagcccggggcga

SEQ ID NO: 569928 - DNA, 658 bp, Homo sapiens
taatttttgtatttctggtagtgatggggcttcaccatattggtcaggctggtctcgaactcctggcctcaagtgatccacccgccttggcctctgcaaagtgctgggattacaggcgtgagccaccgtgtccagccgattgaatgttttaatctctgattctgataccgttttttgttttttgggtttgtattctttttttagacagtgtcttgctctctcatccaggttggagctcaatggcgccatctcggctcacggcaacctctgccccctgggctcaagcagtcctcccacctcagcctcccaagtagctgagtctacaggcacccgccactatgcctggctaatttatgtgtgtgtgtgtacacacacacactttttttttttgagacagagtctcgctttgtcgcccaagctggagtgcaatgtgcgaacttagcttactggaacctttgtctcccaggtcaaggcattcttggaccttagcttcccagtagcttgggattcaggtccccacaccatggctggctaattttggattttagtagagccggggttcaccaggtggccaggttgccttgaactcctgctttaagtgaatcacctgcttggcctccgatgtgggattgtcgggtgaggcccccttctgcccccc

SEQ ID NO: 569929 - DNA, 220 bp, Homo sapiens
ttcccctgatggcccatcccagcccctgaagttttatgccaagaacacaggtaccgcacaccaccttgaaacagccacagccaaggtaggcatgcatatgaggttttccccataccctttgggtgttgagaggtttagccacatgagggagcagaggacaatttttgcagggctgggagtgggtagggactgaaggtttcaataaaccttcagaccctga

SEQ ID NO: 569930 - DNA, 144 bp, Homo sapiens
  misc_feature (28)..(28): n is a, c, g, or t
  misc_feature (135)..(135): n is a, c, g, or t
gatcttaaaagtgttattattggctttnattttttaaaaaaagaaaaggaaaattggcaattgtattaatccattctcgaattgctgtaaagaaatacctgagactgggtaatttaatttataaagaaaagaggnttaattggc

SEQ ID NO: 569931 - DNA, 396 bp, Homo sapiens
aatctcgagacccgcttgccatttgaacccgatgattggggacattccggcacctgtacaaacgtctaccattggaaccacgcaaaaagcactgattaatagatcaggaaaagaatggcatttaaggaaattctcagcgacaagggctttgcgctatcgcataaagcttttgaccatgttcgttgttgaactaacctgcaaaacgaaattagctgactacttaccaccaatggcggaaacaggaaagagccctgcgactggattgattctcaggtttaactggcacagatgcaaagtttatataataaactgagtatgatcaatctgctgctaagggtgacgatatgagttgatactttgcacttgcggcgtgattaatgagcgtgccccagaggt

SEQ ID NO: 569932 - DNA, 523 bp, Homo sapiens
ggtgtagttgtaatcagtggcctctcatctccattaaaaacacgaaattcacgcgggaaacctatggtcatggatttcctatctgctactcacagcttgaccagatggtctaacatgggggaatgcctagcagttaacagccattacctagcctcgggttaccctcttctggatttctagtttttttcttacggtcttcttgtactggcttaccgctctgttcttggtgagaaagcttttcccgtgcggcctttaaaacttatactatgctggggaaaatttgggactaaagtgacattcacattatcctgacctcatcgcccaaagtgactgaatgaactgaactaatgtacactacaagaacatgtcttaataggaaagtagacggtggtcggtagtcgtcccatggtttaatcatggctgctactatatggacatgaagtagcagtgggtgtgcatgttggtatatcttgccggtgcggttaaataagtccacgcacatctcccgtggggtaggaggtgc

SEQ ID NO: 569933 - DNA, 875 bp, Homo sapiens
ggaggtacttttctaaaagtggtatctgttatccacaatgtattttagttattcccacaagtcaggagtccagatgacatgagcggttatcagctaactgataatgctatcgattgaggttcatcaagtgaatttcgtacagtttctagttccctattggtgaaggcgaaaaatgatgattttgctagacctagattttggcttggtttctatgcctcctttttatggcagccttcagtcttctcatctcccaaatcccctgagccctgtaggtttacatagtggacaaagaacttgtggtcttttaataactgggtactgatacttttttgagagagtatcgtgtcgaacagtgtgatgttctaccactttatcgaataactaatttcgaacatacacagttggcctctctgatctagaggaccgaaactagtacagctcacagtcggacggcattatcaagggttggcattagcggtcgaagcagcgtctgctccctactctgctacagccaccaggctcggtcaatagagtgactgtgacagcatgtagcattgttcctattatgggctataaactaggtccacagacactaagctggtaacggcttattgtacagctatattgtcagtattcttctggcttcagcataccttactagttcatctctaacctgctatcactctgaactcgactggcgcataacacacgctgtcacccgcacttctcatctctccctcagaatgcatatcacaacgcccctcctgctactcatccgtccgctcgctttcctctgcgttcctctcactcgtcaactgtactaacaccaccaacgtgtctctaccgcttacttcacgggcctgcatatattccaa

SEQ ID NO: 569934 - DNA, 391 bp, Homo sapiens
agtacccaccttgcatgtaaaatgtttatgataaagataatgaacacagtaatgaaaaaaaaaaagaaagaaacggtatggagattggctcatggaactagagctgggtcattctcttaattaactccggtccaaagtgatgatggaatttttattctactttttcatagatccgagtacaggtgacttgtgtcatgacacactccaccattatttccccttctttcacttttctggtgatggtgcttcccttcccatcccattcctgatgctgaaccaaggcaccatcgtgtaggtggcagacagtctgagtttttctgccatcagcggtggtttcttcaaacttctctcccagggtacaagaaagcggtgtggtttccaaggtgccctc

SEQ ID NO: 569935 - DNA, 170 bp, Homo sapiens
ctactagtactctttgctgtcaagacagaaaatatcatcataagaaaactacaggccgggcatggtagctcatgcctgtaatccaagcactttgggaggccgaggcaggcagatcacttgaggtcaggagttcgagaccagcctggccaagatggtgaaaccctgtctct

SEQ ID NO: 569936 - DNA, 489 bp, Homo sapiens
tgtctagaggacccgtgattctctattatcgacctgaatacgtatgtaaatgatagcactaaagttaccagttttaagaactcctgcatattcccaagggaacagaaaaaaatacattgcatggataaattagatgattccaatccttaacgtggtaagggctgcaatagagaagtgggcagtgtgctagagggactcagaggaggaaacatcattgatgcctaggggagctgggaaaacctttacagagtagggaaacatagccactcagtcctgcagagggagtaggaggtaacagtaactcaaaggaaaaagggagaaaggactttctggcacagaaaatatcatatgcaagggcaccctgctggaaacagacccagcctgtccagacgctgagaaatgtattattgccaaggtttagggatagacccattgaggtgaagctggaaatctgattgagaccagaccctgaagagcttcaaaagccaa

SEQ ID NO: 569937 - DNA, 293 bp, Homo sapiens
catgcggaacagggaaaatcaactataaccgcaattcctcagagataacgagctatcagaatattatttcagagttctgctcatcaccacgaacatacgcaggtttccacatgggtacttcccagggcacctgccatggcagatcccgttcacgttggaacactggcacacaacagcacaccagtggcatggttctcagctgcagcatctgggcatcagtttcctgcaattccagcacagtgttcaccgagcccaccattgccatggtattcagcgtggccacccatcatcat

SEQ ID NO: 569938 - DNA, 427 bp, Homo sapiens
  misc_feature (23)..(23): n is a, c, g, or t
cccgggtcgactactactactanattcgcggccgcgtcgactgagctgctgggactacaggtgcttgccaccatgcccagctcatttttgtattttctgtagagatggggtttcaccatgtttcccgggctactcttgaactcctgggctcaatcggtccacctgcctcggcttcccaaagtgccgggattacagccatgagccactgtgcccgaccttcagtagcttcctgactggtctttcttgctgctggtctctctccctagctatcctacatttggccgtttgagttagctctccaaagcataggtctcccaacacctacaggataaagtccaaacatcttaccagaatatgcttcaaactctgacaccaactatttgtttaatgtctgactctttaatagactgtccattctatcagggca

SEQ ID NO: 569939 - DNA, 937 bp, Homo sapiens
  misc_feature (451)..(451): n is a, c, g, or t
ggctgccctcatcgatctccccatcccattcaatatactccgtatgtatggaacattgagatcagtccttgggtgcctgcctgactcctccgacatcagcacaggacctagtcctagtccatgttcttagtcaccaaacgcctcgaccggcttgtcatcaagcggcccacatcagtcgcagacgtacagttgtggctgaatcatccgaagaaccttccaagtcagagatgtgacgtcctacattaatttctctagatctgacctcttctctacaccatcaggagacgagtgatctatatccacgagatcatttctctagtcagaaacctgaaaacatcgtttcataaatcgcatacctgctgtgacaaactatagacaacaagaaacttctatagagctaatgtccgccgccgttgaaggcccaaatatcactctctatggggggccaacnagcttgatatacaaactatgacttatccgcacaatccccaatatcgatttgggtgcactaagcacacatatgttacaaagtggtaattcctggatggtagggctatcatccatgtaataccatgttcccacaaacctcttcaactaccgtataacattttgacccttatcgaacattatccagtctcgtccacttgtgcgatatactatgcaatgcgcccatacgcaagctcgacacaactcgtctctattcgtgtggcacgatagagcggcgcgatcgaaactaggtccccctaaggagatcactctcccaatatccgaagtaaagatcaggcatggaccactcccttaaagagattaaaccaaaaagagggccctcgtgcttatatttctgttttccttttttctccctgttcaattggtgtgacaggcacttaatatgtcaacaaggagcttccctaattgggtgaacccaaaacaaacgttt

SEQ ID NO: 569940 - DNA, 667 bp, Homo sapiens
cccccccccacagcaccaagactattatgacgtgccgtaccggttgttaattcagtgccgaggcctcgaatctcttggttaaggtttggtcaccacgacagaactgcctgatggaaaggccctgtagcacggaaaggatatggtacccagcacacttgagagaaccgaaagaagtccacgaagggaaagcagaggctgtgagctgttgggaggcaatgcagggcgcatcacctagtggccttctccgccaagtggtggaagctagtctttatcctaatgagcattgtggaaactatcgtgaggctttaatcatggaaacgatgtcttaaagggaacggagtgcaagagtggacactgttaggtgccagttcagtggccaggttgaaaggtcatggtagctcacactagcgatcggcagtggtagacaaacaggcaggctgattactagtgtatctgggacagaacattccatacaaatcgtaggatggtggcgctggaattatagtgattgattactgtggcccactcacacagtacagactatctgccccccgagataatttctaggaagtggaattcacgactctctcagtttgacaggtggggtaacagcaagttcaaagaacaggaacttgagtcccagaccatgtgccatgtccagagctgg

SEQ ID NO: 569941 - DNA, 257 bp, Homo sapiens
agaggatcctgggctcagtgatcctcaatagcagggattcactggggcccatcaaggcagcagtcttccagctgggtgggctggctcatccctggaatcccaggatttaaggaggccaaggttggaggaccactcgaggccaggagtttgagaccagcctggcaacatagcgatgacagcctgtctctacaaaaaaattaaaaaaattagccaagcatggtggggcatgcctgcagtcccagctactcaggaggtgg

SEQ ID NO: 569942 - DNA, 141 bp, Homo sapiens
gcgcgctggctccccccatgacagtgccagcttcagatagaccatctgaaaagagatacgtgtgcgagaagagttgtactgctgtcacaggaaatggacgctggattacaagcatggcagctcaggcagcaggttgagtga

SEQ ID NO: 569943 - DNA, 1016 bp, Homo sapiens
gaggattctgtggactcggatgaatctgacgaatctcaccattcggatgagtctgatgagaccgtcactgctagtacacaagcagacactttcactccaatcgtccctacagtcgatgtccccaacggccgaggtgatagcttggcttatggactgaggtcaaagtctaggagtttccaggtttctgatgaacagtatcctgatgccacagatgaggacctcacctctcacatgaagagcggtgagtctaaggagtccctcgatgtcatccctgttgcccagcttctgagcatgccctctgatcaggacaacaacggaaagggcagccatgagtcaagtcagctggatgaaccaagtctggaaacacacagacttgagcattccaaagagagccaggagagtgccgatcagtcggatgtgatcgatagtcaagcaagttccaaagccagcctggaacatcagagccacaagtttcacagccacaaggacaagctagtcctagaccctaagagtaaggaagatgataggtatctgaaattccgaatttctcatgaattagagagttcatcttctgaggtcaactaaagaagaggcaaaaacacagttccttactttgcatttagtaaaaacaagaaaaagtgttagtgagggttaagcaggaatactaactgctcatttctcagttcagtggatatatgtatgtagagaaagagaggtaatattttgggctcttagcttagtctgttgtttcatgcaaacaccgttgtaaccaaaagcttctgcactttgcttctgttcttcctgtacaagaaatgcaaacggccactgcattttaatgattgttattcttttatgaataaaatgtatgtagaaacaagcaaatttactgaaacaagcagaattaaaagagaaactgtaacagtctatatcactatacccttttagttttataattagcatatattttgttgtgattattttttttgttggtgtgaataaatcttgtaacgaatgta

SEQ ID NO: 569944 - DNA, 105 bp, Homo sapiens
tatcgtacaccatctctggtccccagcatcctcagacctctcagcttctctttcattaacttttattctaatctgtattacttccttccttctttctctttcttt

SEQ ID NO: 569945 - DNA, 174 bp, Homo sapiens
tcccaacgagtcgcaataaacatgcagttccaggacgtgatactctgcaggaacaaagagagacagcagactacaagtctatggggggtgacaaaggatctgagatcccatcagagtagacttcaagttggcagaaaccttttcattggccaccaggcattcccttgattacac

SEQ ID NO: 569946 - DNA, 376 bp, Homo sapiens
agggatctctgcgctcaaaaattatacctgtgcagcttctcaaacacgtgactgtgtgctaaacattaagctacgaggatcttagtgcacctgaggcacattctatctgacacggatatggcagggtaaggccactctggactggcacacatgctaaagcgccacaagaccttcaacattgtctgagagcaaccgagtatttgccaataaatgagaccttatttttccagcttgactggccatgtaacttaaacatagaataagcgctaattttcaagcacggctggaaagccgggctttacctgcccctccgttaccatctaaagtgtatgctgaccaaattgctgagtaacatataccgaggctgagaccacgg

SEQ ID NO: 569947 - DNA, 536 bp, Homo sapiens
  misc_feature (11)..(11): n is a, c, g, or t
  misc_feature (48)..(48): n is a, c, g, or t
  misc_feature (72)..(72): n is a, c, g, or t
  misc_feature (74)..(74): n is a, c, g, or t
  misc_feature (77)..(77): n is a, c, g, or t
  misc_feature (112)..(112): n is a, c, g, or t
  misc_feature (119)..(119): n is a, c, g, or t
  misc_feature (133)..(133): n is a, c, g, or t
  misc_feature (150)..(150): n is a, c, g, or t
  misc_feature (157)..(157): n is a, c, g, or t
  misc_feature (177)..(177): n is a, c, g, or t
  misc_feature (179)..(179): n is a, c, g, or t
  misc_feature (181)..(181): n is a, c, g, or t
  misc_feature (185)..(185): n is a, c, g, or t
  misc_feature (187)..(187): n is a, c, g, or t
  misc_feature (222)..(222): n is a, c, g, or t
  misc_feature (225)..(225): n is a, c, g, or t
  misc_feature (227)..(227): n is a, c, g, or t
  misc_feature (229)..(229): n is a, c, g, or t
  misc_feature (242)..(242): n is a, c, g, or t
  misc_feature (249)..(249): n is a, c, g, or t
  misc_feature (251)..(251): n is a, c, g, or t
  misc_feature (286)..(286): n is a, c, g, or t
  misc_feature (292)..(292): n is a, c, g, or t
  misc_feature (313)..(313): n is a, c, g, or t
  misc_feature (322)..(322): n is a, c, g, or t
  misc_feature (333)..(334): n is a, c, g, or t
  misc_feature (337)..(337): n is a, c, g, or t
  misc_feature (339)..(339): n is a, c, g, or t
  misc_feature (343)..(343): n is a, c, g, or t
  misc_feature (354)..(355): n is a, c, g, or t
  misc_feature (375)..(375): n is a, c, g, or t
  misc_feature (379)..(379): n is a, c, g, or t
  misc_feature (421)..(421): n is a, c, g, or t
  misc_feature (429)..(429): n is a, c, g, or t
  misc_feature (449)..(449): n is a, c, g, or t
  misc_feature (476)..(476): n is a, c, g, or t
  misc_feature (489)..(489): n is a, c, g, or t
tgaaagtgcanagggtgaccaagcctgggaaggccccaggggtccaanaccaaaattaaaggtttattaaananaanaggacgttctgtccctcaaagtggctggccacccnccccacnctggccaaggtccngcacaaaggtttgtccncaagggngacccttcttggccgcccanancnaaancnccggcggagaggcacgcagtccatgctgctggcanaantnanttggccagctccncaaccancnctttgcgcatcttgtccttgaggtaggcgcctttntgccantaaaaattgagttccaaccantcaaaaaangggacgtccannaanangaancctgcagccannatgtgtcgccgggccaaaanaaancgacccagcaagtccttgcttcggctgttgaagttggggaantcccaccncaaaaacgctagcctcttanaccctggaggtggtgactggctcccanttggctgggcaangtgaggtgccacaaagtcccttacgggcagaaactcgccgtcactgt

SEQ ID NO: 569948 - DNA, 135 bp, Homo sapiens
  misc_feature (107)..(107): n is a, c, g, or t
ttgtgtactagcatatctgagtagctgacgttgagactggcaccaatgtgagtttgtgttatcaatgtactgtgcccatccagcggaagacttctccgtaaccttgncttttgagcacactacacatgaaaactt

SEQ ID NO: 569949 - DNA, 856 bp, Homo sapiens
gacacactttctgggcactgtgtccagtcccaaaatggaacataatgaagtgttgcttctagttcttcatttctgaaatcaggtcaaggagagccctgaatgattatgtgaatatcgcagtggcactttcgactgttcagtgtcacctaagaagcagtctggggagcgaggaagcagagaagaatgtgcagcactaatgtgaagaggagaaagaattctgctgcaagggtattccaatatgtaagtaaagagctaaagtgtgtgataatggtctgaaaatcaggatgtcctccataatcattaggatgagagatgcagagtaagatctgaaaagtaaagtgtatcttccatgagttgcatagactgggaatggtatgaactacagagggactattgtacataaaggaaaaatggaatcagactgtcatgaaatggtgattccatttactccacggaagatgcataggtcgagattttgaccctttggatctattgtgtatacttactgtaaagtgtcggtgtgtgtctgtgagggatggttccaggatcgatgtggatacgcaagatccatggttctcaagtggcttatgtacaagtggtggcacgtgttagcgtatgacctacatacgttctcttggtgcattcccgtaatataatgttaaatgctatgtaatccgtggtaatactggattgatttctaatgtcgtattgttggttcattgcgtattggaaatggtcgtgtcagtcgtttcaaagtgatttgcattccagagttggtttgatttggttggtgtggcaccatggaataggagggcaattggttcggatgatttatcaattttagtgggacagagta

SEQ ID NO: 569950 - DNA, 117 bp, Homo sapiens
gcaggattagggcaggagaaggtggtgggatgggagaaagagctgaggattctttgtttggtttttgagatggagcctcactctcttgcccaggttggagtgcaatggcacaagctc

SEQ ID NO: 569951 - DNA, 255 bp, Homo sapiens
gatacactcgagctcggtaccgaacgggtgatgcggttgtagacctcgctgaggactacaggtgtgctctaccatacctggttaaatttttttcactttttgttttctgtagagataaggtctttctatgtttcccaggctggtctcaaactcctggcctcaagggatcctccctccccggcctcccaaagctctgggattacaggcatgagccaccatgccctggcgcgtattctttttctttttttttttttt

SEQ ID NO: 569952 - DNA, 745 bp, Homo sapiens
tgggcttgggctatagagcattaatggcaaacaaaattgaggtaaaaaaatgctgacccaaaacccacgcccgtccaggcgggggaattctctatctcgccccacaccatggcccctgagcaccgtgtgtgtgccctgaatgcagcccccagagtgacatgagtggtgccctgcgcactgaggtacgctgcatcctaatgcccccatgagtacaactgcccatgtggcttgcccaattcccagatggtggatggatgtgatgagaagatgtgcatgtgcatgggagtgagcccctgtgtcttcatggtggggtgcacaccccacaccctccaaacaaacctccccagctctctcgggtctgggcatcttcctgctccttggccacccaggccatgccatgggtggcatgcggtggtgtgccaccatgatgtgcgggctgtgctgggggttgcgaggtcatctggtttgtctccaggcagtcctcggtcaccccctggtgtgcatgccagcttcatgccatgaatggttctgcatggtcagtggggtgtcagggataagcctgtggccctgtaatgtgtgcggctccatctcgtgtctgggtggtggatctcgttccataccagggggtgttccgtctccccgtggttgttggatcgtgcccactgtgtaatgagccgctcttccaggccctcaggagccaggccttgtgccttgcgtgttgcatgtcctggttgacccttgcata

SEQ ID NO: 569953 - DNA, 334 bp, Homo sapiens
  misc_feature (210)..(210): n is a, c, g, or t
gcagcaagatgggatggtggcagggccttgtgaactccggggccttgttccggcagcccgtctctcggctgcgatcgtctccatggcatgaaccgggttgtggtaccctggttgtgtgggagccacggagactatcttcgcctgccgactgaaaggccgcgcgagcaaatggagaaactctcggagggaaacatcagcaatcattggtcntatgtgggaagtgaatatccatccaagtatggacatcgaacatggcacagggcaaggaaggcaggacattgttcgcaagagaagtaaagaatcagcagaagaacttctcttcgcagacaaacag

SEQ ID NO: 569954 - DNA, 324 bp, Homo sapiens
  misc_feature (12)..(12): n is a, c, g, or t
  misc_feature (41)..(41): n is a, c, g, or t
  misc_feature (75)..(75): n is a, c, g, or t
  misc_feature (96)..(96): n is a, c, g, or t
  misc_feature (278)..(278): n is a, c, g, or t
gagtgccaatgncacaatcctggctcactgcaaccacccanctcctggtttcaagcaattctcctacccttagcncccgcccccgagtagcctggnactaccaggcgtgtgccacccacacctggcttttttttttaaattagagaccagggtttcaccattttggccagtctggtcttgaactcctgaactcagatgatctgcctgcctcagcctcccaaagtgttagaattataggcgtgagccaccgtgcctgacctatattaagactttttatncccagaaacattatgccattacgttgaatatcatggttctgtcttt

SEQ ID NO: 569955 - DNA, 198 bp, Homo sapiens
acgttaacggctcctagtggactgccctgctgacctaaaatgaagaacccctgagatgacccgcagccaggcccatttgctcctcttctgggatgcccatcatcctcatggcctccatgctctcctggaacatgtccttgtcctgcgacccgggcatgtgagcacacagggggggctcgaaagctggaaggccgccaa

SEQ ID NO: 569956 - DNA, 779 bp, Homo sapiens
  misc_feature (779)..(779): n is a, c, g, or t
attcagcgttatttaagcgcataaagaccaaaaaaaaaaaaaaaaaaaatccaaaagaatccaaactttttttataatacttctacaaaaaattctcttctggtagtattggtcaggtggcacttttttttcttggccaataattggtaaccggtagcttcggccccggtcaaaacaattctcaatgttaacaattctcaggggccaggcaatctccgtggttcccccttcagcattccggattacaattttctccggtggtgggcaatatgtagggcgtgggcttatccttcacaaatttaaacataaggtttcacggtggaacactttttctagtgcaatgtgcgtggcactccttactattggggactctctctcaaactgtggcccaggtcttgcggacacaggtgacacacgaacatatttatctctcagagggtgggtggcaacgagccaaagtgacacctcaaagtgttttcacaattttaaaacgtccgtgagaaacacaggcggcgcttaacttcggggcagaaactttttgggcgcccccaatattatttataaactctcccagagacagattggcgccacacaacagaagacaaaacaagagtggtctctctccaatttatttttaccctccaggtcgtgttgagaactctcgcggcgggctcccctccatctttctccccaacattttctttacaaactctctttacaaacacttttcacttgcggggtgtctctcacaaacctctctgggtgggctgtctaccccn

SEQ ID NO: 569957 - DNA, 255 bp, Homo sapiens
cagtggatcacttgaggtcaggagttcaagaccagcctggccaacatggtgaaactcttgtctctactaaaaatacaaaatcagcagggcaaggtggagtatgcctgtaatccctgttactctggaggctgaggcaggaaaaccgcttgaatccaggaggtagaggttgcagtgagccgagactgtgggcaaagtcatcatctctctggatctcagttcttgttctgagcagctgaattctccagaaattctccg

SEQ ID NO: 569958 - DNA, 790 bp, Homo sapiens
agcggataaactatatattaggtaggtagtcataacacattcgtttcagacatttattcaatcattgttcagtcttattaaatacctatcatgtgtcaagaaccaaatgcgtaggtttgaattaaaaatggaaacagggctaaatagctaccatgatcttggcatgagagtacacacacacaaacacacactatacatatatatatgtggtccttcactaaaatctaaaagtgctgtaattataaggtaatctgcagagtgtatattgttacctcagtccctttgggctgtgactgctgtacacattatcatgttaccattgacatcttcacgttgtcccagatgctgatgtgtacatgcatataagcagcactatgtagtggttagaaggagtacatggctgtctgggaaatggcacaggcgctgggattccaagtttaacatgctctgtgcgcctcaagtatttcttcaatcgtctgaagcatgcgtgagataatgaatatccttcttcctagggtctttcggtaggatcaacttggagtttaaatactattataaccactatttacgagacaattgcatggacaccgtaaataacgctcttgagtgaaaacaggctatttacttgaagtactaccctgtgtgataaccagggaagagttttttttgacccagtattatatcggggctgtagtgtaaaggcgtagatccctttgtactagtggtaaaagtgcgccaagactaccttgcggtaggcctctgcttgagggggcgggcatctcttcctcac

SEQ ID NO: 569959 - DNA, 164 bp, Homo sapiens
  misc_feature (136)..(136): n is a, c, g, or t
ttccctcaaggcagtgttggagttcagtggaggagggagttcttggccttgtgaagagtgcccagcagtccgctgtctggggcgggctccttagatgagtatcttggatctccttagaactgggtggtggacggcnatcacccgacaatgctgcagaattgagc

SEQ ID NO: 569960 - DNA, 609 bp, Homo sapiens
tgatcgcaggtgtggagctcccacagctttgggtagctctgcctctgtggctctgcagagtacagcctccatggctgttttcactggctggcattgagtgcctgtggttcctcaaggcacatggtgcaagctgtcaatgaatctaccattcttgggtctggaggatggtggccctcttttcacagctccactaggcagtgcctagtgcagactctgtgtgggggctccaaccccacatttcccctctgtgctgccctagtagagggtcttcatgagggctccacccctgcaacagacttgtgcctggacatccaggcatttccatacatcctctaaaatctaggcaaaggctcctaaattcctgccttctgcacacccacaggcccaacaccatgtggaggctgcagagacttggggcttgcaccatttgaagcaacagcccaagcttgtaacttggtcatttttgccatggttggagctggagtagctgggacacagagtgccatgtcctcatgctgcacagagcattggggctctgggtctggccaagaaaccattttccctcctaggctctaggcctgtatggaagggtaccacaaaggttctgac

SEQ ID NO: 569961 - DNA, 295 bp, Homo sapiens
  misc_feature (92)..(92): n is a, c, g, or t
  misc_feature (94)..(94): n is a, c, g, or t
  misc_feature (106)..(107): n is a, c, g, or t
ggctgtcggggaaccatggctgccccgagagacaatgtcactttattattcaagttatactgcttggcagagatgaccctgatggtcgtagncnataccatagctnnaagaaacacaaggacatcatttttttatctctacttttcaaccacagccgtgtgtatcacagaagttataaagttattgctaagtgtgggaattttagctaagaaaaacagatttgggggaaaaagatatcaacagtttgattttggagaaactggtagtctgggtagattcaaagcatctttaagag

SEQ ID NO: 569962 - DNA, 139 bp, Homo sapiens
tgaaaatgaaaaagcagaatagttgtatgggtgctggagtactgtttctactgaatgtgtatcgccttctcaccatcattaaggtaaaactcgtaacccaaatcataagttggggactgtccatcgttccatagcctga

SEQ ID NO: 569963 - DNA, 315 bp, Homo sapiens
cggcacgagggatttttaataacaagaagagagtaatgctttaatcagcaaaaaatggagaactcaaatacccttttataaggtccagatttagtagcaggtggcttttgttcagtttcttattcaacaagaaagctcattaatgattttttgtttcattttgttttttggcagtctccctgtctcacccagactggagtgcagtggcgccatctttgctgattggctcacggccatgtccgcctcccaggctggagtgtggtggcgccatcttggctcactgccatgtccacctcccaggctgcagtgcggccg

SEQ ID NO: 569964 - DNA, 291 bp, Homo sapiens
ataatttttgtatttttagcagagatggggggtctcgtcatattacctaggctggtctcgaactcctgggaggattgcctgaggccaggattttgagattaacctggccaatatagtgagactctgtctctcaaaaaaatttatttttccttttttttttttttttttttttttttttttttgggggaaaaagacctctttttggcgcctggggtgaggggggggggcacaaatagggtttttggccccccccccccccgggggaggggggttttagggggtggcccccca

SEQ ID NO: 569965 - DNA, 815 bp, Homo sapiens
gcctttgagaaatgaatgaagtagagagaaaataaaagaaaaactagccaggcacagtggctcacacctgtaatcccagcgctttgggaggctaaggcaggcagatcacttgagaccagctttgggcaacatggcaaagccccatctctacaaaaaaaacacacaaattagctgggcatggtggcgcacacctgtattcccatctactcgggaagctgagatggacagaattatttgagcccacgagttcaaggctgcagtgagtcgtgatgtgtgccactgcacttccagcgggggtgacaaggaagagacctgtgtctccgaaacaaggaatctgaaaaccaattggaaccatgccttcataattctggaaggggttatttcaactgataaatctatattcaccccaaataatcaaggggtgaggtaccactaattacatttttagacaagcaaagactcaggggttacctccatgtggccctttttggggaagctgtgtggagaaaaattacttccagcaaaatgaggagtaccacaaaccagagaatgacttgaatccagcaaataggatccaacacaaggcaatattccagctatggagctagctttaaaagggaccgtaacaatattatcggttagctgggtggaatggccatggcttgtagtcccagtactcagggggttcagcagaggacgattggagcccaagagttcagacagctggcacctatgaatcctttcttaaatatactttggccgattgcgggtggaaagtcctgggaaacacctacacacaacacaagggggtggtc

SEQ ID NO: 569966 - DNA, 101 bp, Homo sapiens
gtgaatttctgtgccacgagggggttctttttataatctctcttgtctgttgtgacaacttctcccttgactcggaaatcccgtcccgttgatttgtcccc

SEQ ID NO: 569967 - DNA, 312 bp, Homo sapiens
cctggccctaagtatatttgctttattcatatagcatgaggataacattatatcgtggaagcttgcacttagtggcactgactgatgatctacacagggacatccttcaaaggctactattaacgatccactggccgtcgttgcagactcacgcctgtaatcccagcactttgggaggccgaggcgggcagatcacctgaggtgagaagttcaagaccagcctggccaacatggtgaaaccctgtctctacaaaaatacaaaaattagccaggcatgatggcgggtgcctgtaatccctgctacccaggagc

SEQ ID NO: 569968 - DNA, 410 bp, Homo sapiens
gaggacccccacactactgagtcagactctgccggcttcctttatggtacgaattgtgctgcagtcttcttatccactgtgcaacacaccccattggctgttgcagaggtagctttacctttctaggggtgtcaaaatggcaaatgatttagttactgtctaaataagggggaaagaggacttaactctgctcattgtaagggactagtctgaaagagcctcaaacgcatgataatattattgcatgatagactgcctgacaagtgagaggaaaaagaaagcactaataggaaggaggaagacacaaagagctacggggagaaaagtagctcaggaaagggggaacctgaaatgtagatgggtttaaggcccactacgattaaaacttttaggtatccccattgtccata

SEQ ID NO: 569969 - DNA, 172 bp, Homo sapiens
aaccacaaaaacactaccacataagctatacagtgcccttttttcacagtgtctataggtggaagatactcagtgaggtttgttggagtgaataaaggatcttcactgggtgcatcccatttccttacaatttatttattttttattgatcattcttgggtgtttctcgcag

SEQ ID NO: 569970 - DNA, 252 bp, Homo sapiens
tgctcatctcagcagcatggcacccaacgcttaattctaactatgcaagatagcatcttatttctaccaacataggccaaacgtaaccgcgaggcactctgttatacagaatatcaattattacaaagattcaaaagattaccaacaagccctgtaccagtttcttaacgccggtaccaactctggcctcacaacatttgtcttccctaggagtttccaaaatgcctcactcctgtcaacactgccccaaaa

SEQ ID NO: 569971 - DNA, 106 bp, Homo sapiens
acgaatttgcatgtaatagagcttcgcaaaacagaatgagagaaaattgtataaccatcctgctgttcctttagtgcaatacaataatactctgtatgggggatct

SEQ ID NO: 569972 - DNA, 348 bp, Homo sapiens
tgcagtggctcacacctgtaattccagcactttgggaggccgaggtgggcagatcacttgaggtcagggttcaagaccagcctggccaacatggtgaaaccttgtctctactaaaaatacaaaaattagccaggcgcggtggtgtgtgcctgtagtcctagctattcgggaggctgaggctggagaactgcttgaacccgggagacagaggttgcagtaagctgagatggagccactgcactccaacatgggcgacagagcacaactccatctctaaacacaataaagactgcagttgttgctatgattattaataattcttcaatcagcatagagaggtagtattct

SEQ ID NO: 569973 - DNA, 438 bp, Homo sapiens
agggcgtcgccccatgtctgcacgggaaggacccatctttctggatgctactcccatggctatttggtgacgtggccaagaacctctgcctttctggggacccaggaccgcgggttcctcttctgcaggggattgagctacagcccatctcaactctcccaccagatttgcctcgggcccaggagcccctcgttgtcacactagactgtccctgtctctctgaaggcccatcttccccaatcagatcatgagctctctgggggccttccagggcgtaggtccccctcagggtgctggctcctgtcactgcatggatagagctgcatgcatcctactttcccccttcttcggctcctctcatccattacaaaatccagtgctttctcccgtctctcacccccagaaacaacacttcctcttttcactctcaaaattccc

SEQ ID NO: 569974 - DNA, 344 bp, Homo sapiens
  misc_feature (285)..(285): n is a, c, g, or t
  misc_feature (325)..(325): n is a, c, g, or t
caccgcgggcacacgggttcatcagcaggaaggattgccgtacaacaggagcacgaacgcagcccctgacgtatccccgtgacgcctggttttagcggtggcgcagttctggcatcggggcgatgtcgtcccataaccagcgacgatcaacgcactgaaaagcgcgcagttgcaggacacaaaataaacaccaggggagaaagctgctgcctaccccaatgctgccgtaagccatcagtttaacgaaactgaccagcacacccgcgaggaaaatctccgccattncccaggttttgagttgaaaaagcacccgtgccagttagtnttttaaacgggaccggtta

SEQ ID NO: 569975 - DNA, 273 bp, Homo sapiens
gtcggtaccccacttatgcgtgggcacatagtttattgagaattttttttttggagatggcaggggtctcatatgttccccagactagagtgcaggggctattcacaggcgccgtctagcgcactacaaccttaaactccgtgggctcaagcaattctcctgcctcagccttgggagtagctgggattacaagtgcccgccaccacgccgggtctgccaatactttctatcagtctgtcatgtttacggtcttttcccccacggcataagggg

SEQ ID NO: 569976 - DNA, 227 bp, Homo sapiens
ttttggggcgtgatttttagatttgtccttttttttttaaagaagaatttgttactatgtaaaccccgacatttaaatgttttatctctaccagcatcaggaggaatcactgctttaagggtattaagtaatgcctagtgccttttattttcagttaaaaaaaggttttgcgaaggcctttatggtcattacccaaaacttaatttaaggccctgggtttttaagcc

SEQ ID NO: 569977 - DNA, 244 bp, Homo sapiens
tatcccctgtcggaaccctatccatacatatcccaaattagtttttgatcaaaaacatgattatagatccacctgctatattttaagcttattatgcaggaaactaagttggaccattttctatttgtctattttatacaataaggctactacaattgttacactttatacagattacaatttattagcagtgattattagttaattagtgttctacatcattactccatctcttaaacattag

SEQ ID NO: 569978 - DNA, 184 bp, Homo sapiens
  misc_feature (48)..(48): n is a, c, g, or t
  misc_feature (129)..(129): n is a, c, g, or t
  misc_feature (160)..(160): n is a, c, g, or t
aaccctgggtcttgtgtgataagccccttgtcccagggacccacaggnacagggggccagccactgtcagaggtgccctatccaggatgacctcgtgggattcaagctgttcctgcctgaagggccttntgaccacaccgtgtcaagcttccagccaggngatatggctgccatcaccaccaag

SEQ ID NO: 569979 - DNA, 298 bp, Homo sapiens
aaatagttaccacagtgacaactcagaggatatcatcaagctcctgttaggacatagatccagtctaggagcccagcacacaagagacgcaacactagatgcgtcagacatcatttacttcatttgacaacctgcgtgatgcgcacctccactgacacacgggtcacaaaccggtagatcattacctttttattttgcccaatccggatgagctctgataaaggcctgaatgtcattatgggggttccagtcagagtcatagctaataaatgtgtccgcagtggacagattgattcca

SEQ ID NO: 569980 - DNA, 178 bp, Homo sapiens
tatatatctatctgttcatagttatatgaatacagagagatatgtggcttggtccccatcatgttgttctatttgtgtgccaataatagcatatacatttttcctcttgaatattttcctgtggcgcacgccattttaaatatgctgccagggctgctttggtccccagtttagtatg

SEQ ID NO: 569981 - DNA, 577 bp, Homo sapiens
atagctgactctagaggataaaccgacgcctggcaattaaaaactagcagcctcagagccaagaccagcctagagaaacagagttcagggaggagggaagatagtggagtgagacgtgcggagaccagccggcctctgagcttggggtgcgctgacctctggggagccgagtgcatctgctggactgaaggcagagtaattttttcatctcatgcagaagaagaaagaagatatgtagcagaggaaaggaacggaacattctccctccctaccttacacaggagagtggtcatctacactaaagcaaaacttccttatcataggaagaccattttccttgacctttaggtgattttatagtcatctcgaaaaggaaacaaaactcaactcaggacttgattgaacacagagagtccactaggatgcagtattcctgcccacttctccaggaagaaagaagcaaatgacgcgggtcttttggcactgtttgcttaattataaagaaattattttgcaagctgaatactgatgctttatttgaaacaggtgcttagttggtggcatttatgaattcttt

SEQ ID NO: 569982 - DNA, 1141 bp, Homo sapiens
ctggagatttctctcttgaaatctgtgctgtctctgactaaatgtcacgtgggggatttttcctgccgctgtccaatctgggtccccccaaagatattctgtgtggccccctggtgcccaaccacaatgtggggaaggtctcatgaattcctccgtaaaaattttctatccggggaaatactcttcaggaattcccgcggctatgtgagcatatccataaggcccccgccatatcacacaagaggttattggcgccttgatttaggcgcccacaaagttgtccttaattggggccaccccgggagttgccccacctgcggtttccattgccctcccctccattctctttacggaacttttggagccccccacgtgcccccgggtattttccaaggatggaaacttctttcgggggccctcgtggttggcccccttctgtgttgccgctgtcgcaagcccttggaaggaggcccatccacgttctagtcaaacccacgcgtgatgaagcccccctgggcccctttaacaatgtttttccacgcacacgactcaaaagcgtgatttaaagaaagaagtgagttttccccgcagaccacttccccactggtttgtggttgccggtccccacccgaaggtcacttcggtccaccatgcaccctttgcacacttctttggccctttcgggggctctttgggaaacacccggccactgggatcctaccactggccacagaaagagactttcgcagacttttctcttcaccgcccgccttcttgtcctcgcgtgaggcctctctgatgaatgactgaagagccctcaaggtccgaatatccccccgaggcccggccacaaatgtagccccgccctgaggaaggggtttctccccctggcctggccactatctgtgtcccactcggagagttcggagccacaccctcacactggctctcctggccctgggagaatctgctcctgcagccccacgcccacgccccacactcctctgcatgagacctgctgaaccctgtgcaccacccccacactcccacacacatgggcccacaggcctcacccacattcccagtttccacccctttttagacccataaagagaccaataccattttttaaactcagcca

SEQ ID NO: 569983 - DNA, 315 bp, Homo sapiens
cgttgccttcacacatggagaaggctggggctcactttgcagtgtggcacaaaagggtcatcatctctgccccctctgctgatgcccccatgttctgtcatgggctgtgaaccatgagtaatgtatgacaacagcctacaagatcatcatgcaatgcctccttgcaccacccaacgtgcttcagcacccactggccaatggtcactccctgacacacttctggtatctgtggacaggactcactgaccacatgtccactgccactcacttgccacccatgcaagactgtggactgtgcccctcctggtgaaactt

SEQ ID NO: 569984 - DNA, 960 bp, Homo sapiens
  misc_feature (638)..(638): n is a, c, g, or t
ctctcgttggtaaacacggtctgctgtgcacggtcttgtctcacccggtgtccggtagtcctgtttcccggtaggcccatatttagcacgtgccgccgctcatatagctcctttcggccgggggtctgtccgcagttccccctgtggcccccttgtttgtcccccggtgtctggtcagcgactgtggtgtccccccgccccctcatggtggacccagccttcgttctcttcgggggcacttctcctcgtcgagtgtggtttggagccacacgtctgttctgtccccgggatgcgtaattccgttgtggttcgaagatagccacacgacgtcctcacgctggtcgaccatgttccatagcgggtcggttgtttagcacccctcgcggtgcgcacctttcctcactcaggcaggttcttctgctccataactgttggttttgttgaaccgcggctgcctttctgtgcggcccccgcggtgggagatatacgcccccggcggtgtttattcccccctcgtgtggacctccctctcactcggtagatggttttgtccccacctctcgcaccgcacgcacgccctcctccttgggcgggagaagctgctcacgcactccccccctcctcgcgggggggcggancccactcacacgctcgggcggcaggaacgcatctacaacgcccgctcgctaaagaaggacctaccttttttcagaatgcttcttcatctgagaccgcaggcgaatatgtaatatttgttttccgccatcagtgatcgcactggcagctcgcaagaaagactgccgatctatcttttgtaagcaggcgacaagggagcgccgcctctgtgtggtggagacggcgcgcctctgcccccggttttctactgcagtgataatacttgtgtttcccggcccgctctccgcgacaaaccctttttttcctaaaacgacaaacaaaaca

SEQ ID NO: 569985 - DNA, 519 bp, Homo sapiens
tcaacgctttatactttaaaacagatcttctttaattgtggaggtgagggactatagcttgttggaaagcattcgtctttgttgtttattacggcttgcatcatatataaatgaggagtctggtgctatggccttagcacaatattaatgctgtcaaggtttctattatactgggtatgaaagtctccgtaactattacatgaactcggggtcactcaaggggggggcggattgcagctttcatatctagacctgtagactatagggtatgggtctttattgccttaactaaataacaatcacaaaataattgcagatttccaaatgatatctaaaatgatgggtactatatacattccggatattttcagtacttaaatagttgctttggtataccaaaacatcagtctaccaaaaacaagttcgggcatgagtaatcccagagttgagaccttcggggtcaacctgaaaaacaaaccttcaacttccacctatgttgctgggtggaagtttaaagcg

SEQ ID NO: 569986 - DNA, 957 bp, Homo sapiens
agcagccagccccaacacagaggccaaagggttcgtcagagccacatggtggaaactctagcagagggttttgaaagcaggttgcacttcattcttactgagtgcacgtgtgtgtgtgtgtgtgtgtgtgtgtgtagtgtgtgtgtatgcagcgcccctgggtctgtgtaatatggcacttcgtggtggcttccacgcgtgcacggcgcacatgcttcccgggggaggggcccggtgggacagcgggtgtcgcgcccccctcttcttttcataagagtccgtggcctcgggacagccgtgcacaggcgtgcctagctcgtgtggacgacggggacaggccctgtcccacatcacctctttccccctgcgcgctccgtgcccggcagcctccaacctgtgggaggggcgctgtctttctcgcattcgtgtgtgtgtcgtgactctggcgggagctgaaacccaggactccagggggtgtgcccggggggtgccctcagaactcctcgtgtgtcacgtgccagcgtgtgtcggtgcaatccaggttcagctctttctcgtgagatcatcaccaccccgagggagacgtgtgacgacatcaagcgagtgtgcaacagcggcgagagtgtcgtgcggaaaatcttcggagtgggggaacacagagggggagctacgagtgcgtgtgcagcccgggatttgagccagtgtctggcgcaaaacacattcaacactgagagcgagaaccctggtccagatgtggacgagtgcactccgggcagcaaccagtgtgacagctccgcgatatgctacaacacgggggtcaaacagacggcggtgcgccaggggggagccagaagggaaccccaaaaacaaaggacatgtgtggaaaaagaatccccaccgaccgcccggacaagacaacaaccattagaaagcggcgggaaccaaaaccgaggaaca

SEQ ID NO: 569987 - DNA, 581 bp, Homo sapiens
  misc_feature (184)..(184): n is a, c, g, or t
ggtggttgggggggggagtgttaaaagagtgggcggtcttcggcccccgccttgagtggcaggaccacagggacagatcttctgccgcacaccgcagtgaggacacggcgggggggccgccttgtctcaagttggataaagttggtcccgggtcccctcctccctctgcccgcagtggtttttntggtttttttttcccctttccctccctccctctgcgcattcttcccttggttgagcacaggtaaaagggttcccctccctccctgccttcatgggtcaccagctcacgtcatggtgccttctcttttcttgggggggggggtaatttaaggtatttttcttcctcctctcccttttctttttgggcctccctccctcccttttttgccatggaactggaggatgtgctatgagtttgcaaacagctgggctggcagggtgctttttttccagatggtcctcctttgcctccccttcccctcctctcccctccttttccttccttccttcctttccttggagccctgagccccatttggaaggttgagagaaaccaaaattaaagagagaaagagaga

SEQ ID NO: 569988 - DNA, 185 bp, Homo sapiens
  misc_feature (31)..(31): n is a, c, g, or t
  misc_feature (76)..(76): n is a, c, g, or t
  misc_feature (115)..(115): n is a, c, g, or t
tggctggaggggcctaatgatagtgggcganagaaccctgcagcctgtgccagcccagtggatgcgtgccccagcncagccagcttacccagcccctctctgtgttgcagccggnaggttcctaagaatggctacccggagctaatgagggcccagccttttttctgcatgatccaggagcacat

SEQ ID NO: 569989 - DNA, 169 bp, Homo sapiens
cagagtccaaacagtgcccagagtccaaacagtgcccagagtccaaacagtgccatggaaatacttattcagcagtgatctgtattcgtatctgcattattctctttcgattgatatgaccctatataaaatttacattcgagaatgtctgaatcgcatctacttaaat

SEQ ID NO: 569990 - DNA, 363 bp, Homo sapiens
ttctggaagtgatatatgtcaaattacattcctactgcaggtatttgagcagggacagtcattttttaaatgtttttggccgggcgtggtggctcatgcctgtaatctcagtacattgggaggccaaggcaggtggatcacctgaggtcaagagttcgaggccagcctggccaacatggtgaaaccctgtctctactaaaaatacaaaaaattggccgggcgtgatggtgggcgcctgtaatcccagccactccagaggctgaggcaggagaatcgcttgaacctgcgaggcagagattgcagtgagccaagatcaagccattgtactccagcctggacaacaagagcgaaactctgtctaaa

SEQ ID NO: 569991 - DNA, 537 bp, Homo sapiens
aacattctgtttcaggtacctgtatgaaattcacgaggatcagctgtctcttactcttaccagtgactattgacctgtcctgatattgagtctcctctcaaacaggaagtagagaaaatcctatgtagctttgttatattactgcctacagaacctaacaaatccacaggtcctaaactaccaaacctgcgttaaaattttcggttgggactgactcggatcagaacccaacctccgagcagtacatgctaagacttcaccagtcaaagcgaactactatactcaattgatccaataacttgaccaacggaacaagttaccctagggataacagcgcaatcctattctagagtccatatcaacaatagggtttacgacctcgatgttggatcaggacatcccgatggtgcagccgctattaaaggttcgtttgttcaacgattaaagtcctacgtgatctgagttcagaccggagtaatccaggtcggtttctatctacttcaaattcctccctgtacgaaaggacacgaatgttca

SEQ ID NO: 569992 - DNA, 124 bp, Homo sapiens
  misc_feature (65)..(65): n is a, c, g, or t
gtggtggtgaagacgctggagcagctggcgcaacaaggcaagatcaaagagaagatgtacggcangcagaagatcctaacaagaggagtacacaccttgatttaaggatggtggcctaagacag

SEQ ID NO: 569993 - DNA, 882 bp, Homo sapiens
  misc_feature (1)..(1): n is a, c, g, or t
  misc_feature (72)..(72): n is a, c, g, or t
  misc_feature (77)..(78): n is a, c, g, or t
  misc_feature (106)..(106): n is a, c, g, or t
  misc_feature (113)..(113): n is a, c, g, or t
  misc_feature (228)..(228): n is a, c, g, or t
  misc_feature (232)..(232): n is a, c, g, or t
  misc_feature (252)..(252): n is a, c, g, or t
  misc_feature (256)..(256): n is a, c, g, or t
  misc_feature (258)..(258): n is a, c, g, or t
  misc_feature (261)..(261): n is a, c, g, or t
nctggccggcaacagagaatcccgttgtgcttgctgtgctggatgaagaaaaggaaggggtggtcggcgcanaaccnnggacgggctggggcaccgcatcatcatnatggcanctgtggcggctgcagcctccgtgccttcctcattgacctccacaaaagacttgtgcacgaccttggacagagacaggtctgtctgggacattccagagaagtctgccttgcccanctcnaatgcatcgggcgtgggcangttncncangacactctccatgtcgtagctttcctctagtttaaaccgcgggagggacacttccacctcctcttcatccatcatgtccagcctcgtgcattctacgaacttctcgtaagtgagttctttctccaccgttctcaagtcaggggtctcgtccggaagcatgatgattatatttcgttccttgccacatatgggagcaccaagattggggtaaatatttctcctatataggggcttcttaaaggggattgcgtaaacatcttttgcacagggttctcctcattctggctggctataaacagggctctcctggggggtctccttggcaaactgggtatcccaggttcctttggaatagaccgcctttccccagaacccagccttgtggagtgggttcacctggaccccggagaagagacactcggaattgtacctttctgggtttgcagctagcccgaggtgttttggggtttctgggactttttgcgggggggtgagggagacgtcgcccttgcgctgtggggaaattgggcggggattgttaaaagaggagggaatacaagaattgtccaaaaggcggttggctacgtggaggaagtgggggccggttggcgaccttgggaa

SEQ ID NO: 569994 - DNA, 213 bp, Homo sapiens
  misc_feature (160)..(160): n is a, c, g, or t
aagatccgtgacttagttggtgactttgttggtgactttgtctgtcgacttctgtctaggaatcattgtacccctctagtgctgtcactggtctttcagtgtcgtagttgtgaaataaatgtgaaatgaggacataacttaatgttttgacatctagttnttgggaatttgattgtgaaaaaaatttggaggcattgaaaatattatatagat

SEQ ID NO: 569995 - DNA, 805 bp, Homo sapiens
tagatagcttttgttcacacaaaagctgaggattttgaataccactccatttagtttctcttctggaggcccaacccacacaatcctaaccactctacctcttaagttgatgccataaccaagtactgtgagacatcattttaatgaagacaaagaaaacatacagaattggaagccctgcctccccaaggcacagacagagtctcctccgtcttacttgggctccaccaaactcaggaagcgtgcaaatactttcatcctgccagcttttctttttaactttgctttcttggctactatggaagatctaactgtggggcgcctccatcaacaatttggaatgatttttgctaacaaagtgacacccagaaaaaaacaacgttcacaattttacacagaaatcagtgacatgcgtggaaagaaaatggaacagaaggtagaaacctgcgttctggaattagactgccggcgtttaaagcttatctctgccactaaccacttatatgatgatagcggaacatagtttatctgtatgtgctactattttctcaaaagtaaaaatgggaagttgcattgtacgtctgcctaactccataatttttgagatcccgatattaaattcgcatccgttatattgtgtactggcccagagccactgcttacttacaatattctcttcttttaaactgtccaagatgtcaacatgcttctttttcatcccatttctttaacccatccatctttcattcctgtgcgatttttatcgcaatccctattacactacgttccttagtatgagtaggct

SEQ ID NO: 569996 - DNA, 929 bp, Homo sapiens
  misc_feature (1)..(1): n is a, c, g, or t
  misc_feature (106)..(106): n is a, c, g, or t
naaagtgtaagcgtttctcgctatcctctttcgccggatgttcgttctctgtcgctgtcgttgtggcgcgtggttgtctccttgctcctgtgtggcgtgctgcggncctcggtccggagtgggacccggtcgcctctccggttacgcgcgccgagttgttatcccccatatggcgtcttccccagtgctgtgccgctcgccgtacccttggtggtgaatccgccgccactctctgttcggacacctttccaggtgccctcgccgcgccccgaacaattgtcccggggttttctccctcttctgtcccgggttgggcggcttccccggttctctcttcccagccaaaatagcaggtgcccgccccgcgccatttgggctcccccgaccccgttcttgtcttcttcaaaggtacccccttcctgttcccgcgggttaaaaaattcccccaccttcttacccagggtttttgcatgctggcgcaccaggaaccgactattccagcacttggggaactcaaacgggcgatggcgccacgattgtggcgaaaggaactgctccctcatgactcacagaggcttgataatcccccgacgttcaaggtcataaaccttcatgagtgctccgaaagtatctacataaactctgtggattttatcctcacaaacccagagagccctcctttcttttccttctcacaccacgcggcccttgtttatcttccactgaggttcatattatccatcctggttctacccccgctccaagacccctctacaaaatgccaacccacactttaccctacgaggaccccgacaggaatacacatgtatggcaagactatgcaaactgcccaaaacccctctttgggcagccccccagggtcccccccgggggggagcatggaggcccctttcaccccccacaaaaca

SEQ ID NO: 569997 - DNA, 490 bp, Homo sapiens
  misc_feature (84)..(84): n is a, c, g, or t
  misc_feature (106)..(106): n is a, c, g, or t
atggcatgtagtgaggacagttttaaagtgaagaatgacatagaagaggaggaaggtttcttgtagaactccagagtggataantgggaggggcaaacagtcaaantagctataaaaaccatttagcaatactaccacctctccctgcattctggttgcataagtcatgacttttcttagaagtctgtttgtgcaatagttttgtatgtttgtacatatgtgaatagccattttctactagtacatccagtattttctgataaaagctgagtcatgattgatcacagttttgaacaccaaaatttcaaacttctgtaagtatcaattttccttcaaaggctaccattgggttatgtttattgtaaggtagtagctaatattaacagctaacagtggcagttgcatacaatgtggcagctgcatacaatgtggcagcctctgtggggaacattttacatattatttcattaattctcatgacaattgccat

SEQ ID NO: 569998 - DNA, 942 bp, Homo sapiens
cacggtagctcggatttctattcaagtgattttggtttgtcctgggcgtgcggaccagttgagggcgagttagttcgagatagtcctgaccgcctgaatgaaatcctgtgtctcactagaaatacaaaaattagggtgggatgatggtggttatatgccatgtagtcgcgagataagttcaggaggctgtaggcgggaaaaatttggcttgaaggccagatgaatgcgtgtaggttggtagtgagctcgtggcggaatcaattgcatctccaagtcttcgggacaacatagggcagattcatgtctcaaagtaagaggagaggaaatgattcatagtgacttatctggaggttgacttggaatgtaagatggaaactatggggtataactcagatggttctacaaatacagtgccatactggtgcggagactcccgtcctggacaggtggggcataccgtgggaattcgtgttagttgatgttcacaatggctttagtttggagtaacttgtcccgtatgggactctgcttcgacctagatggggcaatgtgtaggactagggggtaagctagtccgtatagaaaagaaaagtgcggttagggtcagaagggaaaaaggtacgagagtggcacgcagtagacaatccaggagttgggcgctttttgtgaaccctgattatggccatggggaaacagggatgggaactgagatagggtttatgattgagagatgttgttgtagtgaatcaggagctggtgcgttgggcactgtaaaggaataaggtgggggctagttgaggaaaaaaccaaatgcagttgtgaaacattggacctggtgcggagtacggaaaaggacacagtgggaatggggggggcaaatggggaaggtttggatagtatagcgcattatacgtggataaagtagtaaggagtgatgacaaa

SEQ ID NO: 569999 - DNA, 870 bp, Homo sapiens
gagcgaggggaaaatttcgaatgtggcggggtaggttccaggcgacggggaggtggtacggtcctggagggcccagtggcggggtagccgtggtggagagttcgaagagcctcgaaatgtgaggaggaggaagatagctggtggcagaagtagtggccaaggtatcgttctggacgcgcctgcggcagggagggtcgccgcgtccacttccgcagcccacctcccccccggcttcctggagtccctgaaagaggacgacgtaggcttttaaggcaaaacagatggcaacggaaagatgcctgaaaaagtcctttccaagatagtccttgaagacattaaagaagcgaatgaccagagaaaggaatacaaatttgggcagagatgggaaacgcaggtcttttatagctgaccatgcaaaataatcaccaacatttctacatgctgaaaaaattaccaagacaaccaacaaaaactgtgagttttagcttggcaaatgacaatccaaagttgaagaagccaagaatatcatcctacagtgagaaagaatgttactatctcaatgtcaggtatatgcttgaaggaaaactttactcacaacaaacagtagaactggtcagagcaggaaataggttccttctggaatggacccaatagtgtgacgtccagaaatcatggggaggattaaccgaattctcttgaaaaatgattcccgacacgggatcttccaatgaaatcgatctactttctcagacctggggtggtttgatcacgggggcagtcacggaggttccgaacggttcggcgctctacacatgcgcccttcgcgcgtgggtttgacacctcggggcgcctttccaagttgccccactc

SEQ ID NO: 570000 - DNA, 109 bp, Homo sapiens
tccgcgcccagtttgacgtgcgcttttatctcgtcgccatcctgttcatcatcttcgatctggaagcggcgtttctgtatccctgggccgtgtcggtcttcaaacttgg

SEQ ID NO: 570001 - DNA, 1200 bp, Homo sapiens
accggaagccaccaacatcgggaaagggggcgtagggcgagggatggcgagagagaacagggcaggagagaggatgggaacagggcaggacgagagaataggattaggagaaaggcgatcccttctgggggaaggggcgcgtggagctagtgtgtgtgagtgtgctgtgctgtgcatacggtgtggttgcacggatgctcgcttgcgttctgcgtatctgcgggatgtgatgccttcttgtgtagttgtatgtcctggatgtcagctgtctcgcgttctgcgcgctgcacgtgcatgtccactgctgtctgctgggttgggtctgatgtcctttgtggcttggccgtgtcgtgtccgtgccgttcgccagctgggggtctgtgtcgtacatgttgcgctgtccgctacactggcttctttctgttcgttctctggcacgagctaaacttccatggtcgccagtttgcttatcggcgctggccgttgctgtcatcgctggcgtttgacatgggcccgggtcgccgcttcttctcgagcagggcctacgcgagtcctagggccctgcgtgccaacctgttggctgcttgccgtccatgtgccccagctcggccctttgcgcgggcctgcatcgagcattgctcgtcgtccctggcccaggacgccgttcgtgacgccttcaaggggtggggcgtggggcacggtccggacggcccatcatagactaggtatgcgttccacgatccctgcggtgctggagctgggggccactctccggcgcacgcacctggatagctgcccttgtggccgcttttcatcccctggggccgggggttgcggcgccgcggcgcggccccctggtgcgagcgccctgcaagcgagttgggaggcctgtgggtacttcatgtgccagtgggcacctggttcttggctatgggtatgcggtgccttctcacccttcgaaagacctggccttgcatgccggattgggcgcaagtgggggcacgtggccttgtccttctgggggcaggggcaacgccaggctgcagccctttcgagcctggttgcaatcttggcccgactgcgggggccccttgctctttgaggctcctaccttgcgtcttcttgggaggggaccgccaataagtgtgggctcgggatttcaggcccagggtggcctcctggtccgtccttatattgggc

SEQ ID NO: 570002 - DNA, 207 bp, Homo sapiens
attcgattccattggcaccgtacgttatgtaggcctccctgcccacagtcccggtcctcatgccgcacccagaacttcacgcgtgctgggtccaaggctcgccagagctatagatcagcggacatagagcccaaagcagatagcagctggagggaaggagacgaagtcacactcgtctgctctgccgacgcccattcaacgcctccg

SEQ ID NO: 570003 - DNA, 229 bp, Homo sapiens
ctttctcttttgatgagcttggcctaactcaaacccagttgcaaggactgggtttattcaggtttgccatgttgcccaggctggtctcaaactcctgggctcaagcgatccacctgcctcggcctcccagagtgctgggattacaggcctcccagagtgctgggattacaggtgtgagccactgcacctggccccaaaacaccatatcttggaagtataaagcgttgag

SEQ ID NO: 570004 - DNA, 926 bp, Homo sapiens
cttgaatatagttgtgtaccttgattatctaggtaataattagcaacagttcccttcacaggctgcattgtgcctctactgccacctaagatattacttcccttacaaatctgcctttgaatcatcatcatctaaagaaaatcaacatgttcatgtgttagttatctgtctggggtttcaattcctcagaaacaactttttatcacgaccgcgccaaggaaagaacactagtgttctttcagtaaagtacaaagtgtttattttacaaaagagtaggtactcttgagagcaattcaaatcatgctgacaaggatactgatagcaaaagtgatttcttcttcattataaagtacatttacaagttcactggactaaccttatttatttgggacaggggaggaggaacggaaatgatatggtacccagacactgggctaggctgcaactttatctcatttaatactcccagctgtcatgtgagaaagaaagcaggctaggcatgtgaaatcactttcatggattattcatggcttaagagggcatcaatcagctcaactcaagatttcataatcattaagtattgtagattgtgcctcaaagttgtacgtacctcacaatacctccactgggtttcctggttgggtaaaaacctttcagtgagttttgaccaattgatgctctggggtctggggcctgggagttccggtgtgagggaggtaaccactagacagttctttggtacaacccctggtcttgtgtccccgggtgattcctacaccagtggtggtgtatttctcctaaaggggctaccatacccagggttaagatgacattgcgtcatgttaaagtgcggaactagtactaagaggaaggcccccggacatagtgggtgaacacgtgtagacaccggcgcgagaaaacatgga

SEQ ID NO: 570005 - DNA, 276 bp, Homo sapiens
aggtattaaaaatgtgttgttggtttccaaaaaggaaccctggaaaataaattttgaatgtttatgttctcagaatcaggttgacagtcccttgctgacagggctttgctttgggtaaaaacagtggatctcaattttcggggtgtgatgaaaagcgaatcatttcaaatccttgagccctcagtttagtgaaaatgttgtcattatggccaaaacaaaactagtttaattaactatgggatgttaactattattaataaattttaacattttcca

SEQ ID NO: 570006 - DNA, 361 bp, Homo sapiens
aatcgaagatgcatgtcacgaagatgagtataaccactcactacacggccaatgcactgaacctgaaatcacacagaggcactcagacaccattgaacgaacaagccgttttttactactatagacacaatggtgaaaaaacaacgcataaactgacaaaagaacactaattaggcaccaaagctagacacaatcacacaactctggtatgaccaacatcatccacagggcaattgagcatggagaccaaacaaaacagactactctcatcataatacacaaaacatatagagcgtacactactagggcacaaacgacactatccaccagataacacacacgcacaagcactcatatgacg

SEQ ID NO: 570007 - DNA, 153 bp, Homo sapiens
cgctgatgacccgccgcgtcctcgccctcatcgtcggattggccctctacggtgcgggagatgctctcgcgatccgcgccggtctgggagtcgatccgtggacagccttcgcgcagggcctctccctgcacacgggcatcggtgtcatcagcg

SEQ ID NO: 570008 - DNA, 453 bp, Homo sapiens
attcggcacagaggagagaactcccctacagcccagagatgtggcagggctcagagaagcagccagagctcctggaggaaaggcagtcgggactgaccccctctcttaaaacacattcccgcccgccacagcctgaggtctgggacctttccctcccaggagtcccctaggtggctgggggaggcaggccactggccattttccctggagtccagcacactgcagaggtcggagaggattcgccaccctaagcttcctcagcccctgcctggtcccagcctcagtgcctcttggccaggcagagtcgtggttgcaaagacattaggtgctgctgtggctgggagacagggacaatggggaaaagttaaggagcaaaatgggggttggaagcaaaaaatagggccccacctatttaggacgagattgaagactgacccttgaggcacacttgca

SEQ ID NO: 570009 - DNA, 745 bp, Homo sapiens
  misc_feature (653)..(653): n is a, c, g, or t
gtgagtgctacatgaattttagtcatgtactgtggcgactatatgataagccaaaagtaggagtctcacactttagtttcaaattgtgtgctgttcattgagtaagatttcttaacaatgagatcgccctctttctggctaaactgtcatagtatataagcccattgaaattgacttttatgcctcttttccttgtttgttttttgttcaaccgggttaagaacttttgtttgctttctcatttttaccccgtggctgagaggagggcctcaactctcccgggaaatactttagtacaagggcagaaaagaattgtattgctgtagatggaagtagaagataccgaagagctgtgtggtgacgaggatgtttcggtcatgttgatacagtaaggggctgcagggtccaggggcttggatttaccttaacttgttatgtttgagaaggaggatctgttctggtggggggaagagatgtgaagccacgtgattgggggcaagacgaatgtaagagaggacgctgtgagcatatgagatgtggatcccatgggcagggtgccttgggaggggccgggtgcctggagagtgtgttctgccttggttcttgacgcgaggatctcattatcctgtggacgccgtcaggatgctgatgtncgggctggtggtggtggggtcggccttgtatcgccgccttgggggcggttgcggcaagatgttggttgagcccagggtgttgggtccatcgg

SEQ ID NO: 570010 - DNA, 368 bp, Homo sapiens
acctggggccctaagtttatgaggaaaaaaatagacaggattcataaagagatatcaaagcacgattttacgatacctaaactggcccatcttattacgaatgttgattatagtctctcgagtgtcggttaaagattgctgttcttgggagtcttgaggtcttgtgagttgatttcctgctttctttcagtttgtttcaatttaagttataatacattgtgtcatatccctgttccgggtgttggtaagctatttggacaattttatgggaacatgtgcattctctatgtgagcttctatcatattcctgtataattagcagaacctaaaggaatttatttaatgatgttgtgacattactgcttttt

SEQ ID NO: 570011 - DNA, 396 bp, Homo sapiens
cgaatggtggttcctgagaggactctgatgggagtagatgcacactgagaaggcatgtgcattgaggctctctatcgcaagtgatagctctgaacggagacaattctcggtcgggcgcggtggtcacgcctgtaatcccagcaccttgtggaggcgtcgggctcccaaaggaagtgaggataaggcaggaggataacgaggtcaggagatcgcgaccattctgacaaacacggtgaaaccccttctctactaaaaatacaaaaaaaaatagccgggtgtggtggcacgcgcctgtaatcccagccactcaggaggctgaggcacaagaatcgcttggacccaggaggcagaggttgcagtgcgcagagatcacaccagtgcactccagccttgaac

SEQ ID NO: 570012 - DNA, 388 bp, Homo sapiens
acagtaaattcatgtggcttgggacgtgacacactataaggtcacatcaagagaccgagatgacctcgtctcagtgtgagccctagcgggccccttcaccaccccctccgccctgccccggacacaagggtctgcattgcgtccatttcaagaggtggcccaggacgcgtgcagcccaggctcctgctgttcttgggcaagatgagactgttcccccaaatcccatccttctccctccaacttggatgaaacccacctggagacgcagtacacgtacaggctcttccactgtggaatcttgggccagtcagtaacgagcctcagtttcctcacctgcaaaacgggtacagcattcctgtatgatagctcacgccgtcccaaagcacag

SEQ ID NO: 570013 - DNA, 580 bp, Homo sapiens
  misc_feature (345)..(345): n is a, c, g, or t
tcatcctatggagaaaggcacagaccacagactgtttctgtgattctgtcttttcttataggcaggtccttaactttggcaaaataaacttctaaattgattgagatcagtctcagatagttttggtttacactgtttaaagatttcctttttttttttacctgcttcagcctcctgaataactgggattacaggcgcccgccaccatgcctggctaatttggggtttttagtagagacggaagtttcaccatgtgggccgggctagtctcgaactcctgcctcaggtaatcctcctgcctcgtgcttccaaagtgctgggattacaggcatgagccgccgcgcncggccaggaacctttatatggtacaatgaattccagcctgaaaattccccaagttctgagcctttacttcatacatatttacccaaatatatcaattattatattaaccttagcacatgaagaatggctgtcagatttataatgactaaagtcagtttgcttattttccttcaagcgttattaaaccgtactcctctttaagcaagtttgggggtcactaggtacctatgtgatt

SEQ ID NO: 570014 - DNA, 118 bp, Homo sapiens
  misc_feature (118)..(118): n is a, c, g, or t
ggatggcggaggtgcaggtcctggtgcttaatggtcgaggccatctccttggccgaccttggcaaaatcaaatgctaaacaggtacttcttcggccggcaggttggtggtccgtacgn

SEQ ID NO: 570015 - DNA, 343 bp, Homo sapiens
tgttccgggcaggcatatagcgagactctgtatcatcaactttttaaaacttagctaggcatggcagcacagacctgtagtcccagttactcaggaagccaaagcaagaggatcacttgagcccaggagttcaaagctgcagttagctatgaccacaccgctgcactccagcatggacaacagagcgagactctgcttaaaaaaaaaaaaagaaagatggattatacttcagttggagaaatattcaaaataactaatttaaatacctaaatattggcccattggtgctactttaccacacaacatgtacggtatgttagtatggatatatatgggcctcccg

SEQ ID NO: 570016 - DNA, 365 bp, Homo sapiens
  misc_feature (137)..(137): n is a, c, g, or t
  misc_feature (190)..(190): n is a, c, g, or t
  misc_feature (331)..(331): n is a, c, g, or t
gaggttcgttgagcccaggagtttgagagcagtttgagcaacacagggagaccctgtctctcccaaaaaataaaaataaaaaaataattagcctgtggtacatgcctgtggtcccaggtacttgggagactgaggtnggaggatcgtggctacagtgagctctcatcacgccaccacactccagccttgnaacagagtgagaccctatcttttttttttttttttttgagacagagtctcaaacaaacaaaaaagaatgatattgtgggttcatgcctgtaatcccagaaatactggaggccaagggtgggaggttcgttgagcccaggantttgagagcatgttttgagcaacacagggagacc

SEQ ID NO: 570017 - DNA, 329 bp, Homo sapiens
gggtcgttatgacgttcggtaggtacttgttacacactccttagcggattcctgatttccatggccaccgtccttgtctgtctatttttatcccccaaatttctggggtctgatgagcgtcggcatcgggcgccttaacccggcgttcggttcatcccgcagcgccagttctgcttaccaaaagtggcccactaggcactcgcattccacgcccggctccacgccagcgagccgggcttcttacccatttaaagtttgagaataggttgagatcgtttcggccccaagacctctaataattcgctttaccggataaaactgcgtggcgg

SEQ ID NO: 570018 - DNA, 797 bp, Homo sapiens
  misc_feature (257)..(257): n is a, c, g, or t
  misc_feature (340)..(341): n is a, c, g, or t
  misc_feature (350)..(351): n is a, c, g, or t
  misc_feature (353)..(353): n is a, c, g, or t
  misc_feature (356)..(356): n is a, c, g, or t
  misc_feature (364)..(364): n is a, c, g, or t
  misc_feature (375)..(376): n is a, c, g, or t
  misc_feature (413)..(414): n is a, c, g, or t
  misc_feature (424)..(425): n is a, c, g, or t
  misc_feature (429)..(430): n is a, c, g, or t
  misc_feature (449)..(449): n is a, c, g, or t
  misc_feature (476)..(477): n is a, c, g, or t
  misc_feature (479)..(480): n is a, c, g, or t
  misc_feature (526)..(526): n is a, c, g, or t
  misc_feature (579)..(579): n is a, c, g, or t
  misc_feature (594)..(595): n is a, c, g, or t
  misc_feature (598)..(598): n is a, c, g, or t
  misc_feature (616)..(616): n is a, c, g, or t
gccggctctccgcgcggccggggaaggtcagcgccgtaatggcgttcttggcgtcgggaccctacctgacccatcagcaaaaggtgttgcggctttataagcgggcgctacgccacctcgagtcgtggtgcgtccagagagacaaataccgatactttgcttgtctgatgagagcccggtttgaagaacataatgaatgaaaaggatatggctgaaggccacccagtcgtgctgaatggaggccgagtgaagaattnctggtaccgtcagcatccacagccatacatcttccctgactctcctggggggcacctcctatgagagatatcgattgctacannggtccctannantgntgcttatnatgactggcannccttctgagaaggcaatgtatcctgattactttgccnngagagaacanntggnngaaactgcggagggaaagnctgggaacgagaggttaagcagctgcnngnnggaaacgccacctggtggtcctttaactgaagctttgcccccgtcncgaaaggaaggtgatttgcccccatgtggtggtatattgtgaccagaccccgngagcggcccatgtannaangagagagacctcatcttnctgcttgcaagtgaaatatgttacaggaacatgcacttgcccttagataagaactccgggtgaaagtgctccacaagagaactaactcagcgcatacaaaagccccgggggcactttctgtgtagggggccggcgaacatcggtacacacgtggcagggtgcaaaccagtgttccgtgccg

SEQ ID NO: 570019 - DNA, 871 bp, Homo sapiens
  misc_feature (331)..(331): n is a, c, g, or t
  misc_feature (414)..(415): n is a, c, g, or t
  misc_feature (424)..(425): n is a, c, g, or t
  misc_feature (427)..(427): n is a, c, g, or t
  misc_feature (430)..(430): n is a, c, g, or t
  misc_feature (438)..(438): n is a, c, g, or t
  misc_feature (449)..(450): n is a, c, g, or t
  misc_feature (487)..(488): n is a, c, g, or t
  misc_feature (498)..(499): n is a, c, g, or t
  misc_feature (503)..(504): n is a, c, g, or t
  misc_feature (523)..(523): n is a, c, g, or t
  misc_feature (550)..(551): n is a, c, g, or t
  misc_feature (553)..(554): n is a, c, g, or t
  misc_feature (600)..(600): n is a, c, g, or t
  misc_feature (653)..(653): n is a, c, g, or t
  misc_feature (668)..(669): n is a, c, g, or t
  misc_feature (672)..(672): n is a, c, g, or t
  misc_feature (690)..(690): n is a, c, g, or t
gaaggacatgatgaactgatgaataactgaactgaatgtgattggactccgtatttggagagtagtaagacgtgcaatagagatatacagttgtattaaagcaccatggccttaatgattcactgatgggacgcgatcttcgtcccatcagcaaaaggtgttgcggctttataagcgggcgctacgccacctcgagtcgtggtgcgtccagagagacaaataccgatactttgcttgtctgatgagagcccggtttgaagaacataatgaatgaaaaggatatggctgaaggccacccagtcgtgctgaatggaggccgagtgaagaattnctggtaccgtcagcatccacagccatacatcttccctgactctcctggggggcacctcctatgagagatatcgattgctacannggtccctannantgntgcttatnatgactggcannccttctgagaaggcaatgtatcctgattactttgccnngagagaacanntggnngaaactgcggagggaaagnctgggaacgagaggttaagcagctgcnngnnggaaacgccacctggtggtcctttaactgaagctttgcccccgtcncgaaaggaaggtgatttgcccccatgtggtggtatattgtgaccagaccccgngagcggcccatgtannaangagagagacctcatcttnctgcttgcaagtgaaatatgttacaggaacatgcacttgcccttagataagaactccgggtgaaagtgctccacaagagaactaactcagcgcatacaaaagccccgggggcactttctgtgtagggggccggcgaacatcggtacacacgtggcagggtgcaaaccagtgttccgtgccg

SEQ ID NO: 570020 - DNA, 820 bp, Homo sapiens
  misc_feature (280)..(280): n is a, c, g, or t
  misc_feature (363)..(364): n is a, c, g, or t
  misc_feature (373)..(374): n is a, c, g, or t
  misc_feature (376)..(376): n is a, c, g, or t
  misc_feature (379)..(379): n is a, c, g, or t
  misc_feature (387)..(387): n is a, c, g, or t
  misc_feature (398)..(399): n is a, c, g, or t
  misc_feature (436)..(437): n is a, c, g, or t
  misc_feature (447)..(448): n is a, c, g, or t
  misc_feature (452)..(453): n is a, c, g, or t
  misc_feature (472)..(472): n is a, c, g, or t
  misc_feature (499)..(500): n is a, c, g, or t
  misc_feature (502)..(503): n is a, c, g, or t
  misc_feature (549)..(549): n is a, c, g, or t
  misc_feature (602)..(602): n is a, c, g, or t
  misc_feature (617)..(618): n is a, c, g, or t
  misc_feature (621)..(621): n is a, c, g, or t
  misc_feature (639)..(639): n is a, c, g, or t
ccggtaccgaactcttcgtcccatcaggatatatacattgatttgttggttatctgatggagcaagatgggacgaagatggcgcagtcttctcccatcagcaaaaggtgttgcggctttataagcgggcgctacgccacctcgagtcgtggtgcgtccagagagacaaataccgatactttgcttgtctgatgagagcccggtttgaagaacataatgaatgaaaaggatatggctgaaggccacccagtcgtgctgaatggaggccgagtgaagaattnctggtaccgtcagcatccacagccatacatcttccctgactctcctggggggcacctcctatgagagatatcgattgctacannggtccctannantgntgcttatnatgactggcannccttctgagaaggcaatgtatcctgattactttgccnngagagaacanntggnngaaactgcggagggaaagnctgggaacgagaggttaagcagctgcnngnnggaaacgccacctggtggtcctttaactgaagctttgcccccgtcncgaaaggaaggtgatttgcccccatgtggtggtatattgtgaccagaccccgngagcggcccatgtannaangagagagacctcatcttnctgcttgcaagtgaaatatgttacaggaacatgcacttgcccttagataagaactccgggtgaaagtgctccacaagagaactaactcagcgcatacaaaagccccgggggcactttctgtgtagggggccggcgaacatcggtacacacgtggcagggtgcaaaccagtgttccgtgccg

SEQ ID NO: 570021 - DNA, 356 bp, Homo sapiens
  misc_feature (44)..(44): n is a, c, g, or t
  misc_feature (105)..(105): n is a, c, g, or t
  misc_feature (353)..(353): n is a, c, g, or t
aaccaaagaaatttaaatgttccattgccccttgttcctgtccnagattaccctgtttgaagcccgtaagcctacttgtgcccaacttggtgttgtaaatagcancccatggacccagtcgtggtggcttatgccctgtaatctcaacacttggggaaagccaaggcaggcggatcacttgaggtcaggagtttgagaccagcctggccaacgtggtgaaaccctgtctctactaaaaatacaaaaaaaaaattggctggatgtggtggtgcgtgtctgtagtcccagctactcaggaggtggagattgtagtgagctgagattgccgttacactccagcctgagctacagangtg

SEQ ID NO: 570022 - DNA, 129 bp, Homo sapiens
attttttgttttttcaggttttactgatgaggcttgggaggccaatcaaaaaaatgtttgtgatttttaccactgttgattttgcccccggagccaactgaataaagcccccagattgaaaaaaaaaaa

SEQ ID NO: 570023 - DNA, 468 bp, Homo sapiens
  misc_feature (54)..(54): n is a, c, g, or t
  misc_feature (80)..(80): n is a, c, g, or t
  misc_feature (96)..(96): n is a, c, g, or t
  misc_feature (127)..(127): n is a, c, g, or t
  misc_feature (164)..(164): n is a, c, g, or t
  misc_feature (189)..(189): n is a, c, g, or t
  misc_feature (201)..(201): n is a, c, g, or t
  misc_feature (227)..(227): n is a, c, g, or t
  misc_feature (250)..(250): n is a, c, g, or t
  misc_feature (253)..(253): n is a, c, g, or t
  misc_feature (319)..(319): n is a, c, g, or t
  misc_feature (338)..(338): n is a, c, g, or t
  misc_feature (406)..(406): n is a, c, g, or t
  misc_feature (451)..(451): n is a, c, g, or t
ccgccctgcccctcggttctgctcggctggcccctggctctttcttgaaggaancccgtcaatggggggaaaggtccttnaaaatgaatgctcaanctgtggggcgggcctctaaaaatgccccaanactttgggggtctcaaaaaatggaacccccgttgtanaggggttgggtgggggttgcaggantccactcaaaancctcctgatgtcaaggacaggcgganagggctggcctcccccagtcccnaanccccactgtgccttgttgtctgctggggggccatagctgcactgcccaccgtaaaggccctcgcanattttcccccttcctgtanacctcggggccagcatcctcaccttcttcaactgaccagtcgtggttactccctgctgccaggtcctntcccttcccgggggtattctgtgaccatgaataaagttatcaaantctttctctttcaaaaa

SEQ ID NO: 570024 - DNA, 292 bp, Homo sapiens
gtctagagggcatccccagtactgtcgacagggttgcttggcgtgtattgcgtattattacgtcacatggttctaaagtgagagaaaatctagtatgagacccagtggaacttcgtggcacagacacacacatcttcttaaatctattcaattagggaggtgaataaccggagactcagtcagtaggccctaccatcctgaacgccattaagacactgtatttcgtgagggacttaattcgtagggacttgtgggttgatttttaggtacactggattagttgtctttcgta

SEQ ID NO: 570025 - DNA, 540 bp, Homo sapiens
  misc_feature (33)..(33): n is a, c, g, or t
  misc_feature (74)..(74): n is a, c, g, or t
  misc_feature (79)..(79): n is a, c, g, or t
  misc_feature (96)..(96): n is a, c, g, or t
  misc_feature (102)..(102): n is a, c, g, or t
  misc_feature (105)..(105): n is a, c, g, or t
  misc_feature (109)..(109): n is a, c, g, or t
  misc_feature (115)..(115): n is a, c, g, or t
  misc_feature (124)..(124): n is a, c, g, or t
  misc_feature (136)..(136): n is a, c, g, or t
  misc_feature (149)..(149): n is a, c, g, or t
  misc_feature (153)..(153): n is a, c, g, or t
  misc_feature (216)..(216): n is a, c, g, or t
  misc_feature (234)..(234): n is a, c, g, or t
  misc_feature (240)..(240): n is a, c, g, or t
  misc_feature (259)..(259): n is a, c, g, or t
  misc_feature (269)..(269): n is a, c, g, or t
  misc_feature (271)..(272): n is a, c, g, or t
  misc_feature (276)..(276): n is a, c, g, or t
  misc_feature (280)..(280): n is a, c, g, or t
  misc_feature (324)..(324): n is a, c, g, or t
  misc_feature (442)..(442): n is a, c, g, or t
  misc_feature (449)..(449): n is a, c, g, or t
  misc_feature (476)..(476): n is a, c, g, or t
  misc_feature (478)..(478): n is a, c, g, or t
  misc_feature (533)..(533): n is a, c, g, or t
gggggaatggatagggggggggggggggggggngaaactgacacagaaaagagagaggagagaggtttggggcnggggngagaagccagccagagngggggnggnaggngatagnggggggggngggggccaaggnggggccacaggangagngggctcctccccccagaatacaaaattggggggactgacaggggcggtcctgggcctgggggncggggaagagatgggcgntgtggnggggctgaggtcagtagtnggtttccttntnnaccnaacnccctgggttcctgcgcaggatgagtttgcggatttcgtcgtagnaagggatgaggaaactgtaggggaaggcacagaaccaccagctgggcttgagagggtacatgcgcagggccacgtccatgccggggcagttggacaggaaggcagccagggccgtctnctcaaanagcccgaagatcaggatcttgttcttnangccctgctggaagaccgagttcctccgggtcttgcagatgatcagatcggcccantggacga

SEQ ID NO: 570026 - DNA, 1077 bp, Homo sapiens
ggcggcgggcggaggctgggccggaggggtggggactggcgacggaggtggaggcctggcgctccgctccgctccagctcggtttcatgtccctgccatggctgaaggatgacttcctgctggcactacacagtgtctggaccccaggactcaccccaagggctacacctgagtacaaagtaacctgcgcagttcatctcaaatgaatggacccatgagtgatgtcaaagcaggtggtggtctggaagcggtacagcgacttcctgcaaagctgcatggagacctgtgcctacagcccaccggcaacctcttccagcctgcctcgaggagttcccttgctttccccctgtggccccaggtgtttgcgccgggtttgagagccttcagtgatccgaggcagctgggcgacaatggcgggcagcatggaccttgcttcggtttcacgtgtgcacattaccattgcagctcgaagcaacaagccaccacagcctccacagggaggaaccttccagggggatggagagatggtagaccctgagccccttggggaagggtaggtcccatgggggaaccctttacaacaattcctttgggacaaaaccgccttcatggaatccccgcaaagcacacgggacaccactcgaatagacatcgcacgttgagagtaatccccgaaagtcgatcccacttttcctagacaaattacgtccatacagcagtggcacatctgagcagagaaaaatttgggaccaggtgttgcccaacgcattgagatatcctagcctataaacacaatattccatgccaccttggccccaaatagggaagcggcacaattcgaaacctagatactaccattattaaacaccatagacagcaaagtaagcaaccctgtaaagtgccagaggaccactctcgtgggatcagcacccattgtgaccccgtgagtggtaccaccctatttataacaaccggtatgtgcactagtatcgtgttctgtactccattcaagcttagggatcgacccacacattcctctgccacaatagcataacaccaacgcggacacccaacgag

SEQ ID NO: 570027 - DNA, 155 bp, Homo sapiens
cagcagcagctgcgggttgacccaggactgcgtgtgagtttgtgacttgtttggtgggagagcagaggtggacgcggcgagagccctacagagaagctggctggtaggacccgcagagaccagctgaccaggcttgtgctcagtcgaacggactg

SEQ ID NO: 570028 - DNA, 144 bp, Homo sapiens
actgggaataatctctgaaacagtctcatgcgtggcaggggacatttatcttttttaatgatcatcaacacgagtgtcttttggtagctatataagtgatttttacctccgttctattaatatcctcttgcatgtatgttttgc

SEQ ID NO: 570029 - DNA, 171 bp, Homo sapiens
  misc_feature (21)..(21): n is a, c, g, or t
  misc_feature (57)..(57): n is a, c, g, or t
  misc_feature (147)..(147): n is a, c, g, or t
caaggtagtttcataccgttntcataacctaaattgtcatcgcataaactgtttcanctcctacagctctggacaggctgcttttaattttggtgagtccatccagtacctccacgtgccctgtttttttccagggacatccttggnctcttccacagtccttgggtaaat

SEQ ID NO: 570030 - DNA, 142 bp, Homo sapiens
tagcgaccaagcagttataagactcacggtgaaggctatgcaaagcccaaatgagggtgctatcgtggaggttgcactggaatggtactacaaggacaagctctttgaccagcgggagttcgttttgagattggcgaggggg

SEQ ID NO: 570031 - DNA, 149 bp, Homo sapiens
actggagctcgccaccctgttttggaatgaacaaggcggttttgcttgcctagcacttctgaagatagtatagctcttcatcggtgtcattgatcacgtcgtcagaacacgtctactgagaggggacaatcactggcaaacacaaaagg

SEQ ID NO: 570032 - DNA, 503 bp, Homo sapiens
  misc_feature (393)..(396): n is a, c, g, or t
  misc_feature (406)..(406): n is a, c, g, or t
cctgccgcatcagggctttatttaacagttttattgatataattcacatcacatacaattctcccattgaaagtgtacaattcaatggcttttagcacattcgcaaagttcacccgcatcaataatagaacaattgttattaaccccaaagaaaacccagggccccaaaaacaattaacccccaattcttttcatgggggcctttttcaaatttttaaagggtaaggagaccgggggttttttaaaaactctttcccccatcaaaaggggggaaaaacgcgggagaaaatttttgagataccccaaaaacaccgggctttccccccagtttttttttttcttaaaaccccttttttaaacccacaaaagggccccccccctctcttttttttnnnnaactattcantctacatttcttgaggaagactggaggggctgttccgtgacctgtctcagggctgaatttgttcctcaatttcttttggcatgtattatttttctat

SEQ ID NO: 570033 - DNA, 383 bp, Homo sapiens
gctgggcgttgctgtgtgccacggctgttgtcccataccctcatcttttaatcttcatggttaaccctattaaggctgtctcgttgactcccattttatactaaggaagttgatgttctgaacgggtttcggtctcatgacccccatgtgttaaatcatggattcggtccagctttgtctatctccgaagctagtaccctttccatgcattctacccatatgctctcttccctgttgatgttgtttatagcctggatcttcttcttggtaagttttgatcgggctgactgacctttaaattttgcttaaacagtcaatcgaagatctctgatctatgctggcctaccatggtcctgttctgcagccccacttggtcgatggtg

SEQ ID NO: 570034 - DNA, 481 bp, Homo sapiens
ggggagactgggaaggtcctcagcctttcagcaccatgcggacgagctttttatagttgatacaacctttgttgtcttcatgccctgccaccagcatctttactttttcctctggcatcttttcacccagtgtgacaagaacatgccggatttcagcacccatgacggggccttttccttctttgtcaaacacccgaagtccttcgccttaattctcataggtggccctgggccttgttcttggccactgtttgcagcatgggcagaaaaggctcaaaatccaccccctttccatttattttatatattttttggggttccccaggaccttaaccccctcggcgttggtagggtttttgcccaggggcccttataatttcccacactgggttgccaggatttttcccttaaccttgtttggttaacaaagcgggaaggcctccttaaaccttttgggtcggtttttcgggaaaaaacacca

SEQ ID NO: 570035 - DNA, 208 bp, Homo sapiens
ggtccatacagcgcgtctgcgtggactggctaagagatcatctcaggagctgaattattgctgatatcttaatcaggatgcacagaattatcatgcctggacagcatcgacaatgggtaatgtcaggaattgtaaactattgtggatacatgacgctgcagatatgtcggaccagacttctgtacacgaggatgtgacgaaagtatat

SEQ ID NO: 570036 - DNA, 848 bp, Homo sapiens
ggaagagagtaccggtatcgggtttccttgcggatcaagtttcattaccgtgtacctttcccatgtgtggtcacgccatttggcagggggagaatggggaggcttggccttcttgtgtgatggcagtgtgagcagaatgaagctgatgccagcatgtcactggttttgaaggggatgagcccagacttgatgtgttgggattgtccttattgttaagcctcaaggtctcgcatggtgtgggcccctgtaccaagctacagcaagttccctcccagcaagtggacatcagtgtcttctctgtgaggcatctggccattcgcactccctggtgtgtgtcagtctctctcacacaaggaggaacttgggtgacaggctgagtgtgaggcacctgaagtttccctgcggaggtcgataagattagcagtaacacactatccgccatctgttaggccttggtgaggaggccctgggcataagcaagggtctgttcgcatcagcgattgtccagagggcggttttgacgctattctataagctatagcgtttgtgtatttcacccgttcactttactgtataatttaaaagtcattgtatgtagactgagacacttctgtgagtctcaatcattatcactgaacccttttagtttagctaaatctatgtgtcatgtgtaggctgcaatatgtggtacactcgtgtttaagagaaaaactgaaaccaaaatggcgcattttcctgactcaccttctgccgtgggatgggccagggaacatacttctaggcaagcagcctaaactggtgatcgggggcagatacaaggaacagtatgaagctcccagcggttcgca

SEQ ID NO: 570037 - DNA, 470 bp, Homo sapiens
gattgtgtgtgtgtgtgtgtgtgtgtgtgtgtgtgtgtgtgtgtgtggctacatgtgtttatgctaactataaggatccccagaagcttaaaataaaatcctcaagggtctaaggtaatatctcagtcagagatatatttgctttataagacataggacctgggttcagtagttcagtctccaaaacacaattgatgaaagccaggcttggtgatacatattgccatccatctaggtgctggggtgggatagacagctgggtcccaagagtacattgagaagcctgtttgattcagcctacttggtgatctccagacaaaattagagagtgtgtgtcatgaaacaaagctagtggcccctgaggagcagcagtatggcttcctgtggcttgtctgtactcatctgtacatgcacgcatactcacaaggatatgcacacctttgcagatataaatgaaaaagaaaagaaag

SEQ ID NO: 570038 - DNA, 1083 bp, Homo sapiens
agtctccagcagatccctccagagcagccagaagcccccatgtctaccccccgagagccctgccctcatgcctcgaaccagagcctggcaggcctccccctcagtgccttagccccacaccatggttcgtcccgacaccacaccgagtccctgcagctgctcactgggagggggtcagggaaacggggccaggaggggagagaggcggcacttacgcgcgcatcactggtcgaggccaggcacagcccgggggacgaaagactgcgacaacgacacgcagacacactgcgacgcaacagggacccctcaccaacgtgaccgcggacaaccgactgggcgcgcctacaaaatgcgcccaacaatcagcaaacgggctccccccaaaccgaaagaacccccacaaaccaatagcgaccagcactaacacggcacaaagccaagacaccagacaccgcccggtcgcccagacgaccccaacgcggctaccagcacaaaacatcaaacggcgggaacaaccaataacactgaacagcgcgacccaaaaacacacgttgaacgccacacgggaagacggatcaagaccacgacaaccagcacccgccgtacagcagagcacccgcgaaccgcgaccacacacaatcagaacaaggcacatcacaccccaccggcaacccaaaccagccagccacagcaagccacgaagacaacaagcagcaacaaacggcaaaccacaccgaggagaaaacgacaaaagagcagcagccataaacacaggacacacagaaagacaacaggagagtgagaccacaagcaatggacccatccaccaacggaggaaccaacacggacacaacaagacaccaggaaggcaaggagagtgaccaacaaccaaacaaacggtaagagagaacaacatcgggaaacaacaaaccaaagagcaagcccacccgcaaaagcagaggagaaaagaagtctggaggaaagtacaatcggaaaaacaacagtagaaacatatgcagacagaacaaagcacagcaaagacaacagcctagacgtacaagacgacgaagtagcgcgagaaca

SEQ ID NO: 570039 - DNA, 186 bp, Homo sapiens
caggcggtaccgtctcatctctgaagtccaggactggtggaggacaaggccaggcttacttgagcccaggagtccaagactagcgtgggcgacatagcaagaccctgtcactacagaaaatttataattaggtacacattgtgatgagcatctgttgtcctagctctatcccaggctgaagccata

SEQ ID NO: 570040 - DNA, 157 bp, Homo sapiens
tgagctggtaccttggttcacaactcttcatccacttgtgtggctgcattcatagctgcatccacctcctccacagtggcatatgtgacaaacccaaagcccctggagcgcctggtgtttgaatctctcattaccacacagtccagaattgccccga

SEQ ID NO: 570041 - DNA, 192 bp, Homo sapiens
ttggctctggtggtaactccctccctgtggtcccagatactcggaaggctgaggtggaaggatccttgtgcccccagggagttctgggctgtagtgcgctaatgcggaatcgggtgtccgcactaagttcggcatcaaatattggtgacctcccccgggagcgggggaccaccaggttgtctaaggaggagt

SEQ ID NO: 570042 - DNA, 118 bp, Homo sapiens
tcttagttaagagctaatagaaaggctaggaccaaacctatgggtctgctgagattcctggtgcagggctcttgggggaaggagcatgggggctcaggtcaaacataccctgaggtta

SEQ ID NO: 570043 - DNA, 119 bp, Homo sapiens
ctccctcagttcaggcgtgcttggccagagagccattgtcaaccgcagagatgctgttgaaactcaagtccctcttagccaaattattcagtcctttcaggctagctgaatcatctcaa

SEQ ID NO: 570044 - DNA, 975 bp, Homo sapiens
gtagaaaaacgggagggaaggaagaaggaagatgaatccagttgctacacaaccccaccggggccctgggttcacataacacaagtagcacaggctaaacagggctcctatcaccacacaggggtggcatttcagagtgctggtgccagtgcccaaagcctgttagtaggctcacagagaaaaaccacagtatctactggttagctttactgtgctgataccactcctggttctagatggaactaaaatgaacttgcctaaatcctccttccctagaggtctctttaacatgttcatcagggttatggtttaggatcatcatggttacctaagcatcttcctaagagaagttagtgatcttagtcctatagcaacaacaacaagagaaaggtgagtgtattgtggctcaccatagaaaacgcctccctcctaaatataaacgaagagaatcttttctaacacatcagggaatatgctgatcttttacacatattagaatagtgaaagcaacagtagcaggcaaacacacagtggaatataatatagagcaatataatctataaaatgttaacaatcatgacaagaggagctgcttttcaatgttaggctcacaatgtcctaattatcaggtacctaacagagacaatggaaaagacaaaataaagtttaccaaggaaaggagaccaagagtttggaaacatggtgccaaggtttgagagaagggaataatgacattaaaaacaggaaaatagggctgggcgtggtggctcatgcccccagcactttgggaggcagaggtgggtggatcacttgaggtcaggagttcgagagcagcctggccaacgtggtgaaaccccgtctctactaaaaatacaaaaattagctgggcatgatggcaggtgcctgtaatcccagctactcaggaggctgaggcaggagaatcacttgaaccaacgaggtggaggttgcagtgag

SEQ ID NO: 570045 - DNA, 126 bp, Homo sapiens
cgctaatccctgcagagcacagtgacgggcactgaacgtggagaggcagcccttcctgctcccagaggatggcacctgaagcccagtgaagcctggtcaccatgacaatgtacgcccgcaaagatg

SEQ ID NO: 570046 - DNA, 1799 bp, Homo sapiens
ggtgatgtctcacagaaagttctccgacacccagacatggtgtccctcgagacttcctgcctcggacagctgcagcagcaggcatcagtggtgaaggtgaagagcttccctaagtgatgaccctgtccaagcctgtgtccacctcacagccttcctgtggataccaaggctggcatgactctacatctgtgctgggaagtcgaccagtgcctggtgcatccaataggtgcaacacagcacatggcaggttgtgttgtgcagtgcttgttgcacccacttggttaacagacaaccaacaccacatgtggtgcgctaagatgggcgcatactgttgggtgctcacgattggcaaacaaccactctcagtgccctccagcgcaccgttcccacagcaactggtctatttgcgttgcagccaccatctcagatgcatgccacttgcgacagtcagggctggtattacttcatacacagcacaattggggccatcagagatcatccaagcacagcaatgtgcccattctacaacccacacgttcactttgccgaagaaggaacacacataaggaggagcaaggagacttagaaacgcggaactcggcgcgccacaaggaccagggccacgcacgttcggcagagacacaggggacacctgttccaaggcacgcaggagcacgtacgagcacggcgaacggtaacgcactgagcaaaaacgggatccgacaatgcacgggaggcacccgcatagtagggccccacacacgacgcgcccaacggacgtcggcagggcccagctgccaacgaccctatacgatcgcgagcggcacatcaggcaacacgacacacgtgggcacctcacacccacgatcgggacgaggggacaagaacgtcccacgagatggtgagcacacaccggaggagcacggcgaccccccctggagtggggccagcccaggcacgaggcacaaagacacatggaggagcctagtggtgacgccaccgacggaccagacagggaactgacgctatcggaaagagcaagcagcgagaaggaggtcaacgacctgttgagttgagcacacgaccaccacaacgtactgggtcacagggacgcgcacaagggacccgcaacgaattgaaacaccacgacacagggtacgcaactacaggcagagggaactgccacccccagagcggtgatcaacagacgcgacgctaccgaacacaagtcgaggtaccacaccaacaggacaacaggaacggagacaccccacagaccagaagggaacgcagacatgaccccccgacagacaacagcgaccacaaacggtaagagagcccaatgacgacacccagagcagtggcccacgtgtaccaatcgggcagcacagtggacaccacagtgcaacccgaggctaaacaccaatcacacagtcatgacacgacagcactagtggacaagaccaatgggctaccacatcacacacggcaaccgtgcgaacacaaccgacaggagccgacatacaccactgaacagggccacaacgagacccaatatacccaggacacggccacagaagacacacacacacagacggccacgcgcataccctcaacgtacaaaggcgcacaccaccactggcgacggaggtacacaatcaagacagccaccaaccagcgacacgcgaaccgatcgtgcgcccaacagacggcacaaccacaaccaacgatcagcccacgagccaccaccagaaaagaaaaaagcgaacaacgagacagaacacagcaacaacacagac

SEQ ID NO: 570047 - DNA, 775 bp, Homo sapiens
tgaaattcgtgaaagggcaaatcgggggtgtggaaaaagctggccgcactgccgaacaaatggcaggcagctcaagtgatggagcttctggtcattccggaaggtcagcgtgtatcagcactggaacagttgaaaaaaggccctgttacagtcagtggacctgcgttgaatgaagcgctggaacgatatatccgattacgaagtcttgagttttcccgactgaacttttccggtctgcctgccattcaactgcgtaatctggctcgttatgctggcatggcgtcggtaaaatatatcgctcgaatgccacagcagagaaagcttgctgtacttactgcattcgttaaagcacaggaaataacggcattagacgatgccgttgatgtgcttgatatgctaattctggacattatccgcgaagcaaagaaaagcgggcaaaaaaaaagactcaggcaccactgaaagatcttgatcaggccgcattgttactggcgcgggcatgtgcattgttgctggatgataatacagatgtcccagatctcaggcaggttatcttcaagtgcgtacccaaaaaccagactggagaatctgtaaagcaaggttaatgaacttgctcgtccacagaacaatattttccatgacgaaatggttgagcagacggtcgggttaaaccgtttcttccggccggtgttgcgggacctgcatttccgtgcggcaccggcaggtgaccatgtactggtgcgattcattatctggcagaactgaatgggttcga

SEQ ID NO: 570048 - DNA, 179 bp, Homo sapiens
gtttttttttaaaaaattgggccccgcgggggggcccccccccgtaatcccccccctttggggggcccaaccccataaatccccttggggccggggttttagaccccactggcccccccccctgagtcccctttccccccccgtttttttttttttttataaaaactgttccgggttta

SEQ ID NO: 570049 - DNA, 294 bp, Homo sapiens
caccctcctaacgttctagtgaggactaattgaggtaaaatatgtgaagcacttgccccaaagtatgaggcaaaagtgaatacatgtgactatcaataataaagatcttcgcgtgaatgtgcactaatattatggaacacccccaggaacttacctgggaaaaataagccccaaaccaaccctccctgggggctacaaaaaatcttggggcagggaaacaaagtccccggacaccagattatttcctgtagcacacctgcattaactataattatttaactgcctcattttatg

SEQ ID NO: 570050 - DNA, 426 bp, Homo sapiens
tcttctgtgtgtgttgttggtgtgttggcttacgctgtaatcccagtactttgggaggcgaggcaggcagatcacgaagtcaggagttcaagacccgcctgaccaacgtgatgaaaccccgtctctactaaaaatagaaaaattagcttggtatggtggcacgtgcctataatcccagctactcaggaggctgaggtaggagaatcgcttggacctgggaggcagaggttgcagtgagctgagaccgcgccactgcactctagcctgggtgacagagcgagactccgtctcgaaaaaaaaaaaaaaaggattttcgtctctgggtatttctcacaggaaggcccaggcgtttggatttgccctacggtctcagtgaactccccacctgtttctctcacagtctacttggtccacctctcaacacag

SEQ ID NO: 570051 - DNA, 300 bp, Homo sapiens
acggatcgcttccccgaggcaggactctgccattacgctgcggtcggtgccagaggttttccggaccctggcatggtgctttcatggtctggggcttttatgagcccccgcgtgtggcttacacattccacagcatacagctgcaggccacgctcaggtcctgcgtgcgggccagcaagttctggaaaccacgtggtgtcccctgccaatggggcgatcaagtgcagagcctggacactttcagagtttgaaaggtaactaatagcagcacgtcctccagttacaactccggcgatgcat

SEQ ID NO: 570052 - DNA, 360 bp, Homo sapiens
aaaattttggccttttaaatattaaggttaaaaaaaccccgtatctaaaattgattttgttaacggttgtcttaaaactaaaggttttaaagtataaaattaaaatttgccattttttttaaaaaattccaatttttattttcatgggggaaattggaaaaaatttttttttttgcctctggagtttaaagtttccctatggaaataagttttgtgattcccgtaaaaaaggggtatgttttttatttgaaagttaaaccctttgaaagttaaaacctttagttttaaacccccctatgtataaaaacttttgggttaatttttgctttgtccttaataaaatttaaaaaaattccctta

SEQ ID NO: 570053 - DNA, 155 bp, Homo sapiens
agtgtgcggcccatacagtaaattctcgagtcaaatggggtgaacatgtggtgtctacatacatactggcacaaaatcatttctccaagctataaatacacgggtaataattctctaaaactggccaaaacaacttagaacccactgtctaaatt

SEQ ID NO: 570054 - DNA, 1084 bp, Homo sapiens
  misc_feature (808)..(808): n is a, c, g, or t
gcaaccggcgtgggcggacgctgtggggtacctaaccatagggtatgatagatcaaacaggaacctgttgcttctgaggtgcaactaggataatgacgaatagagtagcaagacaggatcacttggtgtactcctcatggaggctgacgtgggtatgagccgagattcctcttccagctgtggtcccctaggcatcaagcatgccatggtgcagtcagaagtctacgatcgccccacaacacaaccaatgtactcatgagagaagactgtgctcgtgcaacatgtaccgaccttgaagcaatgagaatggggataatggcagagacggaggaggcagacccaatcttcaaatcagcttgcaaccatgacatcctagatctgatatgcacgcatctagaaaccttaggtgaggtttgacacgatgttggaaacccattagaataatgaacaacgttgaatccatgaacagtcgaggcatctagaggaggcccaacatataggtgatcgcacgcgtctgagcgttccctactctcctagggcggaaagaggcccacacatagacctagaaatgagaggattgactacaggtgtacattcaccaggcgactggattgccagaaacactcaatatggatcctctggatggggctttacaacaggaaatctgctccttaactagaataatccttaagaccactgtggctaggtcccaacgtccgtaaacaacattgctacatttgcactgggtgaacccaaacctcttggcttgaccaaataatgactattgaggaccatgccctagtgtaanacgttggtatgctaagcataccccagaaaccaggggtttacagcggaactcactagcgttcaaagaagagtcacagcctatcaaaatgccaaaacggagaggcggaggcgcaaattaaagccatactggcacaaccaagagtgtagaaaaactgcagatgaatgaaaatatcaagagatcacatctaggtccgaggagacaaacaggatactcacatttctctcgtcactgtgttctattatcgcacaaacagacacaaccaaaaagcagctaaaa

SEQ ID NO: 570055 - DNA, 100 bp, Homo sapiens
cccctgccaaatgttaatgtagtgggtggtcatctacaaaagataccagcctataacaattttagtgggagttcttacagtctagttgtacttataagca

SEQ ID NO: 570056 - DNA, 103 bp, Homo sapiens
atggcgacaacgcgctgggctctggcgcggaccaggacctttctcacccacgtatcacccatagagacactcacagcaagcagcaaccggggaaaaggacgaa

SEQ ID NO: 570057 - DNA, 1321 bp, Homo sapiens
gaattggcccggagcaggagcatggcgtcgtcggggtcggtgcagcagctgcccctggtgctgctgatgttgctgttggcgagtgcggcacgggccagactctacttccgctcgggccagacttgctaccatcccattcgcggggaccagctggctctgctggggcgcaggacttatcctcggccgcatgagtacctgtccccagcggatctccccaagaattgggactggagaaatgtgaacggtgtcaactatgccagcgtcaccaggaaccagcacatcccacagtactgtggttcctgctgggcccacggcagcaccagtgccatggcagaccgaatcaacatcaagaggaaaggtgcatggccctccatcctgctgtccgtacagaatgtcattgactgtggcaatgctggctcttgtgaagggggcaatgaccttccggtgtgggagtatgcccacaagcatggcatccccgatgagacctgcaacaactaccaggccaaggaccaagactgtgacaagtttaaccagtgtgggacctgcactgaattcaaagagtgtcacaccatccagaattacaccctctggagagtgggtgattacggctccctgtccgggagggagaagatgatggccgagatctatgccaatggtcccatcagctgcgggataatggcaacagagatgatgtctaactacactgggggcatctatgctgagcaccaggaccaggccgttatcaaccacatcatctctgtagctggctggggtgtcagcaacgatggcatcgagtactggattgtccgaaattcatggggcgaaccctggggtgagaaaggctggatgaggatcgtgaccagcacctacaagggaggcacaggtgacagctacaaccttgccatcgagagtgcctgcacatttggggaccccattgtttaggtagatgtctctggaagcagcgctgtgaaccatgacagggaggggtgattaattactgacactggacatgtccagacagctataaacagtgcttgtggacatgaggaccagagtgtggactgcatcccgagaggagacggtaaaggatgaaacacaactgcactgggaccctccgccgtaccctccaggcctgcctcctccaccacttgagccctccaggcctgcctcctcttctacagtgcttgccttcagccacccggagaagagagctatggtttaggacagctcaacttatcaccagatctggagccctggaatccatgggaggggggaacaagtccagactgcttaagaaatgagtaaaatatctggcttccca

SEQ ID NO: 570058 - DNA, 222 bp, Homo sapiens
cacctatgggaaacggaggagacgaagacgagaatcaatccttgaaagagagatgggcattaagtgaacatgctgaacacttataatcttaactactaagcaggaagcctcatccttgcacagaactgaagaggaagtagtatgaaaagagaggcatgctgtcgaccccggagtgagccagctactagcctatatgaaattgagatgctctacacaacacag

SEQ ID NO: 570059 - DNA, 1490 bp, Homo sapiens
  misc_feature (1121)..(1121): n is a, c, g, or t
tcaggcttccgggtcttaaatgggggcgggggctgggggcagttcatccaaagttgtgttccaaagctagaggtcaacctttgggggtgggcttctgcagggcaaagggagatggtaacgcggcccgtcaggctgggggagatcttgaaacggctggaatgtgaagagccccatgtggttggcagccacagtctcaaagagtctgagaggaagaagtcttcctctgggcccaagtcacccgagaagtctttcaaaccacgaggcgaggcgctctggggcgcccaaggcgaaaaagcttggcattgggcctctctggtgtgggcgcctctcttgggcagagggcggcggggttcctccaggtgtggcgccggaggacccccagggacgtctgggttgggggccccacttctgggttatcctctggccccagccccttggggccgggcgcctccgggagaccctccgggggtcacggcacccggcctaaattcccaggggggctcttacacacagagggctctccggttgaggctctcagatacgcgagagatctgggagatactactgggcccctgtgtgtgtggctctcagagtacaagttttagtccccacaacacaagatactcggctttggaggcctattctcccaaatgttagtggctcctggagggttgagccccccccacgatggtgtccccaaaccttgtgtcccccgtgtcgtcccagtgagcccttccttccgggggcccaaccacattctgtggtctcccgggaaagaacgtccggggcgctcccacttcgggcgtctagagacccccggtctggtctccacccacgaggtcattttgggcgcgcgttgggtgtacgcccgactcccatctgtgacaattgcacccacaacgaaccaaagcctcgcggcgactgcaaagggaagctgtagaaggcgttgtaggcaatctgtagtgggcccgtccaaggtaaatttcgcaaaaagagacctcaggggtacagcggtgttgcggcacggtttcacaccacctatgtctgtggtaactcgttgtggtccgccgtgttcgaaaagaaaaccaccgcgtgtgtgtgggaagacgaggctaaatgangtgcaacagcgcaccttcggtatcggtgagccacaaaagacgaccaccgtccaacaaacgagggtcagacacgaagactccggcgtggacaacaaaacgaggggcgcaatttcaccactctgtccgagaagcccctattaagttctcgacaacaaaggcgaggagaggcgccctaacaaatcatctgcaagagacatcacattcgtgggccaacatgatcctcacgcaagccaccatcaggagaagcggggagtctcaaattaccgcagctgataatttgatctccttcgtagacacacacttcatcaaatcagtaagtaggaatggtcattatgcctcttcgatggctacatgtttagtactatcggt

SEQ ID NO: 570060 - DNA, 1308 bp, Homo sapiens
gggatccctgagctcggcagcagcgcagcgggccggcccagctgctggtgccgctggaggctctgagtccccggcggcgcccgggtccatcgcggaacgtacggggcgagatgcgagccgagccctctggctgctcctgtcgtggttcccgtgctccatggatgggataggcggttgtgatgttggatgacacacttagataccgatgtcgtcccgtccagtaaacgagctcgaaagtgggccccagtcccaagaactggcaccgcacactgtgcgtgatttgcgcgccgtgcatggcccgaggcatagcatgctcgcgagaatgcgctgtcaagctgcttggtgtgacgcagctgcgctaccccgtctatggggccccctattgtcctccctgggaagtcccggaggagggcgggcggggcctatccagggcaccgtgggcactggccacccttagcaggggcgactgtagtgtataccctgtagaagggctgtgtactccccggaatcccgaggacaggcccttgggacccggattgtgctgccaagacaccacgtaattgcgtgcgggccatgaccccccggtcaccgaaagcacaatggtggcctccgtgaccccaacttgaagggtcccctggtggcttcgtgggaacccacaaagctttcccttccataaactggcccattgctctgccagacttcgtgggaacccccaatgtggcgcgagaacccacttggccagcaagagggccgtagagggatggcagaaaagcgcacggcacaacccaggtaagttcgcccttgaatggcgcttggaaggtggctttgcaccggtagcccgtcttattccaggccaatgaagtggggccccaccccggagcacttgtgggcggccactttgtcgaacctaggagcaaccgggctcttgggtttcccattggccggttggaattccttctaaagggctttgggtatccaggcgattgggggtcgtttcaggcgttgcaccctggtggatgacggggaagacacggccctggtatgctgggaaaggacacccttgggaagcgccgaacgtccactggacgagttgcctgggaccttggggggaccgataaagggcaatctccgccgtgtgtggggaaacaaaagtggaacgcgcgttggcccccagggccctcacaggatgggaggaaaaccctgcagaaatacgtgcggctcacacggggccttcaaatactcgggtgacaaggggtaccccggatgttcatgggaggacctggggcggttgaggcgctcttccaccag

SEQ ID NO: 570061 - DNA, 704 bp, Homo sapiens
gcccagtgtattgctgtctgtagaccccagcactgacgtccggaggacttttggataaagacttacaaaaagtagcccactctatccacagagcggtagagctgaccctgcagatccagagcgacactggtgtcagagccaccctgaaagagttcatggagagactggcaggggataagtaccagacgaccgagcaggctctccgcaaggaggttgagagcttcgactctctctttcatatgcactgcctgcctgacttctaaaggagcgcgcccactctgaacccacctggcgccacagaggaagctggctgacggaggacccccacctgagagatggatgagctgctccaaatgggaactgataacactcaggccctttgagggaggtgattttggacttttatcatgtactattgacagatcaaaatttgactaagcctcattgttagaaattctgggacaggctattaaaggatttaaatttgaacctggctttctcacagctggacatacttctaggtgctgaaagaaagacggagccgtttactctacctgagctttcctccggcttgctgaacagagaggaaatgcccatgtccacaggtgtgacacactgaaccttactatcttgattccagtgcatgccaaggagaactgattacctctgaggtttagtgcaatcgaagcgatgttagccaaggc

SEQ ID NO: 570062 - DNA, 331 bp, Homo sapiens
  misc_feature (323)..(323): n is a, c, g, or t
tgtagaatcagacaggaggggagagagaaacccacacataaacaatgcactaaagatcactgaagcgtttaaacatttccacttgccagtttaactttcttgaagactgtagctcgtttggaactgtctctcgtccactgcattttaacggttgcatctgagaaaagactaataggcttcagtcaccctcccaccaccaggcaatgaacaacaaagcattttaccgtaaaaatacaccagcaagaatgtactcagcgttcaatcacaacatacgacgtgcttaaacactgcaggaaatttccgtcaacacgtcagccgtttantgcactca

SEQ ID NO: 570063 - DNA, 1306 bp, Homo sapiens
tttaggggttaccacaaaggctattgggtttgattattataattttaaacaaacatacatagggaaatagtaaaggttcctaatggaaaaaagacctaacggcaatagtattctctgcagcatagaagaccaccgtgtttccaaactatcaagggttagggcttggaaacataacccgtggtaaattatctccagcgggctagctagtcaggcatatggggtgccacacatgtggtcatcacagagggtgacttcatttattggccatatatcacgcacaagtgcagcggctatatcactatttgtggcagtgtaattttacacatcccagaatgtgcctcaacaaagctcatggctccatctctccacggggacagccttctatgtgttccaatacacaacacaatctagtgtgactacacactccaataggtggaaacagtgggtggccgtggtggggcaatccctatagatagcagaggctcccagtggcactgcaagggctgtgaaaacataccttagaactccctgggcgcgaacatatcaagggggttaaatgggacgccaaacggggtctatgagacacaataagcgtcacagagaacgctcaccaagatcatacccaaaaggcaacatcatacagctgataaccaccagaatacagagttcccaagaaggacaatttaccatacaaccctcagtgggacacacaactggcgacaacaactggcaccaggccccgggggaaccctccggggctggccatataggcgaaggaaacgccgaaactcaacaaaatcaacggactacatgcgacaggggagaccacacggagacccccccgcgacccaccacggacggcaactcaaagcccggcgacaaacaccaggagacccccatggaaatcctcacgacaaccggggagcgaagacaaaaactgcacaggcaacagacccccccaaaacaaccgggggcaacaccgcaccccgaaacaacacgacaggcacaaaacaggaaacaacagagtaaaaacaggataccaccacatgcgcacagcggcaaaaagaccggcacagcggggaaaaccggcaaacgcctatcaggagcaacacacgggagcaacgcccacgacggaagccgccgcagaaggacaacgacgaagacacaaaaagcgggtacagtcacaagcaacggatctgggacgaagcgcaagcagggcaatcaacagagacagaaacaaccagaccggaggagcaaccccgggagccaccgcaacggcagacgcgatggagcgaccacgagcgaa

SEQ ID NO: 570064 - DNA, 106 bp, Homo sapiens
gaattctgtgactgtcgcagacacggccgtgtattactgtgccagaggaaagtacggtgaagggactcgacgctggggccagggaaccctggtcaccgtctcctca

SEQ ID NO: 570065 - DNA, 164 bp, Homo sapiens
accaccccttccgccggctccatgttaagagagggcggaatcgaaccccccaaagctggtttcaagccaaccccatggcctccatgactttttcaaaaaaaaaaaaaaaaaaaaaaaaaaaaaaaaaaaaaaaaaaaaaaaaaaaaaaaaaaaaaaaaaaaaaa

SEQ ID NO: 570066 - DNA, 313 bp, Homo sapiens
  misc_feature (1)..(1): n is a, c, g, or t
  misc_feature (21)..(21): n is a, c, g, or t
  misc_feature (32)..(32): n is a, c, g, or t
  misc_feature (58)..(58): n is a, c, g, or t
  misc_feature (67)..(67): n is a, c, g, or t
  misc_feature (74)..(74): n is a, c, g, or t
  misc_feature (79)..(79): n is a, c, g, or t
  misc_feature (91)..(91): n is a, c, g, or t
  misc_feature (105)..(105): n is a, c, g, or t
  misc_feature (111)..(111): n is a, c, g, or t
  misc_feature (114)..(114): n is a, c, g, or t
  misc_feature (121)..(121): n is a, c, g, or t
  misc_feature (152)..(152): n is a, c, g, or t
  misc_feature (265)..(265): n is a, c, g, or t
  misc_feature (294)..(294): n is a, c, g, or t
  misc_feature (310)..(310): n is a, c, g, or t
ngaagcgcccaccaccaaccngacgtgttttnattgcgtgctggttcctccagtgagncggttctgngactgcnctccntggccagtgttncgtcatccaggggntcgtgntanggctaangaggtaagtaaagggctctgggccgcaccanaaaaatccgggggtggataggatgcttgggccgagagggctcgaagcgagaacagggacgcgccctgcgaaaagggcgctctttgcgcgccgggaccaggcctttcctcgctnccaaacggcctcgcgcggggcgggagctncttcgtgttcctcttnggg

SEQ ID NO: 570067 - DNA, 316 bp, Homo sapiens
tttcagacgcttcagctaactcctgatcaagctttacaaattgcagtcttctactcaagctcccatccgtagtgcacatgagctagactctcacacgatccagttagagacgtagcaacatatctagcacatcacgctcctcgactagactatcatcattctgtcgtagcccagtgagatccagctcataaccatactgttcccgctctcagaacttcccccctcccactccccaccatgtgaccaggaccctcccaaccgccgctccgagctccaccaatcagcaaccacctccacccagaacccgggacctggc

SEQ ID NO: 570068 - DNA, 130 bp, Homo sapiens
ttcgcaaaggagtcatcacctcatgagctcccatctgcctagcgatacctccgctacacactccagccttaagtctcttggagaagctggtgctgtgagccagaggatgtcagctgccaattgtgttttc

SEQ ID NO: 570069 - DNA, 172 bp, Homo sapiens
tacatatcgatcgagctctcccatcttatgcgtgcctagggtggcgacgctaactcagacgttacgttcagtgtgactggggtgcgagcacgtcactagggggagcgcttcccagccacatccatcgtggctcgttgctggctggtgtcctggctgtcctagctcctaggag

SEQ ID NO: 570070 - DNA, 464 bp, Homo sapiens
atagctgactcttgaggataaaccttatgctctgacccaccaattagtgaaagtagctgtcaccgtgtgagctatcgacacaaagtgaactaggaggcaaatttatatccatcaggggcagggaatgcaccaactttttaagttcaggctatcttgaaagcttgcaacataccagatattgctatgttgtctctcacgacagcaatggatgacactgagaagttgtgttttgagtagcaggtgttttctatagtatgttgctggaaatcaagaggtttataaaacatggtacatgtttggaaatgagttagatacttgaaaagtctaaacacactgatttaggagtgcttatgttgctgtctcaatgaacaatgggtcaatagttcatatggactaaattaatctctgggtagcacgtatgtgtgtaaatataaaattatattagacattagcaccagtgcaga

SEQ ID NO: 570071 - DNA, 220 bp, Homo sapiens
agctgcactcagtgcgcacttccgtgagcgaggcagcacccgggcccggctctcacccgacggcgtgcacccacctgcccgctctgtgggaagaccttactcgtgcacatacacactagcagaggcacgagcggacacactcgggtgcgaagccctatacgtgtgtgcagtgtggcaaacagttttcagtactcccacaacctgagccggcacaccgtag

SEQ ID NO: 570072 - DNA, 146 bp, Homo sapiens
tgtgtgtgtgttgtgaggggtgtgtgtgcctgtgcacatggtgggtgtgctgattgtgtggtgtttgtgtgcagtgtatgcatgtgcatatggtgtgtgtgcagtgtgtgtggtgtctgttgtgtgtgtgtgcacaatgagtgtat

SEQ ID NO: 570073 - DNA, 338 bp, Homo sapiens
ctggtccaggagcacaacgtgccacgagtggaggatccgggtgaaccgcaggagctggtagaagatgaagcgcacgtgaacgtcctgcagcagaccgccctaccgaatgactgcgttcaggtcagtgtctacacagagggtgcgcactgcagtcgagggtggggggctggggggacaacctggggggagtgggagaggggcacctggcaggtctgtcccactttgaaccagcccacggcctggccgccccgctcctccatcctgtgcactgcctgtgggcacagcggtgaggtctgcaggagttttaacactttatttcatgttgcctttgtttcata

SEQ ID NO: 570074 - DNA, 496 bp, Homo sapiens
  misc_feature (354)..(354): n is a, c, g, or t
  misc_feature (382)..(382): n is a, c, g, or t
gtcaccttctgactcctgttgggtgcggcatgacccaagtgcagcgcaggccatctgcaggcaccagcgacagacgctgcaaggggtgcttcgtttcagcgttaatgccgctcaagttatcgtttgtcctgagaggtgctcccatgtcgtggtgctgagacctcctctgaagatgggtctttattcctcctgtaacctacctctaacagtccacccagctctgctttaaactgtatgtagaagaggcccatttccagaagcccctggaatggaggagacaggggctgaagcagactcatctgtgcatgactagttcattaggagttcagttttttttttttttttggggggccnggaaaaaaaaaaaaaaaaatttattttntaggaggatttttttgtaaggaggatgctcctaaaaccatgggcaaccaaatacataaagtggggctttcttttccccttgtaacagtgttttactttatagatttatttaaag

SEQ ID NO: 570075 - DNA, 141 bp, Homo sapiens
gtcatcttgctacagaagatataataataataagaaaccaaactacaatctcagaaaagcactagcaacttagactgacatactaaaggccaaaaataccctccgtgacacacatgctaataatgtgtagaacattgaact

SEQ ID NO: 570076 - DNA, 169 bp, Homo sapiens
atatagactgtacttttcagacaggacttttcagaagcaggaaatttagttgtcgccagagaggtgtgtcaggaccccgtgaaaggagccatgcggacatggggtcaagggcttggtccacatgttacaaacttttgtaatgagcaaacatctttacaatcttataatc

SEQ ID NO: 570077 - DNA, 966 bp, Homo sapiens
  misc_feature (173)..(173): n is a, c, g, or t
  misc_feature (204)..(204): n is a, c, g, or t
agcggggctacgacgggccgtcaggcggggatacagtctggaacgtgcgtgtggggctgggtctcggagtgggagacgtggagttgcatcgtaatgcatggttgtccaatgcgttacagcacgagttcgacgagaagggtgtagatagagtgacgaacgacgcaggtgaccgntgtgcctgtgtgggtcgctttgacctggtgnggccgtccctggcgcccgtacagcgggggactcctacggggtggcacatgtacgcaaatgccgcatccaatcgagccatagtacgagtcccaccaaccgcaggtcgagggctaggagcggaccagtgtctggaggagacctgagccccagcttgctacgcatgacaggtagagcccgggacttggtggcaagcaactggcgcagacatccccagactagcaagtagggcgggagccgtccccagggaagggtctcggttgccccctgctttacctgtcctgctggaccaatgctggcaactgggtacacaggtatatcactgagtgctctcagtgggaaaacgtcatatgtaacgacactgagggtgcgagaaagaatccagacgggactaacgagaaccaatctataggttcattggaggtagacctagtagataagagcaaggaaggatatttaatctcgagggtgtgattgacgttgcttcgaacctccatttccctttggtaaggcgaggttttaagaaatgaggattggccgtataattcctagagaatagttagccacttttagacaagacttagatatggaggtgaacgcgaagaaagtcacgggggaagacacggcggcgacacaatagaatttacatcgccaaacaagttaataattgagggcaatttttgaatggacattgggaagaatgttcgctttggggaaaaaaagataattaggaggaaactctggctagaggggttataggggttg

SEQ ID NO: 570078 - DNA, 470 bp, Homo sapiens
  misc_feature (87)..(87): n is a, c, g, or t
tgtcacgtcctctatgcatgacttattaaatattcccctgcagcttcatttcagatcacgggtgtttcctccttgacctggagcgtnctgtactaattcactcctgtcctcaccgaaaacagcggtactggaggaatcaaccccatgcccgccagtcaccgggttgtttgaggtcatggattaatacagctgaagatcctctgtcccgtacgtatcgggtagcacgagaaacttactgtagttttagttttaacatttctcccataggtgactttaaactttcatttcttgaaaatggggttccaataagaaaaacttggcctggttgcgcagggatcaccaccccgcagcagacggcgcgcgctggccttggcggggcgggcgagagcggccttaggcgttcactcccctggcctgcctgcgctccactcgaacccagctttttcttgggcgagtatgctaagggccga

SEQ ID NO: 570079 - DNA, 230 bp, Homo sapiens
atctagagatccccagcggccgcctatttttaactatatttgtctgttaactggtggtgaactttagtcttttaacaattttcagactatgaagtttggatgtatacacctctaatgtgggacattagttttttttaaagtatctgtatggagttatggatatatattaatttaatgtgttgaatctgttttattttagtaacatcttttgaaaatgttcaaacatatat

SEQ ID NO: 570080 - DNA, 864 bp, Homo sapiens
attccccgcccccttctgttgttaggaggcaaacaattgtttgcccccccgctgtcggaaaggatgtaccgcacgtgtcccctctgtaactgctccgcttccacctctgaggggaggtcaacatattgggggctgcgcgcgccttccttccactcaaccgattggcgagacatggccgcctccttgctcccgcgtagctctgggtcgtctgagctctgtcgtgctttcgtgctcgatcttcttctgtctctccccgtcccgcccacacttgtgagaaaatgtgttagtgacatatataaatgagaaaacctccccacctgcttcatgtcacatcttccgagattctctctcgtgcctccccataactatatttctctcccctagatgttccccccccccctaatccctctggcagcgcccctagcatgcaacgcctgtgcccacatgtcttcactcctctctgtttaagagagacaaggagggtcagaagatatcttctcctgttgtctactcgtagacgtaatacaatatgctttctctacgcctctcttctcaaaacatctgtttcaatgttattaacagagtcgtccgccccgcccccctctcgagaagtaatcattccgtcggacgcactggcgcttactatcagccgtctcatgagtagttgtgatttccggagtgctctctctctcatgggttaagatgacaacattgggtggtgcaagaataacgtggtgtgtctattgtcattagtgcccccgcccctattatggtaggacttgtctgacaggaattttctgccccctcctttttcctcttcccaccagtatcataggattctaagaaaaaaaccccaacaaaaca

SEQ ID NO: 570081 - DNA, 349 bp, Homo sapiens
tgagaaggtcaggtttggtcaacaaattgagtcccaagaaacctttgggtttccagagcttttatagattttgggaatggtgggaacaagattttaaacctgtgcgggggcgcggtggctcatgcctgtaatcccagcacttggggaggctgaggcaggcggattacctgaagtcaggagttcaagaccagcctgaccaacatggagaaaccccgtctctactaaaaatacaaaattagccgggcgtggtggtgcatgcctgtaatcccagctactgggggggctgaggcaggagaatcgctagaaccggggaggcggaggcggcggtgagccaagatcgcaccatggc

SEQ ID NO: 570082 - DNA, 926 bp, Homo sapiens
ggcgcttcttgtgcttgcctggtgtcggtgtgttagttgctgcgacttgtgttggagactgctgatagtgaagatgtctctcacgtgaaatgctcaaatttggggcaccctggcccactaaatgctaaagaccatcagtctgtttatgtgcaggatgtgctcagttagagaatgatatcatgtcctggtcttgactatcgagagaggcaccaatcatgtccgtgttctattctatttatcgcctctatgacgtgtcaccatttgtgatgccgccacggagatgcatagctttcagctgatgagggcagagatacattaatgaaactcaactgccaggctggagtaggtgtctatctgtgaggatctctgtccacctttcatggtcagtctaaagcgaatggtggtcagatacaaccgttaagaatgacaaagggcagtgtactgaggacccacttgatccatttccctcttgggatgatcaggaacccggaaagacggcgaccatctggcatcaggactctagtgggcgctcgtaaaacagcgctggagtgacgggcatctcggctagcaggaggccctcttgtgaatcatgttggagtgataccggggtatacctccgcgccaagatcacggtcacaatagaggcctcctcctggtagagccagcatcggggaggaatgaagaactcttgtagtagctatgcttcacgtgcgctttgccgggttcacttgagcaagagcatgggcgaacttgtagcccacgctaggcgtgggactagcttggtgggttggattagcatgcaatgcctgagtgtccacgaatgagccccagaaatatttcctccaaggcagtaaagtgagcgccgggcttgggccaggtgccaggctgcgggggggcagccatgacaacaagacccttccggcgtg

SEQ ID NO: 570083 - DNA, 100 bp, Homo sapiens
tgcactcaccacctctggtagttccagacactccacgccacctggtcctctcccatcgccgcaaaagggggggcacgagggacgagcttagctgagctgg

SEQ ID NO: 570084 - DNA, 436 bp, Homo sapiens
aattggttcaatgcgtacagatgtttaaaacgcagcaaacaagattaaccactctataaaaatacctagtggcgccaactagtggtgttgggaagtagattatcttcctcggagatcatatagtggtactatagtgcaaagactgaaaactaacaataaacataatcctaatgtggatttatcataatgtcaatcagatggaatctttgactggcttttacaatagagggcagtttcattacactggcatactttgcataccaggtaagtacagaaacccttttcaagatttaaaaaatggagcaacactagtcagcatttggtaccgtgaatataatacacctactgaaaatcttcccatacatcatgaaaacttggaagtaatttgtatagcttgaaatgtcttcattttagaatattatgcacaaaatccccg

SEQ ID NO: 570085 - DNA, 105 bp, Homo sapiens
ggtggatgcaagtgttgcaaaaccagaccagcgtcgagttatcagtacgacggtggttttgcggaatatatgatcgtcccgcccgcaagtactcaaggtagacgg

SEQ ID NO: 570086 - DNA, 336 bp, Homo sapiens
gagatgggaataggccagattgcaaatgtcctttagacaaaactgggcacattctaaatcacacagatacttgtattgggagtgaaaacttttgcaaagagccagttggttcagaacatcacaggcaaaggtgaaaaaatggatgactttttcatccactaaggatttatgtaaacaatgtatagataagactgtctcatatccagaagagatttcacctgcaactcctaatatgcagagactagaacaccgtaaatacatctctagtaggtaacagagcctcaaaaaccattcaagctgaacatgagggcagtttggtgtcttacaaagcccact

SEQ ID NO: 570087 - DNA, 138 bp, Homo sapiens
taggctgtggaagacgggtaggctgaggaagacgggtaggctgtggaagacgggtaggctgtgcaagacggtgatggacgagctctccgcgcggcgaacctcacagccatcgtgaccaggcctggcacagagacctga

SEQ ID NO: 570088 - DNA, 301 bp, Homo sapiens
ggcagacactgaccttcagcgcctcggtccagcgccatggcgcctccaggaagttcttcgtgggggaaactggaagatgaacgggcggaagcagagtctgggggagctcatcggattctgaacgcggccaaggtgcggccgacaaccgaggtggtttgtgctccccctatgctatatctgacttcgcccggaagaagctagatcccaagatgggctgtggttgcgcagaattgctacaacagtggctaagtggggcttttactggggagatcagccctggcatgatcaaaagatgcggagc

SEQ ID NO: 570089 - DNA, 1926 bp, Homo sapiens
cgtgcaggggtaggcacaccagcgggtggcgctcagtgatgtatcagcgttcgtcttgtgtcgaggcgcccccgtaggtcgtccggcgcgtttttccgcggttcgtcgccgtcaccgctttaagggagatgcgtggctcttcgtggtgttgtgcttcataggtgtggggggttctatcgtgtttgctggctgatctcctcctcttacggtcgggctttccgccacatgttttgtgggctttgtttgttgtagacttgttctttttgtaaagtgtctgttcgtgtgttcgacactcctatgtggcccttctgggatggaagtggcgtgctgatttcgattggtgtgtctgctgtggggcccgccacgacggcgccgcgaggatagtaggtgtggggccgtcgctcgctcgtctctcgtgccaccccgatggctgtgggctgtgatgtctcttgtctggccggcggaacgccccgttgtgcccgcccggggcgtgtccctgctttgtggggagatagcgatgcctggcgttgattaaagggttggttcttgcgaaaatgtgtcgtagcatgcgccccgcgagccccccgggggtttaagttgggccccgccccaccacgccgtcgtcttgggatgggggatgttctcctaccgttcgttcccccgccgctagcaggtgggtgatggttataggggggctttattatgtgcggggtcctcgtggttattgagcaccacgtgttgtgctgtatcaacaacacggggtaggggggtgttggtgggcctcctcctctccgtcttgttctcggggaggttgtagaggatccccccggcagttggtggccccacctgtatgccacgccccgcctggtctgtttggatatgtaggtgtttcttgcgccgccggtcggctcgtctgttgtgggtacaccgcgtgatgcatctgtcggtggtggtagtgagagcacccccctccggcgatgacaccagcctgggtttagtttgggtgggtgtttaccccctcttagtggcccccccccgccgcgccgctggggagatgatagatgttgtgctccatcatgagccctccccgcgcagcccacgctctctgggttgttgtgtgaagacacacgactggtgtggggtagccacaacgcgcggtgagcacactatagacgcttcgggaaggttgttctttttgttgtgggcgggcacactattggtgtgttgttgccacaccccctgcgcgctgcgagttttctctgtgggtgtagtctctcggtggttgttgagaaaataaatagagatatatatagggggttgtcccacacgggagcgtgtttcttgctctgtgggtgtctctctcacacagagagagtactcttggagattttattataagaggtgtgtgatatgcgagataggggagactctctgttgtggccgcactgtgtgtctctctctctcgagtgttgggtgagacccctcggtctcggcaccgcagcaccgctggggggtttatattctctgtgggagactccccgcggcgagaagagtgtttatagctcttcacagagactcttctctctcgcgccctctcctctcccacccgcagcagagttgccccagcagagtgtctctctcggatagagaagagaagaccttggtgggtttaacacccagatgagaggttagagatcccaagacccaaaggtgggcatgtgtatttgccttggtgtggactaccacaggtttgtaagaaatagatgtcccataagaggacacttttgataataatttgcaccacggtttagggaattgtctattcccgaaataaattaccctagagactcttgtcgtataggcccagaagatttccagaattttctggttgtgtaattaaccccccaagtcgttccatgtaaataa

SEQ ID NO: 570090 - DNA, 1176 bp, Homo sapiens
  misc_feature (971)..(971): n is a, c, g, or t
  misc_feature (1033)..(1033): n is a, c, g, or t
  misc_feature (1037)..(1037): n is a, c, g, or t
  misc_feature (1045)..(1045): n is a, c, g, or t
  misc_feature (1101)..(1101): n is a, c, g, or t
ctataccacaataatatataataatagaaaatgcgaatctattgtacactttgagaaactagccacatcgtactcagcacccccacagcagactacaggcaaatggtatccctgaagaaagaaaacctgcactcgaagccactcgagattctactaaatctaggacacatactatgcgaccgctagcatacagcatgtgtctgtttactacttcacaatcaatagcgatgcgagctttcttactcggccatcatcgttactagcactgtatgcgcacgtacttagagtgtgatacacaaagccagtacacacatcaaccttctccattctctactacatcgtcgctttcttcgagccactttacaacgcacctcctccccacgaactccttgtaaacaacacaactggacgcaaccgttatacaagccgcgcccacaatcaaaagcttggacacctctctcaccagtccatactaaatacacccattaacacattaccccactactccacccactcacaaagcgtaacttactaactcacccgcgtagcggagaaggctacaccataaaaccgctctctccttcgcgcccactcttcgcaactctcactataggtctcacccatatgtcatcgagccgcagccgccacaaccgaactatcctccagctgcgctacagataagcggacctatcgtcaccctcaacccccgtacgacagaacgcgcaacgcctaaccccactctgtagctactactacagtctctcgatcaccaacaatccggtgcactaacccacgggaaatcaataatggtgaaccaaccgatgtgcctcctaaacatattcacgacatttcccgactcacaccgcccgccacgtccggcagtcgcccatgttaactccatactcgtagaccccatcgaacattacctgcatacgactgcccgtcgcacacgcattgcacacgcgcgcacncgcactctgctatacagcaggtatccgagcagatagtctatgatgacgcagctgagtcactnaccntgcaactnctacgacggcagtatattgatatgcgtagcggccatcgcgacagcatgaccgtagntacgcgcaaggatatggcgacgatccatgatacacggtgtggcggaatatacactccgaaccattcacccgcgcg

SEQ ID NO: 570091 - DNA, 234 bp, Homo sapiens
ttttggctttcccggggggttttttttccccccctttgggggggggggttttttttatccggccggggcgggggccttttttttttttccttttccggataaaaaatggggttgttttacccccccgcccctcccccccccaacctggggggttttccggggccatttttttttttcggggagggttttcggcccgttttttttggttcctaatttaactttttggttaaatta

SEQ ID NO: 570092 - DNA, 190 bp, Homo sapiens
tgcctaggctcgacttctcctgtcccctgtcctgcgtctgcattttgcattttatcatcaaatctctctatggtctggtggattctggccttcaccttcttcatgtcatcatagatgaccttcgggagaagctgtggccgtgcgggggatcctctcgacgtcgctctgcatgcattctcatggtatctct

SEQ ID NO: 570093 - DNA, 193 bp, Homo sapiens
cgtcgacgtctgacctgggccgattgggcctgatgatgatgatgatgtctgacctgggcccattggacctgatgatgatgatgatgatgccttacctgggcccattgggtctgatgatgattataatgatgcctgacgtgggcccatttggcctgatgatgatgatgatgcgtcgacgcggccgcgaatttag

SEQ ID NO: 570094 - DNA, 731 bp, Homo sapiens
  misc_feature (176)..(176): n is a, c, g, or t
  misc_feature (387)..(388): n is a, c, g, or t
  misc_feature (434)..(434): n is a, c, g, or t
  misc_feature (499)..(499): n is a, c, g, or t
  misc_feature (547)..(547): n is a, c, g, or t
  misc_feature (591)..(591): n is a, c, g, or t
  misc_feature (669)..(669): n is a, c, g, or t
  misc_feature (707)..(707): n is a, c, g, or t
tacagaggtaggaggggctaattacttcaccaacaaaatcatccccctaaaaacttttttctatagcaaatagggaaatctaatatcacctttcaacatctctggatcgaaaatcaatctaccacgaacacgttctacaacgttatccaaaatttttttctgggaggggggacganaacaccacaaccccctatttagaactccgtacccctattttcaagcttcaatggtctttaaatcttcaccacaggccattactctcctcccttataatacaccaatttaaatgttaacggcatccagcaggtaccccacttctccaaaattttttgaagatcaacgctctttcattgtacgatttccacgacaggctcccatccaatcccnnagaccttccaaaagcagcgggttggttattaagcctatttcccganagcctttttccgatatcttaaaatagggggagcccaaaagcctttctttcctaaaaagagatttngaacggcgcgtgaattcttaaaaacgcgcctttaacccttttttttanttaaaaaaccttcctttgcgagggttttgaaaaatcccgaaagnacttctccccctctcaacttatatccccccgtgggaaagtatttttaaaaaaaagatctttgaaaagctgctcatccnctttttttcttttgagacttttttccagcattcccaanaaatgatccccccccccaccatag

SEQ ID NO: 570095 - DNA, 128 bp, Homo sapiens
gctgaccccccaggttgtgggcccacttcgtacatgcgtcacgtactctgactcaagcctgaatcatgctaagctgctaacagggagttgtatgtcggtgtatacaacgtactgtgcggtcaccgctt

SEQ ID NO: 570096 - DNA, 1186 bp, Homo sapiens
  misc_feature (507)..(507): n is a, c, g, or t
agcgggtgcctgccgcgtatgctcgccctggcatgcgctgtctgccctggcgtcctgccgccctgtcggcctgccgccgctggtcgctgggccgtggtgctccggtcggctccccgcggcactcctcatctgtcctctccactgcgtcggggaccagtctcgtgcttacagacgagtgtcgtcggctagtgattcataggaagatctctgcgtgttcccggaacgccgtagaggactgtgctctgtgtgcacgtgtccctacagtctaaatgggtgaacaaatggcatacgcaatacgctttgcacctactttgaatcgaataagtgcgctcattgtgcaaatggccgggacacaacttgtagcactagcgaagataacgtataagcttgtagcaaggaatagaagtctcatcgttgggacttgacgggtcgtacataagcgggggaaacgccaaaatgtccccaatagggttcggctgacatagtattgctcgggggcgagtcacncaaagttgaacgaatcggtgcacactctggcggaattggagtgcatcgactaggttgctcacttcagtgcattccatgtctgtctggctcggatttacgccccaaaactgtaaagaacttgtgcgtgctcattgccatcatagcactcctttagttaacggtcctggtgactctcaccggcggaaagttttccccacaggaactcataccttgtatcgacaagagggccaggaattcacccaacacacaaagtggcggtcctcccaaagggtggcactccatataccaagaccaggcatatcaggacgaagtctcgcaataaacatctgcggcggaaaaatgggagctagagttctaaggtggggttccttactttctctccaagttggtccacgcttgtatgggcggggtagccgttaattatttgccaccgacatgcggagaaaagcccgtagggaactcattaggcgcgcttgagagtcgacgcaaaaaagttgccacaacgcggcggggtccctggcccggcctgtccattgttcccacctttgcggtaaagaggtggccccaccgaaggtcggcgaatagcgcttaagcccctggggcgggggagcggacacccatattcgggtaagccctaatccattggcggcagcggagaaggttcgtaatgttcaccctc

SEQ ID NO: 570097 - DNA, 258 bp, Homo sapiens
  misc_feature (144)..(144): n is a, c, g, or t
  misc_feature (146)..(149): n is a, c, g, or t
  misc_feature (156)..(158): n is a, c, g, or t
  misc_feature (160)..(161): n is a, c, g, or t
  misc_feature (165)..(165): n is a, c, g, or t
  misc_feature (167)..(167): n is a, c, g, or t
  misc_feature (179)..(179): n is a, c, g, or t
  misc_feature (184)..(184): n is a, c, g, or t
  misc_feature (187)..(187): n is a, c, g, or t
  misc_feature (202)..(203): n is a, c, g, or t
  misc_feature (211)..(211): n is a, c, g, or t
  misc_feature (226)..(226): n is a, c, g, or t
  misc_feature (235)..(235): n is a, c, g, or t
  misc_feature (244)..(244): n is a, c, g, or t
gagccaagcctgatcccggagccggagggggactgggaccgagagaacggcgatggggggcggccccgccgcaggaggacccgggcgcgtaaccccgggggcccggcccgctccagacccagacccgcggggtgcggcaccctngnnnnccctaannnanncctnanctggccatcccngcccnccnccccgccccctagcnnccaacacnctcggcccctcaaanaccgaaacnacagctttntcaaaaataaaaaa

SEQ ID NO: 570098 - DNA, 699 bp, Homo sapiens
  misc_feature (20)..(20): n is a, c, g, or t
  misc_feature (50)..(50): n is a, c, g, or t
  misc_feature (56)..(56): n is a, c, g, or t
  misc_feature (101)..(101): n is a, c, g, or t
  misc_feature (138)..(138): n is a, c, g, or t
acggacagaatatggattanaacattgttgccgaaaaacggttgcaaacntttganatggcggcacacagtgaataatgttgagtaagccaggagaccacngtggcttgcagccatgaaaccacttgtcggggctganagtgaatcccagcagactagagacttagaggagctaaaatctcccaggccgctgcctaattccgcactgttccacggatgttactgggacaggttccaatcgctttcctttccctctgtttctaagaatccttcctgtgccagaggaaatggaccgaggagggaggagggaggtcgggatagagtcgggcgggacaccctgtcacccaagcccgcgtgatatttatagacattcatggcgctgactccatgctgtcacggcggcaaggctgccctgtgatggggcgctggggtcttcagcctgccctcactccctctgcccaagctccctggggtggtgattcggatgtctgctacagggaaggaggcctctgaagagccattcccctggcaggggcctggagcttcgggaaggcctgctcagggcaaacataaaaaccgctgaagggggcagaatcccagtaatcttagccacccggcccccacccctccctggccaggcattaagtgtcccttgccgcggcggggccctccttgagctccctcctccccggtcgcgtgc

SEQ ID NO: 570099 - DNA, 111 bp, Homo sapiens
gtaggtcaatcagcagtgaatcatcagctcctggtactcctttcagacgcaggtcctgcttggccttctgcagggcatgtgtgtctgcgtgaatgcgtgggtatgagtgtg

SEQ ID NO: 570100 - DNA, 492 bp, Homo sapiens
  misc_feature (144)..(144): n is a, c, g, or t
gaaagaaacagtatttgccttatttaatctgagccgtgcctatctttgtaaagttaacatgagaataacttcttccaaccatgcttaattttttttttagactggtgatgatgtcctccaaacaacatcctctcaggtacccanaagtggcattttatcaagtaatcaaagcttaaccgggaatccccagttaagcatctttattctggtttaattggcggatcaagaagacccagttgtgggcaggatggcctttgtgatcccagcaagagaagtggatggcatcacgtgaattttaacccccggacccttgtgcccaaagggaaaaccctttaacccacaaaagggggcaaaacgtgaccaacacgggggcaggcggcatctatatattgagaatttaccccacgagtggagagggggccacccacaacacgggtcccccccccttttggccaaccaaccttgggacaccgcgaaacggccgcgggcgag

SEQ ID NO: 570101 - DNA, 113 bp, Homo sapiens
gccagcgttcaagcaaccaaatactacactgttttcatttagtagttggagctaaacatgggtactcacgtacattaagatggcaccgcagggagttgtggtcacatctgtaa

SEQ ID NO: 570102 - DNA, 444 bp, Homo sapiens
gtgccccctatgctgcgcggacttcggaccggctctgtgttcactacactcagaatagcctggctgctcctctgatctccgatcaccggaggtcgctggtaaccaacagactgggctggagagttggtgctggcgaaacagtccttcccctggggccggttcttaccctggtccatagaaaccaacgcgggatgtccgtaccttcaccagaaggacttcctggttcccccttgctggcttcctggcagagcgttcgtcctctagtttctcagggatggagcgacagccctgcctgagaacagctatcaggagctgctctcctatctgcactcacccaggccttcatccatacttttccacggacggcgcctcgtgcagctctcgctcggtccgcgtccctcatccttttcttcttctgcacgttctccgtgaaactggaaggat

SEQ ID NO: 570103 - DNA, 164 bp, Homo sapiens
cacctcccccatccagctaatctctgtactcctagtagagacaaggtttaaccgcgttggccaggccgttttcgaactcctgacctcaggtgatccacccgcctcggccccccaaagtgctgggattacaggcgtgagccactgcacacggccaaggagagcgg

SEQ ID NO: 570104 - DNA, 548 bp, Homo sapiens
agtatcgcgacggaagatggcgtccgccacccgtctcatccagcgtctgcgagacactggcgtccgtacagaccgtgaggaagctgagtaccacaggagatctcagcgaatcagctcctccaagctccctgtgagtcctagccacaagctctccaacaattactatgtgcactcgagatggccgccgggaatctgtgcccccttccatcatcatgtcgtcgcagaaggcgctggtgtcaggcaagccagcagagagctctgttgtagctgccatgagaagaaggcggtgactccagctcctcccattaaagaggtgggagcttgtccctcggaccaagcttaccgtgtaaacacttgcaccctcaaggccacccgattaattttggcctccttgggatttcctccccagggagacatgtggccctcagtctattgaccaaataacgatagagctcagggtatcactttcttagcttttaacctttaacaacacttaccaccaatacgacgacgaccaacaaaaactacacaaaacctaccacaaaccc

SEQ ID NO: 570105 - DNA, 257 bp, Homo sapiens
  misc_feature (17)..(17): n is a, c, g, or t
  misc_feature (175)..(175): n is a, c, g, or t
gtggtgggggggagggnaggccgtgtgcgggggggtgggtaccgggggggggggtgggggggggggggggttccttggggtgaggggggtggaaggtggggggggtacggcgaggtgggatgggggggtggggggagggggagggggaggaggaaggggggggggggggaggaanaaccccccccattcctccccacatttttgggccttaccgggggattcctacctatttccccttttaaattaatatttttata

SEQ ID NO: 570106 - DNA, 282 bp, Homo sapiens
cgtacgtagatctagcgaggaggaagcagaagactgatagtgttggccaaactgatgcccactctttactggttaccagcagcagaggattgcagagttggaggccgctgcatttggctgtcgattggatgagctggatgctggttgggcagtggactgtggcaggggctgattggactggttaaagctgttgtctcaactgctggacttgctgctgctgctgctggctggaagcccgctgttggtactgagcactccctggagagaaagggccagtgtaat

SEQ ID NO: 570107 - DNA, 443 bp, Homo sapiens
ttcaaagacctcctgacgtcgtctaactaggtcaggctgaaggcacagctaatctcagtagaatatggcacagaggaaaaaataaaaataccaataatatctagtaaatacaaggtaccactacagaagtggtaggaacatagaaagagtgtctttactaccataagattttccattagaaggcccactggcatatgatatagaagtaattaaagacaatacatcaacctgtagttcaaatactgtttctttatatctttatgcttatattctctctctctattctcatggcactttcataacattcatggctaacctctaattacagattttgctttagcctccctgaatgaattacaagcctataaaagatatgaaatatgcctacccgcagagcttggcacaaagtggagtcaatctttaaatgtttaaaatatgcatat

SEQ ID NO: 570108 - DNA, 146 bp, Homo sapiens
agtgacctccgcttacattatttagctttatgagcaagctacccacaaaacgtgtgtgtgtgtgtgtgtatctgtttcagacagagtttgctctgccacccaggcaggagtgcaatggcactatctcggctaactgcaacctccac

SEQ ID NO: 570109 - DNA, 676 bp, Homo sapiens
  misc_feature (46)..(46): n is a, c, g, or t
  misc_feature (76)..(76): n is a, c, g, or t
  misc_feature (87)..(88): n is a, c, g, or t
  misc_feature (93)..(93): n is a, c, g, or t
  misc_feature (95)..(95): n is a, c, g, or t
  misc_feature (101)..(101): n is a, c, g, or t
  misc_feature (118)..(118): n is a, c, g, or t
  misc_feature (120)..(122): n is a, c, g, or t
  misc_feature (133)..(133): n is a, c, g, or t
  misc_feature (146)..(146): n is a, c, g, or t
  misc_feature (213)..(215): n is a, c, g, or t
  misc_feature (238)..(238): n is a, c, g, or t
  misc_feature (240)..(240): n is a, c, g, or t
  misc_feature (245)..(245): n is a, c, g, or t
  misc_feature (253)..(253): n is a, c, g, or t
  misc_feature (255)..(255): n is a, c, g, or t
  misc_feature (298)..(298): n is a, c, g, or t
  misc_feature (380)..(381): n is a, c, g, or t
  misc_feature (569)..(569): n is a, c, g, or t
  misc_feature (581)..(581): n is a, c, g, or t
  misc_feature (667)..(667): n is a, c, g, or t
gcatctcattacaaaacagaccccctggaaccagggaagccaaggnagcggcccacctgaaagtatttagattganaagaaaaattnnacctncntgacanaggttaggggtcacggngnnnggagggctgcngggatcacagggncagcagcatctactagcagcacggccataccagccactgaggtcctaactgcagcgaaggggccgtnnngcacacgtcgctcaccctctgtncnctgtnccccacanancaaacgcacatagcaacgttggtccgctcagccactggttctnagggggaacggtggatgtctgccctgtcacaacagccgagtcagtcacaacgactgacgatgccgctgacccagggctggcnnaggggactcccagcccagacaggcttggctgtggtttgctttgggaggagagtgaacatcacagggaacggctcaagttagccccaggagggtgggctggcccctggtccccgggctccttctggccctgcaggcgatagagagcctcaacctgctgccgcttctccttggcccgggtgaaggccgtntggaagagcctncagtcgaggtgcacagccagcagagagtcgtcattaccgggtacagggtaggtgaagaggcaggggttgcagttggtgttcacgangcccactgt

SEQ ID NO: 570110 - DNA, 760 bp, Homo sapiens
agcggggtggcgccttgaggagggagagagaacgtgctgcacgtgggtcccaccaggtgtcatagacatcacaagccgcggatccctcccgaagaatggattcctcttctccttctcctccactgcctatatgggagcctctatccagtccacagaagcccaaatcgaggttactaatgagctccccttgcttcgtgacccaggggacccctactcggacctcaaggctctgctcccctgagcttggcccatggcacccggcgcccctgggactcaggcccagccatcgtcacctacccgggccagggcggcaagggctccacaggagaccggacaccagggaggagcgggacatatcgtgacgtcacattccggccgggcctggccaaagtaacgaggctccgtatggccagagggggccgatacggaggctaggcagcatagtgggacggaggcgtgacgtgggaaggcccgaggagctcaaagccacggaggcaatcccccaacagttcccggggaccgatggaaaccttgaacacctggcagacgtacccgggaaagctgaaaccgggccaggatagggaccagcgtgaagcccagaatacgaggcacactggcttgagaaggccaccatctgggaagctgaacaatcagggcatgtatcccgcatatcatgagaggaccgtggaagccctggagcgattcccatgtaccctgattggactcccgtatcggctatacatccggtcaagcaatattg

SEQ ID NO: 570111 - DNA, 3074 bp, Homo sapiens
gttttttttttggatgtggaagccgagacctaaagttggggggtgatctctgaggagatggatcggtacctgctgctggtgatctggggggaaggaaaattcccgtcggcggccagtagggaggcagaacatgggccagaggtgtcgtcgggtgagggtactgagaatcagccggacttcacagcagcaaatgtttatcacctcttgaaaagaagcattagtgcttcaattaatccagaagatagtactttccctgcctgttcagtgggaggtatacctggttccaagaagtggttctttgcagtgcaggcaatatatggattttatcagttttgtagttctgattggcaagagatacattttgatacagaaaaagataaaattgaagatgttcttcaaacgaatatcgaagaatgtttgggtgctgttgagtgttttgaagaagaagacagtaatagcagggaatcattatccttggctgatctctatgaagaagctgcagaaaatttgcatcagctgtcagacaagcttcctgctcctggtagagcaatggtagatataatactgttgctttctgacaaagatcctcctaaattgaaagactatttacctactgtaggagcattaaaacatttgagagaatggtattcagcaaagatcactatagcaggaaatcattgtgaaataaactgtcagaaaattgcagaatacctttctgctaatgttgtatctttagaagatctcagaaatgttattgactcaaaggaattatggagggggaaaatacagatatgggaaagaaagtttggatttgaaattagttttcctgaattttgtttaaagggagtcacacttaagaattttagtacttctaatttaaatactgacttccttgccaaaaagatcataccatcaaaggataagaatattttgccaaaggttttccattattatggccctgctttagaatttgtgcagatgataaaattatcagatctaccctcctgctatatgtcggatattgaatttgagttaggattgacaaacagtaccaaacagaattctgtgttgctgttggagcagatttcttctctgtgtagcaaggttggtgctctttttgtattgccatgtaccattagtaacatactgattccacctcccaaccaactcagttcaagaaaatggaaggaatatatagctaaaaagcctaaaacaatcagtgttccagatgttgaagtgaaaggagagtgttctagctattatctcttgttacaaggtaatggcaatagaagatgtaaagccacattgattcactcagccaaccagatcaatggctcatttgcactcaatttaattcatggaaagatgaaaacaaagacagaagaagccaaattgagttttccttttgacttattatcacttccacatttttctggggagcagattgtacagagagagaaacagttagctaatgttcaagttttagctttggaagaatgcctaaaaagacgaaagttggcaaagcagcctgaaacagtttctgttgctgaactcaaaagtctgttagtactcacaaggaaacactttttagattattttgatgctgtgattcctaaaatgattctaagaaagatggacaaaattaaaaccttcaatatattaaatgattttagtccagtggaacctaattcctcaagtctaatggaaaccaatcctctggaatggccagaaaggcatgttcttcaaaatttggaaacttttgaaaaaactaaacaaaaaatgagaactggttcattacctcattcatctgaacagttgctgggccacaaagagggtcctcgggactcaatcacattgttggatgctaaagaattgctgaagtactttacctcagatggattacccattggagatcttcaacctttaccgattcaaaagggggaaaagacttttgttttgacaccagaacttagtcctgggaaacttcaggtcttaccttttgagaaagcctcagtatgtcattatcatggaattgaatattgcttggatgaccgaaaagctttggaaagagatggaggattttctgaacttcagtctcgtcttattcgttatgaaactcaaactacctgcaccagagaaagttttccagtacctactgtgttgagccctcttccatctcctgtagtttcgtcagatcctggaagtgtccctgacggagaagttttacaaaatgaacttcgaactgaagtatcccgattgaaacggagatctaaagatctgaattgcctttatcccagaaaaagacttgtgaaatctgaaagttcagagtctcttctttctcagacaactggtaatagtaatcactatcatcatcatgtgacatccagaaagccacaaacagaacggtccttaccagtgacttgtccattggttccaattcctagctgtgaaactccaaaacttgctacaaagaccagttcaggtcaaaaaagtatgcatgaatcaaaaacatcaaggcaaattaaggaatcaagatcacagaaacacacacggatactgaaagaagtagttactgaaaccctgaagaaacacagtattaccgagactcatgaatgtttcactgcatgcagccagcgtctctttgaaatctctaagttctatctaaaggatcttaaaacttcaaggggtctatttgaagaaatgaagaaaacagcaaacaacaatgctgtacaggtgattgactgggtattagaaaagacaagcaagaaatgatacataatcattctctttaagacaattataaattggatggagctattattcactacttcttttcttagtttgaaaattataaacaaattttaagctttattcaaagaatagatgttatatttctaaagaatttcatgaatatatattctatatttgtatagtttgagggatgctatgttaatgtatttttaattagatacatattttgtaaagtgttactatattttaaagttatttttatatgttttaaaatgtttactcttatttaattattacaataaacagaattttttttttttaaa

SEQ ID NO: 570112 - DNA, 129 bp, Homo sapiens
gatctctcacggatccccggcacgatctttgccgaacgagactctggtcctgctggctagttccgcacccccgcagcggtctgcgctcccccttcttcttagagcgcgtacatgctggcgttcagtcct

SEQ ID NO: 570113 - DNA, 1989 bp, Homo sapiens
gttttttttttggatgtggaagccgagacctaaagttggggggtgatctctgaggagatggatcggtacctgctgctggtgatctggggggaaggaaaattcccgtcggcggccagtagggaggcagaacatgggccagaggtgtcgtcgggtgagggtactgagaatcagccggacttcacagcagcaaatgtttatcacctcttgaaaagaagcattagtgcttcaattaatccagaagatagtactttccctgcctgttcagtgggaggtatacctggttccaagaagtggttctttgcagtgcaggcaatatatggattttatcagttttgtagttctgattggcaagagatacattttgatacagaaaaagataaaattgaagatgttcttcaaacgaatatcgaagaatgtttgggtgctgttgagtgttttgaagaagaagacagtaatagcagggaatcattatccttggctgagtatgcttatatggtttttgtattatcattaaaatacttaatattagacagttattttaatccatgagaatgaagattatatattttagcatctttactgaagaaactctagttaattgaaatttttgactctcaatttgggccttttatttgaataaaattctttaaaatgcatgtttcttaagcttacataatgtcaagaatcataaaaagtgatattttaataaacatgttcctttcttgaagataaattctgcctaatattttattttatttttgaaacagggtcttgctgtgtcacccaggctgcagtgcagtggtgcagtcacggcttgctacagcctagacctgggctcaagcgatcctccgacctcggcttccagagtagctggaactgcaggtgtgcaccaccacacccagctaatttttgtatttttttttgtagaaatatcatttcgccatgttgttcaggctgacctcgaattcctgagctcaagcaatctgcctgccttggcctcccaaactgctgggagtacagctgtgagccaccgtgcctggccaataatgtattttaaaagcttgaatagaaatgttatttaatgttaatagctagcattcataccaaagtatcattttcattttgctatttgaggctgaaatatgtgacttctttaatttatgtgtatttgcagcatttcaggtaccttttaaaatccatagagtttgtgaggattatatgtacatgattgagttcacttttaggtttttttcaattgtggtacaatatgtaagttgatccaggtgacataagttgtgataataatttttctcttgatgaaatatcccacctcttatagttaataccttttattttagtctttcataacatttcatgacaaaactgctcttattttagtattcacatattatatctgtaagtagctgtagacttaaaaattttcattttcctttttccagatcatatttgtttgtactgattaataaaaggagacctttccaaaccagagaaatatcattgaaccagggattagtagaggtaactttatttacacaatcttaggccagtcacgtaacttctctggtcgtttgttttctcatccataaagtattgaagtacttttagataatttcttaggtgctttcatttacccttaaaaactcttatcatcccatatgttttcctaccactgttaaagacaagtatagccaggcacagtggctcacgcctgtagtcccggcactttgggaggccgaggcgggtgggtcgcaaggtcaggagttcgagaccagcctggctaacatggtgaaaccccttttctactgaaaatagaaaaaaattagccgggcgtggtggcaggtgtctgtagtctcagctactcgggagcctgaggctggagaatcgcttgaacccgggaggcggaggttgcagtgagctgagattctgccactgtactccagcctgagcgacagagcaacactccgtctc

SEQ ID NO: 570114 - DNA, 692 bp, Homo sapiens
ggggttcttgttgttgaaatacaacgatggtttttcatatcattggtcgtggttgtagtccgtgcgagaataccaaaaaaaaaaaaaaaaaaaaaaaaaaaaaaaacataaaaaaaaatatcacaggcaaaaaaacaccccaaaaaatattgccttcccctggatttatcctcctttatctcctatcacccttttatcaccctgcattccctctactgtaacaccttcttaaatcctctctcttgtctgaaaccccccatcccccatttcttccgctctgatggtttcagccttcctcaacctgtgttttttctcatcacagcccctccttctgcgctttccagagaatctcccacttggagtggctcttgtcactcctcttcttccaaatttcgtataatcccgagcaaccttcttcttacacctcctctttttccccctttgcccatattgccctaaatccccccttcattcacaccattggcccttttttgccttggtcgtttctccactttcccccccgtctccttttttattcccctggccttccctcccttttaccaatcccgtattcccgggcggcccccccctattgaccttcccccttatcagcttcttgctgccggtttccctttgtacccctatcccatccctaaaggtccctccgaattattttttacgccgcgagacct

SEQ ID NO: 570115 - DNA, 415 bp, Homo sapiens
  misc_feature (394)..(394): n is a, c, g, or t
  misc_feature (408)..(408): n is a, c, g, or t
ggatttgagttcctttcttaagacactgtagtcatttcctgctaacatattattcctgtgacacttctgaccatgtaaatgttagatcttttttttctcaatcattttgtcttaatgaacctgtctgtcttttagcacagcaaaatgaatgtgtaattcacaggattgaactctaaagctgaaataataggtttgtgccttttccaagaaatattcgtcatatgttatgttctgttcaagatactgaaagaagtagttactgaaaccctgaagaaacacagtattaccgagactcatgaatgtttcactgcatgcagccagcgtctctttgaaatctctaagttctatctaaaggtacggtatcttcccaactaatgggcaaatttagttccangttctaatgttccngtttgac

SEQ ID NO: 570116 - DNA, 679 bp, Homo sapiens
ggggttcttgttgttgaaatacaacgatggtttttcatatcattggtcgtggttgtagtccgtgcgagaataccaaaaaaaaaaaaaaaaaaaaaaaaaaaaaacatgtggtggcggcgcgcgcccgcgggccccggcgagaaaagcttttacaaaacacacattgcgcgggggggcgcgcgggggccccaggagggtaagggaaacagggggcacaaagggggttctcccagagaggagaacaccgcgggcgccagagagaacaagagggaggagggaaatctctctccacacaaatataaaaacaacagcgccgcgcggggggacacaccgcgagaggcgttttcggagaaaaatctccccaagagagggagagcctctgaggagagaggccaataagagggggggccctctatacacaagcgggagagccaccaagaggagagagcccgcgaaatatataaaatattatatcagcgccccccccgaggccctgcgggggggggggtaaaacacaacacacgcaccgaacactaaactaacaacgaacgcgcaacaaaacacaacaccaacaacaaacacacaacaccaacaaaaccacaagaaagaaaacatataacaaccaaaaaacacaacaccaaacacgccaagacacatgaaaccagcacgaagaaaaata

SEQ ID NO: 570117 - DNA, 493 bp, Homo sapiens
gtgcggcgctcctagaggatccccttcgacggtgtctgagaaggtatgggtaccaggaagaaacaaacagaagtcttaagattagaatgagaaccaaagagaatttaaccctgccatttttttttttttaacaccaagatcctaagtaattccaaaggccttagatatcaaggaaagctacacaccatggagaggggcaaaattctttctctacaaggggagtaatcaagtaaataccgtgtctctttcaagggacggtggcctatggagcatgggggatgagtggtgtttcagatttccaggtgaagttctgaccctaccgtggtgggccaaagacgtaaatggagaggaaaggcctgggtcttccggatcaaccagcatttaacgaacaggggcttaaggcagatcactcaagaggcagcatagcaaggtaaaaggaatataagtaggtgtgggatgcctttttcctagaccaggaagggggaatatataa

SEQ ID NO: 570118 - DNA, 3437 bp, Homo sapiens
  misc_feature (3216)..(3216): n is a, c, g, or t
  misc_feature (3345)..(3345): n is a, c, g, or t
gttttttttttggatgtggaagccgagacctaaagttggggggtgatctctgaggagatggatcggtacctgctgctggtgatctggggggaaggaaaattcccgtcggcggccagtagggaggcagaacatgggccagaggtgtcgtcgggtgagggtactgagaatcagccggacttcacagcagcaaatgtttatcacctcttgaaaagaagcattagtgcttcaattaatccagaagatagtactttccctgcctgttcagtgggaggtatacctggttccaagaagtggttctttgcagtgcaggcaatatatggattttatcagttttgtagttctgattggcaagagatacattttgatacagaaaaagataaaattgaagatgttcttcaaacgaatatcgaagaatgtttgggtgctgttgagtgttttgaagaagaagacagtaatagcagggaatcattatccttggctgatctctatgaagaagctgcagaaaatttgcatcagctgtcagacaagcttcctgctcctggtagagcaatggtagatataatactgttgctttctgacaaagatcctcctaaattgaaagactatttacctactgtaggagcattaaaacatttgagagaatggtattcagcaaagatcactatagcaggaaatcattgtgaaataaactgtcagaaaattgcagaatacctttctgctaatgttgtatctttagaagatctcagaaatgttattgactcaaaggaattatggagggggaaaatacagatatgggaaagaaagtttggatttgaaattagttttcctgaattttgtttaaagggagtcacacttaagaattttagtacttctaatttaaatactgacttccttgccaaaaagatcataccatcaaaggataagaatattttgccaaaggttttccattattatggccctgctttagaatttgtgcagatgataaaattatcagatctaccctcctgctatatgtcggatattgaatttgagttaggattgacaaacagtaccaaacagaattctgtgttgctgttggagcagatttcttctctgtgtagcaaggttggtgctctttttgtattgccatgtaccattagtaacatactgattccacctcccaaccaactcagttcaagaaaatggaaggaatatatagctaaaaagcctaaaacaatcagtgttccagatgttgaagtgaaaggagagtgttctagctattatctcttgttacaaggtaatggcaatagaagatgtaaagccacattgattcactcagccaaccagatcaatggctcatttgcactcaatttaattcatggaaagatgaaaacaaagacagaagaagccaaattgagttttccttttgacttattatcacttccacatttttctggggagcagattgtacagagagagaaacagttagctaatgttcaagttttagctttggaagaatgcctaaaaagacgaaagttggcaaagcagcctgaaacagtttctgttgctgaactcaaaagtctgttagtactcacaaggaaacactttttagattattttgatgctgtgattcctaaaatgattctaagaaagatggacaaaattaaaaccttcaatatattaaatgattttagtccagtggaacctaattcctcaagtctaatggaaaccaatcctctggaatggccagaaaggcatgttcttcaaaatttggaaacttttgaaaaaactaaacaaaaaatgagaactggttcattacctcattcatctgaacagttgctgggccacaaagagggtcctcgggactcaatcacattgttggatgctaaagaattgctgaagtactttacctcagatggattacccattggagatcttcaacctttaccgattcaaaagggggaaaagacttttgttttgacaccagaacttagtcctgggaaacttcaggtcttaccttttgagaaagcctcagtatgtcattatcatggaattgaatattgcttggatgaccgaaaagctttggaaagagatggaggattttctgaacttcagtctcgtcttattcgttatgaaactcaaactacctgcaccagagaaagttttccagtacctactgtgttgagccctcttccatctcctgtagtttcgtcagatcctggaagtgtccctgacggagaagttttacaaaatgaacttcgaactgaagtatcccgattgaaacggagatctaaagatctgaattgcctttatcccagaaaaagacttgtgaaatctgaaagttcagagtctcttctttctcagacaactggtaatagtaatcactatcatcatcatgtgacatccagaaagccacaaacagaacggtccttaccagtgacttgtccattggttccaattcctagctgtgaaactccaaaacttgctacaaagaccagttcaggtcaaaaaagtatgcatgaatcaaaaacatcaaggcaaattaaggaatcaagatcacagaaacacacacggatactgaaagaagtagttactgaaaccctgaagaaacacagtattaccgagactcatgaatgtttcactgcatgcagccagcgtctctttgaaatctctaagttctatctaaaggatcttaaaacttcaaggggtctatttgaagaaatgaagaaaacagcaaacaacaatgctgtacaggtgattgactgggtattagaaaagacaagcaagaaatgatacataatcattctctttaagacaattataaattggatggagctattattcactacttcttttcttagtttgaaaattataaacaaattttaagctttattcaaagaatagatgttatatttctaaagaatttcatgaatatatattctatatttgtatagtttgagggatgctatgttaatgtatttttaattagatacatattttgcacagtgcacactacattctaacgtcatctgtatcccttccaaaatgccctcctcttactcaaccatcacaatcaacacaaactccttgtttcacacccacctaccccacatgccatcacccccaaactcccaaaccccacgtcaaaatcaattatcgaccccccaggccccagccacgaaccccgcccagccctcccctccgcaacgagctcatcacctcacacctcacgctccnaacgccaactacccaccagcccctccccccccagccacccactctatctcacttccccgacgccacaacatcaacaccctaagcactcgttcatagtccgcgcgttccgtcaccccacagaacgtcgtncccgccactaatgaggctcgccgaggaaccaggccgtgtccgctccctcgtccacacccggagtgcaacaaatatattctcacccccagcat

SEQ ID NO: 570119 - DNA, 440 bp, Homo sapiens
ggggttcttgttgttgaaatacaacgatggtttttcatatcattggtcgtggttgtagtccgtgcgagaataccaaaaaaaaaaaaaaaaaaaaaaaaaaaaaacatgtcggccgaagcagtggtatcaacgcagagtgcccattatggccggggtgaaggctttggaataacgcattgaatgacttagaaaattctttgaatataaaataaacatttgaaaaaaccattaaaaaaaaaaaaaaagaaaaaaaaaaaaaaaaaaaaaaataaaaaaaaaaagaaaaaaaactgaaatacaggaatcagttgattttgcatatgggcacttacggatagcccatgctattacatccacctaaggaatgactcccaattgtaacaattaagagataaggttgtgtgcacagatgtaatttgatatgtccgatttatcccatt

SEQ ID NO: 570120 - DNA, 742 bp, Homo sapiens
acgactgggaattacccagtgctatgtgccatctccaccgaatgcataagtccagacactgtgaataaccatcatgggcgcgggtgagacatccaaacaattgtgtcgatgcgagaagctagagtgctcttgcgatgcttgctgttgtttggagtcgtaggctgagatttgagaatgtatgaatctgaggtggatgtgtagtatacattttcaatagattcgagcaccagatggggaagaggaagatgttgcagttcaatgaatgaggtttcctcatggtatcgatgggatatgagtcgatgaccatgatgggtcacatggataaggtaatgattagggaagtcggggccgatagtgttggatgtatgcaacatacgagagatgagacttggatcagtgtgtaccaatcttagggaatccccatgtctttcgtaaatctttatttgatatcagtgtttggacaatatagatgatagtttagtatcaatgcctttcaaactaatataggataaccacttgatgccacaacgtaggaaatagggtagatagtggcagtgtcgcctttaggtggtggaatgatgtttcacattgaattgtaatgatgtacaacctttcgccttcatagatgtgcttggcaagatgttaaggcatgactgtgagctacaaggaaactgaataggcaaaatttgtgaaaccctaaaatggggggggcaagtggtcctggaatgggattttatctgtc

SEQ ID NO: 570121 - DNA, 423 bp, Homo sapiens
  misc_feature (11)..(11): n is a, c, g, or t
  misc_feature (67)..(67): n is a, c, g, or t
  misc_feature (88)..(88): n is a, c, g, or t
  misc_feature (169)..(169): n is a, c, g, or t
  misc_feature (187)..(187): n is a, c, g, or t
  misc_feature (191)..(191): n is a, c, g, or t
  misc_feature (217)..(217): n is a, c, g, or t
  misc_feature (281)..(281): n is a, c, g, or t
  misc_feature (312)..(312): n is a, c, g, or t
acaaaaaaaanggaaaaaattaacgccttccaatgccttttaaaaacagccaagataaatagtttcntttgataactttgagaggcgnctttgatgacccctccatcccaagtcctatgaacacctttcccttatggcttttcctgttattcttatgttctggaatggnagcctgttcaaaagatgnaacnaaattggtggatatttggggaaagcnaacacgaaatcttaaaactcacccgtgaagtgtgagaaaacagaggaggggaacaaatgggacnttaccaagcaaggtcaattgttgtgaaaagnctgtaaatgcttctaactcttccccctctcaaaatcataatagttgtacagaattttaaaaaggaaaagtttaaaatacctatataatagaagaaaaattagaggaaagca

SEQ ID NO: 570122 - DNA, 1039 bp, Homo sapiens
  misc_feature (1024)..(1024): n is a, c, g, or t
gttttttttttggatgtggaagccgagacctaaagttggggggtgatctctgaggagatggatcggtacctgctgctggtgatctggggggaaggaaaattcccgtcggcggccagtagggaggcagaacatgggccagaggtgtcgtcgggtgagggtactgagaatcagccggacttcacagcagcaaatgtttatcacctcttgaaaagaagcattagtgcttcaattaatccagaagatagtactttccctgcctgttcagtgggaggtatacctggttccaagaagtggttctttgcagtgcaggcaatatatggattttatcagttttgtagttctgattggcaagagatacattttgatacagaaaaagataaaattgaagatgttcttcaaacgaatatcgaagaatgtttgggtgctgttgagtgttttgaagaagaagacagtaatagcagggaatcattatccttggctgatctctatgaagaagctgcagaaaatttgcatcagctgtcagacaagcttcctgctcctggtagagcaatggtagatataatactgttgctttctgacaaagatcctcctaaattgaaagactatttacctactgtaggagcattaaaacatttgagagaatggtattcagcaaagatcactatagcaggaaatcattgtgaaataaactgtcagaaaattgcagaatacctttctgctaatgttgtatctttagaagatctcagaaatgttattgactcaaaggaattatggagggggaaaatacagatatgggaaagaaaggtaaatggattattcacagtttgccaagtaggcctttcaattttatttacaacacagatatttaaataaatcttaatgaaaatgtaccttataaagatattctagaatagcactaagtagaactttctgcaataattaaatgttctatatctgtgctaatacactagcctacaaaccacttattgctactgagcactttatatgtgagtagttcatccantctgaaactgaattt

SEQ ID NO: 570123 - DNA, 736 bp, Homo sapiens
gttttttttttggatgtggaagccgagacctaaagttggggggtgatctctgaggagatggatcggtacctgctgctggtgatctggggggaaggaaaattcccgtcggcggccagtagggaggcagaacatgggccagaggtgtcgtcgggtgagggtactgagaatcagccggacttcacagcagcaaatgtttatcacctcttgaaaagaagcattagtgcttcaattaatccagaagatagtactttccctgcctgttcagtgggaggtatacctggttccaagaagtggttctttgcagtgcaggcaatatatggattttatcagttttgtagttctgattggcaagagatacattttgatacagaaaaagataaaattgaagatgttcttcaaacgaatatcgaagaatgtttgggtgctgttgagtgttttgaagaagaagacagtaatagcagggaatcattatccttggctgatctctatgaagaagctgcagaaaatttgcatcagctgtcagacaagcttcctgctcctggtagagcaatggtagatataatactgttgctttctgacaaagatcctcctaaattgaaagactatttacctactgtaggagcattaaaagaaatcccaaagtgctgagattacaggtatgagccaccatgcctggccttattgagctttctaatttgcttcaaatgccaaatgaccatagaatggtcgacaatga

SEQ ID NO: 570124 - DNA, 181 bp, Homo sapiens
gtacctgtctctgtctaggctgggtgcagggctcactctggaccagcactttgggaggcactgtgggcggattgcttgagcccaggagttcaagacccgcctgggcaacatggcaaaaccccgtctttacaacaaaaaaatacaaaaattagctgggtgtggtggcacacgtctgtagtcc

SEQ ID NO: 570125 - DNA, 1237 bp, Homo sapiens
gctggtacggggaacctaaggacttgaacaactccaaggaagggagtgtacagaatctggggagggacagtgtccccatctgacaagtttccggtcattgacagggattttaaggacgcgcgggtgtagtagccagggatgcagtgaatgtcgttggtagtggagaactgagttgtagaatcgagagtgtagggggaattctggtcatatctcagtgctgctatgtgctgaggtctaatattgtattggatgcggggtacgtcatgtgacctcatgtgaagcctcaattctcctgatctgtgcacccatggggatacattatgccatagatgatgcctgtggattacctgatgctgggttctctgttgaagctagagcctcacactcgactgtaaagaggggccagggtgtctactaggcactccatgctcgctgtgacttaaggggactgtcccctggggttggtgcaatggtctatgggagccgcaaggcctccaagcacagggcctggtgggacctggtagccatagacctagaggtcgatccctctgctctggatggcaacttgaaagcagacacagatgagtaggtttcataggacctgtggggaaaggacttacgcattgcggaaaatgggacaacgaacgtggtgcgacccaccagtgacggggtcctacatcgaaggtggacccggggtcatcaacgatgaccgaatcacttataatgcggacgagactacctgtgacgcatgcacttatacaacaccagaccagggggagaacacataaaacgatcccgcgggtgggagcgtgagaacacactcaaacacaccgaggcggagagaataacacggggaaaaacagagcggcacagacgcaccgccaagaagcacccacgagggacaatcgagggatgagaacactccaagacgagaacaaagcaacaaagagagcgcgccaagctctgctggctgcatgagtagaacagagcacacgaggagaaaaaagacagctacgaaaagaggctgaagagaaacgcgaagacagcagcggagggaagcaaccgacgcgaaagaaagaggagaccgaagccgacagagagagggcgagagcgagagacacaacaacgacgaggaggggaaggggcaggcaacacacgcgcgagcgcacacagcaacgaaggaagagagccaaaagaaagggggacggggtaggtaagaagcaggcgagaggcaagc

SEQ ID NO: 570126 - DNA, 895 bp, Homo sapiens
cgcccgccgcgcgcgcgcgcgcaaccccggccgccgcccgcgctcccgccccggctctagcgcccccgtcccggcctcgcgccccgtgcgccctttgtagacgccggccaggccggtgcggtcggatgcgcggcggcagccccgggccccggctcggaggctcactggcggagaggaggcggcccgcccgggcccgggaccccgcgcgagtcggcagcccgcgcgaggcggctgcgctaggccccgcccggccacggcccaccccgggcccctggacacagacacggccacggcacttgctccatgcacctgcaccgacctcagcagccccgccaatgacctcagggaacggaaactctgccatccagcatcgccggcactgcccccacagaagtggtgacgaataacacccacacacggccacgtgtgaccagcccaacactcctgacgcactgttatcgacacgggtttgtgatccaggaccgcgcggccgcagcctaaccccgccagggacgctcgtaccgtgcctggctggcgcactctcgcagaagaagtatgcacacgggcgtccccggcctgaagaaactcaccacccgccacgcatcacggcccatcaccaactgcacctacggagcaatgcgagcgcagttccgtagttctgcccacccacattccatagacggcagcggctgccacccctcccacctcctccacatctgatgcaagcttcctcgcgcgcacgtgcgctgacactgtctgccttactatagggttcaacgcagtccacggccccataccttgatacacatgcggcgttttcgcgatcccaagtgctacacaccgagatgaatgtcgcgcaaccccgcggtgcccaactattttcccttattcccta

SEQ ID NO: 570127 - DNA, 951 bp, Homo sapiens
  misc_feature (7)..(7): n is a, c, g, or t
  misc_feature (19)..(19): n is a, c, g, or t
  misc_feature (46)..(46): n is a, c, g, or t
  misc_feature (62)..(62): n is a, c, g, or t
  misc_feature (64)..(64): n is a, c, g, or t
  misc_feature (88)..(89): n is a, c, g, or t
  misc_feature (91)..(91): n is a, c, g, or t
  misc_feature (96)..(96): n is a, c, g, or t
  misc_feature (107)..(107): n is a, c, g, or t
  misc_feature (109)..(109): n is a, c, g, or t
  misc_feature (117)..(117): n is a, c, g, or t
  misc_feature (120)..(120): n is a, c, g, or t
  misc_feature (123)..(123): n is a, c, g, or t
  misc_feature (157)..(157): n is a, c, g, or t
  misc_feature (160)..(160): n is a, c, g, or t
  misc_feature (175)..(175): n is a, c, g, or t
  misc_feature (185)..(185): n is a, c, g, or t
  misc_feature (197)..(197): n is a, c, g, or t
  misc_feature (203)..(203): n is a, c, g, or t
  misc_feature (220)..(220): n is a, c, g, or t
  misc_feature (257)..(257): n is a, c, g, or t
  misc_feature (270)..(270): n is a, c, g, or t
  misc_feature (272)..(272): n is a, c, g, or t
  misc_feature (281)..(281): n is a, c, g, or t
  misc_feature (287)..(288): n is a, c, g, or t
  misc_feature (298)..(298): n is a, c, g, or t
  misc_feature (306)..(306): n is a, c, g, or t
  misc_feature (311)..(311): n is a, c, g, or t
  misc_feature (315)..(316): n is a, c, g, or t
  misc_feature (318)..(318): n is a, c, g, or t
  misc_feature (325)..(325): n is a, c, g, or t
  misc_feature (329)..(329): n is a, c, g, or t
  misc_feature (335)..(335): n is a, c, g, or t
  misc_feature (339)..(339): n is a, c, g, or t
  misc_feature (347)..(347): n is a, c, g, or t
  misc_feature (357)..(357): n is a, c, g, or t
  misc_feature (365)..(365): n is a, c, g, or t
  misc_feature (369)..(369): n is a, c, g, or t
  misc_feature (382)..(382): n is a, c, g, or t
  misc_feature (420)..(420): n is a, c, g, or t
  misc_feature (434)..(434): n is a, c, g, or t
  misc_feature (467)..(467): n is a, c, g, or t
  misc_feature (507)..(507): n is a, c, g, or t
  misc_feature (671)..(671): n is a, c, g, or t
  misc_feature (691)..(691): n is a, c, g, or t
  misc_feature (761)..(761): n is a, c, g, or t
  misc_feature (763)..(763): n is a, c, g, or t
  misc_feature (784)..(784): n is a, c, g, or t
  misc_feature (799)..(799): n is a, c, g, or t
  misc_feature (824)..(824): n is a, c, g, or t
  misc_feature (847)..(847): n is a, c, g, or t
  misc_feature (851)..(851): n is a, c, g, or t
  misc_feature (853)..(853): n is a, c, g, or t
  misc_feature (888)..(888): n is a, c, g, or t
  misc_feature (951)..(951): n is a, c, g, or t
caaacgnggcatagaaaanaacatgttcagaagccatggggccaancacatgcggggacggncncaaatgcgtgatcagcagaatccnncnccttngccgaaaagtnancccagcanccnccnccaccccccccccccccccccccccccccccccnccnccccccccccccccncccccccccncccccccccccnccccancccccgccccccccccnccccccccccccccccccccccccccccccctccgcnccccccccccccntnccccccccnctcccnnccccctcccncgcacccnccgcncccnncnttcgctntctncacccncctntccccccnccactcgctntgcaaacncacngatctcagaactnttctaaagttaaaattttaaaaaatttctgatttgttntgccaatatttggngtggtgtttacctcttaagaaatcgcaatgctngtaagaaaatgctcaaaaagttgcataatggggactcagntcctttaaggtgcttcttttttctttttaaagaaaataaccctccttacaggtgtgtaaaccatttgcgggctctggtccaccttctcgtttgctgctctgtgggcacataatcggaaagcaggtacagcgcgcgggctctaacacgcttggggtagcgggganaaagtcactgtttttctttnatttctttaaaaaaaaaaaaagttctgttgcaaacgactgctgttggattctgagggtggggagggagananagggagggagagggagtgaanagcctgccctcctanatggattcttcagggccctccacanctgaggtggctcattcccatcanacananattgtcctggtgttcatttcaaggccagtgttcancagcagcgtttggaaagcaggttctgtgggacccccgccccgcccccgcactccttcatagcn

SEQ ID NO: 570128 - DNA, 259 bp, Homo sapiens
ctttttccttctaaaaagggttgccttcgtcttgtcccgtcccctccttttctcttacataaagttgtccttgtggttctccaaacaactgtccatagcagaaaaccccaactgggcagcagtcaggtggggaggcagcctctcaggggtggggaaaattcaaagtaactgctggcaggctggtgggcgccctccaggaaaagggggtgctgggccgagccgggctggcaagaagtggtgtcggtcttgcgtaaaagtg

SEQ ID NO: 570129 - DNA, 113 bp, Homo sapiens
ccagtgtgtgtcacagaagatgtcgcagcttctctgtgagggtcactgctgaccactgcagtgtccctgatgtgaagtaatcgccggagctgggattggccagtcggcagtga

SEQ ID NO: 570130 - DNA, 188 bp, Homo sapiens
ctgaccaaagcgtgcagtcagaaatatcaaaagctggaatctcttctagtacacgagtcttcacctgctgctcatgatatattctgagagccttttttacattgcacacttttggagaacggataggaagagattttatttcagatgctgtacgagtactcaaatcaccaatagtttgtatattctta

SEQ ID NO: 570131 - DNA, 672 bp, Homo sapiens
  misc_feature (171)..(171): n is a, c, g, or t
  misc_feature (177)..(177): n is a, c, g, or t
  misc_feature (179)..(179): n is a, c, g, or t
  misc_feature (302)..(302): n is a, c, g, or t
  misc_feature (310)..(310): n is a, c, g, or t
  misc_feature (332)..(332): n is a, c, g, or t
  misc_feature (335)..(335): n is a, c, g, or t
  misc_feature (350)..(350): n is a, c, g, or t
  misc_feature (354)..(354): n is a, c, g, or t
  misc_feature (361)..(361): n is a, c, g, or t
  misc_feature (376)..(376): n is a, c, g, or t
  misc_feature (395)..(395): n is a, c, g, or t
  misc_feature (407)..(407): n is a, c, g, or t
  misc_feature (430)..(430): n is a, c, g, or t
  misc_feature (468)..(468): n is a, c, g, or t
  misc_feature (470)..(470): n is a, c, g, or t
  misc_feature (472)..(472): n is a, c, g, or t
  misc_feature (580)..(580): n is a, c, g, or t
  misc_feature (666)..(666): n is a, c, g, or t
tcagcaaaataattttatttcctaacatatggtaacatatacatccaatatgtgccccccttgcacatctattcacaagttactcccaaatgacaactgctttgatatttaagcatgttctaaaagttattttagttgagaaatgaaaaatgctttagatggataacattntgagtntnttggattagtcacagcagaatttactttagttagatgagttctacaaatttaaagctttgaaaagctactacttttacttctaatacatccagatgaacacgatgtagcaatatcagcttgtnttccaganaaatctcattagtttttctggnganggaaccacttatccncgtntgtgggnactgtgcaggcaganacacagggggggggtaaancatccaaaaaanactggcagcatcaggatcaaaanaaaaggggctctcagacaaagttgtattcatgccactnantncttttccattcgttttcttagtcactaatgctttccaatggtcatgagtgcttttaataatatcaatggcaaagtccttatctttatattctgcattacacgcacacncatttttctggttttccatcaggaaccttataccttctaaaccagtacacagtagcttctaagtagccaggtttcagccgtgtganatcatt

SEQ ID NO: 570132 - DNA, 294 bp, Homo sapiens
cgtcgactgagatagtctggctctaaccggaagaccatcaagttgttcttgcccccatcttgctactattgatacaccccccaggtagctcccccaaccttgcccaggtctcactgtgccttctccatgaccagttctttcttgcccactcccaacatgatatagggacagtgtccttctgccttgatctggtctctgtttgtattatattctccctccaaaataccctgaggagcatggacaacatacctgcttgggaacccattaggatctgatggaatccctcgtccacgc

SEQ ID NO: 570133 - DNA, 160 bp, Homo sapiens
aaaaaaggtttttgtggcccctttttttaaaaaggccattttatgggggggggggttcccccaaattttttttttttagcccccccgggtgtccttccttgaatttgcccccttttttttcggagggggggcccttttttttataataaaaaatggaaca

SEQ ID NO: 570134 - DNA, 157 bp, Homo sapiens
aacccccctggaaagggcattttaaaaccctgttttttccccccaacccttatgtggttccctttttttaattttttcaatttttaaaatgtttatttttttttttgggggcttatttttttttaaaattatgtaaataaatgggctttttttttta

SEQ ID NO: 570135 - DNA, 659 bp, Homo sapiens
ttgaattgagatatgaaaatcttaccatgtacattatagatgacttacagaatattttggtgggaaaatgtgagggtcattaccaggtaagaaatgatctcagatggcattcttagatgacaccttcagttatgaactgtatggcagaaagaatttttgttaggggaaaagctttcttcttacaacattgtgactatacaaccaaaacaatcttgaaagtctgcataaaaatcttgtgcctttccagaagtgtcttcgaggctttaggaccattgcctcaaccactgtctcccatctgcttttctaatgtcaccaagtaaagaaaagacttgtatggtgaaaccccatctctactaaaaatacaaaaattagctgggcatgctgaccggctactgtaatctcagctactggggaggctaagggagcaggatcgcttgaggccaggaggcggatgttgcagtgagccatgatcatgacactgtactccagcctgggtgacagagcgaaattccagcaaagaaagggagagaggaagggagagagggagtaggggagagagagagagagagagagagaggcaggaaggaaggaagaagggaagggaagaaggaagagaaagaaggaagggaaagaaagaaggaaggaaagagaaaaagaaa

SEQ ID NO: 570136 - DNA, 659 bp, Homo sapiens
gttggagaagcgggtgacgaacacgtggagagtggtgagcgaggggctggaagcgtgaaacatatgtgatcgcaagagatccactatgatgcgcttactaatatactcatatggatccgccgtctgagacaccgagaagcgtgaagaacgtctatgcgcagattctgcccttgtagtgttgtgtggactggtgcggaggggccaaatgtccatatggtccctcgtgtcatccatggttggtctgtgtgtctcgtcttgggcgtccctgatagttgatgatttggcgtgatggcaattacgctcatagccatgaaactgaacagaaaagactgggactctctatgctggatttgcacttccttacaggagtttggccctggggcgctgtcgcctggcagtttcgtacttgctgtcatagcccagtcatctcttcccacgtgcattgcatggtctcacgaaactgatctttactctgcttcaccacctcagtgcaactctatgggcaggcagcacgtaggctacactctttgctgggacggtatcgttagatgtgcagaccctgagcttgttgcttttgtcttccctggggaatgtttcttcggatccattcggcttttccaggacaaacctgtatgtgggagctggtggtacactgtgtg

SEQ ID NO: 570137 - DNA, 155 bp, Homo sapiens
agcggagtggaggggagggggcggcggccagcggctcgcgcggagccggtctcccgggcttacgtaaggcgcgagtcccgcgcggcggccggggctccgcgactgggcgggcggaggcggcgccgccctgcaggatccgggctggaagcctctcg

SEQ ID NO: 570138 - DNA, 1168 bp, Homo sapiens
ggccaagtgacttacgcccccgaccctgagcccggacctgctaggcgaggaggatcagatctccgctcgagaatctgaaggtgccctggtcctggaggagttccgtcccagcccggcggtctcccggtactgtcgggccccgtgcctctggagcttcagtgaggcgagcgtcagggtcggggagtatttgggtccggggtctcagggaacgggcggcgcctgggtctgcggtatcggacaagagcctgctggagccaagtagccctccctctcttgggacagacaccctacggtcccatgtccatgtgtgggcaccgcgtgtaccatcctcctggccctggttgctggcactggccagttgcccgtaccgcaccaacaatcgttgctgatctttgccgacagagctcggactatggggacctagggctgctatggggcaccccagactctaacaatccacaaactggaccatgcttgtctggcgtggagtggcttgtcggttcacagacttcatacgtagcctgtgtctcctgtgacacaccctctagggccaggcctcctgacctggccggctcccggatccgggattgaggcattgtaccctggcagtcccttggtttgcccaagtttccaggggagtggacctgccccctggcaggcagcgtgaaccgagggccagaggtccctagactgccagaggcaaccctccacagcaacttggccgggcacaagatggcaactatgagagataggcggccattgaaggagtgacccatatccagtcacaaccaccatatacaaggggcttaccaaacaagacatgccacaagacaatcccaggttatattcccacagaaccacgggatcgatggatcccccgagaccccagctgctatggagacaaaccatcactcgcatgagaacgggcagcagtacccaggcagggtaattaccacatgcacgttaagatggggccgggaacaatggcgattggggaccagagaacacgtcatatgggcaaatggcccaacgtgccctggtacgcgcgcgcaaacgcatcgaggtacacatggacatagtaacaggaaccacgaagaacttcatggtcagaggcgacaagacgctggacgagcagtgtatgagcgtgggctgcaagttgggagacaca

SEQ ID NO: 570139 - DNA, 763 bp, Homo sapiens
ggagagctcaaccagtatagttgcaagtctggagagcgtgttggtgaactgttcaaggaacgcagctcccggcagatcatacagatatccagattatccagggacatgaccatgtttgtgaccgcgtccaaggatcgcacatcggcaggcaagcttttgtgactccacagatgtcttgatacatcatgaatgactttccggacgatgaacgtcctgttcaaatctcagcatgaacctctcccccaaactatgaccatgtggtccttgggcggtggtcaggaacgtccatggatgtaaccacaaactccaggcaggggtattggacaagatttgaggcacagagttcttccatttggcctttgacagaagagtctaggaaagagtcaaggcgtcgacttgggagcctatcaacaagtgtagccacttccatcctgatggcaagcagcgtactagcagtcggcggcgaagcatggttacgtccgtatccattacttcgagcctacagtacttcgaatccgaggttagaggcttacgaagcctggatactcctgccgggcgtgggtggctccatgcctggtcatacccgatgcacgttgtttatttacatggccagtgcgggtcacctgaggtcacggagatcttaaggaccaggactgaaccaaacatgggagaaagcactccgtctccttactaaaacattacaatacaatttaggccacggccattggtgggctcacgtcctaatagtccccctggctacctc

SEQ ID NO: 570140 - DNA, 559 bp, Homo sapiens
taggcagaatatagtatacatttcataagctatttgaaatttggtcttaataggtacttacagattatacgaggcagaacgtgtttaatcgcagtttcctaacaaggtactagaattgcatctttccatagtgtaaataataatcaaacataaacatgtacaattacggatatttgagtgcaatgttgtttgtttcaattacatatcttttagcatcctacctattatacataaagtaacatcaaaatgaaaactccatttaagaaagagcatccggaaatgacccccaaatggtagccgagcaaacagagaagcggtttccaaagataagtatttggaagacctatagtgaattatcaagctatattccaggctgtgtcactttatagtctaagaaattcggcaaagcatgaaactacccaaagctacatgggctctacagttggctagagagccatcaaggctatgcgttaaccagctggcaaacattcagtgataagtgagttctcttcacacctgttagtccctattctgtccatggattgtcactttcgtctga

SEQ ID NO: 570141 - DNA, 328 bp, Homo sapiens
tgcctctcccaaacccaagccggcaacactgcggcccgcggagacactgcgtgttgggtactagctgataactaagcatgagcacaatgaagggagactgcaagtgaaaaggccaggcctaccctcctccaacgaaaggacgaactgatccaagagacggcgtgaggcaggagaggacgtagctccgcatcaggcaggcccggacaggcaccctccaaagagggtttcattagggatgcaaaatgaatctggctttacagctggtgtagaccaggctcctgccccatcctgggctacccaggccctgccggtgctgacagcaaagaca

SEQ ID NO: 570142 - DNA, 390 bp, Homo sapiens
  misc_feature (360)..(360): n is a, c, g, or t
gctcgaccaaaagtttggtatttcgagttgtcgtggtttcttttgtaacattgctttgtggtaattatctgcatgtgttttggttattctgtgtattcagagctgtctattttaatccatgtatgctttggccatagtaacccatccagattaacacatttataagtcaccatcgatttgtcccatagttgtgataccgttgctttgtattaacaccagagagtcagtgatgatgaagggaagtgtagtcgttagtcaccagggattgctgagcagcaaggatcaagaagctggtcatgcccaaacgcaaccttgagggagagatgttggtgagagataagagatgggtggctgggtacngtgactcacacctgtaaccccagcactctg

SEQ ID NO: 570143 - DNA, 375 bp, Homo sapiens
tgagatggagtctcactctgttgcccaggctggagtgcagtggcttgatctcggctcactgcaacctcggcctccggggttcaagcaattctcctgcctcagcctcccaagtagctgggactacaggcgcgtgccaccacgcccgggtaattttttgtatttttagtagagacggggtttcaccgcgttatccaggatggtctggatctcctgacctcgtgatccacccgccttggcctcccaaagtgctggaattacaggcatgagccaccgtgcccggccatctcctctcttttttacaactttacttctttcactttaccaagaaaataatatttctcattctgggatttttactacagtattctgctcaag

SEQ ID NO: 570144 - DNA, 482 bp, Homo sapiens
  misc_feature (429)..(429): n is a, c, g, or t
  misc_feature (438)..(438): n is a, c, g, or t
gggggggccgggtgtatggagggtgcggtggtcggggtttcgggttggtggaaggaaggcgggccgggagaatggggctgttcggagcgcgctgtggtttcgtttagtgggttggatgtcggcagtctgcggggatgctgtagagggttcaggtagtgggggatgcctcagcaggcattggaggcgcccatccttcggagagcttgaagccgcaagtgtccatcttccaggatgcacgggactccccgagccttcgtcctcccattactatttaatatccgcgctacattgttcggcgcttggtttccctccagtatgcgccgtggcagccagtgagacgcccccagggagcgcggccgcagcaaacttgttctcgtgccgagttcctgcagcgcgggggctccggtggttctagagcgccaaacggcnctgcagtcnccagggggtcaaaggggggcgagtgtgtggtttggcgcggtggg

SEQ ID NO: 570145 - DNA, 422 bp, Homo sapiens
cgctctgcaagatggagtttcgccatgttggccaggttggactcgaactcgaactcagtggttccgaacaacttggcctcccaaagcgctgggattacaggcatgaaccaccgcaccccagcccagcatttgtcccttggtggactgctttatttcacttagcataacgtcctcaaggttcatctatgttgcagcaggtgtcagaattcccttccttttaaaggctgaataacattgtggtatacaccccattttgtttatccgttcatctgttggtgtgtattcaggctgtttctgccttcgggctgttgtgaagaatgccgctatcaacatgggtgtgagaatatctgttcaagtccctggctatatttttcttttggatatttagccagaagtggaattactggatcatctggtttctt

SEQ ID NO: 570146 - DNA, 376 bp, Homo sapiens
  misc_feature (139)..(139): n is a, c, g, or t
cctcgtgtgcttatcacatggatggtccctttggaggacccagtcctatgtgctcgcatcacgtgtgcccagagcttctgccataccaatccacatgcttggtgtgtgtgagagaatgcactggttagggcctgggcantcgacagatcccctgtttagtagttttcccctttcactcatgtccagtgatgtggagcggtccattttcctccccaccatggggtcttagcctccttggtgctggcgccctggtagggactgctgattacattctcattggtcgaccaaggcccggtcccgtggcggctcttccgtaaacacgtccagtgcagccccggcacactggccagactgcagggcccggagcagggcgcct

SEQ ID NO: 570147 - DNA, 250 bp, Homo sapiens
cactactacttaggggtgtgtgtcatacaacacatgtgtctgaacctggtccatatggacgaaacaaactttatctattatgtgccacactctatgcacgctcctcatcagtaatgggatggtgtcgactgacctacacggtaatctacgggcaaattccgggtaggctataaacttatgtctggatacaccccaactctagttgccagcgtcatgtctcgctcaggaacgctgatatgcccttaacctg

SEQ ID NO: 570148 - DNA, 134 bp, Homo sapiens
tcagctcgtcctggtctttcttgagcattggccctcaggcccctggaaccaggcacaccagtgcagagggggagcccttgaattccaggagtaagggccagagaggaaccccaggagccaaccgtggactagtg

SEQ ID NO: 570149 - DNA, 169 bp, Homo sapiens
ccgacccacggccagaagcgccgccagcgccagcagcacgccatggctccccgcgcggcccccactctgcgcccgatgcccatgccgctctgcgccctgttctccgcgacgtcgggctgcctccgcccctccccgcgccgtcctgccgcaaacttccagggactccggg

SEQ ID NO: 570150 - DNA, 590 bp, Homo sapiens
tacaggtcgagacgatcacagtctctgcggagccgcccaagcccgtccagtctccaggcaacaactccaaacccgtggaggacaaggatgctgtggccttcaccggtgaacctgaggctcagaacacaacctacctgtggtgggtaaatggtcagagcctcccagtcagtcccaggctgcagctgtccaatggcaacaggaccctcactctattcaatgtcacaagaaatgacgcaagagcctatgtatgtggaatccagaactcagtgagtgcaaaccgcagtgacccagtcaccctggatgtcctctatgggccggacacccccatcatttcccccccagactcgtcttacctttcgggagcgcacctcagcctctcctgccatgcggcctctaacccacctgcgcagtattcttggctgattgatgggaacatccagcaacacacacaagagctctttatctccaacatcactgagaagaacagcggactctatacctgtcaggccactaactcagccagtggccacagcaaggactacagtcaagacaatcacagtctctgcggagtctgcccaagcccttcatct

SEQ ID NO: 570151 - DNA, 343 bp, Homo sapiens
  misc_feature (185)..(185): n is a, c, g, or t
  misc_feature (187)..(187): n is a, c, g, or t
  misc_feature (203)..(203): n is a, c, g, or t
  misc_feature (251)..(251): n is a, c, g, or t
  misc_feature (288)..(288): n is a, c, g, or t
  misc_feature (291)..(291): n is a, c, g, or t
  misc_feature (335)..(335): n is a, c, g, or t
ctggtccccctggtgcccatttgggctgggtggagccaggaacaggagggacacttccccagaatccgcatgtgtccccagtgattacactccactgccaccgtggtgccgggctttaactcccaccccggaaaggactcctctcggcagagacgcgacgggcggctccagaagggacaaccctncnaaaaaacccagggggnccacacacacacacacacacacacacacacacacacacacacacactnttgatcccttgcttccctcccccagtgcgttctgtgntcnccaagttcaaagctgtgcacatgtggacactcaataaatgttcnttggttta

SEQ ID NO: 570152 - DNA, 95 bp, Homo sapiens
tgcgagggatcgagtctatgtgtatgacagtagtggttctcaatacttccaacactggggccagggcaccgtggtaatcgtctcctccgcctcca

SEQ ID NO: 570153 - DNA, 274 bp, Homo sapiens
  misc_feature (230)..(230): n is a, c, g, or t
agttatacagacgttagatgtatttctcttcctaagagaaaaattagttataaccttggaaactaattctgtaagggtcctccacagctctgattaacaaccgtcccagctggtctaatatgcaagtctgattgcatttcagacctagcaatggtttatatcagggatcgcagatttttctatttcttgggtggggcctgtttatgacagtaggctagtctaaagtgcanactcagtctaacatgcaactcacggggactcctctagcagtcga

SEQ ID NO: 570154 - DNA, 247 bp, Homo sapiens
cactgtaagcatcctaacagccttcactctcccactctctgggcacctggtccacccaccccggctcctccaaacatgtcaccatcccactgtgcccgtgctgcctgtccttctgctgtccccatcttctttttcattatatttttaattggagaccgagtctcgctcttgtcatgcagtgctggagtaccattggtgcgatctcagctcactataacttctgcctccctggtttaggggatgctgt

SEQ ID NO: 570155 - DNA, 357 bp, Homo sapiens
cccaaataccatgtcagatctttttggtaaaagagttaatgaactatgagaattgggattacatcatgtattttgcctcatgtatttttatcacacttataggccaagtgtgataaataagcttacagacactgaattaatttccactggctacttttgaaaccaggaaaataatgactggccatttcgttacatctgtcattagttgaaaacgcatattttgttattaatattaatgtctgacttgtatttgaatattatctattcaaattcacattatggcagaggtaatatgcaatctataatgacttcttaaaaagtgtaacgtaattagagatacatatatcgttacatatt

SEQ ID NO: 570156 - DNA, 383 bp, Homo sapiens
  misc_feature (3)..(3): n is a, c, g, or t
  misc_feature (21)..(21): n is a, c, g, or t
  misc_feature (28)..(28): n is a, c, g, or t
  misc_feature (200)..(200): n is a, c, g, or t
ttntccaaattccgtttcttngtcttcngagggctggataattggctgacacaaggaccaaaaacctgtatatcatctccggaagggataagggacggctacaacttcggggggggttgggcatccaggagggggcattctacaacgaaaggcataccgtggaaaacatggcgtgtttctttattttgaagataatgcangactcatagggaacaataaaggcgagatgaaagggtctgccattacaggaccaggagcaaaggagtgtgcacacttgtggccccggattgcatccaatggtggcaggattggatgattctccagtatatttggaaaaaataaaaaaaaactaaacccattaattaaaaaaaattccaggtaaa

SEQ ID NO: 570157 - DNA, 263 bp, Homo sapiens
ccaaaccaaaggggggggggttggagacgacccaaaccccttgtgttttcccccctaaaaaaacccccccgggggggggggggggttttttcccttcccccccggggggttttcggggaacccaatttttttggttccggggggggggggggtgccaaaatttaatttttaagaattttgggggggggccccccccgggggggggcccgggggtttttttttttccccccgggggccccttttctttacccccttttgggtta

SEQ ID NO: 570158 - DNA, 118 bp, Homo sapiens
  misc_feature (29)..(29): n is a, c, g, or t
tcgagccggtacccagcggacagcactgnaattagagatgtgtgcacatgctggttaattttttttacttttggtggagacagggtctctctatgtgcccaggctcatcttgaactct

SEQ ID NO: 570159 - DNA, 434 bp, Homo sapiens
ggaggacgtgcaagcagccctgtgaagaggtcaacacaggggggaactgaagccccttccgaacagctagcaccaacttgccagccatgtaaagtgattcaccttggaaacagatcctccagcctgtcgaggggcgtccaacccgaccagagatttccgcgcccaacgaacggtttcggagaggccacctttgggcaacccggcgggggggggagggggtgggggtgggggggttggtggtgggggtgggggggttaggggtagcggcgggggggggtcggcggcgcgcgtggacaagactactgaaccagaaacacacagccaagctgctgacccacagactttgtgagagatcataaacatttactgttgttctaagacactgttttagggtgctttgttgtacaacaatagcttactgaaaatacagagag

SEQ ID NO: 570160 - DNA, 234 bp, Homo sapiens
gcggaccccagttggccttttctgttggcacagcttgctggacaccagtgaaagcttccagcttgtttatttatgtttgcagcttgatttctcaggctgctctttgttagaaaaaaaaataataatttattggggctgcttttctgttagacagggaagccttgcccgaggactccttttacccatcacttatcgtgcaaatataatttctttactacgctcctgatatcaccc

SEQ ID NO: 570161 - DNA, 783 bp, Homo sapiens
  misc_feature (138)..(138): n is a, c, g, or t
ttcgtacaatctcaggaatgtatagacccccgccccacacttcatatcccgcgctaggccttgcgtgatgaggccccctgcttcagtcccttccccatgcttccttgcctgatgacaataaagcttgttgactcagcnaaaaaaaaaaaaaaaaaaaaaaaaaaaaaaaaaaaaaaaaaaaaaaaaaaaaaaaaaaaaaaaaaaaaaaaaagaagaaaaaaaaaaaaaataaaaataaaaaaaaaaaaaaaataaaaaaaaaagataaaatgtaagagtaggggtgacgcataataattatttgaggagagttataagaagattatatcaagagcgcgatatattaatatacagaaagtgtgtagagaaaataggtgatagtatgagaaatatgaatgaaaacacgaacactcattaaatcaatgtgtgggggtacgatgaaaataaaaaagcaccacaaaaaacaataaaaatacataagttaataatagaaaacaacctaaagagatgcaaatcagatgtgaagaatactaaataaataacagtgttagttattagaatattggagtcatcaaaacaaagccagcagaagaagaatatttaagagctccgcagagcgataagaagagaacaacaaataagataagagcaatcaatcgagagtatatgatattgaatattgtgataagaaaaacaatagcttaataagcgcttaacacagtgaaacagaaaaaaataaatggtaggtaagagatgaatgattaatttaaattatattttttc

SEQ ID NO: 570162 - DNA, 516 bp, Homo sapiens
  misc_feature (516)..(516): n is a, c, g, or t
cttctgtcctcacgttggctgacatgatgatctctatccctgaacgtctattgtagtgggcctgggcatctttggtagcctttgtttgaatcttaatctggaactgcagcctgggccttggtttgatccttggctttggcctttggcccacacaacctgagacccttggcaatgcgggcacaagcacacttcccaagcttggggtgggtaatgtaggcaaattgattgagcttgaggctgacaccctttggcatctgggcttaacctcctttggctttatgaggaccttgatagcctcagtacgtgcactcatggccttggcattgttggcctgcatcttctttaggcccttcttgttgcacttcttggcaaagcccatgttcctcaggaacttggggtccacccccttaagagattcatatctttgcaatcggggtctcttgatgccattctgtgccattttcgggactggttgtgtgtggtgtggttcttggacttggccttgccatatgacan

SEQ ID NO: 570163 - DNA, 122 bp, Homo sapiens
  misc_feature (42)..(42): n is a, c, g, or t
  misc_feature (44)..(44): n is a, c, g, or t
  misc_feature (52)..(52): n is a, c, g, or t
  misc_feature (122)..(122): n is a, c, g, or t
tagattgagctggtaccgtcaatgacatctgccacagtctcngnctctcagnctcagccccctgcttcagtcccttccccatgcttccttgcctgatgacaataaagcttgttgactcagcn

SEQ ID NO: 570164 - DNA, 872 bp, Homo sapiens
tacgctgagacatcgcatatggatgaccgtaatcctttaacgttagttttgaggccgagcacgattaggatataagcttgcttaaggttatttgatataatatagatgtaatttgagtaattcacatagagattttatgtagagcatattgccacatgggcgagcaaatgtactttcatataagatcaatagagcttggcagaaacgttaggcgacagtgttaagttcaatgaagccaatacttacatatgggaatctagagcctaagaaatcgctacttgaaggaagatatttgtcttactcgtgtattctcttaccaagacttgaagaagcaagatgggatatgctgccacttcaaatgacaactcagaagattgatgggaatatctaaggtgtgactggatcttggttgcttagacaaggaaaacgttcaagtacagtcctaaatactttctaaccagtcagaagttgggccaagtttaaaggtatagtactacaatcttctcatcctaaattcttttaagtactgatctgcaatgcatcaccagtctcatttgaaaatccctttaagctcgtcacgatctgacctatgtcaaatgtagttactcggtatccatggtagtacgagagttagattagtatcctaattggagcaatcattggacggcagtggatgtcgtctacgagtgatggtgtaaaggtgaaatgggggagacatcgtttggacctatggactattaagaaggcagatttatacgaagattgtattagggttgattagacagtgtcgtaggaagattatacacgggggacggagtcttggtgatgatgggaccaaacgtggcgaatatgccgaagtagttagctaagat

SEQ ID NO: 570165 - DNA, 695 bp, Homo sapiens
gggcccaaccaaaccattttaaaaaacgttttaaaaagggcaccccattttaaaaacccccggggccaaagccggggtaaaaaactttcctgggccccagttccgggggaaaaccccctttcccaggcaattcttttaaaaggccctgggggtgggggaaaaaattttttttttttaaaggggggccacccccgttttttggcccctcccaaaggccccaaccttatcgaatatgcccggccccgtttttaaatttccaagggtttttttccttttcttcccaaaaagggaagatggaccccggtgttttctcaggaaaaactatttcaaacccccgggatttttccgtttaccgcctccaaaaggcccaccgcttttttttttttggttccaataaaaaggaaaagcccccccccatggtatcgcgggaggggggggtgtgtccttccccccttttggggacaactccaccacaggccgggctaaagaacccctcggcagggtaaaggaaacccccccccccactccccccggagagcggggggagccctgttctcccgccaacacaaggtggaccaactttggccatatttcccgcgagcgcaatactttatcggagaggggctccctcggcggggcgcgaattatagtgccccttttacacaccggatattaaaccccccggggcgccacct

SEQ ID NO: 570166 - DNA, 966 bp, Homo sapiens
agcggagtggcggtagcggcgggtactgcagtatctgcgtgccgtctactagtcggtgtgactcgatgcgggtgctgtgactgtgtgttgagcgtggtcttcatcttctttgtggaacacatcttgcatagggcaacctgatcagtctgcagcatgaacgtgttggttctggtaccgttgctaccgatgttgttgcgttagcagataggcgccgtagtgaaaactccgtggcggcgctgccaagtccatcgttctgtgtagcgtatactcgctagctaattcatcctggcaaagaaatggatactcatccaagacaggatacagttatttgacagtgatgctggctacagacctgagtcccactatgcaaagatgtaagccctatacgatggcattacgtccagcaatcagagtaggtttccaagctaactgatcagttgctccacaacgtgcattgtcatattgcgctagaagttctattggatcatttgcatgaaggagctaaacgctcgttgcatgtacggatctggaagtggaatccttattgtatgtcttgcacgtgtggttggatgtactggataaagtcagtaaggaattgatcatgttgaagagctagtagattgactctgtaagataatgtctgtgaaggacgaatccaagcacttctgtcttgcagggagagtacagtttgtcgtgggggatggaagaatgggatagtgctgaagaaggcccttatgatgccgattcatggtgggaagcattgcagccctgttggtacccccagggatgcttaattagattcagttaaatgcccggagcgaaccattggatcttggcctggttggttcccttgcaagcggaaaaccaaatggttggaagcagtaatgacgaggctaccaggattgggcgggttccaaaattgaaggcctctaatgggggtggatatagtggcctttaacacattag

SEQ ID NO: 570167 - DNA, 1077 bp, Homo sapiens
ggcctggaggtgatctggggacgtggggaggttattcgatggcctgcagcgcatgcccaggatgatcatgcaagatcaagcaggttctcacctactctcgtgtgggactccgatggaagcagctgcgttgcactttgtcaagagataatcctacgcggcgctatgccatatagccaaaggccaacgactatatcggtgtctgcatgtgtactctctaccacgagaacacgctgtggtactcaatgtctttgaccggttagcacaacgagtaggaagtctgtgctaggtgttgcgacgacgggccccaagacaaaaggggagctgtaataacaaggctctgggtgagcctcagacaagagttgctcgaagtcctgtgatggagacatgactataggataggcgtctacgcagaggataatcgctagaagtgtaaccggtattcccactgttatgagtcctctgcgtgcgtgtggctggtatccgagggatgtacccagaggggccagctatagcatggcgcctgccggtaatcttgacacgcacgtgtcaatggtgccgggacttaaaacccatactactgagctcctatcctggcgatatcgaaatgatccttggggatccacggaaacacgatagtggtcgtagagaggcaggagcgaagggaggtgggcctgagcaatccagagatgactactgctcgcataacgcagacggggaatacaactggggacttatgggcattggcgtgtatactacaagcaagtccatgattgaggatgtaattaaaggcggctagtgacttcaacacgacagcaaggtgttcccccaggtcaagactggaagccgggggtgcaaaggagaccagcacaaggggacagtcccgtgtggccggaagggccctccgtgcccctggaaagctatgagagaggagagacgcccgggtggttggcaccgtacacagtccaaggggcttcggaaagacgcagagaactggcactaaaaaaacacacaggtggagggaattctggggagaaaagagctgaaaaaaatcctgtgggtcagcccccccacgtaaaa

SEQ ID NO: 570168 - DNA, 456 bp, Homo sapiens
tgggaaggtttttccaaagctggatcttctcaccaaagtcccacagcgagcgctggagctggacaagaacagacccataggaactgctcctgtcagcttccgaaccctggtagggtctgcttggaatggaacctgctctggacagctcgaatagagtcgctttgtgcagaggagaaccactaggttccaaaacagtgaacgtggaggatgaagatgctgcgtggaggtacatgcaattttattcaatatagacatttgctattttctgcttagaacccaccccctgaatacgtgctgtctatgcagttatggcccattatatggaaactctcatgccatgaagaatagagtaccgctagttaagtattaattgccaaatgaaagtgacacgttctatgaagtaaatccgccacccgccggggagaggggatatgcgggggcaagttattccccccc

SEQ ID NO: 570169 - DNA, 281 bp, Homo sapiens
gttcaagtgttcacaagagaaagatgtatggtgcaggaattctccaaagtagaaaggacacaaagggactccatccatctaggacaacagttagacatagatattctattaaaatgtgtttaaattttcaacaccttggggatctgggattgacagttgcccttgcttctaaggtaggaatctatgccactctatggttgataaatgcaatagttatgcacatagtcctttgtgaaaacacagtcgacgcggccgcgaatttagtagtagtagtagtagta

SEQ ID NO: 570170 - DNA, 595 bp, Homo sapiens
tgtgatcacggagggtgtgaagccaacactctctgagctggaaaagtttgaggaccagccagaggccattgacctggaggtggtgactgagagcacagggaaggagcgggagcacaacttccaacctgtgggacaacagtgtgatggtctcgtgagaggtgatgctcatcaacactgcgagggcgaacgatctctcagcgtgtgatggcgaacgaagatctaccatcatgcgccaagcatgaggacctcaaggacatgtttggagttcccagcccatggaacttatgagaaatacgttcacaagattgtgtgtggacacaccgttgaacgtgtggagtttgcgttggcgccgaattctcgagtggcggagcaacaatggcgcgtacatatgtggccggggttgtgatgtgaggaaatttccgtgtatccttggttctcttgaggctctaccactgcgatgagcttgaaaggtgcgtccccctgggacactgcgatgctctgcgtctagagacaagcatcacggtggtggatgtttggagggccacgcatgaatgtgggcgaagctggtgcaagcttggatacccccagacttgtg

SEQ ID NO: 570171 - DNA, 330 bp, Homo sapiens
ggggaaacgccgagagccacttcatgaacaaaagcacctacgattctgggcctacatcctctacctggctgatgtctaggatacaagcgaccagtcccattgtcccaatacaggataaccctggtagatccatacctttccaccatgacagagtagtgagaatcactctgagagcattgatagtatctatctatgaagcccattttctcatgctgacaatcctgcttccttcttcttccacaagtatagtttatgaactcactccctgttaaacttcctgcacacaattctccacctcacaatctgcttctcatgagaacaaaaacacaa

SEQ ID NO: 570172 - DNA, 162 bp, Homo sapiens
ccccccccccccccaaaaaaaaaaaattttgggggggcaacaaaaagggggggggggccccccccccccattttagaaaaggaaggaaaaaggggagggcccccccggttttggggttaaaagggggaaaaaagggggaattttttggccagggttttggga

SEQ ID NO: 570173 - DNA, 1263 bp, Homo sapiens
atgggcacctccaaagaaaaggccaagcccctcacgctcaagcaggctctccttggccacactgatactgtcacctgtgccagagcatccctggcctaccacataattgtcagcgggtcccgggaccgaacctgcatcatctgggacctgaacaaactgtcattcctaacccagctccgcggccaccgagctcccgtctccgctctttgcattaatgagctaacaggggacattgtgtcctgcgcaggcacgtacatccacgtgtggagcatcaatgggaatcccatcgtgagtgtgaacacattcacgggccggagccagcagattgtctgctgctgcatgtccgagatgaacgagtgggacacgcagaatgtcatcgtgacaggacactcagatggagtggtccggttctggagaatggaattcctgcaggttcctgaaacaccagctcctgagcctgtggaagacctggagatgcaggagggctgcccagaagcacagatagggcagcaagcccaagatgacgacagcagtgattctgaaacagaagagcccagtgtcagccaggaccccaaggacacgtccagccagcccagcagcaccagccacaggccgcgggcagcctcctgcagggccaccgccacatggtgtaccgacagcggctccgacgactccaggcgctggtccgaccagctcagtctagatgagaaagatggcttcatatttgtgaactactctgagggccagaccagagcacatctgcagggccccctcgcccacccgcaccccaaccccatcgaagcgcgcagttacagcagattgaaacccgggtaccgttgggagcggcagctggtattcagaagcaaactgactatgcacacagcctttgatcgaaaggacaacacgcacccagccgaggtcaccgcgttgggtgtatccaaggatcacagcaggatcctcgtgggtgacagtcgaggccgagtgttcagctggtctgtgagtgaccagcctggtcgttctgccgctgaccactgggtgaaggatgaaggcggcgacagctgctcgggatgctccgtacgcttctccctcacagagaggaggcaccattgcaggaactgtgggcagctcttctgtcagaagtgcagtcggtttcagtcagaaatcaagcgcctgaaaatctcgtccccagtgggtgtctgtcagaactgttactatagcttgcagcatgagaggggggcagaagatggacctcggaactgctga

SEQ ID NO: 570174 - DNA, 881 bp, Homo sapiens
gaacaatgaagaaatccaaaacctgaacagaccaataacaagtaacaagatcaaagccgtaataaaaagtctcccagcaaaagaaagcccaggatccagtggcttgactgctgaattctattaatatcaagcttttaaagaagaactaatgcaatttcgactcaaactattccaaaaaattgaggaggagggaatacttccaaaccttattctatgagactagtattactatgatgccaaaaccaggcaaagacacagcaaaaaagaaaaccataggccaatttccctgatgaacattgatgcaaaaaatcctcaataaaatcttagcaaaccaaatttaacaaaatgtttaaaagatccttcatcatgaccaagtaggatttatcccagggatacaaggatggttcaagacacacacatcaatcaacgtgatacattttatcaacagaatgtacaaaaaccgtgtgatcattttaattgatgctgaaaaagcatctgataaaattcaacatccctttatgatacaaactgtttaaaaactgggtatagaaggaacataccttaacacaataaaagctatatacaacagattcacagctaatttcattatgaatggggggaaaactgaaaagccttttcctctaatatctagaaggtgacaagggatgcccactttcaccactgttattcaacatagtactggaagttctagctagggcaaccagatagcaaaaggaagtctagggcatccaaatggaaaggaggaagtccaattatccctcttggcagatgatggatcttaaaatctgcgacaaatgttaacactttcacaaaaaaatattaaaactgttgcacacacatggataattcggcggatacaa

SEQ ID NO: 570175 - DNA, 1340 bp, Homo sapiens
  misc_feature (361)..(361): n is a, c, g, or t
  misc_feature (363)..(363): n is a, c, g, or t
  misc_feature (366)..(366): n is a, c, g, or t
  misc_feature (413)..(413): n is a, c, g, or t
  misc_feature (597)..(597): n is a, c, g, or t
  misc_feature (612)..(612): n is a, c, g, or t
  misc_feature (729)..(729): n is a, c, g, or t
  misc_feature (862)..(862): n is a, c, g, or t
  misc_feature (864)..(864): n is a, c, g, or t
  misc_feature (1289)..(1289): n is a, c, g, or t
  misc_feature (1313)..(1313): n is a, c, g, or t
gctggcagtgacgacttgcgacctgcgtccttgtgctgcaagcgcacttaaccctgtccgggactggatcgagacctcctggcgatgcagcatcttgtggccgaccgtgcgtgggtttgtgcacgaccatacatcgaggagcgaacttgtctgcatgagaccgctggttactaagtgcaaacaagacttcttgtcgactgctgctttcctcacatccagctctgctgcaatagctacgaaatcttagaaatgctttgtggtgtatttggaactagatatacagatgcgaagcattataactctacatgcgaactgaatcttgagggtccactaccgatttatatacctatgtagtagtggntnctntccatttgcgcatacacaagcataatcgtagcgcctgagagggcttntatggtaaatagtaacagcgaagtaacagtattgtacattctatagactctttccaagtaccataacacgtcgaaaactataaatttcttgtgtaaagttgaatactcatcactttgtcctttggtcggagatcattgaaataaagcaaattacacaggttcggtatacgaaatacaggagccntttgttgtttgcccnatcccggccggattggtcaacggtcgccagagattatttaataaaagttgccgtttgaaagggcgtggtgtcccacacaagatatacataattacaccaatgcttactcaaccatanatccgcggggatcggatacgcctcggggtaatcggattgggacgggaatcaacgttccacgccactttaagtgtctcctaggcatccgaacacttccttcggacggaggaaatgtctttttaccttcgggacntnaatcaacaaaagctggcaacaccatacggcctcttctaacggaggcacgtatacccattgttattgcacacgtaatatatacagaaacgtaataacggtacctgtattgggcggcaccttttgcggatttttttatataatggcaatggtcgcccggtttttggcaaggaagtggtcggggtttgccactattccctatcctttggtaattggtctcctatttgccagtcggtattacatccggtgtgcactcagacattatccaccccccgccccagttaagttgcatatgggcgagggccttccctccaaggttgtttccctttgattcatatcacatatcggcaccattatcgcgaatccggcgttgtattcctatattcacttggggtcttggtgcaggacagcgcgcctctcagggtgtnatgtggcctttcttacagtcctcntcacaggtatccgtgacttccgcatta

SEQ ID NO: 570176 - DNA, 294 bp, Homo sapiens
  misc_feature (217)..(218): n is a, c, g, or t
  misc_feature (244)..(244): n is a, c, g, or t
  misc_feature (257)..(258): n is a, c, g, or t
tttatttgttacagccctgggggctgagaagtccaaggttgaggggctgcacctggtgagggccttcttgctgctggggactctgcagagtcctgagggtggcgcaggtgtcacatggccagggggcggagcatattcacaggccagctcaggtcttccttcctcttctaatgaagtcaccagtcccactccggtgataacccctttaatccatgannatccatcgacaggttaatttcccaanccacgtttagagnngccccaccctcttcaagtactgccacaaattggaga

SEQ ID NO: 570177 - DNA, 196 bp, Homo sapiens
  misc_feature (166)..(166): n is a, c, g, or t
  misc_feature (192)..(192): n is a, c, g, or t
ccctccctcctctgtgtgcacacacatcccatgctgtgtccatgcgtggcctccctctctccgtgtgcacacacatcccatcctgtgtccctgcgtgcccctccctcctctgtgtgcacacacatcccatgctgtgtccatgcgtgggcttcctctcttcgtgtgnaaaaaaatcccatcctgtgttcctgngggg

SEQ ID NO: 570178 - DNA, 423 bp, Homo sapiens
gctgtccccggcgcatgattgtgctgaggcggcaccgtgagccaggatcacacgggtgcccggtaggccgactgccagtgagctgcattcgagagctgagcacaccaaggagaacggccttcccttacctgagccccagcgtgtctggcagtatgaagcttagtccctcagtacccgcgggccctgtcccctggggccttgtctcttgttggagtagaagagctgtgagaatgggcctggagaggagcgcgcctacggctgctgcgtggagctcatcagcagcctgcccatcagcatcccgctcagcaccgtgcagcccaacaagctcccggtcagcattcccctggccagcgtggtgctgcccagccgcgccgagagggcgaggagcacccccagtcccgggcgcagcctcgtgccggggat

SEQ ID NO: 570179 - DNA, 116 bp, Homo sapiens
accgataataccacctaatataggatagctagctcctcctacgctgaaagccatgatatgccatggactcacacgagtttacctggaacatcatcatacatacctagggactagct

SEQ ID NO: 570180 - DNA, 468 bp, Homo sapiens
ttttttccatgttaattgaatttatatattctggaaaaatatttattttcaaatactcatatgcaaagaaaggactcagtttgagatatcttcacctcaccatattcgaaatcttgtttgaaagcggggggttcagggtgtcctccacacattcataaccggggaatgacacagagtttgtaacgtggtggaacacagccaaacccattatgatatagggttaagttcaatatcctttgggtcagcaagaggcttcaaattaaaatgctgcaaaatggcacacaacaaaagaaacacactccatgcaagccaggccttctccagcacacactggttttcttgtggacaatgcgcttgaaatagtcactgtacttgaactttccattttcacacagaaagtgttctggcttaaacttttgtggatcaggaaattcttgggtgtcacacaacacagagtccagagttgcc

SEQ ID NO: 570181 - DNA, 362 bp, Homo sapiens
atgacactttcgcctaaccagggagtggggaagatttcagaacaagaatatttgaaaaatatttttcacttcacaaagtatcaaacttcagggaaacaacaactacgcaaacattttttaaagagtcaaacatggggtttgaaccccaagccaagtacgagagaggagtgagcctgggctgcaggaggggctggaggctgaccctgcagagctgctagaactttccatctggggcgaggcttcttcattttagcttcaggaaagactggcaactgtagatagcttcatgaatattgagtatacttctgagttttttcctccccccgaaaattcaagagaggcgtctgctctgagcgggttct

SEQ ID NO: 570182 - DNA, 230 bp, Homo sapiens
gtcactttcagagggttggggggcacaacatctgctttcctcttgagcaagtgctgtgcctcgatggcggagatctgtcacacagtaatgaagacgagagcgcagtgggctgccgccctttccatgcagtatcgggggtagatctgcctctcccctgcttccttgtccacgatgaagctctccaggatgttgtagaacttcacggcacccgcacacaggtagcgccccag

SEQ ID NO: 570183 - DNA, 186 bp, Homo sapiens
  misc_feature (99)..(99): n is a, c, g, or t
agcggcgatctagcaggatctcctctctcacactggattacactattgacttgttagtggggtagtacttggactggcaggacaatctcccatgacgtngaatgttctagagagatggagcacgagaaggggccattatttgggaaataacacgtgtaacagtgcactgcgatggatcattggccc

SEQ ID NO: 570184 - DNA, 208 bp, Homo sapiens
gggggtttttttttccccccaattttgggggggattttatgcccccccaaaaggggttggggttcccaaacccaccccttttttgcccggaatttttttttccccaaaaagggtttttccccccggggggtttacggggccggccccaattttgggggggcccttttggccgggaaaacccagggtcccttaaggttttttcccttta

SEQ ID NO: 570185 - DNA, 244 bp, Homo sapiens
acatcctaccccacgcacaagcagtgtagccaagacaagcagtcgtatcacacgggatcatgaagccatatcgtcctcatccatctcacaaatacagtcgcacaattgcattaaggagcatcatcctcatcctagagattcctcaaaattggtttgaatcaaaggtcctgattgtattacatccccacttcagaagcaagagctctgccggtatgaatgaatcatctagtgaagtctacagtct

SEQ ID NO: 570186 - DNA, 681 bp, Homo sapiens
  misc_feature (36)..(36): n is a, c, g, or t
  misc_feature (75)..(75): n is a, c, g, or t
  misc_feature (94)..(94): n is a, c, g, or t
  misc_feature (108)..(108): n is a, c, g, or t
  misc_feature (112)..(112): n is a, c, g, or t
  misc_feature (137)..(137): n is a, c, g, or t
  misc_feature (238)..(238): n is a, c, g, or t
  misc_feature (327)..(327): n is a, c, g, or t
  misc_feature (549)..(549): n is a, c, g, or t
  misc_feature (571)..(571): n is a, c, g, or t
  misc_feature (579)..(579): n is a, c, g, or t
  misc_feature (594)..(594): n is a, c, g, or t
  misc_feature (661)..(661): n is a, c, g, or t
ataagacgaagctaaaatccctcttcggatccacantcaaccgccctgaacacatcctgcaaaaagcccagaganaggagcgccatggatcacnacagcacatatgcngctntctctctggtcacattgtcggtgtntctgcatgttctccattccgctcctgatgtgcaggattgcccagaatgcacgccacaggaaaacccattcttctcccagccgggtgccccaaaacttcagngcatgggctgctgcttctctagagcatatcccactccactaaggtccaagaagacgatgttggtccaaaagaacgtcacctcagagtcnacttgctgtgtagctaaatcatataacagggtcacagtaatggggggtttcaaagtggagaaccacacggcgtgccactgcagtacttgttattatcacaaatcttaaatgttttaccaagtgctgtcttgatgactgctgattttctggaatggaaaattaagttgtttagtgtttatggctttgtgagataaaactctccttttccttaccataccactntaacacgcttcaaggatatacngcagcttnactgccttccctccntttcctacagtacaatcagcagtctagttcttttcatttggaatgaatacagcatttcgcttgtccncaattgcaaagttaaaagcc

SEQ ID NO: 570187 - DNA, 775 bp, Homo sapiens
  misc_feature (332)..(332): n is a, c, g, or t
  misc_feature (421)..(421): n is a, c, g, or t
  misc_feature (643)..(643): n is a, c, g, or t
  misc_feature (665)..(665): n is a, c, g, or t
  misc_feature (673)..(673): n is a, c, g, or t
  misc_feature (688)..(688): n is a, c, g, or t
  misc_feature (755)..(755): n is a, c, g, or t
gaattactcgtgaggaaactccattaaagaccgaaggctaaaaaatccccttctttcgggtatccaacagttcaaaccctggcccctgtgaaccacatttccgttgcaaaatagaggcccccatgaggaaagagggacgccgccagtggagaattcaaccttacaaggaaaacatttattgcgaggctaatctgtccggggctcactgtgagtgcggatgcttctcgtgcattgtgactcacattcgcgtgtccgtgatgtgcaggattgcccagaatgcacgccacaggaaaacccattcttctcccagccgggtgccccaaaacttcagngcatgggctgctgcttctctagagcatatcccactccactaaggtccaagaagacgatgttggtccaaaagaacgtcacctcagagtcnacttgctgtgtagctaaatcatataacagggtcacagtaatggggggtttcaaagtggagaaccacacggcgtgccactgcagtacttgttattatcacaaatcttaaatgttttaccaagtgctgtcttgatgactgctgattttctggaatggaaaattaagttgtttagtgtttatggctttgtgagataaaactctccttttccttaccataccactntaacacgcttcaaggatatacngcagcttnactgccttccctccntttcctacagtacaatcagcagtctagttcttttcatttggaatgaatacagcatttcgcttgtccncaattgcaaagttaaaagcc

SEQ ID NO: 570188 - DNA, 911 bp, Homo sapiens
  misc_feature (202)..(202): n is a, c, g, or t
  misc_feature (264)..(264): n is a, c, g, or t
  misc_feature (542)..(542): n is a, c, g, or t
  misc_feature (735)..(735): n is a, c, g, or t
  misc_feature (795)..(795): n is a, c, g, or t
  misc_feature (871)..(871): n is a, c, g, or t
gctaactggaggctgggggtacaatggtgcatgagcttatagctgaagccaacacatgagactctgcacatcatattgttgcacctaccactaccatgcatacgggcgctcagcggttggacatgacctagactttagtccatttctttatcctatcataagtcataagcggctactcgcctgcatgaattggggactgttngacatatcgtaccatccagtgatcatggagaacacatgacctactgtctcctctctctcctntactcgagcatgcttaggacacacttgaagaagacctaatcctcgtgtaatctcgcttcactaccatgggaagtaacgctcaacgcctacctctggcgtacgatgatcgagcacgtgtcgcatgacttgtgtcgtagaagacaagtactcttcatcgaccctgcaagagcacgccaactactaccgccataaggccgatatgtggacatctaagccttatgagagtacagtacacaggctccttgttgacactcattcgctcacgcaggtgcgtatangtagaacgcacctacctgtcccctactagcgtacatgaatggcactcggagtatgatatgacctgttgattgcgtctctacccttctaccacgaagagagcccccacacagatcatgtgttcgatcagacaccgcgttgtggtcagcacggatctgctatacgatatcatgctaatagcattctaccatgccncgaacgtaatacatgccgtcctaagactcaagactgggatgattatgtgcgactctattntctagtttcaatggccagagctaattccatcatggcaagggatggggttatctcgagctgacttgccatcccccangatagtgcatggggcataacggacagcgtgtcagaggccc

SEQ ID NO: 570189 - DNA, 153 bp, Homo sapiens
gaacgggtacattttggaacactgataaggacccagtaactaaagaaacctccaataaaatctgcaggggctccaccaacttagctgaagttggaaacagactcacagaggtagaaaagatcaaaacagtggtcttcaaccgcatcacccgtt

SEQ ID NO: 570190 - DNA, 227 bp, Homo sapiens
gaaatcattacggtctcaattcatagatcatagcagatgccagtcgcagttcacccaagacatacacaaacatacacacaccaaacactctgagtgagtggtaaaggccccgtatttaactcgtggcccaccggcaaacaaaaggtttccctcgtgtggcgggagacaaaagaaatccagcgagctctctcccgtggattaacaaccaagcgaggtagcagacccaa

SEQ ID NO: 570191 - DNA, 104 bp, Homo sapiens
agtatcctctttacatgcctataattaagtctgtgcttccattatgaaggtcaattcctagacatacttgggaagtatatatctcatactcatcattcacatat

SEQ ID NO: 570192 - DNA, 574 bp, Homo sapiens
tgcataagttttaacttgatgtgatcccattgtccacttttgatttggttgcctgtttgtcaggtattacacaagaaatctttgcccactccaatgtcctggagagattccccgatgttttcttttagctgtttcatagtttgaggtcttagatttaactttttaattaattttgatttttgtatatgctaagagatgggggtctagtttcattcttctgcatatggatatccagttttcccagcaccatttattaaagacattatcttttccccagtgtatgttcttcattcctttgtcaaaagtggtcaccatagatgtatgaatttgtttctgggttgtctatactgttcctatgtgtctgttgttatgccagtatcatgctgttttggttactgtagctctgttgaataattggaagtcaggtaatatgattcctccagtttgattccttttgctcaggatagctgactattctaagtcttttgtggttcccatatcaattttaggattgtgttttctatttctttgaagactgttcaagttttctggatgtccacagtttatcatttac

SEQ ID NO: 570193 - DNA, 244 bp, Homo sapiens
ccggggggggttttaaacccccccctggggggggggggggcgccccttttttttttttaaaaaaaatttttttttgggggggtgtgggcccccggggggggcaaaaatttttttttccttggggctattttttagggggtttttgaggggccccctccccccttgttggtttctttttttttccccttgggcccccttttttccccttttttttttttaaaaaagggttttggaccccccccca

SEQ ID NO: 570194 - DNA, 206 bp, Homo sapiens
ggttggctcacagtgctgcattagacgtggacctatctgatgattccttccctccagaagacctttggcattgtgtctagaattgctccaatgtcaaatgggaccggatttccctgcttaggcatgtctcccacatttggtgcctgggccctctcaaggctggttatttccaactttcactcggcaacacttacttacctgggccc

SEQ ID NO: 570195 - DNA, 514 bp, Homo sapiens
atgcccagccaggattagtattatgacagcaattattaggatttttattgtagaaggctcacagtgacagtaacaagttttaagccaactggctcctgcttctgcttgctgacataggacctccagccccttgcaaagtccctctgaaatatcactgatggtccccctagggcatttcacatgggctcagaaacatgtttgggctggctgagtgctgcagctgttctggagggctcagtgttttcctgctggtgggggttggggcactggaaatctctcctctcccttgtcacctctgttgggggttcccaagaaaggcggcttgtgttttcatgtgttacagattggcatgtctgttcttcgattttttttttctttttaagacggactctcactgtcacccaggctggagtgcagtggtgaaatcttggcttgctgcatagtctgcctcccgggttcgagtgattctcttgcctcagcctcctgagtatatgggattacaggcgcatgctac

SEQ ID NO: 570196 - DNA, 80 bp, Homo sapiens
tgacccaattcccaatttgtgttccagtcttgattggtcctgcctgattcaaataaagttggtttattttcgaatattaa

SEQ ID NO: 570197 - DNA, 406 bp, Homo sapiens
tacctctcttcatacacaagcattgttacatatgtgatactttgcaaaagttgagatgcgatcatatataagttgttatgtctaagaatattaactgaagaggccatctctccaggtcataacctctctcagtgctccatgctgttccgtcttggggatggttggttctttatcagtcagatccttgtcagtgttcatctgttagtgccaccttgtgtctgttacagtgagctaaggattgaacatgtagtctcatggtttttttttcctacatgtttatcagtctatccatctgcttatttttagaggtagggtctggttcacccgggctggagtgcactggcatcatcgtggctcactgcagcctctacctcccaggcttgagcaaatctcatgcctcagcctc

SEQ ID NO: 570198 - DNA, 132 bp, Homo sapiens
gactctcgaggattaccccgactagcccgacagcctcagttctacctctgaccccagcttctctctgtgttcccacaggcccatgcattctccctgcctcactcccctcagcccctgtcgggctagtcgggg

SEQ ID NO: 570199 - DNA, 151 bp, Homo sapiens
ccccaaaaaaaaaatttttacccggggggttgtgggcggggggccccccccccaggggggggggtttttttgggccggggggtttggggacccattaaccggggttgggccccccccccccccgcggggggaaacccccagggggtttcca

SEQ ID NO: 570200 - DNA, 111 bp, Homo sapiens
cttcggcacgaggaagtcttagggggaccttgatagagaaccttataaacttctctctctctaataaagacttgtcttacaccctgctcccattaaaggcactgttctaga

SEQ ID NO: 570201 - DNA, 537 bp, Homo sapiens
caggctgccaatggcgccgagacaatggccagtagaggcagcactgtgcccataccgagacgttgctcctggcccgagatgccgagcgatgctgaagtggacagaagctgatgcagagtctagagacgctgtaccactagcgagaatgatgctcatttcccgtgttctcatggagcaggcagtcggagatgatgcgatgacgatcggtctttatgtcccttggctgtgtaacgcagtacaagggccgtgtgctcccagcaatatgctgtaatctaatttcggtgaagagacccagcgtttcctcctgagcagtgcctctcacggcttgtctcatgcagtcgtgtggcttcttgcccaggtttcaaagctgaagtacattgtccttagcggctgtaacatgtctcttgacagtagtgcacttggaatactccaggtgggtgattcatacccccaccacccacccccaaccccccacccccccccccacccccccaccccaccccccacccccccccccccacccaccccctccccccc

SEQ ID NO: 570202 - DNA, 343 bp, Homo sapiens
  misc_feature (16)..(18): n is a, c, g, or t
  misc_feature (25)..(26): n is a, c, g, or t
  misc_feature (29)..(29): n is a, c, g, or t
  misc_feature (45)..(45): n is a, c, g, or t
  misc_feature (201)..(202): n is a, c, g, or t
agataatacaggaaannnttgtaannagntccacttctttacaanagaagtgctataaaaaatagcacacaatattaaaatgtacctccctcacacaatcaagttgttttcaacatgtcatttaacacctctgattttaaagacttgcaaaaagtctcagagcttgaaggtatgaagaatgataccatatcaacttatttnngtgtagtgctttctacttcatatatcactatcatatcattcatttgttcaatgaacagttattgaacatccgctttgttctagcactgttctaggtataaaacaaagatcctgcctggggagcaaacagctaacaatgcag

SEQ ID NO: 570203 - DNA, 314 bp, Homo sapiens
  misc_feature (260)..(260): n is a, c, g, or t
cggcatggggtctgtagcactgtattaatagtgattatttccttttttgagatggagtctcgctctgtcgtccaggttggagtgcagtggtgcaatctcggctcactgcaacctccgtctcctgggttcaagcgactctactgcctcagcctcctgaatagccaggactacaggggcgtgccaccacacctggctaacttttgtagtttttggttgttgtttttttttgagacgacgtctcactctgtcacccaggctgnggtgcagtggcttgatctcagctaactgcaacctctgccaccctggttcaagca

SEQ ID NO: 570204 - DNA, 414 bp, Homo sapiens
  misc_feature (382)..(382): n is a, c, g, or t
tccagctgcatgatcctcaaactagaacatcagctcctccccagatctccagctgcacaacccttaaactagaagatgagctcctacccgggtctccagctccatgaccctcaaactagaacaacatcagcttctccctgagtctccagctgaaagaccctcaaacaagaacaacatcaggtcctccctgagtcttcagccgcacaaccctcaaactagaacatcagatcttctcagtgtctctagctgcaggacactcataatagaaaaacgccagcgcctcccaggttctaaagctgcacggccctcaaacaaaaacaccagctcctctctgggtctcaagctgcacgaaactcaaattagaacaacaccagctcctctntgggtttccagctccatgaccctcaaaggaga

SEQ ID NO: 570205 - DNA, 80 bp, Homo sapiens
  misc_feature (51)..(51): n is a, c, g, or t
  misc_feature (77)..(77): n is a, c, g, or t
gtcatctatgaagttattactgtaagtagccttcaggagagtggtatcacnaaggtgtgtgttcttttgtgtccttnagc

SEQ ID NO: 570206 - DNA, 589 bp, Homo sapiens
ggaacagcttgccagtgatgggcagcccaacagcacttttcctcttctagatggaccccagcatttaagtgaccttctgatcttggaaaaacagcgtcttccttctttatctatagcaactcatgggtggtagccatcaagcacttcccaggatctgctccaacagaagtatgctaggttttgctacatgacgggttgtgagacttctgttcgatcactgtgaaccaacccccgtctccctagcccaccgcccctaccccaagctccgctctctgtgcattaatctaagtgggacattcaagaaaactctctcccaggagctcggatgaacatactcagacgtgtgacctccatactgggctaaggaagtatcagcgactagaaagtgggcagtcttaatgttgaatgctgctttctgcattagtatcggatttgatgcaacggctcagaaggaatggtgcgtggcttccctgtacccagtagaggcaactaaaccaatcaggagtgatacttgatgcgggtcaccatataccaaaagtggctagtcctcacttctagatctcagcaattctaacatcatatgtaccca

SEQ ID NO: 570207 - DNA, 317 bp, Homo sapiens
tagttcagagattatcacctgattcagtgaagccagctgtcttccattgagtgggtcatttctatgctgtcaccagcaacgttgccacgaatgaacatccttgtacagacacattcttgtacattcaagcccactattgtccccagtgaagagcttcactctatagcttcatggatgcagtttcgactagattttactttcctgtctgtaacgtttgactgtgagcgccaggtgaccatctataccagggttttggagaacacctagtctcctacttcgtgccaacaggtagcgagtaccaactacccaccaagttt

SEQ ID NO: 570208 - DNA, 97 bp, Homo sapiens
  misc_feature (89)..(89): n is a, c, g, or t
ccgattccccctctggagcccttcagacagctgcggaagaggaggaaacgaaaacatttaaagacctgggtgttacggatgtattgtgnttgggaaa

SEQ ID NO: 570209 - DNA, 499 bp, Homo sapiens
atggtgaaatatattttcgtgggtttttcgtaaaagtggtcaatttttattactctctctacaaggttttccctagtgtccaaagagctgttccctctttgggtttaacagttaaatctacaaggggattaagagggttctgggggcaaatttaaagttgaactaagattctatctgggacacccagctatcaccaggctcgggaggtttgtcgcctctacctttaaatcttccccctattttgctccctagacgggtgtgctcttctagctgtccttaggtagctcgcccggttccgggggcctaagcttgggctctccttgcggagttgtctctagtccattcattatgcagaaggtataggggtcagtccttgctatatacatgcttggtaataatgctcaatctttcccttgcggtactatttctattgcgcccggttccaattactatacgcctatactggataagggtaaaatggtttggctaaggttagctg

SEQ ID NO: 570210 - DNA, 187 bp, Homo sapiens
agttgaatttgagagctacattactaattaacatcaccaaaaaagcaacagcatttcatcattttatttagaaattctctttatgacaaaggataatccagcaattaagggctctctatacagattctaaactaaacgccttaaaggatctttgttctcctctattctacttcactgtggtccatat

SEQ ID NO: 570211 - DNA, 229 bp, Homo sapiens
cctctacaaagaaattccagataatggatctgtataagtagtaagggagcagaagagaagacggtgaatgtacttcaatattattgaacatttatagaaataggaatactatgagtcatctattctttcttacagtcttataccatttactatttactatatatctataattcaactgtaatttgctgtgcccattatagggtaaccgagacacgaataacgtaaatac

SEQ ID NO: 570212 - DNA, 1333 bp, Homo sapiens
ttggacgacacgaacgcagccagagctgctgaacgaagcccacggaagggaagtccagggcaggcaggaaacacgaacgcacgaacgctcttctcgtgccactcctgcttccccctgcgcctgctgcccaacgcactgcgcgacagaccttgcgacgccttcccttggcgcaacactcttccctgcgcacggaacgctacacaacgcaccatcgacccccgctgcgctacgcgccccacggctcctgcgcctcacctgcctcccctcctctcgactactcctccccgcctcactgccctccgcctgccctgcgcgcccaccccgccccctgccccctgcacgctcctctccccctgcgcgcgcgcgcactgcacgccacgcgccctgcacctctctcccggcgcctgcctgcacctacccgcacctctccacccccccctgcgcccctgccccacgcacacctgcctccctgccctacccgcaccccccacgccgccctctctccccccccacctcctccccccacccacctccttccgccctaccccttggcgcttgcttttgcacgatttcacctcttctcggctccctcccaaccgcccctctccctctcttggcgttggtacaattggggggccacggcccaccttgccaaccaacccctgcttgccctcgccccccttgccccccgcccgcaacaccgccgccccccaccgcccctaccgccgcgcacgcgccccgcacgcacgcgcgccccaccacccaccgcgcctccccccgcgcgcgcccccccccgcgccccctccccccacccccaacgccctacccccggccctgcccccacccacacccacaccgcagcccacccacacacacccggcctccccctggcccctgcgccgcaccgcggcacccgcgccgcaccccccgcccccaccccgccccctctgcccccccactcccccacgcggcccccccccttcctctgccccctccccaccccaacccccttatctgccttgggttgtccaggccaccttcccgttggacctcccccggtgcacccccaaccccaatcttgcggccagcgcgcttggcgaggccctttcttccgaccctccttcgcttggcggcccgcccccacctgccctcgcccctcctcccccgtcttcctctcacccccgccgacacgcctctcctcctctcccccctctgcacgccccacccccctccttggccacctcggttcccttggccccgcgcctgcggcgcaccgcttcccccccttggtgtcccccccccacgccccgcggcttccaacccttggcgcttc

SEQ ID NO: 570213 - DNA, 366 bp, Homo sapiens
  misc_feature (11)..(11): n is a, c, g, or t
  misc_feature (236)..(236): n is a, c, g, or t
ttagacattgnctttgagcctaaattacttggagctatagacaaaagcaatgtaatcccttgccccttcaatattcaatcctaagaaaaaatagaggctgggcggggtagctcacacctgtaatctcagtactttgggaggcagagcaggcggatcacctgagatcaggagctcgagaccagcctggccaacatggtgaaatcctgtctctactgaaaatacaaaaatcagcccgncgtggtggcgggtgcctataatcccagctactcaggagggtgaggcagaagaattgcttgaacctgggaggcagaggttgcagtgagctgagatcacaccattgcactccagcctgggtgaccaaggcaa

SEQ ID NO: 570214 - DNA, 270 bp, Homo sapiens
gttacaatttaatattccatcctgcccaacccttcctctcccatcctcaaaaaagggccattttatgatgcattgcacaccctctgggcgaaattcgatctttaaacttttgacgacacgtataacggacaaatctggctctggctgctcttacagagctgagcctgaccaccactttcttctactctctgtgctcttctagaactgaacgctcttgacacaaacacacttctactacaagcacactcctcttacatcagttccagaaac

SEQ ID NO: 570215 - DNA, 244 bp, Homo sapiens
  misc_feature (41)..(41): n is a, c, g, or t
  misc_feature (77)..(77): n is a, c, g, or t
ctgggtcgcctctagtggatcccgtgatcggtaacttggtngtctcagttcaatgtcccttatactgggacattggngccatttgctgaaaaaatttccttggatttctccaatatcagtttcaaagtcatttttatttactaagaataaagagttccccagcggtctagtggttaggattcagcaccaccatggcttggggttggttcaagtcctggtctggaaccaaccaagttaccgatca

SEQ ID NO: 570216 - DNA, 1031 bp, Homo sapiens
  misc_feature (777)..(777): n is a, c, g, or t
agcgccttccccgggccccgtgaaccggctgcgggtcgcccttggtggtgcagcggccgcagccccccacctgggccctcggtcctgccctcccggcgctgtccatgaactcagtgtcgcctggcctgcctgcgcagtacctggagcagcagccctggagtgactgctgctgcctgcctgtgccctgatggccctgcatggcctgctgggtgtcccatgatggcgccatgacgccctaatcgtgcgctgtggtgtccttcctgtgatgccatgcggccccgctcttggctctcccggggctggccctgagtgagccggacgaagtggacaagttcaatggccaaggttcctgacatgcctggaacaactgtcaatgtacggttggggtggttaaaatgccggaccagctttagcaatgatctccatgcatccacctctgtggccgccgctaccgtttcgagggcgagggtgacatacagcgtttccaagcgggactttgtgtcccgcctgtggctcacataccgccgggacttcccgccccttcctgggggctgcctgacctcggacttgtggctgggggtgcatgttacggcagcggccagatgatgctggcacatgtgccttctgctgcatttcctgcccagaggaaagccgtggagagctgctccgacgtccccgcctggtggtgtaccgttctcaggacttgccgtgtacaaggcggatttggcacccttgttgccaggccagacccagagcgattggaagtctggggcatcntggttcccgttcgactgggtggccgagactctcagccccgtgttttttgccttgggttactggcccctgcgttgcgactgtcctgtgggtcatggggtgggaagccgggcccttctggtacctcagtgcgtccccggagcgtcctgtgggcctgggccctactatgtcagcccctgtgttttcgccggcggcgtccccggggatccgtggcctctccgaattgtcttaaatgcccgtctcgtgcttttgctagg

SEQ ID NO: 570217 - DNA, 945 bp, Homo sapiens
gcaggccatcaaagaccacgcctttgttacctcgagatgtcccttgagctgggtggaggtgttgctgtgagacaatgaaattatggacgttcttttcgcacttggtgaaaacctttcaatgaaggcatatgatttctccatcgcagcattctcccctgtggggtcctagcccttctaagtgccaacctccatcaggcagatggaaggagctggtattaacagacactgtgcagtggcagcttacactctgctttgagagtttgctttcatttgcaggacataggtgcttatggttgtgagctgacagtcattcatcgaacattatctcattcatgactagaggaagttttttctggttaaaatagggctggaatcatctaacacctatagggctagaactctgtaatcaaacattaatgcattaatgttttggcagcaaaagccatccttattggtattaagagggatttaagaaaatgattgcaagcagcgttcattcgaatggttcagattttgctgtcagttacattttgataccaacttactaggtagcctttgttgtaaaagctttttagctgttatgttctagtaagggtgtgtggatcaggatcggggagtgagctgggtccacgcttcccaggagtgatgaggctatgatttacttgagctggaacatggttaaggattttatttttatcatcgtcactttattttcacatttgccttcatttctattgagtgatgtgatttcctatttatggaagtgacatagctgcctttagaataattttgtttcatagtaaatgccatgcacaagcctcagatggattcttggtgggaaaaactccatctatacagtatatttcttggataactggggaaatttgagtatgtctaatgatcagtatgtctaatgatcattatttaaagatagtttcctgagga

SEQ ID NO: 570218 - DNA, 106 bp, Homo sapiens
aaagtctccttcactggagattgtgcccacggcataagatcatggagatgtcagctaaaggaataaacctgttacctggaactggaggcaaatctccactcatcat

SEQ ID NO: 570219 - DNA, 102 bp, Homo sapiens
agaccgtttgcatgataggtcaggtacttgttcgtagaaggacataaaacacactgtaaggaaatactcggtaggcactgccgttaactgcccattggtttc

SEQ ID NO: 570220 - DNA, 184 bp, Homo sapiens
ccccggcatgccccgcaacgacggggacgttttccaaaagtttggattccacggccacattcctccctcgctaaaggcacaaccggactcggccgtgtcaagctcagactgtgactcacagcctggtccgtggtgccggggtacctgagcctcgaaattctgtaatacgtggatcatacgctgc

SEQ ID NO: 570221 - DNA, 176 bp, Homo sapiens
gggcggcgtgactagcgcacagagctgcgggagcagtgcacagggagtgttgagcctggcggcgggacggcgtggatcggttggagccggagtccgccgagggtgggctggagtgtggagtgggcccggcgatgccgcgatgaagccgagcggcgagtgaccaggctggcgctggc

SEQ ID NO: 570222 - DNA, 285 bp, Homo sapiens
ggtgcgtgcagtaatcccagctactggggaggctgaggcaggaaaattgcttcaacccgggaggcagaggttgcagtgagccgagatcgcgccactgcactccagtgtgggcgacggagtaagactgtcttaaataataaaatgaaatgaaatgaaataaaataaaataagccaggggtggtggctcacgtctgtaatctcttcaggaggccaaggtggaaggatcacttgagcccaggaattcgagaccagcctaagcaacatagtgagagtccgtctctacca

SEQ ID NO: 570223 - DNA, 141 bp, Homo sapiens
tgtgtactcgcgatgttggtgggagactgtgtacttcattcaaaggttctagagagtcttgatattgctgtcttctaccattgtgctttccgtgagctgtttcattgttcatcactccactcagtttctcatccttggaag

SEQ ID NO: 570224 - DNA, 115 bp, Homo sapiens
gttcacactattacacccgccttggcttcccaaagtgctaggattacaggcgtagagccatggtagcccggccttatcttgacatactatacctaaggatatgacttttaaaaat

SEQ ID NO: 570225 - DNA, 288 bp, Homo sapiens
tagccggcccaatttttacatgaggtactgatttaatgaatcttaaaaactgaacttataccagttgtggtacacacacacacacacatacacaccacacacacacatggaatattccaaacagacttcactacctaaaaaaccccaaatatctaactgaactcctcacacacgatagaaccactctctcaccctatacaaaaactcatgtcaatatatagttacatgaaacacactcgcgggggatccctcgagcatgtcgctcatgcgggcatgtgagcgtatgcg

SEQ ID NO: 570226 - DNA, 346 bp, Homo sapiens
tccagagtacgtctctctggtcttgcagtcagggctgcctctcttgtccacagagctctgcccattccgtgtgaggcctgtgagcgcatcgtgaataaggcgcagcactgtgcctggggtgtcatcaatgttaacgcagagggcattgtctttctccggattctggatgatgaagtgggtatccccgtccacatagtagtagggcttgtgaggagtttggaacctggtcagttagaacgtggcgggtctccacggtgtgacttatgcatcttccccaggcttgtcggcaatggccctcttatccttggtgtcctgagctgtggtcaccctcattgaggtcagttcc

SEQ ID NO: 570227 - DNA, 392 bp, Homo sapiens
gagaaggaggatcaggacagaccagagcttgtacagagacctgtcagtcagtaggcgtccttgaggcccaggatgtggaagctgtgtgaatgccctgtggcggtaaggccatttggtttggtaccttctgtccttccattttgccccacctcctgggattgggggtggccacacaattcccactttgcaggtgaataacagatcaaaagcctcacctagctaggcaggtggcagggtggcacatgcctgtagttccagctacttgggaggctgaggtgggaggattgcttgagccttggggtttggggctgcagtgagccgtgatcgcgtcactgcactctagcctgggtgacagaatgagactttgtctcaaacagacaaacacacacaca

SEQ ID NO: 570228 - DNA, 440 bp, Homo sapiens
  misc_feature (32)..(32): n is a, c, g, or t
  misc_feature (34)..(34): n is a, c, g, or t
  misc_feature (297)..(297): n is a, c, g, or t
  misc_feature (335)..(335): n is a, c, g, or t
  misc_feature (351)..(351): n is a, c, g, or t
  misc_feature (388)..(388): n is a, c, g, or t
  misc_feature (411)..(411): n is a, c, g, or t
  misc_feature (432)..(432): n is a, c, g, or t
tttcatagccacctcctattgctattgcagtnanttcaggtgctgcaagtatccacttaaaatgccacgcattttaatcggcactgatcacctctgtttcagcagtttgtctctgtagtaaattgcctaccacagtaaaaggtaatctcttgtggttctcatgtatttttcatcgtgtttaatgcaatactgtaaactttgaataataccataagactcgtataaagtgatgccactagcactagtggatactgggaagtggctcccaagaagaagagaaaagtctggacatttacnagaaaaagttggaattggctgggtatggtaccataganttaatggtcggcagcnggctatttccggccattttcaagaaaaatggaatggnggtccggccatttcagggttaanggaattccgtggtaagggacnattggtta

SEQ ID NO: 570229 - DNA, 356 bp, Homo sapiens
gggccctttttggggggcccccccccggcccccccccggagagtttcccacccgggtgggcccctttttttttccccccccccccggggggtgggggccccggggttacttttttttttttttaaaaaaagggtttttcccctttgcccccgctggtttttttttcccccccccccaccattccccctcccccccccccccccagggtttggtttccggggttggcccccccggccccccccccctaattttttaccccttttttgggccccgggtggggttcccctttggtttaaccctttacgggggttttaaaaaattaaaagggggcccctttttttgccccggggtgggga

SEQ ID NO: 570230 - DNA, 1298 bp, Homo sapiens
cttatacttctctctcccttcttctctctctgacacacacacacacacacacacacacacacacacacatgtaacacattcctcccttacatgctcatgtgtgccttaaaatgtgccttatagtgtaaatccaggatgactgaggaatccctcgtcacgtggagagtattgtgtatatattccttattattattcagactcgcagcttggggtgtgggtgaaaatatttttcatcgtgaagggctcaaaagagtggttctccataaaaatgctgagccatctatcagtagtgttgcactatcagggacgaaacagaatataggggattagctgctccaattagggaaatactcccatgttgcgcagaggatgctgcaacatcagctactcaaaaaacacaacccacgccagggtattaaagagggtatattataatactccatctatagcggacacattatactactagtggaccaacagagcacaccctagtgctactatttgtcgaacatgcattgctaagttgtgtcaccatagtccgttgttgttgcggtaccaaatacgtgcgtaccaggctatctataagaaaccacccagagcagacaacagacatgcatggttgtgtagtatcttgtcagtcttctgtaggtatccaactctttcgtgggggccaccacaaactaattaaatgactacgattctacgcagcgagggatacttgttctcctgtgaatttaatccaacgcctctttcttggcggtccactccattacacggacaagcgtgcaaacgcggcggcattacaattgtaacattcattctcatccctgatgggccaagccaaattcctcaaacgattaacgcggtggttgtgtccacaccctgatcggtcgcttgggctctgtccacataacgactgtctttaagactcacgttctctagtcacacaatgatttccgcttctgtatgcacacgaggtgtacaggtcacgttaaggtaaatttgacgcgagggaaactaaagaagcccagaagggggatgcatagctaataccattcccgtttatttttcaaccccccaataacgacggtaggttgacatttgcaacacgttacagagcaagcgaactcatccgtttgccgatcgctcttcacaactttgacatctggcggacggccaaacttgaactctgtggcgccagtaccataaaatgtctgttgccctgggggaggcaacacatttaaggtgccatttgaccagccccccaggtatagctatctccccctgataccgccatg

SEQ ID NO: 570231 - DNA, 340 bp, Homo sapiens
tggctgttaccctgcacatctgaaactggatgaagccccatccgcgccctcgggtggaggctcgcacacaaccctttctcttgcgtgggaccttatccgctctgcgctactcgagacttgcagaactcccctgttgagcgggccaggggttccctgccaagtgcaactaccaaggatagccagttggcaaaggccttggaaaaaatccttcggcgcggtgcaccccgtatctgaatgacgggcgcttgaccttggacgtccttgaagcggatcgctgttcaaccgacgggtgaaaacgaggtgttggacaacgcgatccaggtcgtcagcgaaattctca

SEQ ID NO: 570232 - DNA, 192 bp, Homo sapiens
gggcaggagaggttgttgtgctagtttctctaagccatccagtgccatactcgtcgctgcagctacaaacggttttgacggcggcattgactgagcagatgacccttcgtggcaccctcaagggccacagacggctgggtaacccggatcgctactatccccgcagtttcccggacatgattctcttacggc

SEQ ID NO: 570233 - DNA, 1017 bp, Homo sapiens
gtccttagaattcccttcctccctcaacaagctgctgtctatgttgatgaccataactgggatgtataatatttacagacaactctaagttacgttcacatggattatgtacatcattgatttttttttttttttttggagaacagagtctggctcgtgtggcccgggctggaggtgcaggggcgcgaatcttcggattcacgtgcaaccttccaccttcccagggttcagtgccatttctcttgtggtcttcagccttcccaagttagcgtgggactacaggcacctgtgccagttacgcctgtggttaattttattatggtattttatagatagagaagtggggtttcacccagtgtttagccgaggagtggctctgtgatctccgtggaccctcggtgactcgtgccgtgcctcgggcctcccaaaggtgcgtgggaattcacgaggcattgaagccaacaagtgccgtgggaatcaatcgatgtgatttagtggtcatgtggtatatccctttctaccggggaagaccttcttcccaatttatccagtttcccgggagagattcagcggtgaagatagtgaactgggtcaaagatcttaaccaggggttgtagatcaagtccctccttatcttatcctgggccactgaataaatcttgggttttcccataatccacagggtgagggagaattactagggctacattattcaagttcctgtacagctaatgcttgtgtcccttttgaaaaaaagcccagggatcttgacaggtctaacagctggtggaacagggttataaataaggcgcccgtaacaaactgaacaatgtgagacacggggcatattccctggacgcaatggcaacaaggcagaaacatcgtccagggaaacacaaggaaagcctagaaacacagtccccaggaaaaggctacacaggacacacaacaacaaggaaagggagatagagaacacgcatagagagcgagggatacaaaaaggagcggacacgcaaa

SEQ ID NO: 570234 - DNA, 600 bp, Homo sapiens
atgacaggtcaccgaagcacctgaaggcttcactccttgctgggtactcagccatggagatgcaagcactagccaggaggtgagttctctttagggcttggttttcattccttttttgttggcttggcaaaccagaattcagcttatctgaattattttcccaaaggaatgctgtcagggagggactgttctgccagcctaacaaaagcaaacgtagccacgtaatagtacccactttctgctctttggagagaacacaggttatcaagttcatctctcttgactactcttatgatagctgatgccacagagcctatgggcaaatgccagacccagggttagacacaaggacctgaagtgacatgacggcgggacaggggaaatgtgactttctaattaggcattttatgttagtcacagtcttgaatgtataaacagcactaagactctcaggtcaggtaccttggtgatcagctactagttcttccagccctcattgaggtaacaagataaagacaaatccacttctttggccaaatcagggtttgagttatgactttccccagagactggatgcgtcagcctgagacactggcaatt

SEQ ID NO: 570235 - DNA, 209 bp, Homo sapiens
  misc_feature (67)..(67): n is a, c, g, or t
gatcaaggatcctgtactgtggtgtacgtgtgtgtgatgtgtgtccccgactctgccatcgggagcnaccttccagctctgtcaggagtggcttcagaacctcatgtgcatgacatcagagagtctttgtccttctgtgtctgactggcttcacttgaagtgatgtcctccagcgagttcctgtttgaggctcaagagctcactgaacc

SEQ ID NO: 570236 - DNA, 783 bp, Homo sapiens
tctccccgcgcacagcatgatgcttcaccagctcgctcccaccttactccaccaactaccggtccctgggctctgtccagagcgcccagctacggcgcccggccggtcagcctcgcgcaggccagccgctctatgtcaagagctgctggggcgtctctgcgttccccggcatctccgctgctcgccgctccaccgagcttacagagggacggcgatgtgggtcctggggcgcccttggcccatccggagattagcccgcgggtgctctggccttgcgcaagtgggacgcgcatccagaacctgcagaacgggagaacacaatagcacacatgctctagaaaaacgacctcggccctaggctctccttatccctagagatcatgcatgtgacgtgacgtcctaggaagaccagagacaccgtgtagggctgtgagagacaacacactccgggaagcatttggcccaagaatgggaccccaggtcagagactggacgccattacttcaagatcatccgagggaccctgagggcctcaaaatcttcggcgaatactggtggcaccatgcccgcatcgttctgcggacttgacaactgcccgtcttgcatgctgatcactaagacgtcagagtatgataacaggagctgtgcatgccccaggtcttgtgcgcgaaccgagtccatggggctccccaagagggccctttggttaccccattattccaccgactgcagctttggacagagatcgggcccccagggggagcgggccctgaaaggacccaa

SEQ ID NO: 570237 - DNA, 955 bp, Homo sapiens
  misc_feature (643)..(643): n is a, c, g, or t
ggtggacctattatatactacacaagtgaactattcccacagattgggctggatctatatattggcgaaaaggtggtcagccgaggattaccaacaaaatccgtcatgagtcgggagatttctgatcaagattgatgacgcctttagaaggatccgaaatgattctgcgctctttaccattacaggaaccactagggaactcagattcagattgcaacattgtatttgcttgctagaacaagtgcttgacacgcaggtggtgcctgtatgttgaaggtattctaatgcaaagatatattcattcttttatttatagtgtgaagcagtattgctggaaaagtttattgggtggaggacctagatgagatgatcctgtataggagtccttgcaatcttggttgcatttttatcgggctcctcggttttaagcaggccctaccaatttccgtctggtgttcatgtgggtgtcctgtcatacgggggtgctgttgagagctccttatggctgttctcccagctttgtacatgtatatagttctctctctcacatcaggtttcgggcgggggagggagggtcgctgccttaactactccttgggacatttctggaacctttcgctgagcgggtgtgagtttatgcttntaacggcctgaggagcgaggtgatggagaatttctctcctcgtttttattgtgccacccctgtggttgggtcaccgttacttagtgggtggcccaggtctggaatggtcactggtcccatgtcccggtgttgaaccacctgtgtgccggatgtatttcttcctgcagaaaacgttccgagttgtacaaatgggaggccgtcgggggcgcattgtgccggcgcattcagggggggcgtccccggccatacagttatattcgccctgcgatggctcttgggggcagaaagggcctttgttcgggaatggggcgc

SEQ ID NO: 570238 - DNA, 135 bp, Homo sapiens
agaattaactttgcaaaggaggaggcaaaagcttaagacccccgaaaccagacggaggttacctaagaaccaagctaaaagagcaacaccccgtctattgtaggcaaaatagttgggaggatttattaggtagga

SEQ ID NO: 570239 - DNA, 408 bp, Homo sapiens
  misc_feature (148)..(148): n is a, c, g, or t
  misc_feature (169)..(170): n is a, c, g, or t
  misc_feature (179)..(179): n is a, c, g, or t
  misc_feature (190)..(190): n is a, c, g, or t
  misc_feature (195)..(195): n is a, c, g, or t
  misc_feature (203)..(203): n is a, c, g, or t
  misc_feature (326)..(326): n is a, c, g, or t
aggccaccagaggcagaggggaagagcaagggcggaagaatagaagtcaagcagcagcagatggaatgtgtgcacggtcaggtgaggcctgacccgagggtgttgtgagcccttggtcagggtgagcccagtgccaagcagagccatncatgaccttagggccaatgtnnggcaccctnactcttccttnataangtctctcntcctgtattcttcctccccctttctcccaccctctttcctactccctatccacttcattcaacagatttttaacttagcttctactatgtgctaggcactgtgttaggagccacagatagtcnctatccttaaggaatgtacacattctcataacagagacagatactaaatctcaaataataaactaaattaaattacttgaaa

SEQ ID NO: 570240 - DNA, 745 bp, Homo sapiens
agcgtgagtgtgctgagctctccgcgtcgactctgtcgcccgcgcctggcctaccgcggcactcccggctgaacgctctgcttggactcgaccatgccggtggacctcagtcgaagctggtccgggcccttgtagcctgcaagaagtggacgagcagccgcagcacccactgcgatgatcaccctacgccgtgggcgtgcggtggacgagctgggcaaatgtgctgacgcccgacccaggtctaagaatagacccgacgcagcatttcgtgggatggtcttgatccacggggaagctctacactcttggtcctgacagaccctgggatgctccctacccaggaaggatccgcaaatagcagagaattgagcagtcattttccgctggtgagtcaacattgaaggggcaagtgacatcaagcagtggcgctacgtcctctccgacttatgtgggctctgcggcctcccaacagggcacaggcctccacacgctagtgtctggctggtttacgacgcaggagcaggccgactgaagtgtagacagagcccatcctcagtcaaccgaatctggagaaccaccgatggcaaagttcaaggttggcgatccttccggttcaagcgtactgaggctcatgggccaccgcgctggctggcatcggtgttaccatgggccgacgtggcgatgactaatgttgcccaaagctgttacgacgccaccgtgtctgaggaaggtagcgcgggtcaag

SEQ ID NO: 570241 - DNA, 201 bp, Homo sapiens
  misc_feature (12)..(12): n is a, c, g, or t
atctcagctcantgctaacctccggctcagatacaagtgattctcctgtcaagcctcccaagtagctggattagaggcatgtgccacacattgggctaattttttggtatttagtagagacagggtttcaccacgttattagtaaggctggtcacaaactcctgacctcaggtgattcacccagctgggcctcccaaagtg

SEQ ID NO: 570242 - DNA, 215 bp, Homo sapiens
atcaagtgtgtggtggtgggagacggagctgtaggtaaaacttgcctactgatcagttacacacccactgcatttcctggagaatatatccctactgtctttgacacttattctgccactgttatggtagatggaaaccggtgaatctgggcttatggatacagctggccaggagattatgacagattacgcacctatcctatccgaaacagatg

SEQ ID NO: 570243 - DNA, 254 bp, Homo sapiens
gctaccatatttatttttcgaagtgagttttttcgacattgcgttaatagcgcatacatgcttttttgtgtttataagagatgatatactaggttacgtcttagtgaacttggtaatcttgttgtcatggtttaaatgttaattttcaattttaaatgttttggggaatcaatgaccggcagaggtgaattaaaaacacttccatgatcacgaggtaggcagtttcactttaatttacacttatagttagtatc

SEQ ID NO: 570244 - DNA, 220 bp, Homo sapiens
tagaggatcctgggaggaggagaatcgctggtcttgtgaggtggaggctgcggtgagccgagatggactactgcactccagttagagtgacagagtgagaccacaagctcaaaaaaaaaacaaaaacatgggatggtctttttatgaattgggactggtgacgactcctttatacggggtgcaagttcatttggcatttggccagtgtcctggcctgtcc

SEQ ID NO: 570245 - DNA, 522 bp, Homo sapiens
ggccacaaaaaaacaattttattagcccaagaagggaaaacccagccccttgggttgccccagccccaccccaaagcccctcaaaagggtggggggggggaagggggaagctggggagggaatggcccctatccctcaaaaaactggggggaagaccacgggctgggcaaatggggccccaaaggggtttgggggggggggtattagacccggataaccggggaaaagggaggggaccgggggggatctgttgaaggcccaggaaaaacagggggagctggggctaaggaaccaaagggggggggaaaaggggggctagaacccaaaagggggggcctttttgaggcagggggggccctggggtccccttaataaccctccttttgccctggaggtttttcctttggggcttcggccccaggaccccgataaacaggctgtttgcaaaaggggcagggtttccgggtttgaaggagcccgggggtcccgcaagggtttggggaggcaatgacacctggggaa

SEQ ID NO: 570246 - DNA, 280 bp, Homo sapiens
actgccaaaacatgagcctaggtgtgcataccgatatggtatggctgcgtccccacccaaatcggagggggaatgtagttcccataatccccatgtgtcgtgagagggacccggtaggaggtaatcgaatcatgggggcaggtttttcccatactgttctcgtgatagtgaatacatctcactaaatctgatggttttataaagggcagtttccctgcacgtgctctcttgcctgctgccatggaagacatacctttttgctccttctttgccttccacc

SEQ ID NO: 570247 - DNA, 886 bp, Homo sapiens
  misc_feature (100)..(100): n is a, c, g, or t
  misc_feature (106)..(106): n is a, c, g, or t
  misc_feature (189)..(189): n is a, c, g, or t
  misc_feature (214)..(214): n is a, c, g, or t
  misc_feature (323)..(323): n is a, c, g, or t
  misc_feature (410)..(410): n is a, c, g, or t
  misc_feature (419)..(420): n is a, c, g, or t
  misc_feature (440)..(440): n is a, c, g, or t
  misc_feature (452)..(452): n is a, c, g, or t
  misc_feature (461)..(461): n is a, c, g, or t
  misc_feature (495)..(495): n is a, c, g, or t
  misc_feature (502)..(502): n is a, c, g, or t
  misc_feature (504)..(504): n is a, c, g, or t
  misc_feature (506)..(506): n is a, c, g, or t
  misc_feature (541)..(541): n is a, c, g, or t
  misc_feature (563)..(563): n is a, c, g, or t
  misc_feature (595)..(595): n is a, c, g, or t
  misc_feature (611)..(611): n is a, c, g, or t
  misc_feature (615)..(615): n is a, c, g, or t
  misc_feature (620)..(623): n is a, c, g, or t
  misc_feature (627)..(630): n is a, c, g, or t
  misc_feature (635)..(635): n is a, c, g, or t
  misc_feature (639)..(639): n is a, c, g, or t
  misc_feature (650)..(650): n is a, c, g, or t
  misc_feature (658)..(659): n is a, c, g, or t
  misc_feature (668)..(668): n is a, c, g, or t
  misc_feature (678)..(678): n is a, c, g, or t
  misc_feature (715)..(715): n is a, c, g, or t
  misc_feature (743)..(743): n is a, c, g, or t
  misc_feature (833)..(833): n is a, c, g, or t
actttccctgtggcctagcttgcctatttccagtgggcgagctagctagatcctcctcccttaaataagccagtgtttttaagacagaatactacttgcntagtgnacaataatatcttaaagaactgagcaggatgaaaagaatttgatagaaagcaggtttgaggagcacatggaggttggcaggtntcgaggctgcttgagaggacttggnccgatctgggctgggcttggacgtgaccctggcacccaggcaggtggatcccagctggggcttccattcacgactttctggtccctggcaggacagagcgggatgccancagcttgtccaaagggaagttccaggagctcctggtgggcatcgttgtggagaatgacgctggccgcggcgagatcaacgagttgangcaggtggnnggggaggcttcgtgcagcanccgcaaaggaangctgatttncttctatgagtggaacatcaaactgggctggaanggcatcntnanagaatctggagtgaagcacaagggattgattcaantacccaatctttctgaggaaantgaagtagatgacactgagaatttacaacggnaatgattttaccagcnaaanctatnnnncccnnnnaattnactntcaaatgaaanctgagtgnnaataccctncaggttcagncctcatctccagtggcactgggtgtaaggattcccantgtggctcttcacatgatggaactgttngacacaactgtagagcagctgtatagcatcttcactgtaaaggagttaacaaataagaagatcatcatgaaatggagatgtgggaactgnccagaagaacactatgccatggttgcactgaattttgtgcctactctagggca

SEQ ID NO: 570248 - DNA, 336 bp, Homo sapiens
ccacacgctcatcccatcatcgtccctcagcgcttgttacagacgcgcatgcccgaggcgtctctcgacccccagttctctcatgtgtcggtggagccaccgcccatgagcccgtctgggcctggcgcgagtccccactagctctttggtggccctgattatggcgcccaatcgctgcagcctccatggtcagcccagcctggttctgttctatgtcctgttaccccatccccactcccctgcgtggcttgattcccactccatggtggccccatcccccagttcctcacgacatggttttcacttccgtggatttaataaaaacttcaccagtta

SEQ ID NO: 570249 - DNA, 161 bp, Homo sapiens
tgtggggaatggaggataagtagtctgggaagtagtcggagatacgcgaggggggtgagactacctattgtagatatgggaccctatgacattggtggtccgtgatcaagaattgggtgtggacgttggccctgttggctttttataaaccaaactctatc

SEQ ID NO: 570250 - DNA, 811 bp, Homo sapiens
gagttaccggcatctgggctcagttccgccatgatctcctatggaaatcagtctggtatgtcctcgctatgtctcatgcgggtagctcggacaggtgctgcagtctcacgacaggaaagcttagaatatacggttgcttgttacctagcctacaacgagcgctgagagcctgccggtcatcgtgtggatgttggtgaaaaggttttccgagagtggaatcaactatgaaatcatagtcatagatgatggaagagcctagatggaagaatgggatgtccgctgaagcacgtaggacgaagatctatggggtcagaacacgaacttcttgctatagtaccccccgaggagacaccagttggagacttacggaacctgacttactattcatcggacatgaaaggcatgccacgaggaatgctatcactcaatttattatggattggtgatgtactctgtaatgatgattcacaaaatgtttatttccttgatactttagttaggaaagcgaaatggagggataacatgtttgactgttggtcactggaatagttcgggtatctaaaggaaactgtgcaggtgtattagtggcctgggaattgtgaaccagatggagatagtcaggcgatggagtgccagattaaggaacgtacagatccttgcttgagaacaggagcatctgattttaacaggaagtttcagattataccgaaaagaagttctagagaaattaatagaaacaatgtgtactaaagggctacgtcttgcagatggagatgattgttcgggcacaggacagttgaattatctatgg

SEQ ID NO: 570251 - DNA, 138 bp, Homo sapiens
ctacagagtgcagcagaagttcgcagtgagacatcactagagtggtggggctcatgaacaagtttgtggaggatacaaagaagggagtgcaccagaaggagggctggcccagcagcgcatacgtgggtgacgacagat

SEQ ID NO: 570252 - DNA, 391 bp, Homo sapiens
  misc_feature (153)..(153): n is a, c, g, or t
cctctcttttcccctccggggaaatgactttttgttatattcttcgcttcccccccccacacatgcacttttggcctttttttttgcggggaaaacataattcccccctccccaccctgtttttataaggataccgaattgacccccggaatnttgccctctccaaaacattcaccccgggggtatttttttgtggttgggtgtggacaccccccatttcctctttatattgggggttggtgccacattttggtctttttgggcccccccccccggggggttgttccggggaaaaaaccttttcggccttttttgtttctgaacatttgccttgaaccaaaagggaatttttccccgggggacccaaataaaagttaaatttttcccccca

SEQ ID NO: 570253 - DNA, 184 bp, Homo sapiens
tgctggaaattcggctaagactgtcgacaggttggagtgcaggggtgtgactagcaactcactgcaacctaccgcctcctgggatcaagtaatcctaccttagcctccccatagttgagactacaggtgtgcaccatcacacccagctaaatttttgtatatttttggtaaagacgaggtttca

SEQ ID NO: 570254 - DNA, 164 bp, Homo sapiens
cttactgtgaaaagggtgtcagcgggcgctgttatatggagagggtaggggggggaggggagcctacgatcagtccccctgttgggatgtctcgggagagtaggagaggtggccctgttccgggtgtccctcatgggtcggtggtatggcggagcggggtgtag

SEQ ID NO: 570255 - DNA, 267 bp, Homo sapiens
cgaaactccccattatattagaaaataaattaaaggttaccataagtcagttccagaaagagacaacatattgccgacctcacggatttttaccacctactacgctctccctgtggccttcgcacactggcatgctggtctaggatcctctacgcagctacgccttgctcgccttcctccgttttggttgcctatagccaagccgcctgtctacctttcttcaccatatttgcactcgcttcctttcctactgattcggggctcggt

SEQ ID NO: 570256 - DNA, 144 bp, Homo sapiens
atcagagtgggaagtctaggtcaggtgatgaggctagtatgagttaaatccttgaatgtatgagttgatgaggtcggggtagtcacataagagcattagtctatatatgggcaggcaaaatagctcacacctgtaatcccagca

SEQ ID NO: 570257 - DNA, 104 bp, Homo sapiens
agacgccgagatgctggtcatggcgccccgaaccgtcctcctgctgctctcggggccctggctgaccgagacctgggcggggtcccactccatgaggtatttct

SEQ ID NO: 570258 - DNA, 256 bp, Homo sapiens
ttagagatcccccccttgagtatcaggccattaggacccgaggagggacagtatagccttgagtatcaggccattagaacccgaggggggacattagagccttgagtatcaggccattaggatccgatggaggtacaatagagccttgagtatcaggccattagaaaccgatggaggtacaatagagccttgactatcaggccattaggacccgatggagggacaatagagccttgagtatcaggccattagaaac

SEQ ID NO: 570259 - DNA, 742 bp, Homo sapiens
  misc_feature (319)..(319): n is a, c, g, or t
  misc_feature (436)..(436): n is a, c, g, or t
  misc_feature (441)..(441): n is a, c, g, or t
  misc_feature (495)..(495): n is a, c, g, or t
  misc_feature (497)..(497): n is a, c, g, or t
  misc_feature (510)..(510): n is a, c, g, or t
agcggatgggctgtcgcgcatgcgccttgagggaagatggcacctgccggctgctgctgctgctgctgcttctggggcggcgctgtggccgccgcggggccgcccggcgtgtcctgctgctgctgctgctgggggtcctgtccgccgggctgcggccaggcgccctggccaccgagcactactcgccgctctccctgctcaagcaggagctgcagcaccggcagcagcaggaggccccggcgggcggcggcggctgcagcccgcagtccggggactggggggaccagtactctgccgagtgcggcgagtcatccttttngaacttccatgactcagactgcgaacccaagggatcatcaccctgtgactccttgctttccctcaacactgagaagattctgagccaggccaagtctattgcagaacagaagagatncccgnttgccactgataatgacagcacaaatgaagagttagctatgcttatgtcttgantngcagtggtctgtntgatgaagcaatacggcatttttcaacaatgcttcagattctgtcccctctgggacgaattactgaagcagtgaatgacctcactaaagctatccaaactgcagcctcagacggctggtacagacatcggggaaccctggaacttcatatcacacggactatgcaacagcccatgaacacttcacgcagtccttagaactgaccaaaaagcagcctatagctacgctatcca

SEQ ID NO: 570260 - DNA, 281 bp, Homo sapiens
agcacaaagatgatggtgaagggcaggtagaccacctcccacttggtgggaaagtctgttcctggctggaactggttcattcattccaagccagcaacagctccaggtttggacgccatttatgaatctacatgccaccagaccagtccctgtcttccacacaccccactctctggagtctggaaaaatggcgggggtggggctagctactagtttttgtttttttttttattttcgagacacagtttcattctgtcatccaggctggagtgcagtggcat

SEQ ID NO: 570261 - DNA, 451 bp, Homo sapiens
atggtctgcaactgactcaaagggacagttctggcttactagcaggtctgatcattcacccaggtacagtgtcctcatctacctgacaccaggcagctctcgggcgctgggacaggatataagacatcctgggcttctatagctgagagttctgagggtcagagttggcagttgtacttccagccaccatgccccacctctagcacccctagaggcgcatagtacccagaaacaaacccaggctttgtgaccctgtcctacgtgggcccacctgactccagacaacttacccattctcggcccagcaggtcggaaacgcctgtggacacaggcctagggactaactggataactgctcgggctgctgttggtcccagggggaaagagtctggactgaacctgtaccttgttaggaaaccgaggcatcaggaccccagctgggacccattcg

SEQ ID NO: 570262 - DNA, 123 bp, Homo sapiens
gacggagatcgtaatcccaaagaagtggggctcaccaagttcaatgctgatgaatctgaagacatggtggctgaaaaggggctcatcccagatgtctgtggggtcacgtacatccccatgtcg

SEQ ID NO: 570263 - DNA, 385 bp, Homo sapiens
agcgccactagctcatcctgcctcagtctcccgagtagctgggattacaggcacctgccaccacgcccagctgatttttggttggtatttttagtagagatagggtttcgctatgttggccatgttggtcttgaactcctgacctcaggcgatctgcccgccttggactcccaaagtgctcggattacaggcgtgagccaccgtgcctggctgaggtctttttttttttactcttagtgaggtgacaagcttggggaaggtttggagcagaagaggggcatagtcggatgaaatcgggcttacttggacctcggtatggagaatgaatgacggcttgggaggtagtgaaaaagggttataaagaatccgggatatatttggagga

SEQ ID NO: 570264 - DNA, 264 bp, Homo sapiens
gctcgacctccattgcattcctttcaattccattgtattccattccattgcacttgattccactccattcccttccactgcattccattcgattccattccattgcattgcattccattccattggattgcattccattcgattccattccattcgaatcaattacatagcaatccattacattcgagtctattctattccgttccattcgatttcgttccaatccattcgatcccattgcattcgattccattccatgtcgac

SEQ ID NO: 570265 - DNA, 816 bp, Homo sapiens
  misc_feature (40)..(40): n is a, c, g, or t
  misc_feature (357)..(357): n is a, c, g, or t
  misc_feature (371)..(372): n is a, c, g, or t
  misc_feature (441)..(441): n is a, c, g, or t
  misc_feature (453)..(453): n is a, c, g, or t
  misc_feature (484)..(484): n is a, c, g, or t
  misc_feature (576)..(576): n is a, c, g, or t
  misc_feature (579)..(579): n is a, c, g, or t
  misc_feature (585)..(586): n is a, c, g, or t
  misc_feature (589)..(589): n is a, c, g, or t
  misc_feature (591)..(591): n is a, c, g, or t
gggggaaaaagtgtcaactcttgttattgaaaacatgttnatttttctgtctttattttaaccttgatagaaccatgcaatatgggggcctttgggaacggactggtatgtaaaagaaaatccattatcgagcagcattttatttacccctcccctatccctaggcacttaaccaagacaaaaagccacaatgaacatccctttttcaatgaattttataatctgcagctctattccgagcccttagcacccattccgaccatagtataatcatatcaaagggtgagaatcatttagcatgtgttgaaaggttttttttcagtgttctttttagaaaaaaagaaaaacaaaaacaanaacaaaaaaaaaanntcacaccatggctcacagaatggcatctcattttggggacctcccatctttctggtttggaaaagtgtncagtagtgcagngttcctgatgtaactttatggttacaatgtngacatgtctcaggtcatgtgtgcgatggtgtgtccgtctcaggtagatggcaaagtgtagggcccaccacatgggaaaaaatactaataaanacnaagcannacngnaattatggattagtgatatgggcagtatctggctagtttccagtggcgttgaagttgtggagttctcgcagggtccttttgagggggagacactgtttgggtgtagaatacaggaggttaggggcaatgtttgtacgggttttctagggggtgggggaggggaaccacagtccggtgggtctggaaaaaaatttttataaaaaaaggcatgggaggcagggaaat

SEQ ID NO: 570266 - DNA, 204 bp, Homo sapiens
  misc_feature (30)..(30): n is a, c, g, or t
aaacaaacacacccaccaccaaagaaaaanaaaaacttattgtaacgccaggctgctctgggaacaaacgaggatccaccgcccttgagcttactgcttcctgctcattgggggaatgtgctgtgtatctcctttcttctgccatagccagacagacttgctggctcttagccaagctgatcctcagtgctgggaatcctcctc

SEQ ID NO: 570267 - DNA, 717 bp, Homo sapiens
cgtagactcgtgcggtcttaactaacgctatctatccagatgcgtgattctagtcacataggaactactactggaccatgacaatatggctattcatactagagatagaggtctatactcctacatctatacatcgaccgatgcatcaccatgactaatccctaacataagagctatcacctttatagtcttacatctaagctacatactatatttcctaccaccaactgcgataccatatactacgtagctacgcgtctaattacagataacacctaattagcccacactcaggaagccgatctcgacacgatatttacacgggctcaccgacccacacaataaacaagtaagtattcctgacctcaagtatagctacgcttagctacactacctcgctgactcccatacactacatacaagacaagacagcaccacgactatcccagataggacaaaacactaaacacctcctattaccttacctccaacccctattgattaactccctacgaggttagcactatttcccttcgacccttaaaatagcaccaagacccaacccaataacacataactcacatgcgggacatccattcaataacaagacactaagacatctaacaaaaacccacatatctatacacactaaactaacctatataacctacacagaatcaacgaatacgactacaccataccatatgtaacgcaaac

SEQ ID NO: 570268 - DNA, 653 bp, Homo sapiens
tctctccttattctactctacagtctttggacagtatccccaaacgaggtgggacacagctccagtccacaccagcataccaggtcttccttcccagggcagtttaaaggaagcctcctttcgtgggcagggttcagggcggctcctcctttccctctctcctttcccctttggtcccagcctcaacgtgactcgtggcgtggtgggagggtggtggagggctcccttaggctctccctccccaaccgtggcctccaccaacacccctaacgaggaggcccgtggagggctcagcctctccgtcgcgcattccctcctccttccgtgcctatcggagggagccagggttccccttaggctgtgacccgtgaattcctcttcctcccttcatggggaggggggcaggaactccagaggagtgatgaagccaggcgggaccactatgggtctggggggctgggacaaacaagctcagggaggaaatgaggaggcggcggctgcagaggaatgcacccctgtggggcacagaccatgcaatcggggggctgggcccgggtggccagcttgggtccgtgtcctccacctgctcaaccggtgcttccaccaaccagaggaacccatttactagttttctaataatcaataattgctcc

SEQ ID NO: 570269 - DNA, 371 bp, Homo sapiens
  misc_feature (371)..(371): n is a, c, g, or t
cgacttgagaggctgaggcaggagaattgcttgaaaccagaaggcagaggttgcagtgagccgagattgcgccactgcactctagcctgggcaataagagcaaaaactccatctcaaaaaaaacaaaaccaaaaccaaaaaaccacaaaactttacttcagtttagcacctttttaaaaatcacttgtattagtctgttctcacactgctataaagatactactcaagactggttagtgtataaacaaaagaggtttaattgacttcacagttccttatggctaggggaggccttcagggaaactttacaatcatgggcaggaaggccaaggagggaaggcaggctttctttctttcacaaggtgggcagn

SEQ ID NO: 570270 - DNA, 104 bp, Homo sapiens
ggatttgctggtgcagtacaactaggcttaatagggacatgtcaaattcacacaacaagttagtaaatataacacaagagaaagttcgacttacaatggcaaaa

SEQ ID NO: 570271 - DNA, 91 bp, Homo sapiens
tctgctaatccatcttcatgaaaagcaccggttatgaggagtgtagtaatcattgataggataatggcaagtgcagttgaaaaaaaaaaag

SEQ ID NO: 570272 - DNA, 244 bp, Homo sapiens
acgatccccccggaaaatgtaatactgtgatgtagtgaagagagggcgggatttcagtggtgccatgctacgttggaaatcacacagaaataacatggctcttgactggcccctatctcaccttgtccccaatatctacatatgaattatggaaataaagctttcagaaaaacactaaggatagtatcttcatggccttcgggtagaccaagatttctcaaatgtttttcaaagtcaagtcgcc

SEQ ID NO: 570273 - DNA, 321 bp, Homo sapiens
caacacttgtaactcgagttagtatcttccaactgtcacgtagcttgagaaacccggtaaccctagggttccttttaatttaacccctttttggtttaacccaaaggtatgtgcccaggttttaaaagacattttaattttttccttaaaaaaaaaatttttttaccagttttttttaccatttttatccaaaaaaaattgggggaaaaaaaccttttttttttcggaaaaaaaaaaattttttaattaaaaatttcttttttctcccccgggggggggggcccccataaaggggaattttttttttggggtttttttttt

SEQ ID NO: 570274 - DNA, 726 bp, Homo sapiens
ctcctttcggactcagcccacctgcacccaggtgaaataagcagccttgttgctcacacaaaacctgtttggtggtctcttcacagcaacgcgaatgaaatttggtgccatcactcggatcaggtgacctcccttgggagatcaatcccctgtcctcctgctctttgctccatgagaaagatccacctacgatctctgctcctcagaccaaccagcccaaggaacatctcaccaattttaaatcggatcttctcagcttagcggctgaagactgatgctgccagatgactttggaagccccctggaccatcacagatgcccagctttggataactcttacagtggaggaagacaggaatatcaggtctctgagcccaagctaagccatcatatcccctgtgacctgcatgtatgcatccagatggcctgaagtaactgaagaatcacaaaagaagtgaaaatggcgcgtgcctgccttaactgatgacattaccttgtgaaattccttctcctggctcatcctggctcaaaagctcccccactgagcaccttgtgacccccactcctgcctaacagagaacaatccccctttgactgtaatttcccactacctacccaaatcctataaaacggccccacccctatctccattcactgactcttttggactcagcccacctgcacccaggtgaaataaacagccttgttgctccaaaacacaaacaa

SEQ ID NO: 570275 - DNA, 384 bp, Homo sapiens
tcactctatagatcagtaatgacaaaaaaaaaaaacaaaacagattggtgaaagggaataaaaagcacaattcttggtatctggggaacgtttcacgggcaacactaactgtttgatacagaggttaccgggaacagtagttatgtttctcttcctatccccaaaagaagcacaataaaaaaaatagacgcaaaatgggaggagggtgtggtttaccagggttatttcaggtgcagcctgtgggagattgattacacggggccacaggtgagcaggtgccctgtggttgtatcccccaggggtcctggtatgtgggtgcaagggtttatatacaagaagggtttgtgacaaaagaagagttaaacttactaagggttttccaag

SEQ ID NO: 570276 - DNA, 105 bp, Homo sapiens
tgtggtgagaaaggaaatatctccataaaaactagacagaagaatctcagaaacttctttgtgatgtgtgtctcaactcacagagttgaacttttcttttgatag

SEQ ID NO: 570277 - DNA, 149 bp, Homo sapiens
  misc_feature (4)..(4): n is a, c, g, or t
aagnagtcaaacaaggaacagctcgcgagaactgcatctgctccagtgaactggggcctagaggtcaagggcccctatgcctgaatccctttcttacgtgagtggatctggcagggacccctaatcatacttcccaagagaagggggag

SEQ ID NO: 570278 - DNA, 248 bp, Homo sapiens
gacccaaccgcgcctcccaaagtgcgggatacaggtgtcagccaccagcccagctcttagttttcttccggtttctagttggttaaggatttctgtcatgacagaatgttagatttggcccatgttttttctgcatctttggagatgatgatgtggtttttatccttggttctactgatatggtttattacattaattgaatttgggatgttaaactaacctggctttcctgagataacatcacattt

SEQ ID NO: 570279 - DNA, 451 bp, Homo sapiens
ctacgagcttttgtataaatcacggaagggatgatttataagaaaaatgaatactattacacttcatttaccaccctctgatctagattttccaacgatatgtacgtagtggtataaggtgagggggtccacagatataacatcgtttaatttagtactaacagagacttttgtcacaactacatataagtgtacaaatatagtacagatatgacacacttgtagcgccaacgcgcatcctacggattgctgacagaaaaaaaggtcacgtgaccagaaaagtcacgtgtaattttgtaactcaccgcattctagcggtccctgtcgtgcacactgcactcaacaccataaaccttagcaacctccaaaggaaatcaccgtataacaaagccacagttttacaacttagtctcttatgaagttacttaccaacgagaaatagaggctcttt

SEQ ID NO: 570280 - DNA, 314 bp, Homo sapiens
tgccggtcagaatgtattaagtgggccaggcgcgagatgactctacgcggtgtaatcccagcactttgggaggccgagacgggcggatcacgaggtcaggagatcgagaccatcctggctaacacggtgaaaccccgtctctactaaaaatacaaaaattagccgggcatggtggcgcgcgcctgtagtcccagctacacgggaggctgaggcaggagaatggcatgaacccgggaggcggagcttgcaagtgagccgagattgtgccactgcagtccggcctgggctaaagagcgggaccccgtctcaaaaaa

SEQ ID NO: 570281 - DNA, 930 bp, Homo sapiens
  misc_feature (7)..(7): n is a, c, g, or t
caatctntccctcccttcgtagtactatacgtgtagtataactcacagccgagagagacaattctgctcgccggctctctgtctttatacttgtcctctcctttgccggactttgtgactcttcccccgttattgttcacgggtgaatatgtttccgcgaaccttgtgttgccaagcggcccatcctataatatggcgccttctcccgttaaattaaggtctatactgggacaaattaccgtttaaaaacacgggttataaagaaaacttgtcaacaaaatgtgttgaaaaacaaaaacagccgtttttcaaaaccatgggaaattttttttggaaaacgtttttcctggccaattaccgaaggccttatatcctgccaaggccttttcctgggcgcgcgcttttaaaatccgggcttcttttcccccccgcatagagctctggcgaattccccctgaaacatttgggtttctccctcatgttgcacagaaacagcgcttttaatccccaactaaaactagtttttgaagtccacacataaacaaaatgtgtttcttaaaatctaagatatgtgacatattctgtcttcgcagcacataaagattgctgtcgtatacaccccgcatcgcgtgtgttaaagaccaccgggtttaatagagtggcaaaaaaaacacgaggtgaaagcagatgttatttgttttgttctaccggcggggccaataagtgagttttgtgatgagatcttgtaacaatgtggagattaaggaaaatcttgcgagtcctactaaggaagattaacgaaaaagctgcgggttccatatcacacaagagcataccaaagaatcgccgtatgtacggcttcctgttttcccataaactaaaatcccacaaattttcaagggctttggcccaaaaacatttaacaaaaca

SEQ ID NO: 570282 - DNA, 475 bp, Homo sapiens
agttcaccatattctgcatattctgcatatctagtaataatatcactgctatgactgatgacatttctaatatttgattcaaaaacattctagcagagacctaagataattggataaattagtctctaagcttttggttttttattttgtcttttagctttaattttgaatgaggaattaaaggatttatatcaatgtatatttagtgcagtactattttggttaatgtaggaatcccgaaatgacttagatttccattgagttttaaggagcataaagaaatgagagaaatgggttattagatacaaaattgcatattctcagctatgtggacatattttttaaggtttccaattgtagagggttacaaaaaggacataacgatatttgggaatcaagaaggataaaaaagtgttggaagagatactgaaaagtggagttgaatgaaattagtagagaatttggaaataaagat

SEQ ID NO: 570283 - DNA, 273 bp, Homo sapiens
atgctggagcttctagcattgtctagcactagtctactaccttgactagggagcttctagatcgtctagtgatctctctcttagctggggcttccaagttggctgtgatctactttaccttgctggggcttctagatcgtctgtgatctctctcttagacatggggcttccaaagttggctagtgactctcatatccttgctaggggcttctagactcggctgcgactctctcgccattgttgggaccttctagactcgagctgcgactctct

SEQ ID NO: 570284 - DNA, 884 bp, Homo sapiens
taaaaaaagaacgcctcttttttcccgtttggtggggaaaaaaaaggggcaaagggggggggtgtgggggggatgacaacaaaaaaaccaatcccacattctctcgtacccggatcccgccggaaggtcctatcgttgggttacacaccttcaatggggggcgcggcagccaacaagacgaggacaaccgagtgggggggcgccgaccacccacgaggggggaagcggacccaacaaagaggcaagagtgaccacctcgcagaaaagaggccgctgaacatttacagacagagggggaagagggtgaaaccgcggctcccagagacaagcggccgggactcgtgtgggatcccccgtgtgaagtacaacacgagggggggtaccggagtgaggccaccggtgtgggggaagccccacaaaaagtctgctatctcttgtcagcccggagggggcccacgcatgggagtccacaaaaactgcggacattttgtagggaccgcggggcgccggcaaaaagcggccaaaacggcgggataacagatccacccgcattgtcgggcccccaagtgtggggctcagcatgaaaaattagaccagcgcgtgctccttcggaaaccccacggggggaggtgtgccccaaaatgggtgggcgcgaaaaacgtctcgaggggcgcaaacaacatctgtggcggcacaaaggagtgtttcacaaaaaacgcggcggggggggggcatccacacccgattaccaagtgaacccacgccgctaacacaaagaaggtctgccctgtgttgggggcgcacagcagcccaacaggagcgttcggaggcgacttgggaaaccccccgggaccgaggccgggactcccagtggcagaaaacag

SEQ ID NO: 570285 - DNA, 200 bp, Homo sapiens
agcagacgagagacctatggagcttaattattaatgcaacagtactacaaccacagttctaactacaactgcataaaattcggttgggcgactcgagcagaccacctcgagcagtacatgctagactcacagtcaagcgactactatactcattgatccatactgaccacgacagtacctgggtacagccatcttctggt

SEQ ID NO: 570286 - DNA, 185 bp, Homo sapiens
atcctccagaggcacaaggaggcctgggggcttacttggctggactgtctctccagcctgtcaagcgcttctggagctcctgcccgtggcctggagcttccgatcccctcctccagccgagacacggcatccgagctgggagtgccactggcctctggtgctgccctcctccttggtgccctggg

SEQ ID NO: 570287 - DNA, 179 bp, Homo sapiens
agaaaatgccatagttaacgttaccggatgtctggagtaaatactggtctgtgattggtgaaatggagaacacacgtgttggtgcttctgggatgcactggtttgcattagtatatgtgtccatgccagagtatgtgtgagcgggcgcatgtgcaccacagagtgcactcgagaggact

SEQ ID NO: 570288 - DNA, 308 bp, Homo sapiens
  misc_feature (293)..(293): n is a, c, g, or t
tgcagaagcagctgcagccgttccaccttgccagcgtggcgcggttttctgtctaccgaagccgtatcccccgggggcttgcacatgcggatctggctctggccctgcagcagggaggctgagggggcagccgtgagcttctcgcaggaggtagttctgggggccaggtcggggcccggtgaggccgtggagcactgggccgtgcgcagcggaagctggggccagcggaagggcgcatgccctggtaatgccgggtggccgttcagggaggtcgttcaaggattctgcagcgnatggtgccgatcgtc

SEQ ID NO: 570289 - DNA, 142 bp, Homo sapiens
ggcgtgccttccccccggcattcttcatttctcttgcatcaatatgccccctctattatctatctctcttatttccccccttgtgtcatgttctagtgtgctcccacggtgtgttgttctgtgttgtgtgtgtctgtccacg

SEQ ID NO: 570290 - DNA, 1097 bp, Homo sapiens
gcctgtgtgctgggtgaggaattcctgacagtgtcctgtgtgcggcttgagagccagctgcgtttgtctcttcgtccagagccattatcctctccaaagggccgtccaggcaacatggtgagtggccctagctcagatgatgcctggcactcctcatgttgctccttcgtggtctgagttgtgggggacatctctgggtgaggccagtggttttgtgccatggcctctagctgacccaccaaactacgaagctgcatgagccctcagtgagaagaaggtgaaccaggctgcacggcgacacggaggcccctcccagaactggtggaagggtatccgcgtggcaggaagtctcccggagccacgagttccgagtgcgcctgagaacgcctagggagcagtcggtggatgacgactccgcggaaacacggagacgccaagtgctacacccaaagcacataacgagatcaggcactctaggtccctgtcacctcttgggatccgcaatttacaccgcactatgcctttcactaacggaattgacctactcggactagttgaccacttatggtcgacttgtagtggcacgctcaggcctctatagtgcagtggtgaagaaggcctaccatgggccccacgggatatggttgtcccggcaatccccaggcgttttgcatcgcgagcgttacactcgatgccctggtgatgatagtccatgagtctcgttgatttcgcatcgaacgagtagaccttgttcagacgaatagagcgctcacagggtaggctagttcctcgcgaatggaaggggcgcaagagagaaagagggcacgcgacaggaacatcagtaattttccggagatgttattaggcgaaccggttattgacgacgtaccccaatcagcggagacccgcgtgcattaaccacacgacgtagtgagtcactaagacaggaagcgagtcatacccaatataaaaaccgaagggggggaataattcgttgaggttgtcagtacatttccccgggggagcaaagggggctacacagttgtaaacctcatcatcgagacaattggaacccgttccttggggtggttagaaga

SEQ ID NO: 570291 - DNA, 162 bp, Homo sapiens
catagataccatcatatcgagcttgcactgactagtccctataatcgtgcccgatatgggttcccgataacacatagctctgactctacctctctctctactctgctcgatctgctatagtggaggcggagcaggacaggtgacagctacctccttagaggg

SEQ ID NO: 570292 - DNA, 187 bp, Homo sapiens
cacatgcggatcttctcagactctgcctgtgcaaagaggatctgcttcacctttatcaccctcggcaatctgctgcatgcggtgggcctcacacggcaatctgtatcttgcgctgcacaacctctatctcaagtctcattcctgccgaatcttcgtgctgtttcacgggcccccgatacagcgatca

SEQ ID NO: 570293 - DNA, 951 bp, Homo sapiens
tggtccagaaaaccccttattttttccccccccctcaaaaaaccgggggggtgaatccgggaaaaaacccaattccaaaaacttgaaaaaaaaagaccccccatttatcggtgaaattactaacgaggtggtaaaaaactgcgaggatttgtgggtaaaataattacaatatcggaaaattttttcccaccgcgtggatcattacaacttcggaacaagtgtgtactccactctatacaaacaccgtgaaggttaacagagggcacccccgtgtgtgtgcacccagcaaagtcccattttaccttatctgtcaggaccccccggggggacaaacaaaagagagctatgaggagaaagtggagtaccccctgtgtggcggaaacagacactgtgcgcgagacaaccgctgagaggtaacacacgccgtgggcctagtgtgctacaaaacggcgccagaggggcgacacactacctagtaggaacgccaaaaagtgcctttggcgacaactagactcaccccagagagagagaaaaaatataacgaacctctatatctacactaatatttctcaacaccactcccagagagagagttccacaaagaaaccagacacaacaagagaggaggacaccacgagagagagtctcacccactgggggtttcccccgcggatatatcccacaagaaataccatcgagtgagggggtaccacccgagaggaaaaccccgcgggggttataagagaggggccaacaaccgctgagacggggtgtatagataaagaggcagacactatccataaacagggtgaggggataaaaattattgaagtggggggccataagcgggtcaatcaatcagacgcaggaacacaccagacgctctaacaacaggtgttgttataaatctaacacacccgcccccccccacatataacacccgctcccgaa

SEQ ID NO: 570294 - DNA, 1747 bp, Homo sapiens
  misc_feature (432)..(432): n is a, c, g, or t
  misc_feature (1168)..(1168): n is a, c, g, or t
  misc_feature (1323)..(1323): n is a, c, g, or t
  misc_feature (1330)..(1330): n is a, c, g, or t
cagagtacctgccttgcgtttcctgactgccgaacatgcatgctgcttcggtgctgctggttgatagcagggcccgtcggatcccggcgcacgctatccatcgtgcaggggactccggaacataggctccgtccagagaaatagcgtgtatagcgacgtgtacactactgtatgcatgtggctagcgaagagaaactataccatgaccttgcttataacagctacagtcatatcacagataggagcatagagagcatcatgacgtgtaggaattagtcacttgcgtgattccccatctgaaagtcagggcagtaattcgtagtgtcgcatgcattggacttacgcctcctcgatattgaatcatgtagtatatgcataacttgaggccagctgactcttataaagactcactagtgtgtggccactggcggntcaatttgacacgcgagccgataagcaatcgggtgccatgcgaaggggcaacagtggattgtcgacagacttaagaagagaagacacacaatgcgcgttagagagagtctcttaagcgtctcccagaagggccttttcacacacagggaggcttaatcgctgccactttggaaaaaaacctctaagaggacacaaccccttatgtcgacttataatacgtttcaacggcgctacgcttgtccgtttttcccgctgggctgttcttgccgggaaacgaggaatgggacactgaacacaacagtttaataattattaacacgccgccagaaacgcggcacggcaattatattgaacggttggacaaacacgacaaggggccgaagcgagaggagtcaagggagtgcttagatctgtggcattggaggaaggaacggggttattcccccgaagtacttcttggtgtgctggggttaagctgggcaaggggggcctttggggttgtacagcagacggacttaccgaggagttggcctctaaagaattcgtaggaagaaagtaggcacccttgcttgttgtgtgaagtgtatacaaatacctgccggcgctttgaaactctttttccggcccaatgtttgtccggtaacgcacgaacgggatggagcctttaccagccataagtgtatggctcggagcgcgattcattccaccaaatgacggtcaaccctgggcacacgcnttctattggggcgccccaaaaacggcgattacatgagagggatcccgatttggcaatactaaaagagccaactccgcttcgcggagacggttttatatctaccaagagtcatgatttccccaattccggggtatacaccctttatttatcggacntcatgtntgggctcattaggagagagaaaaaatacaccgagaaaaggtggggcgcataatgagcggattcgggttggggcgcaccaatattatgaatacgaggtggtccttagggtttaggggcatatgttaaagcggcttttaatggggggatagagggctcacccataaattgtggtaggggcggaacacgagttggagaggtgtctaggggccagcagttgtgaggaaaagcgtgtgagggaaatgctaccatattaggggggtgggtatgaaagaggtccagggaaatacgtacggcataaacattcttggtggggtgtataagaagcaaatagcgctggtgtctccaacaaatttttagggagccgttgttttagctgcgagatatatactcgaggcagtggtacgagtattttaaaac

SEQ ID NO: 570295 - DNA, 171 bp, Homo sapiens
gcggcgatggcatctctcggcgccctggctgcttcctgctgtccagcctctccgctgctcagccgaggcctgcctggagccccagatacccttcctactacacatttctacgctgtatttcactgagaccgtttacattgtggagatctcctgacatgcaagacaggtcca

SEQ ID NO: 570296 - DNA, 421 bp, Homo sapiens
  misc_feature (40)..(40): n is a, c, g, or t
agcatggcctcctaaatgggaattaaatggcaactcctantgggccattcccaggatgggtggttccctttagcctcccatagaattgggtgaaaccccctacccccgttttttgtttcccccctaccacacctgtgttatgggggtcagcctgtgagtccttgaacccttccaaaggggtcccaagggagggtgatccctgcccttccataaaagggttaggaaagccaagtgagaagattcaattaatttgggcaagttatttaacatttgaacctgttttttttttcattgtttattacttcccttgtcccaaaaggttataaaggggaggggtttttttgttccccctttgtactaaatttttcccccacaaaaatttgcccctgagggccccaataaaggtttggtcaagtgatga

SEQ ID NO: 570297 - DNA, 310 bp, Homo sapiens
aggaaggggtagtcttagtgttatgtcagggtgttacagaatgagatgtgaggcgtataataccatagccgcctagttgcaagagtactgcggcacgtcactattgacccagcgatgggggcttcgacatgggctgtagtggagtcataagtggagtccgccacaagaggtcatctttcactatagaagctattgtgtaagctaatcttattaagttgtaggctcaggagttttgatagttcttgggcagtgagagtgagtagtagaattgtttagttgcaggctagggtgtagtgagtgtaaattagtg

SEQ ID NO: 570298 - DNA, 210 bp, Homo sapiens
  misc_feature (50)..(50): n is a, c, g, or t
gagaaggtttcgtaggagttgaggatcagggtttcggtggcttgtcctgngctgactgtgaaaaggtacgacggaggatttggagtagctttaaacatggtcgacattcctgattggagccgccatctgatcgctactaaacgaattagggtggcagctgtacgcaggttagtagaccgggaaatgtcgaagccggcgcgcccgaagacg

SEQ ID NO: 570299 - DNA, 170 bp, Homo sapiens
gtgggaccccggtttttggggggcctttttggttttcccccgggggggggaaatttcccttttttggaccccccctggttttttttggggggggggggggggccccccccccccccccttggttttggggtttggggggttcccccccctttggggtttgggttttccca

SEQ ID NO: 570300 - DNA, 257 bp, Homo sapiens
ttcccccccttttaggggggaaaaaaattccccggggggggtttcccccatttttttaaccctttttttggggggggggggtgggggggcccccctttttgggggattgggaaaaaaggggggggaaaaaaggggggggaaaaaattaaaatttttttaccccgggcctttttttgggggtttaaacaaaaggaaatttgggcacaaaagggtaaggggtttttcccccccccccccaaaggtttaaaaaaaaaggg

SEQ ID NO: 570301 - DNA, 850 bp, Homo sapiens
  misc_feature (275)..(275): n is a, c, g, or t
tcgcaatctgagttatctttgtgcggttcaaggccacccacttttagctaacacagagggttccacaaccgttgttgagccgatcaagttcgtgtgtgtcagcaggacacttgggtgaatctaatggcgtggtaatgccccacccccttggggaatcacaaaagtctggaatggaagaggactgggggagtaccgggttcccacgaaaaaacacgaggtccacaccacgtccaccacgtgggagaatctctccaggagagagacttcctttcagncataccacgagtggagacaagctcttccatagctagcatctcccttaccgtccctaatatagtagattttaagacccaaattttcttttcttgaattttattaaacaataagcttaatcataattagtagttatactaccccctatggagaccttgacacatgtagcttcttctgaaaaaaaattatttgcccctctgagaaatgtgaccccccacgtcctactccttaataaaaaaaagaccaattcggatgtatgatctctctagctttgtcactagttatgtgagattttcccttgtagctaacttttgcacggataataattttatagaaaaagggaacacacttgcacatttagcttctttcccctaagtgaacttcttgaaagtaacttaacaaaacacccttaaactgccgagttaattgctttgttccccgtagttattaaaatccttgggctgtttttgtaaaagatttcctaggatagtcaagtttgcttttccaaaggaattatccccgttatatttagctgttaactggaaattaaggtttattaaaaccaccctgccatgga

SEQ ID NO: 570302 - DNA, 213 bp, Homo sapiens
cctgggtctagccagaggatggagccgcgggcgccgtggatagagcaggagggtccggagatatgggacggggagacacggacgccccaaaacgcatatgactcaccacgctgtctctgaccatgaagccaccctgaaggtgctgggccctgagcttctaccctgcggagatcacactgacctggcagcgggatggggaggactagacccagg

SEQ ID NO: 570303 - DNA, 296 bp, Homo sapiens
ccaacacgagcaccaagtcacgcaaccggccacagtctaggggaccatgtagcagtagctgctgtgttacgctgaggctgcccactgaccaagaatgaggttgccctgcttgaaagtcagctttagctaccaggggtttagtaagatgggcacatggggcagggcctagcgtaagcagagagacgcaggaagcagctactgccgtagtccaggtcagagaggactggggggttcctgagtctcctgtggctttgccagagctagagaaaagatccgtggtctagatgtgtgtgatg

SEQ ID NO: 570304 - DNA, 193 bp, Homo sapiens
gtctgaaagtggaagacgtcagcacttaaggctccacaggggcttactcagcgtgaactctaggttactactctttacttggttcacccatgggggggtgcagtttttttaaaaggttgggagatggccattctaactacggttgaatgtctctgtttggggaaggtataacaagaaataaaaaagaatatat

SEQ ID NO: 570305 - DNA, 860 bp, Homo sapiens
  misc_feature (4)..(4): n is a, c, g, or t
cacnccccctcaagaatagaaataggtagagtaggtgaagagatggaggttgtgtataaatggagaatgtggtagccagtgccattccttgagtccatggcccgttctttgcgtgttggccaggccaaaggtttgtttattttggcacaggtgcccccttaggctgatgtttttctcggtcctagcgcctctctagagtctttcggggtcgcgtggttcgagcaacgtgaccagggagttaaggcccgctgtccacctgcagagaacttggggggcagtgccagtcatctccctggggggccagccttgttgggcccccttttggccccctgcctggagcatttgcgagcccccacacctgcccttgtggggtgtccggctgcccccgtgctgcccagaccggagggcttgggggatccccacagggggagggccatccccttcacccccagttgcccaaccagacccccccccccctggattttccttctccctgccctcccttgacggttttggccttctccccacatgctgtttgatcttttgaatcctcttgggctgaagccggacccgagttctccccccggcgacccccagttgtgggggagccctgtattttttttaaccaccatcccccgttccccccctggtcctccccccttctccctgcgtgcccgacattttaacccgcccattgtgactctgtgcttgtctgtttagattttgtgtataaatgggatagttgtggagatgacccctccctgtgccgcgctggttcctttcccctttcccctggtcaccggctactcatgggagcccggacccgtaaggggccttcgatttaaaaaaaaaaagaccaa

SEQ ID NO: 570306 - DNA, 442 bp, Homo sapiens
acggtcgaatctagaagaatcccctgttgcgcagccggcggagattaacctatgcaggctcaagcgacaacagaccaaaatgtgtgcagattcttggatcctagctaatgaatagcacagctctagcctacagctgtccttggacaggaaatctgagtgctgacctgttacttcctaaccatgacaaccaaagccagatggacctaaccacaaccactttgacagtcttgacaaggtatggcatgggcttggcctggtgtggcaaagccatcgacattacaagaagacgaactgactccactgaacagcctgacgaccagaagagcctgcccctcactgctgggccctcccggtctcagacacccaggctctcacattctactgtgtgctctaagatctctcttcatgttcctctattctgagggcctgtgcatttgaacca

SEQ ID NO: 570307 - DNA, 206 bp, Homo sapiens
cccccctttttttcctttttaaccaccagaaaccagaaaagaaaaccgggttccccttttaggggatgggttatattttttaaataaaaaagggggggggggggggggaaaacaaggggtttttcaaaggttttttttttccaaaccattttggggggggcccgggggggttttttttttttaaaaaaaggcccagggccttttta

SEQ ID NO: 570308 - DNA, 1607 bp, Homo sapiens
  misc_feature (557)..(557): n is a, c, g, or t
  misc_feature (576)..(576): n is a, c, g, or t
  misc_feature (817)..(817): n is a, c, g, or t
  misc_feature (879)..(879): n is a, c, g, or t
gctaaagccatactcataggaaactttatagctttaaacaataaaaaaaaaaaaaagaaaagaaaagaaaactcctaagtattgggaaattggaacagggtacatttaaaagtagctcctcaaagaaagaaaagtggttacgtggaagtttagaaattattatttttcaacttaaatgtgattatgtgaagaaaaagtggctgtgggcacagtgtggcctccgtgccgtggtaagtgccagccaagttcggggaagttcttgaggccaaggtgtggaatctccacttgtgaagcggtctaggaagttctccagaaccaagcctgtggtccagccaagtggtgtgaaacacccaagttcttcttaacttaaaacaagtggcgaaaacatttagctgtgggcgtgtggtgcggcgcccactatctctggtgagagtctctccaccactctaaactccgaggagagggtaaaagcgtgaaagggcgggtcaccacctggagagttctgggggaaaggtgccaaggggcttcacaagtggagatgtcctatgagaatcccngttggccccatctggggcnaccctccgtgggccgtgagggcgcgaaacaaagaagtgtcgagaaccctgtgtgcgtctctcgagggaaaagaaaaacccgcaaagagatacgaatacaaccagacaaaaactctctggggcactatctacggcggcaccaccgagaaaaaaggggtggcacacacgtctacaacagtgcgaccccgcaacaacaaacgcgtgcgtattaatacgtgcgcgtgaaaccgagccccccaaanaggaagaggggcgtggcagtggttacaacgcttatatacgcgtacttgcgaggaaagttccncaggaacatatattgcttctacgagcacacccaacaggcaaaacacgcttttaccttaggcaagacacgttgtaaccgcaagggcacctcactttccctcaataaacaggcggtcattagcagagaacaggcattactaccgtggcgcaacccccgaggaaacgggatataataggtaaattttcttaacgtttaaggaaacctgggcgtttccctgaaattttcccgatgagggctcgccgaacaaagctatttttcacacgggcaacaaaaaatgggggcaggtccagcaggcgggggggcggcaatcatagacacacagcagcatgattcatgtatcactgcgcgagaacagcaggagggggtgcccaaccaattggtgtgcgcacccacaagagtgcgagaaaagtacgggcggggcggtaacaccaacacggagggtacctaaagggaaccccccaaagaacacccacgcgggggggcgcacacagcgagaacgatcctccacacacaaagatgaacgcaccgccacaaatgatactgtggaaaaacacgagggaggtagaaagaaacaacagccagcaagaaaatgactaacaacaatatgacgacgaagagggcgagggaacaacaccgactggatgacacgagcgtgttaccacacgaccgaacgctaagatgaacccaaccgacacaacgccaacgaggcggtggtacataagcagccc

SEQ ID NO: 570309 - DNA, 934 bp, Homo sapiens
  misc_feature (32)..(32): n is a, c, g, or t
  misc_feature (131)..(134): n is a, c, g, or t
  misc_feature (140)..(140): n is a, c, g, or t
  misc_feature (144)..(144): n is a, c, g, or t
  misc_feature (147)..(147): n is a, c, g, or t
  misc_feature (166)..(166): n is a, c, g, or t
  misc_feature (249)..(249): n is a, c, g, or t
  misc_feature (255)..(255): n is a, c, g, or t
  misc_feature (288)..(288): n is a, c, g, or t
  misc_feature (291)..(291): n is a, c, g, or t
  misc_feature (299)..(299): n is a, c, g, or t
  misc_feature (301)..(301): n is a, c, g, or t
  misc_feature (303)..(305): n is a, c, g, or t
  misc_feature (310)..(312): n is a, c, g, or t
  misc_feature (322)..(322): n is a, c, g, or t
  misc_feature (332)..(332): n is a, c, g, or t
  misc_feature (348)..(348): n is a, c, g, or t
  misc_feature (360)..(360): n is a, c, g, or t
  misc_feature (366)..(366): n is a, c, g, or t
  misc_feature (369)..(369): n is a, c, g, or t
  misc_feature (427)..(427): n is a, c, g, or t
  misc_feature (471)..(471): n is a, c, g, or t
  misc_feature (491)..(491): n is a, c, g, or t
  misc_feature (592)..(592): n is a, c, g, or t
  misc_feature (594)..(594): n is a, c, g, or t
  misc_feature (619)..(619): n is a, c, g, or t
  misc_feature (630)..(630): n is a, c, g, or t
  misc_feature (925)..(925): n is a, c, g, or t
tttcaagtttgtatagagaatgtatgccacantttgtattttataaacacaacctatcttattataaatacaaaataagaaaaagtgatacgttagctgttatgaagggtgaaaacattatataaacttcnnnnggctgntttntgnatctgcatctatgtaattncatggttctctaccaatttcatttacagaaataatctctatagtcaaattattgttcactttcatgccccaacatgggaagtngtaggngaatatctgtaggcatacaatttattgtctgcnccnccactcanangnnnccctnnntctgtccagnctacactcgngcctttgtcttcatgngccgccagatcntagagnggngccttacaacttcttgtatcccacagcttaacaatgttatctaaagatcctgaaatcngctgctgttcatgggtaggggaccattttactgatgtcacccanccagtatgtgacgttagggncagcgacaccaaagaaccatctttagttcggggatcccacagtctgatatgcctatctgtgcttccagatgctaaacgtttacaaagtggagaataggaantncaattaaacactttatttcctgtcnaagttgacttnagactgccagactcaacatcccacactctaattgtatggtcccaagatgcactgcagatttcttcagcatctgaccacagaactgaggaaactgcctccatgtggccagagagggtcactatgggagtccttgttagtccaactgttctgtcttctgtttctttcttggtcgattgtggactctccattcatcttcttcatctgtaggactgtagacagatcttagcatctatccaggagcactgcaaattagttctgagcatcaacagctatagaatctacacttccagcatgncctctacag

SEQ ID NO: 570310 - DNA, 586 bp, Homo sapiens
  misc_feature (27)..(27): n is a, c, g, or t
  misc_feature (178)..(178): n is a, c, g, or t
  misc_feature (184)..(184): n is a, c, g, or t
  misc_feature (202)..(202): n is a, c, g, or t
ggcgccgtggggggggggaaaaacaanccccttacgaagggggggaaaaagggggccaagaagaaagggggtgatccattttctaagaaagattggtatgagtggaaagcacctggtatggtcaatataagaaatattggaaaggcgctcggcaccagggggggggggaccaaaattncatctnatgggctcaagggtccgntgtttaaagggaggcttggtgatttgcaaaatgatgaaggtgcatttagaaaattcaaggtggttactggagatggtcaggggaaaaactggctgactaacttccatgggatgggtcttacccgggacaaaatggggtccatgggcaaaaaatgggagacaatggttggagctcacggtggtggcaagactaccggtgggtacttggttcggctggtctggggtgggtttactaaaaaacgcaacaatcagatacgggagacctcttatggtcagcaccaacagggccggcaaatccggaggagggtgatggaatcatgacccgggaggtgcaaacaaatggcttgaaagaggggggcaataaattggttccaggcaggatggg

SEQ ID NO: 570311 - DNA, 504 bp, Homo sapiens
  misc_feature (324)..(324): n is a, c, g, or t
tactcaaacgtatagaacataataaatacactccatacctatcagaacagttaaataaaaaatactgacaacaccaactgttggtgatagagtaactggaactctcatacatcactagtgaaatgtcaagtagtacagccaccgggaaagtttgttataaaattaagcatatatctaaccaaatgttgatggctattgtgataccctggttcttgtcttcttagtttaaaagagaaggatgggccgggcatggtagctcactcctataatcccaacactttgggaggccgaggtgggcaagtcactaggttaggagatcgagancatcctggctaagatggtgaaaccccatctctagtaaaaatacaaaaaattagccgggcgtggtggcacgcacctgtaattcccattacttgggaggctgaggcaggagaattactttaacccgggaggcggagattgcagtgagccaagattgtgccactacactccggcctgggcgac

SEQ ID NO: 570312 - DNA, 565 bp, Homo sapiens
  misc_feature (9)..(9): n is a, c, g, or t
  misc_feature (16)..(16): n is a, c, g, or t
  misc_feature (37)..(37): n is a, c, g, or t
caagtctgnggtcccntccctctctccttggtaagancctctgctctgggggatgtttaaattacctctggactgattattttaagcccatttaattgggaagcaacttagtggggtggtaggggagcttaaaaaaaagagtgtgaaagttgtacctgatttgagtagccctgaattcctggtctgccttggttgtgacctgtaacttgtcattcagcattctcagctttcatccctttatcccataaaatacaataattgggtatgtaagctttaaagattcctcttctttctaaaattcctttattctgtctgacttacctgcccacagagttggaaggaccaaatatgaaaaatagatacagtggaattttagaaagttttttttttaagtatatgggtttttaccatttcaaaagcctcccaaagtgctgggattacaggcgtgagccaccgcgcccggccaggtggatctttttaaaatgtggaatgtattatgcttttattattacaaaaacacatgcttattttataaaatttagaaaacttagaatcttctctccca

SEQ ID NO: 570313 - DNA, 145 bp, Homo sapiens
gaggagaccagcctcaacgcctacaactcactagacaaggtcggggctgaagcgtacggcgcgctaaagccggacgtaccccccaaaccatcctttgctcccactttccacattccatagaatgcccaatagatgcagtgtacat

SEQ ID NO: 570314 - DNA, 174 bp, Homo sapiens
catatttctaccccaaatgtgagttgagtacggttgggctcggtgaatcagtccgtgatacaacactggatagagcggcggacacaagcaggagcgccgctctatccagtgttgaatcagtccgtgatacaacactggatagagcggcggacacaagcaggagcgccaagacca

SEQ ID NO: 570315 - DNA, 694 bp, Homo sapiens
caaccaccaaacactcagaaataaacactagttaaaaaaaaaaaaatgaaacacaagcctgaacccaaaatacccatgctttgactcccaagaaaacagatttttacattccctaataaatacttgttttactatatccccaaggttttagcatcctcattggtatatcaggctaatggtctctaatacaaattctttttggaatttttcttagttaaaataatcttctggtttgggtggtgtattttcaattggtttaagattctggttcttgtggcttgcagtaattctttttattttcttttccaaaaaaaaaaaaagaaaaaaagaaacaaaacaaaacgtttgggggcgcgccgcctgagggccccccagaaaaagctttagtaaaaccaactccgtgtggggggggcgggggccccacagaaggaacgagagaaccaggggcacaagggccggcccccaaaaggaaaagacccggggccaaacgaaaatatgtcggtgggcgattccaccccataaaaaaaaccgcgcgggggggaaacacgcaggctcgtccgggacaacatcccagatggaggtgcacagaaggcacagaggggggcttcatacaacagagagtccccaaaaaagccgcaaaataaaaacccccgctccgtgtaggcaaaaaaagagaagaaagaaaaaaaaacag

SEQ ID NO: 570316 - DNA, 167 bp, Homo sapiens
ccgggcggcgcagcgctgatgaaggcgctccgttagggatggcacctttcggcgggcacagcgtcgaagcttcactccagctagctttctggtaggaggacacaacctgatttccccgatgagctggacacatccttctttgcccgggaaggtatcctccatgaaga

SEQ ID NO: 570317 - DNA, 1646 bp, Homo sapiens
tgcttgggctccgcgcaagcgccgcaggtagcgaccacgcggtccgcggcccagagtgcgctctgtcggccgggatgctatggtcctcggattgagccggctgcgccgctgcggatgtatgatcgtgcgcgagggcagactgagcgtgcgacctcgagacgctggtgtgcatgtcgggtgcttggtgcccaatggctggcgagtgtgacatcaggctctccagaaggagggagccgaagggcagttggctgagaagcgtcacacaggggacgacgcaggtgcacctagagttaccaggaagggagttgaccccaaatagactcagggtgactcctgaaggtccttgtggctgcaacttagcactggggggttgagctgagttcacggaattgggatcccccaatgcaggttgtgggcaacatacccaatgttcactggaggaaatccgggtcacaatggtacctacaaaaattccgtacccataagtggagctccatggtcgcaacacaccacggtggggtgcacagcaggaatccacattcaagcaagagccctcgagggcgcaaactatatttatgccaccacaaaacgcagcaaccgcctaaatggacagccgggtgccttgagtagagcagaagagggatggataggcagacaaatgtacacaagacagcattggacatacaaacaccaacgtaagaattaattgccccttaaacaggggttcaacgcatcgggatatggtacaaatcacgtccattgccgagaaacaggcaatttgcgccgcgcacagcaataagatggcccaacccgcacagtaagggaaagtaagcacggaggcgacggccacacatgtggcaagggggagcactccggaaaacgcacgccacgtaaaccaaagtccaatgcagacgggcacaggaccgcagaccaatgcaggcggggcggtccacgacctaccatggtggacgtagaccacattgatacccgataagacccagcagagttcgcagaacgcattacacgggagaaacagggcagccttaccaaacagcgacacatgccgtactcacacagggccacaagaaaagcaacacatggagcacacgcagtgacaagagcaaaacgcaccaggaagacacagggcactccaccaagtagcacgcaaggacgtcgcacacaacgcgcgacggacgtcgaccacaaatagcgcacaacacgcgacaggggccacacacaaagatcagcgcatccgtggacctcacagtgagcacaccacataaagcagagagcttcaaaaactaaatcaaggactagagagtacaacatggtggaacaactatgccatagacgattcaggccattaacagaggccaaagacgcaaacacaattggagcactggaataggaaaccatacactacatcacaatcttccaacgaataagagtggaagagtaccatatactatctcacaggttctagacacgtatgccccactcagacgttcacaatataagaggcgctccaccttgaatgtgtaactcgcgtcagatatacgtacatacagagaaaccgagaatacaagaataacgacgtgagcatagatcaccaccacggaccatgcagaggaagagaatagtataca

SEQ ID NO: 570318 - DNA, 429 bp, Homo sapiens
catcatggggtacctgggaggcaggaatagttgcctgcttcattcactgttgaacccccagtgcctgaacagtgctggttgtgtaatacgtgctcacttaacatttgtagacgtgaatgatctacatatagtgcaccttaagaaacaaagcaaaggcacgagtctataaacagctgtgtgtacagcatactgaggtgtgtagtgtctagtggcaacaaaggtgtcatgtgtgtagagacgggggatgttgagcaactaggttcaaaatggtagtgatgagtgaaccctgggacaaggtatgggcagcccttgttctaatcctgaaacttttctacagtttagaatctatttatacaataagactttagaaaatcttatatatactaatttttctctcaaataacacctgaggggtggattaattccagg

SEQ ID NO: 570319 - DNA, 796 bp, Homo sapiens
tgggaacaattcattgggaattgggtggcccaaacacgttttcccgttcccgggagttaaaaaagccttttggtattctgttcctttgggcaaagcattaccccagacatttggaatttgaaaagagcatttacgttgagagggttaccgggttgcagactccactcagaaccgttccattcgcaagaaccatccctcctacgaaatttggcttaagctgccaatgagtactaaaccatagtgctcgtgaggtagcatgtagacgactttgcatcagcacttgtaagtcacaatcccgattccctccgttgtcgaatacttgggctcggactctcaaggtcttaatcgaggttcccaagggtccttgtcatatgagcattttggagtcatatctgttcgagcccagcgagcacctaagcagtcctctcaccccagtgatattcctgtggtgtgtctacaatcctagaacgcggacattatgttccaataacactatggcatcccggtgtcactgcacagaatgacctctggatgagcaaatctgctcctcaacagcctgtcatagaaccaggatcctacctatgttaacagccttatagatcatactcacgttccagtagttagcgcactcagtcaatgggcataaggcacctttctgttgaaagaagagtcaattgctttcaactgctctatgggccgaccatcaacaaatgagaaagcaaggatcacgttttgaaacagcaggtccaggtccctttgtatataggatttagctgtattcaataaatctgtttgg

SEQ ID NO: 570320 - DNA, 191 bp, Homo sapiens
atgcagcaatattttaattgtttcaaataaagcaatatatgtatatatatattttttcagaaaaacaccagatgttaaattctacaaaagcgcatggtcctcagcagatcaagttgctgattattaagagatctgaacatacctctaagacaacaatggactgacacacgcacacacaggctacggctctg

SEQ ID NO: 570321 - DNA, 1626 bp, Homo sapiens
ttattggtgttgggtgtttgttggtctgctgttcaggttgtgtcgtctattgtagttagcgttcgatgctcttctcttattgcttccttctctgttgtcactatatctttttgtgttcgtcttgtcttgttctctacttgttctgctcttttgtttgtttttccagcgctttgttgtcatctttgctggttttagcatttagtctgtttccttcaagtttttggttctgtttagtgtttttattctctgatcttatttagttttcttttttctttattcggtttctcttgaccgtgtttcttgttcgggctgtttttgtctgatccagttttctgtttgtttcttccaaggttatgctgttttctgttgcttttcgtgttatataaagcttgttgttgttgagtttcgttgatttggttgttcgttgtttgtttgttgatctttttgttgacttgtgtgtgtttcgcccgcgccgttcgggcgggcgatgggggtggacctcggctaccaacatggtgtgaataaccaagtgtcaacccgcctctgtaagatggggtgagtcaagagaaacaaagcgattgatcgcggagatttttaaaggggttggaacaacaccttaaatatggagaacttctcttggaaaggggagtccccaccccaagaggtgtgtgagtgacaacaaaaaaaaaatccataggcgtctttgggtataaagacccgtctccggcccccaccgttaaaccttatttatatcgcggttctcctctaaaaagtggttattacctcgagagcgccctcttgggtgttggcccgaaaaatttcgggccccccgagagggagaagaaatatagagttttcgccccccacttctcacttggtgattcgagctcaccccccggtattagactattttccgcgcccacacttatggagagagaggtttcacatgggagaccacacacaccggagatctattaactctctcacagagagggagaaacacaccaaaatgggggtctcacattagagatggttcccctctttcacaccccccggcgggagaaaggggcgaacacacagcgtgtgcctataagacacacagagaaattttcgcggagataaaatcttatgtgcccacacatatatgggagcacaaaagagaccaccatccccgcgagatgtgtacacattcgttttgatatatatgtgtgagattcacgagaacttcacatgtttttgtggtggttggccacaagaacacacacgtgtgctctttggcgacatgagatgttatatgagatttcccctgtgagatatatatgccacaaagagaaaaatgagaaccccacaacacataagagacttgtccaagaacactggcccgtaatgaagaaagaaaaagagcctcacaagaaaagcacacgagaaagggaccgcacaagaacacgagaatgaaagaaaagtcacagggggaactgcacaaaggcccaatgttggtgctggccaaaaagtgagagctggagagattggatcacccaccgaaggagataaaggtgctgccatgatgttagctgtggcccctgtggatttttcgccaagaaccattaattaaccttaaaacttcca

SEQ ID NO: 570322 - DNA, 146 bp, Homo sapiens
aatttggtggttttttggtgaacccaaaccatggaaaagggagggaaaagaaggttccaggtggttccgggccctccccttaaaagcccataactgtcttgtttcttgtaactcaggttaggttttggtctctcttgctcccctgc

SEQ ID NO: 570323 - DNA, 845 bp, Homo sapiens
atataggtataggtagatagagtgcctttctgtttcttttcttttcttttttcttttttgttcttccttcctttcttccctcctccccctcatccttccctttctccttcttttccctttttttttttttgggaccgggggagtaataaagttatttttaaaatggcagggtatgcaatcttttattcctctggtctatgggataagagattggtcgggtcaaaagtggcaaaattggttctgaagcttaatattagagacccaagtaagatggtttaagtctggtggaggaattgacatccattttaaaaattgggtgggtctggtagattgggatttcacagcagcaattactggggtaaaattagagtacgggaatcttgtaggtagaaaaaggcacctgtgagatataaacaaaaagctttaaaaaatattttttaggtggtttaaccctacatctagtttcatttcacattctggctggttttgtggactctgcaaccgtgatgtgtgctgtcaatatcagaataggggcatcagggtccggaaacattgtggtggtggtatgaagctttgtatcaagtgttgatcagaagaggtgtaatcgggtttatgacatatttctctattcttggtatttttacattttggaacccagggggtcttaatataaagttaatctcaaaacaaaaaaaaaaaattttggggtgggtagatttaacatttggcggcatgaatgacgggagtggtcagatggtaattggttacaaaccggaggttgaacatgttgttgtaaagcgtatcaccgggaggaggagagagagaagtatacgcaagtagagaga

SEQ ID NO: 570324 - DNA, 722 bp, Homo sapiens
  misc_feature (415)..(416): n is a, c, g, or t
  misc_feature (439)..(439): n is a, c, g, or t
  misc_feature (445)..(445): n is a, c, g, or t
  misc_feature (469)..(469): n is a, c, g, or t
  misc_feature (493)..(493): n is a, c, g, or t
  misc_feature (514)..(514): n is a, c, g, or t
  misc_feature (543)..(543): n is a, c, g, or t
  misc_feature (600)..(600): n is a, c, g, or t
  misc_feature (627)..(627): n is a, c, g, or t
ccagaaacatccaattctcaaactgaagctcgcactctcgcctccagcatgaaagtctctgccgcccttctgtgcctgctgctcatagcagccaccttcattccccaagggctcgctcagccagatgcaatcaatgccccagtcacctgctgctataacttcaccaataggaagatctcagtgcagaggctcgcgagctatagaagaatcaccagcagcaagtgtcccaaagaagctgtgatcttcaagaccattgtggccaaggagatctgtgctgaccccaagcagaagtgggttcaggattccatggaccacctggacaagcaaacccaaactccgaagacttgaacactcactccacaacccaagaatctgcagctaacttattttcccctagctttccccagacaccctnntttattttattataatgaatttnggttgntgatgtaaacattatgccttaagnaatgttaattcttattaaagtatngatgtttaaagttatcttcangtactagtgtttttagatcagagacttgngaaaatgcttttctcttgacccacagtctcccctgggatgttttaggggtcttgcangatcattatccaagaattttttaacantccatgcatgctaaataatattgtggaatgatattttgtacctttcaccaataaattatttttgtcaaaaaaaaaaattcaagtcggctggaaac

SEQ ID NO: 570325 - DNA, 891 bp, Homo sapiens
gcaggagcccagctctcccgggactccctgcagagaggaggttgctaagtgggggtgaggaggaaggcagcccctgtctgccccttctcctggctctgtcaccataggcctcagaggccatgttcctggctggcttttccaggagtgtgactgcctcaccctgaccccagcgttgggagcagggcagagggagggttctctgcagtcgccgtggacacagggacctgccctcagctcctgggagctctccagggagactgcagagaccccggcctcggaggggcccggtggacagcagcccgagctgatggcccacaggcctctgcaggcgtgtgtctgctggcccagctgcccatctccccggctacttcttggctattccttccacttgcaacaagaagcttgccaataattcaagttcctgccctcaaacttgggaggagtgaagctcggagaaagcgccaccctccttggtgagctctgaatctgccaaatggcttctgcttgcaaggtgttgggccaaggatttggaatcaagaagcttgcttttcaaaagcagagcagggttcttggccaggcttagaaccggaaccggcggggacttattccaagctgatttcggctacaccccaggagattctagattccctctacctaaaaaaaaaataaagagaataaagaaaaagagagtttttttagggccagtttcgttgtggtattactggaacggggttaaccgggtgaaaattgggacaattatgtgacaccccctccgggttattaggcccctaactctcttaggccgcctagggtggtggagacacagtgttttttcgcgtaaaaggtgtttcaaaaaagggggtttggttttcaattaagtcaatagccgta

SEQ ID NO: 570326 - DNA, 96 bp, Homo sapiens
ctgtaagccaaaactttttttttgacactggtaccaatttattgtattattctgttctcatgatactaataaagacataccagtgtcaaaaaaaaa

SEQ ID NO: 570327 - DNA, 995 bp, Homo sapiens
taccgctcataaacctagaatgatgatgtgtaaacgtttacccgctcaatgctaaatactacaagcatatagtatgtaaataaaatcctgctgtatcccatttcctttcatagtgatggatacatctacgggtagtctaaaatatatcagttcagcatacatacgactaaaacgcatgcgaacacactctaccgtcaccccgttaggacatatactgggtgtcctgattgacattagttagcttattggatgatatgtcagactgaaggagcaggggcaaagtactaacatatggtcctcattcatcctgactccataattgcgctgatgaggtagcgctcaacagtggcattctggatagtcatagatgccaaatggcttagtgcgtaactgcggtccattccaatgttattctgggacaaaatccatgtgacaatgacccttatccaccgttaaaacagcaatgattaatgcatgtccattgggcactcgctccggaaggcagctatagtctaatttagtaacatcgatgctcctcaatatattaaaaagtaaacccataatttcatacgttcgagaccattattttcgtacttggttgcccctgggcttttaggactgcctgaaacactgggtaattataggccatcacttgcgtatattccttatactttgccatggatttgcattatcgctttgggaggaaccagaaattagtacgatgactaattatactaggacgtaagctctttcccaggaaggtccacgtttaccttctacaacattgttatccttaccatagcaacttgatctgtggttgaacattgtccaccttccttaaatttaatacgatgacaatacgttctaacgaagactaacagggccactcctagagggtactcccggccgaggggacaaaggacgaaaattcggatgtgggatccaagtcacttttgcacactacataaactcggtccgctgctaggggacggagg

SEQ ID NO: 570328 - DNA, 490 bp, Homo sapiens
cctctttttttgtcattttgtgtcaactcacctcattcttcccataaatgtggtttcattgtgtgaagcctgcagtttgcttagttggtcccctatggatgcagctggctttacatttgaggctaggtgttgctgtttagtggattttgttaagagtaaaatctatacgtggtttaaaataaaaaccttcagcagggtctgagggaaaaggaggttctgcacttgctctgcacaccgatggggacgtctgtcctgtggcctctgacgactcggatgcctgttcctctgtccttgcaccctgctgatgtgtaggtgaccagcgggctcttttctgctggtctcccgggtgtgctccttggaaactgtttcctgtgcgtccttgcagaaacattccgtgtgcatatccaagcacaggaagtaagtggatggaaaaactttgtctctataacaaaacccttctgtttcataattaaaactaaagccaaagtca

SEQ ID NO: 570329 - DNA, 989 bp, Homo sapiens
gcttcttctctacggagtgtgtaattgctgcatcagcaccgaatgggttctgatgtctgctcatcgtatcagatcttcgccgctcatgcaggacctcttgtggtagccgtcactacgcttcgctggtcttaagcatgggtgcgcaattatgacctcctattgggcaataagatggtgacccatagtctcccaacctactgaaccccgttaatggtcgtctctgccctgacgccttcttgcctgttcataggtcgtgtcttgccaggtgctgccggagcttggggtcccttttccccatcctggtcgttggttgggtgtcttctggctgcaccggctgctcttgttcactctcgtgatcagtgtgcgtgctactgtgagatccactccttctctctggccgctctgctcgtccctttgtctgcccttccgtattgtcacgctcggtcaaggaacgttgcccgggcgcctgggactcgatggcccgtacgccaggaacgtgacgtcactcgatgattctgggttcctccgatatcggtgagactgttcccgtagactgtgtcccttctgagccaaccggcaatcctcccgggttgccagaactctccatggtggccactggttaagcaaatgcctcctgcctctgcgcttccggctgctggtctcggggaagctgtcttcttcacccgtggtctcaaggtacaacgtttgagctgatcctcttcttggggacctggtctctgtttctcaatgcactggagctcgatgccgagtaccaccgtggggggcacccggtacagtgggccaggcttcaggaccggatctgtggtttgggatcggtaacttcctggtgtgcccctccatcttctattggaaatcccttatgcctcttcagttagtgaggtgtgaacggcggccgggcctctgggccgtgttgtcgcctctttggcgggttatccccctcgagggcaacgggccccacggtaacccca

SEQ ID NO: 570330 - DNA, 438 bp, Homo sapiens
tatttctattattattcatgtatgttatttatttctgaatcacactagtcctgtgaaagtacacctgaaggcagaaagtgttaggattttgcatctaatgttcattatcatggtattgatggacctaaggaaaataaaaattagactaggccccaaataggctgcatgcatttgtacatgattagtagatttgatatatagatgtagtattttgggtatctaggtgttttatcattatgtaaggaattaaagtaaaggactttgtagttgtttttataaatatgcatatagtagagtgcaaaatatagcaaaataaaactaaggtagacagcatttagaatgcttaattagaactgctccaggtgccctcgtatagttgcagcagcaccagtcctggtggtcctctttgtctccctcatgagagctcctcaggttatg

SEQ ID NO: 570331 - DNA, 519 bp, Homo sapiens
cggagtgcgctcggcccggcccgcgcaggcggctgagtcctccgagccccgtggcccggacccctcgcgccggtccctgcccctgcgctggcctcggagcgctgctgcggcccgtcccgtcccggcctcaggccctgccgggccctgcagtgtgagagcgcctgctcgctgtgcccccgggttatgactgatccccaataaaggaaactaggccttgaaggtgaagctgggagccgggtgagaatggtaccagcctgacggatgacggatgctggtgaccatgtcggtgcgggatgctgacccatgcacctgcgtgtggcctgtcccaaggcagcgacgatcgtccagctgaagcacctgccggcgcacgctcgaagaaccgcggctacgctgccactctgccagcgtgacagcgggtgcccgcacgacaggacggacgcttggagaacgcagaacgccggcgcctgcacccacgagtgtggcacaacgcctggcctccagagacaccgccagacatga

SEQ ID NO: 570332 - DNA, 953 bp, Homo sapiens
gagaaacttaatagtgctgggagatataggtattattatcctcattttacagatgtgaaaattgaggctcagagaagtaaagtctattgctcaaggtcatgtggctagaatatggcagagccactgattcagatccaggtctcgctgattcttattccagtgtcctattctagcataccatgtggcctctaaagattgcagctccttatttgactagaaaatggtgcctgcccaatctacatctccaacctcaccccatctttgtcttaagcactatgtcttgtgtctggatcagtattatattcagtggtctctggaatacatgttctagtgcgagttgggaagcaacatctcttttaccagcttgcactcggaccaagcttggaaaccggaaaagcttacactgtcgtgcgctatgtcagcagttataagaagttgtgacagtgtgtagctttaactttcggtcagaaaatctattaacatgggcttaagtgctgacttgaaatgctatttgtacggtttggatgtaagtaatcaaatcgagggtcagcgagcttgtatgagacataggtacctccatgtggccccagtccttgtatctagtacaagttcgagaatgcattccctggatcgaactgcttagaactggtggtgctccttctttacttctacctatagctcatacacggttggtctttcaacattgaccggtgtcccgttgggacccaacgagaagaaaaacgaccaggaccaacgaccgcccgagaggacactaacaatgaccggggtgaccgagaaaacagaacgcgcctacctgacaagcggcccccggtggtccagacagctgttccaccagaaccacgaggttcgctggcaccaaaagggggcaaaaccgcgcgggaccccccaatagggcggcggccacaaatctcaacacccaggttaccccctag

SEQ ID NO: 570333 - DNA, 417 bp, Homo sapiens
agagaagggatgtcaggagagttgggggccaggaagacaagagagaatgatcaaatattgctgcaaacaaaagaatggttaagcattaaggtggatttgttaggtttagccacaaaatgatttgtgattatgaacttggtgagagtggttttaatgctgtggtgtgaggatcagaagccagagattataatgggttaaggagtgatttggaggaaatgggtaagtttcaaaaacaaaacaaaacaacttttagtgagttttactgtggttaggaggggcaggacatggcagtactttcttatagttattttgggggaagataggatactgtaaacaactagtcaggtgtggtggcatgcgcctgtagtcccaaaatagtcccagttactcaggaggctgaggtgggaagatacctga

SEQ ID NO: 570334 - DNA, 351 bp, Homo sapiens
  misc_feature (48)..(48): n is a, c, g, or t
  misc_feature (209)..(209): n is a, c, g, or t
  misc_feature (240)..(240): n is a, c, g, or t
  misc_feature (255)..(255): n is a, c, g, or t
  misc_feature (266)..(266): n is a, c, g, or t
  misc_feature (270)..(270): n is a, c, g, or t
aatctttcaaacaggcacatgctcacaggctgacacacactcaaagantcatacccattcacgtgccgctcacatgtacattcacacacatacactgacattcccagactcacacacaccagcacatgctcacaaacttccccatactcacaaacttccccatactcacactcacactcatagactcatgtccacactgtcacccactnatggacacacgcgcaaactttcacattcacncaacctctcacgggnacacaccttanacantcacacaaagacgccattgccactctggcctgttaatctaacctcatcagaaagagtagggtgtcgtgggtcctcaacccc

SEQ ID NO: 570335 - DNA, 266 bp, Homo sapiens
ggatgagggactatatgccagagagagagagaaaaaccaagccagtccccagcgaggtgccatcgcaggccttgcagacctagtcaagctgctagctgcctcagcgactacagcatacaccacaacgagtagaagaaccacccagctaagccctgcctaacttgctgcgcgatagcacgaagctgatagacgccactacatatgagcggttagatgcagagacagagaaccccaacagcagacacatcgtacataacagactgact

SEQ ID NO: 570336 - DNA, 499 bp, Homo sapiens
cggggctgttctagaggatcccgtgcgtacggacgcaagaaccctcgacgcatgtcgtaggagagttcgcgcaggcactgggcctgcaacccatgcatatgcgccatgagtaaagggttggggtaagcaggatggctgaagtggaactcgaatgggtcccgcttgtgggcgaggaattgagtgagcagtggcgcttgggcaacgtccacgtcgtcaagcaggtcggcaatgccgatatatgccacatgacggtgcccgccccggccaggactctcagcgcctgcgtagtgctcgccatacaggtggcggtagcaaccgacactccattcctccatgcgtgcaaaccatgcactgagcgacgacgggttagcgggtgcgaatgtcaggccggttgccaaggcgctttttttcagccacgcgatatattggctttgcttgcgcaccgagtcgccgctgaccagagcatgcacgccgccattccaggtggcgtccgtagcgg

SEQ ID NO: 570337 - DNA, 172 bp, Homo sapiens
atcggcatgtcccagaaaggtctctggaggacaactcactcagtaaaacataatgtatcatcacgaagaaaactgattctctatgacatgaaatgataaatataatgcattgttataattactacatgtacgctgtctgcagagacattcaataaagtttgctttgattaga

SEQ ID NO: 570338 - DNA, 145 bp, Homo sapiens
gacagacgcttaacatttttttccttacccacccgtatagacttccccatagaaaaagatcagaacaagcttaatgtgactccacattgaatagcagctaattcatgcaagttcgctctgaactggtcgtgaatgggggatccat

SEQ ID NO: 570339 - DNA, 306 bp, Homo sapiens
gggctgcacgtgtggtaaggcctacaagaagcggccttcagctggaccttggctccccgccggacttcgagggtgtaatcgccgcccctgttggggtgaagcgccgcggctgcagcatgcctacacaggaagaaaaagcctttatgagagaagaagaaagctgtgtcttttacacttggtcaccgagccaacgagatcctttagcagcagatgagagtacaccccagaggtgtctattgcccacacaaaattgagacaatgaagaaaggcgagcagacagaggagtatgagtgttcttgatgacga

SEQ ID NO: 570340 - DNA, 467 bp, Homo sapiens
aatcttcagtatctaggcatctgcatgtatacgtgcagtcacagggatgcgatggctggcctgggtcagagcgctgacatacctagcttcttatattaataagacaaataaaacaaaatagtgttgaagtgttggggcagcgaaaatatttggggggtggtatggagagatactgggcgatgtttctcagggctgcttcaaccgggattatttgcggcgtgtgagcctagagtgggagagattaagctgaagggaggtcttgtggtaaggggtgatatcatgggggatgttagaagaaaacatttgtcgtatagaatgattggtgatggcctggatacggttttggatgatttgagaagctaaatggaagataaaaggtccgaataaaaggaggagaaaaatgggtattaaatgtctaagaattgggaggacctaggacatctgattagagagtgcctaaggagatt

SEQ ID NO: 570341 - DNA, 443 bp, Homo sapiens
ccgcagggcaggctgtatacctcatctttcgagtttgcacagccctgtgtttttgttaaacagttgcctggacctattctctgcgcgtcagattgctatgaggaccccttatcccgaagttacggggtcaatttgcctagttccttaaccatgaatctctcaacgccttagtatattctacccgaccacgtgtgtccgtttgcggtacgggtcgcagtaacattaagtttagcggattttctcggaagtatgattacctgcactcaacgcttcccgaaggaagtgttgtactttcgtgtttcagctcaagtggtggatttgcctgccactctcattacctacgcacttaaacgccctattccgtcagtgcgtggcagtgtcactgctccgtctccacatcactgatactgcgagttgcggaatattaaccgcatctgccatcg

SEQ ID NO: 570342 - DNA, 285 bp, Homo sapiens
tccccccccccccccccttttgggggttccgttttgggggttggggcccccccccgggggggaaacccccccccctttgggggaaccaaacctccttgaattaaaccttttgcttttttgggggggggggggggggggccctaaaaccccccctttgtggggaaaaaccccgggggagggtttttttggccctttttttttttttaaaaaaggaccccccggaaagcttgaaaaaaaccctttttttttgggttttttccaaaaaaaaggggtttttttatggga

SEQ ID NO: 570343 - DNA, 241 bp, Homo sapiens
gttcccgagcttggtcagaattcttacacaagagcaggacgcaccctgtagcctttctgtccaaacaacttgaccttactgttttagcctagccctcatgtctgtgtgcagtggctgccgctgctttaatacttttagaggccctgaaaatcacaaactatgctcaactcactctctacatttctcaacttccaaaatctattttcatcctcatctgttacctatctcggcataattctca

SEQ ID NO: 570344 - DNA, 470 bp, Homo sapiens
  misc_feature (431)..(432): n is a, c, g, or t
  misc_feature (450)..(450): n is a, c, g, or t
ggacgctaccattgggacttggctgcatgagctcgtcatctaaaaacgattaatcgacatcctataattagatgaacacggctgcggaatgttggctcaaccgaacaatgtttgtaggagcccggtcacgctacccaaagcgttcatcacgcgtgccaagcaaaagtttagtacgacgacacaacaacttgaccaggattactatgcagtcgcgccggttctgccaatgcgtgaaaccacagacactaacctacgccgcttggacccctcggctagttgatacacccgaagacggtactaaccctacaaaccccgattatagcgcatcgttactgcctgactggctaacctgtaccttcatcaaaagtggtcatcacgtacccggggtttaccctcgggtgggtggtgggggcgggggcggaggggaaagnnggcccggggtttcccccncaaagggtgtggtggggtgc

SEQ ID NO: 570345 - DNA, 116 bp, Homo sapiens
gagaacttgcgctgaatgtacaccgactcatgcatgtatgagtatgccaaggatttcctctggatctggagaccccggagaaacaaagatgctaatcaccaaacaggctgactggg

SEQ ID NO: 570346 - DNA, 472 bp, Homo sapiens
  misc_feature (16)..(17): n is a, c, g, or t
  misc_feature (433)..(434): n is a, c, g, or t
  misc_feature (452)..(452): n is a, c, g, or t
aagcttcctattgggnnctttggctgcaatgaggatttgtgcgaacagctaatcttttgaacctattatgcttggctgtgagtgttgggacatacggttactccaattatatcagtacgctgccgaagttgacctggtggtgtgatgatgcagcccaggggtaggttacatatgtcgtccatagggtttgctatgtcaatttagaagcacccacggtggattggtctaaccacggaatactaatgtggacgagccggcgcttcgtgatcggccgatgggggctcgtcatctagacggtactaaccctacaaaccccgattatagcgcatcgttactgcctgactggctaacctgtaccttcatcaaaagtggtcatcacgtacccggggtttaccctcgggtgggtggtgggggcgggggcggaggggaaagnnggcccggggtttcccccncaaagggtgtggtggggtgc

SEQ ID NO: 570347 - DNA, 418 bp, Homo sapiens
  misc_feature (379)..(380): n is a, c, g, or t
  misc_feature (398)..(398): n is a, c, g, or t
ggacgctaccattgggacttggctgcatgagctcgtcatctaaaaacgattaatcgacatcctataattagatgaacacggctgcggaatgttggctcaaccgaacaatgtttgtaggagcccggtcacgctacccaaagcgttcatcacgcgtgccaagcaaaagtttagtacgacgacacaacaacttgaccaggattactatgcagtcgcgccggttctgccaatgcgtgaaacagacggtactaaccctacaaaccccgattatagcgcatcgttactgcctgactggctaacctgtaccttcatcaaaagtggtcatcacgtacccggggtttaccctcgggtgggtggtgggggcgggggcggaggggaaagnnggcccggggtttcccccncaaagggtgtggtggggtgc

SEQ ID NO: 570348 - DNA, 422 bp, Homo sapiens
  misc_feature (18)..(18): n is a, c, g, or t
  misc_feature (383)..(384): n is a, c, g, or t
  misc_feature (402)..(402): n is a, c, g, or t
aagcttacctttgggaanttggctgcaatgagtgttgggacatacggttactccaattatatcagtacgctgccgaagttgacctggtggtgtgatgatgcagcccaggggtaggttacatatgtcgtccatagggtttgctatgtcaatttagaagcacccacggtggattggtctaaccacggaatactaatgtggacgagccggcgcttcgtgatcggccgatgggggctcgtcatctagacggtactaaccctacaaaccccgattatagcgcatcgttactgcctgactggctaacctgtaccttcatcaaaagtggtcatcacgtacccggggtttaccctcgggtgggtggtgggggcgggggcggaggggaaagnnggcccggggtttcccccncaaagggtgtggtggggtgc

SEQ ID NO: 570349 - DNA, 174 bp, Homo sapiens
ctcagaaacttcaaatgtttctgctcaaacatgaataatttctagggtggctgcacacccatctcaggagtgactcgtcacccagattttagcatcacaaaggaaagtggcactgtgagctgggatctgtggccctccctccgcctccggtggatggagtggtgctgtgatgtg

SEQ ID NO: 570350 - DNA, 749 bp, Homo sapiens
gcaccctttctatcctaaacacagtccataaaaaatgtgcttatcactgtgctccacaagagaaccaataccagacatttctcctgtggagacacagtgataagcggacgcgtgggtccgcgacgcgtgggtccaagatgtcgaccaagaatttccgaggtcagtgacgggcactggattatgcgctgacaagaaaatgtggcacatgtcagactgttgctacgaagaagcagctgtacatcgatgtggtcgggagaacacaactgagggcaacgatgatgaacagctgggggcaactgaacactaggaccagacacttgcgagaaaacgagccgaggcctatttagtgctaatgactggccatgtaaaactctgcagcactcgtgactagggccagcaagcatcagagtgtaatatgtgtaatactccaacagtatgctcaattagaagaaagaacaggatatggttggtggtttctactgaaagacaaatgttgaactatatccaaagagcaagaatctgatggtcgacatatgatgagacaggacgcataaaaacgaacacacataccagagggaaacgcagcaggaaccagcactctacactcaaggcagccgacagaccacgactcagagggagaacaccgaggatgaggacgaagcactccgcaacactactacacaagcagaacgaagacgcccaaaacgacgcagaccaccaaccaaaagcacaacaccaccacaacaacc

SEQ ID NO: 570351 - DNA, 592 bp, Homo sapiens
  misc_feature (149)..(149): n is a, c, g, or t
  misc_feature (553)..(554): n is a, c, g, or t
  misc_feature (572)..(572): n is a, c, g, or t
tgcatacgaatagttgataagaacataaaaaagaagcgacaaccggggctgccgccagcaacacttatggaagaactgggggacaggtggagggcaattatggggaggcgatacaattatgagctagagtacacagtgtgaggcgtctnagagcccaaaagtacgggatagaaaaaggtataagacaatcagcgcgggaacaaatggccgaaaacgcatgagccatacaggaaagagcgcgatatagcggaataagaacaggaaaattagtaataaacgaggggcgggggaggcatgcgaacaaggtattggcgaacgggggggggtataacgggcggcgaagaagcaacaggtaggaaacccccaataccctgtgcgtgataggttaccagaacaggcctgcgcctatttgaaccggaccagcggttcgtaccccgattatagcgcatcgttactgcctgactggctaacctgtaccttcatcaaaagtggtcatcacgtacccggggtttaccctcgggtgggtggtgggggcgggggcggaggggaaagnnggcccggggtttcccccncaaagggtgtggtggggtgc

SEQ ID NO: 570352 - DNA, 1414 bp, Homo sapiens
gcacggactctgtgaaccatgaacatatttgatcgaaagatcaactttgatagcgctttataaaattcttctcatataaccccagtcaacgcagcagcacctggaagaaggtctatgcaagttattgcacctatagtatgtatgtaggcggcatgcaggggcctatgtccatatggtcactcactttcatatcaggctggcctgccctgtctgccctatgggcatcccatgcatcattgcatgcatttaggcctgcatcggccacacaccatccatcagcccatgcacacactagcaacgagcacacacagcactgcggcactatcctctgcctcggcatctcagcaatatcgcattcacccagcgcaggtatggcacttggtggccacatgaccccctgcgacagctatatggctactatggcatagtgcaaacccaccaaagaccataccactatcaccccacctagcctttactacattgggcgccacgagcgagaccggaacaccaacacaaacacaggcccatacacaacaccaatgcaaacggacacagtacatactggcccaagagaaggaccagcaacaaccaccaacacagacataaaacacatgcgcaacgcggtcaatcatacgcacagggctcacaagacacacaatgcaccgacacagcgcaacagcccaaccaaacaggtcccactcaccccccatgggacgcggacacacactcgctccaatcacaacaacacggagacaatacccccataaaaggcgcgagcaaacacacacccaagcagccacacagcaacaccgtgagtacaatagacagccagccacctcgcgctcgacgtacccatcgaatagcacacagcgacaacccgacgaccgaccaccaaggcaccacaccctccccccgcctcgcagtagaatacggacaggacggggccacgtcaacaccctggtgccgccaatcccacccgacaagcaccaactgccagccgcacaccgggccaatacggaccactatgcgtcgcgatcacgacctccgcacagcgaagccacggccacactgcagccccaacaacccaccaatcagcgcacccacaggggacacacaatcacactgatacacacacgaccacaacaacacacgcacccagaccgccacgagaaacacgtcccccggcagacccacacaccacacgaggcccacgaacgcacacgctcggaaacacaccacgcccaacgcacagcggaccgcgacgtcagcagtccagatgctcccccacgtctaacacagcagcagagaacggatacggcaggcacacagacacagacaaaccaaaacaccacaccactgagacacgcgacgaagcaccacagaccgactgacagaacagaccgaacaacaacaa

SEQ ID NO: 570353 - DNA, 496 bp, Homo sapiens
  misc_feature (258)..(258): n is a, c, g, or t
  misc_feature (272)..(272): n is a, c, g, or t
  misc_feature (292)..(292): n is a, c, g, or t
  misc_feature (303)..(303): n is a, c, g, or t
  misc_feature (457)..(458): n is a, c, g, or t
  misc_feature (476)..(476): n is a, c, g, or t
tcgagtactttggctgcaatgatacggggagaatataagacttgtggataatactttacgtggtgaatacacagtatacacgtatgttgtgctaggtgaaccgattatgcggagaaatgaatatgtgtacaagacccacatatgcggcatttggtttggttagtgatttgtgaataattggagttttgttatacttggtgaatttatatacggatggacctgtttagcatatagcgcaagagcccaatgcagagttgngcccataataactnacggtaaagaacatagttgngagaattcatnacagattttattagacggtactaaccctacaaaccccgattatagcgcatcgttactgcctgactggctaacctgtaccttcatcaaaagtggtcatcacgtacccggggtttaccctcgggtgggtggtgggggcgggggcggaggggaaagnnggcccggggtttcccccncaaagggtgtggtggggtgc

SEQ ID NO: 570354 - DNA, 178 bp, Homo sapiens
  misc_feature (19)..(19): n is a, c, g, or t
  misc_feature (68)..(68): n is a, c, g, or t
agagggccttcgctgctgngcccctggggactccttcgcgacggctcccggggagggggctgaggctngcagcgaggaccctgacaccccttcggagaggagttgctgctaggcggctcgcttgctcctggaaagatttggggtttgagagctcttggccaggaggctcgcgctggcc

SEQ ID NO: 570355 - DNA, 302 bp, Homo sapiens
gcatgatacaatcgagctcgtgtacccagtgaatcgactcgggtactggaggatctctagagtctgaccaggctccatgtaaacgagtatttggagcgccgtatgagtagctcactgtgtctacggaacttgtacaggaaggcatgcaccgcagtggtgaatacactgttgacctggctccatgtttgcgttattgggtcgtgagcacggatctcatgtattgaaggatacttgtctagggaggtagtgcacggcagtggtgaatacacgtcgagctggaggcatgaattgaatgatcgggt

SEQ ID NO: 570356 - DNA, 173 bp, Homo sapiens
acacatacacatcatcacacacagacacacaccctgtgtgtatagagcataatgacgctatatgtcactcgagacgcgggagcagcaccagaggctatatatatctggtgtgtgctctgctcgtgtcacctcagttattcttctcattatatagtacagaatgtttataggca

SEQ ID NO: 570357 - DNA, 523 bp, Homo sapiens
  misc_feature (19)..(19): n is a, c, g, or t
  misc_feature (24)..(24): n is a, c, g, or t
  misc_feature (26)..(28): n is a, c, g, or t
  misc_feature (32)..(32): n is a, c, g, or t
  misc_feature (484)..(485): n is a, c, g, or t
  misc_feature (503)..(503): n is a, c, g, or t
aggcggtcctgactgttgngtttntnnngatngcgggcgctagatggatacatggattacattcacattcccttcccacgccaaatttcacaacgcatgggaaggcttctgcctattgtattaccaccactttaattcatggaattaaaggcaaatgctaaactggttgagtattttttccggtttgggcgtaaaccaaatttccggctactttcctcccatgacccggaggtcttcttctgatcttccatcctgatcaaagaccatccggtagtcgtccagatacgatcataatcggttattcgtaaatcaataacgaaggacggggtgaataacctgggactaaatctataccaccagagcccccgattatagcgcatcgttactgcctgactggctaacctgtaccttcatcaaaagtggtcatcacgtacccggggtttaccctcgggtgggtggtgggggcgggggcggaggggaaagnnggcccggggtttcccccncaaagggtgtggtggggtgc

SEQ ID NO: 570358 - DNA, 309 bp, Homo sapiens
  misc_feature (27)..(27): n is a, c, g, or t
  misc_feature (37)..(38): n is a, c, g, or t
  misc_feature (270)..(271): n is a, c, g, or t
  misc_feature (289)..(289): n is a, c, g, or t
ttaggtcctcgctatgcctgccgtgcnggttatttcnncgctgcggccctggggctatctaacgataacgaaaatgcagtcggagtgcgttcacgggctccccttatgtcgattaatacgttaaaacccaaaaggctgccaccagatgcccccgattatagcgcatcgttactgcctgactggctaacctgtaccttcatcaaaagtggtcatcacgtacccggggtttaccctcgggtgggtggtgggggcgggggcggaggggaaagnnggcccggggtttcccccncaaagggtgtggtggggtgc

SEQ ID NO: 570359 - DNA, 160 bp, Homo sapiens
  misc_feature (160)..(160): n is a, c, g, or t
cagggtgacccacgaggagccattgtggctagagctgccctctgtgctcagccctgaggacagatgcctccttcctctttttccttcccaaagcaagcaagaggccgtgctgctgtgggaaatggtactctacaattggctctacttccccatggccctn

SEQ ID NO: 570360 - DNA, 420 bp, Homo sapiens
  misc_feature (9)..(9): n is a, c, g, or t
  misc_feature (114)..(114): n is a, c, g, or t
  misc_feature (381)..(382): n is a, c, g, or t
  misc_feature (400)..(400): n is a, c, g, or t
gagctttgnctgcatgatagtatagttgataaactgcctgtgtatgatgtgctctaggctatctgtacgaaaaaagttacgcagccttagcgggagggtgactagctaaaaganttgcaataggttgggggggagggtttatcaattgtgcggctacttgatggcagaaattatgtctggctggttctgattgaggattaataggagctagattataatggtggagagtatattccgtgagacggtactaaccctacaaaccccgattatagcgcatcgttactgcctgactggctaacctgtaccttcatcaaaagtggtcatcacgtacccggggtttaccctcgggtgggtggtgggggcgggggcggaggggaaagnnggcccggggtttcccccncaaagggtgtggtggggtgc

SEQ ID NO: 570361 - DNA, 396 bp, Homo sapiens
  misc_feature (229)..(229): n is a, c, g, or t
  misc_feature (357)..(358): n is a, c, g, or t
  misc_feature (376)..(376): n is a, c, g, or t
tataggtacgccgaggtgaggttggagtagttggatggagtatgatgaaggaggatgaggacctagagctggaggggtagccggagctttttaaatgtaatacgcatttgcgccaagtttggcctgttttatacgtgattccttactaataatatgtgacgtgggggtagctttttgatatggatgagagttgggatatatttatgtagggtcaggcttaatattatgnatagcgcccccgattatagcgcatcgttactgcctgactggctaacctgtaccttcatcaaaagtggtcatcacgtacccggggtttaccctcgggtgggtggtgggggcgggggcggaggggaaagnnggcccggggtttcccccncaaagggtgtggtggggtgc

SEQ ID NO: 570362 - DNA, 126 bp, Homo sapiens
  misc_feature (13)..(13): n is a, c, g, or t
cccgtcgtccagncatcaaaaaaaaaaaaggcccctccaaaaattttccccacaaagtagggcaatagggcgggattatctcaaattccttaacaaagggagatagtcctagttcagggagttggg

SEQ ID NO: 570363 - DNA, 90 bp, Homo sapiens
gccgcggacacggccatgtattactgtgcgagagcacccgtggtacttccagttgtcatgccctatgcttttgatatctggggccaaggg

SEQ ID NO: 570364 - DNA, 110 bp, Homo sapiens
cactcctcaaaaggtcactggaacgggcgttcagcagatgtggtttcggagattgttctgctggtctcctgcatgtcttgttggactgttatgcgactcgtggattatcg

SEQ ID NO: 570365 - DNA, 660 bp, Homo sapiens
ggcacatgtgtccgtcccatctatcagatataagagacaggagcacgtgaggcccatctttgtgtaactgtagagagctgatcgggtcgtgatgtgccaccgttccctaggtggaggctgtatgtcatactagttccggggcatctatatacccacatatagagcaaacatgattatgagattgaagtatacatataacgggttactttatataccattgtgagctgtatccaagtatcccctcctttgaggcagtatttaatgacttatagtagattattttgcgagaaagagtcttgccctgtcgccaggctggagtgcagtggtgcgatctcggattactgcaacctctgcctcagccccctgagttgccaggattgtaggcgcctgccaccatgcccagctaagatacagtatttttaatagagacgcggtttcaccatgttggccaggctggtcttgaactcctgacctcaagtgatccgcctgcctttgcatcccaaaatgctgggattaaagacgtgagccaccacacccagctttgttttctttcttatttttttggcccagggcattgtttatatattttagtattcaattacaaataagaccactatgaacattcatgtacaagtctttgtgggcctgtgcttcattttg

SEQ ID NO: 570366 - DNA, 205 bp, Homo sapiens
caggccagcctatgagattaaatgcctcagagtagctgattgtgggaagagaaatgggcctacacattaatctatacttttggttatgttgaaaaataacgtgatgcaaatgctaggagtggttaattatagatagtaagagagtaagttgatgttttggttttgttgcgtgtgacacggtccacccaggctgggcgtgcagtgg

SEQ ID NO: 570367 - DNA, 958 bp, Homo sapiens
gttgtgacccccggtcggttgcccagtttgcgggtccgggttttcggttttccatcccgctggagattttctgggagccgacgtttgtcccccatgtgggggtctgctcccgcgggccacctcctttttgggggtttccgcggagattgtgccccccagggggggcaagcctgtccccccgcctgcgtgggaggagccaccctggtgctgttttgtagaggtctctgccctctgggtaatgttgtacgagttactccccctctgggattgtggccacatccctgttgaggaagcacagcgcggggaccctctcaccgaacctcgggctgttgcggacccctcggtcttcaaggggcgtagaccacgtcgtaggccacgtggttccccccaacgtgtgaagttggggcggtccccttttcttacgtggtgccccacgagttgcgactggttacgcgtgttccgtggtattgttctgtaccgccggtggtcacctctggttagatgactcaaccacttttccttgaatgggccgacgacactacttcgactgcaaatatctttggtgtttgtgtattccaccgcagccctacccttagtgaaccaacgtatttttcggttacactctgcatggaaccagcagtttatccctcctctctctccccaagtcgtgatctactgatggcgcacttctgatgtgtcttaattttcagaggtttttccctctgcagtttatcacacacacgcagcagcccaccacacccacatcatcacaatcacacacacacacacacacacacacacaccccacagtacccgtataagcatctgccatctgcttttcccaatgccatgcgtcctggtcaagctcccctcactctgtttcctggtcagcatgtactcccctcatccgattcccctgtagcagtcactgacagttaataaacctttgccaacgtta

SEQ ID NO: 570368 - DNA, 511 bp, Homo sapiens
  misc_feature (426)..(426): n is a, c, g, or t
  misc_feature (428)..(428): n is a, c, g, or t
agcacttgtgagccccttcctgcctgtctggggacgctgggacccttaccgcacggacattgggcctcagcctgccccgagctcctacagcatcagtggactggagggtggtcctgccattgtccagaaatcagccgcagccccggtgagcctccatcctgctcttgcccaccaggtattgggggcctgtggcagcaagatagggggagagagacccagagatgtgagagagagtcagagacagagacagagagagagagagagagacacagagagaggcagagagagagcgagcgagcgcgcggcagccgcggggcgagggcctttgccgttttgctggggcatgctgactgaaagggatttgtgtttttgctttttttccaaaaagatctccagctccacgcatgtttgcggttaaggcggggngncccccccttcccctcccccttcccctcccccttgggacgcgctctaaataattgcaataaaacaaacctttctctgcaaaaaa

SEQ ID NO: 570369 - DNA, 112 bp, Homo sapiens
tgggctaccccatggcccttgatggagtctgagctgctccaaaaaattctcgaggctccggatttctatgtgcagatgaaatgggaatcaccagctgggtgcccttaaactg

SEQ ID NO: 570370 - DNA, 883 bp, Homo sapiens
gcgcggggcggggcttccgggcggggcaggctggcttccggcgttagcggggccgcggattgccgcatacaggccagcgctcggggcttcgctcgcggttgcccgactcttgcccctcgagcgctgttccccgtcgccggcgccccgtctacgttgtcgggcgccgccatggagcccgcgcctcgctggctggcggggctgcgcttcgacgaacctgcgccctgcgctgcgctgccctgtgggaggcgcctgccgccctggtccctgatgggctgcccctgtcctgcgcctgcggccctgtgccctggggcctgcttcaccctgctgtgcagcccacccccgctgcgggcagccgcggcctctgtggcgctgtcaggagccctggccgctggcgcttgcttgggcctgggcgcgcctgccctgcgctgcgagggcctgatggccctgagggccgccgctgtttctttcaggcggggcaaacggcggcctcctgccggggccggccgaggccccggccggcggcacgtggctactgcggggccaccaaattcgggcccagttcgccggggccaagctgggccgacacgggcgccgccaattgtacccttgggcgcaggtgttgcccgggcggaacacggcgagcgcctgggagcttgcaggtccaggggcgccgtggcccaacgccctttcttccagggccgaacgggtcggcaaaggggtccttacggggccaaggcattccggggagattcctaattgcaggcgaaagccaattgttccaccctggggagttcccccaaccaacacgggtcccgtgcgcctgcggtcaacgtcctgagttcccacggtggttgcgcgacgttgttcttatgatggtaatccc

SEQ ID NO: 570371 - DNA, 841 bp, Homo sapiens
  misc_feature (94)..(94): n is a, c, g, or t
  misc_feature (108)..(108): n is a, c, g, or t
  misc_feature (119)..(119): n is a, c, g, or t
  misc_feature (121)..(121): n is a, c, g, or t
  misc_feature (130)..(130): n is a, c, g, or t
  misc_feature (136)..(136): n is a, c, g, or t
  misc_feature (138)..(138): n is a, c, g, or t
  misc_feature (140)..(141): n is a, c, g, or t
  misc_feature (154)..(154): n is a, c, g, or t
  misc_feature (160)..(160): n is a, c, g, or t
  misc_feature (171)..(171): n is a, c, g, or t
  misc_feature (179)..(180): n is a, c, g, or t
  misc_feature (183)..(183): n is a, c, g, or t
  misc_feature (680)..(680): n is a, c, g, or t
  misc_feature (764)..(764): n is a, c, g, or t
  misc_feature (822)..(822): n is a, c, g, or t
attttagatttgacaatcgtttccacatacactcagacaggcttacagaagaatttcaaatatcaaatagagaagctgttaattcacgcacggnatgtactttcagtnaaggcgtccangntgggagtantgcatnancnncgatagaactacntaaacncaataccgtgnttgttgannctntcaatcaactttgttttggaaaaagctgctccaggtgtgaagaccccgcccgccttaggcagatgagaagcatcacttagaagagtcatggctgcctgaaccatagctatgggggtagccacatagccagcctctggtcctttcacctgagtacaaattttgatatttggtttgttcttatctgtaccagtgccttggctgtatccttgaccaaagaatgtcagcgtgaatgaggcagcatcaatctgtttttgtgttgggccttgttttgaaaaatagccaaaggagaagaaccatgggaattttatgagaagttgccttccaattccaaacctcacaaagaacaaaaagaaaagtcctgcaaacatcagcttaataacagaggtgatgcctcccacagttacatacgcaggcatactgaaactggtgattcctctaaaattttcatacaagtaacggttgagtcctccttaacaacagacacatcagatccccantaaaaaggaatggaataacctttgagttccggcataagaattggccacttctcttcattttggacaatgagcggacaggtttanattgatacattcttagtttctcaattactctgatctcaaaacataaattgctgcttcnaggtacatcatgattctca

SEQ ID NO: 570372 - DNA, 338 bp, Homo sapiens
  misc_feature (218)..(218): n is a, c, g, or t
taagatcccgatcacgtgcacttgtgctgtcgcgtgggcaaatttctcacccctgttgtctgggagaaagaaactgcgctgagttgaagttgagaatgtggatacccgctcactcacacacactcattctcagagtgtgaaaaatacctgagcctccttttagcttggaagcatacagtaccatgtgtgcaaaggtacagcgaaaagtgggcttgagnaccagggtccatctttctcctcagtagacaaggccaggctgtcttttacaacaaagcaccacaggtgaacccagtccctcctcctcccccaaatcaggcatttcacaatggcacgtggat

SEQ ID NO: 570373 - DNA, 118 bp, Homo sapiens
tagatcccccaagcggcagttcatcgcgctgccagcctgcgaatccgcctgccagaattgaaacccgctcgacaccgaaataacgcagcatccaccaggcgcgcggggcggagaagag

SEQ ID NO: 570374 - DNA, 187 bp, Homo sapiens
caaaactgcaggaaaataaaacatgaaaactttttatgaaaaaaaaaaaacccccttgagtttcctgtcgtcttcttttgaaactgtagggcatatgttaaaacatgtatatcatttccagtattgagtcgtgtgcccctgctgtacctgatgtatccaatttggattaaacaaattatgtgcccca

SEQ ID NO: 570375 - DNA, 468 bp, Homo sapiens
  misc_feature (27)..(27): n is a, c, g, or t
  misc_feature (159)..(159): n is a, c, g, or t
  misc_feature (161)..(161): n is a, c, g, or t
  misc_feature (262)..(262): n is a, c, g, or t
aaggtgatggtaaatcttatttcggtnttaatgtgattagataatttcatcggggttttggattaacaacaacattgggtccccgttaattttctttcagtaacccacaattattttttagtatagtccattattgtttatctgaattttaattgaacnancaatcctagtttgatactcccagtcttgtcattgccagctgtgttggtagtgctgtgttgaattacggaataatgagttagaactattaaaacagccaaanctccacagtcaatattagtaatttcttgctggttgaaacttgtttattatgtacaaatagattcttataatattatttaaatgactgcatttttaaatacaaggctttatatttttaactttaagatgtttttatgtgctctccaaattttttttactgtttctgattgtatggaaatataaaagtaaatatgaaacatttaaaat

SEQ ID NO: 570376 - DNA, 237 bp, Homo sapiens
gcggttctggttcagggcagtaccgtgatttgccttattatatcacagataagtttcgattcagaattgggacagatactacctccctcattgattgaccccagctctttacgctgcccgctgctgcctcgtgcaatcttgctatggcacgaatgctattcgtgtacccttgctgccccagttgctggccttgaccgtacgatgtgagtatcacaggagcccgactttgtcccgctg

SEQ ID NO: 570377 - DNA, 426 bp, Homo sapiens
  misc_feature (49)..(49): n is a, c, g, or t
  misc_feature (151)..(151): n is a, c, g, or t
  misc_feature (372)..(372): n is a, c, g, or t
  misc_feature (391)..(391): n is a, c, g, or t
aaaatgtgggaaagtttggaacttcctagaggcttgttgaatggctttnacaaagacattgataatgataaggacaatgaaaaccaggctgaggtggtctcagatggagatgaggaacttgatgggagctggagcaaagatgactcttgtnatgttttagcaaagagactgatggcattttgcccctgcctgagagatttctggaactttgaacttgagagagatgattttgggtgtctgatggaaaatatttctaagcagcaaagcattcaagaggtgacttgggtactgttaaaggcattcagttttaaaagagaagcagagcataaaagttttggaaaaatttgcagcctgacctattatgataggaanggaaaaaccccgttttttntggggggggaattcaagctgggctgccagaaattt

SEQ ID NO: 570378 - DNA, 668 bp, Homo sapiens
  misc_feature (27)..(27): n is a, c, g, or t
  misc_feature (159)..(159): n is a, c, g, or t
  misc_feature (161)..(161): n is a, c, g, or t
  misc_feature (262)..(262): n is a, c, g, or t
aaggtgatggtaaatcttatttcggtnttaatgtgattagataatttcatcggggttttggattaacaacaacattgggtccccgttaattttctttcagtaacccacaattattttttagtatagtccattattgtttatctgaattttaattgaacnancaatcctagtttgatactcccagtcttgtcattgccagctgtgttggtagtgctgtgttgaattacggaataatgagttagaactattaaaacagccaaanctccacagtcaatattagtaatttcttgctggttgaaacttgtttattatgtacaaatagattcttataatattatttaaaaatgcagtcatttaaataatattataagaatctatttgtacataatattatttaaatgactgcatttttaaatacaaggctttatatttttaactttaagatgtttttatgtgctctccaaattttttttactgtttctgattgtatggaaatataaaagtaaatatgaaacatttaaaatcttaaaaaactaatatttcttatctttacttatcatcaaccttcaaattgaatttttttgggggggggcccggtccccattttcccttattgtgggtctcattacccccgctcattgccctgtcttttacaaccttttgcactg

SEQ ID NO: 570379 - DNA, 1731 bp, Homo sapiens
  misc_feature (1728)..(1728): n is a, c, g, or t
  misc_feature (1731)..(1731): n is a, c, g, or t
tctcaaaggaatggctttaatggagggtcacaggcatcacagggggtctggctcagcttcctcgccaccagggagaacaagtccttacgtggtgggccatgggggaaagaataatcttggcagaaatcacctcaaaccattcagattggtgtacgccagctcttctttacacaggcaagcctctaatgtggcgctcccgggccctagggtggaggctgggaagaacttctggcgtacacacaatcatgtgtaaagtacgctggcttctttggagcgctatccatggatccaccagggaaagccctctcgggtcttcacagaaagagtctggcacagaagtgtatcactctcgaagtccgcctctggcacgtcaagagtgcgggagaggtgttctgcggagacatgagagtgagactatcccacatagaccacacaagtgtgtggctgagaaaaacaagagacaagaacaaggacgcgaggggagagaataaaggggggaggcaacgtggggcacacccccaaagtgcgagacctgtggggcctctagaggaagagcttacaaaacatttctaaaccaacgtgtccaaggaaccacccctgtggagtatgtggaacacgcagcgacgagtggcttctatcacaaagagattatcgttcgcactacatatatatctctgaagggaagccccgcgttttcacccatcgtagtataacccccctttttcaagaagcaaatacaaaagagcaacaattttagagtgctccaccacacattgttggtgggaaacaccaagggtcaaaaagaggggcacatttctgtgagggcatatctattatctatattcacaggacacaaataattgttcttccacaaggacgattccctgtggaacaaggaggattaacgtggagcatacattgaagcaataagccaccaagatgtgacggcgaacaagagaagatttcccccgtaatcacacagggggaccttttaccacaccgagaggcagagcaggaagcaacgaggaacgtccttgagcatacagaaatagccgaggggggagggcccccaacacgcccgccagccatgagagcaaacagacacagcgcaacgagagacacaccgaccgtgatcaagcacgcgcagacatcaactaaagggagaggaaacaatcatcgttagaggaaagaaagcagaaaacagtgtcatccacagaacaggggtcggctagaagcaagcaacactcttgcgggagtagtcacgagagcacggggcgcatgaacaaccaaacatgtggaaagaaagatacaacctaagagaaacacccggacgaggatgaacaaacgggcgtcaaaccaagagggtacaccgaacaaagagagaacatcgagaaccccacgagtacctctaacgctggtgtacagacaaggggacaacaagggaacgagcatcactagagagtagagacaaagagacagcaacagaacaccagcgcaagacgactacagctggacggagtggcagagaagacgagacagacacagaagtaggctcaaagagggagcaaataacgggactatagatgagacagtagatacatagacaactatgagccaaagtgagagaaacaagacacaaagtcggcttagcagcgatagggcgtagaccgaagacacctaacacgaagctagcacagaacgagatatcacgtcgcgtcttatcgatcnggn

SEQ ID NO: 570380 - DNA, 718 bp, Homo sapiens
tggagtccagccattgacacggggagccaaaaagaagaaaaggaaacaaaaaaagaagaaagaaaaaggcagtgagacagtttcagcccaggtatcagccggtgaaatatgaatctctttgccagcagagatggatccatggaaatacagaaggccattgagctgttctcagtgggtcagggacctgccaaaaccatggagtgatggctagcaagcgaatgctaccagttctgggatacgcagcccgtccccaagctgggcgaagtggtgaacacccatgtgccccgtggagcctgacaaggacaatatccgccaggagccctacaccctgccccagggcttcaccggggatgcttgggacctgggcgatcgtggtgtgctaaaagaactgtacaccctcctgattgagaccttatgtggaagatgatgcacaccttgtcccgattggattatcccccggagttctttggggggctctccggccacccggcgggtccccccagtggccctgtggggtcgacgtggtctcaagtcggaaatgggtggcggttcattagcgcctatcccagaaacatccatttctatgcccagagagcacatggtgagtcacttccgtgttgtcccagagtggcgtccagagggttgcccatctgtccgaaatcccgcggtcccgggggctctcagcgtaccgcgggtgtcacagccgtgcccgttgtcg

SEQ ID NO: 570381 - DNA, 153 bp, Homo sapiens
cccgctgtttcagagctcttcagaaaaggacgacagcagtgcggcaagctggcctgtgcccacaggcctgggcggccagggcgacttgtcggcctgtttcggcctcgtctccggtagtcggcttgatttcgatattgctgtgaacctgattgg

SEQ ID NO: 570382 - DNA, 1412 bp, Homo sapiens
  misc_feature (761)..(761): n is a, c, g, or t
agcgtagggcgcgcctgtcaccgatcgtaactccccctgaagatccctccgtatcagcgccttcaatcgccgtgctcccggacaccccgtacccgaggcacacaagaaaacggagtctgcccgcaattcatcagagggattgtatcagcctcattcaagtcaagaagtccatcgcaatcacattctcgtcccctcaattcctattccttgggtgcatgcacatagcgatactgggaacaagtcccaatgtcgagagttctctcagtaacagatgccatatgtagcaagtgatgggagccctcgatagtatttagggtgtcttacgcactcggatgaagagctacatgacacttgtagcgtatcacacttactcggggcacgtgatgctaagctgctacgttgctttagtcaaaataggtcagacaacatgacaggaccttgcacatgcgaaggagaggattggtcgtacaagatacgccggtgaccagagctaacccgttgcttgtctgtacggcgacagcggagaacgcttgccaatcaccgacttgtcgtcgcttacacttcccatgggtttgtccctgataggggacggcacgagacggacaacatcggttgacagacagaccgttggcaccctcttagaagccagtcatggcgaccacgtttctaagacaacccaagccactggtctcctcccataaacttcacactttggcacaagacgaaggggaacacagaccaaaatacgcgcgcacattccncttgtctcgggcaagctcaacgactttcgcggcgagccaggcgacacagagcgtagggcaaggccgacaacacactccacgataggtaagatttcatcggacacacgcccattcccttttctctcacattgcgagtgtcgtaacccaatagagaatcttttaaaaaacatcgcccctacaccatcgccacttgtggggattcttggccgaatggtgcagcaccacggggtccactcttcctaccgtaaacgaaatccacaaccattcgaaaaatgccaccacaagaggggttacgccgagcaagaacgtgggtaacttgacaagcaacttcactggggagctgctggacgggttttttacgagcgcaccaatgggcccagtgccccatgcggcttcctattgagcacagaacaggtatatgcagcgtaaggcacctgttatgccccttaaccgcatcgcgccgaacgaacgcggccacagtgctgacaccccaaggaaaggcctacccaataccccggcgggaaaaaaatctcacaaacggggacttccacttcctggcacctgcaatcaaaaggggggaccaacaatacccccagtgaaaacacccggaccaaacaaccaaggcactactcaacgagcgacgcaattcaa

SEQ ID NO: 570383 - DNA, 917 bp, Homo sapiens
  misc_feature (802)..(802): n is a, c, g, or t
  misc_feature (813)..(813): n is a, c, g, or t
  misc_feature (843)..(843): n is a, c, g, or t
  misc_feature (849)..(849): n is a, c, g, or t
  misc_feature (884)..(884): n is a, c, g, or t
aaaaaaagaaaaagaaaaactctgaggaagagtcctgcgagttgtgggaaaaccttcaaagtgaaaaagatttttactgaatgtcagtataccacaatagaaacaaatttctatcttttctataaggttggaaaagctctagtcttattcagacataacctacaggaagagagttgtattattgtaagagatctaatgcagaacttatcagatattgtaaaaatcagtgtgggaggtattcagtcaaaagtcagaaggaaatgtattatcgttataatttcaaaccttaagaaagcctaaattaccaattgcatatcaaatttttttgataatgtaaggaaaacttaaatcccctccatatcctaattggcatttataataatatgacacttaaccctgacagctagagtcttactttatgctaatgctagatatctatttttaaattccacgtgtgtaaacatgctatactcttctgatattaaacttactaagtacataattccagtgcccccttttctcagaatttttttttgtttttaattttggggggtatagttttggttttcctagtgcacattagtttgtgcaagttcttgcaatgttcacagcaaatatagatttattttgctttgaataatgcagcccataaactttattggtttgaaagttcttcactaccatttaatcacagcttctaaacatgtgaaacaggatctttaaaaaaattttccatatgtcaaagtgtagagatgtttctagcagcatttatcttgtcatctatagattgaacacccctggnacagagctttnagacccttgaaattcctgagtggtaagagnaattangatgacaagccctttaacacacctgagtttatgtnaatgggttacttttggaaacagaccccaggagg

SEQ ID NO: 570384 - DNA, 501 bp, Homo sapiens
aaaaaaagaaaaagaaaaactctgaggaagagtcctgcgagttgtgggaaaaccttcaaagtgaaaaagatttttactgaatgtcagtataccacaatagaaacaaatttctatcttttctataaggttggaaaagctctagtcttattcagacataacctacaggaagagagttgtattattgtaagagatctaatgcagaacttatcagatattgtaaaaatcagtgtgggaggtattcagtcaaaagtcagaaggaaatgtattatcgttataatttcaaaccttaagaaagcctaaattaccaattgcatatcaaatttttttgataatgtaaggaaaacttaaatcccctccatatcctaattggcatttataataatatgacacttaaccctgacagctagagtcttactttatgctaatgctagatatctatttttaaattccacgtgtgtaaacatgctatactcttctgatattaaacttactaagtacata

SEQ ID NO: 570385 - DNA, 457 bp, Homo sapiens
gaggtgactctgaggatcccgatcacgtgcattgtgtgtgatgttccccttcctgtgtcatgtgtctcattgttcaattcccacctatgagtgagaacatgcggtgtttggttttttttgtccttgtaaaagtatgctgagaatgatggtttccagcttcatccatgtccctacaaacgacatgaactcatcattttttacggctgcatagtattccatggtatatgtgccacattttcttaatccagtctatcattgtcggacatttgggttggttccaagtctttgctattgtgaatagtgccgcagtaaacatacatgtgcgtgtgtctttatagcagcatgatttataatcctttgggtatatacccagtaatgggatggcggggtcaaatggtatttctagttctagatctccgaggaatcaccacactgacttccacaatggcacgtggat

SEQ ID NO: 570386 - DNA, 971 bp, Homo sapiens
  misc_feature (856)..(856): n is a, c, g, or t
  misc_feature (867)..(867): n is a, c, g, or t
  misc_feature (897)..(897): n is a, c, g, or t
  misc_feature (903)..(903): n is a, c, g, or t
  misc_feature (938)..(938): n is a, c, g, or t
aaaaaaagaaaaagaaaaactctgaggaagagtcctgcgagttgtgggaaaaccttcaaagtgaaaaagatttttactgaatgtcagtataccacaatagaaacaaatttctatcttttctataaggttggaaaagctctagtcttattcagacataacctacaggaagagagttgtattattgtaagagatctaatgcagaacttatcagatattgtaaaaatcagtgtgggaggtattcagtcaaaagtcagaaggaaatgtattatcgttataatttcaaaccttaagaaagcctaaattaccaattgcatatcaaatttttttgataatgtaaggaaaacttaaatcccctccatatcctaattggcatttataataatatgacacttaaccctgacagctagagtcttactttatgctaatgctagatatctatttttaaattccacgtgtgtaaacatgctatactcttctgatattaaacttactaagtacataattccagtgcccccttttctcagaatttttttttgtttttaattttggggggtatagttttggttttcctagtgcacattagtttgtgcaagttcttgcaatgttcacagcaaatatagatttattttgctttgaataatgcagcccataaactttattggtttgaaagttcttcactaccatttaatcacagcttctaaacatgtgaaacaggatctttaaaaaaattttccatatgtcaaagtgtagagatgtttctagcagcatttatcttgtcatctatagattgaacaaaaagtggtagctgtgaaattgtgatttataataaatacatatttggtcttcatcccctggnacagagctttnagacccttgaaattcctgagtggtaagagnaattangatgacaagccctttaacacacctgagtttatgtnaatgggttacttttggaaacagaccccaggagg

SEQ ID NO: 570387 - DNA, 444 bp, Homo sapiens
atccgccacactatttcttcacataccgaatcaggattgaaatgtcaagtgatgctcttcctgagaaggcctgtcagttggacagtcgctactggaggataacaaacgctaaaggggatgtggaagaagtccagggacctggagtagtcggtgaatttccaattattagcccaggtcggatatatgaatacacaagctgtaccacattttctacaacatcaggctacatggaagggtattacaccttccattttctgtactttaaggacaaggtctttaatgttgccatcccccgattccacatggcatgtccaacattcagggtgtctatagctcgattggtaagttaattttttctcctagtgctggatatatgactttgttctaagaccaaccatctttgtttcggtagataagtagtttataatgatgtccctcctccaa

SEQ ID NO: 570388 - DNA, 388 bp, Homo sapiens
gaaattggccatttctcacccagaaatgccactcacataaatcttcacagcagctttatttataatcactaaaaactggaagcagctctccctctccctctccctctccctctccctctccccacggtctccctctctttccacggtctccctctcatgcggagccgaagctggacaacatagagaggccctgtctttacaaaaataaaaataaaaaattagctgggcatggtagcatgtgcctgtagtcctaccttcttgggaggctgaggtggaaggattgctgaagcccaggaattgcaggttacagtgagctatgattgcactactgcattccagcccgggagacagagtgagactgtctcaaaaaagaaaaagagaggaagag

SEQ ID NO: 570389 - DNA, 360 bp, Homo sapiens
  misc_feature (74)..(74): n is a, c, g, or t
aggactggcaaaattgacttaaaatacctcttagtctagtcctcagtcttcaggaaaggtagaacggactaatnggtcttttaaaaacacaccctcaccaagctcagccaccaacttaaaaaagactggacaatacttttaccactttcccttctcagaattcaggcctgtccttggaatgctacaagtcatactcctattcaccgttctcagctactcatacatgccctgctcttgtttacactgccggtttacactgtttccccaagccatcacagctgatatctcctggtgctatccccaaaccgccactcttaactcttgaagtaaataaataatctttgctgacaggaaaaaaaa

SEQ ID NO: 570390 - DNA, 326 bp, Homo sapiens
  misc_feature (93)..(93): n is a, c, g, or t
cctagaggacctcgcttttgataggcaatataacagtaatggcagcatatgtctcgatattctaagatcgcagtggtcgctgctttaacaatntctaaagtcttttatccatttgttcactgctatgtgattccaaacccagaatgaccccctagtgccagagattgcacggatctataaaacagacagagataaggaccaacagaaataatcctcggggaatggactccaaagtattggccccggtggaggcttaccttaaaagtcaggaataaccctggcattatagcctgggaataaactttaaagttactggtccctttttt

SEQ ID NO: 570391 - DNA, 1797 bp, Homo sapiens
tcttttgttggtttttcttagttgctgggtgagttttttcactattcgctgtgttttggttgcgtgtcgtgtacctcttggttgtgtgtgcgtcggtgatttactgttgtgtgtcgtctgttttgctctcctctggcttgttgtgcttcctgtgcccccttgtggtcgcttgtctctctgttctcgggtttttcgtgtgttctcttcttggcctttctgttgtttccgcgattggtcctcttttcctgggtgtggcgctgttcttggcttgtttggtctttttgtctgttgatggctagtggtgggttggttctagctatggtatgtggtgtcctagtgcctctcgtttgtgtgctgctattggttggagtgcttgtcgtgtggtccttcttcttgtggtgttagcgtgtcgcaggttggtataattgtgccgctctggctctgttcgtgtgttgggatagccgtttgggtcctttgcggtgactatttcgtactttgttgtttttctgtacctcgtcctctgtggggttgctccagtggtttcgatgtcatgttcccgtgcactcgttttgcctccttgctcttctccatcgtgttgctcgggggtggtcctcttgtggcacgccgtgtttgctcgtaggctccctcgtggctacttgctgttcgtgggtgtgtgtgggtgttgcgcccatcgtggggtcgttgtgtcgatgtgcgttcgtgcgcgtgagggcagctgtgcatggttgtggctcgtttcctcctcctctgtgcatagctgtggccttttctgcggatgttttgttggtcgcttccgggcttgtgccgcttgcttgcgctcctttgcccttgtgtatctatccggccactcgtgtggggtggtcctgctatgtcgtgcgccagggggacttaccccggctggttctcccgtctgtcgcttttgctccgtcggatattgggtctatggccatagggtggctctcaatgtcgtggttctccctctaggctccgtcgtcaagtgcatctcgaactcgtgcctcctgtcgtgccattagttatcaaggtcagtcaaggggaacattatgctatgtctcgaagggtgtatctggcggcctatgtctgtcttgtgcgtgtgtacgggtacgataatatcctgctcaagcgaaccttggatctgtggcctgcctaggctatctggcactagactgtccacggctgttgcggcactatgcgagctcttggtgctggtgcattcgcgcagtttaggacgccagggaccccggtgtacacatgcactagtaccgcgacgctaagtgtcacatgcgcctacacgggcctaggcctgcgctcatagcgcacaacgtacatccgagaccacgtgcgctcagtagggtgcgctgctgtggatgattgacctggcgcatacgacgtgggcactcttacgtgctcagggcatcaggcccgtggtagtctcgctggagctacgatgggtccccttatgaggagcgtgctacactaagtgcacctcgatggggcataccagctccgtgcacagcatacctcttcggaggaagctaggagtcccagagaggcctgcccctagctcaacgagctactctgatggcagaagctccaggcccctagggcctagcgctgggggacctgaagggggctgaggggattgatgtggtggttcaggatagccccacccatggggggtggatgatttgcactttggttgccctgtgtttgatttctcattaatcagtcgactctgttctccgctgtcttgctttg

SEQ ID NO: 570392 - DNA, 209 bp, Homo sapiens
ctagaggtatccccccgcagtctggggcttggttcccccaggcctacccaggctggttgcccgtgaccaccaccgacccagaggcgtgggcgagccttgtaacatgcttcctttcctgctcccgttgggtggcaccaccccaggacctgggcagcgcttgccgagctgcgggggtacccgagctcgaacttccgtaatcgctaagtcat

SEQ ID NO: 570393 - DNA, 194 bp, Homo sapiens
catagtccgtctattacacgtcaaagtaagcaggcctcatggaatcaaactggatcacagtccatggcgtgcatatctcagacagaaaaaaatgacaacggaagaagtgctgaagctactcaggaggccgaggcaacagactcacttaagcccagatcaagggtgcagtgaaatgtgaacacaccactgcacgc

SEQ ID NO: 570394 - DNA, 941 bp, Homo sapiens
catactgctatgaagaaatactggaaactgggtaatttataaagaaaaagaggtttaatgtactcacagttccacaaggctggagaggcctcagaatcatggtggaaggcaaagaaggagcaaaaaggtatgtcttccatggcagcaggcaagagagcacgtgcagggaaactgccctttataaaaccatcagatttagtgagatgtattcactatcacgagaacagtatgggaaaaacctgcccccatgattcgattacctcctaccgggtccctcccacgacacatggggattatgggaactacaattcaagatgaaattgggtggggacgcagccaaaccatatcgggtagcaacaacctagggtcagttttgcaggtggtaaagccatttaccaagatagttgtaggtaaagaagggcagatttattagagaaattgtgaacaatatgttgcagtgggcaagctcagcagagaaggggctacctgccaaagaggcaagggctggaggaaagttttatagggtcctggcttgaagggtgctaccgtgtgggaatgaggtcattgtgccgcaggttgtagtgattagctgtctctaacaatgtgcatacaatatggttcattatggtcctcaagctggggattctcccaaacctggggacccttcccttattggtggttacttatcagggttccaagttaagggtcgcaacttcatcattcattttctcaccaaatggtagtagctgttttaaacctgtgtgacacaatttgtccagccatattctatactctcaaataagggggggtaaaatctgagaacagttcacggtcatatcacgtgaaaggaagaacacaatcaggatagggaaaagcaggcgacaaggagaatgatagcaaggggatcaacacatggttgtctacagaaggtacctaggcca

SEQ ID NO: 570395 - DNA, 826 bp, Homo sapiens
gaagcttcagactttagctggcagctgcctctgttcagccacttgcaacacaattgtttccaagctctctaaccatgttgaacccgtcaaacagaagaagaatgttggatgggactaccgagattagcggatgactgtgactggaccgactgtcttaagaccactggagcgagttattcagtactttagtgttgagcaagaaattcagtctcagagggcaatcgtggtatgtgaatgtgcccattcaagttgcgtgcagctattgctgcttgtcaatgcgattgctaggggcatggtggtttgctggtaaaatgcataacagcagcatatgtacctcttccaatcttactcataacctgtttcctgattctatgacagcaacacagctactggttccaagtagacgatgcaaggaagatatagtcccttatgtatatagcgttaattgcttctctgtgagaacttcatctttgagtctatctcttaatctagatacaaggataaacgaggcgaggatctacggtcatttgtatgcaatttcctgttaccttgaaaaaataaacactgttaacaggaatgcagtgtgctcattctccctaaatagtacatcccactgtatacaaaactgttctctggttctgcctttcaaaatgttcagggtagacacattaattgaactataggaatagcctctaggagaacaaatgtgctttcctgtcaaaaggcagaccagggcatgtaatgttttcaatgtctcagaagctaacttttacacagtgtttacatttcacattcactaatgtgcttattcggctgatggtgagcg

SEQ ID NO: 570396 - DNA, 299 bp, Homo sapiens
gggtcggcagggatagaaagcttggttttgggccaggcgctgtggctcccgcctgagatcccagcacgttgggaggctgaggcaggagaatcgcttgaacacaggaggcagaggttgcagtgagccgagattgcgccactgtactccagcctgggcgagggagcaagactccatttcaaaaaaaaaaaaaaaaggccggtttgacccattgtcccgggcctcattaatggggtttttttttaattgccactctttgtaccacctttgtggccgaccccgggggtactcttcttagagct

SEQ ID NO: 570397 - DNA, 1992 bp, Homo sapiens
acaaaaaaaagccagaaaaagtttacttttctggagtcccaaacgaggtgctgggacggaagaggggtgtgaaggcccagaggctcgagggacttcaagaaccgctagtctaggagtcccacctataccaggccatgtacaggggacacaactggctatgccccacgaagacaaccggaagacccagaccagaagccccatcagcgagagaggcgatcaccccagagagaaccaccagagagggaccaaaagatcacgagccaaccacaggaacgccaagaccacatcccaggcccacaaacacaccaaaggctatccactaattagaccaccccattcacaaacgtggacacacagagataaaacccaagaggcacaccaagaggggaaacacagaagacgcatcagagaggagcccatagaactgattgaaaaaaagggcaaagtacaacccataatagacagaaacaatacaaagagcaaaaaacatcacagagagggacaataccacattgtataaggcaccaaacggagttcagaggcccaattaccacgcccacagttgacaaaaggccccttagacaaacaggcaccacaagtgcaataatgaccttatcaccgttagaagacaaacaaactggcaacgaggcccagccagccaatggaaacgtgagcaacgagcaccaacgagagaaccacaatgcagactcaccatggagagatccccaataacaagcgaaacgagggaacaataatatgacggccccacccacgaacgaaagcaaaatccatagtacagaaaatcacggcacacccgaggagcaactccacctctgacaacgaccacaaaaaacataccaaacgaaacattacacaatccgctcatctcccaacagcaggggatcaatacaccacaacaaacttgtggagagggcacgccgacaagaagattatcaaaagaagacatgacatgtagacgaaggataacaccacgagaccaatgaaacagcccactggagcttgaagacacacatgaaacagtttcccacaggatggacgcacaattaaacagcgacggtgcaaccacagccacacgaaggcacgcgaggcaattgcaaggagcacaacccaaccagagtcgagaggaacagccccatacatcataggaacacacgaatcgtgtgagacaccataaacccacgaggataaccacaaaagatacgaccataaatcacacaaagggcacaagcagcagaacaaagacataaggaagcacccaggcacacataaagcagcccagaaaaaacaaacaaagggacaatacgaggccagacaacagaaacacgagcgagcaagaccccatggccacctcacacaataggaaacaaacaggaaacaacaggcaaccacgatccaagagcacacaacaccaaacaccaagatgaagagcagcgcacaagaagtatcaaacatataagccagcccgcaagagtaaaaacacagcagcaaaacagagagaggagacaataaagctaagagcaagatagaacggacacgacaaagagcacacacacgaaaacaaagagccacaacagacataaacagaaggagactacagaacacacaagtacagcaaacagaaaaacgacaaaaagaggcaagacacactacactatctaacacaccaataacatacacaacaacaatcaaaataacataaacatataaacaaacataaccttaacaccacactccaaaaagaacactaaatcaacaacaactacatacaaacaataacatacaatatacaaaatagacgactacaaacaaaatcactatcatcatccaaactacattaacatataaacaataccacaaacaaacaccaaaacacatatactcatcacactaacacaaatagcaatacaacaaacacacaaacacaataactacatactaaaccataacctaacagcaaacataacgcaaaca

SEQ ID NO: 570398 - DNA, 218 bp, Homo sapiens
cgggaacagggcagtgccgaacagtgaattagcagaacgatttggaaagatcggccatagcgggtgacaggcccgtatgtcgaaaagtgaaatttgtcggacttgagtaggggggggacacgtttaatccttgtctgaacataagggggagcaacctctaaggctaaatactcggtaattcgacccgatagtgaacttggtaccggggggtaggaggt

SEQ ID NO: 570399 - DNA, 299 bp, Homo sapiens
tgaggctctcgaacagctccaaattcagcagttccattcccagatagcagcccagacctccgcttcagttctagcagaagaattacataacagtgattgcagacaaaggataagcagataacacagactgaagattctttagcaagtgaaacgtgatcgtttaacaagtaaagaagaggaacttaaggatatacagaatatgaatttcttattacaagctgaagtgcagacattacaggccctgcaaatgagcaggctgctcctcacaatgaatttggccattaggaagggccataatg

SEQ ID NO: 570400 - DNA, 360 bp, Homo sapiens
  misc_feature (127)..(127): n is a, c, g, or t
  misc_feature (135)..(135): n is a, c, g, or t
tttgtgtactgtaatgtatgcagaatcgagagtaccaggtatgctacaggctgtcttaaggtgtcagggggtaatgaattcaccaagtatcagcagtgcatacatccaccacaatacactctttgtncttctagnctttagactatattgaaaaaggcggtgcttccaaaggtacatggataaggggacactatagctgtcatgggattagacttgagaacttttgctgttcatttttaaatattattttccaggtccttggcttaccaagggaggcccaattcactccaatgttttgagaactgtggttaaatacacgcaagtgaaagaaaaatgttggtaccgagcgtccgggtaccg

SEQ ID NO: 570401 - DNA, 232 bp, Homo sapiens
cgagagacagatgacatatcgcgtggagcgcatgtgaaaagagaggagggaaggcaagcatctggagcagctcacgtcagggcatcccggagtctctaaacaagtctacccctggggatctaggaggaagtcgtccagatggaacctgaagatgctacagaggaacatcgagtggataactaagaactaggagaataggagtctggagactgggagccttcacttcggcctc

SEQ ID NO: 570402 - DNA, 292 bp, Homo sapiens
gcattaccgttcttatgcggcgcatcacctgtgggtcctatgcacagatccaagccgtccttattcttgccgagctgaatcactccgagcaaccttctagtgtaacgaacacatcaatcacgtcatcgtcacagtcgcatgcatctgtaactaatctcctacatagaaatacccatcataatcgtagggttcgtcgagtgactaattcccctaataatcggtgcccccgatatggcgtttccccgcataaacaacataagcttctgactcttacctgccctctctgttatct

SEQ ID NO: 570403 - DNA, 327 bp, Homo sapiens
agtctcatacgccaagtgagtaaggaatgggacagtgatcggacggaacagttctggagttcgagcaacaggtttgctggcagagagaccgagatcatcttccagggtcgtgacttgcacacccctggcgcctcgcagtggtactggcttctccacaacgctccctggtgggcaccccaggcttcacgctgcggggagggcacagaggggagcaggcaggctggcaaagggctgggctccagccacgctgacgtcacacaggcctacctggtgccggtccccacttttacaaaaaggcgttctgtgaagtgttgacgactttgagct

SEQ ID NO: 570404 - DNA, 276 bp, Homo sapiens
tgctggggtgactcagaggatccttttcggtggcctttcccaaataatgttttcgtatgctttgttgaagatcagtggttgttaagtatttgactttatttatgggttctctactctgttccattgatctaagtgctatttttatacaataacatgttggtttttttgggtttgtttcttgtttttcggtttggtttggtttggtttaagaaagagtctcgctctgttttgtaccaataccatgttgtttttttggtttgggttgggttttgggtt

SEQ ID NO: 570405 - DNA, 644 bp, Homo sapiens
ccctgtccatctgcgcaccaaggagcaaagtggccattacagtgcctgctccacagtttgggcaccaccggcaccctcgtgtgtggagagtgggagcttcttcagatgaggagtctggaggcacaacttgtccaccatccagactttccagactcgcaccaacgtgtcacggacatcagagcagtctatcctgcacccgccagccgtggatcctttagccaagtggtccagtggttccggggtgccggtgatggggtctgagatgcccgtggaacccacacagctcacacagagagtcccaatccaaggccatccactggcacccagtgcacccatcaaacagacgcagcacttatcctggtgaggacgtgtgccatgttggggatcgaccggtccattgctcgagtagatagcaagaatggccaatcgacgctgaaagcgaagagtgtgcactattggcgcccttggagtagtgtgccattggcaacgcaatcaagacggcatccctcgccaagggaccacgcatgataagcatgtcaaggtcccacctccacggagcaaaatggacctaggggacttataggaccggaccccgtatcaagataaccactgaagaccagaaaatcacggaagaagaatccaag

SEQ ID NO: 570406 - DNA, 901 bp, Homo sapiens
  misc_feature (120)..(120): n is a, c, g, or t
  misc_feature (130)..(130): n is a, c, g, or t
  misc_feature (169)..(169): n is a, c, g, or t
  misc_feature (185)..(185): n is a, c, g, or t
  misc_feature (901)..(901): n is a, c, g, or t
gagctcaggcggcgggcgcggctgggatggcgaagagcaacggagagaatgggccgcgcgcgcccgggcggggaaagcctgtcgggaacccgggagagcctggcccaggccccgagccgnaaccaccgangaactcagctctctcgggtctgactcggaggccaacggnttcgccgagcgccgantcgacaagtgcggcttcatctgtgggctcgcagggcgccgagggcgcgctggagtgaagtacccctggacggtgcgtgaggctagagggagtccatcggtggctggactatgctctaactaagctgggactaaatggattggcctaggaacgcggcagaagaaggattcggccttgcgggtggccagaagggtgcattcccggccgtgtcatcagtgcgggggccgatgctgtggcatgtaccgttgtcagggagggcaacggctgaacgttgacacgcaggaaccgctgggaaaagttatgaccgagcctggaccatgtcccgctgggggaacccacaaggtggacgtgagacgttgacttgaagcggtgactctgtcagaccggcaaggttccccgatttccagtgacgactggtaagtgatccgcggtggggggccaacgtgccaaggcagtgacgctaattccagtgtggcgtgagagggcctagcagcgactggtacccaggcgccgaaggaagggggctaccttgcacagggcctcagggcaggccacatttgcccgactgatcattgctgcatggcgatattgccatgcttgaggcaaggccgttactgagtgacctgtgtacaagatctggtgagacagtacctggcccgggtactacatgcgacgaaactgggagtgcgatctccagctggaccgggggagattctn

SEQ ID NO: 570407 - DNA, 336 bp, Homo sapiens
ttaagtaacaatgagatcagcagatatgtggtgatacttacgacgatgatttggggacatccatttagctcctaagccaataataggaatctctcattttgcttgctaatgattggcttagaaaaggacatgagaaattttttaaaaaatattttttgccgcagaggtcttgagagatgcttttcctcacttttaaaaagaggcatccagtctggccaacatggggaagccccatctctacaaaaaatacagaaattagccaggcatgttgacaggcacctatagtcccagctactctgcagactaaggcgggaggattgcttgagcccgagaagc

SEQ ID NO: 570408 - DNA, 852 bp, Homo sapiens
aatttaagccattgctgactcattagcctctgtatttgtgtgcatatcatattatccagacctgtatgttcgcttttaagcattcttatatcacactgtctcctcatctaccgaatatggtaaatgttaaaacgccacatttgtctgcttcagggacaagatgcatgggcacacatcctccctcgcctccctctctgactgctcgctcccttcctgtacaggcctgcttgagcgatgtttgttttcgccatttctgatactactactccatgctgaagattcgccatatgactatttggaaagcattgagtgatagaactcctagaaagattatgcaaagaaatgttacatactgtatatcaaactctcagatttctagtgttgaaaaagtagactatactgtgttattatttatactctggtgccataggaaggaaataagtttattcatgacagcatttactatttgatcatataagtaaaagaaaagaagggcggctttttggagttagtcatggtagtcattagtgatatttctgaacagctcttcacttcaaaagtacgttcaaaggaagtataggtcatggctgtagcttgaaggaaatgctccagcaacattggactgtgttaaacgcatcagtacagtaatacgctgtgtatgttatgtgtatttatcatgagaatgtcttggcatcaattggagcatgtgcttcatcaatatactctactttgaggacaaaaattagtttaaagcgtgtcttgtttaaagccaagtgttccatgttggtgtgaaagaatagctctttcaaatactttggaaagtaagttgattgggaaattgttaaggtatgc

SEQ ID NO: 570409 - DNA, 213 bp, Homo sapiens
agatatgaagccagagtcagtatgagggtttcgcagctgggcatgtatgtccgcgttgcgattgaaactgttccctgtgaattagtgcagaactttgaccccctattaccccattatcctgggtggcttgggcaacagtgaaggcaatgttggacacgtgccgatgcatctgaagcaacatcgctggtataagaaaactctcaagatcaccaa

SEQ ID NO: 570410 - DNA, 116 bp, Homo sapiens
ttaaatagggaaaatcgggctctaggggggtgtgtctggcaaatagggtaaaaggcgccctcctagtgggggggtttaaagggggcgtttagaaaaaagtggggggcgcgccccta

SEQ ID NO: 570411 - DNA, 780 bp, Homo sapiens
  misc_feature (112)..(112): n is a, c, g, or t
  misc_feature (548)..(548): n is a, c, g, or t
ataggttgtgtggttgggtgtgaatgagtgatggtagtaggcgctaggatgatttgttgagccgagtgaatataattagagatataagtattagtgatcaggttggcctttntggtgtgaatagctattatttgtttggatgttagttggattaatcattgttggatcgagattgtgcggttattaatgagtcgtttgggtgttgggaatagtaagcttgggaatataataattaaggtgacaataggtagtcctattatcgtgggggcaataaaagaggcaaatagattttcgttcattttatttctcaaggggtgctatgtttttgagttttgagttcggttgattctgggcttgctgggtatgagtagtttgagatttttagttggaataaaataaataatgttataattattgatgtaattgtaatgaatcatgtggatgtatctagttgtggcataccattgaggggagatttaggctcccgatctctaacttaaaaggttagtgctgactagcttctcaatgaacctgttaatattgatgtngaccatttttcgaagtactttaatgggacaagttcaagtacaatgggcatgaagctgtggtttgatccacagatttctgagcactgtccgtaataaaggccaggtcgtgtggatattagagttgtcaggttcagtcgtcctgggatacctctggtttttaaaccgagggatgggacagctcatgagtgtagtacgtcttcagaggacactaatattcggattgttatttcta

SEQ ID NO: 570412 - DNA, 800 bp, Homo sapiens
cgcatcatccttggtacaagggtcacatgtccgcgagcccgccgtggcaccaggtctttcccgcgagggcctcccgcctgcaggtcaccatcgaggccctgagggaccccatatctggagggtctttttcccgcctggaactccttctggggaggactttccctgcctgccccaccccagggctacttcctgacccagagttttccccccgagacgtgggcgcccatggcgagatttgcgtcacacgtgctccaagagggactgacggctgaactgggcatccgacacgtactgctgaccctccagtgcctgctgagtccccccttaccccgagtcttgcactccacgaggaggcgggccccctgcttttggagaactatcgaggagtatttccgctcgggcccctctgctcacccgagaatccccgggggcccccgcgggcccacacggcacgggccgaaacccgtcgggcctggcccatggcaactgaagcgttcctcccccgagccctggggcccccagggggccccggaaagggctgagggtccccatggcccagaagcaatgctggcgagcgcgataaagaagctggcggcccagaaaaagaccggaccagaaagcgggcgctgcggcggctgtagatgggctttcttcctccttcccccgtgacccccacctttcctgtcccctccctcccaatctgtttttaaattatttaaattatggctggggtcggcgggagggtaccacgggggccctgggacctggatttgtttttttaaataaagttgggaaagcca

SEQ ID NO: 570413 - DNA, 428 bp, Homo sapiens
  misc_feature (10)..(11): n is a, c, g, or t
  misc_feature (24)..(24): n is a, c, g, or t
  misc_feature (26)..(26): n is a, c, g, or t
  misc_feature (29)..(29): n is a, c, g, or t
  misc_feature (361)..(361): n is a, c, g, or t
  misc_feature (415)..(415): n is a, c, g, or t
  misc_feature (426)..(426): n is a, c, g, or t
gcctgggtgnnctgtcacccagtngngangcacatggcgcgatcatagctcactgcggtctccaactcctgggctcaagcaatcctcccacctcagcctcctgagtagctgggaccacaggtgcaaccatcatgcctggctaatttttgacttttgtagaggtggagtcttgctatattgtccagggctgctctcaaactcctgagctcaagggatcctcccgccttgacctcctaaagtgctgggattacaggcgtgacattcggcgcaggtcctttaacatcggctttttaataagaagccctgaggagaagcctcctttgggtgagggaggggagcaccgggagagccaccttttgantcccttgagggttcccgttggcaacaacttgccccgagccaggaaccgggcctngggggggccgnaa

SEQ ID NO: 570414 - DNA, 318 bp, Homo sapiens
  misc_feature (25)..(25): n is a, c, g, or t
aagaagcatttgccatttaacaggnaatttgatgtcaatacttcagcaattcaggtcataattgagcatattggaaacttggatcgggcatatgagtttgctgaacgttacaatgaacctgcggtctggagtcaaattgcaacagcacagttgcagaaaggaatagtgaaagaagccattgattcttatatcacagcagatgatccatcctcctacatggaagttgtacaggctgccaatactagtggaaactaggaagaactggtgaagtacttacagatagaccgtaagaaggctcgagagtcctatgtaggagac

SEQ ID NO: 570415 - DNA, 584 bp, Homo sapiens
ccagaggatccccaggcaaagctctactcctccatttacaaaccaaggtatggaatcataatctttaagtcaaccagtttataaatcttcatctttggtgcttccctctccttcacccacacattcagataacttgcgaatatttgttgattctacttctgtgcttgcatatgaccacaacttttaccctggtggagcttttcatcacctcgtctatgctactgcaatagtctcttagttgaacttttggcatcccaatcttgcctccctcatcctcttatatactgtcactagggttctcttaagcacaagttcaaacagatcagtcccttccataaaaaccaccaaggactcctaattctgaaaaatagaatgtaagtaaggatctgacactaagtaaacagagcaaagacttgggctcatctcaccctccaagctctggtgttgccctattcttttttactcgctgattactagtcaggcacttccatgttcatgttttcctcagcctaaaaggttcttctcctgcttcaatcaaactcctatttatacttcaagtctttcttcaaaggtttcccacaaaa

SEQ ID NO: 570416 - DNA, 592 bp, Homo sapiens
ggagaggacgaaaaaaataaccgtccgcgacgccgagagaaatcgcggacccgcaaccaccagtgaacagcaagaggtcaatatcctaagcacgagccaatcctaccctgtgcagcctccgtgggtaatccagtataccctcagaccttgcatcttccgtcaggctccagcctataccgatgctccacctgcctactcagagctctatcgtccgagcgtttgtgcacccaggtgctgccacagtccccacaatccccatggcttattatccagtcggtcccatctatgccacctggtctccacagtgctggatggaaggagggtatgatgcaggtgcccagattgggagctggggctactgctggcgataattcctcctccatctcctggatgctctctcccaagtgctggctcagctttgcagtgcattgcagggtagccaagcggtcctcgtaaactcagcggcacggggagaacttctttcatgggtggttcagactggggggctagaccatctgggtgaaggaaaccaaggtcaacctctgtgccgggaaagacatccaatacctttcagcaactttctcaacaatgt

SEQ ID NO: 570417 - DNA, 173 bp, Homo sapiens
ctctactagccaacttaaactccagcaccacgatcctactactatctcgcgcctgaaacaagctatctacttgaagtgccccctacattttcaggcatttttcccccaataaggtgacagctgctcacaccggataatacaggaaagttgtaagttcaggttggagatacatt

SEQ ID NO: 570418 - DNA, 476 bp, Homo sapiens
agttagcaagctatccggttcaatcaggtatgtagttatatagcacgtgtagaaggctggttgcccaccctaatcttcttatgcagctgggctttcccgttgatctgcgccatcttgtctgctccttacaatacacgtagctggcagagaagggaagatggaactgccatcttgaaaatgtctagtccttagttcctgcaggcattcacctatgcaagctcccagcttgtaggccgctctttgttagaaaatgatttggggctgctttttattaaaaagaaaagccttaccgaggactcccatactcttgctaatctgtctaagtaatttcttcttaaactcctataatcattatgatatactgtccctttgctgcatgaatctctcatgaattcatttctccctttccatttgcgggttaacctaaattcatttaacctttattatctggtcatttggatatttgcgggtaccga

SEQ ID NO: 570419 - DNA, 265 bp, Homo sapiens
aaaaaaaaaaaattttttgggttttttttttctaattccccccccggtgggaaaagatttttttgttttttgccccaatgggagggggggaaatcctccccagggccctttaaaacgggggtttgggtgggtaagggggtttaaattttttcccatgggttggggggatttttataaaagggggttttttttttggagggttttgggaaagggctttttttaaattccaacccccccctaaattcccctttgggtttgggcccga

SEQ ID NO: 570420 - DNA, 325 bp, Homo sapiens
ccggccgggggggggggtttttttttgttatcccccccctttggggggccaggggggggggttcccctggggtcgggggttttggccccccctggcccccctggggaacccccgtttttttttaaaaattcaaaatttccccgggggggggggggcaggccggttttcccccctttttgggggcctgggggggggaaattgttttaccccggggggccgggggtcccgggggccgggttggcctccccccggtcccgccggggggccgggggggggcccccttcccaaaaataaattaattaattaaaatggattttaaaaatta

SEQ ID NO: 570421 - DNA, 770 bp, Homo sapiens
ttcaaggtggaattgagactggatctatcacagaaatgttaggatgaattccgaactggagaagacccagatctgtcatacgctagactgtcacctgccagcttcccattgacctggtggtggagtgtgaacgtgaaatggccatgtacatttgacactgattggtgtacctattagtgccagaactggctgctggcagtgtgcttgaagagtgtattgtgtactactactgtgcagttgatgtccttgtgataattgtatgcatattgctacgagctgttcaaacacagaccaccagacccatagctccttatatcacatgcatcatgccatagatggtacgaaatctattgtactgcacttgcttatttgtagacatgttgccaccctgcccttttacatgaaccatgacctactctgtgtgtcgagggtagatgctttctcagccagggccatgattgcaacttttgcgcccacgtgatttcatagcgggcatgccttccttgcgcacctcggccttgactgacagtactaggcttggtacgccacgtgtgctacactcacttcacaatcctgtgttgtgataagcttcaacatggttggacttgtgcttggcaagcgagaattgattattgcgttgccatgaataccccaaagacagacctaagtatggggagtgagcatactccatctcgcccagtggcattacttccaaacccacgaaacttgtaatccttgagggacatggtaacgactgtgaacaccagtaa

SEQ ID NO: 570422 - DNA, 412 bp, Homo sapiens
cgggcagtacggatgtggagggatttaaagatccagctcggtatacttccgggtggaagccggttaattgctttcgacgtgtggaaaacccagcgggcctttagcaaatatgagaagtctgcagggtgggtcagcaacagccagttcttagtaaaaccacttgatatgatggtggggaagtcagggaatatgttggcttcaaaagcctacattcatcagtacacaaaattgggaatcgaagaagaggactttttagacagtttcacgtcattagagcaggtggtggccagttacggtaatctctgatctggaacaaggggacaagtataccttaaggcatttcgggactaaaatattttcaatactattttctctgtaaagttttcagaagttcccacatccggtactgggc

SEQ ID NO: 570423 - DNA, 581 bp, Homo sapiens
  misc_feature (581)..(581): n is a, c, g, or t
gagatcaacagttactgtgactgagtcggcccattctgtttagaaatatattttaaagtgtttagtaaaaaaaaaaaaaaaaaaaaaaaaaaaaaaaaaaaaaaaaaaaatgtgttgtgtgggcgcgcggcgtggggcgccacgaggaaagaagtttttaaaaacaaatattgtgtgtggggggcggcggggccacaaaaaaaggtaaaaggaaaagcggtgtgacaaaaaaacgtgtggattacacaaagaaagacaaacatcgtgggggtcacaacaaaacaaatgagggcgagagagggaaattcttctctcacacaaaatatataaaaaaaaagagcgcgcgcgcgagggggaacaaaacaacagaagaaatgcgactttctgtgtaaaaaacaacaaccctaccacacagaaatggggagatatttctaggggagaggagatagaaacaaatagaggagggagtaactactatcattaacacaaacgagaggcaagcaatacccaagaaaaagcgagaccaccagcaaaaataaaacaaaaaataatgagcgacacccacaagctccgggaggaan

SEQ ID NO: 570424 - DNA, 127 bp, Homo sapiens
aacccggaccacctttgactcttccttggcttcaaccttagctggggctgcagcagcagcaggagcagctgtggtggcagcagctacaggggcagcagccacaaaggcagatggatcagccaagaag

SEQ ID NO: 570425 - DNA, 1327 bp, Homo sapiens
cccttatggggcacccgccgggggcccgatctatcatacccctttccggatctttttgatccttttggcccccccggggggccgggggtttacccaagtgtgtgacggacgaccggggggaaccatgccgttggtgcgaccacttagggtcgctctatttttatgtcgtggcaacccattattggagcgcacaggtgtgtgttgcccacgaaaatgcctcagatcgtgtggtgtgtacacccgcgtctcccgggaaatcttccccccgggggttttgtgggttttttgtgcgcacacccacaagtccttaggggacttcttttagacgttttttggcccacgactttattgtgtatgggacccaccacgtggtgaacgcttgtttccccggggggagggttatatatggattttacatggggggtgattcctgttggccccaaccgccctcttgtaggggcgcgccataggtagtgcaccaccctgttggtgtgggagactttgggcccctttggacccccggaggttggccacaaggcgccttggcggtcttttgttagatggaatggccccggttacgtgttgcgcgttattttggccgtccaaggtatgtgttaccacgcgcgcaaatgggcacacaagaggagtggcacatatccagccggctctgtggacacccacacatgtgggagagatagtgtatctctggtacatttggtctccggcgtttctccacatccaagaggaccccatttatatggcgacacatgtgctgtgtgtggtctcaaacttgtacaacagagaggcatctgtgtggcgcccacacagacattttttgtggggggatttacaccccgatctcgccggtgttttctcagaggaggggatctcccaaaaatctggggatatccacaagctcagccccaccattttcccatgacaagaccccacattgccatcaggcgcccattctcccaggatgtctaacatgtgtggccctgggacacccctaggggacccgaggcgtacatggcctctcctgccagtgatgtatggggaggtggcccttcttggaagtatcacacggcctgtaaggcctctgagcgtacctcgactttggacagagtaatgactcccccaggagaaccgtctatataagactttacccagcccctgagaggacccggaggagcatcccttgacccttcatttaacattggcgtcaccatttttttctagacattgggtagaaaagcagagccacaaaaattgctttcctttcccgcctttgaaaagaggccttcagttaagagtacagaacatgtga

SEQ ID NO: 570426 - DNA, 145 bp, Homo sapiens
gcaccctttgcgaggaatgctgagacaagaaagcctaggcaaactttacagctagatacaaaagttcacacagtgcaaaggcacgtgactctggggcagactgggaacgtcctcagtcattcctcgccaacagggtgtgactcca

SEQ ID NO: 570427 - DNA, 1294 bp, Homo sapiens
  misc_feature (18)..(18): n is a, c, g, or t
  misc_feature (936)..(936): n is a, c, g, or t
  misc_feature (952)..(952): n is a, c, g, or t
  misc_feature (1031)..(1031): n is a, c, g, or t
  misc_feature (1033)..(1033): n is a, c, g, or t
  misc_feature (1053)..(1053): n is a, c, g, or t
  misc_feature (1057)..(1057): n is a, c, g, or t
  misc_feature (1068)..(1068): n is a, c, g, or t
  misc_feature (1076)..(1076): n is a, c, g, or t
  misc_feature (1094)..(1094): n is a, c, g, or t
  misc_feature (1098)..(1098): n is a, c, g, or t
  misc_feature (1112)..(1112): n is a, c, g, or t
  misc_feature (1290)..(1290): n is a, c, g, or t
gctgagtgcggccgcganggggcgggcggactctcgggcgctcagagctggcctcgggtcctcggagcctggcgctcgaacctcccttccgacctccacccggaccccgaccccgacccggcctggcccggcccccgcccccgccccccgggccgatggactactcctacctcaattcgtacgactcgtgcgtggcggccatggaggcgtccgcctacggcgactttggcgcctgcagccagcccggcggcttccaatacagccccctgcggcccgctttccccgcggcagggccgccctgccccgcgctcggctcctccaactgcgcacttggcgccctacgcgaccaccagcccgcgccctactcggcagtgccctacaagttcttcccagagccatccggcctgcacgagaagcgcaagcagcggcgcatccgcaccacgttcaccagcgcgcactcaaggagctggagcgcgttttcgctgagacccactaccccgacatttacacgcgtgaggagctggcgctcaagatcgacctcactgaggctcgcgtgcaggtctggttccagaaccgccgggccaagttccgcaaacaggagcgcgcggccagcccaagggcgcggcgggcgcggcgggcgccaaaaagggcgaggcgcgctgctcctccgaggacgacgattccaaggagtccacgtgcagccccacgcccgatagcaccgcctcgctgccgccgccgcctgcgcccggcctggccagcccgcgcctgagccccagcccgctgcccgtcgcactgggctccgggccgggacctgggccggggccacagccgctcaagggcgcactgtgggccggtgtggcgggcggtgggggcggcgggcctggcgcgggagcggccgaactacttaaggcttggcagccggcggagtccggcccngggccttctccggggntctgtcctcctttcaccggaagcccggccccgcctgaagaccaatctcttctagctgcggcctctggaggctccgagcntnctcccagagacgtcccttcncctncaggacctganagctcctnccatcctggccacccgcntggnagttcccatccgtntccacttcctactgtttcaccccttggtgttttctccccaactttggagatcaagttagggccactctcgtcctcacccaccctctaccagcagagcggagttctttataccgggacctcctccaggagaaccccggagctccttctagcttggccttctttggatgcggtatcacangagg

SEQ ID NO: 570428 - DNA, 159 bp, Homo sapiens
ctactaggcggagacagcacattataacccccagggtgtgtcctcgttctttgtacccatggactggtctgcagcttcatccacatctcatccatcatttctccagattcagcaacaatcgggcccaagcagttgcgggcagggttgcaatttgcaggc

SEQ ID NO: 570429 - DNA, 319 bp, Homo sapiens
  misc_feature (1)..(1): n is a, c, g, or t
ncagccaatatggggtgcatctttgttgtcttctcattttccactttgttctcacataacatctttgccaagagtcattacaggttaggaatggctggatgggagattatagacaggggagaaaaactgtttcctattctctcaagatatgttttatcaagtgttgattgttttgtttttgttttgtttttgtcttttctagggatgcatctgcagcatacggaagttcccaggctaggggtctaattggagctgtagccgctggcctacgccagagccacaacaactcaggatctgagccgcatctgcgacccacacc

SEQ ID NO: 570430 - DNA, 1278 bp, Homo sapiens
tggagcacctgggggcttcaactgtgagagagacctaagctgcaagaagtaaaccatcaccagtggcacacaagacaggagaaggccttattggagtagtgtctattctgtagtgtttaaagaacagtgggaaaatccacaccacgactactaagtggacagctcagaataatattaggcatatttacctttgcacgacttaaagttcttccaagcatgcagcactgtagtaaatgcagcagcacacagcacttgcattcagcaggcacacacacacacatgtgttcctctcgtggacgtccttgcccgtagctcgacacaggctatcggcagcacatcgtctatcctcaacatacggcggacacctagccgtcaccagacaaagcagcacatcgtctatccgtatcccttcgtggcgatcatagccaccagcgtcaacagtgtggctctcccatatatcatcacaccagacagagggagcagccttagcgtggacccacggctatcatacacaggcggggtgcccataggcagagccacagagcaaggctggtagcgcccgcaggcaacacgaaggcagtagggcgagcggcaagcccacataggccagcacaagcgcaaccaagcctattgggaggagaaaatagcggaaaaactagactagacaaagacgaatagcgcatgacacactgctactcacacataatgtataaacacagaggaatacgaccgcgggaaacagacagcgccccaaaaggagccatagaaacggcaggacacaaacaccacgctatgcgcgcaaaagagcgaccaacgtagcacagtcaacaacgacacaaaaacaaccagtcggggcccacccgcggaccaaccgacacgaaaagcgattaacgaatacaacaatacgacgcaggcgccgacacccgacgcacagttcagaaaacgacaatccaacataacgccgcggcggcaacgacataacaccaaccccacaagtaacaacaccccacagggtgctcagcagcaaccatgcacaacggacaacaaacaactacccaccgggcagcacaacacagagcgaacagcagataccgcacaatatcataaccaccccgcaggagtcaatcctggcgcaccacgaccatatcaccacacagcaccacacagacagcgcaccacaccctagcgggaccaacagtaatcaataagcgcaaaaaacagggcgccgccaatatatagcccgcccgcgcagccaaagtgcaatcaacgagcgagcaa

SEQ ID NO: 570431 - DNA, 291 bp, Homo sapiens
cctagagatccagacgtcgaccaggttgatgataatatgataacgcaggcgccaactcacggagtgggcaatactacacagttgttgtttataacctaagctctgaggaaaatggcttgtccaaggtaacacagctggtaagtgcagcatggtggagaagagcctaagctctggggtctcagcctggcacatcgtacatcataaatattaaataatatttggaggaggttcagtgtggttaagaacatagactcaggccaggcacggtggctcacacctgtaatcctagca

SEQ ID NO: 570432 - DNA, 278 bp, Homo sapiens
tcactgaacgatgggcattcctggggctagtggtataccaggaaatacggtctactcgtcacaaatctcaatcctgatcttatcacaccacatggactttatatcctatttggagtctatgagtcgcatgtacatcgagtgaggattatgtttaataggaaaagaaaatgccttggtacagatggcggatgcaaatcaagctcagctagcaatgaaccatctaagtggtcagagactatatgggaaagtgcttcgtgctacactgtgcaaacatcaag

SEQ ID NO: 570433 - DNA, 298 bp, Homo sapiens
acccgtcagccaatatgcatccatgagcgtttgcatctctcgtagtttaaaaattctacttaagaaagcaaaggtccagacagtgtcattgaaacaaatgagtagaaccctttggtcatctaggtgaaagcgttttgttctgttttttgttttgtttttgttttgtttttgtcttttctagggatgcatctgcagcatacggaagttcccaggctaggggtctaattggagctgtagccgctggcctacgccagagccacaacaactcaggatctgagccgcatctgcgacccacacc

SEQ ID NO: 570434 - DNA, 262 bp, Homo sapiens
  misc_feature (89)..(89): n is a, c, g, or t
  misc_feature (232)..(232): n is a, c, g, or t
  misc_feature (243)..(243): n is a, c, g, or t
cccagatactcaggaggttcagaggggaggattgcttgaccccaggcaccagcctgggaaacactgcaagaccctgtctctacaaaaanttttaaaaattagccgggtgtggtggtgctcacctagtcccagctactcggagggctaaggcaggaagatcacttgagcccaggagctcgaggctgcagtgagttatgatggccccactgcactccagcctaagcaataagangagaccctgtntcaaaaaacgcacggcaca

SEQ ID NO: 570435 - DNA, 377 bp, Homo sapiens
  misc_feature (202)..(202): n is a, c, g, or t
ggtggagggttggtggggggcttggtgtgctgaagacccaagcggcaagaaactgctctgctaacaaggacgctggcagcctccagtgacgcgtgcccttgacttgcccttcacgtggctcccagtgcaggtcctggtagtcttccctgcagataactcacactactcaacatgaacttgctatttaacaaggtgatgtccntgcagcaaagaacggagcgggtgcagggggcgtgtggatttttccttccaccgcatgacataactgaagcagatgatcacccaatgcaccccatactggtcagccctcaagaccccaatattggcatctcacttccttgacatacacgcagatggacacacatgagagacccctg

SEQ ID NO: 570436 - DNA, 286 bp, Homo sapiens
ggtgactctagcaggatccccaaacaccgcaatcttgctctgtacccaggctggaatgcagttgtgtgatcacagctcactgtagcctcgaactcctgggctcatggaatcctccagcctcagtcttctgagtagctaggactacaggcgcaagccaccatgcccagataattcttttatgttttgtagagatgggggtcttgctgtgttgcccaggctggtctcaaactcctggcctcaagtgatcctcctgccttggcctcctaaagtgagattgcggtgtttg

SEQ ID NO: 570437 - DNA, 210 bp, Homo sapiens
cttggctcctaccgatgtgcggtcacgttgggttaagtgatcctccacttagcctcccaaatagccaggactacgggtgcatgccaccacatcagctaatttttttaaattgttgtagagccaggtctcactatgttgcccaggcttgtcttgaactcctgagctgaagtgatcttcccaactcagcctcccaacggtgaccggcgactt

SEQ ID NO: 570438 - DNA, 675 bp, Homo sapiens
aggaggtgtctctgggtgcatttggtgacaccgcaggcagaggggggacgccacagccagctctgcccgcggatgccacgtccatttgcttcagcaggatctgcatcctggaaaccctggttcctgcctctccgggacaccccactgaggtcagcacaccctgcaggtttagaaggggtgtctgggtgcatttggtgacaccgcaggcagaggggggacgccacagccagctctgcccgcggatgccacgtccatttgcttcagcaggatctgcatcctggaaaccctggttcttgcctctccgggacaccccactgaggtcagcacaccctgcaggtttaggaggggtgtctgtgtgcatttggtgacaccgcaggcagaggggggacgccacagccagctcttgcctgaggatgccacgtccattcgctttagcaggatctgtaccctgtaaaccctggttcctgccttttcgggacaccccactgaggtcagcacaccctgcaggtttagaaggggggtctgggtgcatttggtgacaccgcaggcagaggggggacgccacagccagctctgcccaggatgccacgtccattcgcttcagcaggtctgcatcctggccctgcgtcctgcctttccaggacaccccactgaggccagcacacctttcgtttc

SEQ ID NO: 570439 - DNA, 1199 bp, Homo sapiens
ggttgagaagggggtccccctgctaccgccacatcgtggatgaggctgtgaactctggaagtcatcctgccaggcccggacgtgcaggtgtcatccaatggcggtatctccactgcgtggcaaccacaggcatggtgccatgctacgtgagttctatgagtcctcccaatcagtgcagtcagtgatgacatatcatgacacagcggaatgtcagcattggatactaggaggttctaccagaatctgcatagaatgtcatctacggactaacagtatggtgagatagatggtcatcaactcgtcgaggaggatcgcaaagggcgggctcttcgtctaccgccataccatgcgctgtggaagaacactcactaggcaaccgtccttggcggactcctgccatcaaaccaagctgcccctacccgagcaaacgcggccctcgagccctcgacgacggtgccatacaaccgcagcaggccaccgtcctgcatccgctaggctgactggtcaccctgtcaccccgtcctcgtgaagacaccacccgcaccgcatcatgcggctcacacgtgcatgcaaccctcgccaaccataacaaagacccgctccccaggacatgccagccggacaacacccagcgagcgccgcacagctcgaacgccaacggcaacacccacacccacaggtgccctggggcgacccgccagcgcgcaccaacgcatgccagcagccaagtccgagagtgcgaccttacggccccaccaatcggggccgccacgacaggccccgcgcagcacatgccccacgtcgaggagcacccctaaggcccagtgccacacacgcaccgccaaggcctagacggccccagcgcaccgcgttgccaacggcagcccaccacgcggccgcacaccgcgacaactcgccggcgcgcccacccccaccgccgcccgaacactgcaaacaccgccaccccaacggcgggccccgcacgcgcaccgaccacgcagaccccccgcaccccgcagccacacgggcccggcccggcacgacggccccccccaccgccacccgcggccgccccccacccgccccacgccagcacccgccaccagcgcccccacgcggaatgccacccacgggaccccaggccaggcacaccgcgcacagcccagccgccccccacaccgccccacgcgccccccccc

SEQ ID NO: 570440 - DNA, 750 bp, Homo sapiens
gtggtggtgtgtggaccaggacaaaccttcccagcaatttttcttctttgtacatttccaattacttgcagattgatcatctaagcgttcagactgctgagatgaatatatataactttctgagactcaatattttaagctataaaaaacttcctgaagttatccttttctccctactttgaaccaaaggcaagaatttttaaagaactgttttatcaatggcctggctcctggatatagttccggaagttaagaccagttgccttgttaagtgtgttgacagcacagctaccctgtttggctgtgaatccagaatgtgatgaagaacagtcattcccactgaggtctttagccctgttcttggacctctgctcttgcagaaaaggagcacaacgtaggactatggctcacccgtcagagagctcacattctgatagaaagcactgggattgtttaaatatcctagttcaacattaaaaaaaaaaaaaatttaatcccagcactttgggaggccaaggcgggcagatcacgaggtcaggagatcgagaccatcctggctaacacggtgaagccccgtctctactaaaaaaatacaaaaaaattggccatgcgtggtggcgggcacccgtagtcccagctactcgggaggctgaggcaggagaatggcgtgaacctgggaggcggagcttgcagtgagctgagatggcgccactgcactccagcctgggccacagggtgcgactccatctc

SEQ ID NO: 570441 - DNA, 275 bp, Homo sapiens
  misc_feature (2)..(2): n is a, c, g, or t
  misc_feature (80)..(80): n is a, c, g, or t
gntgattctagaggatcccggacagcacgcgctaacaattactactatagccccataaataggagtaaggcttagaaganagacccctataagtcccattactaaaaccacactcaacagaaacaatgcatacattattattcttgcacggactacaagtacgatcattgatataataaaccttcgttgtatttcatagcttcatgataaatcaaaataaacagaaatctcctgatattctaaaattaataaaatatgatttaaatttttttttt

SEQ ID NO: 570442 - DNA, 648 bp, Homo sapiens
gtagagacggggcttcaccgtgttagccaggatggtctcgatctcctgacctcgtgatctgcccgccttggcctcccaaagtgctgggattaaatttttaaagaactgttttatcaatggcctggctcctggatatagttccggaagttaagaccagttgccttgttaagtgtgttgacagcacagctaccctgtttggctgtgaatccagaatgtgatgaagaacagtcattcccactgaggtctttagccctgttcttggacctctgctcttgcagaaaaggagcacaacgtaggactatggctcacccgtcagagagctcacattctgatagaaagcactgggattgtttaaatatcctagttcaacattaaaaaaaaaaaaaatttaatcccagcactttgggaggccaaggcgggcagatcacgaggtcaggagatcgagaccatcctggctaacacggtgaagccccgtctctactaaaaaaatacaaaaaaattggccatgcgtggtggcgggcacccgtagtcccagctactcgggaggctgaggcaggagaatggcgtgaacctgggaggcggagcttgcagtgagctgagatggcgccactgcactccagcctgggccacagggtgcgactccatctc

SEQ ID NO: 570443 - DNA, 1238 bp, Homo sapiens
ggttgggatggagataggaggatctcagtatattagtttcgtagtattcttatttatttggcaaataccaaaggaatgtacaaaagactcaggtgatctagaagtgtttatttgcttcccgttcgcttcccttcactgtcctttacccttttcccgttatccccgttacccaccattgcccgattaaccacgttgcggcgtaaccacttgcgcctggcaatctgatcgtattggcaccagagacgggaatgcaggtgatgcaaccctgtggcatctttgggaaactacggaatcgtccggcgggcttcatatgcgactgacttgccgagccttgcatggccgtccgtggatgtagacttcgcgagagtgtaccatggcgatagtgcgcaagggctagtaggccctggcataaattttgaggtcattgttgaggagacgaccatgatttcctcggcgtcatggtgagctcacgaggcctagggaacgcgttctagggtcgcgttcgccgaacccctccgagccatataatctggcaaaacgcataccgaagccgtctcccaggggggtctatcaaggatgcaatatcgtgccggtggggcatccaaagcccatcatctgccacgttcacgctagcgaggaaaattgacggacgagcgccattacgaagggaccaagaaggacccagattgccgtaaatctctgttgggatcaatttgcttttcattgctgaaaggaaagggaacaaagacgcggtacatacccttcgcccgtggattatgggaactcgacgggggcgtggtggttacctggtgggaccatcttgccacttattagaaacgcctacgaaaaagtgaaaattccctagaacctgaacccctatggagaagcttacgcccaaaaagggtgggcttggggcgcaatccaaagcaaaggcggttcgcaaagccttaatcatacgaagcgcttgggtaacccccaagaaacaggcatggtttgctgctacaactaaatggggaggaaactttatgtcacccttgaagccgcacgatatacctgggatgggcataacgggtgcagttgcgccttataaaatggttcgattgcttcctatattcccaaagaaagacatctcttgaaaattggattgagggacaaactaaacgtataggatgggaattggttacccatatgtgacaaagtaaattgattgaggtacagtaggtgataagttccgtgat

SEQ ID NO: 570444 - DNA, 343 bp, Homo sapiens
actaacatcacttgacttactatcatggaatgtcttattgatcacatgtggaatcgacagacaaactatggcaactcaagcctctctcggtgtgacatctgaacttccacattctggaaaatgggtgcggggtgcgaaatcatcgcactcgagtgtcctttgttgtttccctgataggggtcccagctcttctacaggtcgtctacgaactgtctaagggctaagaccataccggccagatacctgaatctttcaagacaacacacaaactctgccatgtgcacatttgccttttatattgggcagtgaggaaggggagttttctgtttcgttgtgtcctgta

SEQ ID NO: 570445 - DNA, 295 bp, Homo sapiens
gagtctactcaggagctgacatagaataccatgagcacttttgactgctttgtgaagcgtggcatatttatcttatgattatctgctgaaattacatggtactaacgaacatgagtgacataactaggcaactcggtcccgagattcatgccattgtggttgcccctagcaaagtgaagtcagcaccgtaaaaagggtgccttgtgaaagctattagcttgcgagtgcccctgttagccacagtctgatcaattggcacactttgaccgaagttacccaaagtatcactccttga

SEQ ID NO: 570446 - DNA, 123 bp, Homo sapiens
tatccaggatcccaactcagggcgagctgcaactcaggtgcgacctgcaactcaggagcgagctgaaagatcagatgcaaactgcaactcaagtgcaagctgcaactcaagagcgagctgcag

SEQ ID NO: 570447 - DNA, 959 bp, Homo sapiens
ggcatgctcctggccatcctggagaagtgtggggccatccccaaaatccactcggcccgcgtgtcggtgggcgagggcaccgtggctgccggctaccaggacttcatcatctgtgtggagatgttctttgcagccctggccctgcggcacgccttcacctacaaggtctatgctgacaagaggctggacgcacaaggccgctgtgcccccatgaagagcatctccagcagcctcaaggagaccatgaacccgcacgacatcgtgcaggacgccatccacaacttctcacctgcctaccaggagttcatgcagtgggcttcgcccatggagcctgggcccactcgtggcgtggtggcgccctacggccttctcaccggctcctcgactagacctcagtggcgcccgcgacagagcgagaagactctcctggatcgaggtctcgtatgatgaattctaggtagcagggctgcaagctggcggaagtgctggcgccatagccacggtcaaggctgtgctccatctccagactcaccaccaggccaggaggtgagtggtgcagtgctcaggccggctggatctcatggaccagacagcattcacatgtcacttccagaggcagcggggggacaggcaggctccgcccatgggccttcaggactatttctacgtggccatcctgcgtggccgggcaggggccataggacactgggagcatggttcatgcccctgtgccgtccgtgctggggctgctggaacagccgacaggccatggtgtgtgggaccgcgtgggctctaacctgcgccggaatccacagggtgaaacagttccccaccgggaccgtcaaggggtcgagaaacacgcacagcgaggaacacacggcaggtggtggacccagcagagtcagacaaaccaccaacatcagaaggacaagacacacaatccagcgcttgctcgcccg

SEQ ID NO: 570448 - DNA, 124 bp, Homo sapiens
caacatcatgcaggtgcattccacttctttgtcatctttctgcacatggttcactgcaccattttctttttcaatcatcatcacatgcgagttgcgtcacacagttttcatcagtccagcacac

SEQ ID NO: 570449 - DNA, 240 bp, Homo sapiens
tgcaatgaaaataatgatttacaaattttattcaatctaaaacaaatttcacaatgtgtagaacatacacctttcagaaggtatccccccaaaatctgaggttaaatgaataaaaccactgacaagatgcacaatgggggttgccaaaggctggggaaatgagggaatacacagttattgtttaatgaatagagtttcaattgcgtaacatgaaaacatttcagaacatggatggcggcg

SEQ ID NO: 570450 - DNA, 144 bp, Homo sapiens
ccctattggtagagggggcagaaacaaaacaaaaggggggtaatatgaacaaagtattactcaaaactactttccgcttcctcctctaaccaggagaaaagtccagaaagaaaacagtaatttcaggatttggagttcctatct

SEQ ID NO: 570451 - DNA, 668 bp, Homo sapiens
acctgtgactgtatcagatgctgcacggtgcagtacctttatctcggagggggtccgtgggaacgtggttcagaacaagctggatcctactcatctatcctgatgcgtatggtgagaagcgctgatggacaatcccacgctctatctagaagaaatacgtccatgagctgattccagctgtgatgacctgacatcgtgagcagacagttgtgcctgcgaccagagtgtggacaagtcactgggcactccgagacatttggtgtccgcctggttggcccagatctgcaagcatttttagcacaaccactaacaacatccagtcccggatcaccaagaccttcaccaagagctgggtggacgagaagacgccctgagagactcgtgtatggctccatcgcaggcttggatgagctgggacacgagtgttatcaagactctgagttctgccgccggctgcagcaggaaggggagcggatccgcaggtgtgctggacggccctgtgctgagcaatcattgtaccggattggagcagaccatgtgcagagcctcctgctgaaacactgtgctcctgttctggcatagctggcccaccgcctgacaatcaggacgcctatcgggcagaagttcgggtcccttgggccctcgctctgctaccaggtggtcaaggc

SEQ ID NO: 570452 - DNA, 1031 bp, Homo sapiens
  misc_feature (221)..(221): n is a, c, g, or t
tggcaccctgtgtggtgatcttaatggtgtgacctcttgttttttgtctctccccttgtgtctcgcctaccctcgatggggggtccccctgttgtggcgtttaagcgtctggtggtccccccgtagtatcttccctcttggtgtgtttctctgtggtccccccccgtgtttaaatggctctcccctggggctgcttgaaaataatgtgatgtgcccccccntgaaccctctccacacagagggtttaaagtgtggggaaaactcggtagattaatacgcgttccccccggtgacacttaaggagacatttcagcacagttccaaagaattcttacagcaaattgcttaaccgggacagtgtgcgaacgttattcaagcccaaaatgcccaagattggtcccacgtacccccttagggttaagggaatcccgggttggagaaactaacgtgtgtttggttcccccaaattagcgtgaaaatcctggtgaaaacagtgacttccccctttaaaggatctagaaatgggcccaagtgtgaaaatatggcccccttgaaaagtcatgtagtaatagagcatatgcttttttagaaccaggttaaaacctgtttggttatctaatagagtaaaagttactcgaggtccacacgatagaccacggtctggcataaaaaattgcccacgtcataatagtctaattaaagttcttttgacccacacgacagcacttcatcagaggccctaattcgaatgagagttttggctatccaaaaagtgttgattctaaaaattattgaatgagacctgattaaagtctgactttcctggcccccgtgttttgcacggttggctatttcccttatcagcccatcactccataaagttcttagctgcacccagtgattggtgaacaaggacaaccaccaaagcagcataccttgtatggatttatctcaacgctattgtttaatggctgtgtttaatgtgatctatttggaaaatgaggactccgaattaaaagctattactaata

SEQ ID NO: 570453 - DNA, 467 bp, Homo sapiens
ggcataggaggtatacaggatacctgtcttaaaactaaggtctcttatttgcacctgctatggtttgaatgttccctccaaatctcatgttgaaatgtaattgctggaggctgggcacggtggctcacgccagtcctgaacactttgggaggccgaggcaggcaggattgcttgaggtcaggagtctgagaccagtcgggccaacacagtgaaaccccatctctaccaaaattataaaaattagccgggcatggtggcacatgcctgtaatcccagctacttggaaggctgaggcaggagaatcgcttgaacccgggaggtggaggttgcagtgacccaagatcatgccactgcactccagcctgggtgacagagtgagactatgtctcaaaaagaaaaaaggaaaacaaaaaagaaaactaagaacccaattacctctgccacatacatgggctgtctttggttaa

SEQ ID NO: 570454 - DNA, 922 bp, Homo sapiens
ttagttggcgctgtggcggcttcgcctattgtgctctcaccgatcggggccccccaccgaggggcccccgcacacgtggcggcgcctccgcgaatttttcctcccgagagtggggttgatcgcccccggctgcgctccgccatcgccgggggtggattcctgccttgttcggccagactgatcaccgcgccggttgttctttctcacccagagcccgctcttgtcggcgcgtgttttccaccccccccccccgcttgtggtggcgccaccctcttgcgtgtccgcccctgtcgtgtgcgcagctcccaccacatagcctgggtttgtctcctcctcccccgcgtgtcgtcctgctggggagggtagtcagcccccgtggtttgtccaccgcaccccgtcttttccgtgccggctggttcgcccgccccccgtacgtccctacagagtggtgggccaccgcggtgggtcgcctttgtctagtggccgctcgtgtgttggtatggaccgcatagcgtcctgtcttctctaattttgatggtccgccccgcgggtgtgggggtgcgcggtaaaatcactccccgccgcccctctgtgggtggtgcgtggcagtagatagtgtgctccccgctcggcgcacgcactgttggcgggtcggctgggcccctctccccccgcgcccccctgtcggggtagcataaataagtgcacgcagggaggtcttcccccactcggcgaggaggacccgctcctttctcgctgttgcctcctcctcgcacgagtttcgctctggccgatgtttttttttttcatccaccccgaaggggtgcccctctgtccttctcttttccccccccccccatttttttttttttttttttttttttaaaaaacccccgcctttttttttggcccccttttttta

SEQ ID NO: 570455 - DNA, 199 bp, Homo sapiens
cccggcggacagcgacgtcgctgtgctcaggcgggccaggatcaccgccaagctcaacgctttggcaccgaagcacaacggtcgtgctgcctccgatccctcccatccccattacctgagactacaggcgcgcagcaccataccggcctgacatttatatagtatgctcatgtaatccgtaagatcggtatagtgtgtg

SEQ ID NO: 570456 - DNA, 518 bp, Homo sapiens
  misc_feature (505)..(505): n is a, c, g, or t
  misc_feature (513)..(513): n is a, c, g, or t
cttttggggtctttgcttattgaaagaattattttagagttgaagtttttaccacgtcaccttttacatatgtaaaaacatacatataagtaaaacaaaattggctgttactaaaagtacttcacattcagaactttttgactcagattcaacagtatctgtttttaccccacaaagagctgtttaagaacacaagtgacaaagcatttcatagaagaatccacaaaaaagctaatgccgtgagctctagggctggctttgtagtagtgtgcacagctgcttttctcctccaatgctcttcacagtcatttggttcctcaggattcaaagagaaagaaatcctctctcagatttccttccaagccaatgacactcattccacaagttctgatgctaggtttagcattctgcctgtgaaagaacattacaatggccatctggccaatgatatgtgtacctatcctgctttctaaaatgtttaagtatgaaaacaggcaccctacanatcaatgnaatac

SEQ ID NO: 570457 - DNA, 1086 bp, Homo sapiens
ccgccagctcaggctaggtacgaggccttgtgttcaatctggccgcaggctcctcctcctcccgctgctcctgctcccggggcgagcgcgcaggcctgtagcccgtccctcgcctccctggagccctcccccccgtctgctcccatgcgcgcgggtgggtcatgagcacaggccctcgctttctgccctaagaagcagtaagcacagcggcggctggggggcggcgtcggaggctgcggtgcaaccctgcctggaccagcgcgctctctggaagtagctccggcccggcccaggctcgtccccggccggcagcgaccaaagccttttgtgcacgccgtgcccccctctgaccccctgcgccaggcaagccgctgtcaatcaaggtgctgcacgatgctgacggcacgaactggccacaattttgcaccccgagtaccctgcagccccgtgccttccagcggccggtcaggcccatcgagctcgattgccaggaagcagccccgctggcgctgtttggcgccaagacgatgtccgccagcatcgggcaagcccgaacccgtcgccttccttccacacactctcctcggttgcctcccacccggggggcggcgcgcggcctggtcccgtcggctggttcctcgccggtcgcacaggacacccaaattcgggccccctgcaactgagcgaccatcggcttggagggccacgttcgagttccggccgtcactccgagaccccgggactcgggaataagcaaggagccgggcacggcgtgccgtgttggcaggcgggttgccggctgccgtggggccgcggcgggggtatcccggcggacaaggtcgggattcggggaaccgaggtgccacctttcaggcattttactgccctgacaggcacgccggagcacacggccctggcgtcacgtgccccctgtgtttctacacggccgcattacggcgggcgcatacgtggcgttcgcccgctggtctgggcggtgcacgctgtgccgactcgtggactagggccacctgtctgcgggggcgccctcccattggttcggggtgccgtcccccaccgcgagatctt

SEQ ID NO: 570458 - DNA, 151 bp, Homo sapiens
ccggtcacgatgtgaaataggtaggtgataagaagttggcttacttttgcttatagataatgacaaagtctcgattctggttgcccgaggctggaatgcacgggcttgatcatgtctcacgtgcttcgtgtacaagctccgtgggatcaac

SEQ ID NO: 570459 - DNA, 112 bp, Homo sapiens
ttacggatctaaggtggttgtgggtagggtcggtgagtatcctcacaggacaggccgaggagaactgtggtactgattcccagcagagtgtagcatgggctgagggcaggga

SEQ ID NO: 570460 - DNA, 992 bp, Homo sapiens
  misc_feature (495)..(495): n is a, c, g, or t
  misc_feature (573)..(573): n is a, c, g, or t
  misc_feature (645)..(645): n is a, c, g, or t
agcggagggggctgcggcggtgggggtggctgcgcgccgggggtcggtggagctgtgtcttcctgactaccgagcttcggccagtgtccgcctgtggcgcactcggcggtgggcgctggaggaagacctggcggcagccatgggaggagcgacagtggtcgcgtgttgggccaaagacagatggtagcagagatgtgtgcgagagagacagaacggcggtctgggagctatagagattgcggcgtaaaggaggcgttagagaatgattgcctgatgcaccgcgggggacatgacttggcggagaccgacgaaggaagtcggggagatggtcagtgtgaagtagcgtaaattcgcgaaggacagcagtacgatgactgcaggcaaggtgtacactcgtctgggacgagagagttctgctcagtgcaatagtcgcatgggaagagaaagtctacttgagcattggtgccaattccaacaatggagtagagagcagcnttgtacagaacagaggagaggatatacggaccgttgccagatttcacgagtccgccagtgaacaatgcactcggtggnatggcacaggaggaagcaacatgtgacatgttcccgatgcggagtcacagagtgacattgcatagcaagganagagcggattggaagcaccataactggcttgcggcaggagtcacgtagtactggtactctataccgtgtgtcccctcaggggccatcacgaaggtcaagcttcgtggacttgctgggtgcagagtccgaaggtcgtacgcggcagacatgcttcgcgtgcaagcctcgttccgacacagggtggaatgaacgtactacttgacaacttgggtagcctcgatgcaggcacagagtccagggaatctgcgacatgcgcaacgaacgcctagtagtatcgacgcaaatcacaggaataccagaccatgaaacatagcaagcaaagtagacgtacctgaagatacggacta

SEQ ID NO: 570461 - DNA, 214 bp, Homo sapiens
agtgtcggtcgttgtgtctcaggacagcccgtggtgctgtcctgctgctcgttccccagagaccagtccagctcttgcagagtgctctctggggttcatgtttataaacgcagagtgaaccccaggtctagcggccagtgtgcccacttctgtccgtgagatcatttattactagtcacctgaagcgttcccggcctcgtacctcttattcact

SEQ ID NO: 570462 - DNA, 1578 bp, Homo sapiens
  misc_feature (886)..(886): n is a, c, g, or t
  misc_feature (1327)..(1327): n is a, c, g, or t
gtactgacgagtcacggccctccttagtcaggccgccctcagctgagtggccggcgacaatatcttgactgtccgctcgtgcttgtcacgtacgtcagtcgcccagaaactgccccgggagctctcccgtagaggcctcgcataagtaaactaggtatgtacagtgtgccgtgctcacggcgaggggtttggtactgccaccttggaaggcccaggcaatgcgatacgtggcgtctctcactaacgtatagcggggtatatagcctggacacgaggcggtgaggggtgaaccggcaagacgaccacgaagacctgtgatcctgacgtgattagaagcgggaagccgtacggggcttcgcgtggccaggatcacacagaatggccttcacagacacatcggatgatcttccacgccacccacattgacatggatcgcgcctggggggatagtgggtacattggcgaggcgcgatgagccttgaggaagcttcgtgggtcgccctaggaaaaggtcacaaccatgcctggcaaggggcatgatgaaagtgaagtatgcggaccaaacaccatatttgtcattcgtgggtatattctagacagggggggcattgttggaacgaaggacggccccaagaaacccagaggcggtatccccgtggttgacttctagaccaattttttcgacagaatgggttcttaagcacgccccctggggacatatttgcgccacctcgagtggcacctccggggacggagactaggtctccgagaatcacccaattgaaagaacgcaacacagtgggggaaaaacaagattgctttttacacgccaaaaacccattgttgtgtacagaccgtacttctgtaacaccagacaaaaaagggncatatgggttcgcagaatgaatgggcgttggatcctcgcatggcgtagaatatgcaggctctagggatcccggaacaacttgagccccgaatgtgtgcactgggagcgcaggtctcaatcggaatttcggtctctgcgtcaacccacacgtggggcgagtcttatcgtcaggggactttgtaatcgggccacccccattttgaatttgacaccatctaccgtggcattcaatttgcgtaaacgagtagaggcgcctaaaccatatattttcacattgcatggcgtagcatcttttggccaaataattccatacgtttaggttctcactttggacgcggtaaaggttcccttccgagaaaggtgggattagtagttacattgtagctttccttccacaataagcaggaaatggggtggcaaattccaacagcgtcagattgntggaatttcccaattatcacaaaaagggcttggctaggtttggaacacctagaggtgtctcaaagagacccttacaaaggggcgcctaggcatagttgaacgctccgcaatataggggagtttgtacgcgcccgggtggacaacaaggggttagagcaattgagagtgtgccaacgaaggggaagagcaaaacccaagctcggcaatgtcgcaacgacataggacacacataggccctgatagcacgaata

SEQ ID NO: 570463 - DNA, 217 bp, Homo sapiens
  misc_feature (151)..(151): n is a, c, g, or t
  misc_feature (165)..(165): n is a, c, g, or t
  misc_feature (176)..(176): n is a, c, g, or t
tcaagcttctaacgatgtacggggacatgccggacctgtggatctcctgggactccgagcaaggcctgcacgagagaggggctgaaagggctgctggggtctgccacctctgctattcccggcataaggcatctgcccccacagccccttntgaccgttcatctngatggacattntttatacagaaaacaataaagatttccctctcaaaaaaaaa

SEQ ID NO: 570464 - DNA, 337 bp, Homo sapiens
agatggcctgaaggagcagaatcacaaagaactataggacttaaatatgacactaggaccaataggacgtctacagacatcacaagaatatcacattccatcagcacatgaaacatactctaagatcaaccacatgcttggccgtaaagtcagtctcaataaatttaaacaaaatcaaaatcttaccaaccatactcctggaccacagtggaatacaaatggaaatcaataccaggaatactctatgaacaccaccacaattacctggaaactaaacaactagctcctcactgacttttaggtacacactgaaattaaggcagaaatcaaaaaattc

SEQ ID NO: 570465 - DNA, 388 bp, Homo sapiens
  misc_feature (48)..(48): n is a, c, g, or t
  misc_feature (67)..(67): n is a, c, g, or t
  misc_feature (124)..(124): n is a, c, g, or t
tttgtttccttttacctacctttgcaagtcaggcagagatatatttgnccaaagtcatgtattttancttttttattttaaataaatattaagataaactcactaacagcccaggcacgtttgntcacgcctgtaatcccagcactttgggaggctgaggcgggcagatcatgaggtcaggagatcgagaccatcctggccaatgtggtgaaaccccatctctactaaaaatacaaaaaataagctggggttggtggcgggtgcctgtagtcccagccactcaggagggtgaggcaggagaatcgcttgaacccgggaggcggaggttgcagtgagccaagatcgcaccactgcactccagcctggcaacagagcgagactccatctc

SEQ ID NO: 570466 - DNA, 335 bp, Homo sapiens
gcggccgcgactactactactaaattcgcggccgtcgacaaatgtggtatatatacccagtggaatactatttggccattaaaaaaactaaattctgttattctcagcaacatgtatgatcttagaagacattatgttaagtaagccaggcacagaaagataaatactccatgtactgtacttatgtggaaggtaaaaaagatctcatagaagtagagagtggctcatgcctctaatctcggtgctttgggagtctaaggtgggaggatcacttgaggcctggagtttgagaccagcctgagcaacatctctcaaaattaaaaaaaaaagtcgac

SEQ ID NO: 570467 - DNA, 139 bp, Homo sapiens
gaaatgatgcccacctcttcccagagtccccgggatgctgagctcattgctgaggccaagctactgcgtcaacacagggccgcctggggccaggatcaattcggaggaccacaataaacagctgggatcacaattacac

SEQ ID NO: 570468 - DNA, 167 bp, Homo sapiens
gaagtgcagtacagtcgtgatgctcctctgccccccgggcaaagacctcaacgcccctgacctctatatccccaggatggccttcattacttacgtgctcctggctgggatggcacacaggcccagcacctcgggggagaacctttactgaatgccgggtaccgagc

SEQ ID NO: 570469 - DNA, 311 bp, Homo sapiens
  misc_feature (132)..(132): n is a, c, g, or t
  misc_feature (176)..(176): n is a, c, g, or t
  misc_feature (183)..(183): n is a, c, g, or t
  misc_feature (195)..(196): n is a, c, g, or t
gaacacaggaagaactcatcaaagcagacgttggagcagcggggtggcgagtattgagtcgaagtcttgtggtcatcactccacacacgctcggcgtcaccaggtacaccagcacgcggaagatgaagaccnagagacagccatgatgcgcccaaacgtcgtgtggagtacttgtntgacccncgactcaggagnntccctcaaatgataccccagttcatgtgtggacccacgctgtcagttgctactggagtgactaactcctcagctccttcctcagctccgggtaccggagcttcagaattcggtaa

SEQ ID NO: 570470 - DNA, 366 bp, Homo sapiens
ggagggagagaacgaagaaggctattgtattaatctgttttcacattgctataaagaactacctaagactaggtaatttataaagaaaagaggttgaattggctcatggtatcacaggctgcacaggaagcatggctggggagacctcaggaaacttacaatcatggcagaaggtgtaagggaagccagcacatcctacatggctggagcaggatgaatagagggaagggggaggtgctacacatttttaaacaactagatctcaggacaactcacccattataatgagaacagcatgggggaaatccacccccttgatctaatcacctcccacgatgtccattctctctccactcccgggtaccg

SEQ ID NO: 570471 - DNA, 478 bp, Homo sapiens
  misc_feature (290)..(290): n is a, c, g, or t
  misc_feature (298)..(298): n is a, c, g, or t
  misc_feature (388)..(388): n is a, c, g, or t
  misc_feature (422)..(422): n is a, c, g, or t
  misc_feature (444)..(444): n is a, c, g, or t
ttatgtaaaggaggggttgggggaggattattgaataacatgattaaccgttattttgcttctctttgatttctgccagtgttttgcagtcaatacataaagtcgcagttggacgagcctctaaacggcgcagaccaatttcgataccacaggtttcacagaaaccatagtcatcgtttttaatcgcttcaattgattgttcgattttgcggatgagtttacgtccacggtcacgtgtacgtagttcaattgcaaactcttcttcttgtgtcgcgcggtcattcacatcnaggcaaancggtgttttcgtcttgcatggtgttgagtgtgcggtcaacttctgacatcaactctgctttccatgccaacaaaatttggcggaagtgcncaagctgaccttcagacatgtaatccctcaatgnttttcggctggataagggtccnatacccaaataaagcttgcaagtaagaaccaccg

SEQ ID NO: 570472 - DNA, 1262 bp, Homo sapiens
agtgagtcgaggtccagtggaggacccaggtcctatcttgctgatctccgatgacgtcttagactggaaaatgatgactcggagctgtcctccgtcctctgtgctgtcgtcatcaatgttgctattaaagtctctgcagttaaaccctgtggactggtcggccctctaaagagagcgtatgcctgcgtccatcatcgtatagacgggtttgacttgtttcaggtattcatgacttgttggaactcattactctctcattgtgctgttgatctctggacgtgtgcctcatgaagtgtggtggcacctcgtggacagggaggaggtccgcatacctccatgtccttgcatgctgctgcgttttgcacggtaaccagatcgccaagataggtaccttgatctggttgcgtagccactgctgtagcggacttctactcgatattgtcggtctcagatagggcgacatagtcacatctaaagagtttgttcacagtaattctagtatagtaatatagtgcttatccttcgatggctgatagactccacgataggaaggcggatggctactcgaatcgaccattggatttgagctagagttaacattagtcgagtggtactcatctacgatgtaaaggttagagggatggcttggaatagggatcatgctaaagtataggtcgaaagccgtgggctaggccccactatggggcagagcagctcctttctcagtaattcaggtcttcgttggttcgccatctatttaggtcgcacaatctgtggcttccgattggtaccttgccgttgaatgaaatgaaaacccggtatgctaacctcgaagacctcatgtgtgtatgcatagatcatccccaagaaacgatttctatccccaaatttgtccttcgtaatatatggaggactcagtttcccacaaagcacgcagtttggattgaaaagccctttgtgtagccccattcggaccccagtgtcgctaagacaaataaccagtttcgtccttttgctttgcccctaggtttcgctcagcgccgcgggggacataactccgtttgaggtgccactgagggcacttgagtaagttccagaagtccgccattggaggagttatgcgccaacgggattcctatataagccgccaagtctggcaacgtagttccgaagataaacgccctggaagttcgttccgctcgggaagatggggttcgacccggtgtgtgtgtggagagagcagtttgaaactaggcacaggg

SEQ ID NO: 570473 - DNA, 506 bp, Homo sapiens
  misc_feature (1)..(1): n is a, c, g, or t
  misc_feature (481)..(481): n is a, c, g, or t
ngcaaaatacatttttcttgcgcgtcctatgttggtggctgagacccctaaaacaaaagacaaattaacaagagcaaaacatacaagtttctttaatacaagttttacatgacacagcagcctacataaggaaatgaagtcccaaagaaacagttaaagttgtgtatttttatgctaaatttgatgaagtcacagagaaatataaatggacaaagaggatatgatctaatagtaatacactggggcaacttagcaaggcctgtttgttcaagagttttctctgtgactgtgtgtcttcagcaataaagatgttactttcctccaggtatagggagtgcaaatctcacatgagaatcttacgacctgcttcaggggacgttaggaaattcttcctaggttttacaacctgcttcgtggggagatgtgtgggaaaagtccttcctggtttctgctggtttccccaaatggatggagggtgccntaatttggcagtgagtgtgtgtgtc

SEQ ID NO: 570474 - DNA, 138 bp, Homo sapiens
cgcgcattatgaaataagcaggcccctgcttacaaagtctttactcgtttttctgctgcgtaggcaagttatctgccggagtgcaggcgatttctcgaaaaaagtaggaaatctctgtaggcaaggtagcaaatctga

SEQ ID NO: 570475 - DNA, 1109 bp, Homo sapiens
  misc_feature (827)..(827): n is a, c, g, or t
agcgggctgggcaacagagcaacagtccatctcaaaaaaaaaaaaaaaaaaaaaaaaaaaaaacgcacaccagggagcggtttcagggacccccggggggggaacccccccaacccaaaaattttgggcccacccccggggggggggagggaaagggtggccgggggcagggagggaaccaagcaaaactcgactaaacgaaagagaggggttcaccatcgcggaagggtctgtcgccaagagaacttgggacagctggtgggctccaaaagagggaggacatctgcgagcggcggaaccgtgacacagtgacaaccacggtgatgtcgggcgacaggggatggaccctgggggaccgggaaaaaacttctgcacaccgacgcgcagaactaccatatattggacgagagatctatccaccagcggggggcgagcaccccaccgagaaagccggcaatacctgcgcgtgagaagaaaccaacatacgagacacacaatggggggcgcaactactaccaattctgcgtggacacgagcgacaaactggtgttagggcgccgcgtgggaccaccacaatccgggagacagaaaaatcctccgtgtgtccacaagcaggggggacttacacagagaggggaaacacagagtggggcgacagaggtattaatccccgcgcggaaggccaactggttcggcggcactgtgctttcagacaagcagaccgactttttcacgaagattgggcggcgcttaacacccaagaggtggagcatccgaacacaacaccggggaaataatctctttgtaacaatcccccaacggtgagnccaaacaactacgtcggcgcggcagtggggcggctcgccatgaaacccccaactatgggcgacaacagagggacgccagagaccagatgcggccaacgggagcactgatactagagatcaaagacacatgtgcggcacacagaccagccacaagagtggtcatgcaaccaggacgagagacaacagagccgaaggacacgaagcacagaatgagagccgagcgaactagaatcaagacgcagccggagaccagcgacgcaccagcagagtcacgcaacgacg

SEQ ID NO: 570476 - DNA, 117 bp, Homo sapiens
agcctacgttatggatagataacatgcacactactataaccactaaccctgacttccctaattccccccatacatataccaccctacgtaaaccctcaacaaaaaaaactcatacca

SEQ ID NO: 570477 - DNA, 1192 bp, Homo sapiens
aaactaaagtgtcagttgtacacaaagcaggtgtgtaaaacgatggcagtaactataactggtcctaagtgtagctgaggcctgggttgtgtggggacagtcgcccctgtgtgcacacaccctcgtattctcctgcccttccccagccaggcggtgcaccacggcatgtggtgcttgagctaccctcatgtgaaggtgatgatgtgacctgtacctggatctactgaccctgtggtggcatgctgtgccctcagtgagatggcatcctgcagcttttgatgctgcctatgtgaatgtgatgaattccctgtgctgaatgtgaaaaaattgcaaggcgataaagattgttagtgtgtgagctttttggacagagtcccaggatgtgaacgctgaccagtgctccgtgcatcaagtgcagcagtcagctatgtgaatgtgacaactgcagcttgctcccagccagccttcttccctctcttgtggcctaccttacgagccgcccttgtgcttgagctcacatgtgaagatgtgactcaaagtgtacacaggcatcttcccagcaggccccttgcatgccccagttgacaagccaggcaccagtccagagcgcctccatccagtggcagcctcctctgaactttgacgtggtcactcctgaggagcagaattcaccagagacgcagcagccatgccaatgcgatggcgctgggccccctgccccgtgaggacggaacctgatgctgcacctgcagcgcctggagaccacgctgagtgtgtgtgccgcaggagccggaccacggccagctcttcacccacctgggccgcatggccctgcgagttcaaccgaactggcatccaatgttgcacgagaactgagcagcgcaactccattctgcagacccttttgtgaccgcttcgggcacggagcacgacgctcctgacggccccgctgccatacggccctgcacaccccggctcggcctgcccaacgctccccgcacggacaactctggggctacgaagctgcttcatacccacggcacccaaacgcgcgcctctgccgcccggcaccccacttccgcgcctcgccccacgccgtcctgcccacaccgtcctctttaccgcagcaggtcccgcggttccccttccccctccactcgctctccctctccccccccccctcgccgccccc

SEQ ID NO: 570478 - DNA, 202 bp, Homo sapiens
tatctgctatcaggtaagccattagggccatcacagtgtggttgcagaagtgcgcctggttgcgcacccaggcgcactatctgccttccttgagatgtggtagaccgtattctcgggctaccctctaccggcaatcagcaccctgtattccccgatcaccacgtggtcaccatggtcagagcacggcagactaccactcgaa

SEQ ID NO: 570479 - DNA, 878 bp, Homo sapiens
tatgagattagaaacgacattatctctcgatatgtggaaccagtctgccagagttttgccgcatatcttgtaccagtatttggccggtattattcccgaaaattgtttcacggcctcttgaaccaacctggggtttccccactttagaaaggtcacaccctgaccgcgatttctttttaatccccggcggtctaactactaccggcaggtgttaagttccccccccgccctttctggagtcgtccacagaacgctgggccgcaaatttccgccgggtagtccaaccccgatggttaaaccaaaagtgtgggatatattaccagccttaacattttgtgaacctaaaggagtacctgcccccacaaggtcaccgactctttgcaaatactaattatttggtgggtcgtcctccgacaacaaaacacacccggtgggagccccgagcccctgtgcccgcaagttgtgaccctgcgcccttccttccttctcggaagcggtttgctgaaacactctcttgccccgttcaataccctcctccgccccccctctcctggataaatacgatgtatgttccaacttcttcttttaactcacaacgggtatatcatcgcgtttgttaaatatgaaaattggtcaaatagtacacacaagtgtaagcctacgtttccccagaccacaaagctgttcaaaagtatataacgcatgtgcacaggcggtcaatgaagtcccactttccggtttcggtatcggcgctatttttgtagcagcaaatattaccaccacgtatagggattttattttttttttgaggacaccctgtgatctatacgcgtgtttttttccgtttcaaaaaactctaccctttttccccacataac

SEQ ID NO: 570480 - DNA, 113 bp, Homo sapiens
gcgttttgttgactctagagtgatccccccccgagtagagcctgcccccgaaaccacctccatagctggcagaggagctctgcagtgctggggtggtcctggctctggtggtg

SEQ ID NO: 570481 - DNA, 322 bp, Homo sapiens
gggggggggggggtttttttttccaaaaaaccccgcggggggggcccccctagcccccccccccccccctttttttggggccccccccggggggggcccccccccttttttttttttgggggccgttttttcccccccccccccccccccccccccccttgggggggggggggggggccttttgggggggggggggttccgggggtgggggccgggggcccccccccccccccccccccccccccccccggggggggtccccggggggggggggggggtgtttttggggccttttttttttcccccaaaaaaaaaattttta

SEQ ID NO: 570482 - DNA, 700 bp, Homo sapiens
  misc_feature (17)..(17): n is a, c, g, or t
  misc_feature (80)..(80): n is a, c, g, or t
  misc_feature (93)..(93): n is a, c, g, or t
  misc_feature (99)..(99): n is a, c, g, or t
  misc_feature (116)..(116): n is a, c, g, or t
  misc_feature (124)..(124): n is a, c, g, or t
  misc_feature (195)..(195): n is a, c, g, or t
  misc_feature (218)..(218): n is a, c, g, or t
  misc_feature (241)..(241): n is a, c, g, or t
  misc_feature (246)..(248): n is a, c, g, or t
  misc_feature (250)..(250): n is a, c, g, or t
  misc_feature (259)..(259): n is a, c, g, or t
  misc_feature (278)..(279): n is a, c, g, or t
  misc_feature (307)..(307): n is a, c, g, or t
  misc_feature (333)..(333): n is a, c, g, or t
  misc_feature (355)..(355): n is a, c, g, or t
  misc_feature (362)..(363): n is a, c, g, or t
  misc_feature (370)..(370): n is a, c, g, or t
  misc_feature (372)..(372): n is a, c, g, or t
  misc_feature (385)..(385): n is a, c, g, or t
  misc_feature (397)..(397): n is a, c, g, or t
  misc_feature (410)..(410): n is a, c, g, or t
  misc_feature (424)..(424): n is a, c, g, or t
  misc_feature (458)..(458): n is a, c, g, or t
  misc_feature (469)..(469): n is a, c, g, or t
  misc_feature (508)..(508): n is a, c, g, or t
  misc_feature (524)..(524): n is a, c, g, or t
  misc_feature (540)..(540): n is a, c, g, or t
  misc_feature (547)..(547): n is a, c, g, or t
  misc_feature (566)..(567): n is a, c, g, or t
  misc_feature (598)..(598): n is a, c, g, or t
  misc_feature (628)..(628): n is a, c, g, or t
  misc_feature (630)..(630): n is a, c, g, or t
  misc_feature (694)..(694): n is a, c, g, or t
agctatgccttagtatncatgggggattgggttccatgtgactgctaactctctatccctctagttcaccgttctatctnaggatgttcatantctctnatgggcatatggtatancgtttgtncgttatttacgcattccttcctgtataatttaaatcatctctagatttcttataataccaaatactatatntttgctatgttaatttgctatancatattgtttagggattaatggnaagannnanaggtctgtncgtgtttagtaccagtgcnntttcttttttcagatatttcctatccanggcgtgggtggatctaaatgtggtgngccacagtgacggtagcagccngactgtnntggggananctttgggttggangcatttcttagngatggtttatgtnacaccacttcaganagagcaatatgggcatacttctttctactatggntttgtggattnctggtgtttttttttttaatttgatggtttgtggctctnggcttcggtaggcctnttgggctccttttccntcggctnttgtgcacttggcggttcnnttgttgctttttgagtggtagtttatttttnatttagggttggtccgttggtaggattatngnattggcttttagtgggctgcatatgcagtagattgattagattgtcctggtaagtaaaggtgtncgttgc

SEQ ID NO: 570483 - DNA, 290 bp, Homo sapiens
tccattcacgtccattccattctattccatttcattcaactccattccattccattcctctttggttattccattccattccactcgggttgtttccattccattccattccattttattccattccattccattacattacattctataccattccactcgggttgatcccataccattctattccattctattccattaaattccataccattccattccacttgggtagattccattccattccattccactccggtagattccattccattccattcaattccttt

SEQ ID NO: 570484 - DNA, 678 bp, Homo sapiens
agtgcgtaactgacctcgattttaagtttggcggcaacggcaaccgtgacccggagtgtgttccggtcggcttagcctcctaagccctagccactatgctggagagtatctccatccacgtgcgtacaggctgtggaacagactgtctaagtctgctgctagctgtactgcctggaacacggaatccagcctgatggccagatgccaagtgacaggaccattgggggaggtgatgactacttgaacacctgcttaagtgcgacatacgctgttaagctcgtgcccagggctgagattggagactgggtacccactgtcgttggtgaagtttggactggtgcctaccgtcagctcttgcatactgagcagatcagctcaggctggggctatgctgccaatagctatgctcgagggcactgcaccatggcgagggtgatcaatggccatgagttgcaccggattcagacgctggctgaccagagctccgagcgtcaacactgaaaggttcaccactgatctggagaaggacatgattctggactcatctgcctgctcatggagcgtgtgtatgccatgactgcgggtagtacagcctggagtgctcatttaccggtatcacacgtttgccaggttgctcggaccttaagatccttcctgacaaggaaggaactggggtat

SEQ ID NO: 570485 - DNA, 206 bp, Homo sapiens
ccacgtagtccgaggaaggagccgcgggcgccatggactgagcaggcggggccggagatatagggaccgggagacgcagatctccaagaccaacacacagacttaccgagagagcctgcggaacctgcgcggatactacaaccagagcgaggccgggtctcacacttggcagaggatgtatggctttttaactggggcccgaaggg

SEQ ID NO: 570486 - DNA, 938 bp, Homo sapiens
aaaactaaacaagtgtagtgtgtgcacgcctgtattcccagctacttgtggcagtgcttgagcatgggaagatcacttgagcctggtgagtgttgatggctgcattgagctgagatcaagccactgtgcactcccagcctgtggcagaccagcagctgaacacccccatctcaacaaaaacacaagaaagtggatgctgtgctgctcctgccatttggatcatcgcagcattttacttttctctgatatgcgcctttttcctcatctgtgggggctcatgtatatcgtaattccctctccactactagattagtgagcttgtgtgcaatggcaaggttcatcagtttgagtttgctatgtcccaggcacacaacattttgtccattggatagacacatcatcaatcccacttccttctcctctctgcacatttctttcatttacaacaacacacacacagtagcagatggcagtctcactggccttgcccaggctgtgtgtcaacactccctagcgcctcacagtgcatccctccccaccctctacctcacatatcgcacatccattaagccatatgcctaactcatgacatctcgcatactcaatactgcattgacacattcagctcacaggacagtaccgtattcactaactcgggtccatcccgagcctttgcggccatccgtgcacgcggcagacgctcgacacctaccacctcacatacaggcctaatactcacagcaccacttcacctatactaaacctggcctcagcaccacacactttgcaagcataaccaaaccgtggtcccatgcattcccctccacctcctccgacccaacacgtctggctgactccctgcacctgccagtgacatacaccccggtacaacctgcacctggccaaccggccactcggcgcacctactcacgctcatc

SEQ ID NO: 570487 - DNA, 1082 bp, Homo sapiens
gctcggcgctgggcgccctcccggccagcggcggcagcccctcctccccggacgcctcaggaccccccagagacccccggcggcggcagcctgccttgctctgccagtgaaccatgagtgaggcccgcagggacagcacgagcagcctgcagcgcaagaagccaccctggctaaagctggacattacccatctgcggtgcccctgacggcagaagagcccagcttcctgcagcccctgaggcgacaggctttcctgaggagtgtgagtatgccagcacgagacaagccacatctcttcagcacacacatgagactccggacggccggtgctgcaacgccagacgtcatcacacagacacatccgcagggggaccgccgactggttaggagtgaggcaaggacagtgaccagcaccacagaaatggcaggcaagagcatccgtcacttgcagccagcgcatacagggaagctgaagccccaggtactcacgggagctggacctgcccaggcaggacaaacgtgtcagtgacagaaccgagagcaaaccccactcatacgtggggccatgccaagctgggcatgcagaagatcatagaaccaccttggaccgttggactgtgccattccgatgtggcagaatgacacctgcggaaggactgagtgccccaaaagagctcccagtaaagaccagggtcgatgcatccccgtcttgatacatacatcaagactcacagatacagggtttccacaccgggttccagagcggagaggcagccaaagcgaagaaggttcggagagggacccagagaattggaagcatttcccggtgcggggtaccgaccggactcacagagattgaacaagggaccgatacaggtcataggggacattgggacacgttatacgacggaggaaaagggccggtacgaacaacttaaacttcccagcatctagggttaaacccgtgaaaggtgacgaaccaccaaagggattctacccggcactgacgctgggacgcaaatcattacttagacacggcgacagggtctcataccaacgaacacgaatgtgccaagataccc

SEQ ID NO: 570488 - DNA, 148 bp, Homo sapiens
taaaaaaccccaaaaaaaaaaaaaaaagttagttaggcttgggggggggggcccgtagtcccagctacttgggggggtaaggtaaaaaaaaagcttgacccccggaggggggggttgcagtgagccgagatccccccctgcttttcca

SEQ ID NO: 570489 - DNA, 107 bp, Homo sapiens
tctagctcggtaccccacaccacctgagtctataaacaaatatctgaatgaaatccaccctaggagacggagtcaaactaaacttgtggtttttcatttaacttttg

SEQ ID NO: 570490 - DNA, 209 bp, Homo sapiens
actacagcgcatatccatcccgccctctgaaaaaaaaaaataaattcattaaataaaaatatacttagagaggatattgactgttctcaccactaaagaaatgacaagtgtttgggatatggatatgctaattatttcgatttcatcattactcaatgtttacttctttcagaacttcacagtatactctataaatttgcgacagtagt

SEQ ID NO: 570491 - DNA, 259 bp, Homo sapiens
  misc_feature (63)..(63): n is a, c, g, or t
tcccttggacaaacattgtctgtgtttagcttttcctagtattgtgaggtttccaataggggntccatgtaaaaactctttctgctactgaaatgccggcccccttgagtattcatcacccccacagatgggttttcctttctctatgctaacactttttgagccactgacgttcagatcggtggttagtttcttgggcttttatttttccattttatatatatacacatattatatatatatatatatttgggggaaa

SEQ ID NO: 570492 - DNA, 347 bp, Homo sapiens
tatcgtacccgcacggctagccaacgtgtgtgtagctggtagctgggggcgcagaggacatcacctggagtgctgctctcacacatttctgccacgtggtgcccagctctcacccagggccccaaagaacaagcgttctgggccaagaaggaaaatgccctgtccctaggctcacaacttcatccaacacttaaagcccttcgtgcacacaacgacaaactttattccagattgttacaccccaccgcagaataatcttaacaggccaagaaggaaaccaggcaactccaatcacctgacgagccgcgaacttcggttctctggggggcaactgacgaagctgagcc

SEQ ID NO: 570493 - DNA, 403 bp, Homo sapiens
tcaatcacccacatagccctcgtagtaacagccattctcatccaaaccccttgaagcttcaccggcgcagtcattctcataatcgcccacgggcttacatcctcattactattctgcctagcaaactcaaactacgaacgcactcacagtcgcatcataatcctctttcaaggacttcaaactctactcccactaatagctttttgatgacttctagcaagcctcgctaacctcgccttaccccccactattaacctactgggagaactttttgtgctagtaaccacgttttcctgatcaaatatccctttcctacttacaggactcaacatactagtcccagccctatactccctttacatatttaccccaacccaatggggctccctccccccccccatta

SEQ ID NO: 570494 - DNA, 377 bp, Homo sapiens
ggatggtcgaatccgcacggatcaatggtgtttcttgcagtcgaagccgcccaggtcacggtggattgggaagcgagccgctttgagctgatagctcaaacggcgcacttggcggtccgcctgttcggcttcgatcaatcgatcgagccaaagctatggccgcgcaggccgacgtgaggcttcagcaagcagctcttgtaaagcactcgccataccatgcaggtgcaggtttttgagttcagaaatacgatcagtaggcatgctgagtacctcgcagttgctcatagcgtctgccttcgtgaaagggctcaatgcgcaattgcagggcctcgggcaaggtcaactctacgggacgtgctactgaggtaagccgacgc

SEQ ID NO: 570495 - DNA, 281 bp, Homo sapiens
tctccaggatcttcatgatacaccaataaaatgcgggatataatatacctacgctcttagcggttgttgccaggattgagtacaaaagcctgtgagatcagtgcctggtctcatggttaaatgcatgtcggtggtatagacctgataaccatcctcccaggttaaagtgattctcctgcctctagccttactgagtagctgggattacagggagcccaccaccacacccggctaatttttgtatttttagtagagacggggtttcgccatgggtggtatag

SEQ ID NO: 570496 - DNA, 218 bp, Homo sapiens
acatataccttccagaagttacttcagtagcataaagttagaattatttcgttcttgtggagcagaagtgggaatgatggaatatcctcacaggaaaaggcagtgaagttgggagtactgcttacaaaacagaggtcaccagtgcattatgtggcgtgcttcatccccacgccgtgtgtcacgggcctacggcggcgtgctcatccccacaccgtgct

SEQ ID NO: 570497 - DNA, 377 bp, Homo sapiens
gccaagcacggaaaggcagacattacatgttctcacttatttgtgggatctaaaaatctaaacaattgaactcatgaacatagtaagtactagggggctgggggggggggagacagggcacgggtaatgggtacaaaaataggcagaaggaatgaataagacatactatttgacagcacaacagggggactctagtcaataattgtacatttaaaaataactaaaagaatctaattggattgtaacacaaaggaaacatgcttaaagggatggataaccactctccatgatgtgattagttcatgctgcatgcctgtatcaaaacatctcatgcaccccataaatatatatgtttattatatactcacaaaaatgct

SEQ ID NO: 570498 - DNA, 106 bp, Homo sapiens
tgagccggccccccttgggatgtcaaggaaggggctaggctatgtgttttgtcaggtggttgagaatgagtgtgaggcataattataacaagctccatctgcctac

SEQ ID NO: 570499 - DNA, 1092 bp, Homo sapiens
  misc_feature (41)..(41): n is a, c, g, or t
  misc_feature (96)..(96): n is a, c, g, or t
  misc_feature (102)..(102): n is a, c, g, or t
  misc_feature (121)..(121): n is a, c, g, or t
  misc_feature (153)..(153): n is a, c, g, or t
  misc_feature (162)..(162): n is a, c, g, or t
  misc_feature (168)..(168): n is a, c, g, or t
  misc_feature (170)..(172): n is a, c, g, or t
  misc_feature (174)..(174): n is a, c, g, or t
  misc_feature (177)..(178): n is a, c, g, or t
  misc_feature (185)..(185): n is a, c, g, or t
  misc_feature (190)..(191): n is a, c, g, or t
  misc_feature (197)..(197): n is a, c, g, or t
  misc_feature (199)..(199): n is a, c, g, or t
  misc_feature (201)..(201): n is a, c, g, or t
  misc_feature (207)..(207): n is a, c, g, or t
  misc_feature (228)..(228): n is a, c, g, or t
  misc_feature (235)..(235): n is a, c, g, or t
  misc_feature (241)..(241): n is a, c, g, or t
  misc_feature (248)..(248): n is a, c, g, or t
  misc_feature (282)..(282): n is a, c, g, or t
  misc_feature (520)..(520): n is a, c, g, or t
  misc_feature (675)..(675): n is a, c, g, or t
  misc_feature (705)..(705): n is a, c, g, or t
  misc_feature (882)..(882): n is a, c, g, or t
  misc_feature (886)..(886): n is a, c, g, or t
  misc_feature (907)..(907): n is a, c, g, or t
  misc_feature (909)..(909): n is a, c, g, or t
tcaagcaggaggcgccgaccggagcgcaagaggagtgcgcnccacctggagatgccaaccgcgcgcgccacggttggagacgcagcaccggctganccagcngcagctatccgagctgcgngccccaggtggagcacctgccgcaaagccctnccagccgcngggggncnnncngcnncatcccntttgnngcaaangnanctggcngcaacattgccacaacttcangagccanatctgnattgcancagaaagcgggagtacattgaggagctggagccnccccactgacagcagcacagcccggcggatcgaggagctgcagcataacttgcagaagaaggacgcggacttgcgggccatggaggagcgataccgccgctacgtggacaaggcccgcatggtcatgcagaccatggaacccaagcagcggccagctgcgggggcacctccagaactccattccctgaggacacagctccgagaacgggatgtccgcatccgacacctggagatggantttgagaaaagccgaagtcagcgggagcaggaagaaaagctgctcatcagtgcctggtataatatgggcatggccttgcagcagcgagctggggaggagcgggcgcctgcccatgcccagtcattcctggcacagcagcggctggcaaccaattntcgccgtggacccttgggacgcctggcatntttgaaccttcgccccactgacaagcactgacagacctcacaatcaagccagcctgggctccacccaccctggcttcctccagctcacatggcgcccagcactgggcttcagccaggtgctcgagagctttgaggccatgatctctgctcttccctctcccagattggtggggaggnaggncgggaggtagatataggcctntnctttttagcaatgtgattcttgttgttgattctctctcgggagttaatgttctcccaaaggagatcctaattttatatttgagaaaatagaggcgttacaatctcccctcgctgtctctggccacaaggtgagggaaaaaaagggggcccaatatttatcccccttttttttaaaaaaatatt

SEQ ID NO: 570500 - DNA, 127 bp, Homo sapiens
ctcgcacccccgagtctccttcatgtcgggtgtcctgacgggggttcgcggagtcctggatcgtcctggcctgactgttggtattgaagggttgctgggacttgaatgagcgttctacgttctcgat

SEQ ID NO: 570501 - DNA, 173 bp, Homo sapiens
catgcctgaaagtgggctgcctcctctactacgagccctgtacatcgtgatcttccagtttggctgggcctccacactgatctcccacctcagcctcatcccggagctcgtcaccaacaaccataagaaggtggagctcacggcactcagcgtatgcgttcactgtgcgttgg

SEQ ID NO: 570502 - DNA, 416 bp, Homo sapiens
gcagaggttgcggtgggccgaggttgcgccattgcactccagcctaggtaggtgacaagagggaaactccatctcaaaaaataagttaattaaattaaattaaaataaaacatgcgctgggtgcagttgcttacgcctgtaatcccagcactttgggaggccgaggtgggccgatcgcctgggctcgggagttcgagaccagcctggccaacgtggcgaaaccttgtctctactgacggtaaaaaaattagctgggcatggtggagcatgcctgtcgtcccagctacttgggaggctgaggcaggagaattgcttgaacctggggggtggaggttgcagtgagcagagaccgagccactgtactccagcctgggtgacaaagcaagacccacagtaaagcccccacaccccatctc

SEQ ID NO: 570503 - DNA, 332 bp, Homo sapiens
agaggtggacacgggtgcacgaactgtggttgggtagacatgtggttggcgtgttccatggggttgtgccgtgtgtattacagttcactgtccaccgttaaattcgttgctgatgtagcggccattcatctctgagcagatgagcttaaacttccggtcaagcaacggtacctggcatgccagttccgatagcgcagcagtgtgtaaaacctcctcgtatctggccatggtgtccacgcctgtgaaggtcatgcccagttcagagctgctcatcttcaatgcccttctgctgcaggcggtccatgtccacctccaggctctcctgcccgtgg

SEQ ID NO: 570504 - DNA, 172 bp, Homo sapiens
cagtaatctcctgtgatctgtgctagctgtgaggcagctttggaacgtgaaaagctgtttggtttgaaccgtgaacaaaactgtgttttgagtttagctgccattaaaaaaaaaagttcatcccgtgcctgttaatgtaaacctggttattaaaataactatgaaattccca

SEQ ID NO: 570505 - DNA, 399 bp, Homo sapiens
aaatatatttttttaactcttatttcacgttcaaaggtacatgtgcacgtttgttatataggttagtgtgtcttgtgggtttgtggtttggtgtacacattatttcaccacccactaataagcatagtacctaatagagaggttttttggtttggtttggtttggtttggtttgtgacggagtcttgctctgtcgcccacgctggattgcagtggtgcgatctcggttcactgcaacctccgcctcccaggttcgagggattcttctgcctcagcctccctattagctggaattacaggcatgtgccaccatgctgggctaatttttgtattttcagtagagacagagtttcatcatgttggccaggctggtctcgcccctgacctctggtgataccct

SEQ ID NO: 570506 - DNA, 154 bp, Homo sapiens
cttctactattagactttcgcttcgagcgaggcttctcaatcatgaaattattatatactgctgtagagaatgatgagctacagatgataggatgttcatgtgtgtatgcatcgggtagtccgagtaacgtcgggcatccgatagccgagaaag

SEQ ID NO: 570507 - DNA, 147 bp, Homo sapiens
ttgaagtggagataagtccgtggagtgccgtcttagaactgtttcttgtccaggagggtgagcggctgaggaaacagactggggccagtggacaaacggttggcaagagcaagtgccatccattgaatgggttgaacttttcaacag

SEQ ID NO: 570508 - DNA, 800 bp, Homo sapiens
  misc_feature (469)..(469): n is a, c, g, or t
gcgtgctccctccccgaaggtgggggcccccgccgggggttttgggtgccccccctcctggtttccccgccacgaatgttttgtgggccggatttcttgttggcggcgcacccccaccttctttgggcgacgaccaatactgtggcgcggcgacgcacaaggggggttgcgcgacgccgcttttattgtgtcttcgtcgttggttttgttgtgtggggttttctttttgggcgagcgaccccgcgggttttataacctcgtgccgccgtgcagtgaggggcacccccagcgccgtggtgggcaggagcactcccccccccccgtgttctacaattggcgcgcggggcgttggttggtcgaccacccctggtgtgttgttttataataagtctcgtcccccctatagtagcgttggtcgtttgtttctacggagatgcttcctcttcccttctcttaatagccccccccncctcttcttttcttaggaggggtgcggccccccccttctcttcccccgcccccccccacgcggggggtatgaacctccgtgttttcgtagatagtagtaagtgccaccaattttttttttttgccctcatatatgttctattattctgtttatttttcttgaatgagagagatcctctttgccccccccttccccccctctttttggcccccccccgcgagagagagtacttcgtgtggcttgttgctgttccttcgcggggggggggggggccccccgcgggggcccttttcccccttgtggccccccggaaaaaaaagccacccccata

SEQ ID NO: 570509 - DNA, 644 bp, Homo sapiens; identical to SEQ ID NO: 493289
  misc_feature (598)..(598): n is a, c, g, or t
  misc_feature (611)..(611): n is a, c, g, or t

SEQ ID NO: 570510 - DNA, 665 bp, Homo sapiens
atctgtgtgccatctatgtgcatgagttagactttcgtacagaacatcttatgacgtgacttggatcgtaagcttcatacgatgtctacagcagacatgtctcagccgaatgtgatactgcatgtatttgatggaatctatatcaagaattgcagtcagacgatctcctcatagtgcgatcaggcagagcccgttagtacatgtcatgtatgatggattcgtcatttcccactaggcctggcaccttgtagtacttgcagattcgctacaggttgctggtagaattcagcctccatctcattctacagctgttcttgtggcttagccttatactgagtccagcgataagtatcggatgaggcatcaagcaagagcgtgttgagagtagacggctccatgaattccgagttagcctcattgagaagcgccagcgatgctacagtatccatccgtatgggtcaacagtggagagcagagaatcctgcgtctgacactaagagggatgtacgtcttcacaggcaagttcgatggtgtcatggaagaggctgtcttacgcgctcatgagcggagcgccgggtgtcggcgtatacggagcttgcaccagggccagtgccgtaaagagttatgcacagtgcacgcgctctgacaggcgattgccgtcatag

SEQ ID NO: 570511 - DNA, 935 bp, Homo sapiens
gagagcctgcctcagcaagcgtacctgagaatacttttaaaggaaccgtgtgataaactgcaaaacagtggctgctgcaggtgatggaactgtacttggacacaatggggagaagctggtagcttatatggaaggccaaatgatgaccagaagtgttttttcaaactaatccacgggcacagaatcctgcttcaaaaacttgacggttgaattttaacatacttggggcgctcaggaaccccttgggaacaggctacccttgaggtgttttacaaaaccgtgccctgaacccatctgtgcccaaaaacaagttctctgctcattgaggccccacaaggtattgaagcgcagccggaaggcatgcgccaaggggttccttgcccttggtggggacaacaggtgatgtgcttgacccttggcccagaggaagaggagctggggtggaaattgaccttgctgtgttctttgaccacatgttacacatggaacagggaacatggtggggttcacttgtggtcacccccaaaggaaagggttgggccaggactgtgggatggttgggaagaacaatgcttattgcgcccaaaaagatacatctggtgacagccctctgggacgcatttccacaagggaccaagggacttttgggatagaaagtcttaaagcgccaaagaacggatttccaaaaaacacccaccccttttgtgctcggaagtctcccatcctggaacacacggggcactgtgtgtcctgggcccattgattaggacacgcgtgaaaaatgggcggcaccaattgggcacgacacaacaagcaacgggcattgccaggtggggaccctcgaaacattggcggtacgaacattccccaaacccctgatgggagatcccagatcacaggattcaaacccaagggaagccacaaggggattggaa

SEQ ID NO: 570512 - DNA, 1069 bp, Homo sapiens
ctgggtttctgcccacgccggtcctctcgcctcgccgcgttctgccgggcagacgccccgcgttgattgaatcaacccgaggtttccttgccgccgcggcgcgcgcgagtgctcgcggattattgtgcgcgtgatgtgagcgtttctgcctcctgcggcgcgcttcaggaagcccggagcggccgggtcgcttcagaggccgggcaaccagtccgcccgcgcccggaaggtgcctctgccttggaaaacgccccgggcccgtggcctccggaaacttgagaggacggccgtgttcccccgagatccaccaggtgctcgaagcacgatttaaaaaacacactattttggcgccaatgttgccaaaaaacaacacaaaaacaaacctggcggggcactatatggcgggggggggccggacacacacacgcatgttatcttacaacagttgccgcacatggcgccaaaaaccgtgggtccctaagaccccacacgtgtttttgtatcgaaccgagcgtgtgggggaggagacattcgcgccgcgcgccccccccaatataaagaagggaggcgccccagaatttaaaattagcgagataaaacgccagtgtgtgtaaaccccgctcggtataaattagatcactgcacagacacaacctcacgcagctcagatgacacactatcgacatactacctcacctaaccagccatccaatctccacaacacagaacgcaaacacacacaacaccactttaactatacacgcccaactatcacaacttctaacacactaccacatactaaaacaccaatgcacccacaagctccaatcgcctacaacatattcctatacgcctatacttatacccgtacacaaacaccgaaaatacgtaaatcaatacccctaatctctcaccatacgaccacttctctcacaaacataactcacctccactcaaacaatgctatatctgcaaacacagacatcactcattatccttcactcacaccacataccaccaacaacagaaacaaccaacacctaaacatacaacaaaacaccatcacaca

SEQ ID NO: 570513 - DNA, 679 bp, Homo sapiens
tgcgcgggcactcagtgagcccgcgtgccattgtggtgctggtgcggccctagccctggctgcggagctgctgcgcgagcggtgggctggctgaccccgagggacccccatgcgcagcggtgtgcgtgcgatagatccttggagtgagacggcctggactggctgctgtggctgcctggctgatgggacgatgccctgcgtgcttgcagggcttgtgactccactgactgtagatcctagtgctgtgccatgctgcaggagcctgcagtggcccaggattcaccagcaggattgacaagtgagcttgcagattgcggacgtggctgctgagaacctctacagagccaccagctaacaaccgggtgagagagacggtcgccctggaggcttgagctacgtcaactccgaaccttgcagcttgctgacagtgaggagctggaggagctcagcggtggcgtggaccctggccggcatgggagcgaagctgtcactgtccccatgatccccctggtgccttgaaggagaccaaggagctggactggtctacaccgctgaaggagctgatctcagtgcactttggagaggacggcgcctcctacgaggcagaaatcagggagctggaggccctgcggcaggtgttgggttccgaagacagacagaacgggagaatgaagaacaa

SEQ ID NO: 570514 - DNA, 701 bp, Homo sapiens
attccagaagctgacagcattcgacccagagagtatagatgcactgacttagatgtgctcatgctacttactctctgtggaccgtaggctatcaaaagcacttcaaagattcaggtttactgacgtcatgcagcaaagaatgctaagtcacacttactgaattgcgtatgtgtattgggtttcatccatgcgacattgaagttgacctactgaagaatgtccagagatgcagagtggatcaacgagactggtctttaacaatggactcggcttattatcactagttctacactgaattcacccacactgaagaagatgagtatgcctgtcgtgtgaaccatgtgacttggtcacagcccaagatacttaagtgatatcgagacttgcaagcatactgacggatgtaagaagaagccgcattaggaaaggatgactaccaaactgtgcatgcttgctatttaacactgattgcttatacactacacgttatacacaaatgtaggctttaacatgcttcatgacatgatcgtattatactctactatgacagctgctcatgtcgatgctctagcagatgctctcggtactatagaagctggcgattaaagtgatacacaaattcgttatcacataacatgttgtaactgactctcatgcctgcctcttggagaagtcacccgccttggacaccctttctcggt

SEQ ID NO: 570515 - DNA, 116 bp, Homo sapiens
gcacagatgctcaccgctccgagatcacgtctgggaagtcccggtgcggtccttacagctcttggcttgctggacgtgagtgacatcattcggataccaatatacttcttctggtg

SEQ ID NO: 570516 - DNA, 187 bp, Homo sapiens
ttcgccggaagcagatccagaagatggaaaacctgtgatggataaagtcaaggagaaggccaaagaagaagaccgtgaaaagctaggtgcaagcacacatgaatccatccctccatgcttatagatcccgacgacgtcagcgatcagaatagtggaagcctgtcctgctaagtcagtctaaggccac

SEQ ID NO: 570517 - DNA, 375 bp, Homo sapiens
gggcccgggtggaaggcggggaggatgtgtgtgaaaagaatgcaaatatgtgtgctgtgtgtggcaggaggctatgggaagagtgtatcagataggactgctcatattgccctacacgagcaataagttgctcaccagagcgatcccatgcccacatgcaaacgtgctacccctactcactctgggcctggttggcgccctggatcacttagaacctgtggtgcctactgagtctaaatgggatactatgcgcataagacacactaaaaccgcatcttccatgttggactaatggccgtcaggtcagaccaaggatccccgatgtctatcactccacagtagctccagtcaaactgaagcataggcacgcaatct

SEQ ID NO: 570518 - DNA, 221 bp, Homo sapiens
aaaaaaaagaaaagaacatgagtcttaagttaccattcattgtcgtgaataaaaagttggtctcagtgagttttgcgcgttgaccacgaaagatgggtgttcgtgtgtgacagcgactcctggtttctcctccactttaactggcggctcccaccattcaagttttcttctggtggtgcactttctctggctttaacttcatgttggcatcctcccaagta

SEQ ID NO: 570519 - DNA, 280 bp, Homo sapiens
  misc_feature (99)..(99): n is a, c, g, or t
  misc_feature (171)..(171): n is a, c, g, or t
attgtggtcaaatttatattaagtacatggaattaataatttcaatggttggtacataacaaacattcagaatatatgtttcctcttattacctatgtncagagggcaatagatctactttatttgaaagatgtgtcagatcattggtgtataaagtgcaaaacgtgtgtntgtgtgtgtgtgtattattactacagcaaacagaaatggactttggtgaataaatcaataaaaattttaattaaacaattttaggattttataaagttaataaaaatgt

SEQ ID NO: 570520 - DNA, 684 bp, Homo sapiens
acttagggcgcaggccaggaatttgcaagattggacatactataccagtcacatgtattatgcagaggagcctgggcgctgacaggctgtgccatgtattctcatactctaataacatgacgctcatgtagctcccactagcggctgtcgccggtgctacagaaggaagtatagccagatgcaaggtaagctgactgcccggcaaggctattatccgagtcatgacagtacagctgactttattggctcttccctgacacgtcaggatagttcacgtcatgagacaggtcaatgtgcttacatgcgatgtggtactactgctgctaaatctgatcatgatcaaagagtatttttgcatcacacttaaagtcatcatcagatcagtgcgccgcttaccctgcatctagcccttgacagtagaactactttacctgttctgcagcgctagtgacttagctcactactagatactcatagacatccatgctacagaaagactgagaggggaatcaaactagctagcaagtagcttcgattatcttagcatatgagactgtgactcgcgcttgaatactactcttctccatgcagacctaccataaccaactgtaggacacgtagcttgagcaacaccgcgttccctccaggatactaccgacgactgtgcttcccggacagtgctcc

SEQ ID NO: 570521 - DNA, 151 bp, Homo sapiens
agttatgggggcgtccgctcctaaggcaggaagatggtggccgcaaagaagagaattagtcgctggagtcgatcaactctaggctccaactcgattatgaacaagtgggaagtacgcttcttggggtacaacgcagacctctgcaagatga

SEQ ID NO: 570522 - DNA, 235 bp, Homo sapiens
agaaaggcatctaatgaataacactgctaaaaaaagtcgttacttgagtgttttgcgatacctgattacctgaactacaactgaagcgtttggaaatttatggaaaaaaatcatcatcgtctccaaagtagttttgttcctgaagacgcgctaaactttgagtttgcgataacaaatgtcgtcccaacgcagatctaattgagtttgttcaaggacagaacaacaaaattgttcc

SEQ ID NO: 570523 - DNA, 242 bp, Homo sapiens
aattcgggacaggggctgactgaattgctgacacttcaagctctgtgcttatccattacctcaaagccagtccattccattagtaaagtttccaacaaatagaaattaatgaccacctttggtacacctaatatggagattacacttcaattgacaattttacaccatgtcatcctttgaagaacccctcactgtcaccttcccgagaataccctaagaccaataaatacttcagtatttca

SEQ ID NO: 570524 - DNA, 178 bp, Homo sapiens
  misc_feature (34)..(34): n is a, c, g, or t
  misc_feature (138)..(138): n is a, c, g, or t
  misc_feature (149)..(149): n is a, c, g, or t
tctgaggatcccgcccaggtagattcccatcttntgattggctataacttcagtactgggttccattcctactttcttaaggccattcccattttggcatacttagatgggactgaccccctcattgggtagagcttntgtcacttttnggatttttgcttgtcttatttcttgtgcc

SEQ ID NO: 570525 - DNA, 213 bp, Homo sapiens
ttggtcccaagtctttgctattgtgaatagtgctgcaacaaacaatacgtgtgcatgtgtctttatagtagcatgatttataatcctttgggtatacacccagtaatgggatgggtgggtcaaatggtatttttagttttagatcctttgaagaacccctcactgtcaccttcccgagaataccctaagaccaataaatacttcagtatttca

SEQ ID NO: 570526 - DNA, 826 bp, Homo sapiens
gaaaactacccctaagacatgccaacactgggaaaggaacagactcgatatcaacgagttggacgtcatcgcgacacgtagatacgggacaagtccaccgctactgggcatcgtgatctagtagatagtgcaggatgggagtcgagcaaaatgaagctattgaataaatattatgatgaaggaggtgcgtgcttgagattgggaatagggcgtaccttcaagctatgccatggggtctgtggaatagacgtgaaagactgagcgtgaacgtgggtatcatcatttgatattgtccttgtatggaaatttgagaccaggaaagtactattgtgactatcagtgtgattgaccgcacaggacagtagaagaccttgtaatcaaggaagcactgaattagcagggcacattcctacaggactgagcatggtgactgattcgctgattttggttggctggctggatgttattgagcggcacagtttgaaaaggcagggtactgctccaaagcgaaatgggtgcaggaatccccggagtagcagtggcccctttacgtaagggacttaacaaactacctgtggggttgttggaaaaaccaaagcttaaattatgttccgggttggttgatacgccaaaaattggggatttcccaacttgaaggactacccgcgtaacaatgcccaaaaaggcaagatcttgatggcagcgatttgtacctcacggacatgtacaagccaccttagcctttttggccaaacacttggctaacgagcgcccgacacagtttaccatttttgggttggccccaacttttcccgggttgggaaag

SEQ ID NO: 570527 - DNA, 367 bp, Homo sapiens
gtgaagtgaggtacagtaacttcactgcattccaagatagctcgttggttgagctacccttctggttgaaggaatgcagatgttctacttgttgaaatatttccttactttttttctttctttcgtttatttcgagatgagtcacgctcggtcgcccaggctggagtgcagtggcgggatctactggactcactgcaggctccgtgctcccgggttcactccattctcgtggctctagactccctagtgggtgggaccacaggcgcccgtccagcatgcccggataacttttggtgtttttagtagagacggagtttcactgtgttggccaggatggtctcgatctcctgacctcgtgatccacccg

SEQ ID NO: 570528 - DNA, 997 bp, Homo sapiens
ggtgggcagtcacctgaggtcaggagtttgagaccagcctgaccaacatggtgaaaccccgtctctactaaaaatacaaaaattagcttggcatggtggcgggtacctgtaatcccagctgcttgggagtgtgaggcaggagaatcgcttgaacctgggagaccgaggttgcagtgagctgaaaccgtgccattgcactccagcttaggcaacaagagtgaaactctgtctcaatcaatccatcaatcaatcaataaaatagaggtcatgctgaaaaaaaaaaaaaaaaaaaaaacgggggaaataattttttttcccgaggggcacctaggaccgggtctccccggggcccgtggggggccccgttgggtttgtccggtccgcccggggttgccaatcatggggggacggcggcgccaggttcagggtgcctgctggggcccccgggtctcaccaatccctgtcccagccggttcatgtacggtgaaagtgctctctccaggggggagatattggcgccttctttccttccaacaattgggacggaaatatttgggggggggcaagggtttgtcaggtcccggggccctcttagtattcgccccagcccatttgccagtcgtcaggggggagcgcgcgggttggtccaaggggttaactcccggaattggggttcgggaagcgctgtgtagccgcgtgccctcggtaaagtttacggcttcccccgcgacgtgccgggtcggggagttcgctctcgggactttgtccagaaacaagctcttatttcccttggaccacgtttttcccggcagccttcggagaatgtcgttctttggtgtaccccttttacacatcttcctggggtaccctggatctcaggccgcgtctcggccagcaacccactcgggctgggtccccactccttcggagagggctggatcgggggtcccctggaggctctgggtgggccgggcccccctttcgcggctccccacga

SEQ ID NO: 570529 - DNA, 823 bp, Homo sapiens
aattcggggagagatagggcgggaggcaagggcaaggcgggatccaaatcctcatcttactttcccgaccttgaggatgtagctgcctgtcgttgtactgtatcagagtagcttggagcaggggtcatgtgaggccggggcctgatatgctcctacctggggcctatttctagtttcatgtaagtaatatatctggatctgtgagaaatgatttaactaaaggggaacgtgatctttgtgcaaaatgataaatgaaagtaggatgcatgaattgagcaatttttggggcggggttgatgtttcccctgaaaatagcgtgtatcaaagtgacctggcagacgatagaggaggtgacgaggagcccccacgacaggttggaaggagacgaccagtgccgcagagagggcagtgtcccgctggtggtgaagacctccggggactcgggcacctgagggtgcttggtgtatgtttgcctcgccagaaatatataaagacccaggtggggggggtgaagcaaacacgcgctgtgggcttgaggaaagcaaaaaccacgcaattggagaggacacgttcccgaaggggagagaacttcgattcgcgggggacccgccacgcaaataactggggattggcgccagaatgggtccaccgttaaaaatcctaattgataaggcgtcccgggggccgtgattgtggtggatttgagcccggcacaaggttggaaaggaccttttggttaccagcaattgctgtttcaaacttttctttgtaccaaaaatttgtttactttggccttttttccttttgtttgtaacttatcttg

SEQ ID NO: 570530 - DNA, 269 bp, Homo sapiens
ggtcgacggaggtcaggagatcgagaccatcctggccaacatggcgaaaacttgtctctactgaaaatgcaaaaattgattgggcatggtggtgcatgcctgtagtcccaactatttgggaggctgaggtaggagaatcgcttgaaccctggaggcagaggtagcagtgagccgagatcatgctactgcactccagcctggcaacagagcgagactctgtctcaaaaaaaaagaatgagaagaaagaaaaagttgttcccccaagttca

SEQ ID NO: 570531 - DNA, 166 bp, Homo sapiens
  misc_feature (155)..(155): n is a, c, g, or t
ttttcgccagtgtttcccttacacaagaagaaacttccttttcagatagctcaagaaaagtgctctagcatacattgtggacttcaatgaaatgcttattaggctggaaggtggtggtccacacgctatgatcccatgcactttggtgaggccgnagatggcatca

SEQ ID NO: 570532 - DNA, 1089 bp, Homo sapiens
  misc_feature (22)..(22): n is a, c, g, or t
  misc_feature (95)..(95): n is a, c, g, or t
  misc_feature (118)..(118): n is a, c, g, or t
  misc_feature (130)..(130): n is a, c, g, or t
  misc_feature (160)..(160): n is a, c, g, or t
  misc_feature (165)..(165): n is a, c, g, or t
  misc_feature (184)..(186): n is a, c, g, or t
  misc_feature (208)..(208): n is a, c, g, or t
  misc_feature (309)..(309): n is a, c, g, or t
  misc_feature (384)..(384): n is a, c, g, or t
  misc_feature (390)..(390): n is a, c, g, or t
  misc_feature (394)..(394): n is a, c, g, or t
  misc_feature (405)..(406): n is a, c, g, or t
  misc_feature (416)..(416): n is a, c, g, or t
  misc_feature (419)..(419): n is a, c, g, or t
  misc_feature (428)..(428): n is a, c, g, or t
  misc_feature (450)..(450): n is a, c, g, or t
acgcccccggatggaaaccagnccgccgcaaccgtgcggaaagagggcacggcccaaagagtgccgaaagacccgtcaagccgcgcgccagactngaccgagcaaaaaaatgagcaanacggagcagggngacgcctcacaccatgagctagggggaatncattntataacaacaacgcgtacnnngcgctcgatgcctacaacaagngctgccgtgctgcccggtcctatgaggcagttgcagctgcagctgcctccgtgtataattacgcagagcagaccctgtcccagctgccacaagtccagaanacagccatggccagtcacctcacctccacctctctcgatccctacgatagacacctgttgccgacctcaggagcngctgcncacnaggtgctgctnnagcagcagcngcngctgctgtnactgcagcttccacttcatatnacgggcgggatcggagccccctgcttcgcgctacagccccagtccccactgttggagagggctacggtaacgagcatgagagtgagttgtcccaagcttcagcagccgcgcggaattctctgtacgacatggcccggtatggagcgggagcagtatgccgatcgggcgcggaactcagccttttaaagcttgaggtgggatgtgtgtgggctgaaattccgagctgcggttgtgcatgagaatacacccttcgtggtaccccatctccgggacgttctcggctctgtgcgttcagtccctcaggaaccgtggaccttaatttaccttgctaagttcagaccttctcttcctttcctttcctttcctctcctgcccattttcctgttcttctgtccttcaatacttctgtagcttcccattcatgttctcttctcccagcaggcctcattgtgtgcagaaactgtggtgggggctgtgctgtctcctccctgcctcctgcctctgcggctgttggatttgggaatgaccttggtgagagtctcactgctccagggtctctttttggtccaaaggctagacctatagagttggatcactttttttctttccggtgaaataaatggttttctccacttagga

SEQ ID NO: 570533 - DNA, 166 bp, Homo sapiens
acgcttatatcagctagaaaggagggatttaggatctagatttacgaatagaaactgtggttccattatggtaccagctgtttacccttgaacaagtcatttgaggcctttctgggcttctagtttcccaaaggtggactggtgtagggcagggctacatttccag

SEQ ID NO: 570534 - DNA, 722 bp, Homo sapiens
  misc_feature (44)..(44): n is a, c, g, or t
  misc_feature (120)..(120): n is a, c, g, or t
  misc_feature (129)..(129): n is a, c, g, or t
  misc_feature (168)..(168): n is a, c, g, or t
  misc_feature (184)..(184): n is a, c, g, or t
  misc_feature (219)..(219): n is a, c, g, or t
  misc_feature (237)..(237): n is a, c, g, or t
  misc_feature (332)..(332): n is a, c, g, or t
  misc_feature (335)..(335): n is a, c, g, or t
  misc_feature (371)..(371): n is a, c, g, or t
  misc_feature (467)..(467): n is a, c, g, or t
  misc_feature (557)..(557): n is a, c, g, or t
  misc_feature (566)..(566): n is a, c, g, or t
  misc_feature (586)..(586): n is a, c, g, or t
  misc_feature (600)..(600): n is a, c, g, or t
  misc_feature (602)..(602): n is a, c, g, or t
  misc_feature (605)..(606): n is a, c, g, or t
  misc_feature (610)..(610): n is a, c, g, or t
  misc_feature (640)..(640): n is a, c, g, or t
  misc_feature (649)..(649): n is a, c, g, or t
  misc_feature (694)..(694): n is a, c, g, or t
ctgagcgaagttctcaagatatatgttaggtagctggggatctnggaggccagatttcgggccagggcctcagcatcctataaccagggctgcctcccgaagagcagttcagagggcgtnacttcatangggcagggcggctccacaaaggcctggaacacccttctnctcagcccagggagcncatcagggtctgggcctgcttcagttctgccaggnggacctggaacttgtttnctgagagggacatggcaacaggctgggctggggttcctggggcagcggccacctccagccgcagtgcaccaagggctcttccacggattgcagcnggntggagcccagggtgtagtgcacccgccagcgcacanctgccaacctattcatgcgttggctgcagaaccgcaagttcttttgcaaggggctttgcttcttctcaaaacagcggcacaggctggccgcgtgcnctttgggcagctccagctgctgcagttcactggacaaggattcgccatcgacacttttcttggccgcactggagaggatgaaactcagcncttccactntggcctttaaatcgcctganttaaacttggcgtnangtnnagcnttaggatcttcttataatcaatcccctgtnccagccgcncctttagtacctggctgcagagcacgccaacttcacagaggacancttggccagcgtgctgatttctgcaagg

SEQ ID NO: 570535 - DNA, 142 bp, Homo sapiens
aaatgatatgtatcgtaccattgtagagtcacgcagcataggtacgcagtcccaacagtcctctgcgctccacctgttcacctctttaatgacatgtatctaccatagtagtgtcacgcgagcataggttcgctcgtcccaa

SEQ ID NO: 570536 - DNA, 298 bp, Homo sapiens
gcttgagcccaggagttggaggctgctgtgagccgagatggcaccactgcactccagcctgggtgacagagcgagaccctgtcttaaaaataaataaatagaaaagaagagcctgaggcagaggagagaggcagttgcagcctgggacccgcgtctacaccgccaacagcctctaaggctctacgaccggacaacagcctcgggtcccggccgccaccatcccaagggcccccctatctgtcctgggccgtttttgcaggtcgacgagtcagggtgacgctcttccatggatctaagt

SEQ ID NO: 570537 - DNA, 143 bp, Homo sapiens
aatgtttgagcgcttaagtgatagtcaatatatatatataatttattgtgaatgtatgcagttgggatggggagaggacattaggagaaattattttattgctctgataatgaaaacggacgggaaaagtttgcaccacaacg

SEQ ID NO: 570538 - DNA, 113 bp, Homo sapiens
tctatctttgaaaagttcaatgaaactaaataaatttctaaccagagtaatcaaaaaaagagagaagccacaaattacctacattggtaatgaaaaggagacatcagtagttg

SEQ ID NO: 570539 - DNA, 2037 bp, Homo sapiens
  misc_feature (483)..(483): n is a, c, g, or t
  misc_feature (501)..(501): n is a, c, g, or t
  misc_feature (587)..(587): n is a, c, g, or t
  misc_feature (728)..(728): n is a, c, g, or t
ggactccattggagcgcttactgtgttgagtatgacgcagacgagacgatcatgaaatagcaggatatccacatggggctccgtatcttctcgggtctcgtgtccggtgcatcatgaggtccgtgtacccgaccccgtacgtggtgagtgatggttgacccgaggggtgtgcttcttgcgtcccgacgtgaacttccgcgaagcctgcgtggagaggggtctgcttctcgatggtgccgatggcagcgcacgagactgtcggggacactctgggtggtaagctgaagagccgctggactggggtcctctcagtcgagctcagcgggtgggcatccaagcggtcgtaccacgagaacgactgatagatcgatcgcagtggagtcagtgatgcttgcgaatgacgtgatgcctctgagactgtgcatgtctgcagtcaggcagctaagcaggacgtgcgaaggggactagcttcgggcgctacgntagcatagggcacatgtncccacggcagagggaaagacgcggcacgctagagagaccctgctgtctggattggagagacgtagggcttgttcccgtccggacgntcgtgttctcgccccggtgtcgcctcggttacccttccgaagggaaccgtcgcgttccagttgctcccgaagttacactccagttcaattcctacagacagcctgcaggcggaacgagttgctggcgagctgtgtcggcgnccctgggagatgaaaactttcggtgccttctgtaatgggttgtttgttgcttccagtggcgggtgggcggttcgcatgcattaccattgggtaccgccgacttgcgctatttggaggaaagggcaattgcgctcgtggattttcaaggtaccccccggttggataccgttggctttcgattcccacggagattgccaatctagcgtaagggaccgttggtgcctgaggtgaggttgacggattgtggcggccgtggagtacggttctcattgactacgttttctggcacgatgaggcttgaggccaccatatggcacacccaccggatatgtaggcgtagccggtactcagagacagtgtggagatctgggggacactcccctactggggaaaattatgagaccccgcctattccagacggtcggcacacatgcacacatcttgattctcggcatgagaccacaacctttggtagagcaaactccttataagcaagtgcagtatgcaatacaatacaaatgccgttcagaatgttgctcaccgcagccgaagaaaagaatccccgcacacacaaaagactccgtctgtccaacttttgccaatcagaactacctttaccacttcccaacgcccaataagggccgaacgaaacaacaccagccgctttgggcacgcagacggaattttcggagaattcctcgggacggcaagacctctgggcgcttcagctgacacctagcccaccgtccatcgcggcgactacagcccattgctcaacaccagacggcaagcctggacaggttaggcagccacgaacctttcccctccttgcgttagtattttccccggccagcgcgggcaccctcacccccagtcgaaccagcggcccacactgggtcaggaaggaccacacgcagtgcagacgaacgcatagaagaaaagcaccaggcgcgcgtacaccagagaggctagcaaaagggggaacatatcacaaaaaatgaggttatagccaacaccaatgtgggcaacgaacactataaacgaggcgcgtcccaactctgtctatgctgtgacgacaccccctacgtccccacacaaccgctgtgacttgcacacatcacaaacgcaacaacgactgtgcaaattatgcgacgcgacgagcataatcgaaaccgacacttccaaccaagaccatccgaccaaccacgcaaacaatttatccgcctacagacatacctacacgtagtgttatccccgccagaggacagtctcactcgtgcatcatccacagcacaaaagcggccactcg

SEQ ID NO: 570540 - DNA, 305 bp, Homo sapiens
caggtgtgcctataaagcctgagctttggcccgtggaccatatctttacagactgacaaccatccctttctgctgctcgaattgtcattcttgaggcatgagcagcgctctgcagcccctcgtgggatgttttgctcaaacctgctgcgacttccaagggagcctgtgactctgctctcctactcctttcctcccttgtgttggggcactcgtctgagctccttggaaagagccctgcttcctgtgccagagaagtaggacagagcgaggaggcaagactgctaggctaacatcccaggctgccc

SEQ ID NO: 570541 - DNA, 141 bp, Homo sapiens
tcgcagagaggaaacatgactcgtatatgtctcaggtccctgctttgccaagcacctagcctcgctcttggcagggactcagcgaatgaatgctgtatatgtcgggtgcaaagttccctacttcctgtgacttcagctctg

SEQ ID NO: 570542 - DNA, 286 bp, Homo sapiens
gcggccgactaccaccaccaccccccccccggccgcgtcgacgctggatttgctctgcggcaagacccgcgccaccagcggcagtatccagttcgacggccaggaactgaccaaaatgcgcgaatacaacatcgtgcgggccggggtagggcgcaagtttcagaacccgtcgatctacgaaaacctcacggtgtttgaaaaccttgagatgtcttatccggctgggcgcaaggtctggggtgcgctgtttttcaagcgcaatgcccaggtggtggcgcgggtcgag

SEQ ID NO: 570543 - DNA, 353 bp, Homo sapiens
  misc_feature (216)..(216): n is a, c, g, or t
actctctgcggtattcacgacgactccccgacgacgggctgtcccagtactgacactgctgactggtttacgctggggtgtctgacgaccggcttctctgacggacggtgactgtccacacctgacgactacggaccacgacaccttccttatgcaacgactaccggacacgcacgacggactgcacgtacggtactgtgacgaccccacgacggncacggacacgggagcacgtgtttgaccgacgcgggacgttacttgggacacgggcggttgacggttggcgacggttccgcaacggactggagtcccactgcacgacccttgtacggctaccttggacacggacgttt

SEQ ID NO: 570544 - DNA, 520 bp, Homo sapiens
ggctttgtcatactcagtagcattataagtaagcagaaaaaaatgatggcatttgtattggtttagtagactttggttctttgtctataatattaatagtactttgttgtggttttaatcacccttgatctgttaaaaccatttatctggtaatcttcagtctttttttctgtctcagcacagctttgggatgtagcacagtgatttttctaaagtagagtgagggaaggagtatcttctttcagctccctaagagtatttattttatttttatttttattgttcttaccagacagggtctcagtatgttttctgtcttgaagggcagtgggacggtgataattgggtgcagcaggcaaatgctgggcttaaggggtcgtcccatctagccctggtgttttaatattggggcagcgtggatcagcctatcagggcccactagtctgtgcagggagcctctcgaatatgtatgcgttaagtcttgctggtttaaggagggtagcagaggcgccttatgcct

SEQ ID NO: 570545 - DNA, 119 bp, Homo sapiens
cgactagaggatcccggtggcatggggtctgtaaattgcttgagcagaggaaacactctactcccgctcggcatcaagggctgggtgatggagagtcaggccgtggttgccctggggca

SEQ ID NO: 570546 - DNA, 593 bp, Homo sapiens
  misc_feature (139)..(139): n is a, c, g, or t
  misc_feature (344)..(347): n is a, c, g, or t
  misc_feature (385)..(385): n is a, c, g, or t
  misc_feature (401)..(401): n is a, c, g, or t
  misc_feature (440)..(440): n is a, c, g, or t
  misc_feature (451)..(451): n is a, c, g, or t
  misc_feature (487)..(487): n is a, c, g, or t
  misc_feature (491)..(491): n is a, c, g, or t
  misc_feature (495)..(495): n is a, c, g, or t
ggttttttttttttacaggtcaaaaagaacctttattactttttatttttcccacttatgctttcttgccagatgcctttggagctcagcctttctgggctggagctttttgacccttctgagcttttggagcaggcgntggtttctggcctgtggctttctgggcaggaaccttctgggctggagcctttttactcgcggcggtgatcttttttgctggaactttagcagcagcagcagcagcagcagcttttttacccttagtaccaggtgcttttttgggagaagctttcacgagagctgccttttgaagcttcttaacttcattcttgattattctgttnnnnattttctttgccttcataactttaagacgatcaaaatncgtcatcttggctttnctttctctggcttcaatcttcttggcccatcgtggggcngcccattttgnattgatgtctgccttctgccaggcttggaggacatnattntggngggccctgggcggaaacttgaggatgaaatcagtgagctgcatgcacttggaaaggcatggcctggtctcctcacttgagtgcaaggtccatcgaccc

SEQ ID NO: 570547 - DNA, 137 bp, Homo sapiens
ggtcaccagctgagcccagctggtcaacagaccaacagggcctcatcatcagctggcctccagcatatggggagcagtgggggctgggaggtaacctagcagaccccacagtggctctaggcgagaagggggcccag

SEQ ID NO: 570548 - DNA, 1109 bp, Homo sapiens
  misc_feature (371)..(371): n is a, c, g, or t
cagagttgacccctcccacgtttctcaacatcagtgctggccgcaggctgacaggacagggacggatccggaatggggggtggccgacggtgatgactcgactgataccccatcggcggtgctctgtagactaactccgcaatgatgacattcagggtacgtctcatcagccatctatgaaagcttagtccaaggcactcggtccattgtgccctatgtggagatagtaatagcgacgcccgaaagatgacgcttctcgtcctttatccatctaactagaagtgagccactctgatgactggatagattggatggttccttcgctggccctaggcagtatactgggtggtgaatcccttccactagcctcntgtgatagggcaggactcgaccatgtttacgttgtcatcttggccttttgccatgctcgatcaacggaccgtgagaaggtcggacattgaggcctagcaatgatgaggatagccctagcattttgggttgcgcgtcagctaaagagtagtagcgaacgttgcttcatgagggccctctcttctcgccgcaggtcacctcggctcccttctgtaccctgggcgcgtcgtcacctatcgattgcccgactagagtggaagacggggcgtgggcgcgggcgtgcggacgtggggttccacccgtcgccgggcacccctcggtccctgccggtccctcctgtgcttccgatttctggcataaaccgccggaggctgtcccaggtgcatgtgaaaaggcgagacacactttcgaccaggatacctttcccggtataccctgatggcctcagaatggaatgagacccacccaatgggtgacgggccggacccatccatggctccacaaggctgggtgcgcagttttggccgaagggttggcttggaagtcctggggaaaaaccgatccaagcagttggagtaatcaatcacccccaatggatgcgttcccaaacccgtaggggacttcttgacggaagcacagtgaccttcgggatgacaggcgatggcttgcggcagggattgagaagaggcctgttggcgagtgaagaggaattagggcccacaggctatccgtggtcgcca

SEQ ID NO: 570549 - DNA, 291 bp, Homo sapiens
ctcgaggatcccaaacgccatactcaggtatgacgtataacattagtgagaattatattctaagtcacggagattggacgtgttttgcagcccagtatagctattctgactgttactccagggtgggcttttgccaggcatgtctgatgacgtgagagccgccgggaggtttcagggagtaaggggatggatgtaagtggcatgcaagcaggcattttagttagttccgaatagcaggtgcagccctgcagtggggtgaggcaatcagttacaaggcagccagcaattcat

SEQ ID NO: 570550 - DNA, 111 bp, Homo sapiens
ctggagcgagagtaaaaacggggacacagcccgagatcgcaggcgtcatcacccagggcacgaagactccagacatccatggacgatttttgttgaccagcgttctatcgt

SEQ ID NO: 570551 - DNA, 129 bp, Homo sapiens
  misc_feature (121)..(121): n is a, c, g, or t
cctcccagctctgtttcttgtcctcctggtattgggatttgaggtccaggggaccaaacagccccagcaagatgagatgcctagcccgaccttccttcacccaggtgaaggaatctctctnccagttac

SEQ ID NO: 570552 - DNA, 235 bp, Homo sapiens
ccgagtacaggagacaagtatcattaaatctcacagctccaaaacgtcacgagaactcactatcatgaggaaaggattaaggagatgctgtttaactatttgtgagggatcatacccccacccccacttttcacccctcaccgacagcataatccacccatcctccccaatctccatcttgcaacacccagtgccctccatgattaaatcaccttccacttggccccttatcgag

SEQ ID NO: 570553 - DNA, 293 bp, Homo sapiens
agggcccaaccccaacccccccccccccggggggggagggggggggggggccccgtttaaaattttgggccccccaggagggttcccccaaaaactttttggggggggcaaaaggctttggggggggggccccccccaaggggggggggggaaccccccccccccccccaggggggaaaaaatttgggggggggggccccctttacctcccccccggggggggtttccccggggggggttttgggtttttttttttttttttttccaaaaaacccaaaaattggtttttttga

SEQ ID NO: 570554 - DNA, 173 bp, Homo sapiens
tgcaggggtgaagaaagctcatcgttacaggcctggtagtgtggcgctccgtgaaattagagcgtatatcagaagtccactgaacttctgatatcgcaaacttcccttccagcgtctggtgcgaagaaattgctcaggactttcacacagatctgcgcttccagagcgcagct

SEQ ID NO: 570555 - DNA, 607 bp, Homo sapiens
ctttgggaggcctaggcgggtggatcacgaggtcaggaaatcgagaccatcctggctaacacgggtgaaaccccgtctctattaaaaaatagaaaaaattaggcgggcgtggtggtgagcgcctgtagtcccagctactcgagagcctgaggcaggagaatggcatgaacctggaaggcggagcttgcagtgagctgagatggtgccactgcactctaacctgggcgacagagtgagacaccgtctcaaaaaaaaaaacaaaaaacaaaaattatccaggtgtggcggtgggcgcctgtgaggcaggcgaatctcttgaacccgggaggcggaggttgcagtgagccaagatcacaccattgcactccagcctgggcaacaggagtgaaattccatctcaaaaagaaaccaaaaaaaacaaaaaaaaaacatgccgttggagtactgggttttgggtgtggtccaaggaaaattaaaaacctgtagcatgaataatgttgtttttcatttcgaatcttgtgactgttttaaatatatcgctcttaagagacggtgaagttcctatatcaagtttttagtatggttgttttaaagctgtttttaatac

SEQ ID NO: 570556 - DNA, 138 bp, Homo sapiens
cgactgtcaaacaatgacctacagtactcgtgaagaggctgttgctctgcccttgccggtgcctccgtagacggcgtctcgctgctggccctcatgggagtcccccctgttagaccttcagcccgatctctctgtgcc

SEQ ID NO: 570557 - DNA, 367 bp, Homo sapiens
  misc_feature (345)..(345): n is a, c, g, or t
  misc_feature (367)..(367): n is a, c, g, or t
ggcgctgtaggaattctgcacgaggatagagggaggggagattacatccttgagtgtccatggggcgccgccccgccccctgtgcaccctctcgccagactcccgcagaggcaagcgtccgtcttgcattggtgcccctgatgccaagattaccgggacccccgcgaggctggtttatttctagcccacccaccttgcgctttgcggttcacaagaagtgaaccccggccggtgacgccattatgtctcccgaagaggagctggaccgtttccaaccggagacttttgggaagagggcggctgaactggctttcatatacgtgggcgggtacaccccttacaccnccagttgttcccttagttgccn

SEQ ID NO: 570558 - DNA, 383 bp, Homo sapiens
cacggtggctcacgcctataatcccaacactttgggaggccgaggtgggtggatcacgaggtcaggagctcaagaccagcctgaccaacatggtgaaaccccgtttctactaaaaatacaaaaattagctgggcatggtggtgcacacctgtaatcccagctactcaggaggctgaggcagaagaatcacttgaacccaggaggcagaggttgcagtgagccgagattgtgccattgcactccagcctgggtgacagagcaagactccatctcaacaacaagaacaaaaacaacaaaaaaataaaacacttgtataagtgatcatcacttctcactggcgctaaggcaataattaaggcatatgtttaacatgtcctctgact

SEQ ID NO: 570559 - DNA, 197 bp, Homo sapiens
  misc_feature (185)..(185): n is a, c, g, or t
cctaaggacctttgagagacagaagggcagttgcgaatctataatcagtggacttctgataacgtctaatttcacggagcgcacagtacagtcctgtaacgatgaggtttcttcaccctccagtagagggggcactcttgcgagcggctttctgtagcccagttgcttcctggggtgctttaccnacctggtcgatt

SEQ ID NO: 570560 - DNA, 451 bp, Homo sapiens
caagattgaggacattttattttaggttaacctcagtttctcctgtgatttttatgagtattaacattttaacacaagcattgcttttatggttgagttgatttaatggtataatatttcttattcccacagaattatatttaatttttatcctcaagaggtaaaggattggctgggcatggtggctcatgcctgtaatcccagcactttggaaggccgaggtggtagatcacgaggtcaggagatcgagaccatcctggcaaccatggtagactcccatgtttactaaaaatacaaaaggttagccaagtgtggtggcatgcacctgttgtccatgctactttggaggctgaggcaggataaccgcttgaacccgggaggcagaggtcgcagtgagccgagatcataccactacactccagcctgggccacagagtgagactccgtctca

SEQ ID NO: 570561 - DNA, 108 bp, Homo sapiens
tctaatattccgaaagcaagggctatgagcagtccgacaattcggaaaccatagctcgccataatttacacgctctatgcacatattaaaatacatttaaacagtact

SEQ ID NO: 570562 - DNA, 150 bp, Homo sapiens
tgacgcactggaggtggagtgcagtggcacgatcttagctcactgcagcctcaaactcccgggatcaagcaattatcccacctaagtctccctagtagctaggactacaagttgcactccaacatgcacggctcattttttttttttttt

SEQ ID NO: 570563 - DNA, 111 bp, Homo sapiens
aacccgggcgggggggcaagcccgaaaggcgcccttttttttcccctttggttttttccctaaatccggggtccctttttttaatgaaaatttaaagggttccctttttta

SEQ ID NO: 570564 - DNA, 155 bp, Homo sapiens
  misc_feature (1)..(1): n is a, c, g, or t
nccctaatcgctttcggcttgtaaagatcagatggtatgtatgatacgcggcattatttctgagggctctgttctgttccattggtctatatgtctgtcttggtaccagtaccatgctgttttggttactgtagccttgtagtatagtttgaagt

SEQ ID NO: 570565 - DNA, 187 bp, Homo sapiens
ccccctgggttttagtttcagggcccccaggactccaaaaaatcccctttgtcagtgtggtatccaaggcaaagtttaggggccagggaggaccagaacccatctaaatggtcaaagggcctgcaaaaggagatgtggcccttcctccccctcattgaggacttaataaattgggtttatcccccca

SEQ ID NO: 570566 - DNA, 759 bp, Homo sapiens
ttatcctgatcttctggtagaatgcttgcacattctatgcctacaactaagagacaggggccactatacatttgcctagacctacagcgatgccttttctcaaaacagaaaagccaaacaaataaatctcattcacctgagcatatattaccttttcaccacataacatgatctcatagattccctgagtgaaagcagcaaagaggcaggtggcgggaaaacaacctgaaccttccaaagatggctaaaaaaaattgatgctttcggtctggattccctgaggagactagcctggcgaacatcatcccttggtctgtggggaatttgaggaatccctagtaatagcttcataacagatttgagattagtgaggaacaagccatatctgttcacataagggcgaaattcctgatcccccctcatgcaggggaaggcccagaatataaattctgtaaccacccgtcacccaagcgcaaataccagcctgatggccaagttgcaggcacagaaccattggctccaccaccttaccaatcatctaaatactgccaccttaaatcaagttggtgcaaacccacctgaactatataaatgcaatgcatctcccccagaaaacatcgttggggttatgtgagtccaatcttgcgagtaaaagaatccccactggcctttttacttagggggagcggtgcggaaaattaaaaggaaagcccgaagggacattatttagaggattgcccgtcgataaaaattaggctg

SEQ ID NO: 570567 - DNA, 1176 bp, Homo sapiens
ggccgccgttcggtcaaagtgaccgaagcaggaggcaagggatgggtccctgagattgagtaatgggagccctgctgtgatcgtgcgtcagacgtcggggctgagaacagacccggaccagggatagattaccgggacggtctaccggaggccgaggatacgcaggagggtccacacagacaggaagaaaacccacgaggaagaaacctcagacagatacgccgaggggaggccagacgcagggatcccagcacatcacggagtgcgccggacggtagtgcaggatacccaaaggtgcgaaaaggaaagacaggccgaagggaagaaggtagagtgcaccaaccattgcaacgtccagacacaagccacgagaccaactgaacagtagagtgacatcagtccactatgacgacaataggcacacggacaggacatatgagcaaataggacaggacaatacacaagcacacaaacacggacactcaagagaagagagcgaacaaaaagaggcccagaagaaatacatacggaaagataagagaggagagaagcaggacgaaaccacataatacaaccacgaccaacgacaacgcgccccagccactagaacaacaacatacgtcaagaaacaaggcaagcggaacataagaaccgaagccgaaacgacggcacagacaagcagatagaggagctaagagaagaagataggcaaaaagcacacacgacgccagccacacgcaaacagcagacagagaaaaaacaaaacaggacgaaccacgaaaagacaccaacgcgaacatgaaaaccagaacacacgcacaaacgcagaaacaacaaccagcataaaaacacacaacgaaaccaaacaaaaaaaacccacatcccaaaacccagaaggtggccataacgaagaaacagatacacaacaaaacgacacaccaaccgcaccgcacccaacacagaaccaccgaccgaacaaaaccatgaacaagacgactgaacacatgaccaaacgacgcacacacccagctcaacgcacatcagcaaaacaaaggacaacgaacatgagacgcgtgaaccagccagaacagaaagaagaaagaccacgccacaccgatcacagtacacgacagactagaaatacaaaagcaagaaagacacaacgcaacgaacaaa

SEQ ID NO: 570568 - DNA, 378 bp, Homo sapiens
tcggtgcacagccgggcagagcggttcctgtgcctcgtagccaccccgtagcagcccatcctgctggcggaagaaggtgggcccagggacaccatgatgtcgttgaggagcaggtcccccggggcagggccggcctgagataagactgtcacgctgcccattgctggagttttgggggcagtggctgtctcacgtgcgggctccagaggcactggcagagtgtgcacaatggccatggtggcagaggctcaggtctgccaggggctccggggcaacctgtgagcagggcattggtgtcagagtccctgcaccttgaggatcctccccctataagccttctcctgaccccctcctccagatagaacattccccatttag

SEQ ID NO: 570569 - DNA, 823 bp, Homo sapiens
  misc_feature (288)..(288): n is a, c, g, or t
  misc_feature (495)..(495): n is a, c, g, or t
ttgctatgcgccatatggttatcgtagttccactagtgtcacatgttgcaattcgcaccagtgtccgcatttgtggtggctcgtagttttgcttcgtgtgaggtgcacccatgcgcaacgtgctctgtcagtatggtagtcacacattgcctcagtctgtgcgagtggacaaaacgtacacaaactacttatgaataattctgactcacacactcctcacgttgtggcacaccgattgagactaccacaaatcttgggtgtacttagtacacacactatgtcagcgtntaacttgtgcgctcatgggtgcgatgagtcctacgttggcgcgtacatgagtgagatattggggctagcagactttcaccatgttcgagtacctagtgctatgttagtccgtgacaccatgtggtcatgttgggagacgtcttcccgctgcaaggttcattgcgcacatctagttaactgagccgcgatcagtctacgtggtcatcncacactggttcaatgggtcgattcccacgatctatgaatcgtgcagggatgcactacctggcagctccacattggtagtgcgtgacccgggacacttacctggatcggttgccgcaccgtggcctccagctgggcgaactaccggtgcgaggcctgtggttgtgactacccgcgtataacttatggttactccagagtaggtacagggacactcacacagcgcaatcacagacacatagacgcccggtgacatctacaagcccgacgggcgtaggtaggcgtactctggcagttgtcagtcacgccggcacgtgtcataaccggtctc

SEQ ID NO: 570570 - DNA, 748 bp, Homo sapiens
ttaaacaacatgatcctgaaaaactttgggtaaataatgaaattaaggcagaaatcaataagttctctgacaataatgagaacaaaggtaccacataccagaatctctggggcacagataaggcagtgttaagaggaaaattcatagcactaaatgctcagattaaaaaatcagatctcaaattaacaacctatgttcatgactgaaagaattagagaagcaaggacaggtcagccccaaggctcacaggagataagaaatatcaaaaataagagctgaactgaaggaaacatgagcatgtgaaaaaccattcaaaagctcaatgacatctaggagttggtttttcttgacacaaaacaacttgaacaacaggccattacggtagactaactaacacacacacaggaaaggagacgaacgatccaaatacacacaacttagaaactgctgacacaccgacatattactaccatcagaaatataccatagcaactgttcagaaaactaactatagagacaccttcttatggtaaacgaaaggttaagaaaaaccctagcgagatcataggactacatttccgtggtacacattaccaccctgccaaaggctggatgccagcgaacgaaactcgattaccatgaacagaaccactaacaaagcttctaacaattggcatcaggccatcaactcgcctacaaccaacacaagctgggacctatggatcccagtcactccaccaatgctccc

SEQ ID NO: 570571 - DNA, 120 bp, Homo sapiens
cagctcggtcctgtttttcatgcgtggcattacccctttattagagcatggcttggcaacctcctggcccggcagtttgaaggtcgacactcaaagtggggtggcactgacagcccaaaa

SEQ ID NO: 570572 - DNA, 449 bp, Homo sapiens
tacttttccagggcacttccaccctcttagtgtgtctgctgggcctgacaactacatggacagtaatgagaggttcccaggagaaagctactccagacttctcttactttttactgccgcagcagagaagccatttgattcatgcctactttagcatcattaatcacataccacacgacatcactttggaaagtcacttgcgactactgggactgggatttcacgtgtattatgatgaatttgaagcatcagtgtcatgtctgacattggagttcccataggaaaaggaagatccaaagaagcaggtggaactgaatgcttatatatgaagttggacaaaaagtaaattgtgaaaacgtgaccagacaaaggagcatgggctagggcagttagttgtggagaagtgactaggaagataaggattcgttcagcaaggtttgtttatggag

SEQ ID NO: 570573 - DNA, 785 bp, Homo sapiens
tttttttttattttgagacggtcttgctctgtcatccaggctggagtacagtggcgcattcatggcttactgcagcctcaacttcccagactcaagtgttcctcccacctcagcctcctgagcagttgggactacaggcgcatgcaccacacccgtctaattattttatttttttgtaaagacacggtctctctatgttgcctaggctggtgttgaacttctggccttaagtgatcctcccgcctcagcctcctaaagtgctagggttacaggtgtgaatcactacatctggcctaaatttaaaaaagtttttagtctacatccagtgacctatcagggatgcttgttattttatacaagctgctttgttatcatatcagcattctcttcagccagctccaaggcagatagtcacccctctctctgtgtggttggggtgggagcaggccccgtggagggagcggtgctgaggacatgtccctggcgttccgatgctgctccatcgaggaccccctggcctcaggaggaaggagcaggcgatgcagccccttagtgtggtcgtgttgactgacaggtggctgatgcctgagcgcgccctcttcttccatcttaggagacaccgtggtgaagaggaagcctgcttctctgatggcccctctgaagcggaaggaggagttctccttgttcaaggtgtctgatgatgaatataaagtaacaatctcgcctcagctgctcttggccacccagcgcttcctgtcccgaggtgaggcgggagggtggtccct

SEQ ID NO: 570574 - DNA, 166 bp, Homo sapiens
agtctttggtgtgagctctcttcaggagtgatctcgtgctgccactttctgtttaatatactcggctcagactgtacgaagcatagatataagtccctaccaagagggctgcagaggatgagtcacagagtcaggccgaagcaagttgaagtcaggttctctgcag

SEQ ID NO: 570575 - DNA, 485 bp, Homo sapiens
  misc_feature (85)..(85): n is a, c, g, or t
  misc_feature (126)..(126): n is a, c, g, or t
cctttagccgactttgtgtcaccgggggctagaccagctggtctgagactgcccggaacaaggccttccactcatcctgaggganacagacctttgcacccagtttccaagcaaggtcttaaaaanacttgactcagttgctcttctctgcccttaactagcttaaagttgtgcctctgtcctcttcgggcacggtgtcacctttcctgcctaccttctgcatctcgcttcaccaattgggtcccagtaacgctgtcatcctccaggttacgcgactgcagtacctcaatgcactcctggctacccgagcccagaacctgccacagtcccctgagaacaccgacctgcaggttattccaggcagccagaccaggctccttggtgagaagaccaccacagcggcaggtgagtgccaagtggtacatcgtgcatggtgtctggacctgagggccgtgagctcacacacacagacttgcactctcgcc

SEQ ID NO: 570576 - DNA, 390 bp, Homo sapiens
tccagcactgtttcatttcctgaattccttcttcctaactgtccattagcggctttgacaatagtgttagccagatagtctcctttctacacatataaggtgcaaaaataaaagattttaaactgcagcttgaaggaacaaagtattgttatgttggtcaggttttctatggattagacgttaaaaaacagtggcaatagaaatattggtactcttctctgtgagttgatatgaaggctggaaatcagccgcctaagatgatcatttaaaggtaggggatggggccaggcgccgtggctcacgcctgtaatcccagcactttggggggccaaggcaggcagaccacttgaggtcaggagttcgagaccagcctgaccaacgtgctgaaac

SEQ ID NO: 570577 - DNA, 239 bp, Homo sapiens
cccggggtttgaaatgaactcccccctgttgggggcatcccgggccccctggaaagtttttttttttaaaataaaacgggcaacgccccccccaaattaggggccccccttttcccccccccccccccggggacgctaaaaagtttccccccacccaagggccctttttttaaaaaaaaaatgttccccccccaaaagaggaacccccttttttttttaaaaggccaaaaggccgggga

SEQ ID NO: 570578 - DNA, 3945 bp, Homo sapiens
  misc_feature (3934)..(3934): n is a, c, g, or t
cggcacgaggggcagctgctggagctggcggcgcggcccgggcggctgcgggagcgggtgctggagctggcgcgcggcggcggcgacccctacagcgatctcagcaagggcgtgctgatctgatggaccgtgccaggacgtgctcacgcccctcgaagactgcttcatgctggacgccagcaccgtgctggacttcggtgtcctggccagcatcatgcagagcggccacacgcgcatcccggtgtacgaggaggagcgctccaacatcgtggacatgctctacctcaaggacttggccttcgtggatcccgaagactgcacgccgctcagcaccatcactcgtttctacaaccatccgctccacttcgtcttcaacgacaccaagctggacgctgtcctggaggaattcaagcgaggagacaccgtggtgaagaggaagcctgcttctctgatggcccctctgaagcggaaggaggagttctccttgttcaaggtgtctgatgatgaatataaagtaacaatctcgcctcagctgctcttggccacccagcgcttcctgtcccgagaagtggatgtattcagcccgctgcgcatctctgagaaggtcctgctgcacctgttgaagcatcccagtgtcaaccaggaagtgaggtttgacgagagcaaccggctggccacacaccactacctgtaccagcgcagccagccggtggattacttcattctcatcctgcagggcagggttgaagtggagatcgggaaagagggtctgaagtttgagaatggggccttcacgtactatggagtgtcggccctaactgtgccatcctcggttcaccagtccccggtgtcctcgctccagcccatccgccatgacctgcagcccgacccaggtgacggcacgcattcatctgcgtattgtcccgactacaccgtgagggcgctctctgatctgcagctcatcaaggttacgcgactgcagtacctcaatgcactcctggctacccgagcccagaacctgccacagtcccctgagaacaccgacctgcaggttattccaggcagccagaccaggctccttggtgagaagaccaccacagcggcagggtccagccacagcaggcccggcgtcccggtggaaggcagccctgggcggaacccaggcgtttaacggctcactaggcagccccagatctggggaacagatgagcacgtggggagctggagtgagctgagcagaagttttgtgcccgcctgcccccatcccctccaggccacgttttagatggcccttgtagttgcgggtcctgggtgtcctcagaactagacatcaatgcctggatccttcagccggccctgccctcctttaggagacaggagtcaccagggcacagccctccaggcccgcctcaggaaggaatgaaaggaatgccatcatctctagttcccagggcccagccttccccttctcccccggggcagggacagtgcggcatattcagattcagacctctttgggctgagccaccttgtgagtgcagttactgcctttgtgtggccgtgacctctatttgtttgcttttaatttgccaacctatcgctgctggcagcactttttgagcaagccgagagcacccattttggctgggggttcagatcgatggccttgtccatgttgtcctttctggcttccctgatggtgtcatgtttcagcgcatgcgccccagcctttcccatgtgccaaaccagaagctccactgcccgtaggctgtccctgtagccctgctccctccctggaggctgctcttctgattctgagagctggcctagtggtgctgagggcccctttctgcttctctgcccacctgctgagttgccactcgcagtgttgtcagttcccgtgttctgagaagaggtcatgcctgggaggaagggatcgtcatgctgcatcgaatcctctctccgccgtgtggcccccaggagagtagctgcctgttgcacctgctccacacctccccacagcctccctgcaggtgctgtgtggccgtgatgtgcagagagcagtgagggagggttcatgaaccaggtggatcctctttaaaaaaaaaaaagtttttgttatatctctagaacatttcaagtcttttcctttttttctgttcctagctatggggttttagagaagtgggaacaggaaggcatttgtctttttcttctagtttactacattttccttccgtagttcttcagctgtgtggaaacgggcatcacaaggacataggatcatagattgggtagggagggaggaggatttctggaacttttctcaaaggaatttggacccttataaatgggactgaaggtcaaaacaacagtgatatccttgcttagaaattgtcctcaaggaataaactctgagagcaagcccgggttggaaacagatgctttaaaatcctctctccagaacagtggttttttgtttgtttatttgagatggagtctcactctgtcacccaggctggagtgcagtggtgagatcttggctcactgcaacctccacctcccaggttcaagccattctcctgtctcagccccctgagtagctgggattacaggtgcccaccaccacacccggctaatttttgtatttttagtagagatggggtttcaccatgttggccaggctgatcttgaactcctgacctcaggtgatctgcctgccttggcctcccaaagtgctgggattataggtgtgagctaagatcagggattcttaaccttggctgcacaccagaatcacctggcaaattaaaaatacgtggacctgccaccagagcttgtgatttaatcagagtcggcatcagagttttcaattttttatttatttattattattattattattattattattattgagacaagatcttgctctgtcgcccagactggagtgcagtggtgtgatcacggcttgctgcagcctcgacctccctggttcaggccatcctgccacctcagcctcctgagtagtagggactacaggtaggcaccaccacacccagctaatacttttaatttttttttgtagagatagggtctcattatgttgcctggggtagtctcgaactcctaggctcaagcgatcctcctgcctcggcctcccaaagtgttgagattataggcgtgagccaccgtgcccagattcacagaagtttcatacacctttcacccaggttcccctaatgttaacagcttacatataaccttggtacatttatcaaaactaaaggtgcaatcatactaatagctagagtttatttggattttaccatttttcccaatgtcccttttctgctgcagcagccaatccaggatgccatactgcacttagagctgttgctttcttttttcctaactttatattttgaaataatttcagatgataggaagttgtaaaggtaagggccccacgcacccttcatctagtttccctccatggttacatcttatatggttgtaatgcagtattccaacaaagactctgacactggtgcgatgtgggtggacagtccaaatcatttgtcacatgtacatctgtgtaactaccactgcaatcaggataaagaagtcccatccccacaaggatctccctccccaccttccctaactcctggtaaccactaatcgttcatctcttcttattttgtcatttcaagaatgttgtataaatgggagcatagtgtgtaagcattcgggattgtcttttttcactcggcgtcattctcgggagatcatccaggcattgcatgtgtcaacagtttgctcctttttattgctgagtggtattccgtggtgtatgcattggccccctgaaggacacctgggatgtttccagtttggggctattccaaataaagctgctacgactatcttngagaaaaaaaa

SEQ ID NO: 570579 - DNA, 317 bp, Homo sapiens
tgctgtgagacacttggttttgtgcttgtgtctggtccaggtcgggatggactatttgtgtgctgatcttagaatgcttgcctgtctcttccatcctagcttgctctctctggctatcttcttcttttctacttcttatccacttgcaacatcactttcctatgagagaaaagagataaagtcatttccaagtaaagaggcagcatttattgccctgcaccctgtatttgcccttagcatttaccaacggaaatggaagtgattcagtcttctctcacatcacagaactatagtgtgatgtgagagtctccgtcaaa

SEQ ID NO: 570580 - DNA, 405 bp, Homo sapiens
cattcagtccgtcaggaaaactgtggtatgtctgtgtgttatggtaaaatatttatcctgggcggaagacggtataaggtagtactctcagactctattctctgtttttatcctgcaacaagtatcatcacaggggtagttgcaatgctcatgccattgtcctatcatggttgtgtgtactattcatagatacattgagaaatgctttaaacttgtaagacaggatacctcaccgatgaagccacactgattctagatgggaggtttttaaaactctacagtgggatctttacatatctcctttgtgccatatgtcaaaaaatataattaataattattttgtccttctcctcactaatatctatctttctatactttaattaatcttttcctataattgaaaaa

SEQ ID NO: 570581 - DNA, 269 bp, Homo sapiens
ggtccccaggcccccagggccatgccagggaaaggaaaagctcccctgaatcccgaggacccagtcccctgggtacttgctcatgggatgttgcaaaaaacacaaagtgggccttaaacatttttcaagtcatcagggtcccccttccagaatgttcaggtccccccccatttttgggtaatgtaatgaataaggcttttttcatttgtttttgaacccttgggaatttttatgcagggctttaaaaaaaaataagtgattcaatttta

SEQ ID NO: 570582 - DNA, 3615 bp, Homo sapiens
  misc_feature (3604)..(3604): n is a, c, g, or t
cggcacgaggggcagctgctggagctggcggcgcggcccgggcggctgcgggagcgggtgctggagctggcgcgcggcggcggcgacccctacagcgatctcagcaagggcgtgctgatctgatggaccgtgccaggacgtgctcacgcccctcgaagactgcttcatgctggacgccagcaccgtgctggacttcggtgtcctggccagcatcatgcagagcggccacacgcgcatcccggtgtacgaggaggagcgctccaacatcgtggacatgctctacctcaaggacttggccttcgtggatcccgaagactgcacgccgctcagcaccatcactcgtttctacaaccatccgctccacttcgtcttcaacgacaccaagctggacgctgtcctggaggaattcaagcgaggagacaccgtggtgaagaggaagcctgcttctctgatggcccctctgaagcggaaggaggagttctccttgttcaaggtgtctgatgatgaatataaagtaacaatctcgcctcagctgctcttggccacccagcgcttcctgtcccgagaagtggatgtattcagcccgctgcgcatctctgagaaggtcctgctgcacctgttgaagcatcccagtgtcaaccaggaagtgaggtttgacgagagcaaccggctggccacacaccactacctgtaccagcgcagccagccggtggattacttcattctcatcctgcagggcagggttgaagtggagatcgggaaagagggtctgaagtttgagaatggggccttcacgtactatggagtgtcggccctaactgtgccatcctcggttcaccagtccccggtgtcctcgctccagcccatccgccatgacctgcagcccgacccaggtgacggcacgcattcatctgcgtattgtcccgactacaccgtgagggcgctctctgatctgcagctcatcaaggttacgcgactgcagtacctcaatgcactcctggctacccgagcccagaacctgccacagtcccctgagaacaccgacctgcaggttattccaggcagccagaccaggctccttggtgagaagaccaccacagcggcagggtccagccacagcaggcccagccttccccttctcccccggggcagggacagtgcggcatattcagattcagacctctttgggctgagccaccttgtgagtgcagttactgcctttgtgtggccgtgacctctatttgtttgcttttaatttgccaacctatcgctgctggcagcactttttgagcaagccgagagcacccattttggctgggggttcagatcgatggccttgtccatgttgtcctttctggcttccctgatggtgtcatgtttcagcgcatgcgccccagcctttcccatgtgccaaaccagaagctccactgcccgtaggctgtccctgtagccctgctccctccctggaggctgctcttctgattctgagagctggcctagtggtgctgagggcccctttctgcttctctgcccacctgctgagttgccactcgcagtgttgtcagttcccgtgttctgagaagaggtcatgcctgggaggaagggatcgtcatgctgcatcgaatcctctctccgccgtgtggcccccaggagagtagctgcctgttgcacctgctccacacctccccacagcctccctgcaggtgctgtgtggccgtgatgtgcagagagcagtgagggagggttcatgaaccaggtggatcctctttaaaaaaaaaaaagtttttgttatatctctagaacatttcaagtcttttcctttttttctgttcctagctatggggttttagagaagtgggaacaggaaggcatttgtctttttcttctagtttactacattttccttccgtagttcttcagctgtgtggaaacgggcatcacaaggacataggatcatagattgggtagggagggaggaggatttctggaacttttctcaaaggaatttggacccttataaatgggactgaaggtcaaaacaacagtgatatccttgcttagaaattgtcctcaaggaataaactctgagagcaagcccgggttggaaacagatgctttaaaatcctctctccagaacagtggttttttgtttgtttatttgagatggagtctcactctgtcacccaggctggagtgcagtggtgagatcttggctcactgcaacctccacctcccaggttcaagccattctcctgtctcagccccctgagtagctgggattacaggtgcccaccaccacacccggctaatttttgtatttttagtagagatggggtttcaccatgttggccaggctgatcttgaactcctgacctcaggtgatctgcctgccttggcctcccaaagtgctgggattataggtgtgagctaagatcagggattcttaaccttggctgcacaccagaatcacctggcaaattaaaaatacgtggacctgccaccagagcttgtgatttaatcagagtcggcatcagagttttcaattttttatttatttattattattattattattattattattattgagacaagatcttgctctgtcgcccagactggagtgcagtggtgtgatcacggcttgctgcagcctcgacctccctggttcaggccatcctgccacctcagcctcctgagtagtagggactacaggtaggcaccaccacacccagctaatacttttaatttttttttgtagagatagggtctcattatgttgcctggggtagtctcgaactcctaggctcaagcgatcctcctgcctcggcctcccaaagtgttgagattataggcgtgagccaccgtgcccagattcacagaagtttcatacacctttcacccaggttcccctaatgttaacagcttacatataaccttggtacatttatcaaaactaaaggtgcaatcatactaatagctagagtttatttggattttaccatttttcccaatgtcccttttctgctgcagcagccaatccaggatgccatactgcacttagagctgttgctttcttttttcctaactttatattttgaaataatttcagatgataggaagttgtaaaggtaagggccccacgcacccttcatctagtttccctccatggttacatcttatatggttgtaatgcagtattccaacaaagactctgacactggtgcgatgtgggtggacagtccaaatcatttgtcacatgtacatctgtgtaactaccactgcaatcaggataaagaagtcccatccccacaaggatctccctccccaccttccctaactcctggtaaccactaatcgttcatctcttcttattttgtcatttcaagaatgttgtataaatgggagcatagtgtgtaagcattcgggattgtcttttttcactcggcgtcattctcgggagatcatccaggcattgcatgtgtcaacagtttgctcctttttattgctgagtggtattccgtggtgtatgcattggccccctgaaggacacctgggatgtttccagtttggggctattccaaataaagctgctacgactatcttngagaaaaaaaa

SEQ ID NO: 570583 - DNA, 670 bp, Homo sapiens
  misc_feature (263)..(263): n is a, c, g, or t
ggacgagcgtggtgaagatggcgtaccagatgttgtggggtggagtacctgcagaatccgaccggcttaagcgacgctgtacaccatcgtggctgtatcctcacgcaccggctgctcggtgcgagtttggaattgatcacatgcttattcgagttgtacattgcaatccgtgagttattctttatactgactttgaaactatggagattaattcaccacacttctcatgtgtggggccagtcggatccgattctcggatatanacagtgagtctggactatagtcgatatactgtacggaaatgctatagagagaggctctgtctctcgaggatctgaatcagcagtactgtgtatttatgttccttttgggtggtattctttaactgacccttgttggtctgtaagtgagctgagacaacgggggccaggcctttacaataatgctcgtctatgtgtggagccgagaggaacccctatgtccgcatgaacttcttcggccttctcaacttccaggccccctttctgccctgggtgctcatgggattttccttgtagtggggaactcaatcattgtggaccttttgggtattgcagttggacacatatagtattcttggaagatgtatttcccaatcaagctggtggaataagaattctgaaaacaccat

SEQ ID NO: 570584 - DNA, 4142 bp, Homo sapiens
  misc_feature (4131)..(4131): n is a, c, g, or t
tttttttttattttgagacggtcttgctctgtcatccaggctggagtacagtggcgcattcatggcttactgcagcctcaacttcccagactcaagtgttcctcccacctcagcctcctgagcagttgggactacaggcgcatgcaccacacccgtctaattattttatttttttgtaaagacacggtctctctatgttgcctaggctggtgttgaacttctggccttaagtgatcctcccgcctcagcctcctaaagtgctagggttacaggtgtgaatcactacatctggcctaaatttaaaaaagtttttagtctacatccagtgacctatcagggatgcttgttattttatacaagctgctttgttatcatatcagcattctcttcagccagctccaaggcagatagtcacccctctctctgtgtggttggggtgggagcaggccccgtggagggagcggtgctgaggacatgtccctggcgttccgatgctgctccatcgaggaccccctggcctcaggaggaaggagcaggcgatgcagccccttagtgtggtcgtgttgactgacaggtggctgatgcctgagcgcgccctcttcttccatcttaggagacaccgtggtgaagaggaagcctgcttctctgatggcccctctgaagcggaaggaggagttctccttgttcaaggtgtctgatgatgaatataaagtaacaatctcgcctcagctgctcttggccacccagcgcttcctgtcccgagaagtggatgtattcagcccgctgcgcatctctgagaaggtcctgctgcacctgttgaagcatcccagtgtcaaccaggaagtgaggtttgacgagagcaaccggctggccacacaccactacctgtaccagcgcagccagccggtggattacttcattctcatcctgcagggcagggttgaagtggagatcgggaaagagggtctgaagtttgagaatggggccttcacgtactatggagtgtcggccctaactgtgccatcctcggttcaccagtccccggtgtcctcgctccagcccatccgccatgacctgcagcccgacccaggtgacggcacgcattcatctgcgtattgtcccgactacaccgtgagggcgctctctgatctgcagctcatcaaggttacgcgactgcagtacctcaatgcactcctggctacccgagcccagaacctgccacagtcccctgagaacaccgacctgcaggttattccaggcagccagaccaggctccttggtgagaagaccaccacagcggcagggtccagccacagcaggcccggcgtcccggtggaaggcagccctgggcggaacccaggcgtttaacggctcactaggcagccccagatctggggaacagatgagcacgtggggagctggagtgagctgagcagaagttttgtgcccgcctgcccccatcccctccaggccacgttttagatggcccttgtagttgcgggtcctgggtgtcctcagaactagacatcaatgcctggatccttcagccggccctgccctcctttaggagacaggagtcaccagggcacagccctccaggcccgcctcaggaaggaatgaaaggaatgccatcatctctagttcccagggcccagccttccccttctcccccggggcagggacagtgcggcatattcagattcagacctctttgggctgagccaccttgtgagtgcagttactgcctttgtgtggccgtgacctctatttgtttgcttttaatttgccaacctatcgctgctggcagcactttttgagcaagccgagagcacccattttggctgggggttcagatcgatggccttgtccatgttgtcctttctggcttccctgatggtgtcatgtttcagcgcatgcgccccagcctttcccatgtgccaaaccagaagctccactgcccgtaggctgtccctgtagccctgctccctccctggaggctgctcttctgattctgagagctggcctagtggtgctgagggcccctttctgcttctctgcccacctgctgagttgccactcgcagtgttgtcagttcccgtgttctgagaagaggtcatgcctgggaggaagggatcgtcatgctgcatcgaatcctctctccgccgtgtggcccccaggagagtagctgcctgttgcacctgctccacacctccccacagcctccctgcaggtgctgtgtggccgtgatgtgcagagagcagtgagggagggttcatgaaccaggtggatcctctttaaaaaaaaaaaagtttttgttatatctctagaacatttcaagtcttttcctttttttctgttcctagctatggggttttagagaagtgggaacaggaaggcatttgtctttttcttctagtttactacattttccttccgtagttcttcagctgtgtggaaacgggcatcacaaggacataggatcatagattgggtagggagggaggaggatttctggaacttttctcaaaggaatttggacccttataaatgggactgaaggtcaaaacaacagtgatatccttgcttagaaattgtcctcaaggaataaactctgagagcaagcccgggttggaaacagatgctttaaaatcctctctccagaacagtggttttttgtttgtttatttgagatggagtctcactctgtcacccaggctggagtgcagtggtgagatcttggctcactgcaacctccacctcccaggttcaagccattctcctgtctcagccccctgagtagctgggattacaggtgcccaccaccacacccggctaatttttgtatttttagtagagatggggtttcaccatgttggccaggctgatcttgaactcctgacctcaggtgatctgcctgccttggcctcccaaagtgctgggattataggtgtgagctaagatcagggattcttaaccttggctgcacaccagaatcacctggcaaattaaaaatacgtggacctgccaccagagcttgtgatttaatcagagtcggcatcagagttttcaattttttatttatttattattattattattattattattattattgagacaagatcttgctctgtcgcccagactggagtgcagtggtgtgatcacggcttgctgcagcctcgacctccctggttcaggccatcctgccacctcagcctcctgagtagtagggactacaggtaggcaccaccacacccagctaatacttttaatttttttttgtagagatagggtctcattatgttgcctggggtagtctcgaactcctaggctcaagcgatcctcctgcctcggcctcccaaagtgttgagattataggcgtgagccaccgtgcccagattcacagaagtttcatacacctttcacccaggttcccctaatgttaacagcttacatataaccttggtacatttatcaaaactaaaggtgcaatcatactaatagctagagtttatttggattttaccatttttcccaatgtcccttttctgctgcagcagccaatccaggatgccatactgcacttagagctgttgctttcttttttcctaactttatattttgaaataatttcagatgataggaagttgtaaaggtaagggccccacgcacccttcatctagtttccctccatggttacatcttatatggttgtaatgcagtattccaacaaagactctgacactggtgcgatgtgggtggacagtccaaatcatttgtcacatgtacatctgtgtaactaccactgcaatcaggataaagaagtcccatccccacaaggatctccctccccaccttccctaactcctggtaaccactaatcgttcatctcttcttattttgtcatttcaagaatgttgtataaatgggagcatagtgtgtaagcattcgggattgtcttttttcactcggcgtcattctcgggagatcatccaggcattgcatgtgtcaacagtttgctcctttttattgctgagtggtattccgtggtgtatgcattggccccctgaaggacacctgggatgtttccagtttggggctattccaaataaagctgctacgactatcttngagaaaaaaaa

SEQ ID NO: 570585 - DNA, 216 bp, Homo sapiens
agcggacaatcacttgagcacaggaggcggaggctacagtgagctgagatcctccactgcactccagcctggaagacagagtgagagtgcagtggcgcaaactcagctcacagcaacctccctttctttctttttttttttggaaagggattctggctctgtggccaaggtggaattgcaggggtgcaatcttggttcatggaaacttctctctct

SEQ ID NO: 570586 - DNA, 2348 bp, Homo sapiens
cggcacgaggggcagctgctggagctggcggcgcggcccgggcggctgcgggagcgggtgctggagctggcgcgcggcggcggcgacccctacagcgatctcagcaagggcgtgctgatctgatggaccgtgccaggacgtgctcacgcccctcgaagactgcttcatgctggacgccagcaccgtgctggacttcggtgtcctggccagcatcatgcagagcggccacacgcgcatcccggtgtacgaggaggagcgctccaacatcgtggacatgctctacctcaaggacttggccttcgtggatcccgaagactgcacgccgctcagcaccatcactcgtttctacaaccatccgctccacttcgtcttcaacgacaccaagctggacgctgtcctggaggaattcaagcgaggagacaccgtggtgaagaggaagcctgcttctctgatggcccctctgaagcggaaggaggagttctccttgttcaaggtgtctgatgatgaatataaagtaacaatctcgcctcagctgctcttggccacccagcgcttcctgtcccgagaagtggatgtattcagcccgctgcgcatctctgagaaggtcctgctgcacctgttgaagcatcccagtgtcaaccaggaagtgaggtttgacgagagcaaccggctggccacacaccactacctgtaccagcgcagccagccggtggattacttcattctcatcctgcagggcagggttgaagtggagatcgggaaagagggtctgaagtttgagaatggggccttcacgtactatggagtgtcggccctaactgtgccatcctcggttcaccagtccccggtgtcctcgctccagcccatccgccatgacctgcagcccgacccaggtgacggcacgcattcatctgcgtattgtcccgactacaccgtgagggcgctctctgatctgcagctcatcaaggttacgcgactgcagtacctcaatgcactcctggctacccgagcccagaacctgccacagtcccctgagaacaccgacctgcaggttattccaggcagccagaccaggctccttggtgagaagaccaccacagcggcagggtccagccacagcaggcccggcgtcccggtggaaggcagccctgggcggaacccaggcgtttaacggctcactaggcagccccagatctggggaacagatgagcacgtggggagctggagtgagctgagcagaagttttgtgcccgcctgcccccatcccctccaggccacgttttagatggcccttgtagttgcgggtcctgggtgtcctcagaactagacatcaatgcctggatccttcagccggccctgccctcctttaggagacaggagtcaccagggcacagccctccaggcccgcctcaggaaggaatgaaaggaatgccatcatctctagttcccagggcccagccttccccttctcccccggggcagggacagtgcggcatattcagattcagacctctttgggctgagccaccttgtgagtgcagttactgcctttgtgtggccgtgacctctatttgtttgcttttaatttgccaacctatcgctgctggcagcactttttgagcaagccgagagcacccattttggctgggggttcagatcgatggccttgtccatgttgtcctttctggcttccctgatggtgtcatgtttcagcgcatgcgccccagcctttcccatgtgccaaaccagaagctccactgcccgtaggctgtccctgtagccctgctccctccctggaggctgctcttctgattctgagagctggcctagtggtgctgagggcccctttctgcttctctgcccacctgctgagttgccactcgcagtgttgtcagttcccgtgttctgagaagaggtcatgcctgggaggaagggatcgtcatgctgcatcgaatcctctctccgccgtgtggcccccaggagagtagctgcctgttgcacctgctccacacctccccacagcctccctgcaggtgctgtgtggccgtgatgtgcagagagcagtgagggagggttcatgaaccaggtggatcctctttaaaaaaaaaaaagtttttgttatatctctaacacccacccccccctctacccccccactccccctccccttcccctcctcccctactctcctcctcctcttccgcccccactcctctcctactcccaccacactgggggcccgccttggcccaatcctctctaacttcccccagtctttcctctgcccccaatctagctcacttgcccttcccctctatccggcgcgcattccatctcctggccgggct

SEQ ID NO: 570587 - DNA, 2164 bp, Homo sapiens
cggcacgaggggcagctgctggagctggcggcgcggcccgggcggctgcgggagcgggtgctggagctggcgcgcggcggcggcgacccctacagcgatctcagcaagggcgtgctgatctgatggaccgtgccaggacgtgctcacgcccctcgaagactgcttcatgctggacgccagcaccgtgctggacttcggtgtcctggccagcatcatgcagagcggccacacgcgcatcccggtgtacgaggaggagcgctccaacatcgtggacatgctctacctcaaggacttggccttcgtggatcccgaagactgcacgccgctcagcaccatcactcgtttctacaaccatccgctccacttcgtcttcaacgacaccaagctggacgctgtcctggaggaattcaagcgaggagacaccgtggtgaagaggaagcctgcttctctgatggcccctctgaagcggaaggaggagttctccttgttcaaggtgtctgatgatgaatataaagtaacaatctcgcctcagctgctcttggccacccagcgcttcctgtcccgagaagtggatgtattcagcccgctgcgcatctctgagaaggtcctgctgcacctgttgaagcatcccagtgtcaaccaggaagtgaggtttgacgagagcaaccggctggccacacaccactacctgtaccagcgcagccagccggtggattacttcattctcatcctgcagggcagggttgaagtggagatcgggaaagagggtctgaagtttgagaatggggccttcacgtactatggagtgtcggccctaactgtgccatcctcggttcaccagtccccggtgtcctcgctccagcccatccgccatgacctgcagcccgacccaggtgacggcacgcattcatctgcgtattgtcccgactacaccgtgagggcgctctctgatctgcagctcatcaaggttacgcgactgcagtacctcaatgcactcctggctacccgagcccagaacctgccacagtcccctgagaacaccgacctgcaggttattccaggcagccagaccaggctccttggtgagaagaccaccacagcggcagggtccagccacagcaggcccggcgtcccggtggaaggcagccctgggcggaacccaggcgtttaacggctcactaggcagccccagatctggggaacagatgagcacgtggggagctggagtgagctgagcagaagttttgtgcccgcctgcccccatcccctccaggccacgttttagatggcccttgtagttgcgggtcctgggtgtcctcagaactagacatcaatgcctggatccttcagccggccctgccctcctttaggagacaggagtcaccagggcacagccctccaggcccgcctcaggaaggaatgaaaggaatgccatcatctctagttcccagggcccagccttccccttctcccccggggcagggacagtgcggcatattcagattcagacctctttgggctgagccaccttgtgagtgcagttactgcctttgtgtggccgtgacctctatttgtttgcttttaatttgccaacctatcgctgctggcagcactttttgagcaagccgagagcacccattttggctgggggttcagatcgatggccttgtccatgttgtcctttctggcttccctgatggtgtcatgtttcagcgcatgcgccccagcctttcccatgtgccaaaccagaagctccactgcccgtaggctgtccctgtagccctgctccctccctggaggctgctcttctgattctgagagctggcctagtggtgctgagggcccctttctgcttctctgcccacctgctgagttgccactcgcagtgttgtcagttcccgtgttctgagaagaggtcatgcctgggaggaagggatcgtcatgctgcatcgaatcctctctccgccgtgtggcccccaggagagtagctgcctgttgcacctgctccacacctccccacagcctccctgcaggtgctgtgtggccgtgatgtgcagagagcagtgagggagggttcatgaaccaggtggatcctctttaaaaaaaaaaagtcggatacaattcactggcccgcgtttaccgtcgtgactggccctggcgtccc

SEQ ID NO: 570588 - DNA, 3833 bp, Homo sapiens
  misc_feature (3822)..(3822): n is a, c, g, or t
tttttttttaaagatagggtctcgctctgtcacccaggctggagtgcagtggcacgatgttggctcactgcaacctccgccttctgggttcaagtgattctcctgcctcagcctcccaagtagctgggattacaggcgtgtatcaccacgcccagctaatttttgtatttttagtagaggcggggttttgccatattggccaggctggtctccaactcctgactgcaggtgatccacctgcctcagcctccgaaagtgttgggattaaggcgtgagccaccgcacctggcccctgcctagttctcttgtgttgaggtgttaggggcagctgctcacaggccacccgggagatccctggtgggcacaataactttaaattgcctacagtgttgggtgtggttccactggccactaggccccagtggacactgtcccttttttccaccacgtgcagaagtggatgtattcagcccgctgcgcatctctgagaaggtcctgctgcacctgttgaagcatcccagtgtcaaccaggaagtgaggtttgacgagagcaaccggctggccacacaccactacctgtaccagcgcagccagccggtggattacttcattctcatcctgcagggcagggttgaagtggagatcgggaaagagggtctgaagtttgagaatggggccttcacgtactatggagtgtcggccctaactgtgccatcctcggttcaccagtccccggtgtcctcgctccagcccatccgccatgacctgcagcccgacccaggtgacggcacgcattcatctgcgtattgtcccgactacaccgtgagggcgctctctgatctgcagctcatcaaggttacgcgactgcagtacctcaatgcactcctggctacccgagcccagaacctgccacagtcccctgagaacaccgacctgcaggttattccaggcagccagaccaggctccttggtgagaagaccaccacagcggcagggtccagccacagcaggcccggcgtcccggtggaaggcagccctgggcggaacccaggcgtttaacggctcactaggcagccccagatctggggaacagatgagcacgtggggagctggagtgagctgagcagaagttttgtgcccgcctgcccccatcccctccaggccacgttttagatggcccttgtagttgcgggtcctgggtgtcctcagaactagacatcaatgcctggatccttcagccggccctgccctcctttaggagacaggagtcaccagggcacagccctccaggcccgcctcaggaaggaatgaaaggaatgccatcatctctagttcccagggcccagccttccccttctcccccggggcagggacagtgcggcatattcagattcagacctctttgggctgagccaccttgtgagtgcagttactgcctttgtgtggccgtgacctctatttgtttgcttttaatttgccaacctatcgctgctggcagcactttttgagcaagccgagagcacccattttggctgggggttcagatcgatggccttgtccatgttgtcctttctggcttccctgatggtgtcatgtttcagcgcatgcgccccagcctttcccatgtgccaaaccagaagctccactgcccgtaggctgtccctgtagccctgctccctccctggaggctgctcttctgattctgagagctggcctagtggtgctgagggcccctttctgcttctctgcccacctgctgagttgccactcgcagtgttgtcagttcccgtgttctgagaagaggtcatgcctgggaggaagggatcgtcatgctgcatcgaatcctctctccgccgtgtggcccccaggagagtagctgcctgttgcacctgctccacacctccccacagcctccctgcaggtgctgtgtggccgtgatgtgcagagagcagtgagggagggttcatgaaccaggtggatcctctttaaaaaaaaaaaagtttttgttatatctctagaacatttcaagtcttttcctttttttctgttcctagctatggggttttagagaagtgggaacaggaaggcatttgtctttttcttctagtttactacattttccttccgtagttcttcagctgtgtggaaacgggcatcacaaggacataggatcatagattgggtagggagggaggaggatttctggaacttttctcaaaggaatttggacccttataaatgggactgaaggtcaaaacaacagtgatatccttgcttagaaattgtcctcaaggaataaactctgagagcaagcccgggttggaaacagatgctttaaaatcctctctccagaacagtggttttttgtttgtttatttgagatggagtctcactctgtcacccaggctggagtgcagtggtgagatcttggctcactgcaacctccacctcccaggttcaagccattctcctgtctcagccccctgagtagctgggattacaggtgcccaccaccacacccggctaatttttgtatttttagtagagatggggtttcaccatgttggccaggctgatcttgaactcctgacctcaggtgatctgcctgccttggcctcccaaagtgctgggattataggtgtgagctaagatcagggattcttaaccttggctgcacaccagaatcacctggcaaattaaaaatacgtggacctgccaccagagcttgtgatttaatcagagtcggcatcagagttttcaattttttatttatttattattattattattattattattattattgagacaagatcttgctctgtcgcccagactggagtgcagtggtgtgatcacggcttgctgcagcctcgacctccctggttcaggccatcctgccacctcagcctcctgagtagtagggactacaggtaggcaccaccacacccagctaatacttttaatttttttttgtagagatagggtctcattatgttgcctggggtagtctcgaactcctaggctcaagcgatcctcctgcctcggcctcccaaagtgttgagattataggcgtgagccaccgtgcccagattcacagaagtttcatacacctttcacccaggttcccctaatgttaacagcttacatataaccttggtacatttatcaaaactaaaggtgcaatcatactaatagctagagtttatttggattttaccatttttcccaatgtcccttttctgctgcagcagccaatccaggatgccatactgcacttagagctgttgctttcttttttcctaactttatattttgaaataatttcagatgataggaagttgtaaaggtaagggccccacgcacccttcatctagtttccctccatggttacatcttatatggttgtaatgcagtattccaacaaagactctgacactggtgcgatgtgggtggacagtccaaatcatttgtcacatgtacatctgtgtaactaccactgcaatcaggataaagaagtcccatccccacaaggatctccctccccaccttccctaactcctggtaaccactaatcgttcatctcttcttattttgtcatttcaagaatgttgtataaatgggagcatagtgtgtaagcattcgggattgtcttttttcactcggcgtcattctcgggagatcatccaggcattgcatgtgtcaacagtttgctcctttttattgctgagtggtattccgtggtgtatgcattggccccctgaaggacacctgggatgtttccagtttggggctattccaaataaagctgctacgactatcttngagaaaaaaaa

SEQ ID NO: 570589 - DNA, 735 bp, Homo sapiens
gaagactgttccggagccagttatcgcagaggagctaggaagcctttcccgtctgctgtcttccttttgactcagacacgtcctccagagctggcgtgcttgtgcattccctctgctttccttggacagtcccctcctttccatctacagagtgggagctttgaagaagtactcacagatcactagctgcacgagaagaaccatgcaagagaccggcttccaacctcagattgcagcaagctaggattgttggccacgggaatagaacgatagaagcttcaagcccacccacgttattatactgagaggacgacacagcacttcatctggtaaactacagcaatagagactgagaaggtatgctttgagctctgtactgaggccacgttaggggatggaaacgggtgaggctaaggcagggttacaggaacgtggaagagaaggtctgggagagaggaaaagtgtgaggctaggcaggcggctcatgcctgtagatcccaaggatctctgggaagcccaaagggcaggaggagtcattttggagtccagggagtgtagaacccgcagtccctggcgtgacaatagatgagaactttgtcgtctactacatgagggaaagaagcaccggttacaaacacggcttaggacgggaatggttgcgggggggagccattgcccagaccgggcaccccgtgacggaatgaccagggaggtgccgggggggggggcggcagg

SEQ ID NO: 570590 - DNA, 3695 bp, Homo sapiens
  misc_feature (3684)..(3684): n is a, c, g, or t
tttttttttaaagatagggtctcgctctgtcacccaggctggagtgcagtggcacgatgttggctcactgcaacctccgccttctgggttcaagtgattctcctgcctcagcctcccaagtagctgggattacaggcgtgaccgcacctggcccctgcctagttctcttgtgttgaggtgttaggggcagctgctcacaggccacccgggagatccctggtgggcacaataactttaaattgcctacagtgttgggtgtggttccactggccactaggccccagtggacactgtcccttttttccaccacgtgcagaagtggatgtattcagcccgctgcgcatctctgagaaggtcctgctgcacctgttgaagcatcccagtgtcaaccaggaagtgaggtttgacgagagcaaccggctggccacacaccactacctgtaccagcgcagccagccggtggattacttcattctcatcctgcagggcagggttgaagtggagatcgggaaagagggtctgaagtttgagaatggggccttcacgtactatggagtgtcggccctaactgtgccatcctcggttcaccagtccccggtgtcctcgctccagcccatccgccatgacctgcagcccgacccaggtgacggcacgcattcatctgcgtattgtcccgactacaccgtgagggcgctctctgatctgcagctcatcaaggttacgcgactgcagtacctcaatgcactcctggctacccgagcccagaacctgccacagtcccctgagaacaccgacctgcaggttattccaggcagccagaccaggctccttggtgagaagaccaccacagcggcagggtccagccacagcaggcccggcgtcccggtggaaggcagccctgggcggaacccaggcgtttaacggctcactaggcagccccagatctggggaacagatgagcacgtggggagctggagtgagctgagcagaagttttgtgcccgcctgcccccatcccctccaggccacgttttagatggcccttgtagttgcgggtcctgggtgtcctcagaactagacatcaatgcctggatccttcagccggccctgccctcctttaggagacaggagtcaccagggcacagccctccaggcccgcctcaggaaggaatgaaaggaatgccatcatctctagttcccagggcccagccttccccttctcccccggggcagggacagtgcggcatattcagattcagacctctttgggctgagccaccttgtgagtgcagttactgcctttgtgtggccgtgacctctatttgtttgcttttaatttgccaacctatcgctgctggcagcactttttgagcaagccgagagcacccattttggctgggggttcagatcgatggccttgtccatgttgtcctttctggcttccctgatggtgtcatgtttcagcgcatgcgccccagcctttcccatgtgccaaaccagaagctccactgcccgtaggctgtccctgtagccctgctccctccctggaggctgctcttctgattctgagagctggcctagtggtgctgagggcccctttctgcttctctgcccacctgctgagttgccactcgcagtgttgtcagttcccgtgttctgagaagaggtcatgcctgggaggaagggatcgtcatgctgcatcgaatcctctctccgccgtgtggcccccaggagagtagctgcctgttgcacctgctccacacctccccacagcctccctgcaggtgctgtgtggccgtgatgtgcagagagcagtgagggagggttcatgaaccaggtggatcctctttaaaaaaaaaaaagtttttgttatatctctagaacatttcaagtcttttcctttttttctgttcctagctatggggttttagagaagtgggaacaggaaggcatttgtctttttcttctagtttactacattttccttccgtagttcttcagctgtgtggaaacgggcatcacaaggacataggatcatagattgggtagggagggaggaggatttctggaacttttctcaaaggaatttggacccttataaatgggactgaaggtcaaaacaacagtgatatccttgcttagaaattgtcctcaaggaataaactctgagagcaagcccgggttggaaacagatgctttaaaatcctctctccagaacagtggttttttgtttgtttatttgagatggagtctcactctgtcacccaggctggagtgcagtggtgagatcttggctcactgcaacctccacctcccaggttcaagccattctcctgtctcagccccctgagtagctgggattacaggtgcccaccaccacacccggctaatttttgtatttttagtagagatggggtttcaccatgttggccaggctgatcttgaactcctgacctcaggtgatctgcctgccttggcctcccaaagtgctgggattataggtgtgagctaagatcagggattcttaaccttggctgcacaccagaatcacctggcaaattaaaaatacgtggacctgccaccagagcttgtgatttaatcagagtcggcatcagagttttcaattttttatttatttattattattattattattattattattattgagacaagatcttgctctgtcgcccagactggagtgcagtggtgtgatcacggcttgctgcagcctcgacctccctggttcaggccatcctgccacctcagcctcctgagtagtagggactacaggtaggcaccaccacacccagctaatacttttaatttttttttgtagagatagggtctcattatgttgcctggggtagtctcgaactcctaggctcaagcgatcctcctgcctcggcctcccaaagtgttgagattataggcgtgagccaccgtgcccagattcacagaagtttcatacacctttcacccaggttcccctaatgttaacagcttacatataaccttggtacatttatcaaaactaaaggtgcaatcatactaatagctagagtttatttggattttaccatttttcccaatgtcccttttctgctgcagcagccaatccaggatgccatactgcacttagagctgttgctttcttttttcctaactttatattttgaaataatttcagatgataggaagttgtaaaggtaagggccccacgcacccttcatctagtttccctccatggttacatcttatatggttgtaatgcagtattccaacaaagactctgacactggtgcgatgtgggtggacagtccaaatcatttgtcacatgtacatctgtgtaactaccactgcaatcaggataaagaagtcccatccccacaaggatctccctccccaccttccctaactcctggtaaccactaatcgttcatctcttcttattttgtcatttcaagaatgttgtataaatgggagcatagtgtgtaagcattcgggattgtcttttttcactcggcgtcattctcgggagatcatccaggcattgcatgtgtcaacagtttgctcctttttattgctgagtggtattccgtggtgtatgcattggccccctgaaggacacctgggatgtttccagtttggggctattccaaataaagctgctacgactatcttngagaaaaaaaa

SEQ ID NO: 570591 - DNA, 207 bp, Homo sapiens
agcagcatcagtgtagagcaaggaacggtccagggtatggcagggcagggacagggaggtccagggccagagtcaggtccaggacatgtacagggcagggccagaaacatgtcaggaccagaaaggggacagggcaagggcaaggccagagaaggaccatgttaaaaacatggccagggagggtccaggtcaagggcgagtccaggg

SEQ ID NO: 570592 - DNA, 3244 bp, Homo sapiens
  misc_feature (85)..(85): n is a, c, g, or t
  misc_feature (126)..(126): n is a, c, g, or t
  misc_feature (3233)..(3233): n is a, c, g, or t
cctttagccgactttgtgtcaccgggggctagaccagctggtctgagactgcccggaacaaggccttccactcatcctgaggganacagacctttgcacccagtttccaagcaaggtcttaaaaanacttgactcagttgctcttctctgcccttaactagcttaaagttgtgcctctgtcctcttcgggcacggtgtcacctttcctgcctaccttctgcatctcgcttcaccaattgggtcccagtaacgctgtcatcctccaggttacgcgactgcagtacctcaatgcactcctggctacccgagcccagaacctgccacagtcccctgagaacaccgacctgcaggttattccaggcagccagaccaggctccttggtgagaagaccaccacagcggcagggtccagccacagcaggcccggcgtcccggtggaaggcagccctgggcggaacccaggcgtttaacggctcactaggcagccccagatctggggaacagatgagcacgtggggagctggagtgagctgagcagaagttttgtgcccgcctgcccccatcccctccaggccacgttttagatggcccttgtagttgcgggtcctgggtgtcctcagaactagacatcaatgcctggatccttcagccggccctgccctcctttaggagacaggagtcaccagggcacagccctccaggcccgcctcaggaaggaatgaaaggaatgccatcatctctagttcccagggcccagccttccccttctcccccggggcagggacagtgcggcatattcagattcagacctctttgggctgagccaccttgtgagtgcagttactgcctttgtgtggccgtgacctctatttgtttgcttttaatttgccaacctatcgctgctggcagcactttttgagcaagccgagagcacccattttggctgggggttcagatcgatggccttgtccatgttgtcctttctggcttccctgatggtgtcatgtttcagcgcatgcgccccagcctttcccatgtgccaaaccagaagctccactgcccgtaggctgtccctgtagccctgctccctccctggaggctgctcttctgattctgagagctggcctagtggtgctgagggcccctttctgcttctctgcccacctgctgagttgccactcgcagtgttgtcagttcccgtgttctgagaagaggtcatgcctgggaggaagggatcgtcatgctgcatcgaatcctctctccgccgtgtggcccccaggagagtagctgcctgttgcacctgctccacacctccccacagcctccctgcaggtgctgtgtggccgtgatgtgcagagagcagtgagggagggttcatgaaccaggtggatcctctttaaaaaaaaaaaagtttttgttatatctctagaacatttcaagtcttttcctttttttctgttcctagctatggggttttagagaagtgggaacaggaaggcatttgtctttttcttctagtttactacattttccttccgtagttcttcagctgtgtggaaacgggcatcacaaggacataggatcatagattgggtagggagggaggaggatttctggaacttttctcaaaggaatttggacccttataaatgggactgaaggtcaaaacaacagtgatatccttgcttagaaattgtcctcaaggaataaactctgagagcaagcccgggttggaaacagatgctttaaaatcctctctccagaacagtggttttttgtttgtttatttgagatggagtctcactctgtcacccaggctggagtgcagtggtgagatcttggctcactgcaacctccacctcccaggttcaagccattctcctgtctcagccccctgagtagctgggattacaggtgcccaccaccacacccggctaatttttgtatttttagtagagatggggtttcaccatgttggccaggctgatcttgaactcctgacctcaggtgatctgcctgccttggcctcccaaagtgctgggattataggtgtgagctaagatcagggattcttaaccttggctgcacaccagaatcacctggcaaattaaaaatacgtggacctgccaccagagcttgtgatttaatcagagtcggcatcagagttttcaattttttatttatttattattattattattattattattattattgagacaagatcttgctctgtcgcccagactggagtgcagtggtgtgatcacggcttgctgcagcctcgacctccctggttcaggccatcctgccacctcagcctcctgagtagtagggactacaggtaggcaccaccacacccagctaatacttttaatttttttttgtagagatagggtctcattatgttgcctggggtagtctcgaactcctaggctcaagcgatcctcctgcctcggcctcccaaagtgttgagattataggcgtgagccaccgtgcccagattcacagaagtttcatacacctttcacccaggttcccctaatgttaacagcttacatataaccttggtacatttatcaaaactaaaggtgcaatcatactaatagctagagtttatttggattttaccatttttcccaatgtcccttttctgctgcagcagccaatccaggatgccatactgcacttagagctgttgctttcttttttcctaactttatattttgaaataatttcagatgataggaagttgtaaaggtaagggccccacgcacccttcatctagtttccctccatggttacatcttatatggttgtaatgcagtattccaacaaagactctgacactggtgcgatgtgggtggacagtccaaatcatttgtcacatgtacatctgtgtaactaccactgcaatcaggataaagaagtcccatccccacaaggatctccctccccaccttccctaactcctggtaaccactaatcgttcatctcttcttattttgtcatttcaagaatgttgtataaatgggagcatagtgtgtaagcattcgggattgtcttttttcactcggcgtcattctcgggagatcatccaggcattgcatgtgtcaacagtttgctcctttttattgctgagtggtattccgtggtgtatgcattggccccctgaaggacacctgggatgtttccagtttggggctattccaaataaagctgctacgactatcttngagaaaaaaaa

SEQ ID NO: 570593 - DNA, 401 bp, Homo sapiens
  misc_feature (56)..(56): n is a, c, g, or t
atgagctgccgcagcacttgcaatcccagttgggcagctggtccgggaagatatgnaggccagtaatgtaccagaaccccggttgcccgggggaagatgtcccccgagggctagaagagccccccgcccctgcagctaggaaaccccgcagtgaaaaggttggggccttccgtgaacggtgagcggcacctgagcgagaaccgcggggcctcgagccagcagcagcggaaccggcgcggcgagggcccttcacatgcatggagtgcggcaagagcttccgcctgaagatcaacctcatcatccaccagcgcaaccacatcaaggaggggccctacgagtgcgccgaatgcgagatcagcttccgggaaaagcaacagctccaggtgcaccagcgcatccac

SEQ ID NO: 570594 - DNA, 1052 bp, Homo sapiens
atctgtatgcagtcataactttgtaatcctcatctccaattataccatggatccggagccccggttggtactaagattagatcctcagtgacgctacttcctagatgatagatcagtgaccgcagcgcgaggggtcgaggatccgattgtacctgcgtctgagcgaaagatatgaactgctgatgaactatggattgctggtcgaactaagcctcgagccgtgtcactcgggggggtaatgttggatatctcttacactcaagattcgacctgtggctttgcatagattgcgccctgattccatcccattgtttcattattcttctgttcatcgtttctgttttatgttagcccattctggtggtccaagttacgcatcagcctctgtagattcgatctacatctatcgctacttctgctcatctgcatcgtaagagtgtgcattggataccctaacattgctttggtccctgatagatatattgggatgatccctgctcactagtaaaagcacactgtgctcgtatagacttgtctgttttgactgggagactttattctattcccttcgagtttggcaggaatcacttgatgttgactgattgggctaagtaatgctgtttaaagattgcgcttggtaaggattgatttggacaggcgggcctcccggccaccaaaagaggtcccccaccgaggaggccgcaaagtgagattctgaccctgatcctgttgttgccaactgtgggccgtgtgttgggatcggattataaccccaatgagattgcgcgtttagctgcacaacggacgatcctgcaacacgtgttccttcggaccctgtgtaaggaccctatgtttcggtcgtttgcatgttggacaactcccccttgagatattaagtcttaggtaaaattgctcggcggtaatttgttgcctacggttaccttggttgcaattacgcctgggtataactacgactctaccagactgcattcaaaatcaccagcatatcaacgcagcaaccgtatacgcccggcgaccatgtgatatattac

SEQ ID NO: 570595 - DNA, 504 bp, Homo sapiens
  misc_feature (11)..(11): n is a, c, g, or t
gtgactctganatcccggacgctcggagagaggatagggctagctcgcctttgcagaaaaggagtacaggagagaaaaagagaagaaacactttccagagttcctgcaaccgtgcttatgcgatagttactattatgaagatggaggaatgaagccaagagtgatgaaagaagctgtatctactccatcacgaatgggccaccaggatcaggaatggtatgatgctgaaattgccagaaaactgcaagatgaagaacttttggctgcccaggtggacatgagagccgctcaagtagctcaagatgaagaaatcgctcgacttctaatggctgaagaaaagaaagcttacaaaaaagccaagggagcgggagacatcatctttggacaaaagaaagcaagcacccgagtgggagccaaaaacagctaaagcagcaaattccaagtcaaaagagagtggtgaacctcaccattctaagaatgaaaggccagcacgggcaccaccac

SEQ ID NO: 570596 - DNA, 214 bp, Homo sapiens
ctctcagcttcagggcaaagagcaataaattttcagcattcatcagcaaccatggcattccaaagtgcactggaacaaattggctgacaccttactggtaacctgctattcttctggtgttacccttcaggctagttccactcacaatttacttttccaaaaatttacttcacattattctcatgtaagtgatgacttgtcagtgttcccggtg

SEQ ID NO: 570597 - DNA, 878 bp, Homo sapiens
cagtgaaggaaaattaacccgggtgggcagaacttcgagcagtgcacctgggatgtgcactttgcatggaaggagaaatgaccagtatgtgtgatgtcatatactgcattaatatggttgtagaccacatggtcttgagctggtatagatcagggaacttttggtaaggaagcatgatgttggtggaaagttggctgacagaagcaaaatttggggaacgagtggcatgtgaggtgatgcgatgcatcgtctggagatggtcacaaaaccatggaagaatattttgctagtccccatgctggaggtgctgcaccctaacgggttgaccctgctgtacgatggagggatgtgttacttatactcaatctgggataggagtgacctgtgcgtgtggacattcaaccgcaggtagctcttttccccagatgcagcaccgtgttccattgcaccagatgggccccataaaagcataagctgtgtccatgtgctcggtcaaaaggaattggctctgtttgactgcgagtgtggcggctcaggtaacatgtggatcgttccatcttcacacaatggcgtagaatccgtgggctttgttgcgctccacctgcatggatatgtcgctcaatatattgtctcatgttagacgataaggacactagatcaactgtaggccccatcggactaatggaccaatgccagttttcgcttgtgggggggttgaattccacggttcccaaagactaagcctttagtggattgcaacaaggtggtttgaagtcgaaatgggtatggcgaagccattcctttttctccacaattccaaatggggagagaacaagggggggccaatggaacgcggttttttggggtgccccttttcc

SEQ ID NO: 570598 - DNA, 162 bp, Homo sapiens
gatctgatggccgagcttgtcacagggcttatactgaagcatctctcagaaatcataaagctattatcttaaagaaagccatttttttaacttactagggagagggcatggtgaaaaatgcattggcagtttagcctcataatccaaagttcaattgaattc

SEQ ID NO: 570599 - DNA, 951 bp, Homo sapiens
  misc_feature (503)..(503): n is a, c, g, or t
  misc_feature (512)..(512): n is a, c, g, or t
  misc_feature (525)..(525): n is a, c, g, or t
actcaccggcctgggccctgtcacttctctgatagctcccagctcgctctctgcagccatgattgccagacagcagtgtgtccgaggcgggccccggggcttcagctgtggctcggccattgtaggcggtggcaagagaggtgccttcagctcagtctccatgtctggaggtgctggccgatgctcttctgggggatttggcagcagaagcctctacaacctcagggggaacaaaagcatctccatgagtgtggctgggtcacgacaaggtgcctgctttgggggtgctggaggctttggcactggtggctttggtgccggcggcttcggagctggtttcggcactggtggctttggtggtggatttgggggctccttcagtggtaagggtggccctggcttccccgtctgccccgctgggggaattcaggaggtcaccatcaaccagagcttgctcacccccctccacgtggagattgaccctgagatccagaaagtccggncggaagagngcgaacagatcangctcctcaacaaaagtttgcctcttcatcgacaaggtcagttcttagagcaacagaataaggtcctggagaccaaatggaacctgctccagcagcagacgaccaccaccttcagcaaaaaccttgagcccctctttgagacctacctcagtgtcctgaggaaacagctagaatacccttgggcaatgaccaaagggcgcccttgggtctggggctgaagaccatgccaggaccagtggagacctcccgctaagttttgacaccgcgatcacgaacgccctgagcgcaatgaatggggccaagagggtggaggccaactaccaggggtcgggcacgtgacgcaaagggggaacatctgagggccatacgtgggccgatagcccacgacctgttccaagaacagcgcgcgcaatatgtcgcgccaaac

SEQ ID NO: 570600 - DNA, 531 bp, Homo sapiens
tttttttttgtgcccccccgggttttttaaaaggggggaaaaaaaaaattttcccggggggacaaggaaaaaaaaaaacccctttttgggggggggggtttttaaaaaaaaggggtttttaaaggggtgccctttccaaaatggggtttccttttgggggccccttcttttatataccccaaaaaaaaaatatttttgcccagttggggttttttgcccccccccttgtttggggcccctaaaaaccccaagtagggtttttaaagggggggaccaaaaattaaagtgaaaacccctttccggggaaaatttcccggggtaaaaaaaaaagggtttttttgggtttgttccaggttttttttaacccctttgcttttccccccaaaattttttggggggtaaaccaaatttttagaaaaaccttttttggtttgtttaaaagtttcaaatgttccccggtttaaattgggggtccaaaatttaaccattttttaaaaggtttgttccccttaaaattttaatcccaaacca

SEQ ID NO: 570601 - DNA, 201 bp, Homo sapiens
atcctctgttcccaaatgggggtggcgacttttcctgaagtcgccaatgatttccctttgaaactacttttttttactaatttaaactattttggactgaggtagccctgaggtagttcatgaaaatgctgggccctccttccatggaataaatgttggaaagctgatcttttttgatataaaatgttgaatgattttaca

SEQ ID NO: 570602 - DNA, 1084 bp, Homo sapiens
ctgcgttttgtgttcgtgttgtgctgtgcgttgtcgtttcgtgtgttctgctgtgttgttttgtttttttgtgtcttctgtgacacacagataaaatacgtgtccaagaggtggggccaatgacggggacacaagttcgcacaacggggtttttcccgcggccgttattcccgttcttgagtacgcctggccaatcccagggcccaagtaaagccccggaaaaagggtccgccccccttcgtgagacccgagtctaaaaaggggaacccctggtgagaaaaggcctaagatttggccatgcacaggacatcccccttaggccctcccccgcttgggaatggccccctatatcagggtcagcggccgagctccttcctctattaccggctgtaagtgcctctgcggattaccacggtcacccacggccctgggccgccctacagctatctcagctgcttaaactggccccaccagtaccagacccgaggaccaaacgccagagaagtaagccgagactgttggccccgggcccgagaagaaggcttctgcgccaaaggggaccgtccccacgaagagacccccctgtccttcggacccaggagtttaccacccgtccaccccccttggtggagacaccaaggaagcgtccaacctggtggtgattgccaccaccgacagtggatctcccatctgagcctggttgtctttctttgcctgccctgtgtctgtaaaatgggggtccccttactgccattatccagggaaaggccagaactgggaccgtttagtcccccaggaagacctgccacccactgtctcgcccttccaacaccaggtgaactcggaagcaccaaggccgctttggctaagcttggtggaagcttatccaggacccaattcaccaatgcaccagataccgatgagatccccccgtcaactggggtggccaatagtcctgggtcctaagatctgtggctctgtatcccccagctcgaaaaggccaagggcttaagaacttgccccttaactgggtttaaagtaccctgttgagttttctgtaccattaaaataattgaaataatta

SEQ ID NO: 570603 - DNA, 152 bp, Homo sapiens
gaggatcgcgtttctatacggtcctcctcctgttctctggaaaattccaagtgccttccttggaaaggcccttttgacccctggtccctcatcagtcacacacacacactctcttattagacccctatcgcagtgactataattgggtttca

SEQ ID NO: 570604 - DNA, 160 bp, Homo sapiens
ggagtagctatcgatgggcagtgaggggcgatatgatctaggcataaatatcggagtatacgtagccggtaatgtaacacctgtacctctagaatatagtagcatggcaaattaaagcgtgatatcgatcgcgcgcagatctgtcatgatgatcattgca

SEQ ID NO: 570605 - DNA, 184 bp, Homo sapiens
atcatctttagtgggtgactcctggtggccctcccagctctggtggtgctgtggggacctgcctgtggagatgccctgtggtaactgagtaacctgttcggtgtgacccaggcccatggagcctgaggcaacaagggcctgctgcgggtcaaggatgtgtgcagggatagggcaagctggtgtt

SEQ ID NO: 570606 - DNA, 176 bp, Homo sapiens
  misc_feature (16)..(16): n is a, c, g, or t
  misc_feature (53)..(53): n is a, c, g, or t
acaaagaaatattttnaaaagcgacctttgtcctaaaatctgccaccattgantccagcaagtatgagcagagaccccgtgcagttcattcagacaccccgcacagcaggactctttggaaattgacacgtgccaccgcctggcgttctgtttgtggcagttactaactttctaca

SEQ ID NO: 570607 - DNA, 126 bp, Homo sapiens
cgtacctgcagctctctctgatgttggcaggactcatggctgccacttgagcagccatgtcaggctgaagtctccatagccactgtctgggcctggccctcgagcactcagaactggtgactgcac

SEQ ID NO: 570608 - DNA, 125 bp, Homo sapiens
gtagcggttctcttacatactagattctgacacgttacgcaactacacacaacaaatatttgcaaaatgtcactgaaaacataggataaagctatttcaaagatccaccatagtcaatatttatc

SEQ ID NO: 570609 - DNA, 438 bp, Homo sapiens
  misc_feature (53)..(53): n is a, c, g, or t
  misc_feature (66)..(66): n is a, c, g, or t
ttggccccattttcattgagggcggagagttttggggacccctccagcccccntgaggcccagganttgagtagcagggtttgtaaagaggggaagatgcccagaggagggtttctggagagggaggggtgccccaaggggccaggtaagaatcagcccgcgggtgcccccgccgccccggccgcagaaaagttcaaaccccggggggggggggggggcaaagacattgtttcatcccccctgcccaggcccaacagagaggggcctgtgggcagccggacgcccgtggcccagagaggttagctgcctttccccggggggggttgccaagccaaccccccagaataaaggcggcgggtgtttcttccccttatgggggggggtctgccaaagcttcccgattaactggaataaaaaaaatttttttttctttccgga

SEQ ID NO: 570610 - DNA, 223 bp, Homo sapiens
  misc_feature (31)..(31): n is a, c, g, or t
  misc_feature (34)..(34): n is a, c, g, or t
  misc_feature (44)..(44): n is a, c, g, or t
cagagtccaaacagtgcccagatcaaacagngcncagagtccanacagtgcccagagtccaaacagtgcccagagtccaaacagtgctcagagtccaaacagtgcccagagtccaaacagtgctcagagtccaaacagtgccccagctgaaagtactccggaggaagcacagttcacaacagcatcataatgcgaggtacagcccttaaccacagcgcctagt

SEQ ID NO: 570611 - DNA, 453 bp, Homo sapiens
aggtgctaaaatgacgccagtgaatacagtatgtctgttgttacccgtcttgaatgttacaagcccttgcatggataccaaggccaagcccaacatgatgaagcagttgatagggaggaaggttccaaaaaagaaaggagaaaaagaatgatgcaatctccattttggtttcttcctcacctagttgaattctatagcaactttagcagaaacactagatccaagctcaggattcccagttgtggtggtggaagaggtgcccccaggaagtatggtaggactcctggaagtatacacagggctattgctaggctgcagttcagcagcatgcggcaaggaccagcagcagttctgattggttggggccaacgcgatctggggcgtaactatttccaatatgtctagatgtatgctgatattaaatatttacataaacattttatatgtggaaaa

SEQ ID NO: 570612 - DNA, 198 bp, Homo sapiens
  misc_feature (31)..(31): n is a, c, g, or t
  misc_feature (34)..(34): n is a, c, g, or t
  misc_feature (44)..(44): n is a, c, g, or t
  misc_feature (193)..(193): n is a, c, g, or t
cagagtccaaacagtgcccagatcaaacagngcncagagtccanacagtgcccagagtccaaacagtgcccagagtccaaacagtgctcagagtccaaacagtgcccagagtccaaacagtgcccagagtccaaacagtgctcagagtccaaacagtgcccagagtccaaacagtgccttactagaggggtanccgag

SEQ ID NO: 570613 - DNA, 465 bp, Homo sapiens
  misc_feature (32)..(33): n is a, c, g, or t
  misc_feature (84)..(84): n is a, c, g, or t
  misc_feature (97)..(97): n is a, c, g, or t
atacagcgcggagaatcccatagaaaaccaanntgcgtgccttactttttgcaaaccatataggattcagctcatttgtctcgnatgaccgtacctnatgctataaggaagtctagtaaccacataattctaattgaataaattgcgacagccaattcacagtatgacaacaaacaagtaggacattcacagaactccatcttcctgatttcctacctcatcagacatcagggtggcaatggctctgccaatctcatggtaggacttggctttccccttaggacctaagagaatgaacaagaacctaatggaaaaggaaagaagcaaaggctataacacacatttcatcaaactcaacatacataaaactgagaaatgtttaacttaggtcataaaaaggttaggtctagaattcacctttaaaacaaaggtaatatattattggtagtacagaatatactcttt

SEQ ID NO: 570614 - DNA, 278 bp, Homo sapiens
  misc_feature (178)..(178): n is a, c, g, or t
agaatcgagccggtaccgtcattctgcatcgcattaaaatttcggtggggcgactcggagcagaacccaacctccgagcagtacatgctaagacttcaccagtcaaagcgaactactatactcaattgatccaactaacttgaccaagcggaacaagttaccctacgggataacagcngcaatcctgattctacgagtccatactcaacacagtagggtttacagacctcagatagttggatcagagacatcccggatggtgcagccggctattaaac

SEQ ID NO: 570615 - DNA, 405 bp, Homo sapiens
atcacagacatctcgcatcgccggtactaccctggtacatacaaacgaacagagcgtataatacgacctgtcacaccaatttcaaaactgctgggctaaccatagcagctactttgagtggttcggtgttttacataacagtgggtgatgaagtgctaatgacagtgtgcagtatccagaaaagaacagcaatttctctttagcaaaaactcgatgtaatcaaacactaaatgcctgtaatgtccgaattttataagctccagatattaacttaaaagcaccttaattccacagggtcactaacttaagtgagggtctgcaactctccatttaatctctttacccattaacccaattattttataatgtactttcttagaaatacaacaatcttgtaatcaacag

SEQ ID NO: 570616 - DNA, 114 bp, Homo sapiens
atactaaagggatcacttcctcacctggatttacagacactggaacaatgactacggtagaggtcaacataatccaatcgacgatttgcagtgacctttccaaggctggtcaga

SEQ ID NO: 570617 - DNA, 366 bp, Homo sapiens
  misc_feature (363)..(363): n is a, c, g, or t
ggttgaatctttccggaggtctgtcaagccattccagcggaacaccagttgcattgctgcgaattcatggtactaataagctgccatgtgcataaatagcgaaggatgaccatacatcgctggttaacgaataagatactggccagatgtgtcggttcacagcctgtacatcctagcgtttcgcggaggctgatgccgtggcatggtattacttgaggcctatgagttttgagaccatgccttgcgtgctaactatatcctagatcccatctctacgatacagtgaaaaagttaagctgaacacactgtcggcatgcggcatgctagctccagaccggcgtgaagtggagaatgatcacttanagt

SEQ ID NO: 570618 - DNA, 88 bp, Homo sapiens
cttgatgtatttaaatgcaattgttgcagtttcttcatttgtgaaaatgcattgccttgtaaagacatgattgcgttgtcagtcaggt

SEQ ID NO: 570619 - DNA, 509 bp, Homo sapiens
aagccagttaatacagactcaaaaaagaaaaaaaaaagaaaatcctgcagtatgggacaatatagatgacccttgaggacattatgttaaggtgaaatacatcggtcacgagaaggacaaatactgcttaattctacttatatcaggtactaaagtagtcaaactcatagaatcagaaagcagaattgttgccaggagctaggtgaaggggaaaattgaggaactgctaatcggtgagcatggtttcaattatgcaagataaactagtcctagagatctgtaaaacattgcccctgtagttaacaatactatattggtgcacttaaaaatctgttaaggaggtagagctcatgtcaggtgtcttgccacacacacacacacacacacacacgcgatcataaaaaagtgtatgctcttaaagaagaaaagtaaaatatctcaaaggacggttacaccaccgccctttattgaatcaatttatctacattacagagcaagtgtagatactg

SEQ ID NO: 570620 - DNA, 192 bp, Homo sapiens
gggcttagctcctttttgaattgtgatgggagagtagagttgggttttccagttttgctctgtgtgtgtgagagattttcttaaaggcttttggttgtcttcgccttgcttagctttaagggtcgtagcatgagtgtccagtcgtgtgcatgaattcaccccactgtgactctactatgacgctccccagta

SEQ ID NO: 570621 - DNA, 188 bp, Homo sapiens
tgcaggtacatgagaggcaaagtgatggcagaagcactcttcatcactgtgattacggggctgactggatgatacaaaaaggggggcgtgaactctggagtattggcatgaaataagaggtggtggcccagattgtgggagcacctcctcttcctcctcccaaagacccccaatatcagagactcgtg

SEQ ID NO: 570622 - DNA, 1070 bp, Homo sapiens
ggagagaactgtctcggttttttcgagagtggatgtttataattaattccattttaaatcctctgtccaaaatttctcaatctatgaaaatacaggttggcaaagggcaaagttagcacaggaccctctcaggttcaggaggcataagcacgctgacctaccgcttagtgttacacgttcttcgtcttcccagcgaagggaaaagagaaggccctcgtgggcgcaaagcccgtgttggaagctccgggaaaagccaagtgtgggtcttctccgctcagccacgagggaaagatgtgttaacccctctcctatgttcccgtgtataccacgagggacggaaaagaaggcacatataagggtgcctgtgacagaaccaacggaggggggggccccccacaaatagtggctctcggcccccctggaaaagtggtgccccgcgacacagggggccacaccgagaaagcgctcaaagagacacccaactaaagtgggcgcgccgcgagacacataagagggggtctccagagacactgcggggccccccctatgcgagggccacctatcacaccgcgtggacaaagagcaaccaccatacgcacaaggcgcaggagaagcggtctacaaaacacctgtgtgtgcaacagaggggccccaaagaagcgctctctgcgtgtgccccatgaggcctcctatgcagcggccccctttacaaagaggtcttactctatagagcacaagggtacccaagacaatggtgtgacacgcgggggacaccacacaagagtgtgtggcgctctaaacagaaacaaaccatgggaggtggtgttcgcacttagaaagtgtccccccggagggtagaacccacgcaggggggggtattacttataactgctctgtttgtagcaaacgtttttgaaccccatgtgcgtgtggcacacacccatgactacacggagccagcgcacaaatttcatttctacctatctataggcggagcagtttctactggcccatagtacagctgtgagggctccccacaaatattgcgggctctctctagagaaagcacc

SEQ ID NO: 570623 - DNA, 526 bp, Homo sapiens
  misc_feature (26)..(26): n is a, c, g, or t
ctgtgggccttccaatgtgttctccnccaggtggaataaaaaaaaagccaccccttttgtagaaggtggagatgctggcaacagggaggcccagatccacaggcttattaaaagaattaactaaggtgagaggcctcatccttagaaagggtgagttaatgttaaaggataagtggtgggaatcttgaaaacctttccccttaaaaaatgatggggggttgaattttaaacagggcctttgtggggagtggggggccaccattttaaaaaatacagttgggttgtttactgccttttagggcccttttggaggaaaagaaaaacccgttttggggagtctttaaaaatggaaattggggggtcttaaaaaagtaaaccccatcctttctttaaaaccgcccaggttatgttaaatggtaaccgcccaaaggggtttttaaagggtttcttttttcccttcaggggtctacccagattatttttttaaacggggtgggtaataaacaggacccgctctccaatttga

SEQ ID NO: 570624 - DNA, 668 bp, Homo sapiens
gctgtgtaatgactgcagaggcgtggcaaggccgtgactgtcgtccgtccacagaagccctctcacaggcatggccacctccagttcggcattctggtcggttggggaaacggcctcctagagtcggtcccaggttacaagcctgttctgccccccaaaggcctgcatctcattgttaagcgtgtgcattctccccgactgaaaccattccagcagatctgttaggcctcctgcttctacggtgaatcgtgcgatggacggtgagaccatgtggacacgtgatggaccacaagcttatcggcacatctgtcttgttcctcatgaaatcaagtgccctggtacttacaagtgtctatttgtcggacatgcccacaggacgaggccgacatagcagcgccaaggcatggcatgctgtgcgagcgtacgaatgcctgcagagtgacccgtacctttgagtgatccatccctgctaaggactgggctctcgcacaaaaggcacgccgtgtgctctgcctgcttcctggaggctggctgccctccccacagggggtggtgccacatcagggctcagacaccatcctcgctgttggaaagatgggcgcccagctgtccatgctgctggaagggtctggtgcgaggtgaataggctacggagcctgtgtggcaca

SEQ ID NO: 570625 - DNA, 100 bp, Homo sapiens
acaggtgcaggaggggggaatttaggaagtcaatatttagaaggagtactatagaagttactttttcaatcttaatatattaacagacttgcgaccagga

SEQ ID NO: 570626 - DNA, 100 bp, Homo sapiens
cgaccagtagcatgtgaaggtgttcagtgctggtacgtagccaaccactctcatttagtttttattggctgggctccatggtgcgcatctgtagtcctag

SEQ ID NO: 570627 - DNA, 935 bp, Homo sapiens
gcatcctgcccaggctggttccagccttgcaccctgagctgctaggataggctctggccacctgctaccctgaactggaataagcaggtaaataatgatcttgtttttattaatctttcttaaatataaaatatatgtatagctcacatttattttatttatttattttgagacggagtcttgccctgtcacctgggctggagtgccgtggcgcgatcttggctcactgcagcctctgcctcccaggttcaagtgattctcctgcctcagcctcccaagtagccaggattgcaggcacccgccaccacgccgggtcgtgtgaagatggttgctccgcctttgccttccaccttgattaaaagctccctgaggcctcctcagtcatgcttcctgtacagcctgtggaacgatgagccaactaaacctttttctttgtaaattacccagtctcaggtatgtctttatagcagtgtgagaatgaaccaacacaatattgttcagccgtaaaaaggaataacatcttgatacgtgctgccacatggatcaaccttgaaaattatgcttagtcaagccagagaccaaaggacaaatattgtatgattccacttataggaggtacctagaataggcaaatatagagacagaaagtagaacagaggttaccaagggttgggggaaagagggagttactgtttcctgagtacgagatttcgtcgggatgatgaaactgtctccggtctagatagtggtgatggtaccatatctgtgattttttactgccctgggtgccctgcaatggttaaggtaattacgttattttttcccataagtttcccaaaaaaagggggcgcaaattccccggcctcggccttgaaggccacaggggtaaccggggacaacgggaagggtggcccctggcccccaattctctggaa

SEQ ID NO: 570628 - DNA, 337 bp, Homo sapiens
ggtccaggttgtgctagtgactagtatgttagagtcctgtaagtaggagagtgatatttgatcaggagaacgtggttactagcacagagagttctcccagtaggttaatagtggggggtaaggcgaggttcagcgaggcttgctagacagtcatcaaaaagctattagtgggcagtcagcagtttgcaagtccttgcacagcaggcattatgcatgcgcactgtgagtgcgttcgtcagtttgcagtttgctaggcagaatcagtaatgcaggatgtaagtccgtgggcgcattcatgcagaatgcactgcgccggtgaagcttcagggtcttggtg

SEQ ID NO: 570629 - DNA, 1299 bp, Homo sapiens
gagccggtgcgccgcgcgcttcgtgcccgcccgagggctgctgcggaccaccggcctgcgacctgctatctgcagcttcatgatttgagtgatgatcctcacggagccaccctgggcccaatggtgctgcctgtgccctgcagcctgcctgctgcctgctggctgggctgatgctgcgtgaatgttctggctgtgcagtgctgcgttgctcggctggctgctggctccttccacatgccacctgtgcctgtgcttgaatggcctgagcatgtgctggctggtgttcaatgttcccacttgtgcgcctgctgggcttgttcagtggctgatgcttcttgctgttgcatgtgctggcatgtggcacctggtgcctgcccctgtgctgcccagctgagtgtgcagccaacacctgaccggctcgcatgtttgcatggctcctggccgcggaagcgcttgggacgggctgagcatgtgccctgtggtgacgccatggcaaccaaacgccacacgacacggggcagtcaggacgcctgcactggtagtaacacccgagactgcacggctgatggggccttggacgaaaccgctatccgacgcaacgcaagaacgtaacctatttccactgccggaaccagacactagcatccttggctgagctcacccttggggccttgaagcccagcttcggccagggtgacacgacggtgggatacacaggaaatacgggacgcgactgcacacgttgcgaacgaacagatttgaattgtgcttgccagtggtcctgagcgagcaccatggaagcatacttcccgagccaagagcccccacagtgggctgggacccccaaaaggaaaggacactccacatatccaaaccgaagccgaaagcaaggcatacattggaggcaggcgatccagacggcccaagcggcatgcaagcagaaaaccagagcgcgaaggcgtgtaccgggcagacaacccaaacagaaacagggcagcccggcgacgcaaccttggacgcgtcaagcgaacaaacgcggcggcttgagggcccagcggaaatgtacccagcgccaaaaccaagagaagcccgcacaccaacagcgagcgacaacagcccgtgcgaccaggagaccatacccgaggcacgcacgagaaggaaaataacacacgaccaacaaacaagcagaacaagaacaagacagccacatcggggcaacaaacaacagtagcgcacaaaaaccccacaaagacaacacaaagacaaccgagagagtgggattaaaaccggcagacccgc

SEQ ID NO: 570630 - DNA, 587 bp, Homo sapiens
  misc_feature (369)..(369): n is a, c, g, or t
  misc_feature (383)..(383): n is a, c, g, or t
  misc_feature (394)..(394): n is a, c, g, or t
  misc_feature (554)..(554): n is a, c, g, or t
  misc_feature (570)..(570): n is a, c, g, or t
tcagtgtaactcactcatctaatatgttctacagtgtggtttttatcattttccatgtttttcattgtaactcattgatatacactgttctacaatgccggtttccaacgaatgtgtttttcagtgtaactcactcatctaatatgttctacagtgtggtttttatcattttccatgtttctcattgtaactcattgatatacactgttctacaaatcccgtttccaacgaatgtgtttttcagtgtaactcactcatctaatatgttctacagtgtggtttttatcattttccatgtttttcattgtaactcattgatatacactgttctacaaatcccgtttccaacgaatgtgtttttcattgtanctcacacatctaanatgttctacantgtggtttttatcattttccatgtttctcattgtaactcattgatatacactgttctacaatgccagtttccaacgaatgtgtttttcagtgtaactcgctcatctaatatgttctacagtgtggtttttatcattttccatgtttttcattgtaactcngtcgacgcggccgcgnatttagtagtagtaggc

SEQ ID NO: 570631 - DNA, 859 bp, Homo sapiens
gaaggatgtatcaaaaataacacaccttggaagcaatattttcctctggctgaaaccgaccagaaacacaaaaccaggaacccgagagatgcagctcgtagaggagagaaaacaagagtggactgggatgaccattgggtggatgaggaatcaatagagaaacaaacagttccatctgccgtttatgggtaaaagagagcagatgaagaagacatggttacctatggcttggtgatttggccacttcccttttctgggacaaactcagattgtcaattttgtgaacaaagaacagtttttattctacctgcatcatgagagccacatggagggacagctccatttgcccctggaagaatctggcagacactgggaagtcagcgagaagggaggtcactaccaggatatacagccatggagttcatcaaggaaaacagactgactgcctgccgtcttggattgtaatggcacttgtggatggctcagagctaagtgatgacaaactggagatgagaggcagagacacggacagaaagtcaatcctcttatggtggaatcagttcttttgtagaccccgctgtccttggttcctgcaacagctaaacaaggtgatttctgaagagaaaccccttacctttttaaccctttggggttaatgatacgggaatgcaacaacgtttgaggccacatacgacacttgggcactacaacatgtgggacccatgtattaccctttcttaacaagggacaccattatgtggcagaaccgcgttgttaaaagcaaaaaccaacactttgcacaaacagcacctttccgcaaaaaggtgggtgggaacacgcaaaaaatgcgttcatgtgg

SEQ ID NO: 570632 - DNA, 532 bp, Homo sapiens
  misc_feature (499)..(499): n is a, c, g, or t
  misc_feature (515)..(515): n is a, c, g, or t
ctaaattcgcggccgcgtcgacatacactattctacaatgccggtttccaacgtatgtgtttttcagtgtaactcagtcatctaaaatgttctacagtgtggtttttatcattttccatgtttttcattgtaactcattgatatacactgttctacaatgccggtttccaacgaatgtgtttttcagtgtaactcactcatctaatatgttctacagtgtggtttttatcattttccatgtttctcattgtaactcattgatatacactgttctacaaatcccgtttccaacgaatgtgtttttcagtgtaactcactcatctaatatgttctacagtgtggtttttatcattttccatgtttttcattgtaactcattgatatacactgttctacaaatcccgtttccaacgaatgtgtttttcctcatttatttataaatcccatgtaactgccatttttcttatgtgggcaaacttctcacacacttgtcttctcngtcgacgcggccgcgnatttagtagtagtaggc

SEQ ID NO: 570633 - DNA, 294 bp, Homo sapiens
tttttttttttatcctactaaagaaattaattaggcatgtgcaaggcttgggaaagggaagaaccatcacagaatgtttaatttgcattcatagattatttacttacctttagaatctagttttctattaagataatgagctatgaataaggttaattttgcaattattgtgattaaattgaaataggaattttacaatgacaaaattaagtgtcaaaaatcaaagacttataaaggaacttgtatactcctccttacaaagctatatacgtataagaatgcataagtcatacg

SEQ ID NO: 570634 - DNA, 670 bp, Homo sapiens
  misc_feature (452)..(452): n is a, c, g, or t
  misc_feature (466)..(466): n is a, c, g, or t
  misc_feature (477)..(477): n is a, c, g, or t
  misc_feature (637)..(637): n is a, c, g, or t
  misc_feature (653)..(653): n is a, c, g, or t
tcagtgtaactcactcatctaatatgttctacagtgtggtttttatcattttccatgtttttcattgtaactcattgatatacactgttctacaatgccggtttccaacgaatgtgtttttcagtgtaactcactcagataatatgttctacagtgtggtttttatctttttccatgcttctcattgtaactcattgatattttcagtgtaactcacaaatctaatatgttctacagtgtggtttttatcattttccatgtttctcattgtaactcattgatatacactgttctacaaatcccgtttccaacgaatgtgtttttcagtgtaactcactcatctaatatgttctacagtgtggtttttatcattttccatgtttttcattgtaactcattgatatacactgttctacaaatcccgtttccaacgaatgtgtttttcattgtanctcacacatctaanatgttctacantgtggtttttatcattttccatgtttctcattgtaactcattgatatacactgttctacaatgccagtttccaacgaatgtgtttttcagtgtaactcgctcatctaatatgttctacagtgtggtttttatcattttccatgtttttcattgtaactcngtcgacgcggccgcgnatttagtagtagtaggc

SEQ ID NO: 570635 - DNA, 944 bp, Homo sapiens
gggagtgagtagctgctttcggtccggcggacacatccggacagatagacgtgcggacggcccaccaccccatccctccaactagtcagcctgtcgcctggcgcctcccctctcctagtgtccatccagcctatgtggcccctgtgagcgctctcggtgtctctgctggcctctgatccaggccctgtcctttgcagcagaggaggcttctgggacttcaccctggacgatgggccattcatgatgaacgatgaggaagcttcagggcgctgacacctcaggcgtcctgagacccggattctgtcatacccaccttacagcgaccatgtgtactattcggctgccacatgccaccatgctgggatggttcagtgcatccgacacatgggtctgaagtctgtgcccaaagagatctcccctgacaccacgctgctggacctgcagatacatcagacattctcctgagctccgcaaggatgacttgcaagggtctccaggcacctcatacgccctcgtcctggtgaacaacaagatctccaagatgcatgagaaggccttcaggaccacctgtggaagctgcgagaagctctacatctccaagaaccaccgtggtggagatcccggccaagactacaccagctccctggtggagctccgacattcatgacaacctgcaatccgcaaggtgcccaagggagtcgttcagcgggctccggaacatgaactgcatcgagatggggcgggaaccacgtgttagaacagtggcttccgaacctggagcctttcgatgtgcctgaagctcaactacgctgcgcatctcagtagggccaggctgactgggatccgcggaagactccctgagacgtggaatgacctccagccgtagatcaccaacgaccatccctgcctccggccttgggaggcctgggtcggttagtcaaggt

SEQ ID NO: 570636 - DNA, 425 bp, Homo sapiens
  misc_feature (31)..(31): n is a, c, g, or t
  misc_feature (151)..(151): n is a, c, g, or t
aagaatcatagatatgtttgaatacttaatncatatttgccccagatagaaaatgtttgttaatcaaaaggcaaaagttataatgaggaagataatattgcctggggcaatgttgagacaaataaggtgaagatcaaccaaacgccctgangtcctttggcccaaatccctgctggggacccaaatacttttgatatagcatcttgctacctgaggaacgcaaggagaataatactcataagcagagcctctgttttcccataggactgactctaactatgtgaagaactgctacatattctacagtgcttaataggcggtgcctatctaacaggagctgtttggcttgtggatagcagttccaagatgaacaaatgacattgtgtttgaaagccactgctcttattaaagaagagtcaagcaaa

SEQ ID NO: 570637 - DNA, 320 bp, Homo sapiens
gccgaccttccgctggatgtccgtcgcagtgaagtactcgacgccatcgatctcgatcggcattatactgttcggatgtataggttgcacgtcgtaaccattcgtctcgcttgttgctgatcgggtgcaacctatctctcaccgtcgcctagcgtcaagtatggtcacgcattgtcacgtcatgaccccgcgaggaggcacgcagcgctgaccaccgcgtcgtggctcgccccaccacccgcggcgaaccagcgccctaagctcgatcacagagcccgcgccgaggccccgcgcgggcaactcgtcttcgccgagacggt

SEQ ID NO: 570638 - DNA, 626 bp, Homo sapiens
  misc_feature (4)..(4): n is a, c, g, or t
  misc_feature (10)..(10): n is a, c, g, or t
  misc_feature (106)..(106): n is a, c, g, or t
  misc_feature (243)..(244): n is a, c, g, or t
  misc_feature (251)..(251): n is a, c, g, or t
  misc_feature (308)..(308): n is a, c, g, or t
  misc_feature (389)..(389): n is a, c, g, or t
  misc_feature (421)..(421): n is a, c, g, or t
  misc_feature (475)..(475): n is a, c, g, or t
  misc_feature (519)..(519): n is a, c, g, or t
  misc_feature (623)..(623): n is a, c, g, or t
taantaaaanggtcacttttaatggggacccgaggttttgttacaatttcatagtccgacacaaaaaaacccttgggtgaatcaggaattggggggttaccaaatnacgggggtaaccctgggtacaggacaaaaagctgttcccgaacctggggggccaggctttttttttcggcctctccctgcggtcctgtctgtgctcccccctgggttccctcttgcccgggcccaagccccctctgnnccccccnccccggccccctcgggggcctccccggtccccgccgcggccccggtggccgcctcgntctttgcctcctctgcccccccggcggtcttccccgttgtttccccccctgtgggagccccctggtccccctcctgggccntctggttttggggcctttccctggttgctttntttcctcccaggggagttctttttctccccggtggggtttgggcccttcccgtnccccgctcgctgctgttctcccccgcccccccctcccctggggnttcctcctcggccccccccccccctgccaccccctcctttgcctccccggcccctgggtcctcctcgccctcggcctcctcggcctttgcctcccccccggttnaaa

SEQ ID NO: 570639 - DNA, 167 bp, Homo sapiens
tctgggtgcctttccaatgcaggaggtggtctcttcgtgcaccacttggtgctggacccctctcagcaatggcaccggctggtgcacatgacttccccctggggcggcagctccccagcaggacatacccgaccctgggtcttagaggaagtgctgagcagcaggga

SEQ ID NO: 570640 - DNA, 544 bp, Homo sapiens
ggacgcgtgggcaggagctgcatggtcatgggtttggaaaggagaatggacaaatagaagaaggtcggcgggcttggtggttaagcctgtaaccccagcactttgggaggccgaggtgggcggatcacctgaggtcaggagttcgggacagcctggaaacaccccatctctataagcgaatacccatctctactaaaattacaacacacttagctgggcatggttgcgcatgcctgtaatcccagcctactttggaggctgaggtggggagcaattgcttgcacctgggaggtgcaggtcgcatgtgagcccaggtcgacgacacgtgcacctccaggcctggagtgaccacgcagtgacactccatctcaacagaagggacacaacacggcaaactcggagaaggcaggcccactggcgtgacacgagacgaagtccccctcaatagcctgcatgcgaccatccaatccaaacagtggcaactcacatggccacagcaagaccaatattcacgaccatccaagacggcggaccagcgtcgaca

SEQ ID NO: 570641 - DNA, 107 bp, Homo sapiens
aacttgggacccattgaccccccttcccttccttcccctctcccctccccagtttttgggaacccctgttttgttccctatgagataaactttttttgttttccata

SEQ ID NO: 570642 - DNA, 636 bp, Homo sapiens
gggtgctgtatccactgaacagactgatgcatcttcactctactccattgtattagtatggcatcaggctacataggctgtgtgctcgagtacggtcgactatggactggccgggcactcatacattacattctctctatacggtcaactatacttgctgtcaggcacacgtccaatgcttctctcatcggctactcagttcgagaaatcttccataacacgactgtatacctctcaagcaatgttaatcttgaatattagtgtcctattcgcactgcatctgctagaactgccctaatagctataggtcaaattctctagatgactctaccattgcgatatacgatacgacattgtcactactcacactgagacattctttgctgaattctcatgctcatgtgacttgtgtcattaacgcttgactcaccagagctcctaggctgatcagactattgtacactagtcgtcccctgatatagccatttaagatcaaggccgatgctattgcctgttccacacactattcacagatcgcgcactaacaatctgtaggtgtacgacacgtattatatacatgctagctaagtctcatcctcatctacactgatcagacactaaccatattgctcttct

SEQ ID NO: 570643 - DNA, 418 bp, Homo sapiens
tctaataaagttgaatgcccgcatgaaaaacagccagctcgccaccggagcccagagccacagcaggcccttccctacaggcccggtgaacgataatagagagagctcaggccttgccatccaatctgtcgatcagcttgatttgatcgatacatgcccgcaactgcccacatggcaaatatatactgcaaccactccagctgaaggcacacattgcccagccgaactgcacgtgactatccaccaccagctagcaaacgcagaacttccgacacaggggaagcattcccaaaacgagattctttctttccttggggggcgtttacagcttgaggtgaagtgtagccaggcgcaggagtgaggttttgcgggaatgagaaggtgagcatgttgagccctgcgcaaacctgggcccaac

SEQ ID NO: 570644 - DNA, 695 bp, Homo sapiens
accaaatctcagcccgcgtttcctcatcgttcagccgatgtcgaccaccagcccttatgctgacacacacggaatagctatgggtgtgctacgtatctacccctatactcgcagatctcggtgatgttgttaaatatgccagtgacagataactcaaactctgagtttcccattgaaaagggtgttataaactgaggaacacacacaagcgtatactcgtggggacgcatatatagggtgagggatgagcaccctcggtccataacgatagctgctgctaggatgatgtaccagcatgatcatgtaacatgcttgaagatgacaatgtcttaggtacaactgcaaggtggaatgcggaactcctctgggaacccccaggcaacctctcctcctccagccccaatcggtcatgcggatgactatcgtgcacatttcacatcccccaggcacacaggtcacaacacccccaggaaggtgcagatcacagtccgtcttgtaattccttcttgcccagagcacagatgaactcaacttgtccaggactccctctcgagaaagcactaattgattgccagatagagatgctgacctacatatgcactgggtttgaatcagacataatgaacatggcgtacagctgttgcaaagggtgttgccggacccggtggggcaaaatcggtaggagaaattgtggg

SEQ ID NO: 570645 - DNA, 124 bp, Homo sapiens
ccgtctatgtagttgcggatcagacctgcaccacagtcaggaggaatttggaccatctttacaaaactgtttcagttcagaaatattcttaggatgtttaaactctagaggtcatcttgtacaa

SEQ ID NO: 570646 - DNA, 362 bp, Homo sapiens
  misc_feature (31)..(31): n is a, c, g, or t
  misc_feature (76)..(76): n is a, c, g, or t
aacgcgctgatagcctcccaaagtgctctgngattacaggtgtgagccactgtgcccggcctgttaaatcgttttnctaaggtaacatagctgatgaggtacagccagtatgactccagagagcacactcgtaactagtgcacaaaaatgtcttggtttgtttgaacattgattgaaaaacacaacatcagggcatctgtggggtatacttcctggaatgtgtttcaagggagccctggaaacagcgaatgttcataaggcagagaaatgcctggctgtgtggggtagttagaagcatccagggtctagcacatgaatatttgaaggttatgctagggaagggcggaggctatcagcgcgtt

SEQ ID NO: 570647 - DNA, 92 bp, Homo sapiens
taaaattggccaaaaatgttaattctggtggtcttctcgcagtataaggcagggaataaaatctgggaaaaagggccgggtggtgggagtgt

SEQ ID NO: 570648 - DNA, 311 bp, Homo sapiens
  misc_feature (34)..(34): n is a, c, g, or t
  misc_feature (85)..(85): n is a, c, g, or t
  misc_feature (125)..(125): n is a, c, g, or t
tatatgtgttcatcttctattctggagatctaanatgtatagtatagtgactatagttaatagtactgtattgtatacttgaaanattgctaacagagttagatcttaaagtgttgttaccacantcaaaaaaggataactgaggtgatgaatgttaataacttgattgtggtaatcttcatgatatatatgtacatcaaatcatcacattgtataccttaaatatatacaaccatcatattgtatactttaatgtatactatttttgttagtcaattatacttcaataaagctggagaaaataaaagtat

SEQ ID NO: 570649 - DNA, 310 bp, Homo sapiens
  misc_feature (31)..(31): n is a, c, g, or t
  misc_feature (76)..(76): n is a, c, g, or t
aacgcgctgatagcctcccaaagtgctctgngattacaggtgtgagccactgtgcccggcctgttaaatcgttttnctaaggtaacatagctgatgaggtacagccagtatgactccagagagcacactcgtaactagtgcacaaaaatgtcttggtttgtttgaacattgattgaaaaacacaacatcaggtttgccctttcgcatggtcattctggctggtgtgaggtggatgcatgaaggaggccaagactgtagatggagagatgagctggcaggtgaggctaaaggtgaggcaggaggctatcag

SEQ ID NO: 570650 - DNA, 1017 bp, Homo sapiens
tccgaattcttggatagcgcctgccttggcccccaaagtgccgagattgcagcctctgcccagctgccaccccgtctgggaagtgaggagcgtcgtctgcctggccccccatcgtctgggatatgaggagcctctctgcctggctgcccagtctggaaagtgaggagcgtctctgcccggacgacatcccatctaggaagcgaggagcgccgtctatccccgccgccagtcccatctatggaagtgaggagcgtctctgcccggacgcccatcgtctgagatgtggggagcacctctgccccgccgccctatctgggatgtgaggagcgcctctgctgggccgcaagcccttgggtctgggaggtgaggagacgatctcagtgaaccagacagcgaccaccgctcgtgagaaggtgaggacaaacccatcgtgacctggcgaaacgccccgatagcgtgagaaggtgacggagacccctcacgtacacggacagtcacaaccaccggtactggagaaagctgaagcgacgcagatcaacaaggacacgggaaaggcaaagacacagggacacgagagcaggcgaagcgttgagagcaggagaggacaagggaaccagcacagaacacgggacgaagagccggagcgacgaaaccacgcacaaggggactgaagcggagcggccgaccacatcgtaggacgccgcgaagcagcccaacagtaaaaatgacggaacaggacgacgacgcacagccccacaaataggccacgggggtccaagccaggccacgacaagaacaccaaggaaacgacaaaagagaggggtagacggaggcaggatgactcgaggcacaacacagtggacccaccaagagaaccaaggaaaaggaaaaagagacgcggggaaatagagcgacatcaaaacacgtcagcacacgaaccgaatgacccacgcaacaagtataggcagaaacagaaatacagagagagacaatcctagacacaggagcaccgaccca

SEQ ID NO: 570651 - DNA, 930 bp, Homo sapiens
  misc_feature (1)..(1): n is a, c, g, or t
nttcgcccgcgtcgcggcgggggttaataaaccaaagcgccgccctttgtttggcccgcgcccgagtttctcccctggggaacggcacccctcccaccccgtggtgttggccgccccccacattagtgtaagccccccggggggcgcattatcacccacctctccgcgcggttttttatccctttatcgtcctccgcggcgccgcggcataacacactttttctaccaccacgggacaaccaccccttttgccccactacaggcgccccttttatgtggggcgcaccacacatataggaacagacagatggtggtacaccaaacaagagcacccggcgcgtgtgggtcccccggctcttccgcgagattttccccgagggtgattttgtttctacagctcaacccggtgttcgcccccacaccagctggtgggctggccaccaccattgcgtgctcgcgccgccgcgagcacacaagcgcgggcgtgtgtccgaggagggggagaggctcccccccacttctctccccccccccccaaatgttgctgcccccgaaaagatatacccggttgttgttccccccatttgtgggaacacatatctactagggagcccccctctagaagagagattttcccccccacccccccccggaaggagaggagagagaagaaaaaagaaggaagaccaataatatgttccctgataggttgtttccaacctcgtagaaaacggacgacgaattattttgatgatggagtttccctccacactcaaggagataatttgaaagctttttgagatgcgcgccgagacttttcccccccctcgggccccccccccccccggggggggattccaaacccccgggggcgcccttttttattttttttttttggggttttttttttcaaaaaattgggggccccca

SEQ ID NO: 570652 - DNA, 790 bp, Homo sapiens
  misc_feature (194)..(194): n is a, c, g, or t
  misc_feature (218)..(218): n is a, c, g, or t
aatcgtcctcgctataggccaattggggccctggccccttctcaagggcttcatttagtcttgtaatattgtccacttgaggtcaatagcatcattcctttgtagaaacatagaagtattcccacctaaccatcattgtattcaggctaagtgcctcgaacgcacattattgttgttaacgaatacgctgttcntcaaatccattcatgagctaggcntaactagctagtgcctatagttcattgactatggctgcatatcccaattatactatcgagctcttcagttatggtatacggttcagcgtttcgcaatgtctctagtatgtctttccgatactgagggcaagtattcgctctctgtccatcgagtgacatctgcgtgcagctgtatgtaattatgcagggtactctttgtcagagatagataatatatagatataacacatatcaggtacttccctggtatccatatatgtacagcaatcttgtcttgtccaactataatgtgcatatggttcctcataacattcattgcttcgtgtccctttactacttgccctctcattcttttcagttgctcttatcaggaatcctctactagcatctacctatgcgctactatttcaagggtcaggtcacctactatctctttactaaaggacaaagtcttcccttactattctactctacagtaatatatgctctggcattctttagcctttatcatgcatctggcactaatgtctgtgctgcttaatactgctaattagcttttcacaggttttgac

SEQ ID NO: 570653 - DNA, 434 bp, Homo sapiens
  misc_feature (59)..(59): n is a, c, g, or t
gaggacccgacggcttcaacggaacttggggaggctgttcctcccctcttccagctgcngggggctccaggagctccggggcctgtgggtgcctcgctctggtctctgccgcgtcgcccgtgatgttcccccgtgtctctgttcctatctccctcttagaagaacactctctctattccagggtgacgtcatcttaattatatctttaatgaccgtatttccaaataagatctcatcagaggcaccgggagttaggggttcatgtgtcattgggcgaggggcacaattcagtgcatgacaattggccccagggtgggcccctcccacgcgcaagtgacagccccagtgtccccaaaagccttcaccatttcagcatcaactcaagtccaaaatctcatctaactaccatccacaaaaagttccgtggaagccgt

SEQ ID NO: 570654 - DNA, 253 bp, Homo sapiens
tgtcacaataagaactaattaatactaacatctcagacgctcaggaaatagagaccgtctgaattatcctgccctgcatcatcctagtcctcatcgctctcccatccatacgcatcctttagctgacagacgagtacagttatccctccgttatcatcgaatcaattggccaccaggtggtactgaacctacgagtgctagccgattacgggggactactcttaaactcctaacatacgcgccaggttaggcg

SEQ ID NO: 570655 - DNA, 452 bp, Homo sapiens
  misc_feature (364)..(364): n is a, c, g, or t
ttacctgctggagcgggggcaggtcctgggggaccagacggtctcagacaatgagctccaggcaatgtccaaacaggaaagaaaggacggcaatcaggaaaagcaaaaagcggcaacggggtgaacagataaagactctcatggaagaaacaaacgaagagcgcaagacactgctcagcaacctagaagaagccaagaagaagaaagaggatgccctagatgagaccagggaatcagagacaaagctgaagtagctcccaggagtgtgcaatgagaccatgatggccctctgggaagagtgtaagccctgcctgaaacagacctgcatgaagttctacgcacgcgtctgcagaagtggctcagngcctggtggccgccagcttgaggagttcctgaaccagagctcgcccttctacttctggatgaatggtgaccgcatcgactccctgctg

SEQ ID NO: 570656 - DNA, 159 bp, Homo sapiens
ttgctgaagacttgaaactgaatcgcatatatcatgacacttattggagtgtcattaatgggcaggataccctattgaagagtggataccgtatgttcttcatagagagtgtttttcagattcttcaatgggatattaaaatattagccaaatttccca

SEQ ID NO: 570657 - DNA, 764 bp, Homo sapiens
  misc_feature (6)..(6): n is a, c, g, or t
  misc_feature (40)..(40): n is a, c, g, or t
  misc_feature (75)..(75): n is a, c, g, or t
  misc_feature (85)..(85): n is a, c, g, or t
  misc_feature (92)..(92): n is a, c, g, or t
  misc_feature (106)..(106): n is a, c, g, or t
  misc_feature (111)..(111): n is a, c, g, or t
  misc_feature (148)..(148): n is a, c, g, or t
  misc_feature (228)..(228): n is a, c, g, or t
  misc_feature (292)..(292): n is a, c, g, or t
  misc_feature (360)..(360): n is a, c, g, or t
  misc_feature (362)..(362): n is a, c, g, or t
  misc_feature (371)..(371): n is a, c, g, or t
  misc_feature (493)..(493): n is a, c, g, or t
  misc_feature (516)..(516): n is a, c, g, or t
  misc_feature (528)..(528): n is a, c, g, or t
  misc_feature (567)..(567): n is a, c, g, or t
  misc_feature (618)..(618): n is a, c, g, or t
  misc_feature (655)..(655): n is a, c, g, or t
  misc_feature (661)..(661): n is a, c, g, or t
  misc_feature (671)..(671): n is a, c, g, or t
  misc_feature (673)..(673): n is a, c, g, or t
  misc_feature (715)..(715): n is a, c, g, or t
  misc_feature (758)..(758): n is a, c, g, or t
ttaagntgtacaggtaggtgaaaggggaggaagtgcagancccgggcacttccactgtgggtgagtgggccagcncaggggaggnggggcanctgagaaaggcaancaggnacacagggcaggaggggacgatggaaccactggagtnattctgcatgtgctgggaaggtgcagaaagaacctggaccccacgttctctgtgggtggtgccaaaaagctcagcatggncccgggccccaagagtcccctgcccggactccccctgtccagctcagtgcagcttcaaccaggnagtgatggctgcttgctgccattaagtttcccaacaagatctcaggttgaggggcggcaaggagagcnanatgcctgcnacccacgctttccacacagccatgctcaggcctccgggcactgcaggcctgcaggggcctccccacctgggatctgaggtgctctccaggtgcgagctgggctcctgagcattgcaggtgcnggccccctggggcttcaggatancgggctgctgantggagggaaacgggaggggggcagaggtcttcatgcttncttcccacggccaggctcagtgctggtgctcaggctccgacttccccaggnattccctcagtatccgtggcagctcagggctcttgtnaatgtntttgtgcctntngccaaggtctgaatgaaagggcacaaactgaactttgaagtntcggaagcttcgagctggtgcggcgatgctatagagctttctnccaagc

SEQ ID NO: 570658 - DNA, 108 bp, Homo sapiens
agtatatgtaacgataagtgctgtctgtataaaaaccaaattatttttctatttacaattttagaaaaggttaatgtaaaaatatttttcttctttatatatttccct

SEQ ID NO: 570659 - DNA, 104 bp, Homo sapiens
ggtggtgtctagaggatcccttccgggttggtgcatctgcgggtggcttgaaaatcaacgacaacttgagcacagtgagcatgttttggaacacattaacaccg

SEQ ID NO: 570660 - DNA, 324 bp, Homo sapiens
caaacccactccaccttaactaccaagaacaaccttaggccaaagctatttagcccaaaataaagtataggcggatagaaaattgaaacctcggcgcaatagatatagtaccgcaagggtaaagatggaaaaattataacccaagcataattagcgaaggactaccccgtataaccctctcgcaaaaatggaattaacctaggaaataacctttgccaagggggaacccaaagcttaagcccccctgaacccagacggggatacctaagaaccagctaaagggccccacccgtcttatgtggcaaaatagtggggaggtttaat

SEQ ID NO: 570661 - DNA, 116 bp, Homo sapiens
aggatccccattacagagtttgacagcaagaaggtagctgattggattttaaaaggattttaatggtctctcagtgaccactggatatgcccagcatggtctcagtgatgggaatg

SEQ ID NO: 570662 - DNA, 709 bp, Homo sapiens
aatgagatcacaatcaccaatgaccagaatctgcctgacacctgcaatgaaatctgaaacggatggttaatgattgctgagaatgtttgctgagtgaagacaaaaagctcaaggagcgcattgatactagaaatgagttggaaagctatgcctattctctaaagaatcacgattggagatatgagaaaagctgggaggtaatactttgcactctgaatgataatggagatacattggtaataattgctgtcagaatgaaatatgattgaatgtgactggaaatcgcaacaagatgctgacattgaaggacctctaacagcgtcagaatgaagtgatactgcgatagaacaatggttcattccccactttatcagcgaagacgtcatatggaaagctgcgggatccgtcctcctcaaaatgtgctgaagtaggaatacagcagatataatatgactgagtggtagacacttagatctgttagttgcctcgataacttaaggctgtataattacggtagagaactacacagacaactatctcgatttcggacacaaatatctgcctgggaaacgttacaggtcctacagacagtgttaacatgtgaacttgcaaggaccatccataagttcggtaggtcgcaaacttggcggaatggcggctaaccgctagcagattattctagccattttaatctttccccttctgacac

SEQ ID NO: 570663 - DNA, 388 bp, Homo sapiens
ctacaggttggcagcgtcagagcctaaaatagaacaagacctctcctccctgggtcgcagctatctgaccctcgaactacagcactgttgcttctgcctgggtctgcggtccatgaccctcaaagtagaacagcagcaccaggtgctacctggacttccagctccagtgactctcagacttcaaaggcagcaacgggtccaacccctagggtccagctccaacaccctcagatctgagcagcggcagcccctgctcctttcggggtctactgtaccacgatccttaagttagaccagcagccacatcttcacccggggtctccagctccatgaaactcaagctagaatagctgcaccggctcctctgggatctacagctccaggaccc

SEQ ID NO: 570664 - DNA, 104 bp, Homo sapiens
attggtgtgggctgaagatatgctcatgtggtgtaggacaagcagagattgacctcaccaagagggcgggagaactcactgagtgatgatgtggaacgtgtgat

SEQ ID NO: 570665 - DNA, 299 bp, Homo sapiens
  misc_feature (6)..(6): n is a, c, g, or t
  misc_feature (14)..(14): n is a, c, g, or t
  misc_feature (16)..(16): n is a, c, g, or t
  misc_feature (22)..(22): n is a, c, g, or t
  misc_feature (25)..(25): n is a, c, g, or t
  misc_feature (33)..(33): n is a, c, g, or t
  misc_feature (68)..(68): n is a, c, g, or t
  misc_feature (79)..(79): n is a, c, g, or t
  misc_feature (96)..(96): n is a, c, g, or t
  misc_feature (100)..(100): n is a, c, g, or t
  misc_feature (104)..(104): n is a, c, g, or t
  misc_feature (120)..(120): n is a, c, g, or t
  misc_feature (134)..(134): n is a, c, g, or t
  misc_feature (140)..(140): n is a, c, g, or t
  misc_feature (150)..(150): n is a, c, g, or t
  misc_feature (167)..(167): n is a, c, g, or t
  misc_feature (176)..(176): n is a, c, g, or t
  misc_feature (211)..(211): n is a, c, g, or t
  misc_feature (227)..(229): n is a, c, g, or t
  misc_feature (238)..(238): n is a, c, g, or t
  misc_feature (248)..(248): n is a, c, g, or t
  misc_feature (263)..(263): n is a, c, g, or t
  misc_feature (290)..(290): n is a, c, g, or t
ggagtntggtactncncctcanctngcagtcanggcttcataccgttattcgtcctggcccgttagangcaggccagcngggtacacgaattggantttngganacgagggagtcaccanctgcgaccctcccnagacangccaccgtgncacgaccactcctacanaccctttcngattctccctgaccgacgtttactttgttgggccnacaacccccggctttnnnttgaacccncggactgaanttgccgcggtgcttnggaacgtagaactactatatactaccncactacacc

SEQ ID NO: 570666 - DNA, 389 bp, Homo sapiens
cagcttcagcgatgttacttacgtttgatgctacttaaagtaatgaatgaccttttaaggaatccctaaccctactatcagaaaaggagtttgttaaagagccttctcttgtgtgttacgcatgaactttggcctgtaggtgttaaatggaacctttccatgtgtatatagaattttcttgtgtaaagcactttactacctaccacttgtgttgagaacgatcggtgacagctgttgaaagaaggaattgggtccgggagaaagcctactgaagcagtcgcactgtcactacatgtggacaaaagtgaccatataaaagaagccgtgctatttaactctgaatactcggagaaactatgtgaagatgcttccggaaacgagaatatgta

SEQ ID NO: 570667 - DNA, 294 bp, Homo sapiens
catctgctcccatcagatgtttcatacggttattggggctgtgccatcggcaaagccaggcaagctgcaaagacggaaatagagaagcttcagcatgaaagaaatgacctgccgtgatatcgttaagagaagttgcaaaagataatttacattagtacatgacgtaagttaagggataaacgcttttgaactcagaactcagcgtgggattggtgacattaactaagtggaagacatgaacattgttccaagaagatataagagcaagaagcagagaaatatgctaaggaatct

SEQ ID NO: 570668 - DNA, 795 bp, Homo sapiens
  misc_feature (119)..(119): n is a, c, g, or t
  misc_feature (129)..(129): n is a, c, g, or t
  misc_feature (607)..(607): n is a, c, g, or t
ataaaaataaataagttataacaatacctctgaaggaaccaaagatgatagcgagaagatctgtatcgcgttcattgcattgcaccccacgaaatccgtatggaccttaccgcggccgncagttactgnatcattcttagttgtcccctctctattggatccccacctgccaaatatctcatcaacgaaccggagctaattatcatccaacaatgaactaatcaaactaacctcaaaatagatgtatagccatacagaacacgtaaacggacgagcctgatctcttagtacgtagtttccgttaatcattttgtcttgccgacaacttaaccatcctctggacgtccttacgcttcacgtcgagtttacgactcagagccatcccaactatctatggaccttagtccatggcctatccccttatgagcgggtcgcagtgagttataggctttctgctctatagattaaaaatgctcctagcccacttcttaccacaaggcacacctacaccccttatccccatactagttattatcgaaaccatcagcctactcattcaaccaatagccctggccgtacgcctaaccgctaacattactgcaggccnactactcatgcacctaattggaagcgccacctagcaatatcaaccattaaccttccctctacacttatcatcttcacaattctaattctactgagtatctaagaaattcgctgtcgcctttaatcccaagcctacgtttttcacacttctagttaagctctacctggacgaaacactttacaacacgg

SEQ ID NO: 570669 - DNA, 1243 bp, Homo sapiens
ggcagcagtgtgctagctgtgtgcttttgtggcagctgcccagcagtcaacagccaacagcagcaacaggcacagccaggccacgttggcacagtggtctgtgcaccacaccgcccagacacaataagtaggcagcacagccttaggtgtgcattgcaccttaggcttctcatggatctcacatcgcccatctgagagcaggcacacccagcacgcagcccagtgcactccaacaagctccattcatcgtcacagccaaccaccccagcacttggcagcatcaagcagatccaagcatcccaatgctcaacactccacattggttccagtgcactagttggttagctccttctatcaagaccagactgcatcacctggtagcatcacctgccaggcccatctcaacatctcagcacagcaccctgccgcagtaacaactgcaagcaacgcacaggcatcattcctcacatcattatcattcatcatcgctcgtcccaatcccatccaaggcacatcatcttcctccgcatatcaacacatcacaccaaccatctcacaggccatcacacggtcgcccagcagcccaatcattccctggattcaatcccaaaccacagcacagccaacacaacgacagacagcattgtccttgggcagctcttcctcacacatgtgccaacacgacacacaggcatgaactatccgtccatcattcttgaactacgcatggtcgggcccggacattgttcatcattccatctagggaagaggccttattaacaccttccctaagctcattccccataatggtcaggcaagcacagcccattgacaggcatggccgttacctggcggacacacgcaacacccggtgggacaaccgggacacacatacaaacgaccatcctccagacagcaccgaccgaacaccacaggcaaacccccgagacacacatcaggggaccaacacagtgacgaggacaatccacacccaactgaatgcatacctaccaaccatagcacatccaaacacacccacaaccacaagcaaccagacatacaagcccgacaaacacacgggcaacaacatccaaagaacacccatagtggcgccgccaagaccgattcatcgcacgcagaaactagcaaaacaccaatgaacaccgccaagcaatgcaacacaacaccaacgcacggaaccacacacaagaacacaaaaaaacaacaaaacagcagacaacag

SEQ ID NO: 570670 - DNA, 1211 bp, Homo sapiens
gtgcccttcctgcggagtctctcactctgaacgtggcatgctttcacccagtgtactaggcttttagcgcgtggctagctctctcttgtgtggctggatcctgcgagcacctcgtggcccattccttggatgcctggtggtcactcgtcaactcgttctttcccacgtgtccgcacagaatgtagtgctgcttctggtcacccgtcgcggtagcgcggtgtcgcgccgtcagtcccctagttgtctccagaggtgcaaacgtacaatagtcactcatcgaagagatggtccaaggattgcatgtgacatataccattggtgcaacgtgctctcgctcgatgatccgagcacgaagggctgtggtaggatcagactgtaagcaggatacttggtcgacgtagaagtactacttttcgaagccaccaagaccagtcgccgataagtttccactcatatgcagtgcccgcagagattggcgcaattagtggaaaattctcggtgcgttcaaaccaaaggcgaacaacgtcaaagggaagttcacaacattgggataaccaccagggcgccggtagacaaacccgttgcgagcatagtacccattggtgccaactcacaggcggaaagacaaccaggacattcgcaccattgtgcagtctcactgcgttgtacaacgcttagtcgactacgccatgagtgacctcgcggcatcttaactggacacctgtaagtgtcccaattgtaaaatcgaggcacgatcatatggcgagggaagttgaattaaaataaaactgactggtcgaacacaatacatcggcatgagggcaccatggaccccaatatagggcgcacccagaatagggaggcgacacacgcgcttattcaaccgtcctacatgtcgcccaaaaaacgtgacaagttacctttgtggggattggcaccacatttggcgcatgatacttagccatcccgaatctgagacgcacgatatttccccacttccggtgaaacagccaggcatctctaaaccattaagggagagcgaagaacttctgtggacaagcatataacataccgttgcaatatcggtgttggcaaagccaagccgacgcacaaggtcttgtggagacacacacgccgatcacgattgcacaagtgggcaagaagaaattggcaatacaatggaggagagagtagctaagggacttgaccag

SEQ ID NO: 570671 - DNA, 236 bp, Homo sapiens
cgtccgcgtttctacgaacccgacgtacacaccatggccgcgccgctgcaggcgctgttcgatgccgtcaatgtccgcttcgtgcaaggcaccgcctgccatattgatgaaggggcgcgccgagtcagctatcgcacccccagcggcacgttgtgcgccctgccctacgaccgcctgatcatggcctgtggcagcgagctgaaccggcctgacagggtcggtatcgaacatgcctt

SEQ ID NO: 570672 - DNA, 157 bp, Homo sapiens
tagagtttaaggtaactctccaaggatgcaacattcccccaacctactgtcacacacaaatgtgtgaccttccacttattcaagtaaaagaaccagaaggaaggatgtcattcccttttttttttttttttttttttgggcccaggggtttttcaac

SEQ ID NO: 570673 - DNA, 173 bp, Homo sapiens
atcgctatacccaccggttcaagtatttagctgactcgctacactccacggaagcaatatgaaatgatctgctgcagtgttctgagccctaggatacatctttctatttcaccgtaggtggcctgactgggctattgtatatgagcaaaactcctccactagacatcgtacta

SEQ ID NO: 570674 - DNA, 117 bp, Homo sapiens
tgtactgctgaacgaaccttatagtgtgtcagagtcttctggttcttattttagtcgttattcttagttgtgctttgatgactcattccctctgcctggaatttcctccctatcttc

SEQ ID NO: 570675 - DNA, 132 bp, Homo sapiens
  misc_feature (14)..(15): n is a, c, g, or t
  misc_feature (48)..(48): n is a, c, g, or t
aaaaaaaaaaaaannccccttttttccccccccccttttaaaggtttncttgggggggggaagacagccaataatcacataactgctctaatcaaatatttcaccaaaataaagtattagccacctcctaga

SEQ ID NO: 570676 - DNA, 220 bp, Homo sapiens
gcggctcacggaactttcttcaaaatgtttgcaactgttgcgttagttgatgttggccccactgttacgtggtcatgacttctgttttagctgtgccacctgtccctgagcttgttggccgtggacgccagctccgagttctgagctttcaaggttttcactttttcctccagccgggcgattctctccacttcggccttcaaagttccgttgaagccgt

SEQ ID NO: 570677 - DNA, 382 bp, Homo sapiens
gtatagtggtccggaatgacacgtagttagattccttgctactcgacgacaatcgattgcatattatgcccggataccgaccgatggatgtaacgtggcaattaagataaacttattttcgcttatgtcgaccgcagttattcaacaggcgtgtttaaaaggcacttttcgaagaaagtgaagagttataatataagggatttgtaatattcgttgattcgatgcatatttttatttataaaacaaatggtgtggtgactgcttgaacaaatctgctgttggatgttattcctagcttcaaaagccagcttgtaagggagaaatcgcacaattttagaactaatctgtatatatattattccattcactccaccagtaatca

SEQ ID NO: 570678 - DNA, 316 bp, Homo sapiens
  misc_feature (283)..(283): n is a, c, g, or t
  misc_feature (313)..(313): n is a, c, g, or t
gttgcttaccaaatatgtatcctatgttaattatacttatattaatgaggtttgaaatgttgaatgagagtaacgtatttaatcttcctatttagttcagtatttggctcagactttcttatttatagaactctgtaacatagctctaattattttacttttgcagcagagtaccatatctgtttcttatctgcagagatctgttttcaatgcagttttattctacttcttattctgatttaagatgggatgatagttttgacttgaacttatttttttctgngtctgattttttcatttactgtagggctgntgg

SEQ ID NO: 570679 - DNA, 1864 bp, Homo sapiens
  misc_feature (255)..(255): n is a, c, g, or t
  misc_feature (266)..(266): n is a, c, g, or t
  misc_feature (470)..(470): n is a, c, g, or t
  misc_feature (492)..(492): n is a, c, g, or t
  misc_feature (526)..(526): n is a, c, g, or t
  misc_feature (847)..(847): n is a, c, g, or t
gtgtttttgtgttatttttttgtgttgttgttggttagtatgtttgtttgtgttgttttggtttgtatttttatattgttgttgtttagtgttttggttatggtttgtattgtgtgatgatttaagaggaggaggagaggagagagagaaaagaaacgaaatacactagatgcactctaatcctaccgtcacgcctatgcgttgtgggggtcttctctcaggtcatgcacacacacaaacaatgtattgatagtnatgtgtgttgntgtgacgcatcaccagataatgaggtgtcgcgccgcatgtgtcccctacagcggatcactcgcgtgcttctctgtgtattataaattacgggtgactggaccaaactaccacgactgcggtgttttatgagtatgcgattctcatcacacatagcgttgtggtggactcaccacagcgcatcgatgtgtgtgttgtatgtaacnggctgcgtctcccctcctcggnggaaggagttgtcttcttcgtcggaggtagggantgtctgttcggttgtactcatctcacccccgttcttcttcctgtgatgatcaatctactgagatggtgtgtgttgtgttgtgccttctggacgccacacacacagatggggggcatcggtttgtttagagagacgcggtgggtgtaacaccacctgatggaggcaccaaaccacatgtttgtgggagcgccactcataccactcttttctgtgtgtggttcaactatggtgggcagcttaaaactacatccttgctactctgatggtggtgccttctggttggtgtggtccgccctcccttgttgttggtaacacccattngcggtgggggtgttagtatatagagggtggtgcgtcgtcgctctagttatgtggtgtgtatgtctacacatacgtttgcttacctacacacaaagatgttgtgttgggtggtgtccacctcaataacacctcttgtggttggtggggagaccacctctcgctgtgtttgcccaataccgcgtgccggagtgtgttgtttcatatacacctcgggtcgccacgcggggggagtgagtggccgctcgcaccctcgttggttgcacccacacgcgctctgtgcgggagagagaaggtcgtgtctcgtgctcacgagagtcactccctcaacacactcgcgggggtggcacacgcgtctgctgttttgtctcactcactcccacaggtcgtggcgtccaccacaccctcagcgctgggactcctcagcgtggtagtatataataccatccctctgcgagcagagagagagatatgtgtgtgctgtctctcagctgagtgggtgggcgcacacacacacagcagagagacacacacacagagtgggctgtcgttgggagagagatatatgctgtgctgtgtcagtcagcggagagtactcactcacactagcgtgtgtgctcccaagctgagatagcaccgcgtgagatagtggagagcgaggatggtcggtgacacacataatacaggaagggtgtgtcataacaaacacagaaagaagtgtgtagaagatgaggaacactaaccctcgagagaggtgggaggaacaccaagctagggtcgtcaccccccccaccccagcggaggatggattagtacgccaccactcgggtgtgtgtcgtagggattgttgcgttggtgtgtggtgatctcaattgtggtctcacgactcaccactattttatgatagattgtgtgtgtgtgtgtgtgtgtgtgttgagtggatgtgtgtgcgcctcataatacatcatttccaccccctcctcgtgtgttttcggtgggcggtgtggtgtgtctcaaata

SEQ ID NO: 570680 - DNA, 959 bp, Homo sapiens
gctagtgtggtagtggtagatagagtgaatgtcctccaggcatctggtacagtagaggtccgctgctcacaactccgcctgtcagaggtgcgatgcctgatgctcacgggacgggatatcactgtgtttgactttcatgtaatctttgtggtgttgcttgtttcacccatgttgagtcttggctttgagtgcctctcacaggggtatcatcgccttatcaggtgactaggcgtcatcatggaatggtaagacacacacctgcgaaatgcccaaggtgactaggttgcgtgtcgtggtggcagtcctcactgtcctgtcatcgtcagacatgggggtctcatacaaggctatagggaacacgaggtaggtactggggaccccgaatgcagacctatacctttggtgtatgcgagtaccctggatggtgcacccctagtgtgcttgcaggcattttacttggggggtctctaaattgctcgcagtgaaacggacatcttcgtctcatggggcctgtgtaacagtcatggaatggcactaacgcggttaattctatcgggtcacgcactccagctgttacaagtgaccgtccccgctgcttgggggccgcctcttgttgcgagtgagcacgtgtctgatgactaggtcccaggccttgtcccagtttacaatggaagagaccacgatggggggaatctgttgcccagctgcggtggcaggggccttggcggttgagtaccgactcgattcctgcatgttcacccagggagcgaggcgctcttgtctcccaggccgacggtgagcgcggggcgtgtttttcagtgccccggcctggggatggcggcagtcctttcatgccctgatcgtcttctgctatttctttcttcccctgccttctagcccggcctcggcttcgccgcttgcgtggtcttcacaggccgcttcttcggcttgtgcctctt

SEQ ID NO: 570681 - DNA, 579 bp, Homo sapiens
gctgctctctgccacctgcagagctacttatctgcaggttttcccaataatcaaacaatgagcagatcccgcctcatcttttcacaagttgtggaacatgattcagtaaaactcagcttcgtttaacttacaaaggatggcctggcccccagtaaacgccgattcctgctcgcggccttctacgcccattactggagcagcagccatcagtgtagacgacgacgaagtctcctgtgggaaaaggaagtacatgctgctgggctgaccttactaaaaactgaaattcacctcaaaaatccactaggtcgacttagcattttaaaccgagagggtattttacaacgctgcagacgttttctctctaggaaaacatgctccattccttacaagggggcacctaacatttatgcttggaatccacttacattttgatcttgcaggccaggcaagttcggggtgaaggcaatcaccttgtaaaactagagcctgctgcagtaaaactactgttcacatcccacactgtgggttcagaggacaatggcgctgtctccacggcagggtcaccttcactcccaggga

SEQ ID NO: 570682 - DNA, 405 bp, Homo sapiens
ctctaaatctcctctcctggctttcctgcagtcactgtgctttgcaggccagctgcctctaggactcttagaatacaatggtgctttcgtacaaccttgattttgagcatgtggttcctcctttgactcagctgaaaaatttctaaagcagttaactatatgttactggattatacttagatttctactacaacattattttgtcaaaactcgtactctcacgtgtgagaagcattgtgtcaaacaaaatggagtacattttttcaataacaacttcttagagcaaacctgtactgagaagaaagtatagttgccaaatgtatgtggtgatcagaaatctggaagaacccttattaatgtcttgtattacttgaaaatgctgataaaatatgttagcctgcttat

SEQ ID NO: 570683 - DNA, 133 bp, Homo sapiens
tgtaaggggatcgcaaggaattcaactgccctgttcatggtccctctcccaggctcaatcgggacctcgagcgccgtcccaattagcgccctgtgaatgctgatctacgggacagcggggctatcgagcagga

SEQ ID NO: 570684 - DNA, 118 bp, Homo sapiens
tttccatcccccttcgtccggcatgtaggtcagctggcggcacggtgagcggctgaccgtggtgctaggagatgatccgggaagggagattgccggtcgtgcagtccttacttgctgg

SEQ ID NO: 570685 - DNA, 212 bp, Homo sapiens
gcaagctgtactactattggataactaaacgggaaagttaaaaataagctttgacaatatcctcatacttcaaggcacagtaccaaagttagctattccaaaaatattccttgcgtactgtagccagaagtatcctttctggctcctgtgtatagtccctgccttttttatttatttatttttttttgggaaccttatgcccttgggcttgg

SEQ ID NO: 570686 - DNA, 167 bp, Homo sapiens
tgcacgggcgtacttctcattctccgcgtggaagcctatccgccctggatggcctgagcgccggtcgcttgctctgcggcaatcaccgcatcgatccgcaggtagctgtcggacgcggcggcgcctccactctcgatggattcgcctatcatcttcacatgcaatcc

SEQ ID NO: 570687 - DNA, 274 bp, Homo sapiens
  misc_feature (157)..(157): n is a, c, g, or t
cctttaaagaacggatgtcattcgagagtatcgcgtatataatgtacgttataagaagtagcaatactacgtgacatactcaatgtattgaatagcatatcgtctttacaaggtcaaagtagaagtccgacctatagtcctgagtggaggccacaangggcgtaccaaggaaaaatgccttggcatgaactgaacacgttgacacattggtcatggacgaaattcaacgaagccacagcgcgtcaatgtgtgttatgcgtactctgcatgcctc

SEQ ID NO: 570688 - DNA, 516 bp, Homo sapiens
  misc_feature (412)..(412): n is a, c, g, or t
ctcagcagtggtgctttcagcggtgaaagtcctaatgaagtttctagaatagttacgtaaggatgctgactactacaatatgctgctgaagaagttagcccctccacttgtcacttggctgtctggggagccagagagtgcagtatgtcgaccctggaggaacatcagacttaagttgtcgcaggaaagaggcctggaagatcgtgtgaagcgaggaagatcaagagtctgtctttggtgacagtacagatgactcccagtctattgttaagactgagagagagcttggacagtcactgattgcgtttgggcagtcatcaagccgaacattggctcagggttcctggcagaagctgaaacggaagtatgctagcagaggtggacggttgacatttgttcgagaaggctgtgncgggcgcattgggacggtgtgccagtcaatggtggagcaatctgcagagcggctagtgtacagcacactagcttgagtctaatccgagaccaaaggtgagatta

SEQ ID NO: 570689 - DNA, 802 bp, Homo sapiens
caagttccgcccagaaaatgaggaagacatccatggttgttaccacgtcaggggagaggtggaagaggattgatgcatgctacctagacaatgggagctttgacaggtgacaaaccaggcagcatgaagtgacagcttgtatcatgcgcgtccagacagcagacactccagcaccatgcaggctgcagtctcccaatacagcaagccaagggaggcagctagcaacaccacgcctagcaagagaccgatcgacataacggaacgattcggacagctcgaatagctgtagacagaaacgaggacaggacgtgactcggcgagacaagcagcgtagcgtgtctaagctgtaatatgaaacatagaaccaagaatgatgatcctccaggagaagaatgaaggaacgccatgcggacactcacgaagatggcagtcatgcttcgatggcccagcctgtcatcctcgaagatgcaacatggaaagtggagaatctgtgttcagggtagatcaagattggacagagcagttagagcagctgacatagggatatgagcgcatcctctttctcagtgttaagctagaacacgaggcaccggaccagaaaggaagctcgagcgagacctggggcagcaattgaacgcccgaagtgaaactactgcaatgaagaatcaggcagtgaacttaatggcatgaccatacttgaccgtgtcctatacgactgagtgtgaacgacgttatgtgtgatgctctggttgagcacgggtagagagattgggaggggacaggtgatctttggaagaagggc

SEQ ID NO: 570690 - DNA, 713 bp, Homo sapiens
cggcgttcataaactgtcctccatggtgtctagctgtgcatcgatcgtttgatcttcccccaatgccttgtaggcctacatccatcgagctggcaggacagcacgcgctagcaacccaggcatagtcttaacctttgtgcttaccacggagcagttgcacttaggcaagattgaggagcttctcagtggagagaacagggggcccatactgctcccctaccagttccggatggaggagatcgagggcttccgctatcgctgcagggatgccatgcgctcagtgactaagcaggccattcgggaggcaagattgaaggagatcaaggaagagcttctgcattctgaggaagcttaagacatactttgaagacaaccctagggacctccagctgctgcggcatgacctacctttgcaccccgcagtggtgaagcccaacctgggccatgttcctgactacctggttcctcctgctctccgtggcctggtacagccctcacaagaagcggaagaagctgtcttcctcttgtaggaaggccaagagagcaaaatcccagaacccactgggcagcttcaagcacaaaggaaagaaattcagacccacagccaagccctcctgaggttgttgggcctctctggagctgagccattgtggagacaggctacaccctcgtggacggcgaggtctgtgctactgacggctgaacgacgtctg

SEQ ID NO: 570691 - DNA, 392 bp, Homo sapiens
atgtctatacatgagtataaatcaataactaccagacagctccaacaatctgacttaccattatgctgtgcacaacaaaaacaaagacaaaaacaacaaacaacaaaaaagtcaaaccttgaacaacctacattctatgtgaatatcctgactaaaatattggttgtgctacccaattccacttacagttgcagaaatgcattgatttcactgtaccgtagtcgtcggcttaaaaagtgtatttagcacttctgtcactaagcatggccttgctttgaacagatgcatcatttgctaccaaatcacaaatcatcacaaatacatatgagtttggtctgaataacatccagcataaatgtataattttattctggggtatactggctcggagt

SEQ ID NO: 570692 - DNA, 375 bp, Homo sapiens
acgttgacctaggaattagagaccagctgggcaacacagtgagaccttgtctttacagaaaaatttaaaatgagctgggcggctgggcacggtgactcacacctgtagtcccagcactttgggaggtcagggcgggcggatcatctgaggtcaggagtttgagaccagcctgactagcgtggtgaaaccccgtctctgctaggggtacaaaggttggccggatgtggtggcgcacgcctgtagtcccagctattcgggaggctgaggcgggagaatcgcttgaacccggggggtggagtttgcggtgagccgagattgtgccattgcattccagcctgggtgacagaatgagactgtctcaaaaaaaattaacaa

SEQ ID NO: 570693 - DNA, 298 bp, Homo sapiens
aagtggaggatgggggtggtgagatccagcgttgggcgacaatcgggctcgttcatatctctgccgttgtgtgagccatatggatcagaccctggtctccataactcctttacgcgttgggtcagcaaatatgttactgccatttctatttgggcttaagagaaatgaccaaaagatatttgtgtacagactgtgtttctggaagcttgccctgggactgagtgctgaccacatgatgtggagaatagcgaggcctggcatggggcaaacttgtagcgggccaatgggtgtgtgctgt

SEQ ID NO: 570694 - DNA, 513 bp, Homo sapiens
ggttttaagccagtgaggcccacacctgggactgtgggcacatgtacttcatgggaagggagatcccagttgaaatcagcaatgaggagcgatgctgggcagaaaacccatagcgccgtgtccttggggagtccttggaccatctgtttgactgaagcctcggtttttttctgctccaccacacactggctggggtgagacaatgcgtgcgggaccctggcctccaggaagggtccctgccctggctgcagggcctgatgtgccatgttcggctcaggcctgctgaacagcaccatttccagcttctgccttttaccaggcctcttagggagggtctcctaagcctctcattcctgtggcccatgtcgctgaagggatgaactgaagccccttccacagcagtgattccagggattgagacttcactccatcagagccacaaggtcagagttcaactaggagtttagggaaggagatctttttgtagattttgccacaaaagaaagaataatt

SEQ ID NO: 570695 - DNA, 195 bp, Homo sapiens
ggcagtgcgtgcttcatccctttatgaagaacagaaaattatgactactctacaaggtggataatacttcggtaccttgcttgccacagccctgttcctcaaagctgaattgataaatttctctttgacttccaagacctagcagttataaggcgccttgaataaagtttgtgcctgaaaatgtggagcaatgct

SEQ ID NO: 570696 - DNA, 375 bp, Homo sapiens
tactactaaattcgcgggcgagtcgacgggcgtctgtagtcccagctgctgcagagcctgaggcaggagaatggcgtgaacctgggaggtggggcttgcagtgagctgagatggggtcactgtgctccagcctgagtgacagagcaagactccaccaccacgcccggctaacttttttgtattttcagtagagacagagtttcaccgtgttagccaggatgggcttcatctgctgacctcgggatccacctgcctcgggctcccaaagtggtgagattacaggcatgagccaccatgcccagcgcaattatactttttattatttactcaaacgagttgataacttacgttcggacaaaaacctgcacatggatt

SEQ ID NO: 570697 - DNA, 198 bp, Homo sapiens
gagtggagattcaacttgaccattctggctaaaaattaaaaagcacttttttatatctgtggttgtcatgtgtttcaaagcatttggtaaatctattgttcttaaaagtatgtatgcctgttctagcttgggacctaggtcatctatgaaccctcgttgtgtttaatgaacatatcgtgtaacggcatgtaaacctga

SEQ ID NO: 570698 - DNA, 152 bp, Homo sapiens
ccatttgccaaaactgagtctaagtgcatttactctctgcctggatgtgattggtggtaccagtggccattgctatgtagttgatttttccctatcaatttatgggcaattatcaccaaactgtgtcaccagaatgttaactgccctgaaag

SEQ ID NO: 570699 - DNA, 127 bp, Homo sapiens
tgcgtgtgatctagaggatcccaagctctggaaaaggggagaggcaaacagttggcctgacagtgcccatctgccagtctatgaggcactgccttagcagctccgcctcatgggaccactactcacc

SEQ ID NO: 570700 - DNA, 1304 bp, Homo sapiens
gcgcttgctccgagatacacgagtgattgctgttgagttgtgctatttgcgactgactgaattacctggtgagcatctaataagtagctaatacgaagcgctactccaccaccctaactaggcatcttcatgatgacgagccccggtgctcatcgtttcgatgatatcctgcttgtttcgtgccctggtggtgcagtcgatctgtcgactgctggcattcctgatggactctgcatctatctgactctgtaccttggactcctcctggtcttacagatgtccctgctgggtgggcttcttcccagtgtgacacccgtacgctggacgtgtctggagtagttggtgcattgagggcattttgcgtcgcctgtactcgggcctgaataagtccttgggcttttactgtacccactcgacaaactgttagcctcatttgactctaccgagggcacaccagactatctcgagctagcttgatcataacctttctaatatcgaggcatccactatctatcaagaacgcctcccgtgatcacgtaccatacccgcaaccaaggaaatccttgcagttgtgcacgcgacacatgtatatcatagcacgtgccgagaggtcccttggcacttgtcgaacactcttcctgaatatgttcgcccaatttcgacacagaaacaacaagggcgccgagaacgtggagcttggatgcaactcctttggcgtgtgcgcattcaactcctccacttcacagggcgtcaactatctatgtgagttatacccgcattccatggacgcacgcggggagggtaccctcatctagcaacacttggtacggtctcaatgcgcgattaattcacccacgttacgtctgacacttaccggaagtgaggcaaacgtccccctgtgttgcccgagatggaaaccccccctcctctacgcatccgtcttatatccatactatgtttgaccacacgctcccgtctcacagcacggcactgattttccttcttccgagacaagacgtttgcaaacgcacttccggcactactggccttgtcgcccatgaagtcctccttgcgatagctaggcacttaataggggatcttgccgccatcgctttacaagtggatcgcttcgcccaacacacacccactccggcgactgcaggggtccttggggggggcacggtcacccaactgctagggactttgtcccccttgggacttgggcccagatctcacagccaagcacctcggcgttgggcaataagctcggtcacgcgcctaggtcaggacacactcttcaccat

SEQ ID NO: 570701 - DNA, 322 bp, Homo sapiens
cttttgtagagacaggatcttgttatgttgcccatgctggtcttgaactggcctcaagcaatactcctgcctcagcctcccaaaatgctgggattacaggcataagccaccaccctcagtgaactattaacccattaataaagaggcaggatggtggaagaaacatgggaaccggattcatacaactgattttggtttccatctcctccacttactaactgtatgaaccgcacgagaacaccaaccaccttctggtctaatactactatcttacaggggaggcacatggggaaaacagcatcatttaatgagaaggtctttt

SEQ ID NO: 570702 - DNA, 182 bp, Homo sapiens
agcccgtctcagtttgtcatgtgagctacctacagtgccaaagccgttaaacgttcgagactacgctcaggaagaactggtagtactgaattctcggtggaggcgggtcatatcgaatacataatgcgcgggtgcgatcctcgtcacgggccgtggttgcactaccgtcttgagctgtgacc

SEQ ID NO: 570703 - DNA, 305 bp, Homo sapiens
aaaatggcactttcaatttttccaccctacaagatctaaataattcttggcgtaaaatgggcaaatggtgtgaggtgcctgacgtccaggcattcttttacacatcagtcccttcctagtctctgtgcccagtgcaactcgtcccaaatcttccttctttccctcccgcctgtcccctcagtaccaaccccaagcgtcactgagtctttctaatcttccttttctacagacccatctgacctctcccttcctccccaggctgctccttgccaggccgagctaggtcccaattcttcctcagcctc

SEQ ID NO: 570704 - DNA, 249 bp, Homo sapiens
agaatcggtaattaagaatagctactcgaaggtgcagaactgacacacaggacagaattcctttcccagtttgttaccctagcaaggctagggagggcatgaacacaaacatagaactggtcttctacactttctctgaatcatataggtttaagatgtaggtgaaccattctttctttctgccatgaaacaaagttttggatgagcttttatgtatggaacttactccaacaggactgagggaccaag

SEQ ID NO: 570705 - DNA, 146 bp, Homo sapiens
  misc_feature (41)..(41): n is a, c, g, or t
gcaggagaaggaaaagacagcaactcatcccagaattgccnaatgaagatgaggagaatcccctcaaagggatctgtgtgcttacagtggtgacagtgacaatgaggaggactgatgagagactcaagagtgaggaagagagctag

SEQ ID NO: 570706 - DNA, 584 bp, Homo sapiens
  misc_feature (269)..(270): n is a, c, g, or t
  misc_feature (275)..(276): n is a, c, g, or t
  misc_feature (281)..(281): n is a, c, g, or t
  misc_feature (284)..(284): n is a, c, g, or t
  misc_feature (286)..(286): n is a, c, g, or t
  misc_feature (290)..(291): n is a, c, g, or t
gcccagctccacattctgtaaggtgtacaccataaccccactgctcagcgacaaccgggagaagcggggtctcgccctggatgcggacaactccaacgccactgacgggcacaccaacagcctgtgctgtcccagcacatcgtgaaggagggtgcaacaaggaggtgctgggaatcctggtgtcctacagggtcaaggtgaagctggtggtgtctcgaggcggggatgtctctgtggagctgccttttgttcttatgcaccccaagccnnacacnnccctnccngncccnncagcgctccggagacagatgtccctgtggacaccaacctcattgaatttgataccaactatgccacagatgatgacattgtgtttgaggactttgcccggcttcggctgaaggggatgaaggatgacgactatgatgatcaactctgctaggaagcggggtgggaagaagggaggggatggggttgggagaggtgagggcaggattaagatccccactgtcaatgggggattgtcccagcccctcttcccttcccctcacctggaagcttcttcaaccaatcccttcacactt

SEQ ID NO: 570707 - DNA, 221 bp, Homo sapiens
agattcaccggcagcacaggagaagtgagtatgaacagcaggaggagtaactcatagttactgctggccctggcagcgatatctcatcacctgatcttacagatcttacatcctcaagcaaactccccagggcacattcttagttggccagccatcaccccagacttctggaaaacaactcaccactgggtcagtggtccaaggaacactgggagtcagca

SEQ ID NO: 570708 - DNA, 321 bp, Homo sapiens
gcccagctccacattctgtaaggtgtacaccataaccccactgctcagcgacaaccgggagaagcggggtctcgccctggatgcggacaactccaacgccactgacgggcacaccaacagcctgtgctgtcccagcacatcgtgaaggagggtgcaacaaggaggtgctgggaatcctggtgtcctacagggtcaaggtgaagctggtggtgtctcgaggcggggatgtctctgtggagctgccttttgttcttatgcaccccaagccccacgaccacaccccctcctcctctggcctcctctgtgcttccggaccgctat

SEQ ID NO: 570709 - DNA, 1181 bp, Homo sapiens
  misc_feature (887)..(887): n is a, c, g, or t
ggtacggcacccgatggctattcgagctctcgatctcggagactggagcgggccattcagaggcgcggggccgggcccggcggacgcttgttgttgtccggccgggggaggcggaggtcgctcgctcgctcgctcggctcgctgactcgccggagcgctctgtggcggtcggcggcaggtcggtcgcgagagcgggctctgtggaagggggcgatggctatgtcgcggtggcagcccggatgggccggcatgggccgggagtaacgggacgtcgccgcggagcgttcttcccccggatacagtgcggcccgagcggatggccgcggcgccgccctccgatcttgaagagccgcgctgcgcggagccccgtcccctgctgcgcaccggagaggagcggagcgacgagccagccagaccgggccggcgcggctgatctaagccaggcaggcaggcgaatactaggccctctggagcacggagctccttccccaaagaccatgaacgctattggagaactccgagctttgaagcccatcaactcacagctgacttgtggagaccggagatgcccacattcatttggcaggattgagagctactccatgtaagatggccaggagaacgacgaacacttgttcaagcagttctgccaggagggcagccccacgttgtggaggcactttctccgaccccagacttcagggactgagccccaggcagaactcagcaaaatgccaggcgggtgaggaaggaggtcccccttcgttggcagttgacgcccgagaacctctttttacctgattggggcgcctcactgagtccttcaggcctcgactatagcattcgcgcaaggccgcaggcatggttcagccggaggccacggcctnctcgggtgggtggaactgccgggccaactggcgggtcttgttcaccactgtggacggaggagagttccccggaggtcttgaagccccccccttttgggactgcacggtgtgcacgtgagaactctctgcgcgtcgaattgaattctccacgtattaaccgacagtgtaggtaccaacactcctcgggagggaggggacgtccggctgtgataagagacagtctttctaagaccgggaggagagacgagtgcttatgtaagtgagagcacgcatgagggaccaagcacgcctcag

SEQ ID NO: 570710 - DNA, 161 bp, Homo sapiens
cacatctcagcccccatgacgctgctggggaatgtggactgttctagctctgagacgttaactgagagacagagaattcgtacacatgccgatacgtgcagccctgtgtacagttttcttccttaaccagtttaatcaggagtttcttggcccttatcgag

SEQ ID NO: 570711 - DNA, 595 bp, Homo sapiens
  misc_feature (269)..(270): n is a, c, g, or t
  misc_feature (275)..(276): n is a, c, g, or t
  misc_feature (281)..(281): n is a, c, g, or t
  misc_feature (284)..(284): n is a, c, g, or t
  misc_feature (286)..(286): n is a, c, g, or t
  misc_feature (290)..(291): n is a, c, g, or t
gcccagctccacattctgtaaggtgtacaccataaccccactgctcagcgacaaccgggagaagcggggtctcgccctggatgcggacaactccaacgccactgacgggcacaccaacagcctgtgctgtcccagcacatcgtgaaggagggtgcaacaaggaggtgctgggaatcctggtgtcctacagggtcaaggtgaagctggtggtgtctcgaggcggggatgtctctgtggagctgccttttgttcttatgcaccccaagccnnacacnnccctnccngncccnncagcgctccggagacagatgtccctgtggacaccaacctcattgaatttgataccaagtaagaaactcattcccctacttgaccctcttgggacaaagattcctataacattcaaatctgccctcatacctcttccttgcttttggtggggagaagcggattgtagcatcaaatcaagatgccttagccttgtgaggctgcctcttgctgccttttctttgtcccttcctgtaaatacctctggtcccactgctgttcgaacgcctctgtcccagaggcctagcttcggggagggcagggagtg

SEQ ID NO: 570712 - DNA, 206 bp, Homo sapiens
accaattatttctcccagcgcttaaataatattctcctcgtcactcttcgcgtctctcttccatgcattaccccatattctttgaaattaccttgaaagaaccccttctaattgatatctgcagttccaatcctcctgttatctcctgaacccagtccattcaggcttgcaatccctatactctaccacccctgtgtcaatgatca

SEQ ID NO: 570713 - DNA, 1060 bp, Homo sapiens
gcctgaccaacatggccaagaccctgtctgctactaaaaatactaaattagaccacgggcgtggtggtgcatgcctgtaaatccagactacttgcgtgaggctgaggcagcgaaaatggcttgaacccgggcaggtggaagtggcagctgagctgagattgcgccactaggcactccagacctgggctacaagagcgaatgctctcggtctcaacaaaaacaaatattgcccagggactgccgtgtaggccaagatgcacgtgttggatcctcgggccaaccttttggggaggactcggaggactagtggtgggagtctagcacaggctcaggggatcatagtaagcacgcgatccatttggcgtatcaatggtgacaacacccgatctacttactagaagtgtacgatgaaagatgaagagaggaagctaggggacatcttttaagtgttcggggactggaggtacaaatgaacgcggtaggtcaagacacttggagccaactggtggggcaccgcctaggcttggattcctcggtagcaccacccgcgtttgttaatgttttactgacccataagcccgtgggataacaatcgtccgcggaggtagccccctgtatgtattcggggggacgaagttattcagtacttggccagcaagaaagggcgcaagacggattgaacccggtagcagtaaaaagagacacattccgccgaaagaacccggtgctaggcgtcgaattgcacagcatgacacatgcagcagtatggagtggaagcccaactcagggatgtgaaagaaggacatatgaccacttttatataactttgcccattatacaaagttaccaatgtggccaccatgaaaaaaccacaagttgacagaaggcggaacagtgaaaatcgaagccactccccgcgtgaggatagtggataagactggttacccaagttttacatagacacgttgtcccacccaggaacggtacaccgtttttaccaaagaattcacacaagagcagagtacatcaagagacatcaacttccagaaaggaagcaccc

SEQ ID NO: 570714 - DNA, 240 bp, Homo sapiens
tgtaaacgtgttccctgataacacatggtgtagtagtttcttataacgttcatgtttcttcatacgataaaaccgcctttcgtatgtaacttcatgggcaattaagtcacgacgcaacgtgttgatattgatatgtgtcgtttgcgaatttttaacacgttcttgtcgccagtatctgctagatacttcttcaacatgtttctgcgtgtccgtaactcttgtttctgttgatcgtgcttt

SEQ ID NO: 570715 - DNA, 90 bp, Homo sapiens
ggttcagcatgatgaagaggtttgtcttgatgaaatgagggatgcccttaaggagaagtcatcaaagcagttgtgccctccaattccttg

SEQ ID NO: 570716 - DNA, 585 bp, Homo sapiens
agcggctctttccctccccgcctccccggcgcgcacccctcccctcgcgcccctcccgcgccctacatccgaccgcccggcggagggggctcagtccgcaacggcgacgccacacgacgacgccatcggccatcgggtgcaggacagcggacgaccgacagacgagaacagcgtgcgcggggcgaagcagtccaccactgcagacaccatatggaaagaattgtagtatcaagcgcgaatatccaagcacatggtgaccaagaaactacgataccgtaagtcgatgcacaccacgatccaagacggtcgaaggtcgcctcacaggcgtacacaggattggagacacacattgtgcgagaagacacagtctcgcaccgtgcacaacatacctgacaagaaggaagtccacttgacacgggcgcaagaacgtactgctgcagaccaagagataggcacacccaaatgactagccgtgaacactgctttatgaacaagattcctgctgccgaagcaacacatgctggcagagaacagcccggaaaggacccacatcagcgtgcgggacctaccgaagagagggagcaa

SEQ ID NO: 570717 - DNA, 756 bp, Homo sapiens
  misc_feature (7)..(7): n is a, c, g, or t
  misc_feature (64)..(64): n is a, c, g, or t
  misc_feature (97)..(97): n is a, c, g, or t
  misc_feature (110)..(110): n is a, c, g, or t
  misc_feature (133)..(133): n is a, c, g, or t
  misc_feature (143)..(143): n is a, c, g, or t
  misc_feature (148)..(151): n is a, c, g, or t
  misc_feature (177)..(177): n is a, c, g, or t
  misc_feature (182)..(182): n is a, c, g, or t
  misc_feature (190)..(190): n is a, c, g, or t
  misc_feature (204)..(204): n is a, c, g, or t
  misc_feature (210)..(210): n is a, c, g, or t
  misc_feature (213)..(213): n is a, c, g, or t
  misc_feature (276)..(276): n is a, c, g, or t
  misc_feature (290)..(290): n is a, c, g, or t
  misc_feature (332)..(332): n is a, c, g, or t
  misc_feature (340)..(340): n is a, c, g, or t
  misc_feature (454)..(454): n is a, c, g, or t
  misc_feature (462)..(462): n is a, c, g, or t
  misc_feature (746)..(746): n is a, c, g, or t
ggaattnggtttcccgcatttatatatttttacccaactttctatagaaagataaaaaatgttnccaaccttgttttttattattttttaaaaaatnttttaaattttcnttaaaataaatggaaagtaaaanaaagtaaggnttttnnnngtccttttcccctttttatgtactgnatgtncgaggaanaaggaaggaaaaanaattcnatnagagtactagtaatcctagtaccctggggattactgctggatcctcccaggtatacccctatnattgaagccctgangcacccctgcactgaggaacctgagaagggtaagtactaaanagtctgtnatagccacgtgggactgtcacagcacaggtgggactgggagtcgcccagttcttctcggtgctcacaggagtaacaaaggaactaggactaaaccataacaagaggtctcccangtggtacnacagtaccacacgttcacttttgtggcccttacaaatgcacatttatagacccaatgtatttacaggaaaaaaaaaaaaaaaaatgcctttactaatttctgtatcaaattattagaatgaaaataaaagcatttgtctgataaaacacactttctatgttagatgaaaataactcccttgcaagataagcttggtaatgtgtatttgtcactatttatatatttttgcttagtacacacatttctttaatagcatcatctgaacagctttgtcattttttcanacctgtagtt

SEQ ID NO: 570718 - DNA, 255 bp, Homo sapiens
  misc_feature (72)..(74): n is a, c, g, or t
ctcaatccaaagcagggggccaaagcacaggagcacggttgtccaaggaaatttgtagatagttttaccaannnaaggggggttaatgtagatggtaaatcagaaaaaatgtccactacactgtcacttaactaaatagcagttattattgtgttttgtgcccactacagatccctattaaccctactactacaatttaaaaatcgctcttattcaacaactttattcagaatatatttgagctaccagtagggg

SEQ ID NO: 570719 - DNA, 392 bp, Homo sapiens
  misc_feature (202)..(202): n is a, c, g, or t
  misc_feature (255)..(255): n is a, c, g, or t
  misc_feature (268)..(268): n is a, c, g, or t
  misc_feature (280)..(280): n is a, c, g, or t
  misc_feature (299)..(299): n is a, c, g, or t
  misc_feature (315)..(315): n is a, c, g, or t
  misc_feature (331)..(331): n is a, c, g, or t
  misc_feature (363)..(363): n is a, c, g, or t
  misc_feature (366)..(366): n is a, c, g, or t
gtcccgcgccacagcaggcagcgccacagtagatttatgttccacccaaatggtctctttactccctggagagcccccacaaaagatcctagaggggtatatggcccgctgccagaagggagggtaggccttattttagggagatcaagtctaaatttgaaggagtccaaattcatactggggtaatttattcaagattatnaaaggggggaaattcaagttagtggatcaagcttccctggttccctgggagtngccaatccaggtnaatagaaattgnttcaaattacttggttttngccttaatggttaaanattggggccaaactgnggaccaggaaggtttggaaggacccacccttnacncggtcctttttcagggaggggttggg

SEQ ID NO: 570720 - DNA, 312 bp, Homo sapiens
  misc_feature (5)..(5): n is a, c, g, or t
  misc_feature (116)..(116): n is a, c, g, or t
  misc_feature (119)..(119): n is a, c, g, or t
  misc_feature (130)..(130): n is a, c, g, or t
  misc_feature (175)..(175): n is a, c, g, or t
  misc_feature (296)..(296): n is a, c, g, or t
  misc_feature (298)..(298): n is a, c, g, or t
tttgntcttaactgcggagactgggggttcggaagaggttggaacgtgattttgaggtttaggggtgcattctgggtggattcccttggcatgggtggtcggcccttagcaactgnagncctaatttggntatgttaccctgggctgccaggacacaagtttttccatgcttttnccagtgcttgacttggcactccctgcagcaataccacttattttggtattgtgagcagcgcttagaagcttttgtattgtagttagtacagcggggccgctctggagccactgcctctagnanattcagcttgtagg

SEQ ID NO: 570721 - DNA, 1773 bp, Homo sapiens
atggtcgcggcgatgcatcactagtgaggaagtgggtcccgaaggggatggtaggtactctcgtggggggaggttcactgcagtagagggaggtgacaccaccgagtgagtggtggtccaccccgcggggagtgtggtgccatcctagaggagtaggtatacgattgacgatgggggggaccaccacacaatgtaccgggcatgctggggtgggtgaaactatacgagctgtagcgagtgagcctttgtgagattggatccaaacacacacaaaggtggggtccattgtgtggggggggaaacaccaccacaacggttggagtcgcacacatgtgttcgtctacactggtgagaactcactgttctacatggtgtgattcggtgtggttataggatgatgtgttgtgtggggccacatcagtgatagaaaaatatgagggcggggggttagatatataggttatcaccactgtgtgattcccaccattacctcttggtaagagaggtgtgtgtacggctgatgggtcgtgttggtggtaatacccccacagcgggtagtgccgctcgtgattaaaatattgtggaattgggggattgattcactacatgtggcatattgtgcggaatgacacctgtgactgtctggtagtaaggttcgcagctgtgtatgaacagtcgacggatcgtgtcgtcacgggatgtatagtggtgtgtggggaaccacaccacagacagtggtggagggttctactatctgtggtggtagtatagcccaaccactgcgtgctacaaggagatgtggtgcggcactccacagcagaatactggtgcctcccgcccccgccagtggggggttaatgccgtgcacaatagcagaagacggatacagtataagcagctccctgtgatgaatatgtgtggtggggccgttgcacaggagggtagactcctgtcggtgatcggaggtgaaccacacgactgatggggcccacccaacaggtgtgtgcccctgcgtccacacgggcgtacgtcgcggaggtgtctccaaaatacaggtgggggggagcagtcgccgcgttgcgctgccgcgatcgacagaagtggtgtttggcatcgtccacgaggaaaacacacggatgaggggggggtgaatgtgtgtccaccgcacagcgtcggtgcaacagtgacatcgacagcagtgcatatggtgtgccccaaaagatgtgagcacagtgtgggggagtacaaccaacagaggatgcagaccacacaatacgacagagggtgtagtagtagtaaacaactgcggtgtgctgccacaaagagagaagaaatagtagaggggtgtcgcgcacaccgtagtgtgcgcgtgcaccacgcgcgcccaacaacgggcgccaagcgacgattcccgccgtctcgatagagtgtgtatgtgaacccctgtggggcacacacagtgtgtgtgtgtcttgataagttctcctggagatgtgtcacatacaggagtgctcacagtggagaaacacagtggcgcatgctgtgctcacagaggcaagagtgccacccacaccacagtgagcccagcgcggagagtggagagggcgtcacaggcgacagtgtcctgtcctacagtgacccgaaccacgccacgaccaacccacggagtggtggtaagagaatgtgagggcgcctgtagcgcgcacagtcaccataacgggggttcacccggtagtgggtggcgcggcaaagtaaagaaaggtgacgtccaaa

SEQ ID NO: 570722 - DNA, 231 bp, Homo sapiens
  misc_feature (70)..(70): n is a, c, g, or t
  misc_feature (76)..(77): n is a, c, g, or t
  misc_feature (83)..(83): n is a, c, g, or t
  misc_feature (91)..(91): n is a, c, g, or t
  misc_feature (94)..(94): n is a, c, g, or t
  misc_feature (101)..(102): n is a, c, g, or t
  misc_feature (104)..(104): n is a, c, g, or t
  misc_feature (140)..(140): n is a, c, g, or t
acatgtgacgagtcctgctcgacactatcagggaatgagatcgcgggtgcatcgagaaggctacgagaanatcctnncactgnggccaccnggntcctctnntncaacacacccaaaaagatgacagactacgccaagangcgagggtgggtcctgggccccaacaactactacagtttagccagccagcagcagaagccggaagacaccaccattccctattagaactgg

SEQ ID NO: 570723 - DNA, 548 bp, Homo sapiens
  misc_feature (52)..(52): n is a, c, g, or t
  misc_feature (171)..(171): n is a, c, g, or t
  misc_feature (173)..(173): n is a, c, g, or t
  misc_feature (176)..(179): n is a, c, g, or t
  misc_feature (189)..(189): n is a, c, g, or t
  misc_feature (191)..(191): n is a, c, g, or t
  misc_feature (200)..(201): n is a, c, g, or t
  misc_feature (203)..(203): n is a, c, g, or t
  misc_feature (214)..(214): n is a, c, g, or t
  misc_feature (222)..(222): n is a, c, g, or t
  misc_feature (238)..(238): n is a, c, g, or t
  misc_feature (244)..(244): n is a, c, g, or t
  misc_feature (263)..(264): n is a, c, g, or t
  misc_feature (269)..(269): n is a, c, g, or t
  misc_feature (273)..(273): n is a, c, g, or t
  misc_feature (275)..(275): n is a, c, g, or t
  misc_feature (278)..(278): n is a, c, g, or t
  misc_feature (298)..(298): n is a, c, g, or t
  misc_feature (306)..(306): n is a, c, g, or t
  misc_feature (308)..(308): n is a, c, g, or t
  misc_feature (311)..(312): n is a, c, g, or t
  misc_feature (314)..(314): n is a, c, g, or t
  misc_feature (316)..(318): n is a, c, g, or t
  misc_feature (322)..(322): n is a, c, g, or t
  misc_feature (324)..(324): n is a, c, g, or t
  misc_feature (326)..(326): n is a, c, g, or t
  misc_feature (335)..(335): n is a, c, g, or t
  misc_feature (342)..(342): n is a, c, g, or t
  misc_feature (346)..(346): n is a, c, g, or t
  misc_feature (364)..(364): n is a, c, g, or t
  misc_feature (461)..(461): n is a, c, g, or t
  misc_feature (546)..(546): n is a, c, g, or t
gtccagttaaaatctacttcctcttgaaaaacaaaaatacactgaaggaagntgggaagaggtaaaagtggtatcatgattccacagcagtgattgtaagactagtgagccacagggaaatgggaaaacgtgaaaagaaacaagtatcaggaccaaattagagaagatatnanatnnnnccatcaatanangtgaaaatnnanaaacctaaganaaccagtnttggcatgaatatatncaagtngaaaataaatctgtagagnntcganatananggncctagatttaactccaagtntttgattngngannanannnaganananaatttatanaaatatnactntaataagaagcctaaaanataagattattagcctagatcatgtaaagtctagaagttcctttatttgctcatcacctttcctttttctataagactattaagcagaaggtcagtnacagaaaatttaccctttcctctcctctcttggtttaaattttaataaggaatctgaagaggctatggatcagttggcattacantt

SEQ ID NO: 570724 - DNA, 793 bp, Homo sapiens
tagcggcacattatcggccggggcgatcgtactattccgcgcgcagtcttattataagtaccaccctaggtcgggagagtccttatgcatgaggcacatatgcacacacgcgccgcgcaaccatccaacctggaaaatctatatgtcccaagacgtcccataactacatcgcatatctaacaaatgcacaaacgactaagtcaccagaagacacacagcaatggtaacctctatgcacatcagtccaccgctcttggatggcccacaatcacgaataccctatccatgttacctccaccatgcactcgtccacacatagttcgacaacgccacgacgcaccctttaacaatgctgaacattcatcacaacgcccaccttgcaccatcacctcccactcgccacgatgactcgaccatcgctatacagagactaccaactcgacttcagctcatctcatgacactcaaatgtccacccagactatcatcacaagtctactcatcgcgcatccccacgcagacccaatacctaacacttcatccacccaattcattaccacgcatccacgactaaccctatacaagatccccagcatacaatgcatcacatcgcacagtcacaccacaaatccccaatcgactcccaaccaaccggccccctacatacgcactacgctacacacacaatatcacacctatcctcctctccaacagacaccaactcgtacacgacaatccaaacgtctcaaaccatcctactcaacgaacatctatacccaccccacaaacctccg

SEQ ID NO: 570725 - DNA, 506 bp, Homo sapiens
ctgaaacaagaacagaaaccctcaccactcctcccacagcctacacttcagactctttcacctccctccttgcagtgtggggatggggttccatatcccacaacctttagttcgatttgcaaaatttcttccaacacaatcttcctgctcgcagtggagcactggatgggccacgcttaaatattagtatgaactgaccaaactcttcacaaatgcccttctagtgtctaggatggtgtctgccagccacacaccctctaagccagggccactgctgactcaaagtgacctaaacttaatcttaaatggccaaaagagtgtctgaactaaaacttattcccacttcccaacaaatctctgattaagtcaatccattctaagacgtccttgagagaaataccgacttactatactctactctaaataccagttagtctatagtttggtgtcatccatgctattaaagacagcaagaagttcaagttgaataatgaattaaaaaaaaa

SEQ ID NO: 570726 - DNA, 655 bp, Homo sapiens
agcggaggtggctcgcggggccgcgagcggagtgtaccagtgctgctctagtcgctgccatactgcccgaaggtcggcagcagctcgaccagcatgagccgtgccaggggtctgctgtggaccgctagtgacagtgctgctcagaccagcctatgagaaagagtgcagcagtcacagcagcggagatcgggaagctgcgcgacgtagactgagtctacccttaccactgcttgtgcaccatcttgacccataatgggtgacatgacaaaccagatcaagagcgtgatacaacataaattagacatgaggttgccacgtaggaagacacagacaacagggttacagaaggacacactgaattacaaaagggagataataaaacgcaaagggaagaaacttatataaaaaccacaagacgaaagagcacacaagggaacacgccaatacgaccgaaaacacaagcgaaagcacacagtccaacaagcgacagccacggctggacacacgcaccagccaggaagacgccaagaaaccgactagaggaccacagagcgtacacagcacacataacgagggaagacgcagacacaagacagcaacaaaaagcaaaaaaggaaagaaaaaacgaagcgcgaaagaggcacacaagaagcgg

SEQ ID NO: 570727 - DNA, 911 bp, Homo sapiens
cgacttggactggagcctgagctgaggctcggcttccgtgctgatgtgtcagtgattttggcaaatccccggtgtgagaggggtagggagtgctccctggctggcgacggggccgagttcaccagccgccggggcagtagtcgaagtgcccgggcgctggcatgtcctgggtgcctgcgtgtgcgtggcagtgaacagcgcgccagtggctgtgtgatgggcctgtgcagccttgtgcgccaagagctggtacctgggctccgatacccgttgtactgcgcttcagagtcgaccccagcacttgagcttgctcatcgcatgcagatggctggaggagtgcagcacgccaaggacaagtgcataaacgaatgtggctgtgcacattactagcagctaagacgctgattaaatgggcagctatgagtagcactccatttgcatagcactacccaatgacaacagagacacgggaccaccaatgaacattagaaacatggcataggatgacaatccattgcatgcaagggccaaacagaatagccccaactagtccagcatcccattgcaagcattcccaggaggcaacaatacaaaacaagcaagtgcgacaaacaaattggcaagaaagaaagggccggggatatccaaaggggatgccacgtgaggccctcaggaaccaaaacgtgaaagatagaagcaaagaccacaagagaaaggaagaaagacaaaattgttagataaggcgagaaaaaaacaaaagagaacagaagaatgagcaaagaaacatacaggtgaagaaggaaatattatgaaaagagagatgcagaacagaaagaaataagatccagaatacagactagaaggaaagtaggtgtagtataaaacaaaagataaaatccctgcattgacaa

SEQ ID NO: 570728 - DNA, 289 bp, Homo sapiens
aaacccctgccaatattttcattccaacacaaacgatgccagacttctcggcgctaggcaaagtatattgaggcggaagaggtgcctgtaaccttcagggaggaaatgtgctcctggaatgattctctacaaaatacaaggctatctcaggatccaatagctttggtatccctgcattaacgaaaacccaattaaattaatttctttaaaaagaaaaagtaggctggccagggtggctcacacctgtattccctgcactttggaaggccgaggccgttagatcatttga

SEQ ID NO: 570729 - DNA, 913 bp, Homo sapiens
  misc_feature (440)..(440): n is a, c, g, or t
ttgtcctctgtgtgaccttaggcagagggtttgatgctactgagcctctgttttcttatctgcagaatgggtatgcactcagactcaggcccttatggcgataagggttcacgcatgtaataccctccacatggcatctggaccctggaggtgggggcagtgtcacctcagcaatggtcctcaggcacgattgttagtagcagtaggaggtgaagccacccaggtaagtgggcacaaggtcaaagagggtttgggtctcagggtaaatgcctttggttgaactagtggtgtattgagcttcccacactgacattttctgagcagaggaattatcggttagcgcagggatttaggtcattaatttggagcaggtagaagtgcctggaaatggaaggactaacggctgaggcttctatggtccaagtgagtgatcacagggngctgggagtaggaagcacggctgaagggccatctcaaaggcactgtaccaattgggatggtgacatccactactgacggcaccacagagctggggtatatgtatgcttatgtgtaactttcccattttacaggaaaaggaagccggggctccaagaggttaggtgactgtccaaggttcacccaccttaagttatggccccgtgttggtacccatcataatttaaccattttgtgctgttcctaactgaaggatggtctcggcaaaggggcaggtcaaggcagacacccccaatgtccggaacggttaattgctgtggtccccctcggggagcggggggcaacccccacggaagggtggcacattttaacatgttgcggttggcaacgggggtcaacccaacttatatttttatatgcacacgttgtgggcacccttcaccagaggttgccaacacatttagaagcgcaacta

SEQ ID NO: 570730 - DNA, 130 bp, Homo sapiens
ccgcgtcgtaatgatgatactatttcctcgtataaccaccattccaatattgcgctggagtcactagtcgccatctccacacattcatctatcacaaggttcataaagggatcaaatcccctcaatattc

SEQ ID NO: 570731 - DNA, 217 bp, Homo sapiens
attctcagtcgggtgctgtccccagcagcatcgcgccagcttgaggaaggagtctcaggatgccctccagcgagagacaggtcggcctcactccttgaacttccattcctggcgacacatggggcagtgctgctgcccttgctgtgcttacagcacaattgaggatgcagtgcttgtggaaccagtgtgagcactgggcccaaaccagcgggcagtc

SEQ ID NO: 570732 - DNA, 607 bp, Homo sapiens
gggagcctcacaattcggaggaagccacaggacagtgaacaggagatcaatcggctctccatcctggcccttcccccccagtgccggctccatcctccggcgggcagtcgtgaggaatgacctccgcacccccctaagagatccttcagcagcatgtcagacatcacagggagtgtgacacttaagctcctggtcccctgggcctctcttcgtcctcgatcctctgaccagcgtgtggcctttgggaaagccaggaaggccatccgtggctcggggctgtggcctggacttcctcaatgaggtctctggctattcggcgtgtctggcccggagccccccagggggcccagagccgtacggacaagggaccagatggactgtcgttgttatggggacgaggatggtctggggctgtggtcgcgcagggtgctgtctgttggcctgggtccgccatggatggatccgaagagagcaccagtggtgctgacgctgctggtctggagcggggcgttgcctggacctgcgacgtccccacttatggaaccttgctgctgcgaatcaggggtccttccctcccgtccctggatggtcctccatgggcctgccg

SEQ ID NO: 570733 - DNA, 859 bp, Homo sapiens
caatgactgaccagcagcgtgaagacatcacatccagtgcacagtttgcattgagactccttgcattccgccagatacacaaagttctaggcatggatccattaccgcaaatgagccgacgttttaacatccacaacaacaggaaacgcaagaagagatagtgatggagttgatggatttgaagctgcaggggcaacacaaagcaacaaaaaagattatgataacttttcacacaagtgtctggtaaatcttcagtgttcacaacaaacagatgcccatttgtggctgtttttcattcataataatgtctacatctgacacacctctcatcaccgactttacaggatttcatggaagaaccaagtttttctatgatattaacaaaattgtacagtgttaggtattattgacatggaaagacacccaatcaacaacaattgtgctccgactagggcggcaaaccacgcacgtccgattttttcccattatttaatctcattttctggttgccctagttttccccccctatattcggtctccattcacctacgtgcatgcgtcttattacaactcttccctgtcttcaactggccgcaatgttgtgcttccagtgctccggggcacttcggccactccacctctcagaccccttcgcctgcctcctccgcacttccgtttgcacgctgccctcgctcatccgatgggactcctttacccccttcctaatcattctacaggcgacccgttctcggcccgtgaccctgccgcgcttggttcccatatgtgcaggcctcccaccccacaggtatcccgcctccgcggccacatgcgtttgccacctgggctgcgcccgggctta

SEQ ID NO: 570734 - DNA, 162 bp, Homo sapiens
acgggtgaggacagctcgaaaggcgccgacaggtccaggtactcgtctggtggacgttactggtaaggacacggtccagtgtcctccaccagctgcttgaaggtgggccaccgcatggacaagcccgccaactgcacacacgacctgtacatgatcatgcgg

SEQ ID NO: 570735 - DNA, 416 bp, Homo sapiens
tagagttgcagtggtacaatcacagctcactgcaacctccaacttctggactctagctatcctcccacctcagcctcctgaacagccgggactgcaggcatgcaccaccactcccggctgatttttgaattttttgtagagatggagtcccactacgttgcccaggctggtctcgaactcctggggtcaagtgagcctcccactttggcctcccaaatttctcccacgcccagcccaattttctccattacatacacctccctgaagctgtcatctttcaccagtccattttcctccacactcagtgaatgtgatctttttacttaaccgcatcactccctaactttaaacactttattaccatcaaataagtccacgtttgcaaatatggcttacagggactttcctgatctggt

SEQ ID NO: 570736 - DNA, 480 bp, Homo sapiens
ctgtgcaccaatattactgcaaactttgtggcttgagacagcacacagttatcactatgtggtttctgtgggtcaggaatccaggcgtgactcagctgggttcagtgcaaggctacaaccataatgtcagccagggctcagttctcatctggaggcttgactggtgattgatctgcttccaggctcatctggttgttggcagcattcagttccttgcaggctgctggactcagggccccaggttcttgctgtcctcagcttcttgccacatgggcctctccatctggccactcatgacatggcagctcacatcttcaaagccagcaagataacctcctagcaagacaacttaacatcctatctaacataatcactacatcccatcacctctgccatattctcttggttataagaaagtcattggtccctttgtcagatgagttgattgcaaagttaccattctgatgttggagcggccgc

SEQ ID NO: 570737 - DNA, 1126 bp, Homo sapiens
  misc_feature (505)..(505): n is a, c, g, or t
  misc_feature (512)..(512): n is a, c, g, or t
gggatgatgcattcgccggcgctcgtccgtcggacaacggcgtccggcagtgtgcaagggctggcttcgcgggtcgacgatgccccccgggtccgtcttcccctccatcgtggggcgtccccaggcaccaggtccgtgactggtgagcatgggtcagaaggattccgtatgatggtgcgacgaggcccagagcaagatgaggcatcgctctagccctgtaagtaccccagtcgagcacggctatcgtcaaccaagactggtgacgatcactggagaaaatcttggatactcactaactcttcttacataatgtaagcgtggcgttgttggcatccactgagggtatgcaatcccctggtggcgtggctgatcctgcaagaggcactcgcacgtgtataccgcacaagaaggtcactagaaccaggctggacgaaaagaatgacgacccagggattcactggttctagaggacacttatacgagaatacacaccgaagaccaatgntagcggntaagtcgtagtgccagtgactggtggcataatcgcctatggtacgtcgcgtctgtgtgtaccgtatgaccctacatgggccagtcgtgtgactggcagctccaggctgaacgggggctaacaccacatcgtgatacgccatttctaacgaaggggtagttgccctacacacccatagctcagtgcctagcgtactaggtaccctgaggcctggaccgaggagtcttgatctggaacttagctcgtacatggaaacgaattcctacaactcgagtcggctgggttaaccaggcttacaaccaatgcaacaggggcacggaggccggggtaaagattctgctggcggttgaccatatataggtggaggaaagctagttgcctacttgtactggaccctgggggaacgttcctaaagaccaaaaatggattgagcccaactgtgaaattgcctttgcccaagtcttcactttcgccttgggaacaaaaggaacgcatatcaggaagactggacgtgaacagggcccaggagtcaattcaacccattagggacacatagaagcgggattccctgatgcccctagaagggccagatctttgaaagacctgtaccttacc

SEQ ID NO: 570738 - DNA, 692 bp, Homo sapiens
ggcccagcgaccctcaaaaaaaaaaaacgggtttcctgcccttaaacaaatttgaatattttggttcccccattttgtttggggccggatctagaaaaatggttgccccccccccaaatttgtgggggttaaggttccttccacctttatctccacaccatgaaactcaatccgtgggtaggaaattcaggggtatttcctattcccggtcttggggcccccattttaaatgaggtgccccggcagaggatatcacccttaatgagatgcacctgatttctggtctttcttttctgtgcaacgtaaaccgccttgggaaaggcccgccaccctgtcttttgaccccacagaagaagggattttttcataggggtgccaactctcagatgttctggtagtgaagggcaatgaggtagcttagtggaccaccctgtttcaatttgggcagcgcacaagcctccccattccaaactcaaagaactgtggattttgatcaagctggccatgtgagcctgcaggagctcacaatgcggttttttgttatagcttttacaggtgcagaaggcatcttaccatgcttgggcaattgtcttgtgtcacgcggcaagtcccagcgcccttgaagtcgcaggtgggttattcgcgtccgcacctttgtgaacacagcctctcttcaggccaaaacctcgtct

SEQ ID NO: 570739 - DNA, 640 bp, Homo sapiens
gagaggctggctgtggatagtaaatactgatttaatgattatatattctgtgcatttaacaaaatttcacatgtaccccatgaatacgtataaatataatgaatcaggaaaaaaaaagaaggaaaagaaaaaaaaccttaaaggtaaagttggctaacttggagaattttttttttttcttgagaacggagtctcactctgtggctcaggctgtagtgcaggggcaccatctcagctcactgcaacctctgcctcctcggttcaagcgattcttctgcctcagttaccaagtagctggggctataggcgcgtgccaccatgccgtggttaattttggtatttggagtagagatggggttccaccaagttgggccaggctggtctccaattcctgacctcaggtgatctggtccgcctcagcctcccaaagtgctgggattacagatgtgagccaccgagcctggctgaacatttcctaatctggcctctaaggagtagtttggacagcgcggagaatacttggatgagtcgatacggaggaaacccgcaggtagcacctccaatggtccttatcctgaaatgcactctctgtaacaccgctctcctccgcagtcaccggatcacacccttccacaagtgt

SEQ ID NO: 570740 - DNA, 1051 bp, Homo sapiens
  misc_feature (26)..(26): n is a, c, g, or t
atatcaaattgtattgagtgcgtganccgttggttattcaatgcaacgagggggggatgactgctaatcccttcgagatggcctcttctggattctgttcctttttcctggcagtgaattatgcaaagggggccggcaaaggaagggtaggtgggggaaagccaggtggaagcttgaaagactgggggactgggcctgtaaggaaggagccatcccagtccccctccgccctgctcccggcgctgagtcatggggtcgtggagaagggggcggggtggcctgattttggctcgcctgcccctgggggcagtagaaggggcccctgcccaagctagggtgaagccgctccgttccactcccctcgctagccctccctccccagggcctgggcagggaatgtcttgttcccgcttgtccctccccggggcagagggcaggggggcctggggggttctagcctcttctcctcctccccatctcctcccgccaggtgcgagccggatgccgccgctagcgctgctgtcccatggatcacgccgccccgggctgtcgcagcgaagggtgtgggacagggtaaggggttggagagccttgtggacgagcggcgtgagccgtggctgccatctggcggcgttgtctgcagtgtgcgagtcgcccgccggtgcctggagcgagctgtcttcggctctcatccgaacccaggtggtgagcggctggccccatgacaaggtgagacggggaacaggaaacttgtgactgggccgcaggggaaggttgatgcggagcctgtggtataagctatcccctttgcatgaatcttgcccgccgggcatacctggcatggcatggggaagattaatcccatagtcaggccatagagttgataccaaccgcattgtggtacatagccgcgtctgagggagaaggtgaaacatagatcgagaagtgtaaacaagttgttgcgagtggggcacaccacacgtacagcatgagcgggacctttcgttcgggatgcgtcgtaatatcatatgagggagtgctcacaccaatg

SEQ ID NO: 570741 - DNA, 362 bp, Homo sapiens
  misc_feature (82)..(82): n is a, c, g, or t
  misc_feature (100)..(100): n is a, c, g, or t
cagtgtcattgcaaggtattcgttattgcaatatggtcgagggcatctgaagcccgcacaaagggcgatcgtttttcttcgngactacggccctacggcntggcggcatgtatcgtatgcgcatgttggcttcgcagtttcgacgaagtcatctttcatggctgcgccgccttacgaatccatcgcatatacccatcgatgtccctttgcacaatgcttggagcagtcataccgtcgtttggagtgccatcatccgtgcatatgcccttaatggtgatttagttaggtctcgcatctggcttgaatggcttcgcgtcacgcaaaagtcgacgcggccgcgaatttagtagtagtaggcggcc

SEQ ID NO: 570742 - DNA, 404 bp, Homo sapiens
ggcgtcgtacagcgctcgagcatgtagaaggtctcggggtgctgcaggtcctggtgcaggtcgtactgctcgcgaccggcttccaggcgggtcggttccagcaggccgcgcagcagggtttccagggtggcgtgctggccgggtttggcgatcagcgtggcgatgacattaaaagcggtggacatagtcgactccgggcacgggctaacgggatgggcagatgattggctattttccacgccgatcaaagcggctaaaacagcaggctgtttcaaccaaatattgataatgagcggaaatgcatgctgcgttttgatgatttgcagttgtttgtgcgggccgccgacttgggtagcctgtcgcctgcgccgcgcgtctcatggccctgtatatgcggtgctcag

SEQ ID NO: 570743 - DNA, 158 bp, Homo sapiens
caattgaagtttaaaatggaagtttccaattgaagtaaaaaatggtcatactcttcctattattattattattatttgagatggagttttgtgtccagtgagctgagacggggccattgcactccagcctgggtaacagagcaagagtttgtttcaga

SEQ ID NO: 570744 - DNA, 301 bp, Homo sapiens
ctataatgaggataatggtatcatcaaggacatcagaaacatccctggcattacactgcttaatgtaagcaagctgaacatatagaagcttgctcctggtgggcatgtgggacgtaactgcattaggactgaaagtgcttaccggaagttagatgaatagtacggcacttggagtaaagccgattccctcaagagtaactacaatcttcccatgcacaagatgattaatacagatcttagcagaatcttgacaagcccagagatccacagagcccttcgagcaccacgcaagaagatccat

SEQ ID NO: 570745 - DNA, 793 bp, Homo sapiens
cagggtcaggggtcagaaatgcaggcacgtcagcacgatgatacgcgtcgttctggtcagtggtgcctgccgttctcgtgtgttcgtgtttagattgttccttgctacgtagcacagttccatgggagattccatgatagggctattgtctcgatgacagggggtttggatggggtgtcggttgtcatatgcgcctggagcgtaagccattagtcaaagtaattgcacgatctgtgtgagtcccgttaggcttccagatagatgtgaggccgggaggacccgtcaagggactcttggtgacgcacctccttactgctgagaggcttcagcgcattcccccaagagtcaaccaatcaagcctactgtagactagtatgtgactggctgtgttgtgcacccacgttggcgctgcaagtcgcctgggattcctcataataggccagaccccgttgtagagggctggccgggaggcaaccagatttggcccgggtgcttgggacccatattgtaaggggctgacagggattatggccgcaaaaatactgttcacttaagcactgggtgaccaaaaacgagggtgcgccctgttaaggttccccaagtgggcctttttgaggcaaggggggcgtgggaactggtaggccagcccattgggcccggatggttttcaacgaatgagccatggtgtgccgaaccaaaattgggcttaaaactccggtggtgccacaacggcgcaccgtcgatgtcaaaaatgacgatgcgctgcgacaatacttcccattagcaaaaaatc

SEQ ID NO: 570746 - DNA, 887 bp, Homo sapiens
agtgtccaaactggaggttgacatccctttggtgaaatcctatttagcacagttgcagctcgtgccatcatttcagagctggtgagcatttcagaactagctcaacgcactagaaagtggcacccattattcctctcttcctacttgtcttcagcagttagctaaactacaagatcgagaatggttaacagaactttttcaacaaagcaaggtcaatatgcagaaaatgctcccagacatgatcagaataaggaccgcatgctggagatctcggcaacggaaagggactgagttctcttattcccactcctcaaatcggagaaggaactgttgaagcaaactaacgctggatccatcccctcaaaccatatataacatggacttagaagataacatctctcccaaacctcatgtagatacaacggctccgtgaacatcttaactgactagcttcttacagatacatatctacgtgaagtaaacccacccagcgatgcaaacagattcatcctctggctccttccaaagcaaacagtctcagagcacggaaaaacaactactactatctttcaagccagtaatgcagaaatctgcttcatgatcacgtcgatctacaagtcagtgccctgtactgctctccacggtgccaccctactaacagcaacattcccacagcggcatgtcacttcgcttacacgtgcactcctactcacatgcgacaatcactgaagaagcaaagggtacctcgggatggcaacacacgcatataacccgccagcagccaccgagcaaacagcgcaggcctatgacccaggcccactcacgggacaccgggcaagcacctgctgaagaaccagcatcgcgccagaaatcggaacgcacgccag

SEQ ID NO: 570747 - DNA, 138 bp, Homo sapiens
atatgaatgacccacgccaaacactgaatgtacctgtctgccgctcggccaccttgcggccgtgtatgactcaactcagctcctttaacgctaatatatccggcaaaatcccatgcttgggtttagtctttaaccttg

SEQ ID NO: 570748 - DNA, 274 bp, Homo sapiens
tgatcgagctcggtacctatgctgctcaggacatgtgggtgctggttcaggaaggtcagcacctccaggcaggacgccgatgctgctggtggcagcgtgccactgacgatcgtgtcgttggtgctcatcgtctccaccaaaatgcccacgtcgccgatggcgccccactgcacggtcaggcctgggaggccttcgtgccggctgtttctcacatatacgctccatggcggaattggcaaagccgtagttgctctgtcccgtcttccacattcta

SEQ ID NO: 570749 - DNA, 127 bp, Homo sapiens
gccaaggtaaagatctaacccccaagccaggtgtggtggctcacggctgtggtcccggcactttgggaggctgagatgggcggttcacctgaggtcagcttgggcgacagagggagactccttttca

SEQ ID NO: 570750 - DNA, 105 bp, Homo sapiens
  misc_feature (2)..(2): n is a, c, g, or t
gnaaaggacgagctgtacaaggggtctggccaagactctcgaaacgtccatcaacagcatgatgatgggtctgccaggggggtcgatttcgagagtcttggccaa

SEQ ID NO: 570751 - DNA, 156 bp, Homo sapiens
aacgatgaggctgctgacaattgtggtgaaggctctatttagctagtcactcaagcagaggaaggagccaggcttgaaggcttaccaaatcactgctgaacagataccgccgtaggagggacgagtacccgaccctgacagttaccaactactaca

SEQ ID NO: 570752 - DNA, 291 bp, Homo sapiens
tcccaggtccaagcaattctcctgcctcagcctcctgagtagctgggactcacacatgccactacgctcagctaatttttatatttctagtagagacgtggttacaccatgtgggccaggctggtctcaaactcctgaccttcggtgatcccacccacctcggcctcccaaagtgctgggatgacaggcatgcgccgctgcacccagcctcaaagtgtatagtcaatatctaagcaaatgaaagggacaagatatagaaggaatcttaggatcagctgagagataattgat

SEQ ID NO: 570753 - DNA, 439 bp, Homo sapiens
  misc_feature (14)..(14): n is a, c, g, or t
  misc_feature (23)..(23): n is a, c, g, or t
  misc_feature (27)..(27): n is a, c, g, or t
  misc_feature (222)..(222): n is a, c, g, or t
  misc_feature (254)..(254): n is a, c, g, or t
  misc_feature (262)..(262): n is a, c, g, or t
aggaaaagaagaanaataaaganacanactacagaaatgaatgaatttaacaaagtcacatgatacgagatcaatatacaacagctaattgtacttctatatacttgcaacaaataagtggaaaattaaaaaatcatttataatagcatcccaaaccacaaaatatgtaggaataaatttaacaaaatgtgtgcaaaaccaatacgttgaaaactacaaganaatataggatgagactgatctaaataaatggngccacacncacatggcactggattggaggactcagtttgcctaagatggcacttcttcccaaattaatttagaaattcaagtagttccaatgaaaatgtttctagaaactgacaagctgattctgaaattcataaggaaatgcaaaggggtcctaggatagccaaaacaattttggaaaaaagaa

SEQ ID NO: 570754 - DNA, 767 bp, Homo sapiens
  misc_feature (48)..(48): n is a, c, g, or t
  misc_feature (51)..(51): n is a, c, g, or t
  misc_feature (147)..(147): n is a, c, g, or t
  misc_feature (197)..(197): n is a, c, g, or t
  misc_feature (280)..(280): n is a, c, g, or t
  misc_feature (320)..(320): n is a, c, g, or t
  misc_feature (328)..(328): n is a, c, g, or t
  misc_feature (367)..(367): n is a, c, g, or t
  misc_feature (387)..(387): n is a, c, g, or t
  misc_feature (390)..(390): n is a, c, g, or t
  misc_feature (394)..(394): n is a, c, g, or t
  misc_feature (410)..(410): n is a, c, g, or t
  misc_feature (418)..(418): n is a, c, g, or t
  misc_feature (425)..(425): n is a, c, g, or t
  misc_feature (432)..(432): n is a, c, g, or t
  misc_feature (442)..(444): n is a, c, g, or t
  misc_feature (475)..(475): n is a, c, g, or t
  misc_feature (477)..(477): n is a, c, g, or t
  misc_feature (507)..(508): n is a, c, g, or t
  misc_feature (541)..(541): n is a, c, g, or t
  misc_feature (582)..(582): n is a, c, g, or t
  misc_feature (590)..(590): n is a, c, g, or t
taataccaatatagttctctcttaaataccgggtttcccaggacaaangcnggggcaggctctgggcagaaagagtaaaagggaaatgtggaacaaaagggaagggatggcccaggcccagggtccctgcctggggcactagggacnggggctgcctcggggatgggggagtgacagcagctcccccgggtccagtnatggcagaggcgtcgggggctcccctccctccccaggcctgaaacatttctcaggattacttctgaccttcagccccagcagngccagggccggggctcctcgggtctaggatgggccccttngcccaaangggcctgcagcaaggcgtggggtggggcggggagccccntggacaggcccggtgctctnagnaggngctcgtgggggcccgngaggatgnaaaggtngctgtgngcctcggggnnngtcagggggaatgctctccaggatgatgtcncngggggccccaagcactcggaagatcctggnncatcggggatctccggggatcacctcatgggantccaggcttcggccttgcatcccagggctccaaaaggccancacacggncctgcaggcacaccacagtctcgacgggggacatcaagggtcagccacaggggacaagggtggccggtgggctcgcccgtgatgttgacaatcctcaaaaagagtacaagctgactaggatggtggtccagtaccaacgggatcacctgatgggcgaactgggatcccatcaggagc

SEQ ID NO: 570755 - DNA, 895 bp, Homo sapiens
  misc_feature (10)..(10): n is a, c, g, or t
  misc_feature (247)..(247): n is a, c, g, or t
  misc_feature (807)..(807): n is a, c, g, or t
  misc_feature (809)..(809): n is a, c, g, or t
  misc_feature (813)..(813): n is a, c, g, or t
  misc_feature (816)..(816): n is a, c, g, or t
  misc_feature (818)..(818): n is a, c, g, or t
  misc_feature (821)..(821): n is a, c, g, or t
gtcatgcgtnactgactctcttaattaccaccgctacaggaaactttttgggaaagttccccaaaactttggggaactgtgttcccctgaagtttggagggtgaggagtgaaagaggttgagaagaatgagctggctgggttggacattcagaggtgacaatggccagatcaaccttgatggagtcttgttctgtcaccaggctggagtgcagtggtgcgatctcagctcactacaacctccacctnctgggttcaagtgaatcccctgcctcagcctccctagtagctgggactacaggcacacaccaccacacctggctaattttttgtattttttagtagagacggggtttcaccatgttggccaggatggtctcaatctcttgacctcatgatctgcccaccccaccctcccaaagttctgggattacaggcctgagccactgcacctggctgctagttcttaagagggaggtatgagacgtatgtatagactaagtgaaaggaaaatatcttgggcccccaaaatcactaagctaaaaggaaaattcaagctggaaactgctcagagcaaacctgcttcccattctattcaaagtcatccctctgctcactgaggtaaatgcatattctgattggctcctttgtaaaagctaattagaaactcaaaagaatgcaactatttgtctctcacctacttgtgacctggaagacccctccctgcttaagttctcccacctttttggacaaaccagggacttttactggattggataatggcttgggctccctaagggataaaccantntggnctngnccntgggcacagaataagaatttctagcgtggtctggctgcccccacctggaaaagaaccgatgggcggtgcttaag

SEQ ID NO: 570756 - DNA, 422 bp, Homo sapiens
tatgtttaatgttggggaaaagattttctgaggacacaccatacaattgttgaggacagatactttttacaactaactgtcttagcctgttttgtattgctataacaaaacatccgagactgtgtaatttataataaaattaaatttttttggttcatggttctggaggctgggaagtccacaatcaaggggccacaactggggaaggccttcttactgtgtcattccatggcagaaggcagaagggcaaaacagagcaagaacaacagagagcaagaggggatcacacttacttttataggaaactcactgccacaataatgacattagtccttttcatgagggtagatccctcatgacctcagttcccactaggccccactttcctactgcatttggaattaagttttcaagtctgctct

SEQ ID NO: 570757 - DNA, 875 bp, Homo sapiens
  misc_feature (10)..(10): n is a, c, g, or t
  misc_feature (208)..(208): n is a, c, g, or t
  misc_feature (795)..(796): n is a, c, g, or t
  misc_feature (800)..(801): n is a, c, g, or t
  misc_feature (832)..(832): n is a, c, g, or t
  misc_feature (861)..(862): n is a, c, g, or t
  misc_feature (875)..(875): n is a, c, g, or t
gtcatgcgtnactgactctcttaattaccaccgctacaggaaactttttgggaaagttccccaaaactttggggaactgtgttcccctgaagtttggagggtgaggagtgaaagaggttgagaagaatgagctggctggatggagtcttgttctgtcaccaggctggagtgcagtggtgcgatctcagctcactacaacctccacctnctgggttcaagtgaatcccctgcctcagcctccctagtagctgggactacaggcacacaccaccacacctggctaattttttgtattttttagtagagacggggtttcaccatgttggccaggatggtctcaatctcttgacctcatgatctgcccaccccaccctcccaaagttctgggattacaggcctgagccactgcacctggctgctagttcttaagagggaggtatgagacgtatgtatagactaagtgaaaggaaaatatcttgggcccccaaaatcactaagctaaaaggaaaattcaagctggaaactgctcagagcaaacctgcttcccattctattcaaagtcatccctctgctcactgaggtaaatgcatattctgattggctcctttgtaaaagctaattagaaactcaaaagaatgcaactatttgtctctcacctacttgtgacctggaagacccctccctgcttaagttctcccacctttttggacaaaaccagtgtacttcttactgtattgattaatgtcttgtgtctccctaaagtgtataaaaccaagttgtgccctgaccaccttnngcannggtcatcaggattcctaggctgtgtcatggncatggtcctcacccttggcaaaataaacnncgatcggccgaan

SEQ ID NO: 570758 - DNA, 415 bp, Homo sapiens
aaattataccactgtgtcgtaaaaattattatgacctgaagacatttgagaatcaacagatgcagaaagaggctttgtctgaatactcccttatctgactaaaagcagaaacttctgggagtgagacttccactagccccctttctggaggagtttcacggctgtgaagaagatgaagaagaccacaaacaaacatgatgaagaaccatcttgtctcctggtttgttctcctaaaaatacatttgtctttcctaaataaacccatttgttcttccagtagaagccttttcctccctgctcctttacccttattaaggtaggcttgtaaatccctgtctttagttatggataaagtcattttctttgtgggttcctagtatgtgaataaactttatcttttcttttgttaaaaaaa

SEQ ID NO: 570759 - DNA, 708 bp, Homo sapiens
tactcaggtaaattgtataattaagattaatatacactcttattatttttggaatcatgatatttaaaacttaatttttagtatttttgattcatggtctgagtacagaggcctttctaatgaagtcatttcatgcatcaaggatgttcatgggggtgagagtagttctaattatctattgctgccttttgaagtacctaaatactaaattgcttaaaacaacaattttaatttgctcacaattttgagtttcatttttggagatgtacttgtctgggtgcttcatctctaatccatatggaatggttggggatggaatgattaagatccactcccaagatatcaccttttctcacatatctgtcagcttggtgcttgttctctctttctcttcacaggacccttcattttttagggagtctcaatatagcttgggtttctcttgcattaattgatcaaggccctacacctagaagtggcatgggtagaaattttatgtcagaccctctatcttcactctcaaagtcacccataactgttctacatgttgcttttcttcacaaagctttacattaaaatcaaatgaataagcccaaatattgctaaaatattctataaatactcttttacctaacatggcaaataatagtatcttggttaatataacaattatcatatagcaagatgcatagcactgttagtatattc

SEQ ID NO: 570760 - DNA, 225 bp, Homo sapiens
gttctagtggtaactgctgcttctggaaaatatttagagaaaccaacggtaaaaaaaaaaataataattaataccgttggtttctacatacactctcaatatttgcacgagtaaagcgtagcaagtttaacacaacttatgtaaacttggaaaattttccgaaattttattgacttttctcggtctctcctatctttatatacacatctctcatgcacacacgcg

SEQ ID NO: 570761 - DNA, 370 bp, Homo sapiens
ttggcgctccatacaggtgatacaggccacggggccccgtggaggacgcggcagatggcctacgtctggccgagaggcacgggaagggggctccaccaccggcattctcgagggagaagatccacagagacatcaggggagccaaccttctcctcactctccagggagatgtcaaacgggctgacttgggggtgtcaggcgagctgacagcgtcggtggccaagaggaggtcttgcatggggactccctagggcgccctgatgctcatgtcgaagagcagcttccagccgcccaaacggagagataagactcgcgggacccagaatttccaccattttctcaaacgggcccggaatgggagcccaaaggg

SEQ ID NO: 570762 - DNA, 110 bp, Homo sapiens
tagctcggtaccaacttcttcttcatttctggccaatcatccatgctcatctgattgggaagttcatcagactttagtccaagtcctttgatcagcagctcgtagaactg

SEQ ID NO: 570763 - DNA, 516 bp, Homo sapiens
tcctattaataatttcttttttatgtttcttttttctttttttaaaattgagatagggtcttgctctgttgcccaggctggtctcaaactcctggactcaagtgatcctcccacctcagtgggagccacggtgccctgctccatgtttcttatcttttctcttctattttcctatatcctgttttgctacagacagttccagggttacaggcatgagccaccacgcccggccaggttaagtgtattaaatgcattttccaattatgatattttcaacttctgatgggtttattggaacataacgccatcataagtcaggaaacatctgtactttgtagatgatctcaactttgtcttctaatactactaatgaagttttgatcaatgtcatattttatttactttttatttaattattaatttgtgagacaagtcttgctctgtcaccaaggctggggttgcagtgagctgagattgtgccactgcactctatcctgggcaacagagtgagactca

SEQ ID NO: 570764 - DNA, 1011 bp, Homo sapiens
  misc_feature (279)..(279): n is a, c, g, or t
  misc_feature (395)..(395): n is a, c, g, or t
agcggcttgttgtccgacgaaacaccaaactgggggatgacgccggtgtgcagtgggggggcccgggggccctggtggcccctggggatggcgcgaagccagctgggtgcgacgttccccgtggagcgctctggtcgcgcccgtctggctactccggggggcacgaggggatcggcaggacacgtggagcggggcacggcgagccgaggccagcgcgaggctcgcggaggcataagcctaggactaaaggacgatggattgcctcgtataacctagagnttggggcagcgtggttctatacggacattggaaggatcaatgtgctccgtggacggagattcttatcgtgcatctgcgtaccgctggctcgatttcatcggacatcagaatgatcnattgactttcttgcctggggggtgcgtcttcatcataggatagaaggttcttgaaagattgatgttcagatgacacgtagacgcagactcgggtgccagtgaccaaggggcaccgatggttgcatatgccactgtgtgtttgctcactcagagggacatactaggatggcgcacgatcaggtactaggggtgtttaacgtgctccaagggaggtggcctacccggctatgcgtggggtcgtcatcctggtcaagctctccatggtgcaacggatggtggcaataaggtttactgggagggaaacaagaatgccggtaaggactcgggacaactgtacccctttgccataggtgacaggccggagtgggttccgttggtgttaacgaccttcgatgccttgcacccaggggtcctcttggcatcgttttccgaagcctgtggctaaggaaggatggctcagtaggatggagggtactttgaatgtactgagtaaacctcaagtcccgggggggggacatgtcaccctgggtaacttctgcaaggccacctttgatgcatttctaagacttaaagtactgaaccccgaccttgggggacggtttcccaatttcctatg

SEQ ID NO: 570765 - DNA, 163 bp, Homo sapiens
tatgacaagtaacatcgcacctgatgagtgggcctggctgtcgttcggtatcaagcagaaggatatcgacaaggatcttgtgatctagaatccactccttccacagtaccggagttctctctttaacgcctccccttcgtgtttcccccgagtacagcgacca

SEQ ID NO: 570766 - DNA, 550 bp, Homo sapiens
gagatcacttctttgatagggggtactatgaagttactcctccaacattagtgcaaacacaagtagaaggtggtgccacactcttcaagcttgactattttggggaagaggcatttgttgactcaatcctctcagtgtacgttggagacctgcagtcaatgaactcgggagatgtgaatggtatgctctagtcataccgggcagagcaggtccagaacacgaaggcacctggcgtgagtacaggtcacttgagaagcgtgagtgtcgctattcctgagctgtcttcgagcgaccctctctgaaccgagtttggacggaccttgagtaacgtgatgtggtagactcgaattatggaagggtcacctgtgtggactgagttggagcctatgacaagacaggccgcagaaagcctgagtgcgactccggagcgcgtgcagtgctcagaggaggaagaggcgagctagaagatgcgtgatccgtgcgcgtaaggagaaaccatgcatgacccaaaatacaccaaggagagggagggactagggactggggatga

SEQ ID NO: 570767 - DNA, 133 bp, Homo sapiens
aggatcgatgtctgtgcagctccagtgaagctggtgatgagcttgtgctgattgcttccacatcactgctggtgtgcccatgactgcactctgcgtgagtggggtgggagaagcccgtcgcaagcctggagca

SEQ ID NO: 570768 - DNA, 325 bp, Homo sapiens
tttaaaaagttgcgcaaattcctctggccccgggattgttaatttcttgcaatttgaaggggcgaggagaggtttaaagaaaaatcagtttttgtttttaaaaaagcctttaagttgtaaacgtccttttaagcccttgaagggcccctgattttatgtaacttgttgcagactggggttaatgagtatatgtccccgtttaaaaaaaaaagttggttttttataagccccccccattttaatgggaacttttgtagttttatgaataaacataaattgtaatttggggacataaaaactcctgaataaatcatgtggcctaata

SEQ ID NO: 570769 - DNA, 681 bp, Homo sapiens
ggttactagcgtttttcagacggagaccattgggacaaattaagcggtttatcatgctaatgcccgggtcacagagcaagcaatgaacatcactgtcacactagaatcgtcatggaccgtaaatacattcgcaactacattgtgtactacagttgccaaggctttcacggggttaccaccgactacgcacaacgcgcgtatcggcatcaggtcgcttgtactccgttcagcggactatacactttctcacgcagaattcatttaagctcgtcatggcgtctataaccgggttcggcacttgtcaggttcccaactttccgcattgttccgaaatcctacttcattcaatttgccgacttgaatgcgattttcagccgattaggattgtttcacaacaccgccgttcgtcgtattgcgcctttttccatatggcgcaatctctggacctaatgtatgggggcttctacagttcgtatttcgctaaaaggtagctgtaagtggccgcatttcttacaaatggcgcttttccctaacttcatcattaaaaaactttctctacctagacctggtgaatagcataaggttttgtcatacattcctacagcactcctggaagcgtcttgtttaaccatcgcacttcttcgctgtaataatcattctcccatatttggggtaacagtc

SEQ ID NO: 570770 - DNA, 142 bp, Homo sapiens
aacgggtggggtagtagctttgagggaagtacgcttatatttttattttttgggtcttgggtttttttttttcctttttctggggaaaaggggttcctcgttttttggcccaggagggttctcgaaactctcgggggcctct

SEQ ID NO: 570771 - DNA, 714 bp, Homo sapiens
ccgattcccacggaagctctttcttcccccttaagtgcctccgcccttcatattcccgtaatctttgtctccaaagaccatgcccactcatccttgtggtaaccaacatgggtgagatttataactctttacgcgaaacttgttattgtctaacgaattattctttgatgaaattacgcccgcagttaacacatatcttggtgccagcgtgctcgagacacaacatttacgagaaagaccaattgttacaaaacgctacacatctcgtcttacatatataaatacagagtaaatagataatttattcaagccactactcacacgctccacacgggtacatactgtgaaacaccgcttttctaaaatacgcagtagttgtcttgtccacatatatctttttctccacacaacggaaatatgttacaacccacgcttgtaaccctgtatacccacacttacccttcactacatatgtgtaccttatgtgttatacatgtgcactttatctgtgacccacatctcgtgcattatgtgcccgaaccccgattacccctcacctctatatgaaaataagcacagtagcgctataccacacacctttctgtaaatttcttttgttctaaattcaagcaatttccaccctccctgcgctgattcaccactcgggactacatctactttttattctctaaatcaactcgatccccagcaaac

SEQ ID NO: 570772 - DNA, 244 bp, Homo sapiens
gtcagcggacctttatacatcattcttgtccgggatgtagttgctgagatccttctccccagaggatccgactgcattataaagaagtcagcaaatacaaatcccaggacaaagaaatgatgttataaaacattggtttccacttctcacctccaaaggacttatagaatctggcagcaacacatagcctggaggggtgcccaggctggcaaacaaaacaacaatgcagctggcaacacacaat

SEQ ID NO: 570773 - DNA, 367 bp, Homo sapiens
  misc_feature (270)..(270): n is a, c, g, or t
  misc_feature (276)..(276): n is a, c, g, or t
ttcccgttcccccaaggcaaatgcttcccctgctgaatgcctcagcaagccagtgaaagaatgcagcacgccccagcccataaacactaatgaaatcatgttcttcgcctctgacatggatgtagctggcggtcattatcctaagcaaattaaccccaggaacagaaaaccaaggactgcgtgttctcacttataaatgagatctaaacattgagtacacattgcctgggtgcggtggctcacacctgtaatcccagcactttgggaggntgaggnaggtggatcatctgaggtcaggagttcaagatcagcctggccaatatggcgaaaccctgtctctacaaaaatacaaaaattagccaggcat

SEQ ID NO: 570774 - DNA, 284 bp, Homo sapiens
cctttattaggggttcccagactcgctgcatatcggcgtcactggcacatccactgcgtccgcgatttgcagctcccccatgttcttggtttcaagtgccttgtggtgactcgtcatccaagagcgtgttcctcttggctttccccacctccctgctttatgctctaatctctgcctgaaccatcatttctcatgactcctgcgcttcctccttcccatggggtaaagtccacacttttaatgtggcctccagccctttgcagtctgtcctcactacatgccat

SEQ ID NO: 570775 - DNA, 282 bp, Homo sapiens
  misc_feature (85)..(85): n is a, c, g, or t
tcagggctagcaaccccggtcccagcggaggcgcccgcacgcgccgacacttcagcaccagtcgcggtgccaccactgtgcgcgnagatggctgcgacgcgtgcgcagggaaatttgtgcacagagacaacacaggggatatgccatatgaagatgaaggcagaattctacaagcccaggaatgccaaagattgccagcaaaccaccagaagctaggagagaagtgtggattagattctttctcacagccctcagagggaaccagccctgccaagaacttga

SEQ ID NO: 570776 - DNA, 812 bp, Homo sapiens
  misc_feature (812)..(812): n is a, c, g, or t
atttttggtattttatagtagagacggggtttcaccgtgttagccaggatgttctcgatctcctgacctcatgatccgcccgcctcggctcccaaagtgctgggattacaggcgtgagcaccgtgcccggcctaaaatgaaattatttatgtgggttctgaaacagcctcttagcattcagatggttttaaatacttaaacacaccaatgtgtagaaggcaaccctttatttttagcaggtgggtttactcttctcccatgagatttggtctttctacattaactagtaggacataaagattgggaaactggaacctatattatactttttaaccaatctctgtggcttcacctcatgaaatttaacttcagttaaatatgagacgtgggggttaatgtgtgtaacctaatatgcaaaaatgtgtttgtataatttgggggatttcgtaagtgtcaagtgaatgtgattcttatttcacgtgatactattaatcatgcgttgtacactttcaaaatcatgcatggtttcacgttaagactgggtttggagaacctcgactttatgtgatcatggtatgggaatacatgtggggtggaggaacttaatttttcaattggtcacaataggtatattacctgcagggtttcggaaaaagtggtgaacgatttttaatgtatataaaggcccagatttggcacgggtttacacgcacattgtgacctggaatattttcaaggatcacagttgtggaccagggctttagcggttgaatataaatatagaggccaaatattcccaggaagaaaaaagn

SEQ ID NO: 570777 - DNA, 200 bp, Homo sapiens
  misc_feature (199)..(199): n is a, c, g, or t
tcgtatggatcaaccagatcctctggtcaagttgtatgtgcactgaactaatcaggcaggaaagaagcccagccactgtctcacagagtgttgttttgtatatggtagcaaaatcctgaaacaatggggtccttccagtctcatcatacaaagatggcaatcgttggctagggtgcggtgagtatcagcggtggtatang

SEQ ID NO: 570778 - DNA, 115 bp, Homo sapiens
  misc_feature (12)..(12): n is a, c, g, or t
tcccatgcacangttgcttagacaggcttctcacttcctacagacctgaatcaaatttggatagtctgagttcttaagttcccaaagaacacactgttatttcttgtgtatattt

SEQ ID NO: 570779 - DNA, 462 bp, Homo sapiens
ctgagttggagcttcaagtgcttggcctccagttccaactcctgtcgggtttcatgtccctttctatctggcagtgggaaaaatgtttttagtgaaccctgttctctgggggcccatacgtaaagaactgaaaaaaaaaaaaaagtggggtttagaaatctctttgggttctggtcctgaaaaaaaggtaatttccccccctccaaaagaccgccctttagaaaaaaagcttaaatgtccgggaccaaaaaaagaacccctgcaggaaggggtgccccggaaggagcccccgggggccccgtaacaacggctcagtgggtggccctcgatttgggccgtcccctgcccccttgctccccgtgagccctggggaccaacatcccaaagttcccccacccccaaactgtgtgtttcctggtatgtaactctttaaaccaataaatgaactgacttccactggga

SEQ ID NO: 570780 - DNA, 117 bp, Homo sapiens
cagagaactcatcaaatgaggaggaaacgtcaagtgaaggcaacatgagggtgcatgctgtggattcttgcatgagcttccagtgtaaaagaggccacagcatgcaccctcatgttg

SEQ ID NO: 570781 - DNA, 134 bp, Homo sapiens
tatataaaacgctgtctccaagtcctttttccaccagatcagatagcacagacttaagataagagaatgaaaattaagtaaaatgccttactaatgtgtaattcacataataaataattcatacatttgagtaa

SEQ ID NO: 570782 - DNA, 1749 bp, Homo sapiens
cggtcgtatcaccttgcacccgcaagtcaagccgccccttgtagaaaaatccctccaccttccgttccaccgctagtgtcaaccccactgtagacaggaaagccaggccaggagagtccgaatgagaatttatttgcgcactcgattcccaatgactcccttccgggtacaagtggtacatgggacagggaggatgcaacggccccagtgcgacaacgctctgcagcgttcctccgaatcccgtcggcttctcgacccacgcagagaagccccgggcttggcggctctagccccagcgccaaaggagacccgccccagggaccgggctatggacatcctgactacacagggcctaggactgcagatctgcgtggccaggtgcgtgcgcgcgcttctgggaaaacagtacccgccgtgcaacaggaaaggggcaaaatggcacctaacgcatcagcatggaagctttactcttctgattccgtaccatccccctgctaccccatacttaatcagtccccattcaatttgtagactcttgctcctgcttctacatgatcatgcaaggcggacattccagtagaagataaacgctttgaacagaggcatgcgagacactgggcaagaggaacaggcaaccatcggccggcgacggccacgctcgtccacacgcggccaccatatggcagcgcccgcggcgcggccgggcgacagcaaggcacaaaaccccacacgcgcgcgcggcacaacaacacgaacggaacaaaccataatcctccccagacacaacaacaccaacacaccacaacgcacaacacacacacacgcaacacaaagggggcgcccaaacaccgcacacacagccatactacaaacccacacacagcgcacgcacacgccacaccgtgctaacatgttcataattactacgattgcaccaaacacacagcaacacaacacgaacgccacactaaccacacaagccaccgcgagcacacaacagaacacacacacagcaacccacccaccacaacacaaccacccacacaagaaaaaaccacacaccccaacaccgcacgaaaacaaagacgacaacgagagacggcggacaacacaaagagaacgacagcagagaccaacgagaagggaaacaagcagaagaaaccagaaaccaaaaagcagcaaaaggaacagaagcaaccacgagagagacgacagagagaaaaacaagagcaacaagaaaagaccaagaaccgagaaaacaagaagcaacgagacaacacagaagacaggaggacagggggaagacacacgagagcgaagaaggcgagagcgacacaaacgaccacaaaaaacagagaaccaaacagagccgacaggcaccagacgaaacgacgcgacacgcgaagaacaagagaagacacagcaagaagaggagggacaagagagaaggaagcggaggcgggacccagagcaggggaagcgacacaggagaaaacagcaggagcgaggcgaccagcaagacgagacaggaccgagagggacagaaggaagcgagcaaagaaagagcggaagagagagagacgagagcggacacgaccagaagacgagcacagacaaagagagcaagacaacagagcgagaagggacgcagacacaaaagagcgagagcgaagagagaggaggaaacgaaaagcagcaacgaaaagcacgagagggacccaaagacagccgcaggagaacacaagagac

SEQ ID NO: 570783 - DNA, 232 bp, Homo sapiens
agctctaatttcgttgagtgtgggtttacgtagtggccttagctcatcatgtaggtgtctcgacataggtatacgtgtcccgagtcactctgcctggcacactgctagcctgacccctgtcccactggaagcagtccccatctgtgccgatcgccatggccccttgtcccattcatgaccaggggaaggccaaccccgaccatcccgacaaggttccatgctaggcgggtgc

SEQ ID NO: 570784 - DNA, 107 bp, Homo sapiens
aaactcatatacacttggaaaaaaaaaaagtgacagaagacatggaaaaggggtcaggtggcacactccttggacagggctggtcccaagcttcctatgaaagcaga

SEQ ID NO: 570785 - DNA, 857 bp, Homo sapiens
ctgagccctacggtcccgacctcgcgggctgaggccgggtactggtctggatcggagctatcgggcgatgggcagcgccctatgcaggcccggagctgattgcagccttgatgaccccgggaaccggggtccccacccgcgcctggtgacttctccggtggaagggagccagggacttcccgacccttcgccagagcctcaagcagctcccggattctgatccgcatgaagcgagatggaggccgcctgagcgaagcggacttcaggggcttcgtggccgctgtggtgaatgggatgcgcgcagtggcgcgcagatctggggcctatgcttgatggccgatccgacgttcggggcattggctctggaggagacctctggtgctgacccatggtcctggctcagtcgggaccgcagctggagtggccagatggccttgctgccagccagcttgtggtcctacgctttccacagggcggtgtgggtgcacaaggtcaggcctggtcctcgcgaccttgccctgggcggcaatgtggcttgcaaggtgccaattgatcagagagacgtggtcttggggcaacacaaggatggccacctatggcataagcctgcgagtctaattcctgggattcaaatgtcattccagatggcccagaagcatgattgcacagtgcatggcttggcagccaagtgcggggctagcgtgtaatcgcatgcggtcacgaagtgacgcaggcttgcgtcccctgcaggaccggaaatcgctatacttgccaggccacagagacttgtgcacaagcacaacgcgtgcacaggacttgcccacttccacatcacaagggctgaccctgaaatccaa

SEQ ID NO: 570786 - DNA, 211 bp, Homo sapiens
tactctctctacccttacctacctcacttgatataacaatgacatcgccctcacctgctgcgcgtacgtggttacacctgataatccctgcaattgggacggctgacggtggaaagactgcttgaggtcaggacgttcaggagcagcctacacaacaacacgagatcctctctaccaaatgaaaggatgaaaatgggcaccctttatggag

SEQ ID NO: 570787 - DNA, 565 bp, Homo sapiens
caaggagcatggcacaagccagcacatgatgctggatggcttccttgtggaatagatgctttccctacaagcgcgaattccagtggacatagatcaattgctcaaaacaatgagccccaatcacatcgttcacctacccttccatgaccaagtccagggacctaatgcagcaccagaagcgccagtacactgaccctttacctgcatatgcgtgcggatggtgtcatctgctccatcaggtggcctcactacatactgtagtcttcgtcctactgttcaaaagtctgtgaagccctgtaaatgcgacgagggaactcacggccaatcaccttactccacattaacatataatgtgttggaacataaacgtcaccaaggtggcttctaccttgatctgagagaatggaaggcagtggtgggatttagctcactgggtatccaagcgccctaatcgtagggcagaagagaaactcatcctctacccgtgtcattacacgcgtgaaggtccaagatccccatcatgaagagcaggagtgctagcccataaccacgggggccggcctct

SEQ ID NO: 570788 - DNA, 253 bp, Homo sapiens
  misc_feature (40)..(40): n is a, c, g, or t
  misc_feature (121)..(121): n is a, c, g, or t
  misc_feature (129)..(129): n is a, c, g, or t
  misc_feature (208)..(208): n is a, c, g, or t
aaaatgggcataatcattcctgcctcccatgacgggtttntgaattagagatacataaaacattctaggcatggggctgggaacagtggctcacgcctgtaatccttgcactttgggaggncaaggcgngcggttcacttaaggccaggagttcgagaccagcctggctaatatggcaaaaccccatctttactaaaaatacaaaganttagccaggagtggggatgcgcacctgtaattccagctacttggg

SEQ ID NO: 570789 - DNA, 341 bp, Homo sapiens
  misc_feature (269)..(269): n is a, c, g, or t
  misc_feature (294)..(294): n is a, c, g, or t
aaggtcacagtcagactgtggagaacttggagattcagggcggtggagtcatctcagcagaacggtgctaaggaagaggatggggatgaagtgttgccatccaagagcaaggccccaggatcccctttgtccagtgagggagcaacgggagaaggagtgagaaccctgggacctgctgaaaagcctcctctgaggaggtcacccagcaggacaaagaagcaagaaggggacagggccaccgaagaagcccagaacggtgaaaagggcangccggagtcaaaagaagttgacggnccacaacccggcccaaaaggaggtcccggaatcgcctaagttgatag

SEQ ID NO: 570790 - DNA, 747 bp, Homo sapiens
  misc_feature (135)..(135): n is a, c, g, or t
gacgacatcctggactactggatagggcgtgtcggcccatcacaagtcctgagccccccaagacggcgatgcccactggaacaaaaaggatgctggatccaccgcagagactcatggaccaaatccgcaaacaanctacctgacaccggccgactcataggcaagcatgtgacaagctgtgggggcctccttgccaaaggcatggtccgaaatggtggggatgcagacgtgagcgtgagctacgtacctaagcgcggcgaacacttgtccccagacgactccccttgttgtgtcccagaggtccatgggtagtgcgcatgtgatcgcacccgtgtgatgggcacgtgttccagcatgaacaacaacatctggacatcgacatgagcatcatcgagcagcatggcgatggcaacatctcgcgtgaaaatggtgatgctcatctagtgagactcgagtgagtgtcgcaggatgcgggcgtattctcctttgtaatgccgatataatgcgtcttctcctcctttttactgcacgtcttcccttttcggtgggctcttttgctcccccgtctttccgccgtacggtccctcatcggtcggtctttaacttttttcggttccctcggtatttgtgtttcaacaacacatattccagtacatttttcattatccagataatgcgccccaaaaggttgttcaggtatattggggaaagccacaaggggaacttccataagacctggtccctaag

SEQ ID NO: 570791 - DNA, 288 bp, Homo sapiens
atgcatgtcataaacagtatcacaaaggtcagagagtcatagaaccgtgatcctggaatgagaggactggaggaggacttagagaccatagattctctagtttagtagaaacctaagctctcaagaatccagatgacttgctaacaaccccctccccccgcataagttagagacacagcagggccaaaacctgtatctaatttatcagccagtgttcactacagagtatcctatatctccagtccttgtgaagttatttttcagtcctttacttagcttccggtcgaa

SEQ ID NO: 570792 - DNA, 318 bp, Homo sapiens
  misc_feature (6)..(6): n is a, c, g, or t
  misc_feature (81)..(81): n is a, c, g, or t
  misc_feature (83)..(83): n is a, c, g, or t
  misc_feature (85)..(85): n is a, c, g, or t
  misc_feature (87)..(87): n is a, c, g, or t
  misc_feature (89)..(89): n is a, c, g, or t
  misc_feature (97)..(97): n is a, c, g, or t
  misc_feature (100)..(100): n is a, c, g, or t
  misc_feature (102)..(102): n is a, c, g, or t
  misc_feature (177)..(177): n is a, c, g, or t
  misc_feature (183)..(184): n is a, c, g, or t
  misc_feature (190)..(190): n is a, c, g, or t
  misc_feature (206)..(206): n is a, c, g, or t
  misc_feature (211)..(211): n is a, c, g, or t
  misc_feature (225)..(225): n is a, c, g, or t
  misc_feature (231)..(231): n is a, c, g, or t
  misc_feature (235)..(235): n is a, c, g, or t
  misc_feature (292)..(292): n is a, c, g, or t
tttttnaaaatagttccaagcttggagaaagcaatgagctccacctactcagcagaacccacggctcgtcccccgtggacntnantnancagtgacnttncntgccccgttcctcagccgcccatcccactgccttgactgaggggaccctgcttttgctcctggggggtaggattnggggtnntagttntttttttttttggttntattnagagaaaagttgtntttgangganttatccccattccccaaattccaagctcctgctggtgggctgaaggcactgacagantccctgggacacccccaggtagccac

SEQ ID NO: 570793 - DNA, 615 bp, Homo sapiens
cacttaggagatttcaacttaactgaaccgctcgaacctaaaaaaaaaaaaaaaaaaaaaaaaaaaaacactggttcgggcgcgcccttgggccccgccgagagagagagacttttctctagagacaccacttcgcgttgtggggcgcgcggcgggcccccagttgggtctaggcgtgaacacggtggcccaaaggcgcgtgtgttccctagagggagacaccgcggggccaggaacgaagggggcggggaattctcttcaccagatataaagaaaggcccgggggggcaaaccgcggagcgggttctcgtggaaccaaaatctccagaagggagagcgccgcggaggccccactaaggggagctctctacaacacaggggggaggctccccacagggggagaaggccctcgggaaatatctaacaaatttataacgcgcccccacgagcactgtgggagcaccacctcataatctcgggaagagagcaacgtagagaggtggagaagaacctacctaattataaaaggcaattcctagcgggggacgagaactaccgtgggaagaagagccgactaatcacaacaaaacacgggggggactggagactagaccg

SEQ ID NO: 570794 - DNA, 284 bp, Homo sapiens
  misc_feature (152)..(152): n is a, c, g, or t
  misc_feature (183)..(183): n is a, c, g, or t
  misc_feature (260)..(260): n is a, c, g, or t
tctagaggcatccggccaaggagctcagggcgctttgggacgctacaactctgcttttgcagttcaggaaacaggcccgacgaggaggcttgttagtggtgagcttagtagacttaaccaggcaccagacttttaaagcttctgacatttcnatgtcagcttactgaagatgccaaaggctgnggtttatctacacgctcctctagaagctatttatacatgacaaggagcgcgctgccagaaaccatgcagtttaaccntcttaggtcaccttttgttgccag

SEQ ID NO: 570795 - DNA, 128 bp, Homo sapiens
gcacagtcaatttccctttttatatgtcaagtactcttggtaaatgttatctcacaatttattataattcattactattattttttttccaggttgcatggcctgaataagaacggtttcacactgtt

SEQ ID NO: 570796 - DNA, 247 bp, Homo sapiens
ggtacccatccactcttttctcctctttaaatagaatctcagccaagctttcagcaattagtttagcatttgtctcatatttcttttatacaaggcgggggggtttccttcttttgtttcaaaattctcagtttatttccagtttcgttaattcagtaaacaagtcaagataccaattatacacatttattggcaacaaaagcaccacaattcagaaatttataactcaaacaactttcgataaaca

SEQ ID NO: 570797 - DNA, 261 bp, Homo sapiens
aagatcgtacttgtaaaacttcaagagaattgtcttgatcttgttgggcgtattggtgacaggggagctgaatatgtatctagcaatagagtggatgaggatttgctttgagcttttaaagctcttaaaaccccacaaaaaggctattcgtagagccacagtcatcacatttggttatattgcaaaggccattggcccttatgatatattggctacacttttgaggaactttaaagtttaagaaaggtagaacaaaatttg

SEQ ID NO: 570798 - DNA, 3444 bp, Homo sapiens
  misc_feature (537)..(537): n is a, c, g, or t
  misc_feature (743)..(743): n is a, c, g, or t
  misc_feature (812)..(812): n is a, c, g, or t
  misc_feature (1196)..(1196): n is a, c, g, or t
  misc_feature (1635)..(1635): n is a, c, g, or t
  misc_feature (1919)..(1919): n is a, c, g, or t
  misc_feature (2191)..(2191): n is a, c, g, or t
  misc_feature (2403)..(2403): n is a, c, g, or t
  misc_feature (2457)..(2457): n is a, c, g, or t
  misc_feature (2809)..(2809): n is a, c, g, or t
  misc_feature (2817)..(2817): n is a, c, g, or t
  misc_feature (2868)..(2868): n is a, c, g, or t
  misc_feature (2892)..(2892): n is a, c, g, or t
  misc_feature (3006)..(3006): n is a, c, g, or t
  misc_feature (3023)..(3023): n is a, c, g, or t
  misc_feature (3027)..(3027): n is a, c, g, or t
  misc_feature (3070)..(3070): n is a, c, g, or t
  misc_feature (3226)..(3226): n is a, c, g, or t
  misc_feature (3385)..(3385): n is a, c, g, or t
atggcttgcccctggaagtttctcttcagagtcaaatcctaccaaggtgacctgaaagaggaaaaggacattaacaacaacgtggagaaaaccccaggtgctattcccagcccaacaacacaggatgaccctaagagtcacaagcatcaaaatggtttcccccagttcctcactgggactgcacagaatgttccagaatccctggacaagctgcatgtgactccatcgacccgcccacagcacgtgaggatcaaaaactggggcaatggagagatttttcacgacacccttcaccacaaggccacctcggatatctcttgcaagtccaaattatgcatggggtccatcatgaactccaagagtttgaccagaggacccagagacaagcccaccccagtggaggagcttctgcctcaagccattgaattcattaaccagtattatggctccttcaaagaggcaaaaatagaggaacatctggccaggctggaagccgtaacaaaggaaatagaaacaacaggaacctaccagctcacnctggatgagctcatctttgccaccaagatggcctggaggaacgcccctcgctgcatcggcaggattcagtggtccaacctgcaggtcttcgatgcccggagctgtagcactgcatcagaaatgttccagcatatctgcagacacatactttacgccactaacagtggcaacatcaggtcggccattactgtgttcccccagcggancgatgggaagcatgacttccggatctggaattcccagctcatccggtacgctggctaccagatgcccgntggcaccatcagaggggatcctgccaccttggagttcacccagttgtgcatcgacctgggctggaagccccgctatggccgcttcgatgtgctgcctctggtcctgcaggctcacggtcaagatccagaggtctttgaaatccctcctgatcttgtgctggaggtgaccatggagcatcccaagtacgagtggttccaggagctcgggctgaagtggtatgcgctgcctgccgtggccaacatgctcctggaggtgggtggcctcgagttcccagcctgccccttcaatggttggtacatgggcaccgagattggagtccgagacctctgtgacacacagcgctacaacatcctggaggaagtgggcaggaggatgggcctggngacccacacactggcctccctctggaaagaccgggctgtcaccgagatcaatgcagctgtgctccatagttttcagaagcagaatgtgaccatcatggaccaccacacagcctcagagtccttcatgaagcacatgcagaatgagtaccgggcccgaggaggctgccctgcagactggatttggctggtccctccggtgtccgggagcatcacccctgtgttccaccaggagatgttgaactacgtcctatctccattctactactaccagatcgagccctggaagacccacatctggcaggatgagaagctgaggcccaggaggagagagatccggttcacagtcttggtgaaagcggtgttctttgcttctgtgctaatgcggaaggtcatggcttcccgcgtcagagccacagtcctctttgctactgagacaggnaagtcggaagcgctagccagggacctggctgccttgttcacgtacgccttcaacaccaaggttgtctgcatggaacagtataaggcaaacaccttggaagaggaacaactactgctggtggtgacaagcacatttggcaatggagactgccccagcaatgggcagactctgaagaaatctctgttcatgatgaaagaactcgggcataccttcaggtatgcggtatttggcctgggctccagcatgtaccctcagttctgtgcctttgctcatgacatcgaccngaaactgtctcacctgggagcctcccagcttgccccaaccggagaaggggacgaactcagcgggcaggaggacgccttccgcagctgggctgtgcaaaccttccgggcagcctgtgagacgttcgatgttcgaagcaaacattgcattcagatcccgaaacgctacacttccaacgcaacatgggagccagagcagtacaagctcacccagagcccagagcctctagacctcaacaaagctctcagcagcatccacgccaagaacgtgttcnccatgaggctgaaatccctccagaatctgcagagtgagaagtccagccgcaccaccctccttgttcaactcaccttcgagggcagccgaggccccagctacctacctggggaacacctggggattttcccaggcaaccagacggccctggtgcaagggatcttggagcgagttgtggattgttcttcgccagaccaaactgtgtgcctggangttctagatgagagtggcagctactgggtcaaagacaagaggcttcccccctgntcactcaggcaagccctcacctacttcctggacatcactacccctcccacccagctgcagctccacaagctggcccgctttgccacggaagagacgcacaggcagaggttggaggccttgtgtcagccctcagagtacaacgattggaagttcagcaacaaccccacgttcctggaggtgctggaagagttcccatcattgcgtgtgcctgctgccttcctgctgtcgcagctccccattctgaagccccgctactactccatcagctcctcccaggaccacaccccctcggaggtccacctcactgtggctgtggtcacctatcgcacccgagatggtcagggtcccctgnaccatggngtctgcagcacttggatcaataacctgaagcccgaagacccagtgccctgntttgtgcggagtgtcagtggcttncagctccctgaggacccctcccagccctgcatcctcattgggcccggtacaggcattgcccccttccgaagtttctggcagcagcggctccatgactctcagcgcagagggctnaaaggaggccgcatgancttngtgtttgggtgcagacacccagaggaggaccacctctatcagnaagaaatgcaggagatggtccgcaagggagtgttgttccaggtgcacacaggctactcccggctgcccggaaaacccaaggtctacgttcaagacatcctgcagaaagagctggccgacgaggtgttcagcgtgctccacggggagcagggccacntctatgtttgtggcgatgtgcgcatggctcgggatgtggctaccactttgaagaagctggtggccgccaagctgaacttgagtgaggagcaggttgaggattacttcttccagctcaagagccagaaacgttatcatgaggatatcttcggtgcggtcntttcctatggagtgaaaaagggcaacgccttggaggagcccaaaggcacaagactctga

SEQ ID NO: 570799 - DNA, 478 bp, Homo sapiens
gaactttattacatactgattctggaacaaaacagttgtaaaaactttaaaaaaaaaaaaaccgacaaagttacgaggccatcatgctatttatcttctgagttcccagcaatgactcaggcatcagagatgatgctgcagtggaaaacctgactctgtgtgtctgcaactgaatgttgtgcgagtaatttattaactgtctttctaaaggtttgctgcttttaagatgcactataattcgggatgtaatccttacattgcttttccaaggaagggaacaaaagtctagtgattagtatgccaactgccactactcctggctccttttgaaggagtagtggcagttggcatactaatcactagacttttgagaggactggctaaagtgaagtgtgcacagtgtgaagtttaatgctgttgtcaagaggcctaaacccacattttctcttttaatattttatgattgccatcaaaaaaa

SEQ ID NO: 570800 - DNA, 305 bp, Homo sapiens
ggtcgaccgccgaataccctggcggattttaccgagcacctcatgaagtgtttgccgaatgcaacaccggtgcagcgtcaggtactggagcagtggcaggactatgcacactctttgtgcgcacgctttaacgtgacggtcggttaaacacgccgacgattaaattgcggacaataaaaaaacgccagtgtaactggcgtttatttgtaggtcgcgaatagcgtccgtgaccggcttggcttagcccagcagggtagcccagctttcaaccacgtcgccgccccacttggctttccacgtcgacg

SEQ ID NO: 570801 - DNA, 644 bp, Homo sapiens
tggcccccttggagttttgggtttcaaattggggaaaaagtgggttatacggataggatgggggggaagtttgcgggttgcactggcccaaggagggaaaggggtccctaaggggtggccccccgatcccggtaaaaggaggaggccggcggaataggagccaaacaaggggactgggcttaaggggcgcgaaacaatacagcccctgggcgcgcgcagatacttgcgcgggcagtggcggcactaaccgcacgcgcaacgaggacgtgcactcgcaaaataggggaaaggacgcccccacagatggccagagcacacgggcacccggacacaacatcgtgttgcgcagaatagggaaaacacctctccgcggcctagaagtggtggcgaaaggggctatgtcccaagaggggggttcgcccaacgggctcaaaaatggtcgcggggctccgcccataagcaagcaccgggtcggacaacatcagggtacaagcgctccctcaaaggcgcgcacccgcgcagacccaccacaccgcccgaaggggcgtcctaggaaacgggtccccgcacggggtgggccccgcggctccacccgaacagggacccggagcccagcgagtgcggaccccacgcgcccaccacag

SEQ ID NO: 570802 - DNA, 1578 bp, Homo sapiens
ctcagttaaaatattactccttcatggccaagtgtggtggctcacacctgtaatcctcggccttccaaagtgctgggattacaggcgtgagccaccgtgcctggccagaataggttttttctttcaacttgatcagtagaaaatggacatcaagtttgaacagataaatcatggacagccttattgtgattgaaatgcttgtaggttctgtgccaattttccaccactgtgtactttgttgctatttaaaactgtatcaactctaacggaagaataaattatttgtgattttaaaaaaaaaaaaaaaaaaaaaaaaaaaaaaaaaaaaaaaaaaaaaaaaaaaaaaaaaaaaaaaaaaaaaagaaaaaaaaaaaaaaaagaaaaaaaaaaaaaaaaaaaaaaaagaggagcgagcggcgcgcgctacgcaagcatcaaaagaagacccccaccccccccaccacaactccgacaccacgacaaggagaagaccgccggcaacaaagaaaagaaaagaagaaggtcagcaggaggacaccctctcaaagacacgagaggaaaaaaaagaaaaaagaaacagaaagaaaagataagagcccaacccccccagagaagaagaaatcgagaagaagcagacacaacggaaggaaacagagaaaacaacgagtagaaggagaacgaaagacagaaaagaaaacacaccaacaggagaaggcaggaaaaaacaaagacaaacaaaagaaaacaaaaaaaaaaaacagagaaagaacgagcaaaaaaacacaagcaagacacaagacagtagaaaaaaagaaaaaatagagaagaagaaaaacaaaacagagaaaaaaagagacaaggcacacacaaaaaacagaacaagagaaaaaaaaaacaaaaaagacaaacaagacaaacaaggagacagaacaaagaagacagaacagagataaaagaagaacgacaaacacaaagaacaaaagagaaagagcgatcacacacgacgaagaaaatcactaaccataaaaaaaaaagcacagagaaagcaagaacaacaagaaaagagagaaggaaaaagaaaaagacaaacaacaacacaacaacaaggaaaagaagaaagaaaagaaccacaaaatagaaccacacaacaaaacaacacaacaacagcaatagagggacagcgacgaaaaagagaaagacggaagaagaacgaaacagaacacaatggccgagaacacagacaagaaggaggcgaaggagcaaacaagacaacaaaaaaacaacacaaaagcgagaaggaagagtaaacgaagaaaaacgacgacacaaagacgacagcgagacgagaggagcgagcaggaaagagaaagcacgacacgcacaaacgccacgcgaacccgaacaccaacgagagcaagacaccacgcacagatcgcgagcgcggagcggatggatggagaggacgcgaaagaaacaacaacacgagagagaaggagcaagacggagcgatgagcgaaacgacacaaagaaaagagaaagagagagagagagatgcaaagacaaccgaacgacgaaacg

SEQ ID NO: 570803 - DNA, 313 bp, Homo sapiens
tccctccccggctttttgttggtattccccgtattcctgccttaatatttcaccccccaacccgtttttccggggggtttaaacaagggccccgttttatttttttgggataccgaaggttttgaaattcccctatttttcattttcagtttttttttccaattttttgctttttcaacatgggggacctattttttttttttgacttttaacatcaaaatttgatttttgtcaaaccttcctttttaagggaagaatgaccgttttttttgggggaaataatggatttactaatttaaccttttggatttta

SEQ ID NO: 570804 - DNA, 335 bp, Homo sapiens
tgtgaagcacaccccagttttggggagacctcaggaagcttacaatcatggcagaaggcaaagtaggaacagacatgtcacatagtgaaagcaggagcaaggagcgagagagagagagagggagagagtggagaggagagggtcggggagttgccacacacttttaaatgaccagaggtggggggaagtgccacacacttttaaatgattggatctcatgaggacagcaccaagggatggtgcaaaccattcataagaaatccacccccatgatccaatcgcctcccactaggtcccacctccagtactggtgattatgattcaacattagatgt

SEQ ID NO: 570805 - DNA, 578 bp, Homo sapiens
aattatcatatcaatacaatcttttctacattattaactgaagaaaaatggtgaccttaatgatgtataaagattaggaaacacaaagaaatcagaagcaccaaattaggactgtaaagtggatgcctaatgatttcccatcataactctaacagaattgccattgtctgataagaggaatgacttaggagcatatttctggtggaatatcactctctgttgaagctttcctgtgcatttttgtgctaaaactttgggtaactttctcagaacattcatcacaagtattagccaggtgtggtggcacatgcctctagtctctagttccagctacttgggaggctgaggcatgagaataacttgaacctgggaggtagaggttgcagtgagccaagatcacaccactgcacgccagcctgggtgacagagcaacactctgtccccaaaaataagaaaaattaaaaacactctcacaataagcagatgttggcattctctggccttcctgaaaatccgcaagcggaatgccttcagcatccctaaaaactgttggcatgacctttggttttgacccgtct

SEQ ID NO: 570806 - DNA, 161 bp, Homo sapiens
cctacccagaggtgtacctcagattgagtcacttttgacattgatgccaattggtatactcaagtgtctctgctagtgaacaagaagtacgggaaaagagaacacgattactatcactaatgacaagggccgtttgagacaaggaagacattgatacgtat

SEQ ID NO: 570807 - DNA, 646 bp, Homo sapiens
tctgcctacgtgtgcccccttgcatgccgtgctgcgttctgtggatgaaccgccgccggcggttgccggagttcttccctgctggtgcggcccgcccgttgtgctggtttgcgctccggtcttgtgctacccctcgcttcttcgcgtgattggcccccccgcggtgacgtcaactgggcaatgacaacgggtaatgcttgtggaccgtgctgcacgccattttgtgctagacagtaaggcccccctcgtcttaccccgtgcggagtttccttaatgatagaggcgcaatattttggggagacccacgcaggacgtttccccacattggagttgagaattccaaatagagaggacaggagaatagaaatgcctcggtgacaggttagaagagcggagagagtgaggataggagaagaaatggttatgttttgttcgagaggatagagacgaggtgtagcttgaatggaaagaattgataggatatactctttgagtcaccgcggcgggcgcaccgaggcagacgcgagacaggatgagacggagggaacgagcgagtctcggagccccagatgaccaccacactcccgcgaagtgagcgatttcacacccccaccaaaaaggagaaaaggtccaacaaaagaacgaa

SEQ ID NO: 570808 - DNA, 1473 bp, Homo sapiens
tccctaagtgcccggttaatcccccccctgggggggtccacttacccagccaaaaggccggggcaccatggggaaagggcagaactctcctgtgcctttctgtgaggggattcttgggcctctcagggtgtgataaaaagggaaaggagtggtttctctcttctttgcccctcacatagggccataggagaacccaggagcaaattccccacccacgccttctccctatttcttcacaccgcgagaggagagaaaccccacctgtgtgggtgcacggttaaagatctcccacaccctatttaatcagttcaagtgtgcgaaacagagggatatagggcctgtggtctcccaccacacctattcacgcggcgggacacacataatatattacaaccagtcacacaagagacatagatataaacagttgtggcgtagtgagagcgcgccccgcagaaaaagagaagcacaatagtgaaccaccacctaccaaaaagaccttatattgcgcagggagaaaaagggcgcagctaaacggggggatctactgatgtgggagcgggctctaatacaccccccgcgtgccttgtgtgcaagagacaaggcgcatcagcggacacaatagagggaagtgaggagcacctcacatgtgggtgtcgggcactctgtgaatcgtatttctccccacgacaaatatcatgggcgcttatgaggagaggaaaaagacaccccgcacccgcaacacaagcagggaaaaggcgcaactctccacaatatatacaggcgtgagtgcagtggcgcccgagacctccctatgttgaacgagatgtgccgccccaaaggttaacactaaaacgactctctcccatataaacacttgcaacaagaggagggtgccctcttataatgccccacccgggaatatcaaagcaaacaccgttgtaggcatctcatcaagacacacatcccctgcgagaacgcgtactccaacgagtaataaccacccctcgggaggccaccatgaataagacgggtaaattatgaacacacactattgaccacgaaaaaaccacaaatgtggggtcccccaccacaaggcggtaacataataagagccccagagaggacatcacccgttgtgctcctaccgatctacattaaccaggaaatactccacgcgaaaaagagacccctttgatgtagggctcccaaacaaacacaccgtctctctcagaagaaatgcaccaacatctccccctgataactatattaagcgtattctccccccaaaaagcaggagcggaactaacctcaggcaaagccgctccgttccgcaacaatgcggtgcgccacatcttttgccacaaatgagtgtctatgaacatcccccaaagaaagagtcgtctctatattaagagagccccaataaccacccacagtagtctgcgaaattatgagataccacggagggaggat

SEQ ID NO: 570809 - DNA, 712 bp, Homo sapiens
taaattcttattactcagtcatactggtgggactattatggttaagagaactgtcttagatatgttcttaaaatgtgcccatattttcagaaacatgcggtattattggtatgattgaatgtcgtaccgtgtgagcataagatctttgaggcagttgatgtattggtgaattagcaatttatacaagaagctgtccataactgattagtgcttatgtacttatcttacagcatttttaagctttatgagcagcctaaatattctgggggaagtggggtataatatttaacgaatcatgattcagattgtaccattacatgtttcagtgcatgcatgtgttgactaacgctatgtcagacttaatattaaaatcagaaaatttaaatgctgggtgctggtcagagtttcctgtaagattctcgtcatttaaaaacaaagtagctgtttgtttaaagcatgcataaaaatttcatgtattgaaatatacttaagaaactttcaagatgcttcccatgtgtgttgtaactatttacctggtatggactcgtaccttagggttgtcttaacgttgactttgacgtcttccaaggtctccatgtgaaaccaaggcacccaaagagaactcatctgtgagtggttgtaattgttgtgactctaagtgttcaagatggaggtgaaaattttggcattatttaaactttttccattcata

SEQ ID NO: 570810 - DNA, 1091 bp, Homo sapiens
  misc_feature (196)..(196): n is a, c, g, or t
  misc_feature (524)..(524): n is a, c, g, or t
ggttacagactctttagcatttaacagaacagatgtagctgttatgaaagtgtaatgtaaaaatatgtgcccgtgatcttctatatcagagacatggcctttaatttcatatcgcttttcagaacatttcagtcgactacaaaactgcgaacccttcggatttcttatgtgactcagagaatagtgccgattcccncttaagtggaaatagattttgagtcttttggtcattgtaacccccaaatgagaatcatcgtaccctgatctcttggtaccaacaacaaaacattctatttctgcagtgctatgttatgtatattgtgttgagaaggaggggttctcgtgtcagcagcgagaacggggagtcgcaggggggcacggatgctgtaagctcgacttgagcaactgtgctgacctgcccgaggggcttcagagcaaagttcatccgtgggcatcataaccgcatcgcgggaggtagccgtggcgaagtaacgaggggcatgtgtccactcaccgacgccgcncgagactgtaagttccgtgaggctattgtgtgtgtagtgtagacaggcacaggggctcttcgacacattgtgtgtggccccgaggcctgtgggtccccagaaagaacctcgcgtgagacccgctcagaggggggtgaaagtcccaaccgccgacgctttgcgggggccgctcccccaaaaaggagggggcctgtgggggaaaattcacatcacggaggtggcgcgagaagacccaaaatgggggccggccccaaagcgctgtcacgaagagtcaaagtctttttcaaattggttcaacacggacggtgggtacacgaggctacaccttgtcaaggaagaagatgctttaagacggaaaaaaaattgggcctggggaggtatgaaggaagctttgtgttacattatgggaaggcgaacttacgggttttcttccaaaaagtggggtgtctcaccacgccgggcacagagatatttgggtggcgagggagggatggtaagagcgttgggcgaaataggaagccctcgaagtgtgtggcccaaagaggatagggagtgtgcggtaatata

SEQ ID NO: 570811 - DNA, 132 bp, Homo sapiens
cgtagacacttcctgtacctggaactgtttatcttttgtaactgcttctattaccaattaattttttagaacgttgttgtctattctgcttctgtaaaattgctgtcagttgatactcccccgctcccctgt

SEQ ID NO: 570812 - DNA, 1196 bp, Homo sapiens
agcggacagccgctccctcgctctgctggggcctccggacgcgcttcccacgcgggtctctggaacactcggtccgaacgcacgcctgcttgcactcacactgcggttcacacccgcaggcgctctcgcacccacactgccgctcacgcgcgctcacactcccccacgcgcgctccgctccggctccagccccgcgccccgcgaaggcgcaggcactgctgccgagagcgccgaggggccccgcggccttcccatggcggacctgagcttcatcgaagataccgtcgccttccccgagaaggaagaggatgaggaggaagaagaggagggtgtggagtggggctacgaggaaggtgttgagtggggtctggtgtttcctgatgctaatggggaataccagtctcctattaacctaaactcaagagaggctaggtatgacccctcgctgttggatgtccgcctctccccaaattatgtggtgtgccgagactgtgaagtcaccaatgatggacataccattcaggttatcctgaagtcaaaatcagttctttcgggaggaccattgcctcaagggcatgagtttgaactgtacgaagtgagatttcactggggaagagaaaaccagcgtggttctgagcacacggttaatttcaaagcttttcccatggagctccatctgatccactggaactccactctgtttggcagcattgatgaggctgtggggaagccgcacggaatcgccatcattgctctgtttgttcagataggaaaggaacatgttggcttgaaggctgtgactgaaatcctccaagatattcagtataaggggaagtccaaaacaataccttgctttaatcctaacactttattaccagaccctctgctgcgggattactgggtgtatgaaggctctctcaccatcccaccttgcagtgaaggtgtcacctggatattattccgataccctttaactatatcccagctacagatagaagaatttcgaaggctgaggacacatgttaagggggcagaacttgtggaaggctgtgatgggattttgggagacaactttcggcccactcagcctcttagtgacagagtcattagagctgcatttcagtagccaaagaggacaggaacaagtctgtcttcatgagggaggaagacaatggtctataatgcccttggataag

SEQ ID NO: 570813 - DNA, 1772 bp, Homo sapiens
agcggacagccgctccctcgctctgctggggcctccggacgcgcttcccacgcgggtctctggaacactcggtccgaacgcacgcctgcttgcactcacactgcggttcacacccgcaggcgctctcgcacccacactgccgctcacgcgcgctcacactcccccacgcgcgctccgctccggctccagccccgcgccccgcgaaggcgcaggcactgctgccgagagcgccgaggggccccgcggccttcccatggcggacctgagcttcatcgaagataccgtcgccttccccgagaaggaagaggatgaggaggaagaagaggagggtgtggagtggggctacgaggaaggtgttgagtggggtctggtgtttcctgatgctaatggggaataccagtctcctattaacctaaactcaagagaggctaggtatgacccctcgctgttggatgtccgcctctccccaaattatgtggtgtgccgagactgtgaagtcaccaatgatggacataccattcaggttatcctgaagtcaaaatcagttctttcgggaggaccattgcctcaagggcatgagtttgaactgtacgaagtgagatttcactggggaagagaaaaccagcgtggttctgagcacacggttaatttcaaagcttttcccatggaggtaagaataacaaatcatcttgtaaaaatcttgttttctgaataaagtattcagcgatttactgaaaatgatttagtttaaaagtagatgcatagctcttgaattttatcagtttatactaaaatttaaaaaatgcttaatgcaatggaagcctagggcagcacatgaaacctcctgtctactctcgtggcttggcgtgtgcgcatgagcacatggccagaaaggcaatctacagtattaaatttcaccctagtgttactattcttgtaaaaattctgcctctgcaaattcagtaggtcatttttgtggatgctttggataggtgacgagctgaagacaagcaaccgttggagaaacctcaacagtaatgaaaagtgtaggtttgctagtttaaaattggtgggttggttttattcaccccaagccacttggggagggagggagaaagagagattttttgagagtgattcttttgtccaaagaattccctccccgacttacgttcttagttaacttctgctgtttctttgatacgcagttgaaatcttatgtcttctgtgggacttttctctagttttttccctaggcagaattcatctctctctctctgctccctgtatgcttgatagggcactgccatggcgctggccccatgggttgtaccatttagtctccacagcgtctttcttgctgcctgtgagctcctgaggaccgaagctccctctcaccccctttttactcccatcatttgcccactgccaggcacagtggagatagacagttcacactggtgaaagtgaggggatgttggattcagtccaggtcttgatgttatttctagaaggaacctcagtttaccccagaaaatagccctttggtgtcatgtaagagtatgttctgggggctgctggtcttccagtcttttttttttgacattcacaactgtgcatgtgcttaatattaaatataaaattgctcatgaccagatgcaatatccagtaccacttcagtggctggaaatcatggctgtataattctatgtcagtgatacatgtattttagagtattctgttgaagtgtttgacagcattactgtaattat

SEQ ID NO: 570814 - DNA, 546 bp, Homo sapiens
gtggtacatgacattgggttacatcataacgttgcttccagattcatatgtgttcagtgtcctctgaagtaactgcctgttgcctctgctgcacctttgaaccacgtgtacagtcgccagataggtgaccggcggaacatctgattccaaacatgtaggatggggttcttgtcctctttacatgtggtttaattgccaagtgtctagagcttaatatgccgtgctatgtaaatatcatggattggatatagaactaagggtcatattttgatgtcgaacatgagtttagagggataaaatggtaccggtcgaacgatcaagtgacttgatagctgcgaagaaatgtggtatgaggatgaagttctgtatgtgaggaaggaaggaaatgcaaaataaaagtgtgtcggaagaatattatctggggttctatcgtaaaatgtatttcgtacatgctgagattagctctcgaatcttcatggattacgacgcacagaacttgtgtttggtgaaaaaccatgctaagcttacacccctcaccgacggggg

SEQ ID NO: 570815 - DNA, 435 bp, Homo sapiens
agaatctgtccaattgacatcccctaggcacaaagagcgtctaataaaaaggtgaccgtggtcggacttggagggcctatggtctggacccatactcagtggctcccatctttcagcagcgatgccaggctagcacccccgtcattcctgcccctggggcccaaggacaaccttcaggtgcaaattcaaggaaaccaggtccccccccttggctgggtattgctttaaaaggatcagctcccttgaaaacccatccaaggtttaaaaaaggccctccaacctggcaaaaaaaaatgacaaacttttttgtttcacgtggtggatccggtggaaatccaaactttgggctggtaatttttatgagccttttcagcttttgccaaaacaaaaaaaaatttcttttccaaaaataaatttttttttctaatctaaaaa

SEQ ID NO: 570816 - DNA, 715 bp, Homo sapiens
gaaagataactgaatcaatgtgaagtctgtgagtccctccagttgtcttcctcctcatcaggactaaaactggacttaagaggcagcgatccactaagcactgcttctgttcagaaataagaaggaaggaattcatacagagaactcgtattaagccagtagtttgtgtctacttgtgatcctcttgtgctccatctgatccactggaactccactctgtttggcagcattgatgaggctgtggggaagccgcacggaatcgccatcattgctctgtttgttcagataggaaaggaacatgttggcttgaaggctgtgactgaaatcctccaagatattcagtataaggggaagtccaaaacaataccttgctttaatcctaacactttattaccagaccctctgctgcgggattactgggtgtatgaaggctctctcaccatcccaccttgcagtgaaggtgtcacctggatattattccgataccctttaactatatcccagctacagatagaagaatttcgaaggctgaggacacatgttaagggggcagaacttgtggaaggctgtgatgggattttgggagacaactttcggcccactcagcctcttagtgacagagtcattagagctgcatttcagtagccaaagaggacaggaacaagtctgtcttcatgagggaggaagacaatggtctataatgcccttggataag

SEQ ID NO: 570817 - DNA, 150 bp, Homo sapiens
gtttctctcgtacttgagcaggattaccatggcaacaacacatcatcagtagggtaaaactaacctgtctcactctgtcacgcagcctggagtgcagtggcatgatcataactcattgtaatctcaaactcctggccttaagcaatcctc

SEQ ID NO: 570818 - DNA, 367 bp, Homo sapiens
ctgcagcctctttgcagaatggccaccttctcactgtgtctcacggggtctttcttctgtgcctgtccctcgcagacagtctctcccggctctcttttgaaggagattggagtgccgaattggctagtctgaggtttcagtgtgcacgacgtagtcagatggctcagatttggacccctggtagtaatgtattatactttgtccgatggcattgggcgggttgagccagcctgcagtcaggatttccttgtaccgttcacccgggagtacagaatcgcactctggctgaaagtacagcacgagcaccattgtcagccttgatggcctgtctagccggaccaagcaaaaagcttagtaactttctggg

SEQ ID NO: 570819 - DNA, 354 bp, Homo sapiens
cccctgatatactggtatatctgtgacacacaaatttaaaatgtaataaaatattacctttacttagcaaaaagtacataagtcagattatcctttcatgtattaaatgaagcttcttctaaagaagtccttatatacacagttgcaaattactttttaacacatacaatgtatactacatgctggaatcaaacacctgaaggagctggaatcttatgaatacagccagggcaacagtgtagagaatcatgaacaaaaacatcacagtccacacagaaaacctttaggcacacagcacaaacatcaacatgttggtctttcaattccccctgacatccataacaaaatctttct

SEQ ID NO: 570820 - DNA, 437 bp, Homo sapiens
  misc_feature (46)..(46): n is a, c, g, or t
  misc_feature (93)..(93): n is a, c, g, or t
ctgcgcctttaaccgacatacaccatgatatcagggtctaagtgtntagtttttacatgttaaattttactgtaatttattttttaacctgtntttaatttatttcattttgttcttaggtgttgagtggggtctggtgtttcctgatgctaatggggaataccagtctcctattaacctaaactcaagagaggctaggtatgacccctcgctgttggatgtccgcctctccccaaattatgtggtgtgccgagactgtgaagtcaccaatgatggacataccattcaggttatcctgaagtcaaaatcaggtattttagaaaatatgtttgtgtggtcttttaaactagaagtcagcgtagagttattgaactgtgatttaacttgcacaatttaaaaagtacaactgacgtatctctatcttcaggatacctttg

SEQ ID NO: 570821 - DNA, 1189 bp, Homo sapiens
tctctcattttattacaatgaagttataacagtacagaaaagtcacatgacctgtggggggtcaaatttcttaaacccggcaacatggaggaactctaaatactattaaattattggttacactattcagacttccaatggtacaagtacttggaaacagttacagccctcaccaagctaaggttgggggcacatgaagttccaacagcatcgtgaaattgcgtttgaaggcaaacttttacaaattagcaagtgtaccgcttacaaaacttgtgcctttacctaggggtggtatgttccagtgttaattccagcgcctttcacaattttaaggaaccaaatttctactataccttcactttcataaaaacccctagattgacaacagtgaaaaaagaagccaatacagataataaactggcaactttcacggaacaagtcccgtgcttacattatctgcacaatacattattagcgcagttgttaaacactacaattgctcccaaatagctcccgtggaattggtgcggcaacagactcagtgttcgcgtacaaacaagtcaacacatgaacccccttaattaggaccgagaaacgcctgcggcccacttatacaaccgagcacacaacagttgtcaaccaaaacacgtttacactcctccaaaacctatttaaccactgggcattcaacgtaaaaaaccaagatacacgggccccccttgcgcaaacataacacggagggtacacaaataccccaatccagaaggatcaacaagaagagccccaaccactcgggaaaaggggaagagaccccaaatagacgagatacactagtcccaaaaacacggaggaaaaacaaccaccacagaagaagaaaactcggataaagacatctaaacaaaaaaaacacataacgcagacaaacagaagcggacacgaggaggaacctaacaaccacatgcaagaaggaaaacaccacggaaggggcgagaacaaaaaacaccaaaagggtcacacaccaggaggcacataacagagaatggaggcccaccgcgcaagagcagtcacaatatgcaacaagaaaaaaacgaaacaaacaaaacacgacgagaaaaaaaaccaccgcaaggcaaaacacaaaagaacaaaaagaaaagaacgaaaaagaaaactaaaaaccagcgcgaca

SEQ ID NO: 570822 - DNA, 938 bp, Homo sapiens
  misc_feature (669)..(669): n is a, c, g, or t
ttcaccgtccaggtctgactcataaatcaattaccaggaactagtcattgtgggacattagggcccccggctcgggagaggtgccggccagcttcccatgccagcccggagcccacgagtgctgcccacgcgtacctccgcgtcaccgtcatggggctcttctgggagcacggagcaatccgcgcgtgttcctgtttcactcctcagcttctcccctcgaagggactctctggccacctcctccaccgaagtccagctccctcagtctgggcacccactgctacactcagcctcatgatgccacttcagaccagccaggtgtcttcccgggccctgccagaccctgctcacattccctctgctggtctgtgctggtctcacgaaggccaccgcgccctgattccactcaggccaggtccgagctgcagtcccccgcaccttccttccgctgtcccggtccgtgggtcatgttgttgccgagccctgtgtgacttttgaagctgtaaaatgagcttccaggcttgggtggcgtcggggcagggccgcgaggctgggaggaagcccttctgctttgctggtgtgtctggaatttgctttccctcacctctcacttccttctacgaaggagcttcctgagtggaaccagagaatgcatgtctgtccacttgngtggctagtgggtgggggctgggaacaaggggccctgacctgtgtgctggccgggacgtggcaacaacccccccagctaggttcttccccttaagcttatgggtccccggtgggctagccttccctccggaggccggacatggccagaatggggacacggcactacagagaaacccctattggcacacaaccagaatttacgggacacccgtggccccattgtgccgcacgcaaaaagcgccggggcaacaacacaaaacggggcggcc

SEQ ID NO: 570823 - DNA, 453 bp, Homo sapiens
tgtgcttgacactaaacctgaatgggtgctttataatgagtatgtatctaacaacaaagaattacatccgaacatgtacagatatcaagccagaatgattggtgaaaattgcccctcaatattatgacatgagcaatttcccacagtgtgacgcacagagacagtaggaccgcatcattgccaaacttcaatccaaggaatatacactgtactgaattcagtgcttagcactgaagttattgagaggacagctttcaaagatgaatgaactcaaaagttcgagttgtgctcttcacgttggttcgataatggcctttatttgaaagctttttaatttttctttacagtaaatattccattctgatttcataaattacacatttatgcctcccttttgtgtagacactgtagctcatactggaaaagtcgtatcactgcgcaggctaccgagct

SEQ ID NO: 570824 - DNA, 101 bp, Homo sapiens
atgatcccggtagcatagtgtggtatctaatcccagttgggtcttagctattgtgtgacagatatgttaaagccactttcgtagtctattttgtgtcaact

SEQ ID NO: 570825 - DNA, 149 bp, Homo sapiens
cgaccatgctcttgtgccttgaaccttgattaaagcaggctgtacggccggaatcttgggcatttttcaccggcgccgtggccgcctctgaggccagggcaggacacgatcgcgctggagctggcggcggcgactgatgagccggggcc

SEQ ID NO: 570826 - DNA, 98 bp, Homo sapiens
ggatttgctggtgcagtacaactaggcttaatagggacatgacccaaacaattgctatgtagaatgagacaacagcattcatactgaacttttccaaa

SEQ ID NO: 570827 - DNA, 365 bp, Homo sapiens
  misc_feature (230)..(230): n is a, c, g, or t
  misc_feature (327)..(327): n is a, c, g, or t
agccctctctcccacatgagctgggcagttctctgagcagggcccatgatgtttgttcagaaaacagtaagggaagtggggcctcttcacacacaggcccttcctgccagtttaagtgtctggctttctggtgtagccaaagctattcctccctgtgctgcctcctgaggctgcaggctgctgctctgctcctgggctaggcttgctggagaagccacgtgcaggaaggnttataaaagagcctttccataaattttctgcatgacttgccaagaactgtaagttgtaaatctgttttgttgcttcagagagaagtaggaaggaggnaatgggtcatttctactcagctctgggaacaacccttg

SEQ ID NO: 570828 - DNA, 594 bp, Homo sapiens
  misc_feature (484)..(484): n is a, c, g, or t
cttattccgggtgtccttaaaaaataaagagagacttatactggggacaccaatgggcattgccgtatcctagttatttattccccaggtttaaatcatatctaatctgataaattcattcccttcagaacttgattatttttctccatcttataaaattaaagtacctaggaatgttgggctcagaaaagcaacaaattaggaggacacaggggatttggtcttcaaacaactgaagtatggtcatgttagaaaagcatttggatccttttggtatagccccagtggattgaacctatgtatggaatttatagtaaaacagatttcagtccagttaaaggaagaactatcctaacagtcaaatctgcttagagagggagtgggctgcctaggaggggcttgcaggggtccctcttgaagtttcaatatatgagttgggatgaccttctccggggtgtgtatggtacattcagatgtcgagtgnattatcatataaggggggctataaggactatcccaccctgaattttttcctaggacacattgggtgatggaaagaaaccagatgattattacaggatgagtcaggccccg

SEQ ID NO: 570829 - DNA, 659 bp, Homo sapiens
aatcggccatatgccggagcacttgttagcagagcttatgacacctgagctggggagaactcctgactttttagccatgaaatctcacactaaactcttcaataaactacgttcttttaatatcacttacttctactctcacttactttgtctttttttattacattgataattatttatccttatatttatttctaattctttatcttttttctatccttttacttcttttcctatctttcacaatacactttactcattttccttttaatttaacattttctatctttcatctacccattctctatttactcttcattctcttatatcatttattcttttatatttttaatttttacaatctctttttttcttattctttttacctttttatatctttttttctctattcttttttttattctttaatctttctctttctaatctttctttctatatttttttatcttcatctacttatattttttcctcattttcttttatttttaattttttctctaatttgtttattacttcttttatttattttctttttatttctttcttctcctcatcttttaactctttcctcttattttaatttcaatttttaatttactttttcatttattttttaatacttcttttcatttcctccg

SEQ ID NO: 570830 - DNA, 103 bp, Homo sapiens
tgggtccttccctttgctccctactcccccccccggcagagaataggctttttaagatgctgcgatcccgttttgctgcccgtaataaaaatgctctccgccc

SEQ ID NO: 570831 - DNA, 204 bp, Homo sapiens
tgcacggtactggttagcagcggtactggttctggggatgatgaggctattgttttctgtgaattcttcgatcatggcccatttgggtcaaaaagccggttagcgggagcaggcctcctagggagaggagggtgtgatggaattaagggtgttagtcatgttagcttgtttcacgtgcgagatactatccgggtcttggtgagg

SEQ ID NO: 570832 - DNA, 169 bp, Homo sapiens
gcgtctgaagagtccgactacagctatagtgctagtgtggagtagggctgaatctgtgctgggtcctactatggctgacctgagtcgagctgggagacctaatcggcctgaactgcctgcagctgctaggaggagccctagtaaccgagtgagacttctattagcggtg

SEQ ID NO: 570833 - DNA, 614 bp, Homo sapiens
  misc_feature (509)..(509): n is a, c, g, or t
caactacgcaaaggccccaacgttgtaggcccctacgggctactacaacccttcgctgacgccataaaactcttcaccaaagagcccctaaaacccgccacatctaccatcaccctctacatcaccgccccgaccttagctctcaccatcgctcttcgtacgtatgaacccccctccgccatgacgccagaccccctagatcaacctcgaacctagggcctcctgatttattctagccgacctctagcctaggccgtattactcaagtgcctgctgatgcagggtgaggcatcaagacttcgaaagcgtagcaccgctgatcgggcggcgacgtgcggagcgaggtgaggccgcgagaacaattcgtcgatatgaaagtcatccctagcccatcagtgtctcacatagtcgataccatttacgtgacatgaaagatggccatccttattataccacgtacgtcgcacactcgtgtattcacaagcgatcaaagaatcgaacctcctgantttatcctgccatgtcgcaatcaaattgaccccttgggcctagtcacatattagatcttgatctcaccaacacttagccagaagaacgcaaccagaagccccgct

SEQ ID NO: 570834 - DNA, 266 bp, Homo sapiens
tggggcaatgtctgcaatctcactgtctgactcaggtgtagaatacttttttttttcttacacatttattccgcaaagaaatgttatggtcagtgccaggaagcagcatgaaggtagttgtaaatcatgtatgttaaatttgcactaggctaaatatagccttgacatcatggtgttgcatgtagcaaatgacttctccacagataaggatatctcctactctgacctcaaggcccttctggccaagaacaactgcccgtcgacgc

SEQ ID NO: 570835 - DNA, 342 bp, Homo sapiens
  misc_feature (72)..(72): n is a, c, g, or t
  misc_feature (79)..(79): n is a, c, g, or t
  misc_feature (116)..(117): n is a, c, g, or t
  misc_feature (125)..(125): n is a, c, g, or t
  misc_feature (141)..(141): n is a, c, g, or t
  misc_feature (154)..(154): n is a, c, g, or t
  misc_feature (157)..(157): n is a, c, g, or t
  misc_feature (159)..(160): n is a, c, g, or t
  misc_feature (163)..(163): n is a, c, g, or t
  misc_feature (174)..(174): n is a, c, g, or t
  misc_feature (242)..(242): n is a, c, g, or t
  misc_feature (252)..(252): n is a, c, g, or t
  misc_feature (275)..(275): n is a, c, g, or t
  misc_feature (297)..(297): n is a, c, g, or t
  misc_feature (332)..(332): n is a, c, g, or t
  misc_feature (334)..(334): n is a, c, g, or t
caacttctgttcaacaagttgtctgccttaagtttttggaagcaaacaaaaaagcaaaactcctcagatttntttgccnaacccaaattttcaaagcctttcaaccccctgcaaannaaaggccnttatgcattttttcanactggagattccnccncnnacntcatgctaacncagtttgtttcaaatgaataaggcaaggaatcataaaatcaaaaaaaaatttcccgaaccacttgccntttaaagacnaatgtcaatgaaaaaattatgcncagtattcgatcgggttttttnatttaggggtttgggaataaaacaaaaatgtttcngnggcttcca

SEQ ID NO: 570836 - DNA, 156 bp, Homo sapiens
ttgggcctttttttttttaaagggaaaatttttagggctttggccccctttgttttccccccccgaaaaaaaaattttccctttcccctttttgtccccccccccaaaatttttttttggccccccaagtttttgcccataaaaaatctttgctta

SEQ ID NO: 570837 - DNA, 214 bp, Homo sapiens
cgaagctgcttcccctggtgcagcaggctgtgggaggtggtgacagttgaggccagcctctttcaccacgcagcttacgcgttcaccacgttcacagtccgcctgcttggaagcctctctcaggaggccgacaatgactgcggggctcaatggagctgtcttcaggccagaagtgcctctccgcagggacctgcccctgctcctattccggact

SEQ ID NO: 570838 - DNA, 952 bp, Homo sapiens
gcctcttttctccggctggaaccatggagggtgtagaagagaagaagaaggacggttcctgactgtgccatgaaaccccttacgacacacaacgcgacacggaactttcgcagacgctgaagatcaacgcgcctgagacacgaacgtttgcccaaacacgatgcttcgaacacggcaacggacggacacgcttatctactgacaagaacgcaaacagcactactcacacaggaactatcaggcacgatgtacacgaacctgaaaattcgaactggccgaggactggcacagacaacagcctggcaaactatctatgtacccctgcacgacacccaaaacttggcgatcttgtcaatcagacactcaggacgtgtatcaactggacgtgcagcccaacacggcttcgtaaaatgtgtgtcagccaagcgttctatcgcactatcgctcaaacatcttcacatggacaccatttgtgacagctcacgcacaggcatttcgatatacacaatgctgaaggacttgtacgagccactactatacgcactgggcggtacccacagaatctgaacagatcaggcaagcgtgacactcactcgtacaacgcgctggacctctgagcaacaactcaatacagaagccgaactacgtctcttgaccagactcaccgacgtatcagcaatatgcagtcggaatctccttgagtaaatatcacgggcaatcaactactgcatggcgggactattgactccgatgaagaatactaactacgtgaccgggcaaaccagcataacaagagacgggacacaataaaaataaccctgatgggcccgcatacaaacagtatgacacagcgtcacagagacagtggcacatgcaagacccacacacacaccaccaggacaggcacgaagggagacacgaagactggcagcaagaggaggaacaggaggcg

SEQ ID NO: 570839 - DNA, 248 bp, Homo sapiens
atgtaacgattccagagtattcccactgctcatcactagcgctgaacatcgtcttggctatgcgggctcttttttggttccatatgaactttaaagtagttttttccaattctgtgaagaaagtcagtggtagcttgatggggacagcattgaatctataaattactttgggcagtatggccattttcacgatattgattcttcctatccgtgagcatggaatttttttccatttgtttgtgtccgcg

SEQ ID NO: 570840 - DNA, 725 bp, Homo sapiens
agcggtgcgaagcaggcgagcgagcgggaagacgcagccaccttcctcaccagtccagtcccacagcggtttgttccccttctcgggagtgcgccaatgcctgggtcgaccaaaaccctgtccccaatatggcgagaacgacaactgacatcatccaggataataaacggtgacctagtcagttcgctttcctggtaatgcacacagtgcgcggggagcgttcctacagttggggaatggcggtcaatgtgtattctacctcgataacccaagagactatgagcatgacatgacatcattgcatgggttaatgacatagtatctttaaactacaccaaagtggaacagctttgttcaggagcggcctattgccaagttcatggacatgctcgttccctggctgcattagttcgacgaacagtagcattccaagcaaagctggaaccatgaagtattttcacaactgtgaaacttctgcaaggcatcatttaacgcgaatgaacgtggactaaggtaattccagtggagaagctagtgacacggacgtttccaggacaacctggcattttattcaatggttcacgaaattctatgatgctaactacgatgggaacggagtatgatcctgtataggcacgacaatgggccagatgcaattcctcctcctgaccctggtgaacagatcttcaactgccaaaaaaagtctcaccatgcaactcgcccag

SEQ ID NO: 570841 - DNA, 133 bp, Homo sapiens
agatgacttgaggaaggatcccctctatcacagttttaggaccccagaatgatttccatgattgtgatccagttcatatccactacccaagtaactctgggtgcacatgaagatggtgtggctgctctgtagt

SEQ ID NO: 570842 - DNA, 429 bp, Homo sapiens
ctgtgcagcgtactcacagagcacgtcatatcactgcaccagtaggccttgacataggctgagtacatacatagttggtcgctcagtggcagcagcgagacttctgagtagccagtcacagagtgcagtctgtacgctgtacccggggtcagtaggcagggcgcacataggctatcaagtctaaccggcgatccgggttacctcagagcaagaggcgtacaccggctgtcagagcgcgagcttccagccgcagcagggcgcgatcttccactgagcgtctgctgtctcgccgccctggacagacagcaggatcagtaccatccagacgcgatcaacatgaacctgttccatgtccaggcgcaagcagcagccacagacctatgctatctcggttgttgacgacgagcgttgactctcactctggacaag

SEQ ID NO: 570843 - DNA, 445 bp, Homo sapiens
gtggtgccggaggaccaccctcccaagtactcaggtctcttaagctggagccttcaatcaaggacctcctctactatggttcccctctatcctcaaccgggacacagaccatctcctcacccttccctatcgtccggtgattctccccttcagtcagaattctgttcatatcaaaagataaagcttttctgggtaaaactcacatcgggtgcatctcaacaagttatccagatagctggaaacaaggcaactttctatgtacacgggtaactctaagccaggtacgttctcttccttattactttccaccatagtgaaataaaatcgtaactaatgcatttgtctatagttctttacttcatgaaaaatattaaatccttctaatgtctgatacagactgagaccacaatgggctaactgacacctatctggatcacggtgggct

SEQ ID NO: 570844 - DNA, 1318 bp, Homo sapiens
ccaagatcacagactgagcagacccagcctctgtcgctgtccctgaagcccgagccccttggcgctaccatgtccgatgatgccatccgccaccgcgacctccatgcgtcgctgaggacatccacaagggctcacgcccatctgtcaccaacgtgggaccatggaacgtgcacgcccaagcacggcattttgcagccatgccgacaccctcctcatcaatggcacagccgtcgacattcttccttacattcccacagactccctggccgggaccacagacaccagacagctgtcgcatcgatagccaagtctttagaatagcatttacgcgtcggtgcaaccgccgactgccttaggctcactcggtaaacgatatccgactattgcgttcaacttatgacgccccacaccgcacacaacctcgcaaacgggtatatggaagaagataaatcatctataagtaatgaggatgaggcagtggtgggggtcaagattaaggttggacgtggtgtattacggcgggtacgatgggggtcgaaatagtgtgggagccggaaaacggtaaagttgacaaaatgtaacatacgttttaagacagtattggtaggactgagaaggaaaggaaggcgtcagagtgacgtgcttacggcgaaagaaagtggagaacatcgaaggaggctggtctacgagaggttatatggggaggcaggttatacacaccaagtattaatctagtaattgcaagttaagctggttaagtgtaaggtaaccgggactaggcgtaaggtgatcagagaagggcgttgaaatacaagaaggacgccgccccgcaacgcccacacgggcacaatgacaggacccgccaccccctccccacaacggggcagtcggggaactgaccactgacgagcgcaaatcaacactacgcagcgctagccggaaccccagcccaccgagcagcctcaaagggaaaccacaccgggcagcgggcccgcaggaaacgtgcagcgccggcacggcataacgacaacacaacagcgggccgcaacaccacacaagaggcaaaaacgagaaacacgacagatcacagaaacacgcggggcaacagcgcacagacacaggacccggagcagcacatgaggaagacaggccagaacgaccacgcacaaacagcgcagcgcaaaaagaatggataaaagttagacagcaagcacccagaagagacaagaagcgaacgcacccaacgaccgtccacacagcgcacaccagtagacaccgcggactaactcacacattcctctcatcctgcctcagaaag

SEQ ID NO: 570845 - DNA, 158 bp, Homo sapiens
cgactctacggatcctttcgattggcgggcacttatgcacgcttatcatcttaacaagctttgagtgcaagagatgaagagttcaaatctgagcaagatgttgatgttggataagagaattctctgctccccacactctaagttgcccgccaatcgaa

SEQ ID NO: 570846 - DNA, 323 bp, Homo sapiens
catgtgggcatacaggactagtgtgaagaatgaagtccgtcatggaatctgttcaattggaggtaaagtgatagtgagtcaagaaggttaaagagatagttcctacttgggatgggagtctgactaggctttttttcattcttcgtgggttggtcaaacatttatggagtatccgtggtacatcaggcacagacctcatctcaagggaaaaaaatggactaagataccatcccggctcccagggaagacagaagccctacccacggggtaatactgtgctccccacagcactatggcatcctgacaggggggctggtctcccg

SEQ ID NO: 570847 - DNA, 493 bp, Homo sapiens
  misc_feature (5)..(5): n is a, c, g, or t
  misc_feature (165)..(166): n is a, c, g, or t
  misc_feature (211)..(211): n is a, c, g, or t
  misc_feature (323)..(325): n is a, c, g, or t
  misc_feature (331)..(331): n is a, c, g, or t
  misc_feature (343)..(343): n is a, c, g, or t
  misc_feature (380)..(380): n is a, c, g, or t
  misc_feature (402)..(402): n is a, c, g, or t
gaatnttgtgaacctgcttcctgatgaattctcccttgttcccccttggctctgcattatttcgttttcagtgtaatttgccaagccgcagttttctgtgctggctgtgctctagtcgcagctctgtgactgattccctcccgggtgctgagtcccctccccggnnaccatcctgcgtgaatatcctgaaattcatgggcttcctcggggncccgcccgcaggtggtgctgggtgggttccgccaccttctcctggaaggtgagccttttcctggccaagggaagctgccttaacctctgagagtctgcgcttggccttaagnnnacccanaaaacccaaaanagggacttgaaccgtgctgctgttggggagccaagancggccctttggaagccggcatncccaggggtccctgctggatcagagaaatagaaagcacccgaagacggttagtggcaattccttgacccggtttgcttccaaaaccccccc

SEQ ID NO: 570848 - DNA, 100 bp, Homo sapiens
cggtcggagaggatcccggaagatcactgacatagaactgaacgttgaacacttcaaaaacagaagaaagttaaaaaaaccaccaccagaattatcacca

SEQ ID NO: 570849 - DNA, 229 bp, Homo sapiens
gtggccggccaacgctcggcctggagctgccgatagcccaggcgggcggtgttttccatcttgaagggaatgacgacgccctcctcgtcgacgggcaactcgatgctctggtccatcgacgtcttgccatcctccgactgccgtgtccggatatccgagaacagcacgttgcccagcttgagcatgttgtcgttgccgatcacgccgaaatagcggaccagcggcttgg

SEQ ID NO: 570850 - DNA, 306 bp, Homo sapiens
gactgaactagaggatccatctcgtgacggcgattatacagttgtgataatgcaggtaagtgatcaggatagtgcctgtcacctggtaagccttcggtaaactttagttattcccagtggtatctactgaatgaagtgaaccttgagtagatgtagaatatatttatgacttagtttaacaaaaattagccaagtaaggccaagacagagaaagattaaaatgttcaagttcatatctttcaaacacagtaatatgtgattagctatgcaggcagatacatcccacataatcgccggtcacgagat

SEQ ID NO: 570851 - DNA, 168 bp, Homo sapiens
gggggggggccccccccccccccccccctttttttttttaaaggggggttcccccttgggttcccccttggccccggcttttgggggtcccccgggttttcccccccggggttttttttttttttttttccccaatttttttgtttttttttgcccccccggggggga

SEQ ID NO: 570852 - DNA, 220 bp, Homo sapiens
aagaaaacacctgtccatccactgactcttctacattgatgttcgaaattgctgctggtaccaccacctccttaagaggcttccctgattccaatgccatccatcctggcatcctggccctccgacaggctgccgtaagtagcgatctcctgctccagccgtgtctttatgtcacgcagcatcttgtaccccatagttcagcgtctgacggggattctct

SEQ ID NO: 570853 - DNA, 181 bp, Homo sapiens
  misc_feature (16)..(16): n is a, c, g, or t
ctctgaatatggtacngctttagtgatgtctgctttattcttaaaatgcttatttctttggctagatgtaaagatttggtgtaaacaacaagtggttttaacatagtaaattatgaatgaatgcctttagatttacccgtgtttgtcttattattaactctgttttcattttatctcttca

SEQ ID NO: 570854 - DNA, 393 bp, Homo sapiens
cgggctgctgggggagcactgtgagtggtggctgctgcgggtatgtggtgacccccttggtcgttactgtgtgcttcgcacggaccaagagaggattgtcttgttcagccctggaacatgcacgctgcgctgcgggccgtgacctgtagccgtggccaggccgacagcatcctggacccccagtatgtccacgggctctgggggtccctgagcttggcagcccaggttgaaggccgtgttggcggccaccgtcctgtcttcgggctcctccaggaggttttgcaagccctccagcccaacatagcctggcccgggacacgacggtctgacgtcccagatcacccattcactggtactgtcccttgccgcaccccccgggtaacccgctcaaat

SEQ ID NO: 570855 - DNA, 273 bp, Homo sapiens
atcctcactcgatatcagtgcatatatattattagatgccactacagcatgcgataactgtcatcacaacttgtacagaagccgtatctttaaaatgtgttgttttcacaagtaattcacgtatagcattatatcatctggtacttgagtcagagacgacatatagattcttcagctttgaagcatatagtaacatcattgtctagtcaggcagaggaaagaaattcagaagcactttctttttcttctgtcagttcctttgcagaaagatcc

SEQ ID NO: 570856 - DNA, 105 bp, Homo sapiens
tcgaattcaagcttctaacgatgacggggacatgctaaggtgggttgggcttggaccgatgtccccatatgtacagaactgaataaagtgggtctctgacaaaaa

SEQ ID NO: 570857 - DNA, 248 bp, Homo sapiens
tcaaagaggtaaaagcttaaaaataaaaagctaagttgttaaaaaaaaatcactgttcaaatagtttatgctgtacctacttccaaaattattttgaacgttagatgagatgaggaaaagacttatgctgaaaggatgagaatagtttatgctcagcataaactattacagcataaactattacagcataaactatcacagcataaactattacagcataaactattacagcataaactattacagca

SEQ ID NO: 570858 - DNA, 85 bp, Homo sapiens
  misc_feature (63)..(63): n is a, c, g, or t
  misc_feature (70)..(70): n is a, c, g, or t
  misc_feature (75)..(76): n is a, c, g, or t
tttattccatagaaaggaggaaaatatttattccaaaagatggcagaaagaagaaattcatcntgaaagnatagnntggtgcgat

SEQ ID NO: 570859 - DNA, 151 bp, Homo sapiens
ggctgctctagacggtctcgagagggtgggaccacggggagtcatgatcccccaggagctctgtgaagaacatctgccaggagtcaagaactactttgacttctgacctcgagtgtgatgatcgtggaccagtgctgtgtgagacctacgg

SEQ ID NO: 570860 - DNA, 207 bp, Homo sapiens
agatgccttaaaagtgcactcttctatatctcctctctctatacacaacaataaaattggaaatcaagataaagaaaatctttcgaaaccgtacaattgcatggatattaaacaacctgctcctgaaatgactatttggggtgaataactgaaattacaggcagacaatcaatgaagttctctagaaactaatagagaacaacagat

SEQ ID NO: 570861 - DNA, 164 bp, Homo sapiens
ggtgttgcaggaattacagcccaatcatctacaatcaaccaacaagtcattattaccctcactgtcaacccaacacatggcattctcataagtgaaaggttaaaaaaatgtaaaagtgaactcgtgcaaatcttaccccgccacaaccgtgggtacctgagctc

SEQ ID NO: 570862 - DNA, 183 bp, Homo sapiens
attcgcggccgcgtcgactctaaatttttttttgttcctgagacagggtctacagggacttgctctgtcgcccaggctggagtgcaggggcacaattatagctcactgcaacctccaacttctaggctcaagcaatccaactgctttagcctcccgagttataaatgtcattttaaagttgtt

SEQ ID NO: 570863 - DNA, 1367 bp, Homo sapiens
  misc_feature (108)..(108): n is a, c, g, or t
  misc_feature (1367)..(1367): n is a, c, g, or t
ctggtatcaaaggagaaaaaggaaatccaggcgttggaacccaaggtccaagaggcccccctggaccagcaggaccttcaggggagagtcggcctggcagccctgggncccctggctctcctggaccaagaggcccaccaggtcatctgggggttcctggaccccaaggtccttctggccagcctggatattgtgacccctcatcatgttctgcctatggtgtgagagctccccatccagatcagccagagttcacccctgtccaagatgagctggaagccatggaactgtggggccctggagtctgatagcctcaggagaaatttgaagaccaactgcaagaactcttaaggaatcttgtttgagaaaatgttgttatgtggtttgtatgctacttttggggggcagggctcatttcagcagcctaaatctcctccttggataatgttaatattattattattattaacaaaaaatatatatttttaaaaagttcccttaatctatgacatggtagcaatgatttccctttggtgtcttaatggcatgtcagataatttgtttttccagagaagagagctcaaagaggaattgggaaaaataaattgaactctggaatcttctctctcaagtcctaaaatgaacaaacagatatgattgtgtttgagggaaatatgtccctagcaggaaaagaattcaaagaggttcaaagaatatgtcacttactcctacttgctataggaataaccttgctgataagaaaaaaagggacaatattggagaaactacctcttgtttaattgatctgtccaactctgagatcacttggtaactggtttcatgtgtatccaaaaatcagcatttggatttaagctttctgaatttggtagtttaagaaacagatttagtttttcagtggttttaactcatgtgaaataatgattttccaccagctctgatgcaaagagatataattttaatgaacgatttatccagcagtttgttccaggggttgcctctccttatctacggggattactttgtacatgcagataagttttcgcaaacctatttccattttcttttgtaagcaaataaaactttaaaacaaaaaaaaaaaaaaaccaaaaaaaaaaacacttggtgggccgacatgggcccctgaaaaaggtttaaaacccatcgtgggggcggggccccaatgggagcgacacgggccaaaggggggcccaaagagaaccggggccagaacaagcggcggggtctccccaataaaaaacgcggggggacccaggcgtttggacaatcccaagggagccgaggggccaacgggggccacacgggggccacgggagcaaataatacgn

SEQ ID NO: 570864 - DNA, 100 bp, Homo sapiens
taaattagcttccggcactgggcaaaccatttaaccttgcaagccttacatatcttcgcctctaaaatggagatgtaatataataattcctgcccgtacc

SEQ ID NO: 570865 - DNA, 359 bp, Homo sapiens
  misc_feature (359)..(359): n is a, c, g, or t
ggcaacccctggaacaaactgctgggattactttgtacatgcagataagttttcgcaaacctatttccattttcttttgtaagcaaataaaactttaaaacaaaaaaaaaaaaaaaccaaaaaaaaaaacacttggtgggccgacatgggcccctgaaaaaggtttaaaacccatcgtgggggcggggccccaatgggagcgacacgggccaaaggggggcccaaagagaaccggggccagaacaagcggcggggtctccccaataaaaaacgcggggggacccaggcgtttggacaatcccaagggagccgaggggccaacgggggccacacgggggccacgggagcaaataatacgn

SEQ ID NO: 570866 - DNA, 2367 bp, Homo sapiens
aagatacagtgactttgatttgcttaacaacagcttacagattgcaggcctaagtctacctcttcctcccaaaaaattgatggtaacatggatcgtgaattcatagctgaaaggcagaaaggtcttcagaactatctcaacgtgatcacaacaaatcatatcttgtctaattgtgagctggttaagaagtttttagatccaaacaactattccgcaaactatactgagattgccttgcaacaggtttccatgttcttccgatcagaaccaaagtgggaggtggtggaacctttgaaagacataggttggagaataaggaagaaatatttcttgatgaagattaaaaatcagccaaaggaacggctagtgttaagctgggctgaccttggcccagacaagtatttgtcagataaagattttcagtgtctaatcaaacttctgccttcttgtttgcacccttacatctatcgggttacctttgccacagctaatgaatcctcagcgttgctaattaggatgtttaacgaaaagggaacattgaaggatctgatctacaaggcaaaaccaaaagacccatttctaaagaagtactgcaaccctaagaagattcagggcctggaactccagcaaataaaaacatatggacggcaaatattagaggtactgaagtttcttcatgacaagggattcccttatgggcatcttcacgcctccaatgtgatgctcgatggggacacttgccggctgctggaccttgagaattccttattgggcctgccttccttctaccgatcttatttttcacaattcaggaaaatcaatacattggaaagtgtggatgtccactgctttggccacttactgtatgaaatgacttatggacgaccgccagactcggtgcctgtggactccttccctcctgccccgtccatggctgtggtggccgtgttggagtctacgctgtcttgtgaagcctgtaaaaatggcatgcctaccatctcccggctcttacagatgccattattcagcgatgttttactaaccacttctgaaaaaccacagtttaagatccctacaaagttaaaagaggcattgagaattgccaaagaatgtatagagaagagactaattgaggaacagaaacagattcaccagcatcgaagactgacaagagctcagtcccaccatggatctgaggaggaaagaaaaaaaagaaagattttagctcgaaagaagtcaaaacgatctgctcttgaaaatagtgaagagcattcagcgaagtacagcaactccaataattcagcaggatctggggccagctcacctctcacgtccccgtcatcgccaactccaccctctacatcaggttagtgatggagtaaagtgacatgccaccttcctgtccgccaacaggaggagcgggctgtgcctcttcctgccttggccaacaatttcaggggttagatagcagcagctttctcaagagagatcagtgggagtgcaaattagcagtgtcatttgggagagctgaggggctagatttccaagctcggctttcacagggaatggaccggtttcagggccactagccacccccgggctccagcttgctgtctttgctgaaaagcttcatgcagagcttctcagattggagcctgtcttggtacatgcttagctgaacaacacaaatgcgccgtggcccaggggtcccgtcctgccaggcctctctcctcagggagcccgtccatagggtcagttttgtcacagagcacaactggtaagatgcctaggtggaggagtgaaagagtcactgcgtttctgattttctggcaacgatttgactctgttttgctctgtaatgtatttaattatctgaatatttttctgttattagcctttgcttcacttttgtaaattagatactagttttgattgaaaaaaaaaaaaaaaaaaaaaaaatcaacaggaagcacatgattgataacatcttgggacagaccaaaaccactgactgatggcaaggctcggcgattctgatttcccttctcaaatctggtcaactccaagagtcttgagaaactgctaaaattttgcctcctggagtcaagtcttacaaatgtaattttgcaaacctttgaggtgaactattccacttgcttggacataggcatcttattcacttgaccctgttacacccagaaccctccgaccagtagattatttgaaacactgggaattttatggctagggacagtcaatagacttttattccaggggcgactgccccctctaaagtaaaggtcatacaggaaaactgcctatttatagcctaaagtaaaggctgagaacttcattttccatggggtc

SEQ ID NO: 570867 - DNA, 2183 bp, Homo sapiens
  misc_feature (108)..(108): n is a, c, g, or t
  misc_feature (828)..(828): n is a, c, g, or t
  misc_feature (2183)..(2183): n is a, c, g, or t
ctggtatcaaaggagaaaaaggaaatccaggcgttggaacccaaggtccaagaggcccccctggaccagcaggaccttcaggggagagtcggcctggcagccctgggncccctggctctcctggaccaagaggcccaccaggtcatctgggggttcctggaccccaaggtccttctggccagcctggatattgtgacccctcatcatgttctgcctatggtgtgagagatctgatcccctacaatgattaccagtactgaagtggaaatcctccactctggttccattggccccagacatttagctgtggatacagaactgtcctgtcaaccaccaccaccaccaagcccctgcccctaacaatggacactctgcttccctgcttcttctgcatccctgccttcccactttcaaacctcttgcccactctgctccaaacatgatggagtgataacatcggaacttaaccaaatcatatatgtctattttaatagacactgactgctccatgtcagcctggatagaggtatatgatcgtgtgccaagaatttatcccagactcccctgtgtgacagcttcataataaagttacttaactgtgcctcttcctccttcctctccccacacaggatggatgggcatctttctccttgaccaccctactctcccttcctcccctgatcacctcccctccctgctctcccctggtgatggacttctaacatgagatttttttaaaaaatttctatttcttttataattttgctgagttttcagggtttcttctgtaaataaaacataatatttaaatggttggttatgattctngttttctaacaatttctgtaatgtatctttcccttcgtctatttactaactgtctgaaaccttatggggaaggtacaaggggcgtggtggattaagacatccactgctttttacccagcaggatatctctgtgtctctaaggacccaggtgaggggagaatatcaatttatgattcctgggtgcagcaagtccccacccccacttttcctctttagctccccatccagatcagccagagttcacccctgtccaagatgagctggaagccatggaactgtggggccctggagtctgatagcctcaggagaaatttgaagaccaactgcaagaactcttaaggaatcttgtttgagaaaatgttgttatgtggtttgtatgctacttttggggggcagggctcatttcagcagcctaaatctcctccttggataatgttaatattattattattattaacaaaaaatatatatttttaaaaagttcccttaatctatgacatggtagcaatgatttccctttggtgtcttaatggcatgtcagataatttgtttttccagagaagagagctcaaagaggaattgggaaaaataaattgaactctggaatcttctctctcaagtcctaaaatgaacaaacagatatgattgtgtttgagggaaatatgtccctagcaggaaaagaattcaaagaggttcaaagaatatgtcacttactcctacttgctataggaataaccttgctgataagaaaaaaagggacaatattggagaaactacctcttgtttaattgatctgtccaactctgagatcacttggtaactggtttcatgtgtatccaaaaatcagcatttggatttaagctttctgaatttggtagtttaagaaacagatttagtttttcagtggttttaactcatgtgaaataatgattttccaccagctctgatgcaaagagatataattttaatgaacgatttatccagcagtttgttccaggggttgcctctccttatctacggggattactttgtacatgcagataagttttcgcaaacctatttccattttcttttgtaagcaaataaaactttaaaacaaaaaaaaaaaaaaaccaaaaaaaaaaacacttggtgggccgacatgggcccctgaaaaaggtttaaaacccatcgtgggggcggggccccaatgggagcgacacgggccaaaggggggcccaaagagaaccggggccagaacaagcggcggggtctccccaataaaaaacgcggggggacccaggcgtttggacaatcccaagggagccgaggggccaacgggggccacacgggggccacgggagcaaataatacgn

SEQ ID NO: 570868 - DNA, 171 bp, Homo sapiens
actcgcagcagttcatttcgaacgcctgtcaggatctgttgcaggacctcctgcagttccgggccgttgccggtatgggggggctccagcagcgcatgccaggggtgcgcgccggtcagcggattcttgcggccgggcacatgggtcatgacgatgtccagctgattgctg

SEQ ID NO: 570869 - DNA, 904 bp, Homo sapiens
  misc_feature (88)..(88): n is a, c, g, or t
  misc_feature (94)..(94): n is a, c, g, or t
  misc_feature (99)..(99): n is a, c, g, or t
  misc_feature (152)..(152): n is a, c, g, or t
  misc_feature (189)..(189): n is a, c, g, or t
  misc_feature (193)..(194): n is a, c, g, or t
  misc_feature (202)..(202): n is a, c, g, or t
  misc_feature (234)..(234): n is a, c, g, or t
  misc_feature (236)..(236): n is a, c, g, or t
  misc_feature (238)..(238): n is a, c, g, or t
  misc_feature (282)..(282): n is a, c, g, or t
  misc_feature (293)..(293): n is a, c, g, or t
  misc_feature (313)..(313): n is a, c, g, or t
  misc_feature (315)..(315): n is a, c, g, or t
  misc_feature (326)..(326): n is a, c, g, or t
  misc_feature (355)..(355): n is a, c, g, or t
  misc_feature (397)..(397): n is a, c, g, or t
  misc_feature (419)..(419): n is a, c, g, or t
  misc_feature (435)..(435): n is a, c, g, or t
  misc_feature (444)..(444): n is a, c, g, or t
  misc_feature (453)..(454): n is a, c, g, or t
  misc_feature (466)..(466): n is a, c, g, or t
  misc_feature (563)..(563): n is a, c, g, or t
  misc_feature (567)..(567): n is a, c, g, or t
  misc_feature (569)..(569): n is a, c, g, or t
  misc_feature (641)..(641): n is a, c, g, or t
  misc_feature (811)..(811): n is a, c, g, or t
  misc_feature (872)..(872): n is a, c, g, or t
agaaagttgaagaattcatatattttccagccccaaaaaggccacacagaatcacaaacattcaacgtgttccacgataatgatatgntatganaagcncttccttataaactttattacgaagcaaataaaataatacattcataatatangaacaaagaaatcatacattaagaatcctgtagtaantaanncttaagancaaagaactgcagaatctctaatataaaaaanangncattttcaatgtgtccattttcctaagacatgcgtgtatgacangcctccccgtntctcatactatatatacttncnttaaagacggnaattatttctcatttcattttccaaatgngaaacattgcctaaattcatgacatccctagggttattcttngtctcagcttccacacagagangtctgagatagggggntcttaagtntcagagttnnggggtataggcnttcacattcaaaagtgcagagaatcccaacattaacaaacaatggttccacaaaaatcaaaattacaacttagacatctctaaaataataggaatgncacngntagagtttacaaactacagtgataactgaattgtaacacatgcagagattaaagaatatttcaagtgcttcnaaatacctattagaaaaatgtgtatctatttgacaatattatgttctctggagaaagatatataaggattacagcagagacttcagtattgacaaagtaaaatttttaccttcaagttgcattctaaaattactatgaagtctcaacttcactggaattaatgaaaatanaatatattccacgacagattttttgtggcacaaatgaaaactttaaaaaatacatgaaacnaaaacaagatgagagattcctgatacatataa

SEQ ID NO: 570870 - DNA, 2044 bp, Homo sapiens
  misc_feature (108)..(108): n is a, c, g, or t
  misc_feature (828)..(828): n is a, c, g, or t
  misc_feature (2044)..(2044): n is a, c, g, or t
ctggtatcaaaggagaaaaaggaaatccaggcgttggaacccaaggtccaagaggcccccctggaccagcaggaccttcaggggagagtcggcctggcagccctgggncccctggctctcctggaccaagaggcccaccaggtcatctgggggttcctggaccccaaggtccttctggccagcctggatattgtgacccctcatcatgttctgcctatggtgtgagagatctgatcccctacaatgattaccagtactgaagtggaaatcctccactctggttccattggccccagacatttagctgtggatacagaactgtcctgtcaaccaccaccaccaccaagcccctgcccctaacaatggacactctgcttccctgcttcttctgcatccctgccttcccactttcaaacctcttgcccactctgctccaaacatgatggagtgataacatcggaacttaaccaaatcatatatgtctattttaatagacactgactgctccatgtcagcctggatagaggtatatgatcgtgtgccaagaatttatcccagactcccctgtgtgacagcttcataataaagttacttaactgtgcctcttcctccttcctctccccacacaggatggatgggcatctttctccttgaccaccctactctcccttcctcccctgatcacctcccctccctgctctcccctggtgatggacttctaacatgagatttttttaaaaaatttctatttcttttataattttgctgagttttcagggtttcttctgtaaataaaacataatatttaaatggttggttatgattctngttttctaacaatttctgtaatgtatctttcccttcgtctatttactaactgtctgaaaccttatggggaaggtacaaggggcgtggtggattaagacatccactgctttttacccagcaggatatctctgtgtctctaaggacccaggtgaggggagaatatcaatttaaatttgaagaccaactgcaagaactcttaaggaatcttgtttgagaaaatgttgttatgtggtttgtatgctacttttggggggcagggctcatttcagcagcctaaatctcctccttggataatgttaatattattattattattaacaaaaaatatatatttttaaaaagttcccttaatctatgacatggtagcaatgatttccctttggtgtcttaatggcatgtcagataatttgtttttccagagaagagagctcaaagaggaattgggaaaaataaattgaactctggaatcttctctctcaagtcctaaaatgaacaaacagatatgattgtgtttgagggaaatatgtccctagcaggaaaagaattcaaagaggttcaaagaatatgtcacttactcctacttgctataggaataaccttgctgataagaaaaaaagggacaatattggagaaactacctcttgtttaattgatctgtccaactctgagatcacttggtaactggtttcatgtgtatccaaaaatcagcatttggatttaagctttctgaatttggtagtttaagaaacagatttagtttttcagtggttttaactcatgtgaaataatgattttccaccagctctgatgcaaagagatataattttaatgaacgatttatccagcagtttgttccaggggttgcctctccttatctacggggattactttgtacatgcagataagttttcgcaaacctatttccattttcttttgtaagcaaataaaactttaaaacaaaaaaaaaaaaaaaccaaaaaaaaaaacacttggtgggccgacatgggcccctgaaaaaggtttaaaacccatcgtgggggcggggccccaatgggagcgacacgggccaaaggggggcccaaagagaaccggggccagaacaagcggcggggtctccccaataaaaaacgcggggggacccaggcgtttggacaatcccaagggagccgaggggccaacgggggccacacgggggccacgggagcaaataatacgn

SEQ ID NO: 570871 - DNA, 2091 bp, Homo sapiens
aagatacagtgactttgatttgcttaacaacagcttacagattgcaggcctaagtctacctcttcctcccaaaaaattgatggtaacatggatcgtgaattcatagctgaaaggcagaaaggtcttcagaactatctcaacgtgatcacaacaaatcatatcttgtctaattgtgagctggttaagaagtttttagatccaaacaactattccgcaaactatactgagattgccttgcaacaggtttccatgttcttccgatcagaaccaaagtgggaggtggtggaacctttgaaagacataggttggagaataaggaagaaatatttcttgatgaagattaaaaatcagccaaaggaacggctagtgttaagctgggctgaccttggcccagacaagtatttgtcagataaagattttcagtgtctaatcaaacttctgccttcttgtttgcacccttacatctatcgggttacctttgccacagctaatgaatcctcagcgttgctaattaggatgtttaacgaaaagggaacattgaaggatctgatctacaaggcaaaaccaaaagacccatttctaaagaagtactgcaaccctaagaagattcagggcctggaactccagcaaataaaaacatatggacggcaaatattagaggtactgaagtttcttcatgacaagggattcccttatgggcatcttcacgcctccaatgtgatgctcgatggggacacttgccggctgctggaccttgagaattccttattgggcctgccttccttctaccgatcttatttttcacaattcaggaaaatcaatacattggaaagtgtggatgtccactgctttggccacttactgtatgaaatgacttatggacgaccgccagactcggtgcctgtggactccttccctcctgccccgtccatggctgtggtggccgtgttggagtctacgctgtcttgtgaagcctgtaaaaatggcatgcctaccatctcccggctcttacagatgccattattcagcgatgttttactaaccacttctgaaaaaccacagtttaagatccctacaaagttaaaagaggcattgagaattgccaaagaatgtatagagaagagactaattgaggaacagaaacagattcaccagcatcgaagactgacaagagctcagtcccaccatggatctgaggaggaaagaaaaaaaagaaagattttagctcgaaagaagtcaaaacgatctgctcttgaaaatagtgaagagcattcagcgaagtacagcaactccaataattcagcaggatctggggccagctcacctctcacgtccccgtcatcgccaactccaccctctacatcaggttagtgatggagtaaagtgacatgccaccttcctgtccgccaacaggaggagcgggctgtgcctcttcctgccttggccaacaatttcaggggttagatagcagcagctttctcaagagagatcagtgggagtgcaaattagcagtgtcatttgggagagctgaggggctagatttccaagctcggctttcacagggaatggaccggtttcagggccactagccacccccgggctccagcttgctgtctttgctgaaaagcttcatgcagagcttctcagattggagcctgtcttggtacatgcttagctgaacaacacaaatgcgccgtggcccaggggtcccgtcctgccaggcctctctcctcagggagcccgtccatagggtcagttttgtcacagagcacaactggtaagatgcctaggtggaggagtgaaagagtcactgcgtttctgattttctggcaacgatttgactctgttttgctctgtaatgtatttaattatctgaatatttttctgttattagcctttgcttcacttttgtaaattagatactagttttgattgaaaaatgtaaaaagaatttatcttggagactgcttataaaaataatccccaattttgttgagtagccccataatactatctttcttttatttttgaaccaagatgtctctcctaaagtcttttgcaagcccaataaaaacaactgggacaccagta

SEQ ID NO: 570872 - DNA, 932 bp, Homo sapiens
ccggtgcccaggtgcagtcccgtccctgcagcaagtgaatgccctcctctttcgaacatgacagatgccgttgtgtccttcgccatggatattactgggaggtggaggggtggccgtctatcgtcccaagacagggggtagctgccatcgagcgggtcgaagcatgcaatggtgcaggtgcacagccactggcaagtgagactagatcactgctgtataagcgaaagtaacaaaggcatttataccatgtgcagtggctctggtagtcccgatggcatcagggagtacatgtcccttctgcgagcggtgatccatggcccacatgtcaatcgagattgagttcctccacgccaatggtcgttgagcttctgccgtatcgacagattaacttcaatgcatgaatcatttgcacggggctggtgtggacaaagcagtaaccacgagttgtaggctcgtatcttcgcacaggaaagtctggcatcgagtggggccgtggcgggcatcatccctgggttcgtgtaccctcttgattgtgccgtaacagtctaccggcggatgtggggtaaagctggagctgaaagggaattccgaggctcgttgaatgcctggtgagatctacgaatctgatgggataagggcggtagcaggttacgtgttgtgctggtatatcatttagcggggcgggtactcggtatttatgaacatgggaggcatggtcccggtgccggaacattcattgtcataggtgtgatgacagatgcatgcgtgcggttgatccatccttgactgtgcctcgtgtttaagggcagagaatagacgaggcgttgtgtgggaatgctaaaggagttaagggggctctcaggggggagtgggagtaaaaaaaagagacgaggaataatacgaaggggggatggaacctcagggaaataggt

SEQ ID NO: 570873 - DNA, 1621 bp, Homo sapiens
aagatacagtgactttgatttgcttaacaacagcttacagattgcaggcctaagtctacctcttcctcccaaaaaattgatggtaacatggatcgtgaattcatagctgaaaggcagaaaggtcttcagaactatctcaacgtgatcacaacaaatcatatcttgtctaattgtgagctggttaagaagtttttagatccaaacaactattccgcaaactatactgagattgccttgcaacaggtttccatgttcttccgatcagaaccaaagtgggaggtggtggaacctttgaaagacataggttggagaataaggaagaaatatttcttgatgaagattaaaaatcagccaaaggaacggctagtgttaagctgggctgaccttggcccagacaagtatttgtcagataaagattttcagtgtctaatcaaacttctgccttcttgtttgcacccttacatctatcgggttacctttgccacagctaatgaatcctcagcgttgctaattaggatgtttaacgaaaagggaacattgaaggatctgatctacaaggcaaaaccaaaagacccatttctaaagaagtactgcaaccctaagaagattcagggcctggaactccagcaaataaaaacatatggacggcaaatattagaggtactgaagtttcttcatgacaagggattcccttatgggcatcttcacgcctccaatgtgatgctcgatggggacacttgccggctgctggaccttgagaattccttattgggcctgccttccttctaccgatcttatttttcacaattcaggaaaatcaatacattggaaagtgtggatgtccactgctttggccacttactgtatgaaatgacttatggacgaccgccagactcggtgcctgtggactccttccctcctgccccgtccatggctgtggtggccgtgttggagtctacgctgtcttgtgaagcctgtaaaaatggcatgcctaccatctcccggctcttacagatgccattattcagcgatgttttactaaccacttctgaaaaaccacagtttaagatccctacaaagttaaaagaggcattgagaattgccaaagaatgtatagagaagagactaattgaggaacagaaacagattcaccagcatcgaagactgacaagagctcagtcccaccatggatctgaggaggaaagaaaaaaaagaaagattttagctcgaaagaagtcaaaacgatctgctcttgaaaatagtgaagagcattcagcgaagtacagcaactccaataattcagcaggatctggggccagctcacctctcacgtccccgtcatcgccaactccaccctctacatcagtagagcatgcaccattttgaacgtgaattttcggtaaagtaaactatgctgatttctcagactttaaagatgctctgtttctgtgtgtgaaataggacccaaagtgtctcgattgctgaagtgatgaacaagtgggaaagcagatttgagactatttccttatctgaatatttaaatgaaatacagcatctttaaaaagcaaaaaaaaaatacgacgaaccatacatcagcaatgtcactacaatattcatacat

SEQ ID NO: 570874 - DNA, 273 bp, Homo sapiens
actccctccttcctgatgcagaatgcagccctagtcagtatagaatcggcctcatatgctgattacagatggtcatcttcaaagaagctgcttatagacttcatgaagcttcttaggaagtaaaactttctgacttatagacagcaaatgtcttccaagaagaatagctctgctcacataatagtgcagcatgagcatgctgcaactgctcattttaatcatctccaagtgtacacggttctgaaatatttaagtacattctcattttgagac

SEQ ID NO: 570875 - DNA, 2021 bp, Homo sapiens
  misc_feature (1686)..(1686): n is a, c, g, or t
aagatacagtgactttgatttgcttaacaacagcttacagattgcaggcctaagtctacctcttcctcccaaaaaattgatggtaacatggatcgtgaattcatagctgaaaggcagaaaggtcttcagaactatctcaacgtgatcacaacaaatcatatcttgtctaattgtgagctggttaagaagtttttagatccaaacaactattccgcaaactatactgagattgccttgcaacaggtttccatgttcttccgatcagaaccaaagtgggaggtggtggaacctttgaaagacataggttggagaataaggaagaaatatttcttgatgaagattaaaaatcagccaaaggaacggctagtgttaagctgggctgaccttggcccagacaagtatttgtcagataaagattttcagtgtctaatcaaacttctgccttcttgtttgcacccttacatctatcgggttacctttgccacagctaatgaatcctcagcgttgctaattaggatgtttaacgaaaagggaacattgaaggatctgatctacaaggcaaaaccaaaagacccatttctaaagaagtactgcaaccctaagaagattcagggcctggaactccagcaaataaaaacatatggacggcaaatattagaggtactgaagtttcttcatgacaagggattcccttatgggcatcttcacgcctccaatgtgatgctcgatggggacacttgccggctgctggaccttgagaattccttattgggcctgccttccttctaccgatcttatttttcacaattcaggaaaatcaatacattggaaagtgtggatgtccactgctttggccacttactgtatgaaatgacttatggacgaccgccagactcggtgcctgtggactccttccctcctgccccgtccatggctgtggtggccgtgttggagtctacgctgtcttgtgaagcctgtaaaaatggcatgcctaccatctcccggctcttacagatgccattattcagcgatgttttactaaccacttctgaaaaaccacagtttaagatccctacaaagttaaaagaggcattgagaattgccaaagaatgtatagagaagagactaattgaggaacagaaacagattcaccagcatcgaagactgacaagagctcagtcccaccatggatctgaggaggaaagaaaaaaaagaaagattttagctcgaaagaagtcaaaacgatctgctcttgaaaatagtgaagagcattcagcgaagtacagcaactccaataattcagcaggatctggggccagctcacctctcacgtccccgtcatcgccaactccaccctctacatcagtagagcatgcaccattttgaacgtgaattttcggtaaagtaaactatgctgatttctcagactttaaagatgctctgtttctgtgtgtgaaataggacccaaagtgtctcgattgctgaagtgatgaacaagtgggaaagcagatttgagactatttccttatctgaatatttaaatgaaatacagcatctttaaaaagcacccagtgacttcatctatattcatttcattttcatcatgaccttcaaaatcttcattttcactctgatttcagttttaaaatacagctctaaaacctgcaaatcaactgcatggcattntggtatattttaattttggaaaccataactctcaaagtgctgggattacaggcttgagccactgtgcccggccaggattgcaacttttggctggccagcccatgcttaggctgttcttccttgcagaactggaggtcggtcttctcctgggctcaagtgatcctcctgcctcagccttctgagaggctgggactataggcgtgcaccacacatccagctaatttttaaattttgtggagacaggggtctcatcatgttgcccaggttggtatcaaactcctgggcacaagcacttcctctcacctcaagctccaaattgctgggattatagattg

SEQ ID NO: 570876 - DNA, 317 bp, Homo sapiens
  misc_feature (10)..(10): n is a, c, g, or t
  misc_feature (105)..(105): n is a, c, g, or t
  misc_feature (123)..(123): n is a, c, g, or t
  misc_feature (147)..(147): n is a, c, g, or t
  misc_feature (196)..(197): n is a, c, g, or t
  misc_feature (199)..(199): n is a, c, g, or t
  misc_feature (205)..(205): n is a, c, g, or t
  misc_feature (312)..(312): n is a, c, g, or t
taaaaaggantcaaatgaaaatttttgtcaaaatggcagaatgacagatgaaggcaatcatgagctagaagacagaacaatataaattacccaacctgaaagagnaaaaaaatattgacaagnaaaaagtaatatgaggatctatgnagacagtaacgaaggggatctaatacactaacataattaaaatcccagnngngagganaaagagattactagcagtagtttgataagtatgtgacaaagtagttttcagaggagtattgacagggatagtgatattatctattgacaaatgattcagtccaccangacat

SEQ ID NO: 570877 - DNA, 796 bp, Homo sapiens
  misc_feature (270)..(270): n is a, c, g, or t
agcggggtggcaggagtcatggctttatttggaaatgtcagcgtgctatcatggttctgtcatttgatgtgcacaggtatcagaggagcctgttaacctctctggtgccttgagctctctctgtggtcgccagtggaacagcagcatcagttgccttgacccgagggcactatcctctacagggcttattgatgaggacaagtgacagtaggaacgatgcataggagacctttaagtacctaagggttgctcaaccactgactacagtgnctggcaatgacttgtgcaatgcttttaccatagaatggttagtgcccactcttccccgtgatacccccggacgagttaaatcagaacctcagacagcaatatgccttgagatgccttgaaccatgcttgagaacggaaggacaaacacattattatcttggaaagaattgcataaggcttatgacttacaaaaaaaaattctttttgggaaacacaagcatttctttaaggatgaccggatgttgccgtatgtataatggcacaagcaggtgtgtctaagcaagtttctctgtttgcttgtcatagcagcatttggaaactcaaacatgctttcatttacataaatagtttatgaagctttgacaacaaattgtcaacaggacacgaaattataaatctgctaacatatgtacttacggggtattaacttattgaaaagtccctttccccaaaactcaactcctatggcccattatgaactccattttagcaagaacattcaagtgcctcagcatctgtatgatac

SEQ ID NO: 570878 - DNA, 371 bp, Homo sapiens
taaagagggcacacacacttttaccgtttataccaaaccaaacttacgaagttcaaaatccgagtaccaaaaaattcacgccaagtcaaagccaaaaccaaggtgtccagcaatttaagggaagccaaaaccagaacaagagtgcccgggcaggcgtgctgtgggtgatcaggccacgtttccactcacatggagtggggcaggatccaaagactagtcttaccaagtcaagccgagtcaaaaccacatcaaagagcgccaatacaggcgcaccacgggggatcaggccacgcttccactcacgtggagtggggcaagtcccaaagactagttgtaccaagtcaagccaagctaaaaccagaacagagagg

SEQ ID NO: 570879 - DNA, 1516 bp, Homo sapiens
  misc_feature (1282)..(1282): n is a, c, g, or t
  misc_feature (1367)..(1369): n is a, c, g, or t
aagatacagtgactttgatttgcttaacaacagcttacagattgcaggcctaagtctacctcttcctcccaaaaaattgatggtaacatggatcgtgaattcatagctgaaaggcagaaaggtcttcagaactatctcaacgtgatcacaacaaatcatatcttgtctaattgtgagctggttaagaagtttttagatccaaacaactattccgcaaactatactgagattgccttgcaacaggtttccatgttcttccgatcagaaccaaagtgggaggtggtggaacctttgaaagacataggttggagaataaggaagaaatatttcttgatgaagattaaaaatcagccaaaggaacggctagtgttaagctgggctgaccttggcccagacaagtatttgtcagataaagattttcagtgtctaatcaaacttctgccttcttgtttgcacccttacatctatcgggttacctttgccacagctaatgaatcctcagcgttgctaattaggatgtttaacgaaaagggaacattgaaggatctgatctacaaggcaaaaccaaaagacccatttctaaagaagtactgcaaccctaagaagattcagggcctggaactccagcaaataaaaacatatggacggcaaatattagaggtactgaagtttcttcatgacaagggattcccttatgggcatcttcacgcctccaatgtgatgctcgatggggacacttgccggctgctggaccttgagaattccttattgggcctgccttccttctaccgatcttatttttcacaattcaggaaaatcaatacattggaaagtgtggatgtccactgctttggccacttactgtatgaaatgacttatggacgaccgccagactcggtgcctgtggactccttccctcctgccccgtccatggctgtggtggccgtgttggagtctacgctgtcttgtgaagcctgtaaaaatggcatgcctaccatctcccggctcttacagatgccattattcagcgatgttttactaaccacttctgaaaaaccacagtttaagatccctacaaagttaaaagaggcattgagaattgccaaagaatgtatagagaagagactaattgaggaacagaaacagattcaccagcatcgaagactgacaagagctcagtcccaccatggatctgaggaggaaagaaaaaaaagaaagattttagctcgaaaggtaagcctgctgtctctctgcagtccctctatgagttcttgagtacatntgaagaaagttctaggttaatggtgcccatttaatgacagatgctgtgctatatctccttgaaagctaagactatttccagatgnnnggggtgcagttttttttttttttttttttttttttttttttttttttttttggggggggtttttttttttttttttttatgagagaaagagggggtggggggggggggcccgcggcgcccacacaccaaacgagggggacagggtgt

SEQ ID NO: 570880 - DNA, 904 bp, Homo sapiens
ggagtctacacagagaaggttctggaagccactaagctgctctccaacacagtcatgccacgttttactgagcaagtagaagcagccgtggaagccctcagctcggaccctgcccagcccatggatgagaatgagtttatcgatgcttcccgcctggtatatgatggcatccgggacatcaggaaagcagtgctgatgataaggacccctgaggagttggatgactctgcaactttgagaccatgaagattctttgatgtcagcaagcaggactgagcgtccacgatccagagatgacgatctagctgactagctggccatagtgcccgggcgactcatggctcacgcttccccaggagcaatagaagcgaagattgcggaccaggtggccagcttccaggaagaaacgagctacgctggactgctgaatgtgtccaaatggtgcacgagcagtggctatgacatcattagtgctggccaagcagatgtgcatgattatgcatggacggcatgacatgactttacccgaggctaaatggaccactcactaaagtacatcggatgtcatcagtgctgccatgaaaattgctgaggcgggatccaggatggacaagcttggccgcaccattgcagtaccattgccccgaactctggcttgcaagcgcgtgaccttgtcttggcctaccttgcaagcgcatcgccctctaaggtgcccacgtgctgtatacttctgtctgccagggctaggccgatgtgcagaatctcggcgtgggagctcgtgtgtctctggggttggcctgcgcctgtccctgattcgggctgcccgactttatgatgcgtggtgccaccggtgaaggctcccgttcctctccatccagtcccggttgggtccctcactccgtgt

SEQ ID NO: 570881 - DNA, 107 bp, Homo sapiens
gacgggggacttacgacacactgctacgggacactggactactgccactttcactctacacggacgctaacgcgacaacgcctcaccggacgaccacactgaccact

SEQ ID NO: 570882 - DNA, 870 bp, Homo sapiens
  misc_feature (12)..(14): n is a, c, g, or t
  misc_feature (38)..(38): n is a, c, g, or t
  misc_feature (41)..(41): n is a, c, g, or t
  misc_feature (72)..(72): n is a, c, g, or t
  misc_feature (93)..(93): n is a, c, g, or t
  misc_feature (109)..(109): n is a, c, g, or t
  misc_feature (117)..(117): n is a, c, g, or t
  misc_feature (125)..(125): n is a, c, g, or t
  misc_feature (132)..(132): n is a, c, g, or t
  misc_feature (142)..(142): n is a, c, g, or t
  misc_feature (145)..(145): n is a, c, g, or t
  misc_feature (153)..(153): n is a, c, g, or t
  misc_feature (160)..(160): n is a, c, g, or t
  misc_feature (203)..(203): n is a, c, g, or t
  misc_feature (214)..(214): n is a, c, g, or t
  misc_feature (246)..(246): n is a, c, g, or t
  misc_feature (270)..(270): n is a, c, g, or t
  misc_feature (288)..(288): n is a, c, g, or t
  misc_feature (293)..(293): n is a, c, g, or t
  misc_feature (349)..(349): n is a, c, g, or t
  misc_feature (359)..(359): n is a, c, g, or t
  misc_feature (721)..(721): n is a, c, g, or t
  misc_feature (863)..(863): n is a, c, g, or t
taagattcactnnntttcccatggctgggatataggcngcngctatagttgaacaagcagtctttaaaaacngctgtgaaacacaggccctcngggaaaacgaaaggcngcactatnaaattagnggttttngaaaaacccnacncccacccngggcagnggttgcctagttggtatagaatgttaagtttcaagaaagtttnccttggctttnggtcataagtcccttatttgatggctgtatanggaaacatggctgttcgtgacatnctttatgggcaaatttgngattncaaaaatgccctgccagtttaagggtacattgtagagccgaactttgagttactgngcaagatttntttttcaggctgtcatttgtaatatgttttgtgagaatccttgggattaaagttttggttacaaattgttaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaatataaaaaaaaaaaaaaaaaaaaaaaaaataaaaaataaaaaataaaaattaaaattataaaaaattaaaaataaaaataaattttaaaaatttttaaaatttaaaaaataaaaaaaatttaaaatataaataaatttaaaaattatttaaaaaaaattaaaattttaaaaatataatttatttttaaaaaaatttnaatatattaaattttaaaattaaaataaaaatttaaaaattttaaattaaaatttaaattataaaatttaataataaatttaattttaaattaattaaataaaattaattttttatttatatatattaaaatattaaaaatntattttt

SEQ ID NO: 570883 - DNA, 229 bp, Homo sapiens
ttgcactccagcctgggcaacgagagcgaaactccgtctcaaaaaaaaaaaaaaaaaaaaaagattactttctttttatcattgcttttttttttaaagctttcttgcagtcaggtgcagtgtctcatgcctgtaatcccaacactttgggaagctgaggtgggaggatcactcaaggctacaagttcaagaccaacctgggcaatgtagggagacctctgtctctaca

SEQ ID NO: 570884 - DNA, 664 bp, Homo sapiens
  misc_feature (615)..(615): n is a, c, g, or t
tgagttatctagaggatccgttgagaagctgggacagcctgtactggatggctccaagcggggtgagggtgccacgagaaacccaccttccatttgtcttcaagcagatggagcaggtggctcagttcctgagggcggctgaggactatggggtcatcaagactgacatgtcccagagtgttgacctctttgaaggcaaagacttggcagcagtgcagaggaccctgatggcttggggcagcttggcagtgaccaagattgatgggcactagcgtggagatcccaatgggttaatgaagaaagcgcaggagcgtaggagggaattcacagagagccagctgcgggagggaaagcatgtcgtgggccttcagatgggcagcaacagaggggcttcccaggccggcatgacaggctacggacgacctcggcagatcatcagtaagagcggagagggctagccctgagcccggccctcccccagttccttggctgcagccatcccgtttagccttgctcacccacacccgtgtggtaccttcagcccgggccaagcttggaggctctgtcactgagcaagggtaactgacctgggcagctcctccctgtgcccccagnctcaggccaatttcttaccggatagcttcattgccttggcccctctttc

SEQ ID NO: 570885 - DNA, 170 bp, Homo sapiens
atcataaagatatcacttcttctcattaatgggtgcagcacaccaacatggcacacgtatacatatgtaacaaacctgcacgttgtgcacatgtaccctaaaacttaaagtataataataataaaattaaaaaaaaaagaagtagaattactggataatatggtataaaa

SEQ ID NO: 570886 - DNA, 177 bp, Homo sapiens
tgtactctcgtgtcactgcgcctccgcctcctgggttcgggcgattctcctgtctcagcctccaagtagctgggattacaggcgcacgccatcacacccagctaatattttatatttttagtagagatggggttggcatcccacaaatttttccatatcatgttcctaaatttgggt

SEQ ID NO: 570887 - DNA, 173 bp, Homo sapiens
cgagacatgcctatcatgggctgatgcacctgctgattgttcgcgactagatgccccttgctggtttacggtgacccttgtgaactattccagccgtggagtcagatctgaattgtgcccatttggaagaggacctttctgagcctctctgacctgtttccgacgagagcaat

SEQ ID NO: 570888 - DNA, 400 bp, Homo sapiens
cataaatcacttccgccccctcacacaaaaccacaatacatcatacatccctgctctttcgctttcaagcccttccattgttcatctcacagtggttgtttgtgatgttatctagcttgctttagcatggtatttctgtgaattccaaattaatatgcttgacacaagccaattatacactgtaaggttaggctatccctctactcagaatagtgcagcagcacctgtgatgggctctaacatcctctctggcatctagtttcctgagtgttgttcactatgaataattaaaccctggcttctgtaatcacctgtgcccttcactgtgaatggattgaagctaacgtgtggctcatacaaattaaatattcacgtcatgttttcatgacaacgtcgacgc

SEQ ID NO: 570889 - DNA, 216 bp, Homo sapiens
cacgggtccaagtcctggtgcttgatggtccttgtcaactcctgggccgcctgccggccatcgtgtctaacacaggtactgctgggccgtcacgtcatgatcctactttgtcaacgcatcaacatttcgggcatcttctttttccaccattttttgtacctggctttcctccgcagacgggtgaacatcaccccttcccgaggatcctatcacttc

SEQ ID NO: 570890 - DNA, 730 bp, Homo sapiens
  misc_feature (194)..(194): n is a, c, g, or t
tcccggtgctacctgcaaaggggtccatacggcgttgtcctggatccccgtcgtaacttaaggggaaactttcacaatgtccggagcccttgatgtcctgcaaatgaaggaggaggatgtcctttaagttcccttggcagcaggaacccactttagggtggcaccaatctctggactctccagaagtggaacangtacattctataaagaaggaaaaggtgagtggcactctatatcataaactctcaagaaggaccgtgggagaaagcttcgtgcgtggacagctccgtggcaatggtgtgccattgtgaaaacccgtgcgtgagtgctcgaggtgtatatactccctccaggaaatacgtggccagaagggcgtggtgctgaaggttggcgtgcgtgccactgggaagccacctccaattggcgtggccgctttcactccgtgggaacctttcacctaaccgagaatccaggcaagcctcccgggagccagcggctcctgggggttcacggaccccgagggctgaccaccagcctctcaggggaggcatcttatgttaacctacctaccatggcgcggtgtaacccagattctcctctggcgctatgtggacttggcatcccatgcacaacagggaggctcctcaggggttacaggtggggacgcggccgggaagtctggcttggttgcccttcccggacccctgggggcttgccgctgactctagga

SEQ ID NO: 570891 - DNA, 486 bp, Homo sapiens
  misc_feature (262)..(262): n is a, c, g, or t
ttccattgatgagcttgctaccatttcctccgtcttctgtgcagatacctttgtacttcacaatgttctcatgatagatgttccttaagatctcgatttcctttttcagatcagctatgtggttccctccactctcaggcttcagatatttaacagccacctgctccccatggtattgtcccctttcggcggtcataccttgcagtagctcaactcttcccaatagtggccctcttcccaagatcacggcatcctcatttangtaatgcgcttttcaaatatgtgtggggctccacttcagattcgctggttttttttctcgaaacaatatctggattctgctcttcaagcttattaatgtctctcatgatggctcggaagaaaggcctctgattggggtcatagttctgccctggggtcatgaggtcagccagctccttacatgatggtgtcactggcctgcaccggctttcatagaatctctct

SEQ ID NO: 570892 - DNA, 909 bp, Homo sapiens
gagacactgagccgcggtgggatccccaccggtctgcgaggcctggagcgcaggaggcgcacgaggagccgggcagcgcgggcacttcaggggggccgcctcgccgccggcggtcgagagatccttgggggcacatctcgcgggttgcggtgacccgcccggggcattcgggggtcggggcgcaatttgccatgggggacttcttggatgcccggccctggcttctgtccgggctccagggtacccctgattggttggcgcttgtgcccttcgcggggcggcccggggcggccgaagggggtgaaggttcccgcccggaattcgggccggggccgggcgcactttttgcaccaacccccgtgtggcattggctcggcggccccggggtgtcgcggggccccaactttggagacgccgtttgggccccccgtggtcccccttaaggttgcacgccgggcggttaggttgcccctcctatttgtcctacggtggggcctggttcctttccgtcccagtgggtggctggtcccttggtacaaacgggctatccttcattgggaggtacccttgtgccctccacgcgtggggcccttctggcttttcgttgccccgagggaacttttgccccagcgggcgctcggggcaccttcgggggtgttctcgggacccgggcttgcgggccttttaacgatgctggctcgggaggcccgagcgtcttgtggtggcgtacctggggcgaggggcctcggcagtgttgttccccttttccttaagagatccggaaaccatgccctgacaggcggccgagataatgccgcggaggtggtggggggcccattggcgggattgtcccggggaggcctcccgtcgtcgagggtactgtccctaagtggcagagaggcctttgcc

SEQ ID NO: 570893 - DNA, 832 bp, Homo sapiens
tactgtggatatatacatgcctgtgtatttatcagcataattttcattaccaaaatgtacagctattattgccatggaaaaggttagtctcatttagaaaaatcgaaagtgcacagcacttaaagggaatatatgaggttttttttttttaaaaaaaaaacttttatttattattggtagtatatggtctggaaatggtggtcggcagttttttttctttaatggtggtcaaatctggaattattaattggtatacttttggtggctattgtttggggaacaaatctggttggattatatagtttatatggaatttttttggccctgatggttaggggggataggtctaaagcagcatatatctatatatcggtatgggggtatatagagatatatgtggggtgtgtatgtatatgtcacatatacatatttatgagtgtataattctaaatttctaaaaatcatttatgaatgttcatcaattgtgactattatagggcagtttccatttagtcaataaaagggtaatttttagttacttacctgtgaacattattcggtgttgaaagaatacctctttcttcacaaggttaaaggtgaattttatgaaaggataccttgggtggaacatagaattttaaccacatctggggtgtcggcaaaaaactggtgtggtgttttcaacaactctgttggtttaacaaaacattttttggggggtgttgggtagaatttcacgagtttaataaatagagaggcgtcttaaagagagaggaataattcgggttaaaaagaaaggcatggaacagggtgtgtgtgttttgaaaaaaag

SEQ ID NO: 570894 - DNA, 1270 bp, Homo sapiens
tatctcctgtaatttcttttattaaaaatactcgctgtacactaaaaaaatctgaaaacaggtattaaagatgaattacccacaacattgtgggtctcagtgcactttcagaacacctacacacacgtgggtgccttattgagggaaagttgtgtgtgcactctccaaactccacagaacacccagggtctccaaagttctcaaatcacaagaggtcaccccctcaaagaatattatttcacaagtgaaagttaatatacaccctaacacaaatatatttcaaacacagaggttcacaaaatatatatgtgcaatagtgcacccacagcgtttcactagtgtatattctcagagggtgttggtcctctttctctgtgtggcctcttattatctctgtgtccaccgaaacagggaaagtgtgtgtgtgcgaaacatgtttatatatatcctcttaaatatttggatctatatctctctcgggcgataatatttaaaaatatctctatttctatatatacatctataaacacaagagactcttttatagagacacacacgctcctctctttaaacagctgcgggagatctctcacgccctctatttgagagaaaacagcaggggggtcctccccgccacaaaaaaaaaccaccctcttaagagccagcagaaactcgtcggaaaagatattccctttgtgacaacaaacccacaatatccccaccaaattaatcaccaaacatcttatactatgacaaacaacatatcaccatatatatcacacacaccaaaaagctctttaaaaccaaacaaaattatattgcctaatttacaccccttggataaacacccaccaaaaacgctttctatagcgcggggggcgcgtggcaaccacatatatactctattataatcccccctgtggaaaaaaacaccatattactcagacgagcgtgcgcccatcatcatccctcttctataaatttgttgtccaaacaccacaaaagatatccccactgaggggagcctataacccataagggggaggccgatagaaaaacaccaacacactattaaggccaatttttcagggaattttgcgcaaaaaacaccatattcaccatggcaagaacatatgggagacgaacatatatcacacgttttgcccctttgtgcccacccacggggcgaaaaattatgcggcgcgggcgctcctataacacggaaaaatttggacgacaacactctcagaagtcccccagataattcgta

SEQ ID NO: 570895 - DNA, 861 bp, Homo sapiens
ggtcttgctcagtgtgcgagaactctggtggaagttgatagggtgaagccggaaagaggcaagttcctggtgcaaaggtggctctgcaggataatttatgcatggaggagctgtggtcgtaacttacgttctacaagatgggttttcgcgggaagccgcctagttcttttttagaactccatcaaattgaagctgtgcctaaccaggtctgcaaagtgatggatttaaggcaaatcattgtttgtaaggagattgcagaagaaactggaagaggaaggggaagagtttgtgaaggaaaatcgtgtggtattttgcgttcaaggtgattggatgggcctgggggtaaagaggccaactggggtggtggattgtgaagaagtggcatacaggatcagtgcttcctatgtcagataagaaggctgagtggacaatcacaatgggtgagtcagacttcctggcttttaatgactcggtaaaatgagtcctcagtcgggcttctttcgaggcaaatggaaaatcactggctacatgggtctcgctgtgaagttataaaatcttcaggttcagtgcaggcaaaggtaagctctgaagaaacttccttcggtactgtttgatagtcatgatgagattattttgatatttttcatacagtttattgtcaaggaaattaagactggaagtaaggagtggacataggtgggagagatgtgggtcgttactgggtgtggccaatccttgttttgctatggccgggggataagaaccggtggtacaaagggttggggaatgggaacggggttacaagaaagggaaggcggggaaaggttgaaacaggaagggagcaaaggtgaaatttgggaa

SEQ ID NO: 570896 - DNA, 713 bp, Homo sapiens
  misc_feature (211)..(211): n is a, c, g, or t
gcccccacctgggtctgtgccctgccccgcgctgggggccgagtccttgaatgtggcttcaggggctcctgtcctgggccagggcctgatgggcaccacgtgaggggcacttggtggacagggcggggctgacgtggcctcctctggggtcgcctgcttttgacccaaaggtcctgacggttgcgtccgggggaggggaaggaagggccgntgtcgccaaggttttctctcccagaacccacagtgggaaagcggtcttgccaggcgttgtccattgtcagtgtgctcgtgggctggtgactgcgtcttgggatcccaggccacgcgccagccaggctgtgggcagggcggggccagggaccccaaagagaggtcgcagtcagaaccctggaccgggtgggttgaggcctctctgacacccgtcttcctgggtagcagaagtgcatatcggcttgggttcgggtgttccttataacttgcagccaatttgctctacaagggtatctcacatccttccaacaccctttagaaggcccatccagtgccttcaagcaaggacctggcctgtctatcgtaaatgagggtcccacattcccttggcccgaccctgtatagccaccttacagcccagcccccaacatgcatgccaggggtactccgttactcccaatgtcctcttggtccccagatttatcctttttaaacaatattct

SEQ ID NO: 570897 - DNA, 126 bp, Homo sapiens
  misc_feature (96)..(96): n is a, c, g, or t
gatcatgtgttttcggaagaagaccacagagcacaacattctgaaattttttggttattgtaatgatgttgatcgggagttgagaaaatgcctgangaatgaggttcttgctctgtcacctaagct

SEQ ID NO: 570898 - DNA, 145 bp, Homo sapiens
ctagaggaccgtgacgcgcatctcctcttctctggagaagagctacgagctgctcgaaggtccagggcgacagtagcacagcttctccttgatgtcgcgcacgcatttccctgctcagccatgggtctcccatgggtacctgagc

SEQ ID NO: 570899 - DNA, 593 bp, Homo sapiens
atagtgtatcatcccatttatatgaaatgtccagaacaggcaaatccatagagacagaaaggaggttagtggttgccagaggctgagagatggaagaaaagtagagagtaactgctaatggtgtgaaatctctttttggagtgatgaaaatgttttaatttttttttttaatagagacagggtctcactatattgcccaggctggctcgttgaacttctaggctcaagtgagttcagcctcggcctcccaaagtgcttggattacagacatgagccaccatgcacagcttaaaatttatgatgctgatggttgcataactgtgaatttactaaaaaccactgaggcggggtttggtgactgacacctgtaatcctagcactttgggaggccgaggtgggaggatcacttgacaccaagagtttgaaaccagcctaggcaacatagcaagactccatctctacaaaaaatttacaacataaaattaaaaaccattaggccaggcatgatggctcatgcctgtaatcctagcactttgggatgccaatgcgggtggatcacctgaggttaagagttcgagaccaggctggccaca

SEQ ID NO: 570900 - DNA, 875 bp, Homo sapiens
gtatatataactgtatctacgtaaatacatgttttatacagaatggggatcacatgcatactgtattctcctttttcttattagatttcttttagcttaatatatttgggagatctattgggtgcttaggcccactggattactttgcccttccttttgggttggccacgatggagttataggggaatggactgtcagctggctttacttataagtctattctactctaatgttggaaattgtagacgatggttttccttactggttgttgtcccagataataatggctggtaagtgtgtgaccgtctttgtgtgaaatattattatgtcttagtacctctaggggtccataatactgtaggatgacattttactaccacggtgggaaatgggctagaattctcagaaactagtgtccttgtgcaaacattttcctaagaccgtggctaaatttgtcttcttacacaagggtttgccccgattaataatggtagctcccgaccagttcgtgtaagcagattgggttcacccccctgcttaattaaacggggacgttaactaaccgcatttcagggtttctagcaaggttgcttcgaacgaaggaataccaacagactgtgggatcaccgtacattgtactttttgttaaattatatcaagctgatttaaaagagtccatggacagtgggggggcccactgatcagtgtacttaccaccaggtgtctcattgggggccatttacgtttaaaaaaattaaattggtgacaaggtggccaaatttaagtatctccttatcaagattggttgagaccatataaaaggactcaatagtattacccctcttggaatttggaaggaagactcataatggggg

SEQ ID NO: 570901 - DNA, 321 bp, Homo sapiens
gaggatccccggccgcatagcttctcctgtggatccttactgctcacaaaaaagagccctccattcctaaatgtctcgaccagtccaggtgtgtcatattacaggaccagaggtggttggtagtgggtttcagtcatcatgtggcagtcaggtgcctgttgacatcagccccatctgccccaattagactatccacacacggctgctttatctcagattcacctgccaagggcctctctagtagcatgcagatcggcatcctcctaactaccagtgaagctgccaattcgccctgtcctctgtagatggcctataggcact

SEQ ID NO: 570902 - DNA, 428 bp, Homo sapiens
gcttgcacagtgggaactcccgttttataaaaccattagctcttctgagacatactcactatggacaagaacagcatgggaaaacccacccccatgattcaattacctcccatcaggtccctcccgtgacaggtggggattatgggagctataattcaagatgagatttgggtggggacagagccaaaccatatcaccacctaagttctctgtaaaaatagtttcagccaggcatgctggctcatgcctgtggtcccagcatgttggaaggccgaggcaagaggatcgcttgagctccggagttcaagaccagtctgggcaacatgacaagaccctgtctccacagaaaattaacattagccaggtgtggtggtgcgcatctgtagtcccagctactggggaggctgagatgagaaaatcgtttgaac

SEQ ID NO: 570903 - DNA, 112 bp, Homo sapiens
cacagaatgctccatggcgacacagcggacggtccatgcagcaagtcagctctgtcaggaaacaatggggaatctgtacaatttcaacacttcctccagaagtcaggacaga

SEQ ID NO: 570904 - DNA, 899 bp, Homo sapiens
  misc_feature (1)..(1): n is a, c, g, or t
ncagccgttttgtgccgcaggttctgctgcccaccgtgagtgtggtgccccaacgggtcacccgcgagtctttttttgggaaggtcaccttcttttgtgctccccccccgggggccccgccgcgtgattttttgcgggaagaaccactatatgttgggggggaaagaacaggcccttacgtggcccctattatagcgcacagttttgtggggtccccggcaggtgtattctttttgtcaaacagaccaccacacatcggggggcaggcaccacattctgtcacaaggcccccctctcggccgagcacactctaatggggtttgcttataaaattggtggggaacttatccccctgccctgtcgccacccacgaaggggccacacaggggtgggagcccccgggcggaacgattgtggttaaaaccaaacttgttgttacggacacagacagttgcgccccgcacaaagaggttgaaaataattctttgtgtttatgataagaacgcggtatgttgagcgcacgactggcgctcatagaggaatttatattatgggagaaataatgtaactcgctgttgatagagagtgttcaccaccgcgagcagataatatttcgttgaagtagatggctttctaagagctgtcccgcgagttgaaccagctcctctctgttaaatagggaggttgcactgcgggcaggtgttttcctccctctgtatatgtgtgatatataggaaataactttctcttttacacaagagggaatattgaggccaccacgtttttgtctgaaacatcgggtgaatagagacccccaaaggttcaataaagataaaaaatttttttttggcccaaaaatttttgggaaaaaaaaaaataaaaggtaccccccaaaaaaa

SEQ ID NO: 570905 - DNA, 447 bp, Homo sapiens
  misc_feature (254)..(254): n is a, c, g, or t
gtcgctgacaggtaagtagaatttatgtgagtattaagaggggggcagcacattggaagccctcatgagtgcagggcccgcaacttgtccagagggccacgactggggatgtacttgaccccaacagcctatctgggaatgagcctgcttttcagccacacatgtctatcaaattcatcagacattgaatcttggtgaaagccccactttctttgagcatgtggatcttcgtggcggccagagaaacttgaacnttggcccttgtcgcaggggccctcaatcagcatgctcctttgttctgggcaggcttgggtgcgggatgggcccatgattacctttggccaaatggtgaccccttggccacaggtgccctgggggcttttccaaaaggcacccttcgcatgccctgttttgggagccttgtacagcaacctttccagggggggg

SEQ ID NO: 570906 - DNA, 895 bp, Homo sapiens
gatacagagtgtcactctgtgactcaggctggagtgcagtgactatgatctcaagtctcgactgcacgcctcccgttcctgagttcgagcaattctcatgcctcagactcctgagtagctgagaccacaggcgaaccgcacagcatcatccagactattgtatgtggtattgcgagtagagacacgagtctcaccacattgcccaggcatggtctccaacatcctgagctcatggcagatcatgcctaatccgttgagctcccagaagtgctgcagttacaggctgtgacccacgtgacctggctcactgtttctttgaataattgccttttatattgaccctatttggtcatcactttgaatggagatttcgccatttaaatctgaaggttaaccttaatagatcctctgagtgtgatttagtgacagtatgattataggtacttatatattcaatattagattttaaagttatcttctcgtttttctttttccttcctgtctgcgattagggacgaataaaatgggaaattatgaaacatgggaatattttatcctatattgaaagtaaacgatttatttgttatgcgtacggaagactgatggctaataacaatctgtcttcaatgtgtgaccggctggcacataaggatcatctcttcctttactaaaatgtccaggcgcgtcaggcaagtaccgcactgtgaaggaccgggcctacaacgatattaccccagaggtatgtttaggcccaaaacattggatacgggtcgcgacaatatacgcgcagcggtcacttaacaacacaacctataaagtcgctgtgacttaaatgctaccgcgaagggaaacaacacaccaccctggttgttaaaacacgccccgcgccctgtgt

SEQ ID NO: 570907 - DNA, 487 bp, Homo sapiens
  misc_feature (22)..(22): n is a, c, g, or t
  misc_feature (65)..(65): n is a, c, g, or t
  misc_feature (105)..(105): n is a, c, g, or t
gaaccatcaggggcccacacgnatggcacatgccatggcccgaacgggatgcctcctgggcctgncaacatttaatacatgggtgatggccagagagcgatgggnctcaagtagtgacagaatgaaattacatgttttctccaaacttagggctggccaaggacaaccctcttaatctctcagtctctacagcccacattcataacaggaagataataaacctcacttgcctcactgcattgacgtggggataaaatgatgtaagctatcttgtcaaacactgagctggaactcgctctccctctagttctccagggtaaaaaacatggtgagcatttcagatcataaatctatgtgcatttggaataataagtggttctggtcagtaagaggcttacaaaacagcagtacttcaataaagtctacagactacgtttattcacattatacacaatttcccctctccctggttttattttttcacttt

SEQ ID NO: 570908 - DNA, 384 bp, Homo sapiens
tgcccacctgtatcgccctaagtggagtgaacatgctctcggctcactatcgcataaccaagggggccactcaagtgtcatgaggtataaaagaccagcttctctaaagtaagaaaaaaagtcatcagtagatcatggaacctacactcccaatcattttaaataaggaaaccaggtcccagagaccacacacaccttccccaaggcccacagccatgcgtctgacccttccacttgttgcttatcctttgtggatgagccaagggcagatacccggctgggggccagctctagagcctccgtggcccttcccaggaccaatccctctgtttcctccttgtggatctgcaggtgaggtcgcaggagctggtgcagccagtgtca

SEQ ID NO: 570909 - DNA, 177 bp, Homo sapiens
gtcgacgttagtgctggttgtaggagacaaagttgtgctggttgtaggggcagagattgtgctggttgtagtagcagaggttgtgctggttgtagtcgcagaggttgtgctggtggtagaggcagagattgtgctggttgtaggggctgaggttcttctgggtgtaggagcagaggt

SEQ ID NO: 570910 - DNA, 278 bp, Homo sapiens
gaagaaaacactgtgtgtgtttactgcttggcagtttatgagtttcaaaaggcctcagcttttgtgaggttaggctgtaacaatgtgcagcacagagagcaccaggcacacacacgtggttccgcagaactagagttgttactcttcgccgcgcggggatgctaggaagtgagtaccagaagcactagacagggtattgggaagctatatttagctggggacgacgaagtgaccaaggtaatgaacaggcagatggcatagcacgaacgccgggtgga

SEQ ID NO: 570911 - DNA, 189 bp, Homo sapiens
tcactcagggcttggcgtgcttacaaacgtacacaccgggtttttctggtaccatgggagactaaggtggcatatgtcaggcttcttttagccctaaaagggtgggggtttatttcctaagacggaagacattctctggtatggttacggtagggtggtgggcggggataaccttaagcttggggtcta

SEQ ID NO: 570912 - DNA, 282 bp, Homo sapiens
ttttttttggtattctttagattagacagggtttcaccgtattagctaggatgacctcaatctcctgaccttgtgatccacccgcctcagcatcccaaagtgctgggattacaggcatgagccaccgcgcctggcctaaaaggctagttttatcagtcaaagtagactacttaacttttttttttttcctttgtagagacagagtctcgttttgttgcccaggctggtctcgaactcctgactttaagcgatcctcccgcctctgcctcccagtcgacgcgg

SEQ ID NO: 570913 - DNA, 790 bp, Homo sapiens
ctggcctaagcttaaggacctggacatttctcaagaaccaggtggaaagcctgcagcggcgtgtagaagacgaagtcaagcagtggagtgggccaggatggctcgctgttgtcctccccgtatcctcaagggattcctggctgcgctatgtggtgtgccaaactgagggtcatcagcagttgattgtggcttatgctgatgaggcacctgtcactggcatctatgcggcatcaggcatatgctgtgtcccaacgtgccagaagacattaagaggactagtttgcaagtttgctaccgcaagtgggcccgactagctctaggtgccatggcaagaggcaggatgagcagtctcatgccttcaggtgtgagacactttgaatctcggattccccagctgtcatccgatttgcctatcgtcgcgaactttgccctgccaccgttcgatccttgcctcgcgcttcctgcagattgtggacagtagttcctcaggctgcaccctggattccttcttccccttcctagctccatgggagtcgccccaagactgtggcttcaaggtaccaccatgcccttactcttcaagcccctgactgtgggagtttggctagatgcctctgtatcctcagtattctctctggcaatgttccacgggtttctcttccctggggagctggcgtcccgtaacttgatgttccccccaacgttgttgcaatcccggtggcctttgtccccccggcgtctgggcgggcatcacctgtccagctcggggttttccgcccggggcgtcccc

SEQ ID NO: 570914 - DNA, 636 bp, Homo sapiens
cacgagtaatgattaaaaaaaaaaatagaatgaataaaacctggtatttgatagaacgggggactacggtcaataataattgtacatttaaaaataactaaaagagtataattggattgtttctaatacaaaggataaatgcttaagggaaggaatactccattttccatgatgtggttattacgcattgcataagtgtagcaaaatatttcatgtactgcataaatatatacacctggctgggcgaggtggctcacacctgtaatcccagcactttgggaggccaaggcaggtggatcacttgaggtcaggagtttgagaccagcctgaccaacatggagaaaccctgtctctactaaaaatacaaaattagctgggcgtggtggcgcatgcctatagacccagctactcaggaggctgaggcaggagaatcgcttaaacccgagggggcggaggttgcaatgagccaagatcgcgccattgcactccagcccaggtgacacagcaagactccatctgtgaaaaaaaaaaaaaatgcataccacacacacacacacacacacacaacacccttgtacccactacgaacttggtagtacaatattctcaatttggtctattggtctttttcgctgg

SEQ ID NO: 570915 - DNA, 865 bp, Homo sapiens
tggattgtttttgtgtgtttatcgtctcgggggagttatatagatcggagagccggtcaagacgacaaagcagaagcagacaccacgccgttggacaccccccctcatcggccccttttgaccgaaatgttctgggggtgctcggagcggttggcgcccacaggggctcttgaaggttttgatggacaatgttgggttcccctgccggtgtgcggtgcacccaagagggtccccacacccggttgagccaagaaaataatgtttgcggcgagcactaatttatatgggggtgagacacccaggaattgaatttgatggccacaggggaaaaaagggacccgcttttccccgatgtgggtatgtttcactaggccccccccccgcgcaatgtgtgggaaaaggtctcttgagggctcccaaaaacacggtggtttttctttccaagtgtaatgtcaacgtttccccaagttcacactagttcgcggtttccctcgtggcctctggcaattaaggcggagccccctgtgttgggggccccccccttcccccccccgggttgccaaatatagaagggtatcccgggtccgtattcacgccaacacacccgttttaaccagatattgtttagtttaaactatacgatttgccccccctgcctctgttgagattaagccagactgtggatactgataagaacccgacccaatgttatttgcggggggtaaaaatctcacttttctctatagtaggaagttccgttgtgtggggaattctctgtgtgtgaaaaaatatttgtggaaaaaggcgcctgtttttgccacataaaaaaaatctctttgtgtatatgtgtgtgccccaaaaaaaa

SEQ ID NO: 570916 - DNA, 325 bp, Homo sapiens
agtcgacatctacgaggatcccctcctacacagtactaggatctggtgccaacgtggatgcttttctctagggtgaagggactctcgagctgtggtcattgaggacaagtcaacgagagattcccgagtacgtctacagtgagccttgtgggtgaaggtactctacagagtggtcattgaggacaagttgacgagagagtcccaagtacgtccacggtcagccttgcggtaagcttgtgtgcttagaggaacccagggtaacgatggggcaaactgaaagtaaatatgcctcttatctcagctttattaaaattcttttaagaag

SEQ ID NO: 570917 - DNA, 462 bp, Homo sapiens
  misc_feature (384)..(384): n is a, c, g, or t
  misc_feature (449)..(449): n is a, c, g, or t
acactgatggtctctatgcaactatcccaggaggagaaagtgaggaaataaagaaaaaggctctagaatttgtaaaatacataaattcaaagctccctggactgctagagcttgaatatgaagggttttataagaggggattcttcgttacgaagaagaggtatgcagtaatagatgaagaaggaaaagtcattactcgtggtttagagatagttaggagagattgagttaaattgcaaaagaaactcaagctagagttttggagacaatactaaaacacggagatgttgacgaagctgtgagaatagtaaaagaagtaatacaaagcttgccaattatgaaattccaccagagaagctcgcaatatatgagcagataacaagnccattacatgagtataaggcgataggtcctcacgtgctgttgcaaagaaactagctgctaaaggngttaaaataaggc

SEQ ID NO: 570918 - DNA, 522 bp, Homo sapiens
  misc_feature (13)..(13): n is a, c, g, or t
tcttccgtgcccntttttatcattttgtgcttatttattcatctacaaaatgagttcattataacatccatcccatactgtttttgtgataatgtatgaagcacaagctgggtacataacatatgatgtgtgggccactatgattatcattaggttcccttaatcattcctaaaagtagctattcattctccacaattactttaggagaagctattctttttcatgtatttatatatcaccttcataacttatttgttgaaaaagcagataattattgggatgcctacctatgtgccagctgactacacttagtactgaggattgaaaaataaactgaaaagacattttctgtctttaagaagataaacactgaggagagagagatgagagcaaactgctgcactaaaatgcaataagtttattggtagaaaatgtaccaagtattgtagaggaatgaggaactgctttgtagaatgagattatataaagaagactgcagttgagaggttaagcatgaatag

SEQ ID NO: 570919 - DNA, 381 bp, Homo sapiens
ggacctcattggaatgaatgtgcaccatgaaaatcagcatatcaccctggggcaacattttagtttccaagtctttgggtcatgactgatggtaacctacactagctgtcaattttttttcagtaattggttttcagtgctttttttttttccaatctgttaaaaaggtgatgcatttaaaaaggagtgtcctttgcctttgagagctgaaaatttgctcatgtgatcccatcacagcccgttataatgcagattacagtactgtctcccgtgtcttttccgcaaattgaagttatggacgttctccacatttggaaattcgtcccacgtgcccagacataaattcaaccacagcacatttcttccaagtgggttaccgag

SEQ ID NO: 570920 - DNA, 1054 bp, Homo sapiens
actggaaactagacactaaagctttctctttctctgggctaacacaacacaactgttccaacacattctagcactagctggcggactgcacttgctacacattcctgcttactacctacacagcctcgctgcgaactgtgcttcaccctaataactgcgactggaacttatactgcgtgctactcacactctatactttcacactacacagccctctacacacacaactaacctctctctgctactctgtgcgcacgcctcttactacacacgccttaactaacccagcagcacacgtgttactgcaccgacacctacaccacgccacagcaccctggcgcagcacacgcaagcgcacacgtggcacacacatacataccgtggccctgcgcacaccaaactgtccgctatgttacgccatactctcttgcggcaggcctaaatgtatgtaatccaactttgctacttcctatctatcgaccctccctggccactacttggctatacaacacggcactgcataaataaccagggtcatcgacgccctcccattccatgcatcacatacccaagccaaggcgcttttcccaagcaacttcatttgaataaggaattatctgaaacctggaacgcaatcaacgcaatatcaacacgaacccatatacatctgtgggacacacacacacaaggccccacacacacacgcttcttacaacacaacttaacccaaactaacacacaagcagccaatacacaacattgcgtatataacccacgcattactaacacccaaacccttaagactcttacaccccaacacgccccacttattcataaccgacacgctgggctaacttccacgcggcctacttaaacagtcttaacacttcccaaggtcagccagttggcacttcttctcacacaggagtaactacattggggtcgcaagcggccacctaccttggattggccttacgccggctttcaacctcacttggcccacaacttggatacgaaccacgcccacgtgtattcaaaacgttaagttggcacc

SEQ ID NO: 570921 - DNA, 655 bp, Homo sapiens
gccatgaggttgatcctgtttttggtgcccattttgggcatatctactgtctagaaacattgtgggagaccaagttctgtgagcatgtaccaagcaatgaagaacgaaattaagaaatctgctacaagttggaggctcaagaacatctccagctgtgatttttggaaatcacccaccacccagggagacagccagtcccgagttcccttcgtcgaacgtccaggcagtcaaagtgttcttggagtcccaggaattgcctattccatcatgattgaagacgtgcaggtcctgtggacaaagagaatgaagaaatgctctttaataggagaagagaacggagtggtaacttcaatttggggcctaccataccctggaagagatttcccaagaaaatggataacctcgtggtgagcacccatgggtctagtgagcaaagtgaatattgggtctttctttgaagaaccggctatgaagtgctcaagttcagcaccggaggagacaagccagtatctggtggatgctgggatcactgtcgagagtgggttaccaagctacggccctttggaccgcaaatagatggtctgattatggaaggaccatccataatccattctggagcctggatatttcttctgcagtcagaacccgatggtag

SEQ ID NO: 570922 - DNA, 145 bp, Homo sapiens
accctcaggcagggccctgcttttttaggaattggctcccatgcagaatagtgagaaatccaccaaaagccaaattaggccattcccgaccctcctgaattttcttggatttaaaagggttaataaaaaccaactattaacccca

SEQ ID NO: 570923 - DNA, 308 bp, Homo sapiens
tattgatactcgtgatacatttgtcgtgattaagtcccagcaggccacgtattattctactgggagtgaggcttttctcaaacgaattaaagggcggcatttatggtttgggatgatctataaagcgcgcgaacgttatttttattactatcaaacgggccatattggtaacatgacctatcaaatttatattggtttagctgaagtgattgggatggtgctgaccgtcagaccgccttatttgtgacgctaactgtgatttttgtcttagcgatatttattgtgcggcaactggccgagatttgaat

SEQ ID NO: 570924 - DNA, 796 bp, Homo sapiens
cagggagtatgatgaagcttcgggaacgcttacattagaagaagcagagtaagtactaaaatgcactgtgctggagcagattgtgacaatcttaaactgctgcgcatgaaacctctaagattggacatctcgtaagctcagtccactctagatggaaagcattgaagttggctaggaggaatggcctagtgaagtcctccgcttctcggaaattaggaaaggccatgaagtagaaaagaaatcgcttgaagattgtagtttctggagaagcaggaatcgctagagaagcaaatcaatgatctgaagagtgaaaactgatgctttagaatgaacaaaattgataatcatgaagaatcgaagaaagaagagcaagagaagagaagcaaattggtatcttgcatgtgtttctttccagaaaaatcctcgagatcagtgtagtcgtagaaacgaggagttagaagagccgtgaaagcgtggtgttaagagagtcaagaatgagaagacgtggatcaacaggacatcaagttaatgaacaatggatgaaactggtggacaaaaagacagacatgtggttgacaaattgaacgcgttgccagccaggagaatgaagaattgaaaggctcggatggacgagcacatggcaatctcaaggaaggttgccagaggagcagggtagtacttgagagaagtcggtggagaaggagtcagaaagtcagaaagagaatctcctatgggaataacgagggaggcatctgtgggaaagttgaacaatgggggacctgtgtaggcccagaga

SEQ ID NO: 570925 - DNA, 1183 bp, Homo sapiens
ggcccgggaatacccgcgggaaattcctgggcaccccacgcggttcgggggggcgccacaaggggctccgtagggcaccggcggttggcggaatgttccccgaggaggacacacagggaggacccccccaaaaatatggggcctgttcctcgggggtccaacacgattccaatccgcggttatgaggaacccggcggggcccccgggggccccttcctggcaaactcttcgggccccggaaggaaaaaccccccgggcccgaaggattccatcgccgggaaaagcacgcttgtttgaagagcccccccccggggaaaaagccaagaaagggaggatgatgcaaaggaaaaaagggaaaaatagaagggggaaaaccccccacgagaaaagaggaaagaaaggagatgagatagggcccaaaggagggcaacaaagggcgggcccacacctgaggggccaccccgttcccgtttgccccaaacaatgtctccctgaagagaggccccacggggaaaccaccccaccacctggagactcccggaactcccaaaacttctcccccccggctcgtataagaaagggaggggaaaagccgggggagacaccaacactggggggacacacgagagggaagcccccgcgttttcgccacagggggggccactggaccacgaagggcttcctgaaaggcctcgaattgggctgggagacccctcggttcacctcgcttgttttgtttggggaaccccttgaaacccctctccgcttttacacctttgctttgcctttcctcgccttcgggaaagtcttcctcttgggtttgttgggtgaaagcccgaggctgctcctcgtggaaatggcttctgggcacaccacgcctcgtgggggctataaagaacttgaacacagctaagcttctggagagcacagccggcttcctgggaaaacctcccacaggttttgcataaccacgggagtggcccctggcttggcctgcgaaaggtgaacctgcccacgagtttatcacgtagaaggctggaactccctctgtgtcctgcccacatggttgcaagcacagccactgggcctaatgagagcggtctaactgtggccacagtatggtgacctctatttttttttatattgactctttgtatttccaataaaaatattttaaaaggga

SEQ ID NO: 570926 - DNA, 213 bp, Homo sapiens
gtaaggaatactggcctgagtcctatctcatctggttctggctctgtgatcccccaggtgtggtggctcacacctgtaatcctagcactttgggaggccaagctggtcttgaactcctgacctcgtgatccacccgccttggcctcccaaagtgctgggattacaggcatgagtcactgcgcctgttaaaattattttttacaaaaaaaaaaa

SEQ ID NO: 570927 - DNA, 1368 bp, Homo sapiens
  misc_feature (198)..(198): n is a, c, g, or t
  misc_feature (308)..(308): n is a, c, g, or t
  misc_feature (698)..(698): n is a, c, g, or t
ggcgtaacagtaagggaaaggtgatccttgtcacaggcctgtgtccggtaggagatgcgtgtacgatccccatgagacaagcacatgaagcataaggcacccggcgccgacgactcgcctttgcaactctctatcgcgacatgtcttgatccgtcattcctgatgaagcgcccgatggaatgtctgatgcttggaggngagttctgcgctcaactctttcgcatctgaggggtgcatgatctcatcgcggttgacgtactctgtgaacgctgggctgaggtcatcgatgcttcgctgtctggactctngcgaggccccgtgtgctcgtgtcgcgctctactccaatgggtagttactcgtcaagtcgtgttatccaacaggcacgcccgacctaatcgttcggttgtctgctcgtcgcggtaacggtggtggtccgaccagcgaatcattgatccagtatgacagggaccgagtctatggacagagagaattgttgtaagcactgtagtgcaatacagtatcatgtcactcctgtgttgatgatgtggcagcagggggtggcagtacgacgtgctacaggtgttgcgaggacactcatgagttctgagtcaaaacatagcggtgcgacatgtgtctagtcagagcagtgactggaaactggggagtcatgtcaatttgttcttctcgcgacggtcaanttgagcttaaacatttcacaactgcccaggaacactctaggcgtggaactgtccttacgcgagttcgcgatcgcctatcatccatgtggaaaccatccatccgtgagctggcatatgatcgagcatcgaggggaccagctgctgtattaacattggactaactgggcagccttgtgccaaatgtcccttttttggcagccccacggctatggtgcccttccttgacttctacaagtattcttcgaacggaatattaacacaccggactatctcaacgtggacaggggccggggaactcctttaggaacatgtctgcgcagaagtcccgaaaacgcgctactcccggaactcgccacacctttggtgggtccgaactatctgtgccaacaatggtgctcacgtgaaccgcgcaaacaatttgccgttccccccaaaaagggcgccatctacgctatgggttttcacccctcccaattttcgagggacaccactcatggacgggagcccatgatgtgattacgatcacctagggaccgcgacacagcggtcttatgcacaaccgagcgcaagcttgtctgaaacaacagcggagctgcactccgtggccacaacaccgtttcatcactcaccttacgcgacgtagtccgcgagccagtgaagcgcaatagcg

SEQ ID NO: 570928 - DNA, 101 bp, Homo sapiens
gtctaggtggatagtggaatacaggtcaaggtgcagagctcctggctctgggggcagtgcgaggaatggaagatagagtacgtgggatacaggtcacgggc

SEQ ID NO: 570929 - DNA, 226 bp, Homo sapiens
ggatggtcgtggaggttgggggaaatggagagcgactggtaataggagtacagggtttctttttagggtgatgacaatgttctaaattatgtgatgatggttgcttaactctgaatacacaaaagccattgcctgatatactttaaatgagtacgctgtatggtgtgtaaatgatatctcaatagagttgttatttttttaaggattccatgggtatttctgctga

SEQ ID NO: 570930 - DNA, 875 bp, Homo sapiens
cgtgagggggaggcgcgggtggcggagggatgccggagcgggcagcgcgggggtcgccatgtgcgtgaacatggagcgaagctcaagcaccaaagtcatgatcaaccatgttcgtgctgacggcgggctgcgacggtgcgaccaggcggaagcaagtgtcttgcgggcgggcactacatggcagttcgagacagccactcagcggcctttttcctagggtaggagcatagcaatccgccatacgagcgcgaccgagtcgagcctagccaggatgattgtgcacctcccgagcaactaccgccgtggctacaatgcgtcgcagaagattacgccgtgtacagactacttaatcccagtggtagcgtacgccggttcgtcaagagggtccctaccggaagaggcctttcgcaacgaagcagggtgaggtcaggcgaagggaagctccgcatgtggccagaggatgagtcgcaaccgtttccaggcacgcgcgcctaaaaacttatcgacactaataggccttctcccacattaaatgagccctcaatggtcgcgagcatcccaagacatttgtactccggaacgggcgggatgcaatcctgccacgccctgtgggtgtgggtgcgcctagcctggggtaacacggggggcaacgaaccgaggaaggaacaggcacacttcgttgaattgtgccacagtgctcatacctgagggcacgcccattatttttccagcgttcttatacaagtgaacgtgggtgacactacaacttgcgattccgaattctgggggcttatcctaccgcgctgaaaccaatgataaaaagggcccgttgtcccctcacacgctaggggcctgtgctcggaaacagcagggaa

SEQ ID NO: 570931 - DNA, 807 bp, Homo sapiens
gatacacattacggtttaatgtgatgtgatcgtgtctaatatactagtatcgagtctcgtgtgcactgtgtcagcaatagtaggacttagtagttgtggtgaatttagtgatagcgtgtcattatgccgagaagatgctagatatcacgattataggtgattatgtgttagttcatatctcttgagtatgtgatggtggtgaagtctgagtatttatatgctgaattattaatggagtaagcagtatcgtgtgtcgttgtgagtcgagtagtggatagtgattccgataggagtgaatattggattactagtaatggattattattggccgggatggttagcttcataagtgcctttaggaaaggggttttgaattgatctagatagggagcatatggaaagtcttgagcactttaaaatacaggtagagggaaggaagccaaagggtgggcaggcaaggagtgagtcggaagtttgcaccaaaaggtgccaaggtgtctttagagttgtgtgaggggaaccaacggggtggggcaatgactgggttacgatgggggatacgtttatgggagagcctgcaatatattagtacacaggggatttcctatgttaccaagggcttggggccagttacggagtagtgagaaagataagaagttaagcacacatttcctgtgcagggttggacgcccttctttaactagcagtgggaatcctgtgtgctggagagttcagtatgggggtctttggcataggtggatggaggagggaagatagtacaaatacaggaaagttgtaacaaatggg

SEQ ID NO: 570932 - DNA, 181 bp, Homo sapiens
tccccctgagaggctgcagtgcagctaggataaaagcaggcagaggaacatggaagaaccaggctggctgagtcttccagcctacatctttctctcatgctggatgcttcctgcccttgaacatcagactccaagttcttccgcttttggactcttggacctttgaccacagactaaaggc

SEQ ID NO: 570933 - DNA, 465 bp, Homo sapiens
  misc_feature (75)..(75): n is a, c, g, or t
  misc_feature (79)..(79): n is a, c, g, or t
  misc_feature (82)..(83): n is a, c, g, or t
  misc_feature (85)..(86): n is a, c, g, or t
  misc_feature (88)..(89): n is a, c, g, or t
  misc_feature (91)..(91): n is a, c, g, or t
  misc_feature (110)..(110): n is a, c, g, or t
  misc_feature (113)..(113): n is a, c, g, or t
  misc_feature (154)..(154): n is a, c, g, or t
  misc_feature (169)..(169): n is a, c, g, or t
  misc_feature (171)..(171): n is a, c, g, or t
  misc_feature (173)..(173): n is a, c, g, or t
  misc_feature (183)..(183): n is a, c, g, or t
  misc_feature (195)..(195): n is a, c, g, or t
  misc_feature (214)..(214): n is a, c, g, or t
  misc_feature (228)..(228): n is a, c, g, or t
  misc_feature (242)..(242): n is a, c, g, or t
  misc_feature (248)..(248): n is a, c, g, or t
  misc_feature (258)..(258): n is a, c, g, or t
  misc_feature (273)..(273): n is a, c, g, or t
  misc_feature (276)..(276): n is a, c, g, or t
  misc_feature (279)..(279): n is a, c, g, or t
  misc_feature (306)..(306): n is a, c, g, or t
  misc_feature (310)..(312): n is a, c, g, or t
  misc_feature (315)..(315): n is a, c, g, or t
  misc_feature (335)..(335): n is a, c, g, or t
  misc_feature (341)..(341): n is a, c, g, or t
  misc_feature (343)..(343): n is a, c, g, or t
  misc_feature (349)..(349): n is a, c, g, or t
  misc_feature (355)..(355): n is a, c, g, or t
  misc_feature (357)..(358): n is a, c, g, or t
  misc_feature (370)..(370): n is a, c, g, or t
  misc_feature (379)..(379): n is a, c, g, or t
  misc_feature (386)..(386): n is a, c, g, or t
  misc_feature (394)..(394): n is a, c, g, or t
  misc_feature (396)..(396): n is a, c, g, or t
  misc_feature (399)..(399): n is a, c, g, or t
  misc_feature (405)..(405): n is a, c, g, or t
  misc_feature (408)..(408): n is a, c, g, or t
  misc_feature (419)..(419): n is a, c, g, or t
  misc_feature (426)..(426): n is a, c, g, or t
aaaaaaaaaaaaagaagtgattttaaataataatagtgaagaaaataaaattaaaaaattattggaaattaaagnaggnggnngnntnntnaaaaaaaggacagtaaaantgnttaaaatgaaagggattattttctttaaaaaagaaaaaaanataagtggaaaaaanangngaaggttgangtgttaataggntaatgtgtgaaaataaaanagggacgaagaaanaaacgtgtgtatgntcttanttggtatatnagaaatatagaagangcngcnatctgtacagtaaaatggggtgatggnaagnnnttntgtgtggggggtgtggggtngttggngntgtttnggtttntnntgggttgtggtnggggggggngtgattngggggggnanggnggtggnatngaacgatcacntgagggntacaacaaagaaaaaaaaaaaatatgttaagtaggactt

SEQ ID NO: 570934 - DNA, 143 bp, Homo sapiens
  misc_feature (21)..(21): n is a, c, g, or t
  misc_feature (85)..(85): n is a, c, g, or t
  misc_feature (104)..(104): n is a, c, g, or t
gccggccgagggagacggtcngaagccacagtggcgcttggggcggatggggcggccggccggctgggttaacattctgctgcantgcggagggccagctgacngtcggggcctggtccgggcggtgcagttcactgagactt

SEQ ID NO: 570935 - DNA, 330 bp, Homo sapiens
tactgtagtggttgtgggcaggcaggaggtttccaaactgcagtatggagccatgtccggggtgaagctggcagcagagcgctggggcccccgtatgaggaaaggctgtgaggcggcagtggcggtgctggtcgtggtactcacactgctgctgctcacactgtttatgccagagccaaacgcaggcttcgaagcagagtctgtggatggactggcagaggtgatgggagccacagcagaggtggcgctggccagtgccagtgaagagcgggggcagttgtggtgggacgcagtggcgggagttagttgtcttgcttgaagtccccctcc

SEQ ID NO: 570936 - DNA, 202 bp, Homo sapiens
tgcttcgtgaaaacttgcttcgaccatccgggtacgtcagtccgagttctccatatccatttaaatggtatgataggaacgtatcttcatgttcttacccatgccaagtcatccatggattaaaacgttaccaggagcagaaccattatgctggtccaggcgagttggactccaccatttctagaagcaggaactgggtggt

SEQ ID NO: 570937 - DNA, 496 bp, Homo sapiens
cgaagggcacagctcccgcgccgcgcacgccgccctgagcccggagtctggacacccccgggatcttgctgccccataggacccgtgcccctagcccccgtcgctcgccctcatggcccacccggagcatgctgcctgcaccatgagcggctcgtgcctggcgctgctaggccgtcctgctgtgctcggcgcccgctcatggcctgtggtgccatgactgcaccctgaccaccaatctccagccattgcaccccaaagcagtgccagccgtccgacacggtgtgtgccagtgtccgaatcaccgatcccagcagcagcaggaaggatcactcggtgaacaagatgtgtgctccttcttttaaccttctgtaaaagcgacacttactctcacgactatctgatggggtttattaactctgggatcttaaaggtcgacgtggactgcctgcgacaaggatttgtgcaatgggtgcgtccaggggcagtgcacagcccc

SEQ ID NO: 570938 - DNA, 644 bp, Homo sapiens
ggcgtgtccgcagcagccgcagctcgggggctggtgcctgccttgctgcctcccctcggcgatcgcgcagccccatctttgtcctggcctccgcgactttgttctcggcgcccgggccttggccagcctggccagccgccgcagcagaccccacgcctgcgctggcagtacagtccatcgccatccctcgaccgacgccccccgacgcgcggccgggccttgccaccccatggtgtcccaggacaagagcccgagggcgaggacatggcacgccgcaactgcacggtagacgccgaccgggctgcatcgcaaccatgggcagctttcacagggtaggaccaacatggaccacacgaacctgacgggccactctaccagatgcatccgacgctggagcggcacggcattgagagcccgcaaagcagcaagggcgcacaggtccatggtatctgccatgatctggtggctgtccacctcaacacgagctgcaatttccgtgcctctacctgtgatctacactgtccgagcatgaaattccacaaagagcaacggcactattccaacgacggcattgcggaagcggccgaaagccgggcacccaaccttggacccattgcatcctgactgtataggacgtcaatcta

SEQ ID NO: 570939 - DNA, 168 bp, Homo sapiens
cagtctgagaggatcccggtcatgccgtaatcctagcactggggaggcgaggtgggtggatcacttgaagtcaggagttggagaacagccgggtcaacatggtgaaatcctgtctctactaaaaatacaaaaattagcccgacgtggtggtgggtgcttataatccag

SEQ ID NO: 570940 - DNA, 152 bp, Homo sapiens
cgttgacagagagactctactggggctcgaactccttctggagacctgctctgtctgttctgggtcctcacctgcactgtacagagaccagctctctggtctcgctgtccctgtataccagcttccagagaagcagcatggcgaggctagga

SEQ ID NO: 570941 - DNA, 188 bp, Homo sapiens
ctctgattcctagcagaggcccaacaacccctctactgtttctcagagtcccaactcctctggcctcctcatcaggcttcctctccctgctcttccactaatacagctctcatcaaagcaatcaccaccttcgtgttgccagacccagtcagttgtattttacatgttcttatcctttcttgacctct

SEQ ID NO: 570942 - DNA, 304 bp, Homo sapiens
caagtggtcccccacagagtcttcaagaaataagaaattctgtaccatctgaaagtagttcttgttggtgccttcatttaaccagcactctttaaaataaaagggcaatgttttctgatagggctaacatttagttggggttcttgatattcatccatttctaaatgagtgttgtttgtacaccagtaacatctttttggctagagagataaatgtctcatgtttttaattaggttttgtttgtcgacagattacaattctattttaaatataaagtttataaaataaatactttttgtatcca

SEQ ID NO: 570943 - DNA, 298 bp, Homo sapiens
tccaattgcagaaaactgctgtagccgtgaatactgtatctcggaccgttttttcagagaattgaaagctcatttgagtggatggcggtttgggctgtgtcagacacggtgaagagagtgcagtaaagctgggtccaggttaagcgaagtggcttcaatccgggctgacagccaagaagagttttcctcccttcggtgacagggcctgcccctccgagtctagagttaaaagcagcttctagaactggcccctaagtctccaaatgtggtggctaagctgaaatgagagactctgaat

SEQ ID NO: 570944 - DNA, 161 bp, Homo sapiens
cctaaaaccaaagccaaacagaggctttaaaggccaagaaggcagtgctaaaaaacattcatgccaaaaaacaaatgaaaattgcatatcatccacatttcagtggaataagatactgtggctctcaaggcagcccaaattctctaaggttgatttggccg

SEQ ID NO: 570945 - DNA, 345 bp, Homo sapiens
  misc_feature (227)..(227): n is a, c, g, or t
cccttggcaccttgagaggagaatttgagtactagaatttgcatctgggagtgtccaccacgtgatcttccagaagcccaggggttcgggccccactcctggcatgaagaaatagcgacgtctggtgtcagtccgacccaggtcctggctgtgtggcctcgggcgcgtcacttaacgtctctgagtggcagtcacaccatcctgtgtggtattcagacttgagctgntcccaggtgctagcggggtgggctccggggagggagtgagggagggagggcgtcgctgggggcggctcaacccttcagtgcccgcaggcggctgtgcgtggcgagcagtggacgccca

SEQ ID NO: 570946 - DNA, 398 bp, Homo sapiens
taccgtggtcctctccgtggtatcgtggtgcatgtctactacgaaccgtcagggcggttcatcagtcaatgtggcgacctgacttattaccctctgtaagatgcaacgcccctataggcaccactgtccttgctctatctccttttagacagttccagcggtaccacacgatcagtgctggtaatcctaggtcttctctcctactactgatgggactttcattccagacatctctgttggacattaccctgcatcttgaatccataatgagggagttccttaccttcgcaaggagcggacccgtcaattcaagccgccgctatcagctgtacacctactctcaggtggtcgtacgtgtctagttacacgctgggcccttatcgccatatgagtgacga

SEQ ID NO: 570947 - DNA, 370 bp, Homo sapiens
tggtctcttaatacgcatgcccaagaagctgctcctccgtggggcctgcagtcaattaacagtttgatgatgttaacaggtgtggaccatcaggaaatggcctctccctggtgctgccaaattatcatttttagacaggcaatgcaataattgctgaaccatcacccgacattctagttggtagaggagagccctctctcctgcccagctcatgcctaattacctgtaacaatcccactgggcccaatctgtttttcactgcaaatgccttgctactaagactatacaggcatcctccctctaagcccagggactgtcgcatgagagtgtaagggcgagttttgaaggatataattaggtcaaggtcaga

SEQ ID NO: 570948 - DNA, 361 bp, Homo sapiens
  misc_feature (11)..(11): n is a, c, g, or t
  misc_feature (167)..(167): n is a, c, g, or t
  misc_feature (274)..(274): n is a, c, g, or t
atcaaactatncagctgtcccccaaccttttcctcttttttcctaacaacccccctccttatgctaactacctgactccgacccctcacaatcatggcaagtcaacgccacttatccagtgaaccactatcacgaagaaaactctacctctctatactaatctcccnacaaatctccttaattataacatacacagacacatcgccctcgttgtaacagccaatctcatccaaaccccctgaagtttcaccggagcagtcattctcatattcgnccacggacttagatcctcattactattctggctagcatactcaatctaggatcgcactcacaggcggcatcataatcctctctcaag

SEQ ID NO: 570949 - DNA, 401 bp, Homo sapiens
aagggcccagctgggtgcgcaggccgggtcttgtgtccacagcacttttgatggggattttgggttttaccctttccttttctgagtatagttgtaacagcagtaacctgtgcatctaagcccgttcaggtggtgatgaccggtagactagatatttacgccaccgtagctgttttcttggtaactttttaaactcttcctccgacgactctaccctttcccgaggaagttcatacggacccagaacctatttgactttcgactcgcacttgcaccatagtggtaactatagaggaacacctttaaactctggtcgttcatgatacactgatagtaactacggggtcctgtgtctctgaaatagtttttgtactaatgtccctgtagagtccgactgacac

SEQ ID NO: 570950 - DNA, 2127 bp, Homo sapiens
ccgggacgctttgtgttctcatcggagctgcatgggaagtctgcatacagcaaagtgacctgcatgcctcaccttatggaaaggatggtgggctctggcctcctgtggctggccttggtctcctgcattctgacccaggcatctgcagtgcagcgaggttatggaaaccccattgaagccagttcgtatgggctggacctggactgcggagctcctggcaccccagaggctcatgtctgttttgacccctgtcagaattacaccctcctggatgaacccttccgaagcacagagaactcagcagggtcccaggggtgcgataaaaacatgagcggctggtaccgctttgtaggggaaggaggagtaaggatgtcggagacctgtgtccaggtgcaccgatgccagacagacgctcccatgtggctgaatgggacccaccctgcccttggggatggcatcaccaaccacactgcctgtgcccattggagtggcaactgctgtttctggaaaacagaggtgctggtgaaggcctgcccaggcgggtaccatgtgtaccggttggaaggcactccctggtgtaatctgagatactgcacagacccatccactgtggaggacaagtgtgagaaggcctgccgccccgaggaggagtgccttgccctcaacagcacctggggctgtttctgcagacaggacctcaatagttctgatgtccacagtttgcagcctcagctagactgtgggcccagggagatcaaggtgaaggtggacaaatgtttgctgggaggcctgggtttgggggaggaggtcattgcctacctgcgagacccaaactgcagcagcatcttgcagacagaggagaggaactgggtatctgtgaccagccccgtccaggctagtgcctgcaggaacattctggagagaaatcaaacccatgccatctacaaaaacaccctctccttggtcaatgatttcatcatcagagacaccatcctcaacatcaacttccaatgtgcctacccactggacatgaaagtcagcctccaagctgccttgcagcccattgtaagttccctgaacgtcagtgtggacgggaatggagagttcattgtcaggatggccctcttccaagaccagaactacacgaatccttacgaaggggatgcagttgaactgtctgttgagtccgtgctgtatgtgggtgccatcttggaacaaggggacacctcccggtttaacctggtgttgaggaactgctatgccacccccactgaagacaaggctgaccttgtgaagtatttcatcatcagaaacagctgctcaaatcagcgtgattccaccatccacgtggaggagaatgggcagtcctcggaaagccggttctcagttcagatgttcatgtttgctggacattatgacctagttttcctgcattgtgagattcatctctgtgattctcttaatgaacagtgccagccttcttgctcaagaagtcaagtccgcagtgaagtaccggccatcgacctagcccgggttctagatttggggcccatcactcggagaggtgcacagtctcccggtgtcatgaatggaacccctagcactgcagggttcctggtggcctggcctatggtcctcctgactgtcctcctggcttggctgttctgagagctccgctgagcatctggccttgaagtttgtgttcttccctctggcaatggctcccttcagcacttctgctttccactccaattcacacaggcttggtattaacagaatcaaggccaggctaggttaggaaaagggaagagctttcaccttctttaaaactctcggctgggcgcagtggctcatgcctgtaatcccagcattttgggaggctgaggcaggtggatcacctgaggtcagcagttcaaaatcagcctggccaaaatgctgaaactccgtctctactaaaaatacaaaaattagccaggcatggtggcaggcgcctgtaatcccagctactcgggaggccaaggcaggagaattgctcgaactcagggggtggaggttgcagtgagttgagattgtgccattgcactccagcctgggcaacagagcaagactctgtctcaggaaaaaaaa

SEQ ID NO: 570951 - DNA, 246 bp, Homo sapiens
gtgcatgtggactggtcactgagtctgctcccggtcagcatttctgctccgatcccagtaatggactaagggcctgcacacgccggtaatttttgtatttcagcttagatggttttcaccatgtagccaggatggtcttgaatcctgaccacgtgatccacctgctcaggctccccaagtggagggatataggtgtgagccacctgtgccagccgataaaggtaagtttaaaaagcgctaggcagt

SEQ ID NO: 570952 - DNA, 1686 bp, Homo sapiens
ccgggacgctttgtgttctcatcggagctgcatgggaagtctgcatacagcaaagtgacctgcatgcctcaccttatggaaaggatggtgggctctggcctcctgtggctggccttggtctcctgcattctgacccaggcatctgcagtgcagcgagacccatccactgtggaggacaagtgtgagaaggcctgccgccccgaggaggagtgccttgccctcaacagcacctggggctgtttctgcagacaggacctcaatagttctgatgtccacagtttgcagcctcagctagactgtgggcccagggagatcaaggtgaaggtggacaaatgtttgctgggaggcctgggtttgggggaggaggtcattgcctacctgcgagacccaaactgcagcagcatcttgcagacagaggagaggaactgggtatctgtgaccagccccgtccaggctagtgcctgcaggaacattctggagagaaatcaaacccatgccatctacaaaaacaccctctccttggtcaatgatttcatcatcagagacaccatcctcaacatcaacttccaatgtgcctacccactggacatgaaagtcagcctccaagctgccttgcagcccattgtaagttccctgaacgtcagtgtggacgggaatggagagttcattgtcaggatggccctcttccaagaccagaactacacgaatccttacgaaggggatgcagttgaactgtctgttgagtccgtgctgtatgtgggtgccatcttggaacaaggggacacctcccggtttaacctggtgttgaggaactgctatgccacccccactgaagacaaggctgaccttgtgaagtatttcatcatcagaaacagctgctcaaatcagcgtgattccaccatccacgtggaggagaatgggcagtcctcggaaagccggttctcagttcagatgttcatgtttgctggacattatgacctagttttcctgcattgtgagattcatctctgtgattctcttaatgaacagtgccagccttcttgctcaagaagtcaagtccgcagtgaagtaccggccatcgacctagcccgggttctagatttggggcccatcactcggagaggtgcacagtctcccggtgtcatgaatggaacccctagcactgcagggttcctggtggcctggcctatggtcctcctgactgtcctcctggcttggctgttctgagagctccgctgagcatctggccttgaagtttgtgttcttccctctggcaatggctcccttcagcacttctgctttccactccaattcacacaggcttggtattaacagaatcaaggccaggctaggttaggaaaagggaagagctttcaccttctttaaaactctcggctgggcgcagtggctcatgcctgtaatcccagcattttgggaggctgaggcaggtggatcacctgaggtcagcagttcaaaatcagcctggccaaaatgctgaaactccgtctctactaaaaatacaaaaattagccaggcatggtggcaggcgcctgtaatcccagctactcgggaggccaaggcaggagaattgctcgaactcagggggtggaggttgcagtgagttgagattgtgccattgcactccagcctgggcaacagagcaagactctgtctcaggaaaaaaaa

SEQ ID NO: 570953 - DNA, 149 bp, Homo sapiens
tgcttccagtacttacacatgggcccccaccttgttttcagacctggcttctgcccgagcccccagccatgtctagaccaggtcgtttcccacgcggtcccgggtccgccgtgcacgatggcgctaggggcgagggggacgacaagcgc

SEQ ID NO: 570954 - DNA, 784 bp, Homo sapiens
gcacgagggaattagggccatagcgtgaaccagttctggacacagttcttggtccagagctgcccattgtaggagcagtctagatagaatccaggcatttaaattttgatataataaaagttcatcatccctacagtcttgctcaagaagtcaagtccgcagtgaagtaccggccatcgacctagcccgggttctagatttggggcccatcactcggagaggtgcacagtctcccggtgtcatgaatggaacccctagcactgcagggttcctggtggcctggcctatggtcctcctgactgtcctcctggcttggctgttctgagagctccgctgagcatctggccttgaagtttgtgttcttccctctggcaatggctcccttcagcacttctgctttccactccaattcacacaggcttggtattaacagaatcaaggccaggctaggttaggaaaagggaagagctttcaccttctttaaaactctcggctgggcgcagtggctcatgcctgtaatcccagcattttgggaggctgaggcaggtggatcacctgaggtcagcagttcaaaatcagcctggccaaaatgctgaaactccgtctctactaaaaatacaaaaattagccaggcatggtggcaggcgcctgtaatcccagctactcgggaggccaaggcaggagaattgctcgaactcagggggtggaggttgcagtgagttgagattgtgccattgcactccagcctgggcaacagagcaagactctgtctcaggaaaaaaaa

SEQ ID NO: 570955 - DNA, 339 bp, Homo sapiens
agctgaacaaatgtgtcatgggttagggcatctggtcccacaccaaatggtagagtgtaaggctacctgtattttcagatcccttctgcttggagaataaaatcggtggtagtcacatactgacttggggcatagttctattggcctccccagtgagcagacaccttgctcttctgggtgtgtatatgaaaagtagaataggtgggaatacataagaagcgggctgctatcatgtaaaggggaattcatgaatgatatcaacaaggagaatgaataaacgaaatatttaaagacccaaactccactaagatgagtagactcatgactgaaaaaaaaaaa

SEQ ID NO: 570956 - DNA, 146 bp, Homo sapiens
agctgctcgtgatcacttcacgatgttggttgcacagtcaggtcctccgagttgggctggctgggcgtgagataagcgaggagcaataggattcatctccacctcagcagagggagcctgggttcgtaaaaatgcccactgttggt

SEQ ID NO: 570957 - DNA, 293 bp, Homo sapiens
  misc_feature (291)..(291): n is a, c, g, or t
tagagatgaggtgggaggattgcctgagctcaggagtttgagactagcttgggcaacatagcaagaccctatctctgttttttaaagaaattagccaggtgtggtggctcatggctgtgggcctagctacttgggaggctgaggcaggaggattgcttgagcccagtagtacaaggctgcagtgagctatgatcactgagctccagcctgggtgatagagtgagaacctgggctctctaaaaatttaaaagcaaaaagaaaattactttcagttagtttgcaaccagtccntt

SEQ ID NO: 570958 - DNA, 212 bp, Homo sapiens
  misc_feature (72)..(72): n is a, c, g, or t
atcctaaacgcatcttgcactcccaatgagatgggtgtagtattaatacaacccatatctcggagacttcanaccaataaatgcgatcctctccttattttggattaggtatatagattttattggtttaacccaataccttattaccggttaatttccactctaatttcgattaatccttttttaattgttgggtactgggacaaatttaa

SEQ ID NO: 570959 - DNA, 985 bp, Homo sapiens
  misc_feature (309)..(309): n is a, c, g, or t
gcggagaaagaggtctccggaggtcgaggggtgacacacgacgcgacacagaagttgacgcgcacagcatatgcgtgtgtccgaccctcgatgttgcacacacgacagaattcgttcccgagcatacatccggtggtgaacaaacaaagaccagttgtgcttgacaaacatcatcgcgagggatacacaagaatcggacacatgcgtgacgaacccaaatattaatgtcgggggcgggttgtacaacacccggcccccctgtcggtgaaacccgcccttccccctacgggataacatgggctgttcacntcaacaccgggcgaatttttgtgactgttctccggcgctcccttttgtatgaaccggcggacaaataatgtcagagagcacgtgtggaccaaaaagatgtaaaaggtggcagggtctggcaccccgacatctcaatgggggatctgtcccccacgcgtgtagtgtttcggttcagggctccccaaagtgccgcaatctgtggattgtcgcccctacccaaaagaaagaaaatgctatgccgcctacccgtattagaaatacactgttgtgttagatacctttggcacggttgttctcagcacggcgcatatcagaacaacttggttacaactcagcaagataggcaaatatgtacggcgggaaaaatataacaactcgcgacaatagggagagacagactttatttcttctgttaaattcagccgagggtaaaatatgcctaaggggcgatgaagcctctatctgtaatgagctatggacgtcgttaggcacccttctgtggttggaggtcggtcccgccccccacgctaacttttcgcattatcaatgcccccagtatgatttgggcacctccattcgatttatattcatgtaatccaaccacgcgagggggccaaattatccggaaatcaccactgtgaaaaacaaaattgagaaaaacacgccccacatgtca

SEQ ID NO: 570960 - DNA, 539 bp, Homo sapiens
  misc_feature (35)..(35): n is a, c, g, or t
  misc_feature (46)..(46): n is a, c, g, or t
  misc_feature (82)..(82): n is a, c, g, or t
  misc_feature (87)..(87): n is a, c, g, or t
  misc_feature (132)..(132): n is a, c, g, or t
  misc_feature (208)..(208): n is a, c, g, or t
  misc_feature (327)..(327): n is a, c, g, or t
  misc_feature (364)..(364): n is a, c, g, or t
gggacccttaagctcagagttcaagccagcttggncaacataccangccccatttttccaaaaattccaaaaactagccagncaggnctggccggtggctcacgcctgtaatcccagcacttttggaggccnaggcgggcggatctcgaggtcaggagattgagaccatcccggctaacacggtgaaaccccgtctctactaaaaatncaaaaaaaattagctgggcatggtggcaggtgcctgtagtcccagctactcgggaggctgaggcagaagaatggcgtgaacttgggaggtggagcttacagtgagccgagatcacaccnctgcactccagcctgggggacagagcgagactccgtntcaaaaaaaaaaaaaaaaaaactagccaggcgggcatggtggtggcacccatctgtagtcccagctacttgggaggctgaggtgggaggatcgcctgagcctgagggggatgttgccgtgagccaagagcttgtgactggactccagcctgggcaacagagcaagaccctgtctc

SEQ ID NO: 570961 - DNA, 468 bp, Homo sapiens
  misc_feature (132)..(132): n is a, c, g, or t
gtcgttcatccgacgcttgagcgaccttacaaaggcggggaccgaattgaagattgatccgatcgacatgacctgtcaccgggtcctcggaggctgtgtatgccgcctaagagggatcccgaatggttgtanccttgtgatcactgagaacggcattactagacaggtcaactagagccgagagatcctcgcgcagcgagtcctgcggtgagtgagaggatgcgtcggatccaatagaatgtaggcgagcgcattcaaggagagcgcatcatatgccacacatgaagtgcctgaaggtaattccgggcatctttgacgtcccagtgcctagcgaaatgtctctcatatggaatccccgaacaatccagagttctaccttttcgtagtgaaggacaaagcttggccatagatcttccgttctagcgatacagtagtgtcaatcgcactagaggaggaatggtagagcaa

SEQ ID NO: 570962 - DNA, 338 bp, Homo sapiens
cttttggggtctttgctcaggttttcaagggaacccaggaccagatgcataaagtgatattacaatctaattgtatcacaaatgtataaaacaaccacagcgatggggtggatgaaattgatgtggacctaagtaattttggaaatagagtctataaaattaaaggcaaaagaaactgtatataagtactgcactctagttgaaaagttgtttcctgagggatatgggttaacaattatgatactgctgtacaggtatgctgtgactgaacaaataaatgcaaagatggtggatgggggaagccaggtttattactcttagaggtgagtgcatagata

SEQ ID NO: 570963 - DNA, 479 bp, Homo sapiens
gagaggaaaatgatagaaaatgttctgtctttgaagcactccagccatttgttcccactgagcttggctctggcttgtggatagattccacgggtggaatgccggcatgttcttggagcacgaggcagacttgggaactgagtcaacacatggcgtatcactgagacagagcagccccagaacacacaccggggagtacaggagcctaggccacgtacccaacattgcaggcagagaaaaaagaaagtgtattccatgtggtgcattccaggccttagaataaaattaaaagggaaatcaatgaagacacatccactgttcacactctcatcttcaatgtttgaccagtggctgaactgtttggagttgcagattgatatttctcttttatagttttaggtgcttgtaattgctctttaatgctcatgtttactcttattctgtgtgtctttgactcataaagacagttttccatgaga

SEQ ID NO: 570964 - DNA, 542 bp, Homo sapiens
  misc_feature (528)..(528): n is a, c, g, or t
gtacagctgtgataaggtgattatgatagattaaatgaataatatatatgttaaatcactggtgaacagtgtctagacaccacagtaggtgctcactaaatgttgattgccttatttctctgcaactggtcgagcaagctgtattactataggtccttaactggcatcgcgatgtacgtcccccgtgagtcgatttctttctctggaaataatgtcactttacatgtgcagagtgctttgtaagtcacaaagtgctctcacacgtgctatctcacttgtactttataaacgtcaggaggcaggtagaagtgggggttgttattctcattttacaaataacagtgagcagaaagaagtgactgagatcacagggcagtggaaggatggaactgggagttttcttattccaagttcagtgcttcttccactgtgctccctctgatcttcaaaaactggtcaagcaactatttttttggactggccgaggttaaggatcctcaaggccatctgctaaccctcctcatttgncccatctcatttcc

SEQ ID NO: 570965 - DNA, 272 bp, Homo sapiens
ggtcatctttctacaccagtgcaactatgtaactcgcttagtaaaaactatccgtcgagaacttatcatcaccactattcctatctcccattcctatacaagatccaagtagcgagctcacactgattcacactcgctagctgttgagtcgacgaatgtgtagtcatatgtgttgactcctaagagagcacacctagacaccccaaaacactcttgcaggcttcatctcattccttccccaagagtattctgacctgtctgcacaggtatcc

SEQ ID NO: 570966 - DNA, 428 bp, Homo sapiens
cgaatctactcaaaaaaaaaataaataaacgctaggtgtggtgctcacccctttatcccagcctttgggaggctgacatgggtggattgcttgaccggagagttcaagactagcctggccaacatagcaaaaccccatctctacaaaaaaatacaaaagttagccaggcatggtggcacacacctgtagtcccagctacttgggaaattgaggcaggaggatcacttgagtcctggaggtcaaggctgcagtaagccgtgatcgtgtcactgaactccagcctgggtgacagagcgagaccctgcctttcaaacaaacaaacaaaaaaagagttaaaaaaaaaaaacccagctgagcatggtggcccacgcttgtatcccagcacttgggcaggccaaggcagtgggctcacctgaggctcaggggac

SEQ ID NO: 570967 - DNA, 468 bp, Homo sapiens
cgcaagtttatgtgtctcagtctgcagcagctcaaatcccagccttctatatggacacagccaaaccatatcacttgctttatccctcatttttggaaacagctcatcatacacatatggctttcctcatgcagcagaaatgcctggcttttaatgactggatagtaggagaatgacctaccttgactattgactggattccttcctagttgtgtctggggagattttcgtcattcttgtatctttttacaacaccctcaaaatctggaattactttggatgtctccagatttcttttctttttttattttccccagagtttcgctcttctctcccaggctacagtgcagtggcatgatcttggctcactgcagcctctgcctcccaggagaatcgcttgaacccagaagacgaaggttgcagtgagctgagaatctgccgctgcactccagcctggtgacagagaga

SEQ ID NO: 570968 - DNA, 847 bp, Homo sapiens
  misc_feature (30)..(30): n is a, c, g, or t
  misc_feature (65)..(65): n is a, c, g, or t
  misc_feature (68)..(70): n is a, c, g, or t
  misc_feature (74)..(74): n is a, c, g, or t
  misc_feature (98)..(98): n is a, c, g, or t
  misc_feature (316)..(317): n is a, c, g, or t
  misc_feature (319)..(319): n is a, c, g, or t
  misc_feature (322)..(323): n is a, c, g, or t
  misc_feature (326)..(326): n is a, c, g, or t
  misc_feature (330)..(330): n is a, c, g, or t
  misc_feature (381)..(381): n is a, c, g, or t
  misc_feature (496)..(496): n is a, c, g, or t
  misc_feature (527)..(527): n is a, c, g, or t
  misc_feature (556)..(557): n is a, c, g, or t
  misc_feature (564)..(564): n is a, c, g, or t
  misc_feature (597)..(597): n is a, c, g, or t
  misc_feature (600)..(600): n is a, c, g, or t
  misc_feature (603)..(603): n is a, c, g, or t
  misc_feature (606)..(606): n is a, c, g, or t
  misc_feature (616)..(616): n is a, c, g, or t
  misc_feature (623)..(623): n is a, c, g, or t
  misc_feature (632)..(634): n is a, c, g, or t
  misc_feature (637)..(641): n is a, c, g, or t
  misc_feature (645)..(645): n is a, c, g, or t
  misc_feature (662)..(662): n is a, c, g, or t
  misc_feature (666)..(666): n is a, c, g, or t
  misc_feature (670)..(670): n is a, c, g, or t
  misc_feature (680)..(681): n is a, c, g, or t
  misc_feature (684)..(684): n is a, c, g, or t
  misc_feature (733)..(735): n is a, c, g, or t
  misc_feature (755)..(755): n is a, c, g, or t
  misc_feature (822)..(822): n is a, c, g, or t
tagtataattacacataattacctttagtngttttcctacaagaaatgcacaggtattttgaggnctnnngtantgcattattggtaaaacattgcanagtattagtttgtggctctgttacaatgggtaatgacaggaatgcatacagatgtctctgctatgataaaatgtgctcttgttgggttacattaaccttccttcaaaagggatttctcagttgtacttcttacagtcttcaggaaattcattaaatcagtgcctccagttcctttggcttccagttttgaagggtcttcagaggtcttattctccttnngnagnnggnttgnaggaatcaggatgtacttagtcacgatttgcagatggtagctcctcagggngaccagagctttcacacaggcgtcataagcttcccgcaggccagcatcaccttttgaaaggacaaactcacggactgagggatttgactctaatgagcacaggaagttcctgtgngctggtggcatatatcttctcatgtcctggnggaactgagcagcatgtcctccaccagcnntctgctngatgcccagcaggacgtcaaagcactgaaagangcngcnttngcctgcactnccccctncaaactccnnnggnnnnnccanaacccttcatacaccanatcntctnatatcttttnnttncctttccagccagacaaatatatgcgaagaacactgaaaaatgcttttnnngtcacatgatcgttgatttngtgaacacttgaagggctttctccaagcaagatgctatttccaacagcgcctttagcaaagtgtccngttcttgcatttgcattgccttgaa

SEQ ID NO: 570969 - DNA, 339 bp, Homo sapiens
attgggcgtgacttgtggctctgagctctgtgagagcatgagtcttcaaggaagccagagtgagtcagtgctcaccgaggccagagtcagagctggccacagtgtggcagcctccaggagcttaataaaaaatggcaaagaacacagaaagaggaggagcaagtgggatgtatatgtccccccttctcttcctgagtgattctcagccaagtccagaacagtgctcggagggtgaaggaaggttctgccccgcagctttctaggttggcaggatggcaagcaaggcatgctgggtgttcagccttgattgcccagggagcaatttccacagggggggcg

SEQ ID NO: 570970 - DNA, 846 bp, Homo sapiens
  misc_feature (30)..(30): n is a, c, g, or t
  misc_feature (65)..(65): n is a, c, g, or t
  misc_feature (68)..(70): n is a, c, g, or t
  misc_feature (74)..(74): n is a, c, g, or t
  misc_feature (98)..(98): n is a, c, g, or t
  misc_feature (316)..(317): n is a, c, g, or t
  misc_feature (319)..(319): n is a, c, g, or t
  misc_feature (322)..(323): n is a, c, g, or t
  misc_feature (326)..(326): n is a, c, g, or t
  misc_feature (330)..(330): n is a, c, g, or t
  misc_feature (381)..(381): n is a, c, g, or t
  misc_feature (435)..(435): n is a, c, g, or t
  misc_feature (447)..(447): n is a, c, g, or t
  misc_feature (449)..(449): n is a, c, g, or t
  misc_feature (451)..(451): n is a, c, g, or t
  misc_feature (462)..(462): n is a, c, g, or t
  misc_feature (495)..(495): n is a, c, g, or t
  misc_feature (526)..(526): n is a, c, g, or t
  misc_feature (555)..(556): n is a, c, g, or t
  misc_feature (563)..(563): n is a, c, g, or t
  misc_feature (596)..(596): n is a, c, g, or t
  misc_feature (599)..(599): n is a, c, g, or t
  misc_feature (602)..(602): n is a, c, g, or t
  misc_feature (605)..(605): n is a, c, g, or t
  misc_feature (615)..(615): n is a, c, g, or t
  misc_feature (622)..(622): n is a, c, g, or t
  misc_feature (631)..(633): n is a, c, g, or t
  misc_feature (636)..(640): n is a, c, g, or t
  misc_feature (644)..(644): n is a, c, g, or t
  misc_feature (661)..(661): n is a, c, g, or t
  misc_feature (665)..(665): n is a, c, g, or t
  misc_feature (669)..(669): n is a, c, g, or t
  misc_feature (679)..(680): n is a, c, g, or t
  misc_feature (683)..(683): n is a, c, g, or t
  misc_feature (732)..(734): n is a, c, g, or t
  misc_feature (754)..(754): n is a, c, g, or t
  misc_feature (821)..(821): n is a, c, g, or t
tagtataattacacataattacctttagtngttttcctacaagaaatgcacaggtattttgaggnctnnngtantgcattattggtaaaacattgcanagtattagtttgtggctctgttacaatgggtaatgacaggaatgcatacagatgtctctgctatgataaaatgtgctcttgttgggttacattaaccttccttcaaaagggatttctcagttgtacttcttacagtcttcaggaaattcattaaatcagtgcctccagttcctttggcttccagttttgaagggtcttcagaggtcttattctccttnngnagnnggnttgnaggaatcaggatgtacttagtcacgatttgcagatggtagctcctcagggngaccagagctttcacacaggggtggtgggggtgggggggggggggtctgctttngggggggcgggntngnggggtgggggntttgggtgtgatgggtggggggggttgttgtgngctggtggcatatatcttctcatgtcctggnggaactgagcagcatgtcctccaccagcnntctgctngatgcccagcaggacgtcaaagcactgaaagangcngcnttngcctgcactnccccctncaaactccnnnggnnnnnccanaacccttcatacaccanatcntctnatatcttttnnttncctttccagccagacaaatatatgcgaagaacactgaaaaatgcttttnnngtcacatgatcgttgatttngtgaacacttgaagggctttctccaagcaagatgctatttccaacagcgcctttagcaaagtgtccngttcttgcatttgcattgccttgaa

SEQ ID NO: 570971 - DNA, 224 bp, Homo sapiens
acccccccagcaggcccccaaggcaggcagcagggcagccaggcagccaggcagcagggcagcaaggcaggcagcagggcagcaagcaaggcaggcagcaaggcaggcaggcaggcaggcagcacaggcagcacaagcacagcacagcaagcatgcaagcaggcaacacaggcacagcacagcaaggcagcaagcaaggctgtcagttgttgcatttgcagtgt

SEQ ID NO: 570972 - DNA, 401 bp, Homo sapiens
  misc_feature (176)..(176): n is a, c, g, or t
actcaacaagcggcggccaaacgcatgggcatcccgcaaccgaaggtgtcgggcatgatgcgcggcgacttcaccaatctatccgaacgcaagctgatggattgtctgaatcgcctcggctacgacatcgaaatcaaggtacggccagcagccgagccgatcgggcatctaacgcntgcaaccgcttaatcggagctctcctgatggcagcccgcatcaccgacgacgaatgggacgaactgactcccgagaatttcgataccacggcactgctgcgtgcagtcgatgccgtggacgtgctgcgcggcgatttgaatgacacggcagacggcgcacctccgcaactgcgcaccgacctgttgaagctgcatcaactggcaatggccgcgttcaacgaggga

SEQ ID NO: 570973 - DNA, 294 bp, Homo sapiens
attcagtcattactcggtgcgtccagtccatgtttcgtgacctaggttggtgaggagttctgatccttaggaggagaagaggcattctgggttaatggaattttcaggcctttaggcactgtgtgctccccagtctttgtggattatctgcctttggtctttgaagtcagtgaccttcagctgggtttctgagtggatgtccttttggttgatgtagatactattcctttctgtgtgttagttttccttctaacagtcatgacccctagatttttggtcttagctggtgggaag

SEQ ID NO: 570974 - DNA, 215 bp, Homo sapiens
ctgggtgatctagaggatccttttggggggctttccccctcagaagttggttctctcagagtctggaaagattttaactgggagtggaagtgggtattggtaatcctgagaacaaaggggcggttggagactctcaacttgtgagagatttgggtgaacagtccccataaaggcagggggtactaaaccatctaatgaaaagcgagactcttcaa

SEQ ID NO: 570975 - DNA, 130 bp, Homo sapiens
gagggctcttagacccgacctgcccggctcacccaaaggggcaatggccttcttgtatgcaagccagacagtctactgtgtatatttgaattttttactttttttttaaattaaaatttaattaaaatat

SEQ ID NO: 570976 - DNA, 1080 bp, Homo sapiens
gtcgtctcttctttgtgcgcgttcctttgtgcgctgtttgtgcgcccccctcctttgtttaggggttcctggcgggcttatcttattgtcccctctggtcacatgggtttttggattactgttctgtcctcctggctttttgtttctgctcggtcacgcatttatatttcggtttattgggggactcgtgcccatccccccttttgggatggttcctcgggcagtccctgggcacctgttttcctggccctcccgggcttcctgtgccaattgtccccccaccctggtcttagcccgatcttgttttgtccagtgttgaggccccagtgtattcggcattggttcttggagatcttctggttcaagtacactgctggccacttggggcacccgaggtgcccccgttttgccccggggttctgatagagaggtatagaggcacgttcttggtcactgttccacttgcagaccagacttgctggcctgagccccaagggaatggctgggaactcacagccagcatagggacatccccctgcagccttttgacccgccatcaaggctggggaaggggtttgcacaggcacggatattgctggcccttcacccctgccactcccatctcccagccccacgcgtcacctatgcccttcaatataatgcccttatacttggagtcaccggggcccaaggcctgagacccccccctgccccccaaacatggctttagaccagctttccagttcctgactcccccacattggtctcttgccctgaaacagggccctgaactcttgggctgcgttcttctgtgtgtaaaatgggcacatctttcctaatctgttaatggtcactggtgtcccccaggatagtgctggcttccatgggaaccctcactcctggagattccattccattgttcaagtgtacagccaccagcaaggagcccgacactgatttgatcgattctgtgacaccaaacccccacccaattgttaatagcaagtttttatttggctgtataataccatttaagctatttaaatttgtaccatatttaccaattaaataatcatctga

SEQ ID NO: 570977 - DNA, 805 bp, Homo sapiens
tactgcgggcgggagcgtggagtcgggaagtcgagggatttcggcttcgtccctcctggtgctatatctcctcccttttactttgccggtagaacacagttatgggtcgcacgaagaagaagcagctgaagccgtggtgctggtattgtaatagagatttagatgatagagaagatccttattcagcaccaaaaagcaaagcattttaaatgttttatatgtcacaagaaattgtatacaggacctggcttagctattcattgcgatgcatggtacataagagaaacaatagatgccgtaccaaatgcactacctggaagaacagacatagagttggcaatatatggtatggaaggtattcccgaaaaagacatggatgaacagacgacgacttcttgaacagacaacacaagaaagtcacacaaaaagaagcaacaagatgattctgatgacatatgatgatgacagactccgcgagcctcaagctctcatttcagccacagacctgttcaatctcagcaaggttatattcctcccaagtggccacagcaggactagcaccagtaccaggagcaccaggaatgcctccaggcatacgtccataaaatgccaggttgttcctcctctgatgcccaggaatgccaccagttatgccaggcttgccacctggacttgtatcatccagagataagtacacccagatcattggcggtgaaacacatattgatggcgatgggtggaatgattgcaccctggacgggaataccgctctgactgcctgaccttccacagtatacaccagcga

SEQ ID NO: 570978 - DNA, 689 bp, Homo sapiens
aatcgagcccgtacctttatacacccagcatgtacacccctgtgacattggcagtaacatccccccagtatattacaaataatatcaaaaggtgtacacacattgtgacattagtagtagtataccgctagtatgttgtgaataattatatcagggtgtagacacctgttacattaggagtaacatccccctagaatattaccaatgatatcacagggtgtgcaccctttgcgactttagaagtatcatccccctagaatattaacgagtaatatcacccccatctcccacaatggatattacgaaccatatcacaggggggtggacaccccccacaatatggcgagtaatatcaccctactctccccgcctagatactacgaaccacttcccctgtaaggacacacatagacttaaaataatgggatgaaaagatatatttcatgtcagtggaaaccaaaaaagagcaggagtagctatacttgtatcatacaaaatagatttgaagacaaaaactataagacaaagaggcccaggcgcagtggctcacgcctgtaatcctagcactttgggaggccgaggtgggtggatcacctgaggtcaggagttcgatgccagcctggccaacatggtgaaaccccaactctattaccaatttccaaattagccaggtgtggtgctatcagggg

SEQ ID NO: 570979 - DNA, 1041 bp, Homo sapiens
gcccgctccagcccggcccgacccgaccgcacccggagcctgccctacgactacggcgtacccggccagcacatgggacccttggagccgcagcctctcggacgactagatgcatgcatgctgcaggtactaccatacttgagctcatgccaggagccggagcacctgaccaccctaggcttatgaccgccgcagagctcacactgttcacaggtagccccaggacgccaacctaggagcagcaggccgcagtccctagggccagagtagacatttctgcaacgcattagcacctggtacgacacaacggaccagcctaatttattcccttcgaacaaccccgattcaaaagtagcggcacacgataggtagtcgattcaccccgtcacaaagggcctctacagcgtattacatcacacccaacagatcccatatatcttggctctacgccctgggcacatccaaccatacagaaaaggtaaacacaaccacaagatcacgactgacaatacagaaggaggcacccaccaaccgcacacccccgccacccatacagcgccatccgcattaactgcgaacatccacccgcacgaacttgcctcaacacttctcgcacaaacatccttctcactgagacctacaagacaggaccagaagcagcagacctggcgatatactaaccatacccatacacgctagcacacagaaaacattgacacaacggccaccaacaacctaaaaccacctggcaacacgatccaaatccaacaacagacacaacgaacgcacacggcacccctcacacgcacatcacctggccccacaggagctgaacaccaccaccctgggacgcgcgcaccacacaacaaccacgacacagacgaacacacaggacggaccttgcacgcggagcaccaccacgccccactggaaatccagcaacgcacatgacccgcaaacaccacaaccacaccacacccaccaaccaacccaccacccacagacccatgacccctcccaaaaaccgcgccccaacccaac

SEQ ID NO: 570980 - DNA, 443 bp, Homo sapiens
ggcagtgtaatccctctgaccggccctcctttgctgaaatccatctagctgacataccctaatgccaagaaagcctgtctcctgtgctccctaaggtcccatgactgtcttcctgctctccacggataagggaagcttgcagatagccaatatgaaaccagcttcaggaacacaggactggccgggggagagaagttgagaatagtggcatcgtgcctctctcatggaagagctgttcccatagactgagaactggagagcggactgggttccatcttgtgtattttcacatgtcccacagtggagtttctctcacagctggacccatatgggggtggggagggtagcagtctgtgtgtcgcatgttacagactctcactgttccctgaaccgctccgtttctttttctgtattaatgtttctctccattcctgagtggtctt

SEQ ID NO: 570981 - DNA, 558 bp, Homo sapiens
  misc_feature (13)..(13): n is a, c, g, or t
  misc_feature (289)..(289): n is a, c, g, or t
  misc_feature (332)..(332): n is a, c, g, or t
  misc_feature (395)..(395): n is a, c, g, or t
  misc_feature (458)..(458): n is a, c, g, or t
  misc_feature (482)..(482): n is a, c, g, or t
  misc_feature (536)..(536): n is a, c, g, or t
  misc_feature (548)..(548): n is a, c, g, or t
  misc_feature (558)..(558): n is a, c, g, or t
gttcctgaactgntagaactgcacgatagtctggcggggagtattcctctcgccgcagatgagtctatccgtcgtgcttctgacccattgcgtgttattcaagcgggtgcagtcgatcgcgtggttgtgaaagctgcgcccttgggtggccccggcagctgttgcacttatctagccacatcccttatccccttaccgtttctagcgctcttgactcagcagtggggatgagtgccggtattgcggctgcgctgctttgccacacgtagccgcatgcgggttaggaacnaggacatttcttcgtgacggatgtatgcgaagcgcacacgctntgttgatggttctttgccttaccgcatggctaccccggatccggctcggttggtagagttacngtgcacctgcgaagcgggagcagtggtggagggaacgcctggagcgttgttattctcgtgcanttcttctcacctcgttctgctacntcatagaatatgtagtatctgtagatgtcactcattgtgcatggcgcctgtttnacctatgaaccngcccactatn

SEQ ID NO: 570982 - DNA, 202 bp, Homo sapiens
agggagctcactcgggagctcactgcgagtcgatagtcttggggatgagctgggacagcctcagcatcaggaaccttggagtccacagctcagaggtcaagctaaggtcaaaaatcagctcactggccgggcgcagtggctcatacctgtaatcccagctactaggaaggctgaggcagcagaattgcttgaacctaggagg

SEQ ID NO: 570983 - DNA, 554 bp, Homo sapiens
  misc_feature (126)..(126): n is a, c, g, or t
  misc_feature (137)..(137): n is a, c, g, or t
  misc_feature (379)..(380): n is a, c, g, or t
  misc_feature (410)..(411): n is a, c, g, or t
  misc_feature (479)..(479): n is a, c, g, or t
  misc_feature (525)..(525): n is a, c, g, or t
gcaaagttctgcgaacctgtacgaggcgggtgcggggaacgtccctgcacggggggggaaaaaaaacccagcgcaagcgccgagttcctggagacggggagttgcagatcagcttgacagaaaacntttaatttganttcccgcccaagccaaagggaacgaagcgccttctcggggcaccgtcaggcttaagtcactccccgccctaagttctctgtgtgtgtcctgggggaccagcagcactgtgacgaggctaagggccgggttgggattagtcgccccacatggacatcgaggcgctgaaaaaactcaacaagagataaagaaacgtggtcaagaagctggccaagaaggtatgactgcggtttttggccctcanngagtctctgatcaagcagattccacgaaanntccttcggggccgcaggggtttagaataaggcaggaaagttccctctccgctgcttccaacaaacaangcaaaaaggaaagaaaaccagttggggttgggggtgccccgaaaanaacggttgtgggaattttttgggggggga

SEQ ID NO: 570984 - DNA, 189 bp, Homo sapiens
ttagaggttccctctctgtccctcccagagttcaacgcggtttcgtgcctcatcctactgacgtaattaggattataggctcttgccaccacgattcagctaatttttgtattaatattagagactgagtttctctatgttggtcaggctggtctcgaactctccgatctcaggtgatccatccacctc

SEQ ID NO: 570985 - DNA, 166 bp, Homo sapiens
ggaagagcattgacaggtagtagctattactctagaaaaagatttcagtatagtatatggaataaacgcgggctgggtatggtggcgcacgcgtgcaatcccagcactatgggaggctgaggcaggaggattgcttgagtccaggagttcaagaccatcctgggca

SEQ ID NO: 570986 - DNA, 179 bp, Homo sapiens
tgtcagaggagtaccccatcatgattgccatcagtgacagatgtcacttcccctgcctcttcgtgcctggccagccccagatgagctctgtggaacatcacatcttagcaacaatttctctccctcggttctccagcattgcaccaggaatacccttacaggggccccttgcattgaac

SEQ ID NO: 570987 - DNA, 395 bp, Homo sapiens
actagaggaccccctacttatgtgtgacaccctagtcatgtcgacctccaccgtcatgctagaatgccagcggcaggcttactactccaccgccttctcagcagagcacaggaaggctattacactctggtgccatagcagtgcagcgtggaaaagatccacaatatgcaagatcaagacctacgttcatcttcctcttcactgtccttgacctctccctctctccttcccttcttcctccccctctttctcttgctccatatctttctctagacctctgaagtgctgctctccctttgtctctgtcatactgaaatttcgaaacagggtcccactctgacacccaagctggagtgcagtggcgtgatctcgggatcactgcagcctccgtctcc

SEQ ID NO: 570988 - DNA, 182 bp, Homo sapiens
gctccggtggtctcctccagctcagatatctttgtcctttcatgggcatgataacgtgtttcgtaatgcgatgaagatgagggagtcgatctataaaccagacgagctactgaatataagaactctgcagtcttagatgttataacactatatatctgactcgtaagagtggttagcacaag

SEQ ID NO: 570989 - DNA, 730 bp, Homo sapiens
  misc_feature (3)..(3): n is a, c, g, or t
  misc_feature (211)..(211): n is a, c, g, or t
  misc_feature (227)..(227): n is a, c, g, or t
  misc_feature (263)..(263): n is a, c, g, or t
  misc_feature (293)..(295): n is a, c, g, or t
  misc_feature (299)..(299): n is a, c, g, or t
  misc_feature (319)..(320): n is a, c, g, or t
  misc_feature (330)..(330): n is a, c, g, or t
  misc_feature (344)..(344): n is a, c, g, or t
  misc_feature (350)..(350): n is a, c, g, or t
  misc_feature (361)..(361): n is a, c, g, or t
  misc_feature (381)..(381): n is a, c, g, or t
  misc_feature (395)..(396): n is a, c, g, or t
  misc_feature (399)..(399): n is a, c, g, or t
  misc_feature (423)..(423): n is a, c, g, or t
  misc_feature (426)..(426): n is a, c, g, or t
  misc_feature (437)..(437): n is a, c, g, or t
  misc_feature (469)..(469): n is a, c, g, or t
  misc_feature (496)..(496): n is a, c, g, or t
  misc_feature (515)..(515): n is a, c, g, or t
  misc_feature (541)..(541): n is a, c, g, or t
  misc_feature (546)..(546): n is a, c, g, or t
  misc_feature (553)..(553): n is a, c, g, or t
  misc_feature (572)..(572): n is a, c, g, or t
  misc_feature (612)..(612): n is a, c, g, or t
  misc_feature (614)..(614): n is a, c, g, or t
  misc_feature (616)..(616): n is a, c, g, or t
  misc_feature (648)..(648): n is a, c, g, or t
  misc_feature (697)..(697): n is a, c, g, or t
ganatgaggggctgtctggtgtgtaaggaaagttggagggacagaaaacaccgtatcgattcagttccatcatccgctgcagtgacttcggaaaacagaatccagcatcccggtcctcccagcctcaggatgaactggtgaggagttgttctttgtgctgtggccagcgtgaccagggtgggctcctggcaatggccacgagaggtcaggngggggagctggcttantggaaggtgttggggttcggtcggatcatcatcaanactttcttaagtgagttagagactcatcgnnnctcngcccaatagactccgtcctnntagcggctcnggtaatggcccccncggtancagaacccgtngaggttggagtgggcacagncgttataccaacannctnccttctggtagtgggcacagtttnctntgtagacatcntgatctctgtccagggtggtgaactgcttgcngttgtgccatgtaaaggagttacccgnattgacatggtaacgccgncaaaaagcttataatactcgctctcnggttncaggcgnaaactggcgtattctgcanagactttgcgggcggaccagtcctccatggtcaccaggantntntagttgccttggttcgtcagccagtaaatgtnctccaggcccagccagtattcgccgtcaatgtgcccaaacccttgcttntgcgtctcccagtacctgaagaagtaaacagag

SEQ ID NO: 570990 - DNA, 969 bp, Homo sapiens
ggctatggggatggatatgacgactgggaaacggacgaagatgaggaatcgtctgggcgatgaagagggaagaggaggaggaggaaggaggaggaagttctggacatagctgcgtggtgggggtggctagagactctgtgaagaggaagggagacctctccctgcgaggcagaggatggcgtgtgggcgctgcgcctctcctcctccggcatctggggcaaggaacatcccgacgtaggctgatgttttcccaggcactgacggtcccggagagtggtgcatcgcccctggattatgaagggggcgccgtgactttcaccaaacgcagagtcacaggaactcatctacaccttcactggcagcgttcacccggtgcctggtacccttcctgtggctcacgtggtcaggaacactgcctcctgctatagatcctgagaccgctgagaatctgaccccagtcgcaaaacctcagatgcttcacttctgttgtaatgccaggactctcaactggggggacgggatgcctggcctaagcacctggagactggggacccatatcgactggtagccatgctccgcattgttgtggccctgaaatctcactcagtgctgttgctcagtcttattggcctaatgagtgctcttttcgcagctcgtgtcatgattcccgagggatagtctgacctggagtccatgagggctcttccctttttgaccatggacttgggcccaagtctgaaggtctcgtggataagcccgaggcaggatttcttgccagtgtgggaaggactccgaagaccagcatacgctagagcatttgtggctaaaccccaggtccttctgcaagtccttgtgccattctggtttaaacttcccaccacagataagtaatggggcgaaaacaaccgggccagcactaaggggcaggaacaggagaggcgcgctaaaggacacccggggcggcgtgaa

SEQ ID NO: 570991 - DNA, 424 bp, Homo sapiens
  misc_feature (18)..(18): n is a, c, g, or t
  misc_feature (182)..(185): n is a, c, g, or t
  misc_feature (241)..(241): n is a, c, g, or t
  misc_feature (243)..(243): n is a, c, g, or t
ttatctacaaggcctcantgggggacagggacatttggtttcataaaacggtgttggggcaacccgaagaaaaggccctgtactggttttgctctcaattttaagggctggatcggggcacgcttcttttgagcaagacaaagcccaaaattgcttcaaagacacttgtgggcgcacctttnnnnacgcaaggcagtttgcttcacggggctcgtcaaacaacttggacaggggtccacgnanctgttgctgtgtgccagaccccaggccaccacctgtttttcctacagccctccagctaagtatggttttgacatttttaaatgattggaaaaaatcaaaagaatacaattttgtgatgtgaaattatatgaaattcaaagttcagtgccacgaataaagccatgtttattccttaaaaaaa

SEQ ID NO: 570992 - DNA, 445 bp, Homo sapiens
  misc_feature (31)..(31): n is a, c, g, or t
  misc_feature (95)..(95): n is a, c, g, or t
gtttttttaaataatgctatccaattatttncagtagcaattgatttgtgagggcattttgaaccttgtaagacaccaaataatgacgtgttttnattagtcttgtgatactagtatccacctaggtcattagatatttaaaatctgcactttatataggaccaacgatatttaaaaaaatagtgaagtatctttcttacactagtgttgatgatgtgtatatttcttgtttacctgagtatagggctcatagagaaatggttgttctttgggaaagcttaggtgagttgattgtttattaagcaagcttaaaaattagaccctcaggctgggcgagatcgtcacgcctgtaatcccagcactttgggaggttgaggcaggtggatcacgaggtcaagagatcgagacaaccctggccaacatggtgaaaccctgtctctactaa

SEQ ID NO: 570993 - DNA, 879 bp, Homo sapiens
ggtgttgcgctcgtattgtggtgcgcgtccctctgcgcgctgtgctacaccaaagtgggctgtttttgtcgcgcgcgagttttgctgttgcggctcctgatcgttgttctgtcacacgggcggtttttccgcctaagatggtgtggtgtgttccgggggcgtgtggtatcgagcaccgtggcgtcgtgttgtgtccctctgttggtgtgtcttgggttccatgatggtagtgcttgcgtcgcccgcgctcgggtgtaggggttgttcgccattgcagtgtggtccgtgtggtggcgaggtgcgtgttcggcggggcattggtccagtcgtgttggtggccgtgcgagcggtggggcggtaggtggtagatcgctgtgtgtgtcgcgaccacggtgggtggttctttcgtgctagatggttgtgttggtgtgagcggtggcgatcgtctgctattcggtggctgtgggggccgcgctcattgtcccgtgttggtcgggttgttgtgattgcgcgccccgccctcctcggttagttaggcgtggggatcgtgtgcgtcgggttggggttcgcggtgtctcaggggggcgcgccgtttgtggtgtctcttttgattcctctgcgggtttggcaccgcgtcaggtgggtcgcccgcccacacttgtttcgtttgcataggtctagtcattggtctcccgttctgtcgtgttcgctcatcgacctcttgcactattaccttttttgcacactccttctttttctcctctctcgatcattatctaggattttttcttcttgtatcaaccacattcataacataccacaaaaatcaataaaacaataaagaaaacaaataaaaacaaaacaacaataatcaaaaat

SEQ ID NO: 570994 - DNA, 169 bp, Homo sapiens
taaatttgtggagccggggggaattgaacccccgtccgcaagccctccgcaaccagttctacatgcgtagtcgatttatttaggttttaacccatggacttagccaaccgacaggccggaccagagcgattcacgtaatttaaatcgactacgcatgtagaactggttg

SEQ ID NO: 570995 - DNA, 102 bp, Homo sapiens
acttagcgacgagtcagtgtggtccctccgccgaacacccagtgaatgttggtatcataagactgtctctgggctgagaactgaggacgaggctgcctacta

SEQ ID NO: 570996 - DNA, 160 bp, Homo sapiens
cgaatcatgcgggatttttttaaaaaaaaagtttactgctgttgtgtgaaatattggctggaaagggatggttaaaatattaccatgatgtggttgaaatataaaataggatttggagccttattgtgaacaatatttatatatgatgtatgtaagactc

SEQ ID NO: 570997 - DNA, 1117 bp, Homo sapiens
tgggctagttctagtaagcctctacctgcacgacaacacataaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagggggggggggggtggagtaataaattaatattttgtggggggaggatggtgtagtatcaaaaaaaagaaggtcagtcttcatttataatataaaaagaggtgagttatttctatatgatagaacagaagcgacggaaacgataaatataagtttatatattttaatggataacagtcgaaaggttggagtggttggatttttaatgaatatgagaaaagaaaaagatataaataatattagtatattagaatcgagaggagcactgtaaaaaaaaaataaacaccacgctgagagatgaatatatagcgcgcgccgagcgacaatatattatttgaattaattgatgatgtagccgcaccacacatcgcacgccgaaagaaaatgtcattttttagtataacaagagagaggggggtgtaagtagcgaccctccttctttcgtacgttaaaacatacatttagtgggggcccaccaccagatgagttgaatactaaaatgaatgataaacacacgaatgggaggagaggagaactataattaacacacacgcaatcaaatgaatgttcccccacgcattatgttcttactaaaacagagacaggacacatggcgcgaccagcatatttgatgggattgatacgaacaggaagtatgtttttcctcacctacgaagtaataagaccccaccccataggtttatgattataatattctagcacagagacaacagtgtttgtatggataccgtataagtgagggccggcccccaatatgttgtggttgaacagaacagaagaatcgcgccgacggagtatgtataagacaggacacattgtggtgagctgcaaaagagagcggggggtattattcaggagcagcgcgtctactaatgtttggtggcacccaccaatgttttggcccgcagctaaaattatgcccccacgaaatgtgtagagggagcgtataca

SEQ ID NO: 570998 - DNA, 850 bp, Homo sapiens
  misc_feature (18)..(18): n is a, c, g, or t
  misc_feature (22)..(22): n is a, c, g, or t
  misc_feature (42)..(42): n is a, c, g, or t
  misc_feature (55)..(55): n is a, c, g, or t
  misc_feature (65)..(65): n is a, c, g, or t
  misc_feature (74)..(74): n is a, c, g, or t
  misc_feature (78)..(78): n is a, c, g, or t
  misc_feature (83)..(83): n is a, c, g, or t
  misc_feature (97)..(97): n is a, c, g, or t
  misc_feature (106)..(106): n is a, c, g, or t
  misc_feature (112)..(112): n is a, c, g, or t
  misc_feature (115)..(115): n is a, c, g, or t
  misc_feature (125)..(125): n is a, c, g, or t
  misc_feature (134)..(134): n is a, c, g, or t
  misc_feature (137)..(137): n is a, c, g, or t
  misc_feature (144)..(144): n is a, c, g, or t
  misc_feature (170)..(170): n is a, c, g, or t
  misc_feature (206)..(206): n is a, c, g, or t
  misc_feature (228)..(228): n is a, c, g, or t
  misc_feature (232)..(232): n is a, c, g, or t
  misc_feature (234)..(234): n is a, c, g, or t
  misc_feature (247)..(247): n is a, c, g, or t
  misc_feature (251)..(251): n is a, c, g, or t
  misc_feature (256)..(256): n is a, c, g, or t
  misc_feature (270)..(270): n is a, c, g, or t
  misc_feature (277)..(277): n is a, c, g, or t
  misc_feature (282)..(282): n is a, c, g, or t
  misc_feature (288)..(288): n is a, c, g, or t
  misc_feature (306)..(306): n is a, c, g, or t
  misc_feature (325)..(325): n is a, c, g, or t
  misc_feature (336)..(337): n is a, c, g, or t
  misc_feature (355)..(355): n is a, c, g, or t
  misc_feature (379)..(379): n is a, c, g, or t
  misc_feature (396)..(396): n is a, c, g, or t
  misc_feature (408)..(408): n is a, c, g, or t
  misc_feature (463)..(463): n is a, c, g, or t
  misc_feature (536)..(536): n is a, c, g, or t
  misc_feature (552)..(552): n is a, c, g, or t
  misc_feature (579)..(579): n is a, c, g, or t
  misc_feature (598)..(598): n is a, c, g, or t
  misc_feature (614)..(614): n is a, c, g, or t
  misc_feature (634)..(634): n is a, c, g, or t
  misc_feature (641)..(641): n is a, c, g, or t
  misc_feature (703)..(703): n is a, c, g, or t
  misc_feature (707)..(707): n is a, c, g, or t
  misc_feature (724)..(724): n is a, c, g, or t
  misc_feature (771)..(771): n is a, c, g, or t
  misc_feature (784)..(784): n is a, c, g, or t
  misc_feature (841)..(841): n is a, c, g, or t
tcaaattaaatacttttnattntcattctagccagggtcctnctaagtggggtcncctgacagtnacatatgcngcgncttcncctaaaccgtggcnctgaatgcnctgccntgngccacaagcngcccagtgntcntcacccncaagggcaggttgctggggtggggcnccctttcctttcatgttttggttcttctcccctgcntttccctttcctaaaggtcccngccncncagcgttcttttngggntttangttgttgggaaaanataaagngaacncaacanccctcctttaagaaaaanagtgaatcccctttttggngggcttccgcnntgggcaaatttggggtcngtgttctcccgtttgaacatagtnttctgttacctgggggngagtggtccggnactgcccgccccgggcggccaaaagcttgacaaacggcagggagatgggggggtngtggcttcggggaatcagctgacagttgggaagattctgcgtccggttggtggggatgatctgccttgttttnctagaagatgggtctnagttggggattctatgaaaaatctctnccatatactgatatatganggctttgacagcgggnatattggtggcatccatcangagggtnactgcttgccctttccgaatcttcactgcccctttgaacacctgctggttattataacaggnagcnaaagtggcaatggccancacctgtggaatagcacagaagttaaacacactctggtttctgagtntcgaaagggaggngatgacatctggggatgtggtgcagtgcattggttataagttcattcaggcactgcncggccaagt

SEQ ID NO: 570999 - DNA, 215 bp, Homo sapiens
  misc_feature (179)..(179): n is a, c, g, or t
gtgtgggaggtgatccaatctgatggagaatcatgtcaaagagatcactagctgtgtggaatgcttcattcattaagacgctgttcccagcatctactttctcataagtgtgacacaagcactggattcttttgagatgacagctatttttaagtgtctgttcggaataccgtactatnttgcatctaaccaaaaaaatacaatgcagtcaacat

SEQ ID NO: 571000 - DNA, 207 bp, Homo sapiens
acccctcaaagaagtcagagaagcctgcatgtctgcacaaacgggtcattctcattcttacaaatctcactgatccaacctggttttaggctaagttagtttaagttttcatggaatactgaaactgcattagaggacaaaggagcctaaaccattgttcccggggttctatcaattaaacctccatgaataaaacatgaaatcaca

SEQ ID NO: 571001 - DNA, 168 bp, Homo sapiens
cgtacgcaaacactgaaacaaagcaaagatgtccacttacaccacttctattcaacataatactgcaagattttggccaaaattaggaaagagaaagaaataaagggcattcgaattgaaaaggaagaagtcaaattgtgcttgtatgcagatgacataatctcatat

SEQ ID NO: 571002 - DNA, 232 bp, Homo sapiens
tgagacaagatcttgctgtcacccacaagggcgtgcagtggcatgatcatggctcacagcacacttgcactcccaggctcccaccccagccccccatgtgactgggaccacaggaacgagcgaccaggcccaatgcattttaaccatgcccacagcaccgccacagcaagtaatctagtctggctccacagccccgcaagccagagaccatcccgctgctgaattccacagg

SEQ ID NO: 571003 - DNA, 205 bp, Homo sapiens
  misc_feature (1)..(1): n is a, c, g, or t
ngatttagagggaggcagcttgattaaatttaaatcaagacaagaaaaactgttactggcagtagaaaataaaaggtaggctaacatctaatatatcagtatttatgtatataaataaaattagtttgttccagactatctggcttagaagtattctttctcaactcatgctgcaagttttcttccactttagaataggaacata

SEQ ID NO: 571004 - DNA, 149 bp, Homo sapiens
  misc_feature (76)..(76): n is a, c, g, or t
tctttttataaactttactcttttgagaatttgcgaaggcaggacccagagcccttggcccaggttaagttatggntttcttcttgttcaagtgcaccaatccaaccaatttctaggccacacggaataggttagggaaaatgcccaaa

SEQ ID NO: 571005 - DNA, 226 bp, Homo sapiens
ctacgactcgggtacgtggaggatctctagagtctgacgaggctccagctttactgatattctggaggtcagcactggtgctcactgtgtcgacggaactatgtacagggaggcatgcaccgatagtgggtgaatacactgtcgaccatggctccagtctataactgatattatggaggtcagcactggtgctcaccgtgtcgaccggaacttgtccaagggcggc

SEQ ID NO: 571006 - DNA, 121 bp, Homo sapiens
gggctggggatgtgcctattatcccatgctactcaaagcaggagagttgcttgaaccctgggctgatgatagcaccactgcactccagcctgggtgacagggcaatgactccgtctcaaac

SEQ ID NO: 571007 - DNA, 373 bp, Homo sapiens
atcagtgaacccgaaggaacaatccaaacgtactttcttctgggaagagtccaacccaacccacttcatcttgccccccaagaagactgcctgggcactactccctggccccggttgtcctgggacttgtccagtccctcaataggcaaaggcagaagcagctactccatgacaacaacaacacacgaatcatcacgggtcattacaaccggcggaccttgttgtcccccagcggcacagagcctggagcccaggctcaacggcaccgacaaatctgatcttgccataacagcattctctttctgctttctcttctcgtcatttcttctctatatcaactaaatatactaataacaaggtttaattctttttt

SEQ ID NO: 571008 - DNA, 410 bp, Homo sapiens
  misc_feature (111)..(111): n is a, c, g, or t
tcccaacctcaagctatccacccacctcagcctcccaaagtgctgggattataggcgtgagccactgcacccagccaatctgatgggaaaaaaaaaaattcgctacggagncttgttctgtcacccaggctggagtgcagtggcgctatctccgctcactgcaagctccacctcccgggttcacgccattctcctgccacaggctcctgagtaaccccttttgcttggttctcattctctctcttggctgccaccatgcaagacctgcctttcgccttctgccttgattgggaggcctccccagccacatggaactgtgagtccattcaacttctttttctttgcaaattacccagcctcgggtctggctttatcagccgcctgactcccgaccactatactgctgtttc

SEQ ID NO: 571009 - DNA, 886 bp, Homo sapiens
gaatcacttgaacctgggaggcggaggtggcagtgagccgagatcgcaccactgcactccagcctgttgacaaagcgagactctgtctcaaaaaaaaaaaaaaacaaaaacaaaacaaaccagctggggagaaaatttgtttttacattgttcgaagcagatttaaaacccagcagtggggccagacgcagttcacgtgacaccgtgtaaactccagcactttgggagaggccgaggcaggagaatcatttttgagcctaggagtttggagaccggcctggacaacacagcaagaccccgcctctacaaaaactacaaaactcagctgagtgtggtgtgaccccttgtggccccagctactcaggaggctgaggtgggaggatcgcttgagtcccaggaagttgaggcaggctgcagtgagcttgatcatgccattgcatttcagccctggggcgacagagtgagaccctgtctcaaaaaaaaaaaaaaaaatgtttgtgcgcaagggccacctctgttaatccccaacattgtggaagcccaaggagcggatggcaaccacacacggttcagaggttctagagaaccagcttgccccgaatggtggtgtagaacccccggtctcgtatgataacagcgttcacacaaaattcggtggctatggtgtggcgccacctgtattccccacaattgtggggagctgaacacggaaaacacttttacccggtaaggcagaagtttcaaagaacaaatcttgtgcagttggccaacctggaacgcgacgccagactgttccacaaataaataacaaaaaactgttttcgggcgcaccagaaattaacatgttgccgcccaggataaaggcaacgtctaacagctgaagagg

SEQ ID NO: 571010 - DNA, 461 bp, Homo sapiens
  misc_feature (460)..(460): n is a, c, g, or t
gcactgatcatcagagaaatgccaatcagaactacaatgagatattatctcaccctagttaaaatggcttttatccaaaagttagataggtgctggtgaggatggggagaaaggagaacccttgtatactgttggtgggaatgtaaattagtacaactactagggagaacagtttggaggttcctcaagaaactaaaaattgagctaccatgtgatccagaaatcccactcctaggtatatacccaaaaggaaaaaaaatcagtttacagaaaagatatctgcacttccatgtttattccagtactattcacagtagccaagatttgaaagtaatctaagtgtccatcagcagatgaattaataaagaaagtgggatcacatgatcccattaaagaaaattttaaaatatagtaatatataccaatggagtactattcagccatgaaaaaaaaccaatgng

SEQ ID NO: 571011 - DNA, 616 bp, Homo sapiens
  misc_feature (275)..(275): n is a, c, g, or t
  misc_feature (277)..(277): n is a, c, g, or t
  misc_feature (605)..(605): n is a, c, g, or t
tttttttgagacaaggtctggctctattgcccaggctagagtgtggtggcacaatctcagctcactgcaaccttcccctcccaggctcaagccatcctcccacctcagcctcctgaggtgctgggactacaggtaagcaccaccacgcctggctaattctgcattttttgtagagatggggttttgccatgttgcccaggctggccctgtactcctgagctcaagtgatccacccgccttggcctcccaaagtgttcggattacaggcgtgagcncngcacctggcccagcattttaaatttgatttcttagcgagcctgcacagcacacttccgtgggtggtctagtgctgtccactgttttacataaagaaattttctttataaaatcctagaaagcaattattattcttcataaaccatactaatgtgtcattaactgttagacattaatacttcatgtatcattttcacttatcagaaatataacagatttttttccaaatcagtactctgtcacagattcagtaataggcaaaggaaactgagttggattaatcttgggagaagtcattctaaaaataatgtgatgtgcgtcgacacggncgcgaattagt

SEQ ID NO: 571012 - DNA, 173 bp, Homo sapiens
gattatcactggcccttgaggtacagtagaatgtccctttgcaatgaggaggagatctgtgctaggcgggacagctggggaagcattagactatctggaacttgtgtgtgcctcctcaggtatggcagtgactcacctggtttcactaaaacaacctgcaacatctcaaaata

SEQ ID NO: 571013 - DNA, 266 bp, Homo sapiens
ttaaaaaaccacccttcccctcccccggggggttttggggaacccccctttcccttcagggtggtttagtgtttccaattttaaaaggtttagggggccccccaaaaaagggaaaaaggcccccaaaggtccccttccctttccggtaaaattaattaaacccccccccccccccaattaaattgaattaaaaaaaccaattgaattaattttggggtgggccgcctttaaaaaaatccaaattaaaattttatgggggccaagga

SEQ ID NO: 571014 - DNA, 460 bp, Homo sapiens
ctactactactaaattatcggccggtcgactaatgctgaaatgagttaaggctttgaggaactgttgggaaggcatgattggttttgaaatgtgagaacatgagatttggaggggccagggacagaatgatgtggtttggctatgtccccattcaaatctcaacttgtatctcccaaaattcccacgtgttgtgtgagggacctaagaggacgtgattgaatcatggagccggtctttcccatgctattctcatgatagtgaataagtctcacgagatctgatgggtttatcaggggtttccacttttgcttcttcctcattttctcttgctgccaccatgtaagaagtgccttttgcctcccgccatgattctgaggcctccccaaccatgtggaactgtaagtccacagtccaaagtctcatctaagacaaggcgtcgacgcggccgcgaatttagta

SEQ ID NO: 571015 - DNA, 170 bp, Homo sapiens
aatactagtactcttgctgtcaagacagaaaatatcatcataagaaaactacaggccgggcatggtagctcatgcctgtaatccaagcactttgggaggccgaggcaggcagatcacttgaggtcaggagttcgagaccagcctggccaagatggtgaaaccctgtctct

SEQ ID NO: 571016 - DNA, 565 bp, Homo sapiens
agcgggcaggcttcgggaggcgagggggcggggggagcagcgccgaggccgccgcctccgcctccgccgccgtagagactagaggggtgggggacggactaagaccccgatgaccgggggagacggaagagccgagaaccccggacgtcagcaggaccaggaagggggagaaggacggctaaggcaggatccaggaggagaccccaagaaacgagacacactgaaagcggacagcggcggcagccattgccagggaacacagctagaacaacccgcacgtgcatcgactggcgagcgtacagggacacagacggccgaggaccgacttgacgagacacagaccgccggaccgcaagagtcgatggataacacagcacagggaaggaacacgggcccgcagattataacaccgaaccgggacgagaaagagaagacacgaacacccaggagaactacggacacatccacgaaccgaatcaccccagcgagcgagacaggcacccaaaccgacccagcaaccgatccacacgagagacacaagataaccagaggcacacggaaatga

SEQ ID NO: 571017 - DNA, 974 bp, Homo sapiens
  misc_feature (1)..(2): n is a, c, g, or t
nnggggtgcgcacataatgtgcatgcgacggactagagcatgtgaacacgaggctcgctcctctctgggttcttcctcacggaatatgtgtggacccggcgttacttagtggcacagcccgacttgcgcagctatagaccatattgagaggtaccgttcttactcagggggttggctcaaatccgcgccgtggctgctctatttcccacgcatagggcctgcttgtctccggaagcctggctcaccatgaggtgttcatgccgggagacatttctggtagaccccgcgcactattaaatgggtgatgagccgctgctaagacatacgcggtagctggttgtccccgccgcggtagtcttcaagaggcgccgccagtcgtcttatcagaattgcggcaagccatgggggcccccgttaggacactagctgtagtgcgaaaaccagagtgggtttatatgacttgagcgcaaggagattattctcgccggcatttcgaacggcccaggttgttacccgcgagcattgttgcttccgcggtgtgggcactatgtcatacaccaacagcaagtgcggggcgcacacaattattcttgttatcgatgtggatctcctgtaggaaacaagccaagaagttcttgaccctctggatacccacaggatacatcaggtcatagatagcacacacgctggaaggcttctttctgaggaacatgcactattttaagttgtctccaggtagatgaacatagtaaacgacagcgcggccaggacatgtcgcataacagcaggtgcatgttgggaccgcatgttgcaattcatggcctgtggtggtttctgccctcaagactagaggagcatgtcgaggcaggaaagtttctggcaacacagataacaagagtaatcgcatgttgctgacacaacaaagacgctttttcggcggccaaaaaacaaaaactttttcaacaaacatgaca

SEQ ID NO: 571018 - DNA, 124 bp, Homo sapiens
acggccgtgtattactgtgcgagagatgggtctgtccttctagcatattgtggtggtgactgctattcgatggactggttcgacccctggggccagggaaccctggtcaccgtctcctcaggga

SEQ ID NO: 571019 - DNA, 97 bp, Homo sapiens
  misc_feature (25)..(25): n is a, c, g, or t
acggccgtgtattactgtaccacanatcggtcgacgggtgataaaataaggttcgacccctggggccagggaaccctggtcaccgtctcctcaggga

SEQ ID NO: 571020 - DNA, 88 bp, Homo sapiens
tgtgcgagacgaccgggggtattgtactggtctcgaaactggttcgacccctggggccagggaaccctggtcaccgtctcctcaggga

SEQ ID NO: 571021 - DNA, 85 bp, Homo sapiens
ggggattattactatggttcggggagttccacggggtggttcgacccctggggccagggaaccctggtcaccgtctcctcaggga

SEQ ID NO: 571022 - DNA, 272 bp, Homo sapiens
atgatgtccactggctggagctgagtatcagcggccctatttagaaaggggctgcgctttcgggtccatcacgggccccgccattccttagggcttatacctggcccacattactcatttcggtcatctgcctggccaacatggggaaaccctgtctctcctaaaaatacaaaaattagctgtacgtggtgacagttgcctgtaatacagttactgtgagcctgaggcagggagaactgcttgagcccggaagtatgtagtcggttaccgag

SEQ ID NO: 571023 - DNA, 475 bp, Homo sapiens
  misc_feature (138)..(138): n is a, c, g, or t
  misc_feature (165)..(165): n is a, c, g, or t
tggcagagcccgtccaagaggtgggggcccatccacgaggttaatacttcaccagaaaaaagcactgtagcaacctgtgttgttgttggtcttcccaatattggtggaaccccaaaacaggacccacaaggatggggnatttcgcccccacccgttgggagaganaccccaccttcagggattatgggtcctccccctggtattagaccccccatgggccccccaattggggtttcccctggttgagggaagccaatagggaatccgcctccgggaatttaacccccctccaccagggattaaaggtccccctcccccaggaaagggtcccccaaaaccttaggaaaatgttgatccatttcagtcactttttcccccgcaatgggttttgtgaaattgtgtaaagggtttgtgagctttttgttccctcattttgcattaaaaaaaggtaataataaatggatagggccattta

SEQ ID NO: 571024 - DNA, 1408 bp, Homo sapiens
tctgagtggtctggctgaagccctggtggcactgcatcttctccttatgactgtgcaaggacgtcctgagtgcaccccacctggccccagaagagcgtgtggcatggctctgtgaccccaactgggctgcaggctgacctgagagctacttgtgagactgtgtgctggactgtgatgtgctccctctggccactgggccatgtgcctcctcgcatgcttgggtggtgcatgtgctcctgtggggcaagatgttgccgcgatgcttgccatcactgcctacatctgtgctctgcactttgagaacagcttcatgacttgcctcccaagtagcccacctgccttggcattgcggatgtgccgtgaggcaggacctgggctggctccgacgagggacagcccccgaccgtgggccacgggatggcggaccgtgccaggcccccatggccaccaggtgaccctgtgcttgcccatacctcttcctagtaataggatatcactgttttccctgtaacttccgttcaaacgcatgccattactcacgggcgacacgcgccgaacctgaacggtggatattgggtctgtaggcccatggttttaaactcatcgactaacactgatacgaggggccgggtccggcatcccttagggagtgttgtccccctgcggaggggggggcgcccaacggccatacacggactgtacgccccggcgatattcttgatatgtgattacttagaggcgtgttggtgtcccccctttacttatgttgataagcatcaggtcatacacatcaagcccctcgtgggccccgttgtgtaccccgcttccgtctatgtcacacacagcgttatagtgttagcacttggcgtcacatcaactagtcgattacgcttttggtgcgacctctctcgttgtaagtggtggcaagcttttacacatctattggtgtgggtctgttggaaacattatatattgtggaagagatatattagctttcacgtggtaaatatagtagagcataaaaaaggggaaaggatgatgatgatatatatcaagtgatgttttaaacgtgtggtgtgaagctggaagcgtgtgatatttttattggcgttgttgtaaacatttgatggataacggagggaagatagatttgaaggaccagatagtgtatcctaggtggcgcgaatgggaattagagatgatggcggatcgagcagctctcgatggcctgtggcagcagatcgccagtctaccgctgggctgcctcccgcgcggctgatcaggcagcagcccgcgttcctgtcgtgccagtgccactccgcacgctatgtcacagtgactgatggagctgtcatcctcggacttcctcgttcgtgccttgatgaccacgcgtgccagatccagagtc

SEQ ID NO: 571025 - DNA, 470 bp, Homo sapiens
cggctgatgggatttagacagcacagagcaagtggttaggtttaaagaacgtcatccaaataccctggcaggaaaccttgtatactgacagttgcaatatgtgtaagaaaagaatgcatccaatggtatcctcaattaattaattaattaatttttgagacagtctctctctgtcgcccaggctggagtgcaatggtgcaatctcagctcactgcaacctccgcctcccgagttcaaatgattctcctgtcgcagcctcatgaagtagctggaattagatgcccgccaccccgcctagctaatttttttgtatttttagtagagatggggttttaccatgttagtcaggctggtctcgaactcctgacctcaggtgatccacccacctcaccttcccaaaatgctgggattacaggcatgagccaccatgcccggccaatgccatctattaaaaaaacaaagaaaaagag

SEQ ID NO: 571026 - DNA, 130 bp, Homo sapiens
  misc_feature (77)..(77): n is a, c, g, or t
ctctagaggatcgcatatggtgctcatccccctggtactcaatttcaaacttcgagccattgatgatctggtaccgncccaggggcgtaaggatgagttcggtcctcaaccacgatgcagtcggggagtt

SEQ ID NO: 571027 - DNA, 106 bp, Homo sapiens
actccgggtattcctgtgagagcatccctgggggccacctcagctgactgcgattggttggacatgtgcaccacgtcagcaagaagctttgacgtgcactgccaca

SEQ ID NO: 571028 - DNA, 355 bp, Homo sapiens
atgtagacatgagcttgagatttataatctctaaacatactaaagtgaaatcatagcttacctctatagcagtatcagttatttagacacagaatgggattttatagtgaattgctttaaggttggggagtcggagccaggaatcttttcattaattataaggaaaggttgaaacctctgagtacctttatagggggttctcttactatttggctcttgcgtagaactggttaaccccaggttgctcagagaactgatattggagccacatacaagcaattcacatcatatttttcctttgaaggataatcattggatgggaagaaggacaaggcccgttgggttcgggcttggc

SEQ ID NO: 571029 - DNA, 236 bp, Homo sapiens
ggcgaggagtatagagcggaaggcaagagagtgagccacggtatggttagtagaattttccagatgttgtgcttggaatggtggagtgttcggttcagtctcctcttgtttatcgagtatttatccctgtgcttcagtcggtacagcccgaattatcggtgacccatcactacatggagatgtttggtcgtggctggaattcttcctcacgtcaattttcagtactcttcgggcat

SEQ ID NO: 571030 - DNA, 552 bp, Homo sapiens
  misc_feature (10)..(10): n is a, c, g, or t
tggtacgtgngaacttccctaccgttaccgcctaatttatcatcctatggctctctcaccgagcggcccgattctgcaggacgccatactctttcacatatcatttcttcgtgccggcaatgccggatctgcattcgcggggaccacacactttaccaccgattcagagactattctcgaacctcaccactaggggtttcccataacccaccaccccacatggcgaataccaaccacagagattggtgggcaaatatcccacaaacacacggctgtctcttcttttctcctctgaaccttcacattgctctctctcccgcaacttctgttttagaataataccaccccgccccacttggctcacgccctatcgcacaccttgggaagctaacgcgccgattaccaagtcagtagattgagaccatccggctacatcgtgaaccccttttgatggaaccaccggccggggggaccgggccctatggaggaggccgagaagcgaccggggccggttttgccgggattccccctccatccccggggcaggcaacc

SEQ ID NO: 571031 - DNA, 320 bp, Homo sapiens
ggtgcgtgctctagcctctcagttacagctctttggaggaggatcaaaatcagatgtgatgtgggatgggtaataggtgagagtagaaacccttccctccaggagtccccagctgactcccacagaaacccacctaccataagatgtcttcaggtggccttgtccactgatgggggtcaggcatcttatatcaagggtgctctgaacatatattattttttaaaaaaactatgtttgtgaattttgcgtatactggcaagcttttgaaaatgtattacattttgtattgtttaccactgatttatttacacgatatttac

SEQ ID NO: 571032 - DNA, 1027 bp, Homo sapiens
  misc_feature (26)..(26): n is a, c, g, or t
  misc_feature (61)..(61): n is a, c, g, or t
  misc_feature (86)..(86): n is a, c, g, or t
  misc_feature (100)..(100): n is a, c, g, or t
  misc_feature (106)..(106): n is a, c, g, or t
  misc_feature (132)..(132): n is a, c, g, or t
  misc_feature (142)..(142): n is a, c, g, or t
  misc_feature (150)..(150): n is a, c, g, or t
  misc_feature (152)..(153): n is a, c, g, or t
  misc_feature (157)..(157): n is a, c, g, or t
  misc_feature (160)..(160): n is a, c, g, or t
  misc_feature (168)..(168): n is a, c, g, or t
  misc_feature (186)..(186): n is a, c, g, or t
  misc_feature (190)..(190): n is a, c, g, or t
  misc_feature (208)..(208): n is a, c, g, or t
  misc_feature (211)..(211): n is a, c, g, or t
  misc_feature (216)..(216): n is a, c, g, or t
  misc_feature (225)..(225): n is a, c, g, or t
  misc_feature (227)..(227): n is a, c, g, or t
  misc_feature (230)..(230): n is a, c, g, or t
  misc_feature (243)..(243): n is a, c, g, or t
  misc_feature (251)..(251): n is a, c, g, or t
  misc_feature (258)..(259): n is a, c, g, or t
  misc_feature (272)..(273): n is a, c, g, or t
  misc_feature (284)..(284): n is a, c, g, or t
  misc_feature (311)..(311): n is a, c, g, or t
  misc_feature (340)..(340): n is a, c, g, or t
  misc_feature (352)..(352): n is a, c, g, or t
  misc_feature (356)..(356): n is a, c, g, or t
  misc_feature (428)..(428): n is a, c, g, or t
  misc_feature (432)..(432): n is a, c, g, or t
  misc_feature (533)..(533): n is a, c, g, or t
  misc_feature (543)..(543): n is a, c, g, or t
  misc_feature (547)..(547): n is a, c, g, or t
  misc_feature (552)..(552): n is a, c, g, or t
  misc_feature (556)..(556): n is a, c, g, or t
  misc_feature (643)..(643): n is a, c, g, or t
  misc_feature (690)..(690): n is a, c, g, or t
  misc_feature (787)..(787): n is a, c, g, or t
  misc_feature (821)..(821): n is a, c, g, or t
  misc_feature (833)..(833): n is a, c, g, or t
  misc_feature (890)..(890): n is a, c, g, or t
  misc_feature (929)..(929): n is a, c, g, or t
  misc_feature (942)..(942): n is a, c, g, or t
  misc_feature (1026)..(1026): n is a, c, g, or t
gaaaaacatttacactttcccatgtnacagcacaatatttcaatggaatatttcttgccanaaataatatcttgctgatttgtagnaagtcaaacaacantctatntccttcaaggtaaagaaaaatgacanagtcaatcantgtctaananncccnaanccagacanaaacccatggcttcattncccncatcctgtatagtccatnacnaaatnatttccatnancanttagcacccattnataaagangccttcnnaacattgtcttgnncagccggaatncagcagacaaattaacacagtcgacanatatcaagcatacatttttgccacatatnaatctgtatggnaacnacactttatggtatagggttctgactagcctttattacccataagtctgtcttcaaataatttttaccagtnatcnggaaattttgacaatttaaaatgattcccatttttatgtctgcctcaaaaactaatacaaaaaataatttgactaaagtcaaaatttcaaataagtccacnggcagacganaatnaagcnaaanattacaatagattcctcatcttctacagtagtcggtttcaaacgtgtacaaagtaaaccctatactatgagaagatgaaatcatctnagaagtcagtttttaagatcagtcttaaagatatttcagaacatacnagaatatgatctaattattctttcagttgtttacagaaaaatgaaaccacagaattattcctgttacctgggttgaagatcctaatagctaggtgtnaatttggataaggtacagtaattcgaaataagtngtgcatgaagtntttaatgtctggtttctctataaagcataaatagattttaaataccttatatctgtnacccagaatgtcaaattacagcatgtattgacagtcgcngtctattgcaganaggcaatacttggcctgctatgaaggacaataaagaaaaacaaacttttttttttttcttgagaaaaagagtttaaatagaaana

SEQ ID NO: 571033 - DNA, 1038 bp, Homo sapiens
cggcgcgatcggagtatcattgaacgtcaggtgttctctgatcagagcccgggaagaagctgtgagatctgtttcggggacttagaccgtcgagctccgagccatggatgcgcacgctgtgctgggcccagagggtcacggttaggatctttctagcggacaatacctgatggatggatgttgagtgtaaccagaggtagctgagagtcgccaatgagtttgaagccattctaatatactagagctgaacaaattaccatgcgtggtctctcattgcatttgtgccgccctccacgatggatgtaatgcattgacctgtcatgccagagtgtaagagaacccggtaaggtgctgtcttgagaaatgagattctcttctctggacagcgatgcaagatgtcgtgtgctcgacgccggagctgagaaggacatgaacgctccctgggagaaagagacatgcggatatcctggggagagatcttgtttgagcaatcaacctggaaagactattaggctaggcctgcacacccatgttaagccagacgaggttccaaggatggaggctggtttctggatggatagactgttgatgttcgtgagcgtgtaccatgaatgctttctctacgagaagattattttcgttaggttgttcttggtcccattactaaatgtcgcagctttaatgggtcgaatggcttgctatggaatatccgaaaagacctagggcacgtcgaatgtctgggtggatccttctgggtcggcgtgaggtatagccgtactaagaggcactcagttggagatcacgattgagttgtattgctgcacgtttgttgcagcatagcagtggttgttcccaataacagcattccgtgctttgcctgaagttgcctcggagtagttttaacagttaaggctaccttctctagggtggttgaagccgggacccctgtagactgtgtaccctggggcagggaatctgggccccttttaaaccggtgggggcgctctttcggtttggaaaaagacctaacggttgaac

SEQ ID NO: 571034 - DNA, 130 bp, Homo sapiens
gaccccacgtgtatacctcttccctcctaggctataaagtatcagtggtagagaagagcttattcggacctgttactaccccacagctgtgtactatacttgtatcaccgcaaatactaatatacaacac

SEQ ID NO: 571035 - DNA, 145 bp, Homo sapiens
cacaatcacaaagtgctgggattacaggcgtaacgattccgttgcccggcccattgtgtgtttttattaagtcaaatttatcaatctttatctgttggattatgaactggtggatgcttatacgcattttgctgctattataatg

SEQ ID NO: 571036 - DNA, 104 bp, Homo sapiens
  misc_feature (34)..(34): n is a, c, g, or t
  misc_feature (50)..(50): n is a, c, g, or t
ggaagtaggcattataaatgcttcacagttaaancttgacccagtaaacncttgtgtgtttagggagtatacaaaagaaaactgttcttttcctttttctttaa

SEQ ID NO: 571037 - DNA, 126 bp, Homo sapiens
tgtccgggtccaacatcgaggtcgtaaaccctatggtggatatgaactctagaaataggatggcgctgtaatccctagggtaactggtccggtgggtcacgttatgggatcgatggagtatagtag

SEQ ID NO: 571038 - DNA, 178 bp, Homo sapiens
atcaggatgaaaccctggtagcatgattaaatcgaagcagatgtctttaacaatgaagaatatactgtcccgggctcctatcttgttggctgatggtaacctccggggattctctctctgttacagagggccccccccacaggaaacttcgcagagatgcaacccgggctgtgtgggg

SEQ ID NO: 571039 - DNA, 349 bp, Homo sapiens
  misc_feature (42)..(42): n is a, c, g, or t
  misc_feature (46)..(46): n is a, c, g, or t
  misc_feature (65)..(65): n is a, c, g, or t
gggtctgtgatggcggtgaacagcagtgaaggatggtgagcnaaanagccttcaagccaaaacangcgtggaccagaagagtgtgcagttgcaagatttaatagagtgaaaacagagcttccatacagtgggaggggaaccaaagggggtggcccactcccgcctcatatgcctggggtttatatcccaatcattgtccctcctcctgtgctctcagatgatagatgatttgactatttctttacctcctgcttttaacctaattggtattttaatgagccctctttactgcctgattggtcaaggtgtgagctgagttacaagcccggtgtttaaaggtgggtgcgat

SEQ ID NO: 571040 - DNA, 168 bp, Homo sapiens
tcagacagtataaaattagtatccctacaaagacaatgttaattattttaatccataaacatgggatatctttccatgatttttatcaatgacttctggttttcagaatctactgggcaaacgatatgaagacatgccatctaaagaacattgaaagtgaatatatat

SEQ ID NO: 571041 - DNA, 199 bp, Homo sapiens
agggcctgcctgcccccgttttgttggggtttccacgggggggggtgggggacgcccccttttccttttccctgatttttcccccaccccttaggaggaacggtccccccgggggtaatggttgccccctggggttttttttagaatggccctaacgggacccatttgcccaaataaacgaacatcccatgtttggtga

SEQ ID NO: 571042 - DNA, 631 bp, Homo sapiens
  misc_feature (42)..(42): n is a, c, g, or t
  misc_feature (45)..(45): n is a, c, g, or t
  misc_feature (49)..(50): n is a, c, g, or t
  misc_feature (52)..(52): n is a, c, g, or t
  misc_feature (57)..(57): n is a, c, g, or t
  misc_feature (301)..(301): n is a, c, g, or t
  misc_feature (335)..(335): n is a, c, g, or t
  misc_feature (380)..(380): n is a, c, g, or t
  misc_feature (431)..(431): n is a, c, g, or t
  misc_feature (519)..(520): n is a, c, g, or t
  misc_feature (534)..(534): n is a, c, g, or t
  misc_feature (539)..(539): n is a, c, g, or t
  misc_feature (542)..(542): n is a, c, g, or t
  misc_feature (545)..(546): n is a, c, g, or t
  misc_feature (558)..(558): n is a, c, g, or t
tcttaatagaggaagttgaagattcctgggggaatagcattnganagcnnanagggngagggtgctgattactagctaaaagacttagaaattttgcaaacatggactcatgatagttttgggtgatgagtcttcttgtaggatagcttgaaagaggaggaggaaactagaggccctggtaatataaggtaacattaagtatcctgatgtcagtaatggagaagagtgaaagactatgattgattgggtgactgtgtgggcagaggatgtgaggaaaaaaggacatcttgtgtgtgtgtgngcacacatttttagttgtgtatcttctacttgtnttctcccccaccttgtacctgtactttctcaagcccaaaaatganaatttacctgctaccaaccacatcatcttgtgcatctgtgtagctcagttnttatttctttagatctgtggtcctccgtggaaagagagccactaccccaagacacatctaatataatacacagggcgcttacgtggtnngaaaagaagagatnagccnggngcnnggccactctgtnatttcattgtaatgttttaacgggtaccccctgtaaattagtgtatgaaagggcttttgtctgttgtaaagca

SEQ ID NO: 571043 - DNA, 335 bp, Homo sapiens
  misc_feature (9)..(9): n is a, c, g, or t
  misc_feature (21)..(21): n is a, c, g, or t
  misc_feature (27)..(27): n is a, c, g, or t
  misc_feature (35)..(35): n is a, c, g, or t
  misc_feature (38)..(38): n is a, c, g, or t
  misc_feature (44)..(44): n is a, c, g, or t
  misc_feature (98)..(98): n is a, c, g, or t
gatattganagacggaaagangttganagcatctngangaaaanctcagattggctatgggattggccaagtcggccggaaaatattccccccaaggngttcctctttaaacacccgaagcgcacggccaccctcagcatgaggaacacgagcgtcatgaagaaagggggcatattctctgcagaatttctgaaagttttccttccatctctgctgctctctcatttgctggccatcggattggggatctatattggaaggcgtctgacaacctccaccagcaccttttgatgaagaactggagtctgacttggttcgttagtgggattacttct

SEQ ID NO: 571044 - DNA, 665 bp, Homo sapiens
gcaaatatcgactctattagaatactcctttaatcacaccatatcccttcagtatcgcatgggagtgcttgacagttgtacttgcgctatggagacatatcagtatacagtcatgctacgctgaatggtaagatgtgccatcatattcgatggtgatcctcagatcgggcgtagacgagcaatccgtcgagttattgcctgactctgatgatacattgagcatctaggtaaggtgttggacccctagtggctcttgggagtgcttatattctgtggatgtatagaatgcaggtggacactagctttgaccgttcggtacacatcgatgcagtagaagggcatcatgtgggtctagtgcaatagaacgatcgattgagcgcaacacttctagacttgcgacccgaagggattgacaccgaatctcaattaaggtctcaagaaaatctagccctctatccacacatgtactgtgatcacaaggatcttgttcccgatttcgagcaacttctatgcacagtccaattccattgagccttctttgagagaagaaggatgcatctcaggaaggcaagcagcagtaatctgcagtccatagaagagcgtgagaaactggcacgggctctacgaggtgcattctctgtgccttgctgtagcaccagctgccc

SEQ ID NO: 571045 - DNA, 327 bp, Homo sapiens
ttcgtgctggcttgctgccggttcgtgtctgcttgccagtttgtatcagccacgggtcttcgtcattcctcaccaggaacttcaccctgtagtgggccgtgtcctggtcggggatggttgcagcccatttctgttggttggcagtgggtatccttgccgacgcgcaggcgatggagctggcctctggtctggtacagcacgccgtgattggccctcagtgtgagataggtagcccctctgggagaatgtaggcagagagcagagataacctgatttgtccgtgggactctagaattgggtaccgagactacgaaattacataatcat

SEQ ID NO: 571046 - DNA, 1421 bp, Homo sapiens
gcgtgtggtcgttgtctcctctgtccctcgtgcgtcagaggtgggtggtggtgagaggacctctttttataaggagtgtgctgctcgtttttgtcgcggttatttctccgcgcagtttgctcggcttgttgggcgtctgatgagtgtgaagaaacgggtggcccctctgttttccggggttttgtgcccccccgcgcccccccccccgcggggggtcaccccccgaggtttttccggggggggtgccctccccccccctgtgggtggtgagagccctctctcctggctccccgggtggggtccccaccccgcggtgttgttcttttttgtgacagggacccacccccgcacacgggggggtgtgcccccttatggggcaaccgtttggtgtcttccccccccagcgtgtggtgtgttggaggagagctcccccctccctgtcggtgtggttttatttgtggggggctaccacctcgggccctccttgttgtggctccactccctgggggggggtgggctcgttcttctcgttgtggccacaccttgtgtggctggggtgctcccctcgttggcccgcccgctgctgtatcagtgggcctttttgtgtgggtgtatattgtgtggcgcgccccgtttccgacgccgcacacgccatcggcgccagcaccccaaaaagttgtggggttccctccctcttgttttgtgcccaccgtgcgaggtgcctcctcgctcagcaccccccagggggggcgccccccttgtatagagtggaatagcgccccccactctctctcttgttgttgtgtgggcgcccccacgcagcgcacctcactgggcgcattttgatgtggtgttctctttggggggacctctctcctgtggagagggaagagtttattatgagactgtcgcgcacctgtgggcggtcgcacactcttttcttgtgggccaccggcgcgctttgtcgcctctctcttgtgtgggagaatgttcgctcgggagatattgtgggcctctctccctctatgagaggggaatatctccctcacactttttatgtctcccgcgtttctccctcgtgagaaagaagattctcacaatatacgcacccctgggctcccctctctccacttattttcgtccccataccacctttgtgcggccacattttttcttaataatattgtttttctccgccctccgcgaagatgggagtctccccccggcagaggagaacccccttttttgtttttgtggagaaccccgcaccgtgttctaccctttgtggggcagcggcggggaacacatatttcctttggtgaagatttgttttgtgataaaccggtcccccttttttctccccccccccctgttttttggtgaaaacccggtttataagggggtttttggggcccccaata

SEQ ID NO: 571047 - DNA, 291 bp, Homo sapiens
gggcccgaggaaaagttagggtttgcccttttcaggtcaactccccttccaaatagttatatccaaaactgtttttcggtctcccctcccttgtcccccctattaaaataaaaacagggattgattaatgtcccgctcctgaaaacaagaaaaatttgtccaaaaatattttttatgaaaatgatttgtaatcggtagacttattacctgggaaatgtcttaatgtaaaatcccatcctttgggttgcgggttttttgttttctccaaataaatttgggctttaaagttca

SEQ ID NO: 571048 - DNA, 526 bp, Homo sapiens
tttcttgccccgactcagggggtttctaaaaaaacaggcagtttgtaaggagtatagacgcactgacttgtgtgtggcctctgtctagaaaaggtcagtgtcatctgagggaatctagcagaaggtgggccgtatgcatgtgagtcatcgagtctgtaattgggaatggtgtggaagtggaggctgaatctggattactgaaaaccgtttctgcattatacatgttggatttatcacatgcagtggctttcaggttgactcttttcaccctgcagaattacagtgtatatatatcgttgttgtatatctccagtgcatcatcagggcaaaagaacataaattacagaattagacatggcttttagcaaagtgtgtgcatttttgtcccaaaggaaacagaaaggtcacccttggagaaggaattgccattctgtcctgagatagccctgaagctctatgtagaagactgagaatcaagttgaaggcattgtctttctcctattgtgaataactaacttttgcattg

SEQ ID NO: 571049 - DNA, 641 bp, Homo sapiens
  misc_feature (430)..(430): n is a, c, g, or t
  misc_feature (476)..(476): n is a, c, g, or t
  misc_feature (512)..(512): n is a, c, g, or t
  misc_feature (515)..(515): n is a, c, g, or t
  misc_feature (594)..(594): n is a, c, g, or t
cacttaggagatttcaacttaacttgaccgctctgaccaaaaaaaaaaaaaaaaaaaaaaaaaaaaaatttgggggcgcccggggcagcccctgaagaagaaggtttcgaaaacatcttgccgtgtgggggcgcgcgggcgcccaaggtaggtgcacgtggaacacatggctgcaaaacgtgggttccctataaggagaaaccctgggcgcccatcggcaacgatacgtgacgttggggggtcttctctctaccccccaagcataataaacagcgcgccgccggggaggaacaagcgcgaggagcggtttcgcggcaaccacacatctcaccagaagatgaaggagagaattatcgcgaagacgaggcccaccactatccgagggagggctattccctataccaccagcgggaggcgagacttccctccnaagggcgcaggaagctaccgcccgtataactatcccacaaatattnaagcagccgcccgccgcgcccgctgccgtgggtatnaantacgacatatacgacggtagccaactcaaccgaaccgacctaaggctatgaccaactaccgaaccgaacgctacaacanagacagaacgaggccacacaaagaaaccggaaacgtcagcacttgag

SEQ ID NO: 571050 - DNA, 604 bp, Homo sapiens
cctgaggtttggctgatcgcttaagacatattaattgaaggaagtcggtcacaaaagaccattcgttgaatgattccatttatatgaaatgtccagtataggcaaatgtatggagacagagagtagattagttgtttcacaggcccgaggagggtgagcggaaatagggagtgactgctaatgggtataggattacttttgggagtgatgaaaatgttctaaagttatactatggtgagagttgcacaaccctgtgaatataaatatactaaaaaaatgaaatcagtgaattggatgatgtataaattatacctgtttttttctgtttgttttttttggagacggagtctcgctcttgtcacccaggctggagttcagggaacaatcttggctcactgcaacccccgcctcccgggttcaagtgattctcatacctcaaacacacagacccaccaaccacacctggctaattttggtggtctagtagagacagggtttcaccatgctggccaggctggtctcgaactcctgacctcatgatccacctgcctcaggctcccaaagtgctgggattacaggcctgagccactgcacctggcctcct

SEQ ID NO: 571051 - DNA, 120 bp, Homo sapiens
gtatttaagactttactttattcagcaaaatcatttatttacacaatggggaatgctggtttgattttgttcccgtcccttaggctttttgaacagagacaatactgaactgtatatata

SEQ ID NO: 571052 - DNA, 870 bp, Homo sapiens
  misc_feature (6)..(6): n is a, c, g, or t
  misc_feature (163)..(163): n is a, c, g, or t
  misc_feature (188)..(188): n is a, c, g, or t
  misc_feature (203)..(203): n is a, c, g, or t
  misc_feature (224)..(224): n is a, c, g, or t
  misc_feature (226)..(226): n is a, c, g, or t
  misc_feature (229)..(229): n is a, c, g, or t
  misc_feature (233)..(233): n is a, c, g, or t
  misc_feature (237)..(237): n is a, c, g, or t
  misc_feature (239)..(239): n is a, c, g, or t
  misc_feature (242)..(242): n is a, c, g, or t
  misc_feature (257)..(257): n is a, c, g, or t
  misc_feature (262)..(262): n is a, c, g, or t
  misc_feature (270)..(270): n is a, c, g, or t
  misc_feature (311)..(312): n is a, c, g, or t
  misc_feature (339)..(339): n is a, c, g, or t
  misc_feature (341)..(341): n is a, c, g, or t
  misc_feature (348)..(348): n is a, c, g, or t
  misc_feature (350)..(350): n is a, c, g, or t
  misc_feature (374)..(374): n is a, c, g, or t
  misc_feature (378)..(378): n is a, c, g, or t
  misc_feature (383)..(383): n is a, c, g, or t
  misc_feature (386)..(386): n is a, c, g, or t
  misc_feature (389)..(389): n is a, c, g, or t
  misc_feature (392)..(392): n is a, c, g, or t
  misc_feature (397)..(397): n is a, c, g, or t
  misc_feature (399)..(399): n is a, c, g, or t
  misc_feature (406)..(406): n is a, c, g, or t
  misc_feature (416)..(416): n is a, c, g, or t
  misc_feature (432)..(432): n is a, c, g, or t
  misc_feature (434)..(434): n is a, c, g, or t
  misc_feature (447)..(447): n is a, c, g, or t
  misc_feature (457)..(457): n is a, c, g, or t
  misc_feature (463)..(463): n is a, c, g, or t
  misc_feature (465)..(465): n is a, c, g, or t
  misc_feature (486)..(486): n is a, c, g, or t
  misc_feature (488)..(488): n is a, c, g, or t
  misc_feature (500)..(500): n is a, c, g, or t
  misc_feature (516)..(516): n is a, c, g, or t
  misc_feature (522)..(522): n is a, c, g, or t
  misc_feature (529)..(529): n is a, c, g, or t
  misc_feature (571)..(571): n is a, c, g, or t
  misc_feature (806)..(806): n is a, c, g, or t
  misc_feature (842)..(842): n is a, c, g, or t
cacgcnctggggtccggcgccctggttcctgcttctgccgctgccgccgccggatcccagtggcccggcgtgctcggctcccacaggcctgcagccagcatcgcaccgaaccttcggggggccgcggctggagcgctcggccggcgtgggagcgccaaggccncagatgcaatcttcttaccgcgaanaagccaggggaatangtagccacatcttgtttgcananaanaaangaancnaangcagtatctgcaaanccagnagtctgantcagtacttttctcactcatgcatacaaagcagctaaaaannacacaacttatttaccatacccctganantgcactnancactttataaacttaaactctgtnaatnctcangancanctnatganantctccanaaaaagcaanagtaatggagtacatnancactggaagtganaataaaaaanaaattnanttattaattaaacaattaaananatctaaagtaanaaacattatggaaaanctttangcaaatnaaaaaccagcagtttatgaacccagtctaatgaccatgtgtnaagacagtaatcaaaacgatgagcgttctaagtctctgctgcttagtggccaagaggtaccatggttgtcatcagtcagatacggaactgtggaggatttgcttgcttttgcaaaccatatatccaacactgcaaagcatctttatggacaacgaccacaggaatctggaattttattaaacatggtcatcactccccaaaatggacgttaccaaatagattccgatgttctccngatcccctggaagctgacttacaggaatattggttntgattttattcctcggggcgcctttgga

SEQ ID NO: 571053 - DNA, 367 bp, Homo sapiens
  misc_feature (294)..(294): n is a, c, g, or t
  misc_feature (308)..(308): n is a, c, g, or t
  misc_feature (363)..(363): n is a, c, g, or t
aactttcccacatcgtcctgtctcctgagtcctccaagtctccaggaagttccaaactttcccacattttcctgtcttctgagtcctccaaactgttccaacctctctgcctattacccagttccaaagttgcttacacattttcgggtatcttttcaacaacaccccattctactggtaccaatttactcttttagtcagttttcatgctgctgataaagacatacttgaggactggggcaatttacagaaggaaagaggttcattgggactttaacagttccacgttttctnggggtggggggggnctcacaatcatgggcagaagggcaagggaggggagccaagttcatgtcttaacantggg

SEQ ID NO: 571054 - DNA, 188 bp, Homo sapiens
acttagaaatggttaaaggtagccgtggtacggtgaggccgggtactgctggctagcctgtgatggctaggcgcgcgaagccggggtataaagaagtgcaggcgagggacgggcaccatgtcaccgccagcttgcggcaggatctgcgtacagttggcccgggaatgcgcaggcaggtggtgacccct

SEQ ID NO: 571055 - DNA, 164 bp, Homo sapiens
tcgcgcttggcggatatttgagctcaggagtcaagacaacctgggaaacacagtgagaccctgtctcaacaacaacaaaaaaagtattttattttatttatttaatttatttttgagacagagttttgctcggtcacccaggctagagtgcagtggtgcaatca

SEQ ID NO: 571056 - DNA, 1009 bp, Homo sapiens
  misc_feature (5)..(5): n is a, c, g, or t
  misc_feature (155)..(155): n is a, c, g, or t
  misc_feature (166)..(166): n is a, c, g, or t
  misc_feature (429)..(429): n is a, c, g, or t
  misc_feature (442)..(442): n is a, c, g, or t
  misc_feature (455)..(455): n is a, c, g, or t
  misc_feature (470)..(470): n is a, c, g, or t
  misc_feature (481)..(481): n is a, c, g, or t
  misc_feature (484)..(484): n is a, c, g, or t
  misc_feature (496)..(496): n is a, c, g, or t
  misc_feature (507)..(507): n is a, c, g, or t
  misc_feature (516)..(516): n is a, c, g, or t
  misc_feature (521)..(523): n is a, c, g, or t
  misc_feature (531)..(531): n is a, c, g, or t
  misc_feature (534)..(534): n is a, c, g, or t
  misc_feature (539)..(539): n is a, c, g, or t
  misc_feature (564)..(564): n is a, c, g, or t
  misc_feature (568)..(569): n is a, c, g, or t
  misc_feature (581)..(581): n is a, c, g, or t
  misc_feature (585)..(587): n is a, c, g, or t
  misc_feature (599)..(599): n is a, c, g, or t
  misc_feature (602)..(602): n is a, c, g, or t
  misc_feature (613)..(613): n is a, c, g, or t
  misc_feature (617)..(618): n is a, c, g, or t
  misc_feature (622)..(622): n is a, c, g, or t
  misc_feature (635)..(635): n is a, c, g, or t
  misc_feature (641)..(641): n is a, c, g, or t
  misc_feature (646)..(646): n is a, c, g, or t
  misc_feature (648)..(648): n is a, c, g, or t
  misc_feature (657)..(657): n is a, c, g, or t
  misc_feature (661)..(661): n is a, c, g, or t
caaanaataatttacaggcacgaacaggccaatgtggatcttttaaaaccaaaacagattggagggattggatggagatgccaaggaataacagatgtgggaaagatattaatagaaaagtttcagctgaagaatctttctgaacttcagaccantagctttcacnagttagtttctcagagacattcaaccccccaaaataaaaatgctgtatcagtgcactctaatctgaactctgaggctgtaatgaaatcattaactcaaacatctgcaactgtggaagtaggcagatggaataacaacaaaaagagccccataaaagcaagtgacttgacaaagtttggtgattgtggtggtagtgatgatgaagaagagtccacagttataagtgtcagtgaagacatgaacagtgaagggaatgtagatttngaatgtgataccnaactatacacgtntgcgcccaacacatntcagggtaaanatnattctgtcttantagttctcagnagtgatganagccnnncagtctgnaancagtnagaatgaagaggaactttatgtttngttnnaaatagtggccnaagnnngtcattaagtgncgncacaggaagtntgtnntgtnacaatgcattgtntgtaantgacncnactcctggnatgngtgctgatacacacaattcttaaccttggaacgaggaaagaccaggcaacgtgaggttgccatcgacggaacgaacaccgacgacggacacgaggatgaaagacaagtgacacgaagaattcaatcagaccatgaccgaacatgaaagatgagttctagtgatgaagaagacttcctaaataggcagaaaggcttaacacttctgaagttgaccaagcagcagcaatagacccctggtctgagtatcaagcagttgggtggttttgcactaattaactttccactggagggactaaacgtacaggtctaacaagagaaccccttaacacagatcacggagaaacaaga

SEQ ID NO: 571057 - DNA, 725 bp, Homo sapiens
  misc_feature (5)..(5): n is a, c, g, or t
  misc_feature (155)..(155): n is a, c, g, or t
  misc_feature (166)..(166): n is a, c, g, or t
  misc_feature (429)..(429): n is a, c, g, or t
  misc_feature (442)..(442): n is a, c, g, or t
  misc_feature (455)..(455): n is a, c, g, or t
  misc_feature (470)..(470): n is a, c, g, or t
  misc_feature (481)..(481): n is a, c, g, or t
  misc_feature (484)..(484): n is a, c, g, or t
  misc_feature (496)..(496): n is a, c, g, or t
  misc_feature (507)..(507): n is a, c, g, or t
  misc_feature (516)..(516): n is a, c, g, or t
  misc_feature (521)..(523): n is a, c, g, or t
  misc_feature (531)..(531): n is a, c, g, or t
  misc_feature (534)..(534): n is a, c, g, or t
  misc_feature (539)..(539): n is a, c, g, or t
  misc_feature (564)..(564): n is a, c, g, or t
  misc_feature (568)..(569): n is a, c, g, or t
  misc_feature (581)..(581): n is a, c, g, or t
  misc_feature (585)..(587): n is a, c, g, or t
  misc_feature (599)..(599): n is a, c, g, or t
  misc_feature (602)..(602): n is a, c, g, or t
  misc_feature (613)..(613): n is a, c, g, or t
  misc_feature (617)..(618): n is a, c, g, or t
  misc_feature (622)..(622): n is a, c, g, or t
  misc_feature (635)..(635): n is a, c, g, or t
  misc_feature (641)..(641): n is a, c, g, or t
  misc_feature (646)..(646): n is a, c, g, or t
  misc_feature (648)..(648): n is a, c, g, or t
  misc_feature (657)..(657): n is a, c, g, or t
  misc_feature (661)..(661): n is a, c, g, or t
caaanaataatttacaggcacgaacaggccaatgtggatcttttaaaaccaaaacagattggagggattggatggagatgccaaggaataacagatgtgggaaagatattaatagaaaagtttcagctgaagaatctttctgaacttcagaccantagctttcacnagttagtttctcagagacattcaaccccccaaaataaaaatgctgtatcagtgcactctaatctgaactctgaggctgtaatgaaatcattaactcaaacatctgcaactgtggaagtaggcagatggaataacaacaaaaagagccccataaaagcaagtgacttgacaaagtttggtgattgtggtggtagtgatgatgaagaagagtccacagttataagtgtcagtgaagacatgaacagtgaagggaatgtagatttngaatgtgataccnaactatacacgtntgcgcccaacacatntcagggtaaanatnattctgtcttantagttctcagnagtgatganagccnnncagtctgnaancagtnagaatgaagaggaactttatgtttngttnnaaatagtggccnaagnnngtcattaagtgncgncacaggaagtntgtnntgtnacaatgcattgtntgtaantgacncnactcctggnatgngtgctgataaaaattctttcttgcagtagtcagactaggcacgtttggttgcctttaagaaaaa

SEQ ID NO: 571058 - DNA, 224 bp, Homo sapiens
gccctttttttttgaccccgggggttggggtgagaccgggggaacctgtgccccccccccccccacccggtttttccgggtcccccgggggggccccgggggccctttcccccgggtccccccttggggggcaaaccccgggtttccctcttttttttttcccgggggggcccggcccttttgttttttcccaaaagggggaaaaaaaaaaaggatttttttta

SEQ ID NO: 571059 - DNA, 702 bp, Homo sapiens
  misc_feature (614)..(614): n is a, c, g, or t
  misc_feature (648)..(648): n is a, c, g, or t
  misc_feature (661)..(661): n is a, c, g, or t
aggactcttatagatacagtgttctatggaaaaaaaaggccaccatggaggcagaatatgtgtcatatagtataggctgaaaatgaaagataagcaataagatctgagaaataattccaaacgttgtcaatcccatactctggcagacagtcatcataaaagctatatacttgcataaattgtcggctctagttattacctcagaatattgtaatgagttgtgaataacacaccattaatggaacaagaagagtaacagtcaccagtgaataatatactctgagtacatagtcaaccatgaataagtagtttgtatccggtgataatccaccaattttaaagagttccataagatcatgaaattgaccatgaaaatatcaacagacagtaacagggaaacgaacctcatgcacatttgattcttgtgttaaaatttcctttgccttctcacacagcgtccgaacttggttctagtacagcagcttacactcattcagatactcaacccactagtccaactagttggtgaacgccttgtcgtccatgacggcccgatcccgaagcggataccaagccccagaacggctgccgccctcccccctccccacccgccnccggccccggcccgggcgccgctcccctctcccnccgccgccgtcgncaggtcccacagggggaggactgagccgggtagggcggccg

SEQ ID NO: 571060 - DNA, 192 bp, Homo sapiens
cttttctcacactcataacaaaactactaatactaacatctcccccagttacctccatatgcccagtttcctccatacaccccagtttcctccatatgcctcaatttcctccataagccccccagtttcttccatacaccccacagtttcctccatacaccccacagttatctccatatgcccaggtatgca

SEQ ID NO: 571061 - DNA, 229 bp, Homo sapiens
ctctacaggatccttaggaggagggcaggtcaatgtcaagctagtctggaagtagaagctgagacttgagacaggaagaggggggatcttctagcagcgagaacatgcacgaaggtgcctagccaaagtgcggtccacagtggggccttacctgtggcatgagtgaatcaatgaacctaaggattcagacaacattgctagtttgaaggggccttaagtccagaattgc

SEQ ID NO: 571062 - DNA, 269 bp, Homo sapiens
atcagtgttggacattagatctttgtcacatgcattgttgcaacagttttctcctattctgtaggttgtctgttcactctgttgacagtttcttctgctgtgcgaggcttcaagaagaaggatccgattggttctgtgtctgtctctcttggtattctcagacttatgtagtcatccatatagagaggtgattaggaaacagcacacgatagcagaatctacataaaatgtgggaattaaattagttaccagcatacaaaactactata

SEQ ID NO: 571063 - DNA, 370 bp, Homo sapiens
  misc_feature (44)..(44): n is a, c, g, or t
  misc_feature (210)..(210): n is a, c, g, or t
  misc_feature (324)..(324): n is a, c, g, or t
  misc_feature (333)..(333): n is a, c, g, or t
  misc_feature (356)..(356): n is a, c, g, or t
  misc_feature (359)..(359): n is a, c, g, or t
gaggctcgattctcatcggtgtcatcgggccccttgctttcctnttggcaggccgtcgcagggagcagccgcccgtgacaacggcaggcgcaagcaaggccaccgcagccaccgcgattgacgagctctacaaatgaccgcacccgctattcgcatcgagcatctcgtcaagacctatccggctggatcgggacagacaaagcgtgccgncaacgacgccacgttcgacattcccgcaggtcagatcgtgagtttcttgggccccaacggcgcaggcaagacgactacgctgcgcatgatcctgggactggctcggcccacgtncggctcggnccagaatcttggccacgataggncgnggctggagcat

SEQ ID NO: 571064 - DNA, 294 bp, Homo sapiens
gaaccctatccatacatattccgaaatagtttttgatctaagatcatgaaatatgatccacctgcttgatttaatagcgtattatagaaggaaactatttggtccattttctatttgtctattttatacaaaaaggcaacacaattgttacactttattcagattacaattgattagagtgattatgaattaattagtgttctacaccattactcaattcttaaaaattagaaattgctgtagcagtattcactataacttaacactacgagagacttaaaaaacagttactgc

SEQ ID NO: 571065 - DNA, 385 bp, Homo sapiens
tatgagcttgtcatgtctacttgtagacacgtttgttcttaatatgcatagtctactgcaggtgtaaaaccgctgtaacctcaaatttagcacatgttccagaacaagcattaaataaaacttatttcaggctgtttgtatatttacatcctgaaatgagagaaaacaaagaagattcctggggtcattggggagtgacaaaactagcagcacgtgagttttgcaactttctaatctttcccccttaagattaccaaatggaaaacccttattttaaattaaaatgacttaaaattaatttggctttgaaattctcttgagattaattttgtgattatttataagacaaacgacaaaaccaaaggtaaggatcacttatttgaag

SEQ ID NO: 571066 - DNA, 240 bp, Homo sapiens
ggtttttcatttttatttttttttccccccctttccccctccggccccccaaaaaattatttattgggttttaagggcacaaaaaaaggcattgtttcacgcccgtttggggtggaaccccttgggttaaggggaaacaaaatgttgctttttttgcggtttggaaacaggggcttgctttaaattagtaaattttgaaaaagctttcctggcatgtttaaaataaaaggttggggggga

SEQ ID NO: 571067 - DNA, 217 bp, Homo sapiens
  misc_feature (10)..(10): n is a, c, g, or t
  misc_feature (40)..(40): n is a, c, g, or t
  misc_feature (63)..(63): n is a, c, g, or t
  misc_feature (69)..(69): n is a, c, g, or t
  misc_feature (93)..(93): n is a, c, g, or t
  misc_feature (136)..(136): n is a, c, g, or t
  misc_feature (165)..(165): n is a, c, g, or t
  misc_feature (182)..(182): n is a, c, g, or t
  misc_feature (193)..(193): n is a, c, g, or t
  misc_feature (211)..(211): n is a, c, g, or t
cactcaccangataaacattgctgtatgttacagtaaagntatctggagagaacacataaatnattttngcataccattagagaaaccatttntaaaactcaaatgaccacataaagcttatcaaggagtctagantggttttgttttataccatatgggatgangaaaatagaaatgtcantagactcattngtgggtgctcttgccagntgctga

SEQ ID NO: 571068 - DNA, 514 bp, Homo sapiens
  misc_feature (398)..(398): n is a, c, g, or t
gctctttgtatctgttgtctctccatcccacacatacatataatagggagaaatacacagcataatgtattttagaccgcctatattacccacccagagagcaacatattctctcctccctctgctcatataatagtatagtgcgcccccccattctattctcgccaacgtgttctcctctcccccactaatgttcttgtgcgctctcagagcgcatcacccgttgttgtttctctctttgggggtgtttttgtgccgaggagacacccctgagtgtcctctcttctccctccagagtgtggtggcacactcccctcgcgctggcagagtgtgtgtgtgcgtctctctcagctgtgtctcctctccctctctcacactatgtgctcaccaccctttantttttatctttctctatctcccacagagatcgcctctatatttgtgaagattttcaaaaaataaactgtatctcgacaatttgtatttctcccccacaacaaataacaaacaaaca

SEQ ID NO: 571069 - DNA, 328 bp, Homo sapiens
aggagagaaggggcaagacagaacggagggacgtcatgggaaatccttttcgcgacgggggttcaagtggtagcaagcgtagccgacgaaaccgccagcgcaacgcaccgcagccgcgttcgccacagaggcggaactcgtggccataggccatgcgcgaagtacgcggccagtacccacaacaccaaggcagcgccccaggccacgccctgccgtgatagttgccagcggctgttcttggccgagttgcttgagggtcctcggcgatggaaaatgtcggtctgtaggcgcttgctccctgcgcctcgacggtgacttccggaacgcg

SEQ ID NO: 571070 - DNA, 214 bp, Homo sapiens
gctcgagcctggcgcctcgcggcaaactgagttcaaagtgtggggagggtcctcttcccgggacgcagccttcccgggcatggcagacggtgccccggttagacagagccgtgacacccggcagcgagtcccgtcattctgaaaggcgccgttcgtccgaccgctcgcccgctcctcccggcgtcgccgccgcctgtttccctgcccgcgcccc

SEQ ID NO: 571071 - DNA, 287 bp, Homo sapiens
tcaacgctttatacttcacccagtaactataggtggaagtggaagtttgttatttcaggttgacccagaaggttctcaactctgggattactcatgccagatacttgtatttggtagactggttgttttggctatacaacagctactttgtaagttactgtaaaatatcatgtaattgatataagtaccacatattttaagtatattatggaaagtctgaacttatttgtgtgagttgtgtattgtagttaatggcaataaagacaatagcctaatagtactacagg

SEQ ID NO: 571072 - DNA, 193 bp, Homo sapiens
  misc_feature (165)..(165): n is a, c, g, or t
tgtccaaagcgtatacccaaattagcgtatgttcctgcttataatgtgggagctaaatgataagaacttatgaacacaaagagggaaacaacagacactggtgtctacttgagggtgagggtgggaggagggagaggatgcagaaaagatcactattcgggtacntgggcttacttgtggtactatcgctttg

SEQ ID NO: 571073 - DNA, 412 bp, Homo sapiens
atccatgaagtgatgcaggctgctcttccctcatgtgagaaaaacctgtttccctctggttcttactggctttgcacctggtggctattacaaatcagtactgcagtatgtcttggacctggaaagttccattgtccctgtctcccctcttttctcggcctagtccagagtcctgttggtggccaccctatgttgtcaccagtcagttggtgcagggggccctttcattggtaaggtccctgtcataccttcattcagcctcttccaagagcagaggaacaccagtagtccacacgtcagtgcgtgaccagaaagggccttgtggcatcagtggacatgcttcattagcggaagtgtcaccatctcaggccttggttcacaggatcaccagtaattacatgtgttatcccaa

SEQ ID NO: 571074 - DNA, 221 bp, Homo sapiens
ttatgtcatagatactacataatttctaggctaatctgccaaatactatccaagacaaaacttaaatcaaaacttacagaaaaagtggacaccttttactcacacttaatactagtcaattttccaggaatttttgggcagggaatattcccaaatcgaaacgataacactatccccgactcgcggatgctgtcacgtattccttcttgcttgtaccgctg

SEQ ID NO: 571075 - DNA, 198 bp, Homo sapiens
tcgcccgaccaaggagctggaggctacagtgaactatgatggtgcctctgaatagttgctgtactctagtctggtaacacagcaagaccctgtctctctatcttgtctttttttttttttttttttggaaccgggtttccttgttgtgcctggggttgggttgtggggctgggttttgggggccttgccccgggttca

SEQ ID NO: 571076 - DNA, 472 bp, Homo sapiens
tagatgatggggtatgaccatttttgctagttattgggatttttttttttaattaagttctggggtacatgtgcagaacatgcaggtttgttacataggtatacatgtgccatggtggtttgctgcacccatcaacccatcatctacattaggtatttcttttaatgctatccctcccccacccccatccccttgtccatgtgttttcattgttcacctcccacttacaagtgagaacatgtggtgtttggttttctatttttgtgttagtttgctgagaatgatggtttccagcttcatccatgtccctgcaaaggatgtgaactcatcctttattatggctgcatagtattccatggtgtatatgtgccacattttctttatccattctgtcatagatgggcatttgggttggttccaagtttttgctattctcacagtgcctcaataaacatacatgtgcatgtgaaaa

SEQ ID NO: 571077 - DNA, 449 bp, Homo sapiens
  misc_feature (83)..(83): n is a, c, g, or t
  misc_feature (85)..(85): n is a, c, g, or t
  misc_feature (236)..(236): n is a, c, g, or t
ccccctcttccttgctgccagggtcggaccctccacaaccaaaggacccctttgttttctataggccctggaggagttgggcnanccgccccccccccccccagggcaggggtggttttggggaggcagggcaaccttccggttttgggcactggtgggttggcccccaaaaccccaataggacaaaaggggttgggtttgggcagcccctttggttagaagggtccccctggccngccaatttcccttcccccaaccccgtgtcctgtggtttggttgggggttcccaaccccccctggactgcccccccaggttgtttaaagtcaaaattgtattttggatttttacccaactgtcccgttcccccccccccaaaaaaacccaaaaaaaaacccccaggggatggggggccaaaacaggcaaaaatttataaacaaacaggctttta

SEQ ID NO: 571078 - DNA, 152 bp, Homo sapiens
gctgtgggtgatctagaggatctggctcccactgggtgccagaatggtctcaaactccgggactcaagcaatcctcccgcctcagcctcccagatggctgggattacagtgttttaaggattggaatgtgacgtctccaaattccagacaca

SEQ ID NO: 571079 - DNA, 376 bp, Homo sapiens
ttcaagtggaagcctcccatatttctccactatatttttgcaagtgcttaacaaaacagggcagggcaaaacaagggtttagggtggggaggggaatagggcagtagtcaggagtctcccctaattatcacagtcaggcctgaattagtaaccttgaatatcaaacacagactctcaaagtataggacagagacagcagggcaggtaattattaagcacctactacatgccaactacagttctaagaattgaaacagggcagggcaaaaagggcaaggagaaacgaaaagataagacagtgaaagagaagtcgaagtcaggcccggcacggtcgtcacgcctgtaaatcccagcactttgggaggccgaggctggt

SEQ ID NO: 571080 - DNA, 235 bp, Homo sapiens
  misc_feature (2)..(2): n is a, c, g, or t
  misc_feature (6)..(6): n is a, c, g, or t
  misc_feature (17)..(17): n is a, c, g, or t
  misc_feature (67)..(67): n is a, c, g, or t
  misc_feature (69)..(69): n is a, c, g, or t
  misc_feature (79)..(79): n is a, c, g, or t
  misc_feature (153)..(154): n is a, c, g, or t
  misc_feature (159)..(159): n is a, c, g, or t
  misc_feature (215)..(215): n is a, c, g, or t
  misc_feature (217)..(219): n is a, c, g, or t
  misc_feature (221)..(222): n is a, c, g, or t
gnggtnattcccatgcntgtgatattgtaagcagaataaatgtctaaagtaggtgtaaatagtaaantntatggcttanagttttaaaaggaaagaaaaaacatgtatctattgatactgccatggttcctcacaggcctggaatattctccnntaagnaattgtatttttttttttttttgctttttttttttttgtaacatggctttgtaaangnnntnntttatatgtttgt

SEQ ID NO: 571081 - DNA, 508 bp, Homo sapiens
ctgaggatgcatcagttaagctgatacttggagcttgagaaagagccagccataggaaggctccatgcaacactgcagctgaggagtagcacgtgcagaaaggcaactgaggcagcaacgtggaggaggctaacggggagctggagttgataggggaggggttggcagggactagattgtgcaggacctggtggttcaagtaaggagtttcactttcattctcggtgcaatggaaaactctagaatattttaagctggaaagtgctgacatggtctgagacatggtttaaaagatcacagacaatagtgtacttgaaccacggttttcgaagaccctcacagaaattactttccctaaataatttgtgaaggatacagttaagaaactgtgaactaaattttgctactttccctaaataatttgtgaaggatacagttaagaaactgtgaactaaattttgctaccatatccaatatagcaagatcctgtctctaaacaaaataaaac

SEQ ID NO: 571082 - DNA, 221 bp, Homo sapiens
  misc_feature (27)..(27): n is a, c, g, or t
  misc_feature (47)..(47): n is a, c, g, or t
caagtcagggaacaggtgtgagccatntgcccggctcctcagtccantaatactgaaggtataaattgtataaagatgtttagaaagttctaattcaatgcatttttgcaaatttgactccatgaaagtgcattatcacgaagctgaatttgtgtaagcattgtgcatgtatgtaaaaacattgcaacttcctcaataaaatatcttctttttgtacatcc

SEQ ID NO: 571083 - DNA, 338 bp, Homo sapiens
gggccaagttgctgaaaaagttttggtttaacccgaagattagtggaaaagagcttgtccctgaaccccggttctccctctgtttacagaagtgtgttgagtcccgttggtgaaggaagaggtaaccaaaaatgcttaattttttttccctggaaatggcttccagaaaaggaagaatttggacccccggccgaaggggaaaagatagtttatagtattttctaacctggttggtttttgtaatgaatggtgattttaattagtccttagccctaatgatgtttttttcccgtattactcctgaatgcttctttaattaacccgggttccaactgcca

SEQ ID NO: 571084 - DNA, 391 bp, Homo sapiens
cgatactgtataggtcagactgtctaggaattctgtcacatatacacacacacttggccaaagtaatatcgttttattccatgtagaacaaattatgggcagaaagtaaagttagttttagaagtgctgtgtgtggatgtagaattgtactcttatacagggataagtgaattagtggctcttaatataaccactgctttagcccgatacacacaatcactgatacatggaccactggttattaggccagatatatattcatatatgtctagagtatatcatgtgtgtatgtgttgcttacgatgactagcttcagagtctctcatctctattaatcactgtatatacagcaatactgaagacttgagagaatgcacattatgtcggtgct

SEQ ID NO: 571085 - DNA, 148 bp, Homo sapiens
cacgaggggaatttccataatttaaagtcttgagtcatgatatgacactgacagaattcaagttcatctggtagatggagtactcacaccgaatgtggggtcgccttgtaagccttgtgtacatcctgactgttgcctacttttggag

SEQ ID NO: 571086 - DNA, 489 bp, Homo sapiens
taaattcgcggccgcgtcgacggagttgatgggttaaattgggacatacagagtcaagaaacagatacctaaaatagagtgcatgtggttggtgcttacataaatgtttgctgtgatctgggacagaaatgatctgatagtcatagggtttgtttcctcatctccttcacatttttactaaaatattgctgccttaggaaagccttccttggtcatcctatctgaaattgcaatattcatgacctacttccttaacactcttgtccaatatatcctaataagtcctgtgtcacttctacactatttttttacctgagcatttatttatattaaactacatatatgcttacttatttatcatgttttcctaatagaaggtaagctcaataatggaactttttatctgttttgctcactttgtagctccagtgcctgggacaatgcctgacacttagcaggtcgacgcggccgcgaatttagtagtagtag

SEQ ID NO: 571087 - DNA, 651 bp, Homo sapiens
gatctagaggaccccacccgggtcttctccaagccgggtgacactttcccagtctttcccggtccttcaggaccatgacactcaggatgagcaccgggtcagtcactcggcaaaatacatctcacctggggctggtggaccgctctcccatgactagaccgagatcatgtggtctggacaaataaaaaagaaacccacacgcagaagtgatgtgcatgacatcgggagggcaggggacatggatacatctaatacattatgtcaacttcaattagcgggtccagggggcatcgaggggatttctccagggcaacaggaccagtttttcttgggtaaaaacggataactatgtcccccattcattcatcatcccttacaatatgccatggatcggaaggggcatcccaaggtcctagatgtaaaaaagtgaacaagggtccatctgagaggggaggggtaaggtacttctataattatagtcaattaagaaagagagcaggggaaaggggaccaagagcatgacagagaaaatagcagcaacaagccacgggaaagacagaagactggagagtgagcagtcctagaagggatgtgctgtgggtgtgcctatcatatacgaggggggagggggacagctgtcccctttttgta

SEQ ID NO: 571088 - DNA, 1203 bp, Homo sapiens
gttccgcgtctgtgctgacctgtccgtcccgagcgcgcagcctgcggtagtgccaggtcagagcagcccaccatgtggatggggagggggtggaggctgcacccctggcccacccatccaccagcagccgccggagcgccgcgtggtcaccgttgtcttttctcggcctcctgctggacctcctgtggccttcactgctgctgctgccccatgctgaccgggctgttggagagccacgtgctgtgcccactgaccccctctatggctcctggcagggcggggtggacttggtttgccaactgacatcgtggatgccagtggagaagaggtacaacagtgtcctgtacggaggtctcatttggctcggcattctctgtccatgcagtttctgtgtgcgcacactcactggggccaactctgactgactatggggaggcgcccggtgatgcagctgtgcctgaatagggtgaaggccacctcatatacagacatagaagacacctctcgagagctatagcggactacctggaacatccaggctgattgggggcatcagacaaagggaacagtcaaactactccacaggaacatcagtatgattgaaccatgtggctacgcaatcatggcaccaacaagtacaaagagcagtaggaggaccataagagggtagagcatatagatcaatgaaaacttcaaacactgaggcccaaataagcacaagaagacctaccatgcaccacttggacatatggcaaacacatagagaatctgtcacaatgaatccttacggcaagacacatcacgaagccgatgaacagctcacattcataacttgagtaaccactgcacaagaaagataacatagagccccaagtggaggaacaacggatacgacacaaacaaatacaacaacagcaacagagattacaagaatacaatgacagaaacaatgaaaacatggactcaaaaaaaacgccatagaaacagctatatacaagaagacaaataccaatacgcaagacacaagaaaaagaaataatatattgaatacaagtaaaacacacagaaaccaatcaagtagaaatagaccagaagaacatcagaacaacaaaattatcaacaagtaaaactgaatagaactaaggaatcatgaaaataacataacaaataacaacaccaatacaaaagataacaaagagaaga

SEQ ID NO: 571089 - DNA, 787 bp, Homo sapiens
  misc_feature (13)..(13): n is a, c, g, or t
  misc_feature (63)..(63): n is a, c, g, or t
  misc_feature (126)..(126): n is a, c, g, or t
  misc_feature (189)..(190): n is a, c, g, or t
  misc_feature (192)..(193): n is a, c, g, or t
  misc_feature (353)..(353): n is a, c, g, or t
  misc_feature (364)..(364): n is a, c, g, or t
  misc_feature (373)..(373): n is a, c, g, or t
  misc_feature (518)..(518): n is a, c, g, or t
  misc_feature (606)..(606): n is a, c, g, or t
  misc_feature (632)..(632): n is a, c, g, or t
  misc_feature (680)..(682): n is a, c, g, or t
  misc_feature (684)..(684): n is a, c, g, or t
  misc_feature (764)..(764): n is a, c, g, or t
gggggaggggggntcacggggggaaggtggcggggggcaaggcggccgtgcagaagctgcagncgaagggcctgagcccgcgctttcacaaatgggacatcgacgactcgcagagcatccgcgccntgcgcgactctggcgcaaggagtacggggggctcaatgtactggtcaacaacgcggccgtgcnntnnacgagtgatgatccaacgccctttgagattaaatgctgagatgacactgaagacaaattctttgcgacttataaacatgtgcgacgcgttactgccgataatgaaacctcatgggagagtggtgaatatcagtagtttgcagtgtttaagggcttttganaactgcagtgnagatctgcnggaaaggttccacagtgagacactcacagaaggagacctggtggatctcatgaaaaagtttgtggaggacacaaaaaatgaggtgcatgagagggaaggctggcccaactcaccttatggggtgtccaagttgggggtcacggtncactccaggatcccgcccaggcgtccggatgagcagaggaaacctgacagcactccggtgaacgcgtgctgcccaggaccagtgaagncagacatggatgggacagacagtatnaggactgtggaggagggggctgagacccctgtctacttggccctcttnnntncagaaaagaatgaaaaatcatagaagttggttaacgacaaagttgtgcaaacaccggtcaacgtctgccttggaggttgntggttaataaaagatggtggaat

SEQ ID NO: 571090 - DNA, 179 bp, Homo sapiens
tatcgtaaaacctctgctctcataacctgtgcttgtgtatccttgcgtcactgcagtgagtgctctaggtcagcacgtgttgcctctgccagtgcagcactcgcatgtgcgcacctaaccccaggacccagccctgcctccttctccaggtctgttacctcgcgaactgcctttgacag

SEQ ID NO: 571091 - DNA, 271 bp, Homo sapiens
ccctggggcttgatgttggtgaaccgactgacataggaggacagcgagaccgcctgcttgaccagggtgaaggggtcaccgctcacgctgtccaccatgatgatcgatgctcccgatcagtcctcgtcgcccttgttgagggtatccagcagtcgctcctccagcgctgcgatcagcgacgggaacttggtgacctcgccgacgaagttcttccactggtactcctggatgaccgtcgcatcgtcggagtaggaggagcggaagttctcct

SEQ ID NO: 571092 - DNA, 149 bp, Homo sapiens
tacggaacgacaagaaaactcatggccagacatcccagggctaccccttaagaaggtgacctcccttcaataccacttcccaatccacccaagcagcaacagacaaatatctgtatacccgctaaaatggggtgcaactttctacttcc

SEQ ID NO: 571093 - DNA, 297 bp, Homo sapiens
gggccttcttcactttgtcaaagaggtgagtcatgtccgccagaggatctgtcgaaagccgtactccatcttccccaggataagccggctctggccagtctgacaaccatctttctttcctcccatccctcccttcaagaccccagaatcctgttctcccctgtctctactaaaagtgcaaaaattacccgggcgtggtggtgagtgcctgtaatcccagctatccagaggctgaggcacaagaattatttgaacctgggaggtggagtttgcagtgagctgagattacgccactgc

SEQ ID NO: 571094 - DNA, 367 bp, Homo sapiens
cacgtttattatgaacaaaaaagtgaaggacgtgagggttatgaccagaggagccatgttgagaagggtcacagcgatatgagcgaagtagtggagagagggcatgggtaccttttctcgaaatctccagtgcccgctggcgcagaggctctgcctccttgtacttgccccttttgccatagagcacagccaaattgttgagtgtggcagccacctatgaagacaggcctgtccccatcagacatttgggttgcaaaagagctatgggaatctgaggttccccacctcccagcagggcccaacactcactgcacaactctaagagacaaagtctactaccctggagccaggggctgaagggagggga

SEQ ID NO: 571095 - DNA, 110 bp, Homo sapiens
caatcatctgtctccctaaagcactccaggtagtagtagtcaaggtagtcaccacagcaagagtactaataatacctgacatggacaactgacatcataaatcttgcata

SEQ ID NO: 571096 - DNA, 321 bp, Homo sapiens
ccgatgtaaatatcacatgatactatcccttctcctcctctgatgtcttcatcacctcgccatgatcatgaagtgtatacattcactggtttgccaaattggtcagggtccccagcgtgaacgattgcctagaggacctggtagctaaggcagttgccataaaaattacaaccactgctggatagtcgggagcagcttactgtgtctggggcagaccgaccaccttctatctatgagtgccagctacatctttgggatcagtggtgtcgaggctgggctgaccaggagcgcaagtgaatacgtcagacagctggagtccag

SEQ ID NO: 571097 - DNA, 191 bp, Homo sapiens
aggacaaaaatataaataaagtaaaatctggtccctagtaataaaatgagaccaggagtcaggagatctgggcccctaaggctgccccgctaagctacccctttctggatgtcaaaggaagcctataactagagaggtgttccccaatttcccttccagagcagtattttatgtgcatgttttaaatgacc

SEQ ID NO: 571098 - DNA, 143 bp, Homo sapiens
ggcatctatgtggaatccaaaagatttcgggcaccgagggggttcattcttaccttctacccactctttttgcaagggcaccaccttcaattcaccacgccggcttaaaggcttccgcaaccttgtaatttttttttacccct

SEQ ID NO: 571099 - DNA, 341 bp, Homo sapiens
  misc_feature (45)..(45): n is a, c, g, or t
  misc_feature (89)..(89): n is a, c, g, or t
  misc_feature (111)..(111): n is a, c, g, or t
  misc_feature (134)..(134): n is a, c, g, or t
aagtgtaatttggttatgactcttttcaacccccctaaagcaganagctaattctgtaagaaagaggttaggagtagatattgattacnaatccatattcagcacttaaancatgagcaggcatcaatactaanacttccacctacatattcacttaggcctttatcatccttaaaacaattctgtgacaataccatattatctcattttacacaaagggaagtcgggcatggtggctcatgcctgtaatctcagcactttgggaggctgaggcagaaggattacctgaggcaaggagtttgagaccagcttagccaacatagtaagacccccatctcttt

SEQ ID NO: 571100 - DNA, 401 bp, Homo sapiens
  misc_feature (45)..(45): n is a, c, g, or t
catcagcagtgggatggataaattctggtacattcattgaaatgnaactacgcataaatgaaaaagagcaacttgcaacaacacgtagtatattcatcaaaataatgttgagcaaaataagccagacacaagtaatacattctgtatgattccattacataagtttaggaaaaaccaaccaatagtaaattgataatctgaacagtgctactttttggaggaaggtcttgactaagttgggggaaggaggatccttcctggagcctgaaggtttcttgacctgggtgttactaccttgagtgtttttttacttaaaattccttgtaaaatttaacttaggatttatgcatttgacttatgtaaattatacttcaataaaatgtttctacaataaaaaaaaa

SEQ ID NO: 571101 - DNA, 1073 bp, Homo sapiens
ggtgcagcgagagctgcgcggatctcagcgcgggagctgtgcttctgcgtgcaggagcccgtgtgacaaggcccactgctctgagcctgaactatgagcacctcctagtggactgcccaggcttgctctgctctgacccttctgctggccagctctgtgcacctgtcaggcccctgacggagggagctgtcagccagggaaaaccgataacaccatcaccatgacaaccagtcaccagcctcaggacagatacaaagctgtctggcattatcttcttcatgctgggtctgggaacgctgctccccgtggaatttcctctcatgacggccactcagtatttcacaaaaccgacctggacatgtcccagaatgtgtccttggtccactgcctgaactgagcaaggacgcccatgcgctcagcactgccccctgccagccaccccttgccctccaagccgcaacctcctctcactgccactctccccaacaacttgtcaatgagccctatctcgccatgccctgcccccctgcatgctcattcaaccttaccctccaatcttcctttaccttgcattcccggcagggtatccccctccagcttcccgctacgcgatccctgcgcgcaaggccctggcatgcgccagtccctggctgggctgctactcgtgatccgccctgccaccccctgcgctgaacagcgtatgaccaggctctggcggaattgtcctcctggggcgcctatcattctcggctccactccaccccaactccactcgccacgcacttccgcctggcttcgcatttcaccgtcgtcgccgtccatgcagctcgccccacactcccgcttacgccgagccggcccatcgcgcctggctcctaggacggtccttaggccttcggtccccttctccttcggcccctcgccacacgcgccttctctacccggcgccaccccaccacagtgttcacgttcgaacgcgctgggcgcccaccgcggggccccttaacgcccagccggcgccctcccctctctctcgcccgttcccccgctcgtgcgccccgactcgactgtcg

SEQ ID NO: 571102 - DNA, 327 bp, Homo sapiens
  misc_feature (2)..(2): n is a, c, g, or t
  misc_feature (50)..(50): n is a, c, g, or t
cnattctctttcccccgggaaagttgaactgaggtgaccaagtaataganttgaaaagggagagtgtcttcagtgcaatgtggcatcctggattgggtcttggaacaaaaacaggacattagtgggaaaattggaaatctgaaaaaagtctgaattttagttaatataccaatttcagtctcttggttttgacagatgtaccatggtgatgtaagatgttgaccttggggtaggctgggtgaagggtatacaggaactctttgtactatctctgcaacttctctgtaaatctagtatcgattcccaaaataaaagtttatttaattt

SEQ ID NO: 571103 - DNA, 103 bp, Homo sapiens
ttcgccagacttccaggctgatttgccaaatgccagagaatgataacctagtcaaagaacttacgggaagctagacgaggacattcagaaagagcgagtcacc

SEQ ID NO: 571104 - DNA, 205 bp, Homo sapiens
tgcggcctctctctaatgagctgcagtttgagggagacacctacggtgctgttgcttatcttggatattcctggtagatatttacttctatcactatgctctttcccagtcacagcatggattccaaggctcctggagattgccttgtccagtgccagcaccccaaagatttagacctgtcacagaaagcttcttaaaatcccca

SEQ ID NO: 571105 - DNA, 181 bp, Homo sapiens
gttgttgttgacctgtgctgaagggctggagcaaccccaacctggggggcggatggagcaggctttttccagaacgacccggcctcaatcctcatagaggggagaaccatcaagaattggtcatcgaaggaggtacggtgccagcaagcttggagtgggctaattttcctggcaggctgaa

SEQ ID NO: 571106 - DNA, 100 bp, Homo sapiens
cggagactctagaggactccccagatctgtcgacaggttggtaggccaaagggcccgatggtgaagcatgctgaattctcaaggctatggggtccttcaa

SEQ ID NO: 571107 - DNA, 413 bp, Homo sapiens
  misc_feature (3)..(4): n is a, c, g, or t
  misc_feature (7)..(7): n is a, c, g, or t
  misc_feature (12)..(12): n is a, c, g, or t
  misc_feature (178)..(178): n is a, c, g, or t
  misc_feature (368)..(368): n is a, c, g, or t
  misc_feature (386)..(386): n is a, c, g, or t
  misc_feature (398)..(398): n is a, c, g, or t
ganngancctancaggctggaatgcagtggcatgatcttggctcactgcaatctctgcctcctgggctcaagtgattctcgtgcctcagcctcctgagtagctgggattacagatgtgttccaccatgcctggctaatttctgtatttttagtaaagatggggtttcaccacgttggnccagggctggcttcaaactcctgaccctaagtgatctgcccatcttgggcctcccaaagtgctggggattacagggcgtgacattttgttgcttcgggccattcagttatttttctgtttccttagtaggagcccaatggataatgaaggattaggctgcagagatccaaagtatcccggaaatctattnctgattttttggaaaagnatttaaatgggnttttcaaaatagttt

SEQ ID NO: 571108 - DNA, 1409 bp, Homo sapiens
  misc_feature (642)..(642): n is a, c, g, or t
  misc_feature (949)..(949): n is a, c, g, or t
ggttcgacaatcatccgcatcttcttctgcgtcgccaggcgatgccacatcggtgagacaccatggagaaggtgaaggtcggagtcacatggatcaggatcatataggggcgacttggtacactcatggtctgactcgttaagctcatggatacacagctggcatgatggctcgccatgcaatgcagccccttcattgcagctcaatgtacatggtttaacatgtttaccaggtatgatgccatccgatggcggaaatttcatgagtcgaccgtgtcccgggatgcataactggcaagactatgatcatgcaactgggaaatcacgcagtcacgcatcttgccacgaggcgagatcccttccctgaatccgaagcgtgggtgccgatgcctggtgcggctgagctacatcgttgcagataccgactgggcggtcttcaatgcaccatgggagaaaggggtggggcttcactcttgcgacgcgggaggaggccagaacaaaggcgctctactcattctcatggccgctgtccttgctttgatcggccgcttctagtgtgtccgctcaggtggagtggttgacacgcgattggaacgaaatcgctattgatcgaaacacagcacatccaatcgaatccagtcantccacactgacgtgccgtgtgagacaactcaaacggtcgactataacgtaggacccccttgcgttcgcataagagatcagtttgcgattggaaccagagcttttgggttgactaccggcggatacagagaacgtcaattgagtcgaccgacgtccacttggctagttccacggtgggcacgggcaaggaaacgaacctggaagggatttgggccctcccctgtcggtgtgcacaaccctggtgaggggttgaatagggcgccgccggagggactcctcccctggaaaccggatcgatccgcgcttgnacctccttaactgggccgactgcgccaaacggctttgttggccgcaaaccggtgcactttcgccctgtatgggtggaaccgagcgatgggttcacttggggccgtttggcccttccacggtggttcaccccaccttggtgctaagaccgctggtcccggtcgcgtgtgtgaccctcggaaccctgaagcgggttgtttggagaaagaaactctggcggccaaacatcctgtgatggttaccttttccacgccaacgggttcggttgcacgactctggatccttgcgtaataggggccccccctccacagaggcgcctccctcgggaggctcacacaggctttgtcggtaagcccgcgtggggcggttcccctctggtgtctctctaacgagggggcagcgccgctcgcttcacctcgcgacctttcgaaccgttgtgcctgtggtatatggacgcccccg

SEQ ID NO: 571109 - DNA, 361 bp, Homo sapiens
cagtttgatggttacagatgagctatgatcctgccactgcactacagcatgggcaacagagctcttaaaaattaaaaaaaaaaataaaaaagagaaacagcacataaaaaagagcagggtgcgtgggctcacctgaggtcaggagttcgaaatcggcctggccaccttggtgaaccctcgtctctactaaaaacacagaaaatcaccaggcgtggtggcaggcaccgtgttaatgtcagctactcgtagggctgaggcgggagaaatcgctggaccccgggaagcggaggtggcagtgagccgagatggtgccatggcactcgggcctacgtgacaagagcgaaacactgactcacaaaaa

SEQ ID NO: 571110 - DNA, 328 bp, Homo sapiens
  misc_feature (267)..(267): n is a, c, g, or t
  misc_feature (283)..(283): n is a, c, g, or t
ttgaattatcactttggttaaatgaatgactattattagtggcctgtaatcctattttgatcaaatattttaaaccttcagtatctgacatactcccaaaatcaaatttaaaattctaaaattaagtcttttccagaagaaaaccctgggaagtccaagagagatatattaggcttatttggtatattaaaatcatatgggaagcactgtcaaataagaaatagtatttaactttgagttatatttgtatagctatgttaatatgtncccaaaattgtagggngattccactttcagatatgtcttggtatatggaaaccagtcatgg

SEQ ID NO: 571111 - DNA, 201 bp, Homo sapiens
ccccagggggccctttttttggggtttcccggggatttttttttttccaagtttgccctttccccgggggtggcaggggaacagacctttttgccctttgtttgggttgggcccttttttcctggtttccccggccccgttggggggttcctttttgaattttttttttttccccagggggttccccgccttggtttccca

SEQ ID NO: 571112 - DNA, 162 bp, Homo sapiens
  misc_feature (30)..(31): n is a, c, g, or t
  misc_feature (159)..(159): n is a, c, g, or t
caagagatccactcagccttgccctcccanngtgctcgggattacaggcttgagcaccacgcccggctaaaacattgcaaatttaaatgagagttttaaaaattaaataatgactgcactccagcctgggcaacagagcaagactctgtctcaaaaaanaaa

SEQ ID NO: 571113 - DNA, 158 bp, Homo sapiens
tacgctggttgtcctcgatattacaacttcaatctgctgttgatcatcttcaggtggaagtaacaatcgagtccagagctgagcattgtaaagattaatcgtggactatcataatccttgccagcatgtagcctggtaccaaactgaccattgtgctg

SEQ ID NO: 571114 - DNA, 866 bp, Homo sapiens
  misc_feature (866)..(866): n is a, c, g, or t
ggagcaggtagcagaccccccgaccaccagtcgagtggaccctcaccccaagcactgggtaaggtctgaagacagcaccagcagccatcaccccatcacgcatcgatataaccgacctatccacccagcattctagccatctcccctagtgctacttgcacccatgggcaatacggccagccatgtgttaggaactagcaatctccaggcaacagcacacactcggcgcgtgcttagctacacaacctaccagtacactcgtcgaccacaccaacggatcctctaacacactgctagcgacgacctatccataccaccacttctacccctagacgacagcactcactacacacctgcctccaccacacccctaacgccctagcgccaacacgcgacacgacccccaaatgagacacatccctagccacacgccaaaccacactcgcgcccctatcggaaaccatcagcacatagctcgaccgggcaacgccggcgcgccactcgcgtgagttcgcccacaccacgcccaaggcgcacccactgatggccctccccacccaaggcggcacccacaccctcgcgcagaacggcccaccacgcccacgcgttccgcccctcgcaccagccacactttgacccacctctgaccccgatacgttcgtctacaccacacgctcccgcacacccccataccatcggacccccaaccaaaccataacaacacactacaccaatcgcataccaactaacctctacacatactcccacccccaaacacatacccaccatcagccaaccacttctctaacacatacccacaccatcacctaaaacccccacctactcaggatcgcccctaacaatan

SEQ ID NO: 571115 - DNA, 370 bp, Homo sapiens
  misc_feature (17)..(17): n is a, c, g, or t
  misc_feature (33)..(33): n is a, c, g, or t
  misc_feature (50)..(50): n is a, c, g, or t
  misc_feature (70)..(70): n is a, c, g, or t
  misc_feature (96)..(96): n is a, c, g, or t
  misc_feature (113)..(113): n is a, c, g, or t
  misc_feature (207)..(207): n is a, c, g, or t
  misc_feature (217)..(217): n is a, c, g, or t
  misc_feature (266)..(266): n is a, c, g, or t
  misc_feature (282)..(282): n is a, c, g, or t
  misc_feature (357)..(357): n is a, c, g, or t
agccgggaatggctggnaactgcagacctgtcntcctggtggtccagggnccctccagcttgtggagccnaaactggggtgccgcctgcccgtctnatctcccatggagcccnaagcccctttgggcccagggacaccagccaggctctgtgctgaccctccttgttgcacccagccctggtctcagcagcgaccacccctgcctcnaccctccganatttgcatgttccacttaaccccgggcgggtggcaggtggaggtgtcanggcatgtggcgccttntgcaagggcagaacacttaaccttgaccgtggcggggcattgggtatccgcccccaataaaagcaattccaaccnttaaaaaaaaaaa

SEQ ID NO: 571116 - DNA, 460 bp, Homo sapiens
  misc_feature (4)..(4): n is a, c, g, or t
  misc_feature (238)..(239): n is a, c, g, or t
  misc_feature (250)..(250): n is a, c, g, or t
  misc_feature (252)..(252): n is a, c, g, or t
  misc_feature (257)..(257): n is a, c, g, or t
  misc_feature (261)..(261): n is a, c, g, or t
  misc_feature (267)..(267): n is a, c, g, or t
  misc_feature (271)..(271): n is a, c, g, or t
  misc_feature (275)..(276): n is a, c, g, or t
  misc_feature (279)..(279): n is a, c, g, or t
  misc_feature (284)..(284): n is a, c, g, or t
  misc_feature (293)..(294): n is a, c, g, or t
  misc_feature (297)..(297): n is a, c, g, or t
  misc_feature (310)..(313): n is a, c, g, or t
  misc_feature (333)..(333): n is a, c, g, or t
  misc_feature (344)..(344): n is a, c, g, or t
  misc_feature (388)..(388): n is a, c, g, or t
  misc_feature (394)..(394): n is a, c, g, or t
  misc_feature (439)..(439): n is a, c, g, or t
agtnaactggctcattcctgcttccagtgggaacaatttttcagttaaatcttgcttccttgcatgtcaagaattctctactggtaaatcttacaggtgtcaactttcattatcagggcatctattggccatctattaaaggccttacctgttttttctgtcatccagcaaatcttagactatttacttgtgtaaacattagatagcaaagaaactaagggcaaaaatctctagttcnntttagccttgntncctcngggngctggntggngggnnggngtttngtctggttnnggntcgggtggggggnnnnggtggcgcttcatttcaggnttgtctttggncatttcgggtgcctttgggtcttgggcgatgctcgttgccagtntctttnagaggccttatctcttgggctgctttgtctcctgcttagcgtgtncttgagaacacatgtcctggc

SEQ ID NO: 571117 - DNA, 325 bp, Homo sapiens
ccggcgtcttcagctgcataggaacatgtcatgcaccatcaggccgtcggcgcggatcctgccgtctttcacgaagaaatcgttcaccgggttggccttcagccacttcatcaccgtgtcgccatcggtactgccggtggcggccacggccttcaggtaggtggtggtggccgagtagtcgccggcctgcagcatcgacggcttcttcttcattttctcctcgaagcgcgccgcccactggcgcgacgcgtcgtcctggtcccaataccaggccgtggtcaggtacatgccctgcgcggccggcaggccgagcgcgtggatgtcg

SEQ ID NO: 571118 - DNA, 982 bp, Homo sapiens
ggcgagcgcagtggagcctggagagaaggctgctgggctgcgaggtgcgcgaggtgcgcgagggcagggggcaacctggaccccgcccgcacccatggctgccctgtctgcctgtctgggcctgtgctggcctgtctggactggatgctctgtgtgctgctgtgtgcactgcctttgcccgcccaggccaacatgcaaaatgtcttctgtaccaagacctcggacaccgtgtgtgactcctgtgaggacagcacatacacccagctctggaactgggttcccgagtgcttgagctgtggctcccgctgtagctctgaccaggtggaaactcaagcctgcactcgggaacagaacctgcatctgcacctgcagtgccctggctggtactgcgcgctgagcaagcaggaggggtgcctggtgtgcgcgcctgttgcgcaagtgcctgccgggcttcggcgttggccagaccaggaactgaaacatcagacgtggtgtgcaaagcccttgtgccccggggactgttctccaacacgagttcatccacggatatttgcagtggccacagatctgtaacgtggtggacatccctgggaattgcaagcattgggatgcagtctgcacgtccacgtaccaccacctggagtatggcccagtggtgcagtacacttacgcagtcagtgtcacacgatcccaacacacgcagacagtccagaagccagcagttgtccaagaactccttctgctccaatgggcccagaccccagctgaaggagcatggggaattgatcttcagttggactgattgtggtgtgaaggattgagattagacgtaatggcagtggtacctgggtaaatagacaggttaaataagcattgtatggaaggaagcagggtgtataggtagaaaggcgggttatgggcggagaagatatgagagagagagagagatatgagagcaggtaagaggatagaaaaaaatggg

SEQ ID NO: 571119 - DNA, 144 bp, Homo sapiens
ttagtagcggagcatcagtaagacgggactcagataagcggagcatcagtaagcggagcatcagtaagcggagcagtcacgcctgctggggtatgttgtgttgctcccttactgatgctccggctactgatgctcgcttactga

SEQ ID NO: 571120 - DNA, 269 bp, Homo sapiens
ggtcccggacattgtgtaagattgaatagacataatagtgattaaaggcttgtcaaggtcttggcaataagggtcagcaatagccttgtgtatagaacagttctggtagtatttggtagctgggggatggtatactgtgacacaacaagtatcttattcccatttcacagagaagacataagtctgggaaaaaaatttcactgtcatgatacttgcccacccccgacatatctaagactggcacgtatatttaatgaaattggggatgg

SEQ ID NO: 571121 - DNA, 191 bp, Homo sapiens
attagattctggctggaaatgcaacatctacaaggcccctggaggtgtaaattttgaacacaaaacatgatatcaagaaaagcagcttaggacagataggaatcaggagaggccttttcactctctgcccaggacctcattggacccttatccgagttggcccccttggaccttatcgagggggatcctct

SEQ ID NO: 571122 - DNA, 258 bp, Homo sapiens
gtcgctacagcctgcttcaggtgggagagtaacgtcaggcaagcatgcagcgcacggatagttgaactgttcaccagcaccctgcttttccagcaacattccagcggagttggaaccattttttccagcacacacccttacaacgaagtccctccccaaacccactttaaccatctcaagctaacacccaattacttgcaaacactggtataaaacacagtataaaacaattagaaaactgaaaactgataccaactt

SEQ ID NO: 571123 - DNA, 401 bp, Homo sapiens
gttcgtcatgataccgcctaatcacagcagatcctacttctcctatctctcgccagatcctagactgctggacatcactatagctactaggcagaacgaagagactcaacaccacctatcttcgatcccgacaggaggaggagcccccattctataccaacaactagtactgattatacggtcaccctgaagtttatatacttatcactaccgaggcatcggaataaatctcccatattgtacacttactactccggaaaaaaaagaaacatttggatacataggtatggtctgagctgtgatatcaataggcttcctagggtttatcgagtgagaacacacatatattgacagtaggaataagacgtaaacacacgagcatatgtaagctccgctaccat

SEQ ID NO: 571124 - DNA, 107 bp, Homo sapiens
actgtggaaagagaagaggatgaaaaagataaaaggaaggacgagacagaaaaagaaaggaggcaggacggggagtctcttatagccccccctctcaagctatcgaa

SEQ ID NO: 571125 - DNA, 457 bp, Homo sapiens
  misc_feature (212)..(212): n is a, c, g, or t
tttctctgagcatgagcccactgattggagctctgggtcatctctgtggcagaaaccacagagcagtgaatcagcactgatttctggtttcagtgtttctaaagggacatgagaactggaaggcgcttgcaaggcaatctcgaggcagagtccttcattatttgtgtgattattttccccaaatcattaccctcatctgtgctgggactttncaaagcttccagcctagcattcagggagcagctccctttctgcattaatatttcatcagcttccctcagtggctctccgagagtggcccagggaccacttgcgaccctttcagggaatccaaagtccaaattcttttcacggtcaaactgagatgttgtttgcccttgatgctctcattttctccagaaggtacaaataaagattttcagagcccccagcccccagccctggcctctgacagccg

SEQ ID NO: 571126 - DNA, 496 bp, Homo sapiens
ttcggggcagtgggtggctcacgcctgtaatcccagcactttgggaggccaaggcgggcggatcacgaagtcaggagatcgagaccatcctgggtaacacggtgaaaccccgtctctactaaaaatacaaaaaaattagccgggcgtggtggtgggcgcctgtagtcccagctactcaggagggtgaggcaggagaattgaacccgggaggtggaggttgcagtgagctgagatcgcaccactgcagtccaacctgggtgacagagcgagactccgtctaaaaaaaaaaacagaaaagaaaaaacacacttttttttttttggcccagcgagcgggagctctcttttccagttattccataacctggggggtggggatctcggcggggattggggccggggttaatgggcggattgggggaccccctctgagactctctcctgagattcccccctcttttttggttgtccagtggcttcaagctccctcggtcccg

SEQ ID NO: 571127 - DNA, 121 bp, Homo sapiens
aggtgattagaggactccggctaagtgatctataggctcaagtgatactactactcagtctccaaaacgctggaacttacaggcgtgagccaacgtgtacagcctcaaaaaattctttaac

SEQ ID NO: 571128 - DNA, 123 bp, Homo sapiens
agaaggctgatgtccacaagtggcctcacagccctccttgccacaggatcagcccgctgagcacatccacctggtccaggtggacctgccagtagagacttgcgggatgacattcaggatagg

SEQ ID NO: 571129 - DNA, 267 bp, Homo sapiens
aatagaatcgagctcggtacctgaacattcgtgtcccctggtagacactctggtagattgagaacttggggaagctgccattgtacaatatcatcgattgattaagatcgagggcctggagaacctcgtacacctggatctggctggactctgtctttcaacatagattgagaccatcgaggggctggacacactggtgaacctggaggacctgagcttgttcatcaaccggatctccaagatcgactccctggacacgaatgttca

SEQ ID NO: 571130 - DNA, 309 bp, Homo sapiens
tctggggagagatgcaccatgggaggatcccatgagtcaggaggttctggccacagctgatccatgattataccactccagcctgaatgacagagcaataccctgtcttaaaaaaataaaaactgtaaaacagttattgccttgaattttatttaggccttggggtacacaaagattcttttaggcaggatgcaggaccttggggtagaacacagaaaaacactggcataaaaataggtaaattgataaataaattcatctaaacaaaacacttgtgctcatcacagggcactgttagaaacatgaaaa

SEQ ID NO: 571131 - DNA, 100 bp, Homo sapiens
acaatcgagaatcatgagggcggttcgcgaggttcgatgaaatcctggcaggccagtgatgggatcatggtggctcgtggtgatctaggcactcgcgatc

SEQ ID NO: 571132 - DNA, 438 bp, Homo sapiens
  misc_feature (201)..(201): n is a, c, g, or t
  misc_feature (261)..(261): n is a, c, g, or t
  misc_feature (377)..(377): n is a, c, g, or t
  misc_feature (422)..(422): n is a, c, g, or t
  misc_feature (426)..(426): n is a, c, g, or t
gcagcagtgaagcagagagatgaaggagttgtcaagtgacacagcaagttagtgactcatccccaacatataacacaggactgtcatacaggggatccttattaaatgtttacaaatgaataaacaaattaaggtgccaaagcacttttttccccccccatttttttcatttaaaatttttttttatttcagtagtgtttnggggaacaggtggcattgggctacatgaataagttctttagtggtgctatctgagatttnggtgcacccatcacctgagcagtgtacactgtacccaatgtgtagtcttttatcccttgccacctccaccctttcccccaagttctcaaagtccaatgtatcattcttatgccttngtgtcctcacagtttaggtcccacatatgagtgagaacatacaangttnggttttccattc

SEQ ID NO: 571133 - DNA, 606 bp, Homo sapiens
ggtctgtctcttgcttcacacagtgtttggaacggaacatggatccgggagtactctcttccaagtgctccgaccgccctccgaatttgctctccgttggaaagctccgggaccatcttctacgtgccatactcctgactgctgggacctgaacaggcaccgtagttagtggttcagctccttcttggccaaacaaaccgatgagctcccagattgcgtgcaggaaatgtattactcaaccgatggtggaggggccagcgcgatcaacaagcctggtcgaattttgtatcgcatgcaatggccgtccctaatgaccataccttcatctcggggcttctatgtatcgaaccggcggagtgagtgtgagctctgaggagaaggcgtgaggccaagttcctttccctgcgaatctggcacgtaggagcagacgccgctaggggcgtaacgaagacgatctctctagtaaccatgtcattaactccagcgttgagcggggcctgcggcttcttctatcccagagtacattcaaagcaatacctcacgtcttgaagcatggagtgcggcgtaaaaccccgcatgaacgctatagtaaacgctgcctatggc

SEQ ID NO: 571134 - DNA, 306 bp, Homo sapiens
  misc_feature (15)..(15): n is a, c, g, or t
  misc_feature (115)..(115): n is a, c, g, or t
acatagcagcctgcncaggagtcctgtccatctgtggctcagacctgtggttgctgcacacaccatcaccacttgctggcagtgtaagtttctataatggaaaagctgaatttgnggaggcatcaaaaacaaaacaaaacaaaacaaaacaaaaccccacaaacccttgaagactacatctgcatagtcatttaagaattgctctctattccatttatacttaaagggtattttattcctattcagcatctaaattttcagttttatgtatttggcatatagattttaaattacaggttgagtgac

SEQ ID NO: 571135 - DNA, 444 bp, Homo sapiens
  misc_feature (8)..(8): n is a, c, g, or t
  misc_feature (26)..(26): n is a, c, g, or t
  misc_feature (37)..(37): n is a, c, g, or t
  misc_feature (85)..(85): n is a, c, g, or t
ttaaaaanaaaaaaagtcctcagccngatacggaaancccaacagtcaaagtttggatgaggaacagaatattttacatattccngcaagtgtttcccccacacattacctttttaattacaaaaggtggatataaccttaacccaagcaattaaagctagcatcacccaatattgggatgaatcaacatcatatgcctcttgatgtgatatactaagaaggacaaagtgtcaattctttggtattcctgtgaaaaatttataacttgaatcttaggaggaaacatcaaacaaatccatgttgagggacattctacaaaataacttgcctgtacctttcaaaaatattaaggtcaagagacagaaaggctgaggaactgttccagataaaatgagactaaagagacataacaactaaatgcaatctgtgatcctgggttcgaac

SEQ ID NO: 571136 - DNA, 261 bp, Homo sapiens
ctggctatatggagtcattctgtggttcacatatgacggtcaggtatataaaccgagatacgtgtgaagaatataattgatagggattataggtgaatctctagatggcttcgggtagtatggtcatttaaacagtattagtaataccaacccacgagcataggatgcctttccatttgctcgagtccttctcaatttattttatcagatgtctggtggttttcatcgtagaggtttcttttctttttttttcttttatca

SEQ ID NO: 571137 - DNA, 181 bp, Homo sapiens
agaggacccgacatgaagcaagcggcgagcaggagcagtggggtccattcggaggcaaggagacgcaggcgttcccgatcaagaggaaaacacgcagcgggacagatgtaaatagagcaacctatataaaccgggattttttttttttttttttttttttttttttttttttttttttttt

SEQ ID NO: 571138 - DNA, 612 bp, Homo sapiens
  misc_feature (339)..(339): n is a, c, g, or t
  misc_feature (522)..(522): n is a, c, g, or t
gagatctggtgtctgcagttgacacgaagcacttgcagaactcatcagaagccagccgcggttatcagctagatctcaagagtagcgttcgggtggagggcctgtggttctgcagcagcgtactagccgtgctcctgggaaacgtgcgtctgcccagatgacgtcggtagctctggaagcatgagtcacccactgtgagacctggaagagttagcgaagcgcagcaggggagcccacgtgaggcactctaggaactacgagaggactcctttggcgtcgtatttccaagaagaatccaaacagtgtcttttccattcgaagagcacaatcattgtcagnacaatgcatacatgttgtggccgttgcagtataatctaatacgtaagatgcgataggggataccagatagggagttgtctgtcctcgcttaagaaaaatcgtgagactattgggtagtaatagggagggaagatattcgttaccaagcagaatgggtcatcacctattgcgagagcatagggnggagagcttgtatctaattcatagctagaatgctagtagtggttacttgggatcgttggacgagcggacgggccatcgcaggagtacaga

SEQ ID NO: 571139 - DNA, 884 bp, Homo sapiens
tcagcgcccggcgaaccctgctgctgctactgctgttgctgctgctcggcctcatgcattgtgcgtcagcagcaatgtttatggtgaaaaatggcaacgggaccgcgtgcataatggccaacttctctgctgccttctcagtgaactacgacaccaagagtggacctaagaacatgaccatttgcacctgcctatcacgatagccactagttgcgtgacatcaagccagcatgcgtccatgatggcaacacagagcaacgacattactcgcaccaccgagctctacgctcgacttgctatccgcgaacaggacatacactcactctcaatttcacgagaaatgcaacacgttacagcgtccagctcatgagtccagtccataacttgtcagacacacaccttctccccaatgcgagctccaaagaaatcaagactgtggaactctataactgacatcagggcagatatcgataaaaactacagatgtgtaagtggcacccaggtccacatgaccaacgtgaccgtaacgctccatgatgccaccatccaggcgtacctctccaacagcagcttcagcaccggacagacacgctgcgaacaagacaggccttacccaaccacagcgcaccctgcgccacccagccccctcgcccatcacccgtgacccaagagcccctcagtgaaccagtacaacgtgagccgccaccaacgacaacctgcctgccggaccagcactggggctgccactagaacctcaccctatcaaaggaaggacaacaagaccgcgacaaaagataatcaaccagaaaaaccacacaaaacacctacaaccaaacgaaaacagccagagcccaccccgggcgacacccagaacaactgcacag

SEQ ID NO: 571140 - DNA, 438 bp, Homo sapiens
atgtataaattaattaccatatcccacccattcacttcatttaagctggggcaagtattatccagtttggttccatgtttagcttaattaaggtccactggtttgttccctaggacagtgttgggcttggtcatataagttagaagcacctgggagcttgggcattgcgtgtcacgcctgtaatcccagcactttgggaggccgagcgggcggatcatgaggtcaggagatcgagatcatcctggctgacagggtgaaaccccgtctctactaaaaatacaaaaaaaattagctgggcatggtggtgggcacctgtggtcccagctacttgggaggctgaggcaggagaatggtgtgaacctgggaggcggagcttgcagtgagctgagatggcgccactgcactccagcctgggcgacagagcgagactccatctca

SEQ ID NO: 571141 - DNA, 1068 bp, Homo sapiens
  misc_feature (198)..(198): n is a, c, g, or t
  misc_feature (208)..(208): n is a, c, g, or t
  misc_feature (212)..(214): n is a, c, g, or t
  misc_feature (216)..(216): n is a, c, g, or t
  misc_feature (223)..(223): n is a, c, g, or t
  misc_feature (225)..(225): n is a, c, g, or t
  misc_feature (229)..(230): n is a, c, g, or t
  misc_feature (484)..(484): n is a, c, g, or t
  misc_feature (617)..(617): n is a, c, g, or t
  misc_feature (647)..(647): n is a, c, g, or t
  misc_feature (657)..(657): n is a, c, g, or t
  misc_feature (664)..(665): n is a, c, g, or t
  misc_feature (669)..(669): n is a, c, g, or t
  misc_feature (680)..(680): n is a, c, g, or t
  misc_feature (682)..(682): n is a, c, g, or t
  misc_feature (687)..(688): n is a, c, g, or t
  misc_feature (690)..(691): n is a, c, g, or t
  misc_feature (713)..(713): n is a, c, g, or t
  misc_feature (720)..(720): n is a, c, g, or t
  misc_feature (726)..(726): n is a, c, g, or t
  misc_feature (740)..(740): n is a, c, g, or t
  misc_feature (748)..(748): n is a, c, g, or t
  misc_feature (757)..(757): n is a, c, g, or t
  misc_feature (760)..(760): n is a, c, g, or t
  misc_feature (767)..(767): n is a, c, g, or t
  misc_feature (771)..(771): n is a, c, g, or t
  misc_feature (778)..(778): n is a, c, g, or t
  misc_feature (782)..(782): n is a, c, g, or t
  misc_feature (792)..(792): n is a, c, g, or t
  misc_feature (797)..(797): n is a, c, g, or t
  misc_feature (799)..(799): n is a, c, g, or t
  misc_feature (806)..(806): n is a, c, g, or t
  misc_feature (819)..(819): n is a, c, g, or t
gcctggctgtgccggcggccaatagagcgaggagcctgagttgggctaatgccgcgccctccgtagatcgagagactgaggtagcccagatatgagtcaagagactacgcaacatctcacgggaaatgcccacagaaacgaagagggagcggccccaccagatgaagaagatcccgcatttggagggggaagccagancctgcaggantatnnngngggggcnanttanncaacttgtccctaattttcgatgggccatacctaataggcatattgagcacaatgaagcgagagatgatgtagaaaggtttgtagggcagatgatggaaatcaagagaaagactagggaacagcagatgaggcactatatgcgcttccaaactcctgaacctgacaaccattatgacttttgcctcataccttgaatcctaaaagttttcgctgaggttaatgtgaacactgctttacaagcttgtatttttgngatttactttttctgtaagccttttggtgtttacacttaccagtttctaatggaaattagaattctaattgaatattgttttgtctcagcctaaaagttacggtcagcatggcaattcacctattttaggagnaatactcttttcataatatgaaatgcatanagcagttcanaaagcannctgnattccatcatntnccttnntnnattcagtccttatttttgaagnattactnttcctnctccggctacctgnactaaaanctcagttgnctntgacagntttnttcttgncctnaccaaaaaanatgancntacccanaattcaatgtttnatatttaagaatgtatgttgtagtgtttttgcagagtgtagtctactcatctgtataaacacagccattgggggcaggcaggggcatgttaagtgaatgtaggacatcagtcgtccagactcacagagtggggctccagaatctccatgtttaacaaacttctcgttaaggtaaattctgaatgtgtaccaaaatcagtgccatttggtgtgtgtgtacgtaactatataaataccgggtgtggtataa

SEQ ID NO: 571142 - DNA, 157 bp, Homo sapiens
ccgactgacctccctcagaccactacactctgtgcatcagatgcactaacaatgagacatggtcacatcactgagctaggtgggcatggtgaaagcctttattccccatagatccgtgggaactgcttaaaagcctgacctgcattcagttagatgc

SEQ ID NO: 571143 - DNA, 160 bp, Homo sapiens
tctagaggatctccgctctcaccaccccaggatcagatgaggctcatagaaaactagggaccgtaaaaacccaaagtttggagcactgcagagctggtgatattgagatgaagggaccaggatggacatgcacgcagagcccggggtgggtggagagcgg

SEQ ID NO: 571144 - DNA, 169 bp, Homo sapiens
tcgaagatggcggttgggccaccaatcatgctatcatatagtaaaacccagcccttttttctctcttgtttaatggaagccatgagaaaatataccaacctagacccagccagccagaaggaaccactatcttaagccttcggttcatctcccaaccggccatcttcga

SEQ ID NO: 571145 - DNA, 197 bp, Homo sapiens
  misc_feature (42)..(42): n is a, c, g, or t
  misc_feature (86)..(86): n is a, c, g, or t
  misc_feature (153)..(153): n is a, c, g, or t
tcctccttccactacttcggggccggtggtgcccctcacgtngaagctctcggccggcgacaagctggaccgagttcctgcaaganccggatcgctactacgaccccaacggcttcaatggcccactacctccgaaacctggctcttcttcgnacctgggctatgacaacatcctgggaccccagcagcccgcagtg

SEQ ID NO: 571146 - DNA, 169 bp, Homo sapiens
catgaccttactgttagatgctgtaccaaatctcatccgtctaacattttcgccactcgttaaatctggtctttgggaggaatgatcaatgatatcatgctggtgtcattgctgcgagccgcctcctaagctcttaatgagcttcttgatcttccagatctccacgttc

SEQ ID NO: 571147 - DNA, 446 bp, Homo sapiens
  misc_feature (128)..(128): n is a, c, g, or t
  misc_feature (138)..(139): n is a, c, g, or t
  misc_feature (176)..(176): n is a, c, g, or t
  misc_feature (224)..(224): n is a, c, g, or t
  misc_feature (235)..(235): n is a, c, g, or t
  misc_feature (247)..(247): n is a, c, g, or t
  misc_feature (276)..(276): n is a, c, g, or t
  misc_feature (278)..(278): n is a, c, g, or t
ctcgaggccaagaattggccctccggcgtggtgatgtcggtcgccaccgcgatcacgcggcggccatggcgcgcgcgcaggtctgcggcggccttgtccagcgcctcggcgccgcgcgccacgatcancacgtcgacnncctcggcggccagcgcatcggcacaggcaaagcccangcccttgctcgcgccgcacaccagcgcatgcttgcctcgcagtccganttccatgctcncttctccttgantcgctagattttccaatcgttcgggcgcncnatgcggcccgttcaggtccgcgcggtcttgccgcgcgacagcagatagatgccgcccatcaccagcgcactgcccgccagctgcaccagcgtgatcggctcgcccagcagccagaagccgaggaacagcgtcgacaccgggccgatcatgcccgcctgcgatgccatc

SEQ ID NO: 571148 - DNA, 619 bp, Homo sapiens
  misc_feature (169)..(169): n is a, c, g, or t
  misc_feature (209)..(211): n is a, c, g, or t
ggaaacagttcttggtgggaaagaagcccaaaagcccagacagactgaaagtgaaatcagaaaaagagcccaaggtggaagattctgcgagatgatttcatgatgggagccagcataaaggactgggacaaggagagcaagggcgaggagcctgctggtggcagggcanaggccgcagccagccgttgagcggcagacgggagcatccnnntccgctgcaaatgacccgacggttgggagcctgcgcatggccatctgccaaatgctaggacttcctgagaacctgtgctctagggttcctcaggtgcagactgtattaaagctgtatttttaattcttacagaaatttaacctgtttttctaaaatatttgtacagagaaatattttttttcttgagcagtaaactgcaattttctaggatcctttgctgtggacacatgcccatcatccatcagggtttctaaagtgcggtcccatttataattaaagtgaatttgatatgaaatctctgcttccctgctcagatccatagatctgtctgtcacggagggtgggtgattggtgccgttggtttgtgtggctaagcctttaagaaaaaggtacataaaatttcaaaaa

SEQ ID NO: 571149 - DNA, 710 bp, Homo sapiens
  misc_feature (19)..(19): n is a, c, g, or t
  misc_feature (22)..(22): n is a, c, g, or t
  misc_feature (119)..(119): n is a, c, g, or t
tgctaccttatgctgaagnacntgcagtcatcccagcagctgccatggatggattttgggggcacatgcgactccagtgtggcttgtggaatggtgtgaattcgccggtggtttctctnccggaattgaatcccgaaatggggactgaccatgatagtgaaaattggaaggaagtgcataagatggtggttgaaagtgcctatgaagtcatccagcttaaaggatatacccactgggctattggattaagatgtggctgatcttattgaatacccatgttggaaaatctatcccaggattcatccccgtgtccaaccaatggtaaaggggatgtatggccattgagaatgaagtcttcctgagcccttccatgtatcctccatgcccggggattaacccagcgttatcaacccagaagctataaggatgatgaggttgctccagctccagaaaagtgccagatacccctgtgggacatcccagaaggacctataaagaccctgtgactagtgagctcttaggcctgtagaaattttaaaactacccatgtgattaactcgagcccttagttttcatccaagtacctggatccccgtttgctttgatctttttccatatgtgaatttgggctcacagaatccaagcctatgcttggtttaatgcttgccatctgagctcttggaccaataaaattaactattgtagtgtga

SEQ ID NO: 571150 - DNA, 178 bp, Homo sapiens
ataagaaacaaacaaataatgaatgaaccccccaaatttcagtaccttcccgcattaaacatttgcttcattcatgtaactctttaaatacaggtgtctctgttcatcacgttgctactcccctaaggaagattcaaggtgggaaaaggatctgacaaagaatggatatgtcctcgtt

SEQ ID NO: 571151 - DNA, 298 bp, Homo sapiens
  misc_feature (24)..(24): n is a, c, g, or t
  misc_feature (91)..(91): n is a, c, g, or t
  misc_feature (122)..(122): n is a, c, g, or t
  misc_feature (184)..(184): n is a, c, g, or t
  misc_feature (290)..(290): n is a, c, g, or t
cctctgctcagcagtacagatacngtgtatggagggctctaggctagatgctgggaatccagagaggaataatcaacagttcttcccccanggcgcacagcctacacgtggctttttccttnggcatctggaccacacctcctctgagggctaataatgcagcctgtggtccaggcaacacctngccattctatcaagacaaggctcactgaccccatgctgcagtggctagaaagaatggctagcagcagttcccaaccagtagcaattttctttcctaggggaccttngtcaatgt

SEQ ID NO: 571152 - DNA, 931 bp, Homo sapiens
gccctgttgtgattccgtcctgcgcggttgtgctctgagagttgatgcgttcttggtatctccgtccgtcttctctcctacctaattgcttgtcgcatccgatggaagcattcgatcggacatggacatgagcccccatgtaggcctctagaaaattatctttgtcgggtgtgttgaacttaaatggccggacataagattcatcgacttatcaggtggtgatattggatgaagattgaggcacgccagttcatcttgtatctgcaacggtcacgcttttagcgggtgctgggttcctcaccgtgaattgatttggctcaattgtccgaaacgctagaggctctggaattactgaaggccggccctttaaagttcctcttggcgaacttatcgaccttgtctgtacaagccgcacgggtttcctcatctcgggggcctttgaatataacttagcgacaagtcggtcattcaatcgttcgagagtgtaggattctaagggtcgaagtccccatatttaggttgggacagcccctttagtcatgctcgtcgtgtcgggaagatggcagtacgtctagaagatgaacgcatgaggcaggtatgtgaaactccttcagttagtatctggtgagcggtctgccccctgtacgttgtgttcgcgcggtgccctgcctcgaacagtctagcttgctgctggtgctgattgatgactgatttggtgttgaggagacgttaccgttgtcgatctttgatcgccgagaatttgcggggatcgggcactcggacaagacctttcctgaaggagttttggattataccctgcgccaattgggcgagttcattcgcatgggcaaatcgcacgtttttaacccaaaatggcgggccttcacggacaactctttcccaacgcgttgtttccacccttacccttaag

SEQ ID NO: 571153 - DNA, 553 bp, Homo sapiens
cgaatcatcggagcaaggaaaaggttgctttgttactcatgccctatggtgggtgattaactgcttgtacaattacgtttcactttaaataaattgtagcttaaggatataattaactgaggagagtcccttctatagagcagctcgtactgacgaaggtgcatgcgctgaatgatgtcacggcagtcgtagaacacacggcggatattctcagtgtccacagcgcaggtgaactgagggtagcagtagtgacgcccatctccactggcagtgctgatcctcagacactcatctcgaatgaagtacttggcccgggtcacgcgtgggtcctctccgggctcgggagtagcatcctcaggagtagtgtagcgagcaaattctggaaagtagtcctcaatcttcgatttccccgcaaggactttctcagcgagcagatctatgcatgtagaggaccaaggatcacagagatgtgcgcagccatctgttgtaccagatgctcttgaagaggttcagagcctcctgcaggcggttggtctggtagtctcccggatga

SEQ ID NO: 571154 - DNA, 128 bp, Homo sapiens
cagggctggtggcccttcatcctgccagcatcctctaaggagtcttgagaaatatgtcttagaactgtgtactgaaaggcaaaaggggaagcacttatttataggctcccatgtactctcccacttct

SEQ ID NO: 571155 - DNA, 285 bp, Homo sapiens
ggccctgatcggagcatagcgcaacaatccccaagcgcaagtgctcatctgacgtcagcccagccatcattctactatcaacattactaataagtggctcctttaacctcgccacccttatcatgacacaagaacacctctgataacacctgccatcatgaccctgtgggcataatatgattcatctccacactagcatcgaacacccgaacccccttcgaccttggccgaaggggagtccgaactacgtctcagactatcacattcttcaagtctacttgctgg

SEQ ID NO: 571156 - DNA, 453 bp, Homo sapiens
  misc_feature (427)..(427): n is a, c, g, or t
tgttggaagcgacatttaagatgtggagcacttggggtcgtttgaaacccgctatcttcagtagggacttttacttctagagaacatgtgcattttgattttatctgtcctcaaactgaacttttgctcattttaatagtaaaaacacattcctaggtggagacttaagatgctaatgagacatgcaatgtatgcacaaataagtacagttagtgcacatgtgcacccagaagaccactcaaaacatgcttacactaacacttctttccaccttcttatgaataatcgtgcaaaacccccagaaggagggtttctccagtaacaattaatgctgtctcactcttatgagcagcctgccctggaatctctttctcagaatgtaccgtctattctgcacttaattttcaaagtagtcttttcttttttngtgtgcaataaattactctatgctgt

SEQ ID NO: 571157 - DNA, 371 bp, Homo sapiens
atcatttatcctgtattctattggtcaaatcagtctcaggcctaaacagattcaagaaggaaaagaaatagaccccaactcaggggtgggctgggatgacttagagagtgacaaagaatttgcagttatttttcatttataattcatttgtttttttttttttgggaaaaaaagtttttttttttttaaaaaaaaaaattttccccccctttccccaagggcgcccggaagttttaaatgtatatatgcagatgtgtatatgttttctttttacaaaatttagatcatactgaaaaaagtacaacatgaatttttattgtatcacaaacattctctcaagtcattaaatattcttgaaaaattgacaaaaa

SEQ ID NO: 571158 - DNA, 449 bp, Homo sapiens
gattcttgaggatacacccgctgtcagtggatacagagttttctttgggggcgatgaaagtgttttggaactagatagagggggtggttgcacaacattgttgttggtgggaatttaaaatggtgcaagcactgtggaaaaaacagtttagcatttcctcaaaaagttaaaacaggccaggcgctgtggctcacgcttgtaattccagcactttgtgaggccaagccaggtggatcacttgaggtcaggagtttgagaccagcctagccaacatggtgaaaccctaaaaatacaaaaaattagccgggcatggtggcagacacctgtaatcccagctactcaggagactgaggcaggaaaattgcttgaacctgggaggcggaggttgcagtgagctgagatcgcaccgctgcactccagcctgagcgacagagtgagactctgtgtga

SEQ ID NO: 571159 - DNA, 603 bp, Homo sapiens
ttcggaggagcctccgtggaccccggggaagtaacagtgtgtctggagtgctgaatgggtggatgtgggttcctgtgatttggggtttgcttgtgaaactcccctccacctcctctctcgcaccacaccacctcaagccgactaacatagagaccagacgcctagagaaaatgtggtcaaagcaacacgtacgcaccacgcaagaacagcagtggaacagcagtgcgggagacacgggggaacaccatggaagatgacagggaacagggccagagagggagagcagcaacaccaccgaaccacggaggtgtatgacataaatgacgagatttgaaccgttgataacgcgatggcatgtaggtggcctaatgacgcaagacaatcaaacactagtgaaaatgggatacatactaactagtatgttacgacggagaaaaggaaacagaaagtgacggagcgaaataacggcatacgaggacaggcgacaaaaaaaagagcacaacgctaggccaaacctaccagggaaaaagaggaagaaacaaaaacagatacaaagaagacaaagaacagagaagacaagaggccgcacgcgagaaaaaaagg

SEQ ID NO: 571160 - DNA, 624 bp, Homo sapiens
gaggagctctgtgcagcctggtggggttctctcgaaatatagttgtctttggcttgtcttttgtgacgaatgggagtctctttgtctgttgcccagggtgggagatgcgagtggccagtgattatcaggctcgcggcgagtctcgtgatcgtcccggagttgcgggcgattctcctgcctcagcgctccctagtcgctggggattagtaaggcacaataccatcacagaccggactaaattcttcgtagttaacgtgggtcggaagacgaaggtttttttgccgtgttggccaggcatgggtctcagaactcctgacctcaggtgatccagcaccgaccattgggtacgtctcaaaaagttgcctggggaacttaacaagggcgattgggaagacacccaacgccaacaacacgcagaggcccaagggtgctgcactaatggaccgattggggacataagaggaaagacccaagggaaatgactaataggatcagacacaaccccccatggagaagacacgggggactacacacgacaatgccatcaccacacaagagacaaacctggacgaacagtaaagtcacacaggggaagtggtcaaaggaaggagagaacaagaagga

SEQ ID NO: 571161 - DNA, 771 bp, Homo sapiens
ttagcgtggctagaccgggtcttttctggctcggagagaagcatctgcccccccccgtgtccaccgggagacaacgattgcttttgctagtgtagcattcccctctacgcgaagtttgctacttcattgctagcgttcaaagcaccacgtggccttgaccaagcgattgctaaaagagtggtggcgcgtatttttgtaccagccccccccccctcgcccgcacgcctcctttgttgtggaggcgcccccccgctgggtactttccgccagggataattcgtacaccgcgttaggttctcccccactgggcccgcatataacacatggtcataccccccacaggcgccccacaaatatgcttaggatttcccctcaaggcgccactttgtgtgctcctagtcactctcatgcgtgcctgtaggcaccccccaccacgctacataaccatcggcgcttgttcctttccgcttcattaaaggggtgttctttatacagaccccccattgcccctttgtatctcacggggtattactgccaaagaacactgtattgcggtggggggagacttttagccagcaggctgtgtcgcgcacatttgggctcctcctagtaggtgtactactacgctgcattccccgagttacctcgctttttactttatactcctaagatttttgagggtttagctccccccgaggaggccccccacggcgggtcttttcccgccgcgccgccacacaaaaagatttctccttttcccccaacataaca

SEQ ID NO: 571162 - DNA, 545 bp, Homo sapiens
  misc_feature (248)..(248): n is a, c, g, or t
ttgggcctcattcagggtcatctcggaaatactatgaggtcaccatccataagttcatcaggggctttatcaagagacacgtcatagtccggaattctctcggttaaatgcggtttaacttcctcatagaggataaggctagtatctggaataaatccggctcggtcacacataacggggagcaagtcacgtatttcacaggatatgggggtgtagatatgcccacagtaattcaagctccgggttgngggatcatacatcttcaaaaataacattacatcatgatctttatcaaactggggtaaggtcgctccactagcagccagctcgggatcaacggtttccaggaatattgtgcaagggtttgcattatcacggagctcaatcatggtttcattgccgtcggcttcattatctaacatggcgggtcgtaatgtcccattactctgtgtttgcatgggccacaatcgaatttgatcttgtggaaatcccatggtctgagagagcgtctgaacaaaactcagcaagcgaggagtccttcaata

SEQ ID NO: 571163 - DNA, 172 bp, Homo sapiens
agatgagccaagatatagttaaatacaacacatacatgaggagtactagtaaacaccagcagcagaacatcagtatcagcagcgtcgccagcaggagatatgcagcgcagagccgaggagacccccgtcctgaggaggactgtccaacttttcaaacaccaagccgctgcag

SEQ ID NO: 571164 - DNA, 301 bp, Homo sapiens
  misc_feature (10)..(10): n is a, c, g, or t
  misc_feature (58)..(58): n is a, c, g, or t
  misc_feature (65)..(65): n is a, c, g, or t
  misc_feature (131)..(131): n is a, c, g, or t
  misc_feature (163)..(163): n is a, c, g, or t
  misc_feature (232)..(232): n is a, c, g, or t
  misc_feature (273)..(273): n is a, c, g, or t
  misc_feature (295)..(295): n is a, c, g, or t
agaacctccnagcctgcctttcggagcagcaccccaggaggggatgccgcgctccagnaacaccnaggtcaggcctgtgcagacccctgccctgcagctgcagaaatccagaagcatccttaatgcttctnagtcttcagccagagggagggctgttatttcnagaggtgcgctttttatgtacttttagctagatgtggcatgcatctgtgagctttagatcattaaatcnaaaatgtttgcctaaattagtttatcaggttgttaaccttnaagaatattaaaatgatttccnataaaa

SEQ ID NO: 571165 - DNA, 114 bp, Homo sapiens
acatgatcaatatgatgaacagataagggagcagagatggttaaggactttcaggaacttaactattactggaataaggaatgaatcaacatagaccttgggccagacaggttt

SEQ ID NO: 571166 - DNA, 1390 bp, Homo sapiens
agggcccacgcgcgtatatctcagcttccccaggagcaagagctctgagcccgccaagcgcggtcgtacggccctcggcagagatggcactgaaggactactgcgctatgagaaggagaaagggttaacgaaagttcttacaaggagttctaccaggatgatgaactcgggaagaagctagttcacagtatgggcaacacagttggttcaggcatgagctctatgcgggaacgaggatggactctgttatgtggaccttggacgacgtagccgaggatgaccccgagttggctggactcaagtttggtgagaactgccaggcgctacgtcgaagctcatatggctgaatgcgcgtacaagaggctgcgtgcctcagatacaaggagagggaagctggataaataagagatgtcctggacgtattacattgacggcaatcgcgctaactgactggagggcagcggagatcgggaccctggggatgggtccgagagctcccgcagaactcgagtagccctgctggaactcgatgcgcaggatttgatggtggttatttaccaagggctccgtaggagggaaacaaggcctcggggtgaatccgggcacagtgccggggcgtggacgcctgtggaggaaagattggtgaacctgtgcgttgcaagtcggtcaagtccgtggttcttcttggaacggtcaaaaccccaaggaatgcgctggatgggtgcactttacagctttgttgaacacagcggtggggtgcaagaaaaccataacagccgagtcccagatcttccgcaattgttgcactgccttcgtgatcatggtggcaccaaggctcagtgtagattggcccaaaagccgaaccggagacccagggaaaggagcggattggggattcatggcctgaaccaccggggggcttcacagcagtcccttcaaaattccccagggcggacggcacgacatgggcaggaagcattagctcgagtcaagtgtcgcctgtgagggcgcaagaatccctcggggcggcacacacggggccggagacaaacgtcgggaggacacacaacaggcgaagtgggccccaaggctgtgcgtaaagaaacgcattagaagggtcaccagggggatacttcacgtgggccaagagacctgggggcaaaccgtgagagaaccccgcacagggttggaagcacgacggatcaaccacaggtgaaaccatgacgctggatacacactcgagtgtgttcaaagaaacaacacgaatacgatagacaaacaagtggaggacgcaaacaacacgagagcaaagagtacccacacagacaggaacaaaagacgcacagcagacacaacggggaggaagaacgaggggagacagagaaagacc

SEQ ID NO: 571167 - DNA, 268 bp, Homo sapiens
tcaatgggcaaacccagggttaggccctggtggggtgtggagcccccaggcaaacccagtcctggttgggatcccccccccgggggttactgcaggtaacccccccccttaggcctgggggccaagggggggggccccccccctgatctttgaaaaccctacccaggggtggggtcccttcccagggcccaggccccagcccaggccccgggcccccccctttgtaaaccccccctgaaggtattaaaaactaattttggggaaccca

SEQ ID NO: 571168 - DNA, 1023 bp, Homo sapiens
ctttgtaacctgtaataaaaaaactacaattctgtacatagtttatagttaggattcttaactgtagcatgaacacttagatataccagttatcccatctatataccatatatcgaaggggcaagtcgctatataagttaacctagctagtcaaagagaatggtatccgcgtgttcgattcagtgaatatgtgactgtgtatcgctcaattgcgatgtctcaatccagtcatatcctaaattggtaagctaatggcgtaagactacaggagttcacctgaacgtgatagtgccacaacgtcaatacacgttcattatggcgtgtctcaccacgctggatggtagcagtagatgtagtcacagtcagctaaaagactggacctgcttacacttgaactaggaagccactgaggttgttagacccttgcttcatgtccttgttagttgtaaaaactccctactgaggtctatgccctaattataactaaatctcctggtgccagtagggccatgcgttggccattaggacattgcggtggttaggactcttttttggtcccatctgcctattactagatggttactagctcttgaaataaacattgtttacatattcatagatcaaggagtgcaagatgtcgaaacccttcgtatattaatatgccttgcccaagtttcaactcactttgtaattagaacctaatattctcaagtttgctaattcgtttcccctatagggggccttctcttaaaatgaaagtagtttgcccccatgtgcgtaaacccacggttggatttgacacggtaaccacatttggaaatcctatacttaaagtggtcgttaaagaccacactccataaggaatgcgccttgggattaggcaatcaatagcgtctcgaagttcaccattcccttaccatttgttacaaaccttaggggatagtctttctcaaattgattaagcacttgtgaagcaattggttaacgtaattagagaatttcaaatggctaaaataatacgta

SEQ ID NO: 571169 - DNA, 286 bp, Homo sapiens
  misc_feature (31)..(31): n is a, c, g, or t
ggctatcacattatctcaaacacattctttnctttgtgtaggaatattcaatatccttctagctatttgaaactatgtatcactgttaactacagtcatcctacagtggtatagaatactagaacttagaacttactcctcctatcgagtggtaattttgtatcctttaacaaacctctccctatccttcccttccccctacccttcccaccttcccatatcctctgttctactttatacttctatgacatcaacttttttagcgcccacatagataatgtgatag

SEQ ID NO: 571170 - DNA, 255 bp, Homo sapiens
tgtcgtctagaggatccgaagcgcacgatggcgcagtaatttggtattagtagagacggggttactatgtggctaggtggtcttgactcctgacctcgtgatctgccctcctcgtcctcccaaagtgctgattactggcataagccaccgacccagccgaatacagctttatttctatatacacaaaatcaagataataatttccataatatgctaagtctcctgtcacttcacctaaaccctatgttgcacatt

SEQ ID NO: 571171 - DNA, 926 bp, Homo sapiens
cgggcaagttaatacccagttcccgtgttttctgaaaagcccctctggcgcttcctatttttaccttcatgccccaggcccttttatgggggcaacccccttcgtgggaactcttaggctttattataggaattcagatggagaagtgggccaaagtaagttcagctaactacaaagttctgtatgtggctggacgtccattggtaagtgtgcgaagggtctaggaaacatttgtgctcttctcaaaagcggagttctttgccgttggcgctggaacgcttgtgacaccatagaatggccttctcagaaggacgtatatatatagagctatatagagacttgtaggctatctttggacaactacatgggggacaacctatagggttcatgagtcattgtgtagaggagaatggatacactacattctacgcgaccgacatacatttgtttcaatccgtggtgtttgtagaacaacttttcttaaagattccttagttcctagactcgcgacgccactcgtaacacaaagcggtcatctcttactccttatgatcaagtgaggaaatgtgtatatttgctttggactgataccctctatgggtccaagggagatagactctagtagacgctgtatactggggatacgggtacggattcttgttgcgtggttttccttctcgtggcgggtggggcgagtgtgttgctgttgctttggctgtctgtgctgtagtggagtatttgtcatgttctggggtggggaagatattgatgtatctgctactgctttatgagttcatttgttacattatccccccagaataacatccatctatacagttgacttacagggggataatactgagatggtaaacgcctgccacctttatattttcctggcttcgatcttaactgctgaggaaaaatac

SEQ ID NO: 571172 - DNA, 600 bp, Homo sapiens
tattatgggcacgcccatgagttcccgagtatgactgcattgtctctggctatcactctgatctgcatcccggtcactggacaccagaagctcggagtgaccacacctcttcaatgatggctaaacaaggactacatttatcctccctctctacgctctttcttgtattcagactgcactgtttttctgctggccggatgactcatttctttgtcatctcttaccccacttggccttttcagctgctcgaatcgcctctgtgtgatgcggacagagctatcgacctgctggggtgagattcacttgcattgaatcagctcaaagcgcaggaaggtccagggaagccaaggaagagaagagacaagtctccaactctctcaggagcaaagacaaaaatatgctcctgctctcttatctcttattcagaccgttcagttgcaaaagggttgaacatgatgcagcgggtggtatgtgtggaccagccctaggtcgtgcttctcctccatctggtacccccacccctagttatccagaaagggggatgttccccaggcaaatgccaacatgtccatactgcactcttcacaattgcagtttccc

SEQ ID NO: 571173 - DNA, 408 bp, Homo sapiens
gcttgtgcacaccttaagccctgtacgcggagctaatgcacgagaatcacttgaacccaggaggcagaggttgcagtgcgctgagattgtactactgcactccagctgggcgacagagcaagatcctttctcaaaaaaaaaaaaaggaaagggtaaatttttttaaggcaaattgcaattcataatttactcaactttcttaaaaggggaccctagataccttccaggatgaccgggtctcaagtgatttgtccgtcattctttcaaaaacgagacctatttaatatcggtgacttattttttgcaactaacctttttatggagccctacgtgttgggctgtgttaagtcctattaggcttcatctcacctgatccttcactctgtgacttcggtttacctgtcattt

SEQ ID NO: 571174 - DNA, 276 bp, Homo sapiens
ggggtttttccccgtttttggggggggccctttttccccgttccaaggggagagggggaaaaattttcccttcgtagggggtttttttacccccccccctttaaaaaaatggggttttttttttaagggggggggggttttaaaaaaattaaaagggtaaaaaggggttgggaaggttttaaaaagggggggttaaaatggttttttggggtccccccttgggggtgggggttttttttttggccttttttttgggccaataacccctttggggga

SEQ ID NO: 571175 - DNA, 356 bp, Homo sapiens
agttcgacggagtactctctaaaaaaaaaaggatcaataaataaaggtccaaaaaaggggccaaagatttgaaaggatacttcaccaagggaagatatgagtgggggtataagaacatgaaaaactattcaatatctttagttatcggggaaaggcaaattaaaaccacaaggagatacggctacccaccaaccagaaagtgattaaaaggtaaagtgccctcagctccattggcgggtgagaacgagggcagtcgaaactctcacacattttgggggacatttgggggaagggtaaggatgtctataaagtactctgaaaggcttcaaaaaggtgtgagagtctccgctcgaacg

SEQ ID NO: 571176 - DNA, 234 bp, Homo sapiens
  misc_feature (1)..(1): n is a, c, g, or t
  misc_feature (108)..(109): n is a, c, g, or t
  misc_feature (115)..(115): n is a, c, g, or t
  misc_feature (121)..(121): n is a, c, g, or t
nattcggcaccgaggcaaccataaaaattagctgggtgtggtgtcaggcgcctgtaatcccagctactcaatgatttgttcaatgatgggccctgtccaagcacagtnncagggntgtaangagtattttgcttggactggatttaatgtgagcaggtatacatccaggagttgtaacagccatcttgcaatcaaaaatgaaagcttgtttaaaaatcgaggcagcattcaaat

SEQ ID NO: 571177 - DNA, 1097 bp, Homo sapiens
cccccgggggttaccaccaacagggggcccccacgcccgaagatgagtgatggtggggggccagctacgaccaattgacaagtttctcctcagaagtttagattttttgtatggtgagcccctgggaagtataatgcgtcgccctaatgtaccaacccccccaatgggaagtgttcttaacaaaccagcgacgcgtgtctaaacaggtgtgacgcgcacacagcggagcctccctccaacgtaaacgcctgccaaaacttggcgttggatgtgttgaacgcccccgtgtcaccccgaagtggtgcagttccactctcacacggaccacacgccctcgagaaggagtcctttgcgcgccctctctttttctcgaaaggggggaccacaccgcgggggccccctcgcgacggcgagaaattggggcacaccgctccgcgaacttttggggatacccccccccacccccccctgagaggagaagatattgtgggggcccacgaaaagattcaaccgcgctctcccccgcccctcgtgtgtccccccgccccgccttgtttgtctccccgcgcttgtgtccttctgtctttggttttctgccagctgccacccccggtgccccctccaagctcccccaagccttatagggggagaggggtttgccacacacaggcctctccctcgttttgagaagcctccgccctcttgtgttcgagagatatctggtaaatggccactcggtaaccccctcttctgggcaattctcgttttggtttttaacccactctgttcttgtttctgtgaatagaaggggaaggggggcacacacatgctgaggttcttcccaaggctgccttctggaaggggcccccgcttttccacaccctggacccccacgctttgccccacacacccacagcccctgccccacacccacaagtccacaaatgtttaacagggaaccctcctgcccacagtccccccactcccccacccctcggaggcccccaaggagaaaagccaccagaagcctcgagaccccccccatcctggagaacccccgtgccccctgctcattttcgtagccttttttaaaaaat

SEQ ID NO: 571178 - DNA, 86 bp, Homo sapiens
ggaggcaactctcggggcgctcctagccctgggtgggtggagcgggggaagcggagtgggttggacccggctccgccctaccccac

SEQ ID NO: 571179 - DNA, 497 bp, Homo sapiens
  misc_feature (30)..(30): n is a, c, g, or t
  misc_feature (99)..(99): n is a, c, g, or t
  misc_feature (177)..(177): n is a, c, g, or t
  misc_feature (182)..(182): n is a, c, g, or t
  misc_feature (260)..(260): n is a, c, g, or t
  misc_feature (270)..(270): n is a, c, g, or t
  misc_feature (278)..(278): n is a, c, g, or t
  misc_feature (286)..(286): n is a, c, g, or t
  misc_feature (321)..(321): n is a, c, g, or t
  misc_feature (327)..(327): n is a, c, g, or t
  misc_feature (329)..(329): n is a, c, g, or t
gggtttggggtgtaaaaatgagtagggttnaaggttgtgaaggaaaataggttggtggctttgggctttggggtttagcaatagcttgaaatagtggtngactttgatagtatggggcctttggcctagagttgttgtgctgtgtccaagggctgtgcctttgcccttggagctgcngtgcntgtgtcttgatggcccaaatgtcagggttttggtgggttttttggactttggggtttagtccccatccggggtttggntgagtgtggntggagagntgatatgntaaacctcctgcctcccaataccagcaggaggttntgggcntntgaaccccctttccccacacctccccctggtgctgctgccccagggtcttgacgggagcattggcccctgagcccagagaagctgaaagcctgccgaaaacaggagcaaatggcgttttataaattatttttttgaaataaagctctgtgtgcctgggtaaaaaaaaa

SEQ ID NO: 571180 - DNA, 129 bp, Homo sapiens
cacgagaggcggtcttaaacgggagccaacgaataaggtgtttgatccattgtctacacagagattggtattatgtgaaagcacctgctatgttctagtactaagaaatattggaacagacgctcgatc

SEQ ID NO: 571181 - DNA, 149 bp, Homo sapiens
aatcttggcatcctcccttacagcacatcttactaaaacccccgagtctcagccagaagcagtggccttatgcctataatcccaacactttggaggctaggtgcggtggctcacgcctgtaatccctgcacttcaggaagccagggtgg

SEQ ID NO: 571182 - DNA, 715 bp, Homo sapiens
agcggcttactttgcggaatcaccatggcggctgggaccctggtacacgtactcctgcaaaactggagaggccttcaaggcatctcatcagctgctcagatacagcggggctcaggtccgcgtgctctccgcatcgaccccacttccatctttggccaaagccagccgcagccccctgaactttcgtccgcgaaattctcctggccggcaaggtcccagcaatggtgagggtgagtgatggagttctgtgtgctttgagcagcaacgctcatttgctctactatgttgagcatatgcaggagctgacgggagaagtactcgcagagagcagcagcgccaggtgagtgcagatgggtgagctttgctgattccgatatagctgcccccagtccaggtacctgggtgtacccgcaccttgggcatcatgcaccacaacaaacgaggccactgagaatgcaaagggaggtaaggtgaggcggaatactggggctgcgtggagtgctatactgtgaaagacgagcgacttttctggtgggcgaacgagttgacattggctgcacatcacacgttgtctgcaccctgttgtggctctataagcacggttctatgagccttctttccgtcaggcctttcccaataccaaccgctggttcctcacctgcattaaccagccccagttccgggctgtcttgggcgaagtgaaactgtgtgagaa

SEQ ID NO: 571183 - DNA, 157 bp, Homo sapiens
ctacatcatgatcatatattgtcttctctcagcattatattgcagaagagaacaccacattgttggtcattgtgtttcaaagatgttcattgctgagaataacatatacacagatgtgtttatctcatcacttcacccatttctcacctgggctgtg

SEQ ID NO: 571184 - DNA, 126 bp, Homo sapiens
tactttcacaggatattcatgatgaaaaaacgtggtgcgaatatatctaagtgcccaagcaatgtgaaaagactgcgccgaagcttgtaattccaaaccttaatcttatagtcatctcctccagag

SEQ ID NO: 571185 - DNA, 429 bp, Homo sapiens
  misc_feature (14)..(14): n is a, c, g, or t
  misc_feature (24)..(24): n is a, c, g, or t
  misc_feature (116)..(116): n is a, c, g, or t
  misc_feature (185)..(185): n is a, c, g, or t
  misc_feature (187)..(188): n is a, c, g, or t
  misc_feature (212)..(213): n is a, c, g, or t
  misc_feature (216)..(217): n is a, c, g, or t
  misc_feature (266)..(266): n is a, c, g, or t
  misc_feature (268)..(268): n is a, c, g, or t
ggtgacgatggcanagcgccgccncagcatgcaggcgctcagcatcgcggcctcggccatgccgacgacggcaggtcgaacagttctcgcgcgccagcaggcccgggtgccgagcngcgatgatcgccgcatcgacgttcgcgtgatgctcggccagcatctccacgcgatggcgccgccgattncnnctcggcgcgggtggcgatataggnnacnncgcgtggggcggtcaggggcacgagttcggtgccgggcgcggcggcacncnggccgcggccatcagggtgccgtgatgccttcgctggtattgggattcaggacaaggatgcgcatggtgtctagggatgcatcgagggttcaaagagctgcggtagcgcgatcggcgtttcagccggcggccagcagttgctcgacgaggcgcgcggccgc

SEQ ID NO: 571186 - DNA, 131 bp, Homo sapiens
cgcgaggcttgtctctgagtcttaacctcagtgatatacccacttcggctcccaaagtgctgggattataggcgggagccaccacacccggacttttgagcagtttctgtttgctaagcatttattgataa

SEQ ID NO: 571187 - DNA, 680 bp, Homo sapiens
ggttcattagaccagtgcattaaaggatacacgtcgtaagaaattttccatcgagaaaggctttgcctactggtcagggtatgtcaagtcattggcagttcacgtggccgagaacagaaggcagcagctgcacctccttgttagagtaccagatgctggtgtccgcctggaggatgcttcgtcatacatgtgccacacactcatgcgagatataatagcatcctgactgagcatctgtggtgcgtcgccagctctttcttgacgtggcttgatggaaccaaagtcattactcctagttccagtcctcagtagaactgccttcgaccttggtgtccatgaagtgcatctctgctgctatatcctcctccgagcagccggaagagaggagttaggttctgtggatgagatccattggtacccttgacggagatcctgcagggagtgctgcaggaccgtccagaaactcatggggaagaacagggacagcgtgttcttcagcattcatcagagtgttgcaatatgaaggagatgagaagtacgtgacatcccccaggtagtcccagctggtgctgaatgtctgtgagaccctccaaggaggaagtgattgcactctttcgaccagacccgcacgtctggccttaggcaggtgccacagaggacaggacagcattggagactga

SEQ ID NO: 571188 - DNA, 956 bp, Homo sapiens
agcggaagtagcacaaagatgggaaggaagagtgctacgagaccaagatcatatgctgacactctccccattctccctctccaccacatatggtgttaggaattctccgaaatggaaggttatgaatggggatgactcaagggattcatgaactacgcagagggaagagaaattgctaagggaatgttggtcagaagagtactgcggtagtgtctgtcaaatgtctgcatggatctaagtatggtaaaatagatagcaacgagaaaacataataaggcccaggcgttgagtcacgtggagagcgtcgacgggagtgaaggggcgtccgcatgcagttctcacgagcacctgaggcgagagcagtgctcaggaggggtcctgacatagctcagaaagataccgtagaatagaaggcactatggcggcggacgcggcgtgatgcagcataacagattctgatcctggctccttgggggaaaacctgcatgctaggaccgcgactatagtagtggagatctcagagtaaacacgtggcagtcgggaaatacctagtgatgcatataatcccccaagcgcctaagatcggactcgattcaagtagtgtactctgcatttacccacacgtcccaatcgagaatattaacgaactagacaatggctaggaaataaatgggttgagaaaacacacacatggggggccggacgctgggattcatacccgtaaaaaggaaccagttcctacctttaggttctccatacttggcagactatggtggattgggaaaggttgcataattcccaagtcaaccttggcccccttcactggcacttgatcttccaagaaggctggaccacatccactagggaacggttgggaagcctaatcttccaagtggacttgtgactcttcacaggagtcgcggaaagaagaacgaaatacctcacagtcaatgaag

SEQ ID NO: 571189 - DNA, 328 bp, Homo sapiens
gctgcgtggcaggaggtacattgtaattgatcttcacacccactccatgatctcagactgggacagactcacctgacccgcctcatgatgaaagctgcctgggagtggtttagactgttgtcgccctgaccttatcacgacacctttgatgggctggaggaggcccaggctgccggacagcgttttggttgtcctggctgctgcccggcttcgagatgacatgtcatatcggctggcctgagacgtgcatctgctcggttacggggcccgtcccgacgatccggtattaggtagggaactgcaggccagccgagcatcggcgagcagg

SEQ ID NO: 571190 - DNA, 486 bp, Homo sapiens
caaaagagaaaagatttgttcagaaaggtaccaagtgaggcaggagaacagctctcaaatccacctccctgaagacaaggctcggggatatttatgggttagggaagcagggtggtctaacgtgtggggaaaagtgattggcaatggggaaaaaatgaagtaacaggttcattctgcacaagcatagtcggggttcatggcatctcaaaggaagtatgttcagtaaatggcagcattagcgtgatctgggggaggtggagcttttggccctccaatgtcaaaaggccacctctccggcacttgctcaggcccagttgaaggggcagtggtcctaactggtttgaactggacaggagcttgccctagtttctgaaaaacaactgttgcgaccattaccgtggtgacctatgaatgttatctgtaaagtagccagtgaaggtcaagttccagcattcaggtgcaaggcctcagcttcatggaaaaagg

SEQ ID NO: 571191 - DNA, 136 bp, Homo sapiens
tgatggtcgatctctacacggatccccgcacgattttgcactgtacatgctctatgtgtttttgttgactcgacatctttagctaaggaatttgaattttctattgcttcggtctattgcacatatccattgatag

SEQ ID NO: 571192 - DNA, 216 bp, Homo sapiens
caagggtcgcgggtgtaactcatgcccctcccagcacgcgccgggtctccccatggcccccggtctgggtgcgtttgtctacctctcctccttgttccctaagaggcggggggggggaagggggcgggcggcgtaggcggggcgccagagtggtggtcgggcaccaggtgagacgcccgggtcagtctgtgtaggccggacccttggcgctcggct

SEQ ID NO: 571193 - DNA, 476 bp, Homo sapiens
gccccctcatgccctggctgcgagctggcccgtgggcacctgccctggacatgtgccctggcctgcgagctgcgcccagctgcgaaagtggagcacctgcctgcacctgctttggagtgttggttgcctgtgtgttgcctgccaggaccctgcgccctgctgctggatcctgcagctgcggctggtgaatgtgatgtacatgcctgaccctgcctgacctggcaatgcccctgtggcccctgcccatgctctaggtttgctggtccatgtcccctcccggtgcttgctggcccaccttgtgctgcataacccttgtgcactgcgttgcaggcggttgtgccgggcaggaatgcctggcccggaacgattctgccctggctggcccggacgtggttgcggccacggcctctcgggtcgccccatagaccccgactttagcgcgagcccttgtttgcgaccccgttgcagaacccctt

SEQ ID NO: 571194 - DNA, 192 bp, Homo sapiens
cactataggttttctttacttcgcctgtctaattttgtacttttagtaaagatgaggttcctccatgttggttagaggggtcttgaactggggatcgcaggaccgcctgcaggtgggggtggtacacacagcagggcagctcctccgagaaggctccccactgaaaccaccccctcatgaatgccacacagg

SEQ ID NO: 571195 - DNA, 862 bp, Homo sapiens
ccaagtgctcctagctttaaggggcctttaacagtgtggctggttgtaaaactcccccccaccggccaaatggtactgccccctatccacgtagccaagttggtatattttccgggccccttctccgggaattagaggccgtcttttcgcttgctcgcgtgttctcccccactaatgtcgcgccgcggtgagttccactcatctgccggtcatctcttggagggatgctggcgcacacacacacgaggatcctttggtagttcttctcgccgccgataggcaggtgcttggtaccccacccacgaggctccccgaatgggccgttttttcttgtcacaaggaagaacctttttgttagcaacaagacctcctgttaccaaagctctcttttggaaaaacccagagctttcccactaatgaactctctcatgatacacttgactcaccctggtccccgtcaagacacgctcccctctcaaatttcatattgtgctaaccccggctataacaccctcctcgacggcagtttttatatgccaccagataggaatcaaccactcccctcgttctttggcgcaacatatttgtctctccccagcgacaaacgagtgcttgacatagtatctattatagacagccccgcaattatatgttgtaaaagttgtatttctccccacgcagtatgcgaccatttctgtttgtaatgccccacatggtgcaagagaaacatctgtgagcgccccaacatggtcccccgcgcctgtgtgcttctaaatctggggcccccacattggggacacaaaatacctcgggagccgcgaatgttttcggtaaaaacgtccccgcccaagcccaacaagac

SEQ ID NO: 571196 - DNA, 382 bp, Homo sapiens
gttcctgggaaaggttaatccccgagagtttttcctggttcatgtgttttggggggtttggggtgggagggaatccaaatgggagttgggggagggggggatccagttcaggatcccccagcctggagtcagggccaggggggcatggccccccttgtatccaaaagttcccaggggggattgtgatgggggttgggactggaggttgtataaggggtttttggaaggaagggccaggagttggaattagtgggtccctactgtcccccatggggttgtgacccccccccccccacttttcatgttttttaaaggcattttggttttttaaaatttggacagcaagagcaactttttttgtcaaataaaaatgagaaatgca

SEQ ID NO: 571197 - DNA, 82 bp, Homo sapiens
tccttttgtgtcattcagtgtaaaactgtctaatttgaaaaaaaatgtaggttatgaaaataaagatttaggcactgttaaa

SEQ ID NO: 571198 - DNA, 259 bp, Homo sapiens
ccggctcatttcagtgaagttcgcgtggttcgcgcattcgactacccgatagcagggcggtcgttccgtttcgccattcatccccctgttcgcgcctctggggcgcgtcgcctacgtcattccgagttcaagacaggtcggcagtgcggcctgctgcacatgaaagcgaagcgccgcttgatctccgccgctgagcggcatctcgcggaggttgttcgcgttcagggtgaaaccgagctcgtgcggttgatcgagcaga

SEQ ID NO: 571199 - DNA, 103 bp, Homo sapiens
cactcacagccgcctgcgtcgccactcacagcctctcccagcctcagccaggtcctcagaaggcgcttaagccagttggaggagggtttttccagagagaccg

SEQ ID NO: 571200 - DNA, 256 bp, Homo sapiens
cgtcgacgaaaagcagagctagtaaagaatataacatcataggcatgattaaaatgctaatagtgagcctgttctggatgaaatagcctagtacttctagagacacggcaaggaaacttggttctcctgtaaggagtcctgttatcatgatgaaggaaatcaaatagttaagatctctacagtctttgtgctggctgaaggagggatggtcaccagaggtttagggggtgcttgaggagggacagttggtccacgc

SEQ ID NO: 571201 - DNA, 128 bp, Homo sapiens
tccgggcggccccatcatagtgcattggcttcagtgggcgcacatcattcatgctttgttgttatggcatcatcatggcaggcatggggcattcatatgctcatgcatgcaggcatggcatcagtcac

SEQ ID NO: 571202 - DNA, 1268 bp, Homo sapiens
  misc_feature (1268)..(1268): n is a, c, g, or t
cgcacggccccggtccccctcccagcctgccgtctccgtgagtagtccgcccgccgaggatgcgacgcaccgcagtgttctaagaacgtgaatgcatctgggctggatggaatttagcatcaaggcagagtcccctttctgttcatgagtgttgtaagacgtgcataaaggatgaaggcaggcaccagaaatcctcggcatgtgccaatcgggagagactccgcagctgctgatggtgaaccgtcgagtgttgctgtgttcctcgagcataagcccagtctctccagtatgcctgcaggagggggtcatgcaggaagtttagactggcctatgacgccctgcgcctttattccagccgacaagctgaacatgatcttacttcccgggtgtttaatggagaacccggcgctacacgatgccaaactgcgttttgagtcccaggaaatgtacagggattggggacacgcacctatcacgacacccatcctatgaaagagatggaacgatgcatgagaagcgatgaaaaatgtctgcaagaaagaagatacaagagaagaacggagactaaaatgacatgagaatgtaaccatgatctaaaagccaataaatctgcgacattacatcaagagatggcacaatcgggcgtgagaatgtgagccattcattaacctctccaaaggaagtcaaacgattctgctgtacaaggcatggtgtgtacccaagtgaggcgatcgatcaatggacaaaccgggctacgaaccaaacagtgctagcaccgtaatgaccacacaacaacaaccataaggcatcctagagcatagacaagcgccaaatcaacacacatggacactgggaacctagataaccacacgaaccacaagacagcgaggggaccggaaccaccccaggcctcccacctgacagatgtgaaccgagcgtggggtagttaaagaaccattgataaaactgagctacgctcaccgaggacgcaaaccaacgaaatcgactacaaccatggagacaaaatagggcgaagaggaacagacagcaaccaagacagggagccacgcaggagcagtcgacacgagggcaatgataacaaacaaacgaccggagtgtatacctcccacagaggacacaccaacaccagctgaagaagatcaactactgacggccagtcaacgacgagcagggaagcacatagagcaccgcggagcgacatgcagaacagcgagccacacgagcatcctcatctgaaattagctaan

SEQ ID NO: 571203 - DNA, 163 bp, Homo sapiens
tgccatggtcagacgcagagagaaatcaggcatagacctcttctcgagtagctacatgttatatggaaaataagccaaaggcacaaaagactaacagggtgaaacttgtccagagataaatcaagtacacgaaaagaactgagggtgtacttctagaggcaat

SEQ ID NO: 571204 - DNA, 1136 bp, Homo sapiens
ggttttgtcgagaagcgtccggcgccgtggaggaggaggcccatgctggtttctgtgcgggctcttgttcggatggtgaagctgttcatcgtgaaatctgccccggtaggctacagagcaggagattcggtcactcttcgagcagtatgggaaggtgctggaactgtgacatcattcagaattacggttttgttgcccatattatgacatagacggcagctgaggatgccatactgcaagctgatccattacaatgcttcatggggtgaacatcaacgtggaagccacgcatgagtaagagcaaaatcgtctgcgaaagttgcatgctgggcaacatcgagtcccacctgcagccaatgaaggagcttcgagccacagtttgaggagtatggtccggtcatcgaatgtgacatcgtgcacaggattatgccttcgtacacatggagcggcgcagaggatgccgtgtaggccatcatgggtgccttgcataaacacagagtttacaaggtgtaatgcacacctctttagggtagagggtctgaaccacgaaggctgtgttgcttgaaacactggtctggatcagatctacaaccggcatgagagttctgcgctaggagggacttcacccatgtcgtgaatcctcgcttggagttgagttgatgtgagtggagaattcaaggtgcttggggtggactgagaagttgcggaaactcgaatggttaaaaacttgccgcttgggcgcagattatcagttggggcctaataagccttttaccgccactatgtgccttctcgggggatgtggatacagcccaagtccacgcgtgttctcccgtaccgggtatggccccggcctattccgcggccctattccgcttggcctctcgttgccttttgggtaagtaccaccccgccttgtggaaccttttcgtagagaggtctttcccggtcgatccctaggctgtggggggcgttccccggcaacttgttgtcgaccaacgttgtcttggtgcgttccagagggtacggcgtgtacccccgacgcttccgttcgcccactctgggatcaccccccagattgccccctcccgtccacggcgggctcccagaacactgccttcccttggcccccgtca

SEQ ID NO: 571205 - DNA, 1234 bp, Homo sapiens
  misc_feature (424)..(424): n is a, c, g, or t
tttgtggcttcggttcgggacccgtctgggccaatatgtctggtgaggctccactgtcggccacagtttctccagtctgattggtccagtctgtgtggccacttcccactacctagtttacattcgtgtgcgggcgtatcggttggtggtcgtcttgctctataagcctcagggccgtgttggtggtctatccccggtggtcgtcatcgagctgcagatgtcatgatcatcgtttgatgccctcggggtgaccccatggcaaggacccccctgttcttctaacaatgagaatttctggtgaataactgctattatgtattcagtctcaggtggcgggtatagggaagtcccctaatagcttttctgttataccacttgacggtgagccattttgtaactaaagagtatgtcccttgctcttganaatagccaaggaatattcaggcatacgtatagtttagacccacaggagatctgacagtaaaacctatttaatatgttcaaggaaattataagatggagaaatttagcagagtatcttagatagcctctttatagtaaaccctagtacttaaatagttcagtatactgatctcaatactcactggatgatttaactagcaaactggtagcactagctgaaggatttgtgagcttgagatatagtatgtagtaaaaaatattacaggtataaagttcgagatttaccaaaatgggacattagagattaagatatgtcataagatatcagggataaagatctgtataaatataaatggagtttcagaaagatattaaagagaatgaagataaatcaagatttgaacagataatggatgacaattttaaaaattaacttaagacattgtagaatcaagaaaggctatacatctcaagcaagagaaagactaataaaagcaggccgggcatggtggcgcacccactgtaatcccagcacttatggaggctgaggtagttggatctcttgggctcaggagtttgagaccagcccggccaacatggcaaaaccctgactctacaaaaaaattagccgggtgtggtggcatgcgcctgtggtcccagctactcaggaggctgaagagggaggatcacttgaatctgggaggttaaggctgcagtgagctgagattgcgccactgcattccagcgccaccacactctcaaaccttctgaaacaaaactgcttcaaaaacaaatacaagaccttccactg

SEQ ID NO: 571206 - DNA, 217 bp, Homo sapiens
ctcggtcctgtagcagacacagcataagttacttagagccaaatgttaattgccaagacaacaatggggaaaatgtctccaggctttgtcagagaactttcccattacaggcctggaagcctaggaggaaaaaatggttttcgcgggccaggcccatggtccctctgcatgtgtgcagtctacgggacttgcgttccctgtcatcccacgtttctct

SEQ ID NO: 571207 - DNA, 433 bp, Homo sapiens
cacggttataagtagttcaccagcaaaacggagaacttagtagacagtggttatagccaacgactgctatagtgccccttgtggcactgtcgagaatgcctcacttgtgttgtattttatgtatttcatcatgttaattttttaaatagcaggtatttgcgttcacatgttttgtgtatagtatgtttggggcctaaatgtacatgttttacatcattaattaaattgctataaaacagtttcaaattacaattttaagagatattagtcgacaatattaacatagtcgaaattggttttatttaaactttccaaactttaataaattatgattctgattgaaattttataaccaaataaacatattttgagacttctgtaaaagatttgcacgtaacacctctaggaaaaatctagcatgcttcatttggca

SEQ ID NO: 571208 - DNA, 298 bp, Homo sapiens
gtccccacgtggggacgagccccaagttgagaacaagttatgaaccattgttatactgaaccacttattacatactgctgatcataaacacctgtgtgtaatatttttccctaaaacgtagcacccttcagcaggaccctataaaactttcctccagcccttgcctctttgcaggtagccccttctctgctgagctgcccactgcaacatattttcacaatttctctaataaatctgcccttctttacctacaactatcttggtaaatggctttaccacctgcaaaactgaccctagg

SEQ ID NO: 571209 - DNA, 486 bp, Homo sapiens
ccggacccggaacacaaataaacaaagccactctttggcacagttgtgttaaatacacatcccaggtcacacttgttcctggctccccaagcctgggtcactgctacatggattgcgccaaaacattcgcagcttcaacactgctagattaacattgctggcatttttaaatcacagcaaagcttttcacaatgccctcaagtacgcgaggacaaaggagaacagcaacatgcaacggcagatcctcatgtgaacgggcaggaacagtccctgcgagggcagcatgccagggcaagcacgtccacggccagccctggacttctactccgtgctcaataaaaacaaaactgtgaagcacaccatacatcatgcaaacgcaatacatgcccggacgttgggcgcatctagttagaatgaagtgacttgcgtacaggagtccatgtacgagaactgccacatgagttcaaactcctttgtagccgtctc

SEQ ID NO: 571210 - DNA, 1273 bp, Homo sapiens
gcagccctgttggtgatcggctatctcagggccccctgctggtctttgaggaggccttcttctcgttctgtagcagacaaccacctggagtacctggtgggccgtgtgtggatcggcttctggctggtgttccatggaccctgctcatggtggccctggaggggagcttcctggtaccgcattcgtactccacgcattcacccaggagatactatacgcctatctatgatctcactcttttttctatctatgagaacttctacaagctggtgaagatcttccaggagcacacaccctgcataggctgcttcagacctccaacagactcagaggtaggacggcggatgagaacatgacatagggccgagggacaagaaccacagctggggccgggcacacaggagcttggctagggaagtactaggcgcaggggaaagacccgggggccaagcccacaacacaggaccatgcatgtcgcatggatgcatcagtgagccagagcaccatatattatcaatcggaacatatcttaccatgcagcacaaatttacaacggaaccaggcacagagatacatataccataggcccgggatacagagccgaggactgaagcatgagaggacccaacatggagaggtgagacacaaatacgacaaaataccatccactcacatggctggcaaagcaggagcaataaccacgacaactaaggaaggcaaccaggcaataactaggccccaagaacacagcctggaaagccagacccaccaaggagggaatacaaccaaccaggaccgaaactagccgccacgcacacaaaaaacaacaacggccccacgcggaagcagatccagaccaaccccatggcgaaaaggacgaagaggacagcgacccagaaacaccatggaagctagtaacatagcaacgagctcacggccagcacagcacgagcgagcacccagcaccaaccaccgagcacgtcgtaacaacgtcaagtgcacaccatatgcatggggaagaaccaccaggaaaaaaaaacacagaaggcaaccaggaaagcagaacacaaaaacagcgaaaaagagactgaccaaaaaagacaaggggaactaacgaggacgtaaaacacagcaggggcacagccggagatggccagcaacacacggaagacaacacgggagacaggacaaactacaagcaagcaccagagataggagacagcagacacacaggagagcgcggaagtaaagcgagccgaagagagaccagcca

SEQ ID NO: 571211 - DNA, 145 bp, Homo sapiens
cactgacactcactgacacgactctcgcgcgcgactcgactactacgcgctttacacactttgcgcactgctacgctactacgttctacgacggtacccggtagttaaccgttagacacggctaccgtactacctaccggacact

SEQ ID NO: 571212 - DNA, 165 bp, Homo sapiens
  misc_feature (54)..(54): n is a, c, g, or t
  misc_feature (57)..(57): n is a, c, g, or t
  misc_feature (62)..(62): n is a, c, g, or t
  misc_feature (71)..(71): n is a, c, g, or t
  misc_feature (80)..(80): n is a, c, g, or t
  misc_feature (87)..(87): n is a, c, g, or t
  misc_feature (103)..(103): n is a, c, g, or t
  misc_feature (108)..(108): n is a, c, g, or t
  misc_feature (110)..(110): n is a, c, g, or t
  misc_feature (114)..(114): n is a, c, g, or t
  misc_feature (121)..(121): n is a, c, g, or t
  misc_feature (134)..(134): n is a, c, g, or t
  misc_feature (141)..(141): n is a, c, g, or t
  misc_feature (148)..(148): n is a, c, g, or t
  misc_feature (151)..(151): n is a, c, g, or t
  misc_feature (157)..(157): n is a, c, g, or t
accggttaggggatttgggttttacaaggaaaactaaactcctgctttttgctnaangtggnttttgcccnctaaatttnaaaagcngcctttttaaaatttncaaancnatgnttttccnggattgtttggtnatttttnaaaaaantcntggtcngggggcca

SEQ ID NO: 571213 - DNA, 411 bp, Homo sapiens
tagagtatcccccatcgtttgaaggcggtggaaatctcttatagtcgaaaaaaaagacatcaagcttcaagtgtgctttgataggagcgttgttgggattgggaagctgccggcgggataaatagtggaaggacatcttatgtcattggtttggggagtatatttggctctccctagttggtcctgagttagcagtggaagaaaaaaacacggaagttggcagtcactgaccaagtcctgggtggattgctccagagttagtagtttgctccagagttagtagtttgacttcccaggttgcttgctatagagtttgtaggtcagaaatctattgtcacatttggtcaggtcattgtttatattttcagtttctcaatcttttaattttctagttcattttccactaattgt

SEQ ID NO: 571214 - DNA, 1118 bp, Homo sapiens
  misc_feature (32)..(32): n is a, c, g, or t
  misc_feature (36)..(36): n is a, c, g, or t
  misc_feature (132)..(132): n is a, c, g, or t
  misc_feature (490)..(490): n is a, c, g, or t
  misc_feature (505)..(505): n is a, c, g, or t
  misc_feature (514)..(514): n is a, c, g, or t
  misc_feature (541)..(541): n is a, c, g, or t
  misc_feature (1063)..(1063): n is a, c, g, or t
  misc_feature (1076)..(1076): n is a, c, g, or t
  misc_feature (1081)..(1081): n is a, c, g, or t
  misc_feature (1083)..(1083): n is a, c, g, or t
  misc_feature (1089)..(1090): n is a, c, g, or t
  misc_feature (1095)..(1095): n is a, c, g, or t
  misc_feature (1097)..(1097): n is a, c, g, or t
  misc_feature (1104)..(1105): n is a, c, g, or t
gctgcaggaattcggcacgagggctgatttanaagngctgctttgggcagttacacagtttgtttacaatgaggagttatttgactttgaacatactgtacatggcaattagaagttgtcatggcaaaaganaaccacagctggcctgccacagccaacacaagaaccagaaaatggtagatgaaatgaaggaataaaggtggggtttattccttattataaaagaaaaaaaataattcttcagcagtcttaacaaagacatcaagatacaaaattacaagtgttttgactccagccctgtccccatctcctccaagagcagaggtaggagacagttgaagcaaacaagcaattctgtaaaaattacctagaaaccctacaaatttgattaaaatcaaaaataattcttcagcagtcttaacaaagacatcaagatacaaaattacaagtgttttgactccagccctgtccccatctcctccaagagcanaggtaggagacagtngaagcaaanaagcaattctgtaaaaattacctaganaccctacaaatttgattaaaatctaaacttctataattttgctttttaaaaaatttaatatcaaaaggcctgctttagtgacatgctattcctaccagaaaataaccccaataccccctctgtcagtaacatgctcaagttgaccagccaactcttatctctaaacctatgtggacaagtgtgtcttttaaaccaaagccacggagatcaagtgactgctagtaacgtgtcgtctgttaactaatccagtgcccaccttctccagagggtgggcagggcagaaacccaaaagggtcttgagggcctaatcccagatcaccatctaagaaccacttcccttgctctctactcaaaatgagatgctttatttctaatccgactatttgtctcaaatttggtgccccgtgacctggatggttttttcctttagcaaaacacacataatccacaaaaccatacatatagtttttgtctttacatttagatataaaaatactattctgctttgtgtgataaatcaanggaccaagcagtnaggancntttctnntttcngntaggatnnctctctgtttatc

SEQ ID NO: 571215 - DNA, 989 bp, Homo sapiens
  misc_feature (32)..(32): n is a, c, g, or t
  misc_feature (36)..(36): n is a, c, g, or t
  misc_feature (132)..(132): n is a, c, g, or t
gctgcaggaattcggcacgagggctgatttanaagngctgctttgggcagttacacagtttgtttacaatgaggagttatttgactttgaacatactgtacatggcaattagaagttgtcatggcaaaaganaaccacagctggcctgccacagccaacacaagaaccagaaaatggtagatgaaatgaaggaataaaggtggggtttattccttattataaaagaaaaaaaataattcttcagcagtcttaacaaagacatcaagatacaaaattacaagtgttttgactccagccctgtccccatctcctccaagagcagaggtaggagacagttgaagcaaacaagcaattctgtaaaaattacctagaaaccctacaaatttgattaaaatctaaacttctataattttgctttttaaaaaatttaatatcaaaaggcctgctttagtgacatgctattcctaccagaaaataaccccaataccccctctgtcagtaacatgctcaagttgaccagccaactcttatctctaaacctatgtggacaagtgtgtcttttaaaccaaagccacggagatcaagtgactgctagtaacgtgtcgtctgttaactaatccagtgcccaccttctccagagggtgggcagggcagaaacccaaaagggtcttgagggcctaatcccagatcaccatctaagaaccacttcccttgctctctactcaaaatgagatgctttatttctaatccgactatttgtctcaaatttggtgccccgtgacctggatggttttttcctttagcaaaacacacataatccacaaaaccatacatatagtttttgtctttacattaatttaaaacctatttcgttgggataatcaaggccaccttttcaacaggatcccagataatacaaacttctttttctaactcctttttctatccccttagaaatgggtatcttagaagtcccccggggggaaccg

SEQ ID NO: 571216 - DNA, 935 bp, Homo sapiens
  misc_feature (32)..(32): n is a, c, g, or t
  misc_feature (36)..(36): n is a, c, g, or t
  misc_feature (132)..(132): n is a, c, g, or t
  misc_feature (358)..(358): n is a, c, g, or t
  misc_feature (880)..(880): n is a, c, g, or t
  misc_feature (893)..(893): n is a, c, g, or t
  misc_feature (898)..(898): n is a, c, g, or t
  misc_feature (900)..(900): n is a, c, g, or t
  misc_feature (906)..(907): n is a, c, g, or t
  misc_feature (912)..(912): n is a, c, g, or t
  misc_feature (914)..(914): n is a, c, g, or t
  misc_feature (921)..(922): n is a, c, g, or t
gctgcaggaattcggcacgagggctgatttanaagngctgctttgggcagttacacagtttgtttacaatgaggagttatttgactttgaacatactgtacatggcaattagaagttgtcatggcaaaaganaaccacagctggcctgccacagccaacacaagaaccagaaaatggtagatgaaatgaaggaataaaggtggggtttattccttattataaaagaaaaaaaataattcttcagcagtcttaacaaagacatcaagatacaaaattacaagtgttttgactccagccctgtccccatctcctccaagagcagaggtaggagacagtattctgtaaaaattacctaganaccctacaaatttgattaaaatctaaacttctataattttgctttttaaaaaatttaatatcaaaaggcctgctttagtgacatgctattcctaccagaaaataaccccaataccccctctgtcagtaacatgctcaagttgaccagccaactcttatctctaaacctatgtggacaagtgtgtcttttaaaccaaagccacggagatcaagtgactgctagtaacgtgtcgtctgttaactaatccagtgcccaccttctccagagggtgggcagggcagaaacccaaaagggtcttgagggcctaatcccagatcaccatctaagaaccacttcccttgctctctactcaaaatgagatgctttatttctaatccgactatttgtctcaaatttggtgccccgtgacctggatggttttttcctttagcaaaacacacataatccacaaaaccatacatatagtttttgtctttacatttagatataaaaatactattctgctttgtgtgataaatcaanggaccaagcagtnaggancntttctnntttcngntaggatnnctctctgtttatc

SEQ ID NO: 571217 - DNA, 559 bp, Homo sapiens
  misc_feature (21)..(21): n is a, c, g, or t
  misc_feature (49)..(49): n is a, c, g, or t
  misc_feature (60)..(60): n is a, c, g, or t
  misc_feature (504)..(504): n is a, c, g, or t
  misc_feature (517)..(517): n is a, c, g, or t
  misc_feature (522)..(522): n is a, c, g, or t
  misc_feature (524)..(524): n is a, c, g, or t
  misc_feature (530)..(531): n is a, c, g, or t
  misc_feature (536)..(536): n is a, c, g, or t
  misc_feature (538)..(538): n is a, c, g, or t
  misc_feature (545)..(546): n is a, c, g, or t
tattagaacttgctaaagaanctgtaataagctattttgaaaacgaagnctgcttttgtnaaatgaataatttctaccagaaaataaccccaataccccctctgtcagtaacatgctcaagttgaccagccaactcttatctctaaacctatgtggacaagtgtgtcttttaaaccaaagccacggagatcaagtgactgctagtaacgtgtcgtctgttaactaatccagtgcccaccttctccagagggtgggcagggcagaaacccaaaagggtcttgagggcctaatcccagatcaccatctaagaaccacttcccttgctctctactcaaaatgagatgctttatttctaatccgactatttgtctcaaatttggtgccccgtgacctggatggttttttcctttagcaaaacacacataatccacaaaaccatacatatagtttttgtctttacatttagatataaaaatactattctgctttgtgtgataaatcaanggaccaagcagtnaggancntttctnntttcngntaggatnnctctctgtttatc

SEQ ID NO: 571218 - DNA, 268 bp, Homo sapiens
tcggaacttcgggactcgcatcctgtgagtaccgggaatcgcagccgcgtcgacgcggtgctggttttcgctcgtcgactgcggtctctctggcagcgaacagccggggtctgagaacttgtctgtaaaccggcgtgggtaagattagtgtaaccatgttactcctctgttccccggtgggaaaaccccgccatctgctcccaccagtgttcattgatatctctctctcccgcgggtaaacaatcctcatctctctgcccgggatcgt

SEQ ID NO: 571219 - DNA, 139 bp, Homo sapiens
cccccccttaacttttttccctaaacacctttttttaggggggggccaagggggggagttctaaattgggtgggggggccggggattcccggggggcaagtgtttttttttcctttgtcaataaactgttttaaagtta

SEQ ID NO: 571220 - DNA, 1167 bp, Homo sapiens
tgtttctacataaccgtatgagctttcgtcttcgttttccctgtttttcttcctcgactctgtgttgttgtgtatttctctttctcgtcttctttttgtgctgtttatttctcttctttttctgtgtctattatattgtttcgctttgttatccttcttaatttctattttcctgttttccttctttcatttacgattggccttttggtgtctttttcccttgtgtgttttacctcgtgacttttctgtacttgctttcattttttgatcagtttttactagtgtcacttttctcttgttatttattcatgtattgccacttttgatattttaattgggtctttatctgtttagtctaatcctttattatctttatttgtttcctgtgtttttctctacttgtcacttttattgcattagtctatgttagccgttcgtcctcaggtctcttttattgatgtgttatattgctttgttccttgtatagctgttttagtgtttctattataatattataccaggtagatttctttttatattctgagttagctgtagttctttattattttgtggattcttagccttatctagttacttatttctgctacatcttctggtttggtttattatttattttttcctatgtaggaaatcctacttctgtattttgttacgtctgtacttagtagtttagtatggtcgtctccatcagtagttaagtgacagctatttgttgtgtataggtgtatggctctccctcctccctccccatttcattggcgtaacgtattagtgtattctgtactatatatttacaaataaaactattttattttcattgttacttattatttgagatatttctcttactactttattattctataataattaagtaccatgtatagggtatgtttttagagtataatggtaagtttgtagtaaccctacagaacatctgtgatctttctacagcagcttcagttttgtgccatacattccatgtattttgatatgagcaaaaactgatcttaagtagcagacttaaagtagctttgtacgccttaatgttcattttgatttattttaaatctttacattctagaaatgagatactgtattatcagaccaggaggcatttactgtcgaagataatttcctattcta

SEQ ID NO: 571221 - DNA, 264 bp, Homo sapiens
gggcgtgaggcccacccaggaaaattgcgcaatcctatcaccgaagtcctgcaggggactctggaacccaacgatgtgcctccaaaagggtgtaaggttgtctcgacatccagtacaaggacacatcacgaaaaaagagtggcacacatacctaaaaaaagctccacagtataaagaacgtctgggctcccaagtgatcacgtcaacggccaaatgcatgtgccacactgtcccccgaaagcacctcctatgcctgcaggttgc

SEQ ID NO: 571222 - DNA, 2248 bp, Homo sapiens
atggcggtggccaggaagatccgaactttgctgacggtgaacatcctggtgttcgtgggcatcgtcctgttctccgtgtactgccgcctgcagggccgctcccaggagctcgtgcgcatcgtgagcggcgaccgccgggtgcgcagccgacacgccaaggtgggcacgctgggggaccgtgaggccatcctgcagcgcctggaccacctggaggaggtggtctacaaccagctcaacggccttgccaagcccatcggcctggtggaggggccaggaggtctgggccagggtggcttggcggccaccctgcgtgatgacggccaggaggcggaaggcaagtatgaggagtacggctacaacgctcagctcagcgaccgcatctccctcgatcggagcatccccgactaccggcccagaaagtgcagacagatgagctacgcccaggacctgccccaggtctccgtggtcttcatcttcgtcaatgaggcgctgtcggtcatcctgcgctccgtgcacagcgtggtcaaccacacgccctcccagctcctcaaggaggtcatcctggtggacgacaacagtgacaacgtggaactcaagttcaatctggaccagtacgtcaacaagcggtacccaggcctcgtgaagattgtccgcaacagccggcgggaaggactgatccgcgcgcggctgcagggctggaaggcggccaccgccccagtcgtcggcttctttgatgcccacgtcgagttcaacacgggctgggccgagcccgcactgtcgcggatccgagaggaccggcgtcgcatcgtgctgccagccatcgacaacatcaagtacagcacgtttgaggtgcagcagtatgcgaacgccgcccatggctacaactggggcctccggtgcatgtacatcatccccccgcaggactggctggaccgcggcgacgagtcagcacccatcaggaccccagccatgatcggctgctccttcgtagtggaccgcgagtacttcggagacattgggctgctggaccccggcatggaggtgtatggcggcgagaacgtagaactgggcatgagggtgtggcagtgtggcggcagcatggaggtgctgccctgctcccgcgtggcccacatcgagcgcaccaggaagccctacaacaacgacattgactactacgccaagcgcaacgccctgcgcgccgccgaggtgtggatggatgacttcaagtcccacgtgtacatggcctggaacatccccatgtcgaacccaggggtggacttcggggacgtgtctgagaggctggccctgcgtcagaggctgaagtgtcgcagcttcaagtggtacctggagaacgtgtacccggagatgagggtctacaacaacaccctcacgtacggagaggtgagaaacagcaaagccagtgcctactgtctggaccagggagcggaggacggcgaccgggcgatcctctacccctgccacgggatgtcctcccagctggtgcggtacagcgctgacggcctgctgcagctggggcctctgggctccacagccttcttgcctgactccaagtgtctggtggatgacggcacgggccgcatgcccaccctgaagaagtgtgaggatgtggcgcggccaacacagcggctgtgggacttcacccagagtggccccattgtgagccgggccacgggccgctgcctggaggtggagatgtccaaagatgccaactttgggctccggctggtggtacagaggtgctcggggcagaagtggatgatcagaaactggatcaaacacgcacggcactgaccccacctccgcccggacccccacagacctcgggaaggcgctgggccgagccagtgtggctgagtgaccggggtgtgcccggcagacacagcaggacagggctctatgtgcggccaggacagcagaggctgaggggccggggtgtggctgagtgaccagggtgtcacccactgcatctggagtacagcttctcctaggacaggcggctctacccgagggagggcgtctggggacagtgatgccaactcaaacacgtgccttctccacggtatctcctggccaggctgctgggacagccgccgcctctgcatgtaccacagccccccacgccccatagggaggccaagccccggaccatgcaccaggctgcaccctggtgtcttccacccgcaggcctcccatgctccaagcagcctcccccagcacttgcggccgc

SEQ ID NO: 571223 - DNA, 188 bp, Homo sapiens
ggtcgactcttgggctcaagcatcacgcctagcagttggaggctgtagtatgctatgatagcatctgtgaatagccaccgcactccagcctgggcaacacagcaagacctcatctgtaaacaaaacaaaacaaaacaaaacagacaaaaatgaaccagaaagtcctctttacttatgctgttaaagaa

SEQ ID NO: 571224 - DNA, 214 bp, Homo sapiens
attggtccatattcaaacctattcccaaaggttaaaagggtttaaaattcctttattgggggcccatgtctgtttacctatgcttatgagcaccaataaattactagtttcccttctggaattttaattgttaaacccgaatcaattattggaaagtgaaaaaccccccccggtcccccaacaggggacgtaaataaatgtgttgttccccgta

SEQ ID NO: 571225 - DNA, 1409 bp, Homo sapiens
gagcggcctagtctggaaggcagaaaggaagccccggctcaggtggctggaaaaccccaggcttttctcaggcaggttgtcccacagcagagacaacagacagaaacccagaaaccacctgccacgatgtgaacctgatgcagaaacgcggttcgctccctcgggatgcaaaggccaacttcagcctggcacggcggcgccgcggactccaccatcccggggaaggagccggacccctgtgtggcagtgtggcggcagcatggaggtgctgccctgctcccgcgtggcccacatcgagcgcaccaggaagccctacaacaacgacattgactactacgccaagcgcaacgccctgcgcgccgccgaggtgtggatggatgacttcaagtcccacgtgtacatggcctggaacatccccatgtcgaacccaggggtggacttcggggacgtgtctgagaggctggccctgcgtcagaggctgaagtgtcgcagcttcaagtggtacctggagaacgtgtacccggagatgagggtctacaacaacaccctcacgtacggagaggtgagaaacagcaaagccagtgcctactgtctggaccagggagcggaggacggcgaccgggcgatcctctacccctgccacgggatgtcctcccagctggtgcggtacagcgctgacggcctgctgcagctggggcctctgggctccacagccttcttgcctgactccaagtgtctggtggatgacggcacgggccgcatgcccaccctgaagaagtgtgaggatgtggcgcggccaacacagcggctgtgggacttcacccagagtggccccattgtgagccgggccacgggccgctgcctggaggtggagatgtccaaagatgccaactttgggctccggctggtggtacagaggtgctcggggcagaagtggatgatcagaaactggatcaaacacgcacggcactgaccccacctccgcccggacccccacagacctcgggaaggcgctgggccgagccagtgtggctgagtgaccggggtgtgcccggcagacacagcaggacagggctctatgtgcggccaggacagcagaggctgaggggccggggtgtggctgagtgaccagggtgtcacccactgcatctggagtacagcttctcctaggacaggcggctctacccgagggagggcgtctggggacagtgatgccaactcaaacacgtgccttctccacggtatctcctggccaggctgctgggacagccgccgcctctgcatgtaccacagccccccacgccccatagggaggccaagccccggaccatgcaccaggctgcaccctggtgtcttccacccgcaggcctcccatgctccaagcagcctcccccagcacttgcggccgc

SEQ ID NO: 571226 - DNA, 1425 bp, Homo sapiens
ggcgcttctgaagacgggtgggcagacgatggaggacgaggctctgtcccgcccctgcagcttccttcgttccggccccttccagcgaagggcaggctccgagcagagacaacagacagaaacccagaaaccacctgccacgatgtgaacctgatgcagaaacgcggttcgctccctcgggatgcaaaggccaacttcagcctggcacggcggcgccgcggactccaccatcccggggaaggagccggacccctgtgtggcagtgtggcggcagcatggaggtgctgccctgctcccgcgtggcccacatcgagcgcaccaggaagccctacaacaacgacattgactactacgccaagcgcaacgccctgcgcgccgccgaggtgtggatggatgacttcaagtcccacgtgtacatggcctggaacatccccatgtcgaacccaggggtggacttcggggacgtgtctgagaggctggccctgcgtcagaggctgaagtgtcgcagcttcaagtggtacctggagaacgtgtacccggagatgagggtctacaacaacaccctcacgtacggagaggtgagaaacagcaaagccagtgcctactgtctggaccagggagcggaggacggcgaccgggcgatcctctacccctgccacgggatgtcctcccagctggtgcggtacagcgctgacggcctgctgcagctggggcctctgggctccacagccttcttgcctgactccaagtgtctggtggatgacggcacgggccgcatgcccaccctgaagaagtgtgaggatgtggcgcggccaacacagcggctgtgggacttcacccagagtggccccattgtgagccgggccacgggccgctgcctggaggtggagatgtccaaagatgccaactttgggctccggctggtggtacagaggtgctcggggcagaagtggatgatcagaaactggatcaaacacgcacggcactgaccccacctccgcccggacccccacagacctcgggaaggcgctgggccgagccagtgtggctgagtgaccggggtgtgcccggcagacacagcaggacagggctctatgtgcggccaggacagcagaggctgaggggccggggtgtggctgagtgaccagggtgtcacccactgcatctggagtacagcttctcctaggacaggcggctctacccgagggagggcgtctggggacagtgatgccaactcaaacacgtgccttctccacggtatctcctggccaggctgctgggacagccgccgcctctgcatgtaccacagccccccacgccccatagggaggccaagccccggaccatgcaccaggctgcaccctggtgtcttccacccgcaggcctcccatgctccaagcagcctcccccagcacttgcggccgc

SEQ ID NO: 571227 - DNA, 94 bp, Homo sapiens
  misc_feature (67)..(67): n is a, c, g, or t
  misc_feature (80)..(80): n is a, c, g, or t
attcgcggccgcgtcgacataaaataaagacactgcccagtccctccctcaacgtcccgagccaggngctcaagggcatnattccaataaccca

SEQ ID NO: 571228 - DNA, 808 bp, Homo sapiens
  misc_feature (143)..(143): n is a, c, g, or t
  misc_feature (193)..(193): n is a, c, g, or t
gcacactccacctgtattactgtgcattgataatctctgcattatatcccaataaaagtatagagtggagtatagtattgataacctgtttgcatgtctatatgagtatctgcttggaggatatacttattcatatctcttgncttcaagcaataagaactttggaatggagctatggcccttatcatccatntcgtgtcaatacctgaacgcatggtctacgtaataagtactttctgctagtgtaccagccctacttacgttgagactcactcgtacgtcgttaaagctagtacgtgagctgaatagactcgatgcgcccgatcaacatcatagacgctggacttcgtggaatgcgctcaagcattatgaggatcatactttaatatgcgtagcgacaggactattgggacacctatgccagactgcacttcgtgactactgcacggatggctcccaacggactattaatattcttagattcaaccttgtcttaactacctggggtcaacaagtagtgccctcctagagtgttccccgttttattaaagcttggtatacatggtttggtccaccaaggaaggactcaagagatgcatcctggccctactactttgcgtataccctcaatgtgtcaatattgacgtacctataccttatgcccactctagtaggtcttgccttgcaacagcattaccatgcacgattgcgaacaaacagttcaaccacatgaaaagccaaggaatttaaccctcctccctcattggtcttacccggtcctctccttttgtaggacccctaatcctcg

SEQ ID NO: 571229 - DNA, 1623 bp, Homo sapiens
  misc_feature (386)..(386): n is a, c, g, or t
ggcgcttctgaagacgggtgggcagacgatggaggacgaggctctgtcccgcccctgcagcttccttcgttccggccccttccagcgaagggcaggctccgagcagagacaacagacagaaacccagaaaccacctgccacgatgtgaacctgatgcagaaacgcggttcgctccctcgggatgcaaaggccaacttcagcctggcacggcggcgccgcggactccaccatcccggggaaggagccggacccctgtgggtgacgtgggactgtggggcgggggtgtccccggctgggctgagctgagcagcgaggaggctctgggttgccggaccggggtcagggagcctggcgttagctgcgtgctgtgtggtcatctcggcgangagggagcggctccctcctgccccggactctggatctgtcctgcggtgggcggtgtcggagcagccgtgtggcagtgtggcggcagcatggaggtgctgccctgctcccgcgtggcccacatcgagcgcaccaggaagccctacaacaacgacattgactactacgccaagcgcaacgccctgcgcgccgccgaggtgtggatggatgacttcaagtcccacgtgtacatggcctggaacatccccatgtcgaacccaggggtggacttcggggacgtgtctgagaggctggccctgcgtcagaggctgaagtgtcgcagcttcaagtggtacctggagaacgtgtacccggagatgagggtctacaacaacaccctcacgtacggagaggtgagaaacagcaaagccagtgcctactgtctggaccagggagcggaggacggcgaccgggcgatcctctacccctgccacgggatgtcctcccagctggtgcggtacagcgctgacggcctgctgcagctggggcctctgggctccacagccttcttgcctgactccaagtgtctggtggatgacggcacgggccgcatgcccaccctgaagaagtgtgaggatgtggcgcggccaacacagcggctgtgggacttcacccagagtggccccattgtgagccgggccacgggccgctgcctggaggtggagatgtccaaagatgccaactttgggctccggctggtggtacagaggtgctcggggcagaagtggatgatcagaaactggatcaaacacgcacggcactgaccccacctccgcccggacccccacagacctcgggaaggcgctgggccgagccagtgtggctgagtgaccggggtgtgcccggcagacacagcaggacagggctctatgtgcggccaggacagcagaggctgaggggccggggtgtggctgagtgaccagggtgtcacccactgcatctggagtacagcttctcctaggacaggcggctctacccgagggagggcgtctggggacagtgatgccaactcaaacacgtgccttctccacggtatctcctggccaggctgctgggacagccgccgcctctgcatgtaccacagccccccacgccccatagggaggccaagccccggaccatgcaccaggctgcaccctggtgtcttccacccgcaggcctcccatgctccaagcagcctcccccagcacttgcggccgc

SEQ ID NO: 571230 - DNA, 703 bp, Homo sapiens
taaagggtagttcttcaaatccctaattatagtcaaaagaaatcttttatatgaattgggggggaaaattgggatttttaattggagtatgattaaagaaacttagtggaaaatctgcaatatgctaggataaaaaatactggtgctttactcggtgggcaaagcagattaattaaaacaatatagattagcaaggggaaaaagcaaagttattaatataaactaggtcatttggcagattgtcgcaaattttatgggaaattctaatggatcacatttggattggatttcataagaagtcaccattattattcatggttaaaagaacacctcaagccttctatgtggctatgattttaacaatcttttatactttaacaacagatttgaaattaaacgggcttcctagctggttcctattttctcaaattggtgcaaaatggacttttataattctctatcttaaaagtcccctaaaagagaataatggcgaactttacgtctcctagtcctaagttctgggcattcaatgcggcctccaatgaaccatgggtagtctcattaaagctctgttaggcccactttcacactcattcatacactgtcaaaccgtcggttcacagagggttcttttaaaagccccttttccagatcctgggattccaagtacttcccatttgggcttccccctgtcttcatctcg

SEQ ID NO: 571231 - DNA, 563 bp, Homo sapiens
  misc_feature (31)..(32): n is a, c, g, or t
  misc_feature (137)..(137): n is a, c, g, or t
  misc_feature (162)..(162): n is a, c, g, or t
ggtgggggggggggaaaaaacacattttccnngaatccactgcacactggggcctatacactttgggcatttaattggatttggcgtggggatattcctggtaaaagaacacattggctttcttttctaggacaganttatgcattcggggggggggcctanttaggttcctatataggggggggatgtcgagagggcagactatgggggaccatgattctattatggatggggacggctggaggccaagatataattttttaaaaataggggtatttctttcaagggttacaaataacaagggggcaccttggatttaaaatgggcattataggtgggaggcgggcatgcgcaggcattgttggttaaggggaatatttttaatggaataaatgggaagacggcgcgggggggggatctgacaggggtgaatgggccaagcgaaaccacagcggggtatattttaaagcgcatgagggctttaagggccatggtgggagggggtctcaggaaggggcataggacgggcatgggagtattgtgggaggcctgatcaggcaagg

SEQ ID NO: 571232 - DNA, 479 bp, Homo sapiens
taatagttttctatggaactgatctaagattagaaaaattaattttctttaatttcattatggacttttatttacatgactctaagactataagaaaatctgatggcagtgccacagtgatagcatttattgttatttaaataagaccttggagcatatgtgcaacttatgagtgtatcagttgttgcatgttatttttgcctttgtttaagcctggaacttgtaagaaaatgaaaatttaatttttttttctaggactagctatagaaaaggtatttagagtatctagttaatcagtgcagaattgcagaaccttcatggtgtatggtatgtgcttctgtggtttcgaaagactttatcatctagtctttgtatatttttccttttatgttcaagtcctagtgtaaaggattggcagtttaaatgctttactcccccttttaatattaatgattaaaatgtgctttggaaaaaaaaaa

SEQ ID NO: 571233 - DNA, 1016 bp, Homo sapiens
ggagtcgcgcggtaagaagcaacaagctctcctcttcgtctccgccatcagctcggcagtcgcgaacgcaggcatagcatgcgtgtagtgcatctcctagtccagcgtgggcaggctggtgtgcgagtatcggcaatggcctgctgggaagctactacgtagcctggaacacaggcatccagcctcgatggccagatgccaatgtgacagagaccattgcgggagaggagatagattgccgttctagaaaccttcttcagtagacgacagagggagctgaggcaagcaatgtgccccggggtcagtgttggttagactctggaaacccgactagtcaatctgagtgacacgtctcggcaactgtggaccttaggcaggcaaagcgtcgttccgaccgcttgaagccacactataatctaccagggcaaacaggaccggatggctggccaaataaacttaatggcccagaaggggtgctacttcaaaggctactatggggcacacgcggacgaatcccagttgaatccgtccgactgctgagagatagccgaaaagtgcccggcacaagcttcgtgggctggacccaaggtggcaacaggggggttctaccaaggggtacatagcctttcaggggtatcatctatccccaacagaggggcctttatgggcggatagcgaccggaaaacctttgggtattgcccttgggggagtatctcaccgcacgtacaagacttggggcttcccagtggggaagaaccagattcaatctatcaaagggttcgcagaatatcactcgaggccaacatggaaaaggctccccaaatgtcctgggagaagtgtgtcttccgtaaactgtaaacccccgtgggggaggccctcgcaaggattttcccccacgaaggcatggttaacggtagggaaaggtcccgtgactaacagtgttcccaagttcgtcttcaagcacaagccgctaagagagcacaaacacctgtgtgaaagacaacctcggtggcat

SEQ ID NO: 571234 - DNA, 292 bp, Homo sapiens
tggctggtgcagagctcttaagttaaattagggtctcactggtcaattttggttttggtggccgtggctttggagagtctccatcatgaattcttggccagggcctatgtcgggagtggtatttcctaggtttcctccaagggtttaatagtttaaggtatcccttttaagtcttaaatccatctggagtggatctgggaacagggggaaggggagggggtcaagtttcaatcttcggcatagggttagccagttatcccagcatcatttatgacatagggaatcttttccc

SEQ ID NO: 571235 - DNA, 1091 bp, Homo sapiens
  misc_feature (327)..(327): n is a, c, g, or t
ggaggctctggctcttgcttcttaggcggccggaggacgccatggccgagtgcccgacactcgtgggtaggcagtcactcgaccacccggatcgcctgtgggcctgggagaagttcgtgtatttggacgagaagcagcacgcctggctgcccttaaccatcgagataaaggatagagttactaggtttacagggtgcttcttgcggtcgggaagactgtctgtcctggggaggccttatgtaccccgctaccctgagatagtgcccaatgctctgcgtgccgtatcactgtggcatgattcttagccgtgtatggtactgagtaccngcatcctcagactcctagtttcttggctgctatacgtgtaccacattcaagatctgacggcgtgcgaggacatgcttctacgagctgctgcgcagatgactgatgtatggtctgtgggagtacctgtctcctttcacctccagggcctgatgcctggccagcctacattgggggatgttgtgtgttctgtctcgccgttcgttctactatgcctgtggtcttctccaccacgtctggggtctgggcggaatggacccgacagaaggatgagctctagccgggtcctgtgggacctgcctgtaagcccactctgctcgccttagcactaccactcctggcacggaggattccatttggccgagcttcttccaggtgcccagctatacctgtgcctcggcttctctcagctggatgatggtcttcaggctctttctgtcccttcttgtccttcacagcactagtatttcatgtttgcacaccaatcaagtccgtgaacttgtgagaaccacagcgattcacctgagcaggactcttaaaccctggaccagtggtctcccatggtgcgtacgctggttgtaacccgcctggaaagctggctggcgtgaaacaggctggaaagctgctgcgcggaaaaagccggaagctgctggcccacaggggcctggcgtccaggaagcgcgaagggaccctttgggccagaaccaagctcgggcgggccacccggagcacaggaggccgagccctgggtaccccacacttcgccc

SEQ ID NO: 571236 - DNA, 318 bp, Homo sapiens
atcgctgctcacaaaatacatggtcataacttttctttaaaaaaaaaaaaaaaaagacagccttaacaccattccaaggggcacactatttgggcaatggttatgcaccatttcaattcccccatggtgacccctaatcacttcatgtggatatccctttttggacccacccatctccttcatatatgggcatgtccatagataaagatagactacaaggtggtatagggctttatggtaatatgggtgggttatatgacctaaataaaggtgtatttatgtataaccagaggggtgtttttaactgtgagcgggtgg

SEQ ID NO: 571237 - DNA, 103 bp, Homo sapiens
atcgggagaagacaaaggcccagaaggagacgatgcgaagctggaggctgagctgagccggtggcgcaatggagagaatgtgcctgagacagagcgcctggct

SEQ ID NO: 571238 - DNA, 415 bp, Homo sapiens
  misc_feature (157)..(157): n is a, c, g, or t
  misc_feature (168)..(168): n is a, c, g, or t
  misc_feature (171)..(171): n is a, c, g, or t
ataaatttcatctgcttccatgaattaaacattaacagttctgtgatgtgctgatgtgccctaccacacagttctacagggtagcagtgattgattttattgtattttttttttgagcaatcaagagggggaagaaagggccgcgttgttggcgaangggaagtgggngcnaagaggcggcgtggcaaaaatggggggggggggggggggggggggggggggggggggggggggggggggggggggggggggggggggggggggggggggggagaatgataggagattctctctcaaccaatattatcaaatatttaatggctttggatttagttttactgagtaactcataacatctcttaaggaagttagtctaaaattacaaacaaaatcatgcctatatgaaaaacttata

SEQ ID NO: 571239 - DNA, 279 bp, Homo sapiens
ggtactagcatcccttaacagcggacccatgttcattgcagcgttattcacaatacgagatatggaaacaacctaaaaatttttggtgtttaatgacaatgtggtgtgtgtacacaactgaatattattcagctatgaaaacgaagggaaatcctgtcatgtgtgacaacgtggatgaacccaaagtcattatgttaagtgaaaggacccaggcacagaaagacagatactgcatgtcactcatatgtggatctaaaaactgtcacaactcacagaaac

SEQ ID NO: 571240 - DNA, 192 bp, Homo sapiens
gcttattcgtgtctgccgattactgcgctaaccacatcgagcagatagctgctgcctccatccactgcgtgtggattaccaacgccgctatcctctggctctggtctacccactacagggtcaatactcgctttgcatgtacccccagcgaggacccccagttccccttggtgcagtggtcagcccgtgaac

SEQ ID NO: 571241 - DNA, 514 bp, Homo sapiens
tttttttttgagacaaggtctcactctgtcacccagactggagtacagtagcgagattacggctcactgaagcctcaacttcctgggctcacgcaattctcccgcctcagcctcctaagtagctaggactataggcgcatgcatcacacgcggctaattattttatttttggtagaaacagggtctccccacgttgctcaggctggtcttgaactcctgagcccaagcgatcctaccgcctgggccttgcaaagtggtgggattacaggtgtaagccaccgcacccagacagagaagaagtattagacaaaaatctctcacatgtgcatatctgtgatggctagagcaggtcatcagaagttcaatgctgccaaaacacaagctgcatgtgtaggtgtagaggtggggataagaggctggagtgtgtggtagattgtaatgatggccccaattctttaccctcctttgtagtctcactgccacataactgcatggccctcattctatgggtgag

SEQ ID NO: 571242 - DNA, 268 bp, Homo sapiens
  misc_feature (156)..(156): n is a, c, g, or t
caccaccaaagacaggcaccctggatcttttcccgtggttcacgtccaacacaccaatggcaccagctttgccactcgactttgccaacatttttgtcattggcgagggcaacaaaccatggatttctcttcccccaggaaagggtatccgcctcnccccccccacaaaaaaagacaaaagactggcggccaaaaaaaacagtgggtgaaatgggtccctgggtgacatgtcagatctttgtacgtaattaaaaatattgtggcagga

SEQ ID NO: 571243 - DNA, 1317 bp, Homo sapiens
  misc_feature (512)..(512): n is a, c, g, or t
  misc_feature (524)..(524): n is a, c, g, or t
  misc_feature (699)..(699): n is a, c, g, or t
  misc_feature (891)..(892): n is a, c, g, or t
  misc_feature (952)..(952): n is a, c, g, or t
tggacattgattcaccacccatcacagacccggaacactggacggatcatctgtaccatcggtcccagcttcccgatctagtgtgcatgacgattagaacggatgatagaattaggctcatggaatgaagatgtgagcatcggtctgaaacatttctctacgatggacactcaatgaagataccgagtgcaggaccgaccagtcgacaggaagtagtagcaggcagatgggcaactgaggaagagtcgtttttgcttattctagacctctcacattcacatactaacaccaggtccctggggtctgtgagctcatagaaatcaactcaacaagggaatctgtaagatctcgagaccttgggactgcatcgacagggcgcaagacggtgcaacattgcaagtagagttggagacgtaggaagcagagttggagcaacacggtctttcaagaggtacgaccagttcgtcgtgattcattcaggcctgatcatttgggaaagacagatgctgaancgattgattagncacttgccctcgaatgggactggggattctcaaactaggagacacacctatacatgaacaaggggggtcgtgctctggaaccgataggaggcgacaacgagatgtaatatcttactcgcctgtaaagtgtattgggtgtccattgagtatgttctttcttccctacgtgctgcanaggcctatgatatatgagctggcccagaaacatattcggcctgaaggatggacttgcggtaccgagtagggacacatagacctggctgagttacttcccctctggtggagtcaggtcggatgaacacgggggttggatgaaaacctctatagcactgagttgagcctctcgacctaggtaagaaccatctgnncttctgattctcggtggggtcccgaggaggaaagaagagcaccaaactcccaccagcggnaagttctagtaccaggctttgtagcaagtggttccctgagcgcctatcgagtggactggatccaattgagtgggttgtccgcttgtttcctatccaatcccgaagaagaccctcctaggattggtccccggtccgacttgttccagagaaaggggtccctcggtggaggcaatggacagggcacactcgctttctgtcacgattccgttctccgcacaagtccgggacaaattccttcgaagggcgtctgggcatgtcgtctaaacacctgggagcgccatagattcgggtcaacaggggcggctctcggaaatctctgactttaacactggagaaaggggacagcagccaaagtataaggccgg

SEQ ID NO: 571244 - DNA, 1461 bp, Homo sapiens
ctggtgccctgcagctcaaaatggatagccacagggctggacgtggaaaaagatatggtgaaggcagaactgcctcacaccagctccagaagcacgtcctctgacttcactgccgcagctctttccacacgtgggccgtgcattgaccctaaacacacttgcacgaccatgcacatacactcggcaccacttgcacggccaacggtcgtccggctactcctgcccctgcctcctagcgcaccgaactagctagaccgttagcccagccagccccctaccccaagagcgtacacgccctcccccacactcggtaactcactcgcacgcaacccctccgcttccacaccccatcatactgacctccccctacccgcgccttccccccgtctgttagccactctacgcgctaattaactcattacccccctaccggcaacacctcactctcaccacagcaccctaccccgttcccacacatcgccacagcccccctggctccaacctctccctggaccctcacagttcagacaatcccagaacgccggcactgattctccaactaccccctgcgtcccgtggcgccctcccacacgcagcttccgacaccagcacaagattattcgacgcactggcgccacctttccccctcgccaaaaccaatccctagggcatagcgccgggccaacacgggcccatcaaaccgcggacacataggccttaaggcccgttcacattacgaaaacctttggccctctccttccctccccctttggcccaaccgcaatcgccccagaacgacatcgaacattgaaagctttataccgaagcatacccaaactgccctaccgcgaaaagcaaccttgccggcctacacaacagcagggcgtacaacttggccgcctacacaacacccacctttaaaccgcctataagagtgctcaccctgcggaaaccccgaaacgcccaaacccgcatggccccaacagcacaccttccacagagcccgcggaacagcccccatcacacaaggctcttcacccaacgttccccactaaccattgtgcccctcgccccaacacagaaaagattaccaccccgatcgggcacaacaaccccgcccttggggccatcgcctgctctaccaccgacagcttcgcgggaaccgttctcaatctgggaccgttggcgatccccacaactactataccggatgagcattttggcacagacatttcccgagagacgccacatactcgggaccaacacattcgaatgtagactagaccgaaaccccccctatcaacatttacacctctcacatctccaccaccaccttcccctgtccacaccacgcccctctctccacataaacatttccgccaccacatcaacaacatcatccacatctacacaaccacaaccacccaacgacagcacaacaccccaaaaatcaaccactaa

SEQ ID NO: 571245 - DNA, 178 bp, Homo sapiens
cgctgaacgctagggccacaacatataaagagggattatagtcatataaccactatagcagtaatagacagagcagcacaaaccacggctgcgaacaggaataaagggaggcagagagaccgagaagatctctgaacatgtacttgagtggggaacaggaatctttagggcgcgaaca

SEQ ID NO: 571246 - DNA, 501 bp, Homo sapiens
gacactgcagccgccctcggcttgcgccgccgcactaccaccgacgccttgccgcttcgcgccactatcccggccgggaggcccaggcgcggcgcgcgcaggaggaggcggaggcggatggagcgccggctgtcgggagcaggaggcgctgtctagttgctcgagcacgtgctgctccggcgcccgtgactgccttccggtcccgcggtgtggttctgcctcctgggcgagtcgggcgttgtctgctggagaaggtgacttaagcgccttttccggccctagctccaggcgttgtgaggcgtctggtgcctgatggtaggtatggtgtgtcgttctgtgccccaggggctggagtcacctggtgcccctgaaggacagattttcggctgttacaggatggcattgtcctgctgtcttctgtgcgttagttttctcgctgagcgggagctcagtatgacttgccaccacctgatactcagggcaaggcccttttcctccagc

SEQ ID NO: 571247 - DNA, 143 bp, Homo sapiens
aacaaacttaatctgtttcaataaagcatccagatgcctttccattctacctgtgctgtagatttctaaatcacaatactgtgggatttgtagcaagtatgctacctgctctgaatctgccgaatactttgaaagtaacatag

SEQ ID NO: 571248 - DNA, 300 bp, Homo sapiens
tggacagcgtatggctccatcacccagactagagtgcaatggcaggatcacagttcaccgcagcctcagcccctcaggccccagcaattctcccacctcagccttccaagcagatgggagcacaggaatgcaccatcacacatggctaatttttgtactttttgtaagatggagccctgccatgttgctcaggctggtcccggactcctcaactcaagtgattcacccggttcagcctcccaaagtggaatctgcacgtggataaatatttttaagaattaaaatattgaaccaggtcga

SEQ ID NO: 571249 - DNA, 498 bp, Homo sapiens
  misc_feature (1)..(1): n is a, c, g, or t
  misc_feature (12)..(12): n is a, c, g, or t
  misc_feature (40)..(40): n is a, c, g, or t
  misc_feature (74)..(74): n is a, c, g, or t
  misc_feature (111)..(111): n is a, c, g, or t
  misc_feature (135)..(135): n is a, c, g, or t
  misc_feature (137)..(137): n is a, c, g, or t
  misc_feature (140)..(140): n is a, c, g, or t
  misc_feature (150)..(150): n is a, c, g, or t
  misc_feature (173)..(173): n is a, c, g, or t
  misc_feature (178)..(178): n is a, c, g, or t
  misc_feature (190)..(190): n is a, c, g, or t
  misc_feature (251)..(251): n is a, c, g, or t
  misc_feature (258)..(258): n is a, c, g, or t
  misc_feature (265)..(265): n is a, c, g, or t
  misc_feature (267)..(267): n is a, c, g, or t
  misc_feature (271)..(271): n is a, c, g, or t
  misc_feature (277)..(277): n is a, c, g, or t
  misc_feature (293)..(293): n is a, c, g, or t
  misc_feature (311)..(311): n is a, c, g, or t
  misc_feature (320)..(320): n is a, c, g, or t
  misc_feature (343)..(343): n is a, c, g, or t
  misc_feature (349)..(349): n is a, c, g, or t
  misc_feature (385)..(385): n is a, c, g, or t
  misc_feature (407)..(407): n is a, c, g, or t
  misc_feature (481)..(481): n is a, c, g, or t
nctataaatccngccacaatatttttaattacgtacaaanatctgacatgtcacccagggacccatttcacccnctgccctgtttggccgccagttttttgtctctttttncagcaatggtgagggggatacccntnccncggggaaganaaaaccatggtttgttgcccttnccaanaacaaaaatgtnggaaagtcgagtggcaaagctgtggccattggcatctttcacgtgaaccacgtaaaaaganccagggngcctttntntgtnggggancacaccaatccttccnaggttagcacccccagtnaccaaaaanaggtaaccagttttgaacttgangaaatnagtaatcttgccagtttctaaatcaatctgaatggnataattcaccttgatgaggggntcgggggagcggatggggcgggcataaagagtaaccagaagagggattccttttgtgcccccaaagatctttcncactttgcacaacttgt

SEQ ID NO: 571250 - DNA, 106 bp, Homo sapiens
cagtcccacagcataacatgctctccttgtgcagcttatctggagtcttgatgttgctctctaaagacctttaataaaattttgtacaaatgacaaacaaaaaaaa

SEQ ID NO: 571251 - DNA, 290 bp, Homo sapiens
cagccggtctatgtgtctctttcaatgtgtcttagaatagcgtttccttcctcttgttctcagggtagcttaggttcctattcactgacacgtgataagcgtatgcgcgaatgaatcacagcacgtttatgaaggcccttttagaccatgcaggtgtactttgtgacatccgactcgcacatgtcccctgaacctgcgcgttcaacgtatgacaccggtcgtctgctcccttgctccgttgggggtgtgtaccacgagcggagccacaccagtcagagtcaatatctgcc

SEQ ID NO: 571252 - DNA, 119 bp, Homo sapiens
ccgaacagcaccgcctcgtcccccaccgccacgccggcaccgtcgggccccaggtcaatgacgaaatggtccatacagattcgcccgacgttgcggtaccgggcaccgttgatgctggc

SEQ ID NO: 571253 - DNA, 487 bp, Homo sapiens
  misc_feature (38)..(38): n is a, c, g, or t
  misc_feature (49)..(49): n is a, c, g, or t
  misc_feature (123)..(123): n is a, c, g, or t
ctcccttcccttaaccaattccaataatttaaatctgnctgaagcttancctttaaccttggaggatccaacttcctgccacagaagtatattccttaaaattacgtattatgcatgtatgtntgcataatatacttcccataaaagctgaaacttggctgggcacagtgctcacacctgtaattctagcactttggggagcacgcctgtaattccagcactttgggagaggatcacttgaggccaggggttcaagaccaacctggccaacacagggagaatttgtctctacaaaaatattttttttaaaaattagccaaacatggcggtgctgcctgtagttccacctactcagggggctgaggcaggaggatcacttgagcccagaagttcaaggttgcagtgagttgtgatcacgccgcaccactgcactctaacctgggtggcagagtgagcctctgtctcagaaacaaaacaaacaaatgaa

SEQ ID NO: 571254 - DNA, 320 bp, Homo sapiens
gaaaaggagaatagaaagagggagagagtgagaggagataggacaggggagaaaaggggaatgataaaaggagcaaagtagaaataaggagaagcaggtatagatggaagagaagggaagaagggagatagagaaagagagtaagaggaagggaaaagaaggtgaagagaaggaatgggaaaccaagaaagagagcgagatatcgaggtgtctatatagatatctgtctagatctacgtgtatatgtatatatatctactatatatatatatatatatatatactactctactccgcgtgcagaatcgtgcagcgccggg

SEQ ID NO: 571255 - DNA, 371 bp, Homo sapiens
ggcacacgagcattaccacctgagctctgcctcctgtcagatcagcagtggcattagactctcataggagcacgaaccctattgtgaactgcgcatgtgaaggatctaggttgcgtactccttataagaatctaatgcctgataatctgaggtggaacaatttcatcccaaagccctgccaccgcatcacatccatgggacaaattgtcttccacaaaacctgtccttggtgccaaaaaggttggggaccactgttgtgggatcatttcgagttacacctctctgaataagtggacatattccagtggtgtttacctggcagctgttgtaatgctatgatgtaggtcttttctctatacagaacatgctga

SEQ ID NO: 571256 - DNA, 423 bp, Homo sapiens
  misc_feature (246)..(246): n is a, c, g, or t
tgttgggccctcccactccatttggcaatggcctggaatcctcctttgccctccttgaggcctgcacaactgtggccgtggagctgacctgaccaggcaagggtgctgtttccatccctgagccgcctgccccctccccctcctgaaaatccattttttggggctcccctgacaaaaaaaacagccgaagtcaaaaccacatcctcttgttgatgttggatgcaggctgtccggcctcagggccanggagccagtttcccctgtgcgggaactttgagtcaaacgtgattatttgggggtctgtcccccctggctggatttggaggcaaaatgccaggccccccaggtgttttcagggcagtttttggtgtttgcttttcaaattccaaggactggaattaaaacctttcctgggactttgga

SEQ ID NO: 571257 - DNA, 420 bp, Homo sapiens
gagtgatattcagcctggcacattgcatgcttacatggtatagggacatcagcattagcctgtagtcccacctactagagaggctgaggcaggaagaatctctatgaatgcaggaggcagaggttatagtgaagcaagatcgcaccaatgcataccagcctgggacaacagagtgagacttcgtggcactcccacccagagcgcaaccaaactgactatcatccgaatccagctcctgggcatcaccgtctaacgacttcacaaaactctccatggtacgaccagtgatgctgaaacacttcaaagctttatctcctcccaaaatggccttgacgatttcctcactgctggagacaccccacaagagggtacacgctgctgctcccatttctgtacaatactctgcctgctgcaggagta

SEQ ID NO: 571258 - DNA, 865 bp, Homo sapiens
ggacgcgtgggtcgaacccacgcgtcgtttttcttaattgtatatacgcgggtttggttattgtctctccctggtttggttttgtaacctaaggaagcagagcctctgaaaccaaacacagcgagtgtcgcccgtcccctagaaggcaccccggtcacaggaggggcaggagaggagacccccgtgttcctgcatgcgctgtcgccccgccagggtgttctccgcaggggtcgaggcaggagggtgcggtgtgaggcgccagcctgtcctcagctggaaggtgcggggcttggcactgggcacggtgggcaggtccaccagcgaggacgcagggagcccggccccctgtcacacggcgtggtgcggcgtggtgtgtagccgggctggttcagccgcgagggttttacacaacacctaggccggggcgaaaaatccccactttctgttcccacacttcggagaacccggctttttgaacttagaaagcgttgttggtgtttttgtgtggggacgccagtctttctcaaggggctccccgcccggggcactccccaggcgaatagggggggatctccttagagaattcgaaaggccgcccaatctttcacatttcgtggacgaccgacaacaagaacctcttctcgccggttgggtggacaaaaaactccttcctggagggcggggcatgtcgtttgtgaaaaaccaacacgcaaccaaaaaccgccggaggggtgttgtggtgtgtggcggcgcacacacaggcgcccgcattaattcaagagctgaacaagcgcgggtcggtgtggaggaccacattcgcaggagagtttctctcaccgcaaccaccaacacttatccaatctta

SEQ ID NO: 571259 - DNA, 337 bp, Homo sapiens
  misc_feature (213)..(213): n is a, c, g, or t
gtagtccaagccctgattagatccatagagtttggaagtcttccttccaagtagaggggcttatgacaaatcttagatttttgtatgaacctacaatcacagagtgtatctgtaagctaactcatggtcaaggagatcagtcagtaatttttttatgtgcttacataagaattgtttttcttcataagaagactatagaatcaatactctctnatacatcttattcacaatgacaaggattcaaaaaaaaaatcactgaaccaaacaaaaatggggatgtggatagtgatacagagtcagattaaagcagtcagtagaggcctggctggcacacatt

SEQ ID NO: 571260 - DNA, 725 bp, Homo sapiens
cttctttggaggatgtagggtattttgtgcatctagatcacgttgtagtaactagtagttccctgttactgggaagcatttcattgcctcccagcttgggagcatacaatggagaaccatgactgggtcatgaaatgggttaatttaggcttcttgtcattacagggcaaagggctccctgtggactgacaattaaacatatgataaaagtgacatctgctcatagaatagaaatcagagagtaaaaagtcttgagtgtaataaacaagtgtctttttcccccacagtctaactacgcagacgcaacctgtgctactagatatgcgatctcctcttaccttcaaggaaagaggtcaccatttttgagttgatgcgtatccttcgcctgagagctatctttgatatcatccttttggggtactttttaattacttgctgtatctctgtcgtagctgctgtgtataatagagaaagacacatttgtgggagtatctgcccacacaggcaggctgtacattctggagagaggtcaccacgtgggtgtactctaacccaattcatatccacattgtgtactcggagatagtgtcagatcccacaggttgagtggctctggccacatgactgtcccctacttgccacaccaattgcatgctgcaggctgggtttacctgtgcttcttgccaaccgattataatttggggttccccccctttcttttggtc

SEQ ID NO: 571261 - DNA, 582 bp, Homo sapiens
gttgggagctggggttgtttgctcccaacttgtttgtccctctttgttcatttttcttgtgggcccgctcttttgtgtgtcctctcctctcgtgggggggacacggtggcgcgcgtgctgcggttgttgtgttgtctacaacagactcttctgtgtggtctcccgcattgagccactcgcgttggagtgagagagaatttttatgtgtgggaccactctctacaagactgcgtgggccttttcttcactaagatagcacaaaccccctcacgatagggtgtcatcgatcgacagtctgttacctcacgtggtcccattgaggtagccatcgataagaagtcctctgagtggtccctctatataaatactgttactcttgtgtagtgggtccccagacgcaagaaggagtttataggagtggaggaggatatttgcgctctcttaattgggggctagcgccacattttgtctccccgcggggaagaccctttataaaaaaggtttcccggggtttttatatttgggggccccgttttttcccacttgaaacaacttttggtttatcattaggggtttttccca

SEQ ID NO: 571262 - DNA, 358 bp, Homo sapiens
  misc_feature (358)..(358): n is a, c, g, or t
aagaaatatttcacaggctgatgagacacagagggccaccatattcagcataagacattctattgatggaggaaacgtcaccatgttcgggaaatgtgtagttcacgatagtgaaaggctggatctttgtaggcagagatataaatgggccacgaacatttgcatgaagtaaatctatttaattcggagcattatgaggaatcacagcacttatttgaaagagtgctgatatgatcaaagtcaattatagatatgatcttcagcattaacctggcactgagtacagaatagattggagtctttgctgagcactaagcatgggagagatactcttaattagtccttatcacgcctatgn

SEQ ID NO: 571263 - DNA, 221 bp, Homo sapiens
tgggggggggggggttttttcccccccccgggggttttggggggggctttccctttttaagggggcccggggggcctttttgccccgaaaattaaaaggggttttaaaaccccctttccccaaaaagggccctggggctccccctttttttcccggggggggggcccttttggggggttattttaggggggttttttccggggaaaaaacccttccccgga

SEQ ID NO: 571264 - DNA, 380 bp, Homo sapiens
tcatttgctttataatcaagcatgggttttgacataatagtagcgcttgcaatttaccaatgcgcattcaggctgagttattgctagttaaagagacagggtcgggtgatttggacattaagggagctggggacatgtggatgtcctgaaatgctgtaaagttgggtcaccttaaagttttcgcattctggatgttgtcaggcacgggagactgaattgcaaaacgggtcttgatacggcgcagggtgtttggtgctgcccccagagcggatgtaagagtagcgactacgggaacgggatcggccacgagacctacagtaatttacgagccgcaaattattattgttatgtcaattatcgcgcaggtaagagctgtaaat

SEQ ID NO: 571265 - DNA, 1946 bp, Homo sapiens
cctcccttcttcagtgtaaatatgaaattaatttgtgataccttactttaaagaacttagagttcagtaaaggaagcaggtatagaaagtgctatgataaagctatacatacgatggtatagaaccacagactaggggcacttaaaatgggcaagaaaatagcctctgtaaataaaatagaggcaagagatataatgctttacctgcaaagagccataaatacagccatgtaccatataatgatgtttcagttagtgaaggaccacatacgagggtggtcagaacagcaggctataccatatagcctaggtgtgtagtaggctataccatatagcctaggtgtgtagtaggctataccatatagcctaggtgtgtagtagtaggctataccatatagcctaggtgtgtagtagtaggcgataccatatagcctaggtgtgtagtagtaggctataccatatagcctaggtgtatagtagtaggctataccatatagcctaggtgtgtagtaggctataccatatagcctaggtatgtagtagtaggctataccatatagcctaggtatgtagtagtaggctataccatatagcctaggtgtgtagtagtaggctataccatctggggttcctgtcagtacagtatgatgttcacataatgatgaaatcacctaacaaagcatgtctcgaaatgtatccacattgttacgtaacacatgactgtagttaattgttacaattgaaatactagatgtactcattgaaatccagaattcccattatctggattatttaatatcgttcaggaaatttttgccagtgcaatggtgcatgaaacaatgtcttttagaaatgaggtggccagatttctatttgcagataataattgtatatctaaaaatcctagaaaaagaaatgataacaaatggagctacttaacctttacatgttgaatgctgccactgttaaaatttctgagggggtataatagataaactatcccatagttcatctggaaaaataaggtggtgaaaattgctaagaaatttttgaaagggtaatgtaaacctagattaactgtttttgaaaggtagtacagaactgaatgcacaactagatatcaatggtatgtactcacccagaaaaaagacttcagtacatacatgtgagggcttaaaacattgttataaagacgggatcacaatgggaaaaggattattcaataagtagggcaggcattctctatgcctgctagggaagtgtgacttgttatactctttatgtacagcaattggcagtctgtgaaacttttaaattcatatacataaccttttgccctgcaattccacttctagaaatttatcctaccaaacaaagcacatagatgtgcaaaagtatgtatttacaagtatattctttgcaacttggtaatgtcaaagaattggaagcaacctaaatatctgccataggtaggataaccatatgctttggctttttgaacactaccagtttatacctgctgttcttggataattattaatggtgctttcattctcaatgtctcactttagataataaattacagaggattggtgaaactaatttgcccaatggaaaaaggaatgaagaagtgctttaggtactgagatgaaaagatctctaaggcataataatgtttattgagaaaagcatggtgtcaaactgtatggcatgctacaattgatgtataagaagaaaaaatgtgtatgtattcctatttgtttgtatatggtagactgtctctgaagacatatatggaagaacctgatcacattggtagtctccaaggagcagaactagatacctgggggataaggatcccaggagtgagccttttcattgtaaacttcattgtactttgagtttttaactgttcaaaaataataaaattagaaataaaaaaaaaaa

SEQ ID NO: 571266 - DNA, 873 bp, Homo sapiens
gagaaaaagatcccaagaatcttcgagaatggagctcttgcagccatcgtacgtgggacgagaaataggatgaaagacatcccagagaggcctttctctcagggtttatctacaatgtatttctcctctgtttgcagagttgaaggcagaagagccaggcgtgcggagggaacttggggtccattgaagagctgtgagtggccatctacctagcgtaggcggtgtgccctggcttcttccgacaccatgggtggcccagctcgtgcgagcggttccgagagatactctctaaagtggtggaggaatgttcatcccactgaaagttccttggcgataggggattaggggcttcctttcatatcctgcttcatcctcctctttttttagaagttcaatgagagccttcggttgactccgaccgaagaggtgcgccactgggagccacctccaagcgccatggtgccgtgctaagggcactaccatgacagtctgcaatgtggcttgcagcgaagatgaagtctctcagatgggattgggggaggagtcaggtccttaccaggtgatcagtctgatttctacttgtatcacttgagtattcatgtttgaaaccgttgtgcacatttggcaggagagtgtctttataactaaaatgaaatgtggaaatgtatcttgggcgatttggataggggcacttaatgtgtggaaggtcaggtgtcctggtttaaggtgagggacaccctctgggggtggagaacagctctggggggggggtgcaggctgtgttatgtctttacgggacccttcgggggttagagaacgggtcaaatgcgggggtttaaaaaaggggaaaatgagggaaaagtagctcggtaa

SEQ ID NO: 571267 - DNA, 494 bp, Homo sapiens
tctgcccttttggaggctgtccacgtttcaacttcctcatggaggtggactgtggggaaaacatcaggctcaccacctggaaaaatgtctgatgtatcgaggtaagtctcaggcttccatgtaacttcaagagactcagttgtttctgtagatgcattaggttgcacagcatgagactattctgtttaggctataacaaatggatgagtatcactttcagagctgtccgagaaatttcgagaaggtgcacattttcaaatctggcacgcgtagattctgtagcttctgggtccttgggcacagtggtaacgagatgcttgccatatatgtactgcacagatggcgtggttagcacatcagtagcatttgcagattcttgtactacttcttccatttacttcactgaggtagaaggtctatgacaattatgtcagggagtcaggtcacattcagccgttagatcatgcacgggatctgttgcttcactacaaggt

SEQ ID NO: 571268 - DNA, 180 bp, Homo sapiens
tagctggtccctagttgctttggagcacatgctctaagtgtaacggctgtgggcggatgcgggcagagaggcggacacggcgaagccttgtggcccctggaaggcccaggcaccagcccctgaccccagccaagaccagtcaggtcctacctctcccaacttcccagtcccccatgatat

SEQ ID NO: 571269 - DNA, 357 bp, Homo sapiens
ttcctttgtctcagaaacaaacacaaccaacaaacaacaaacaaacaaaataaaccttactgaaaaccatgcaagtacatggaagttaaacaagttgcttctgggttacttgtgggtaaatattagaattaatgcagaaatcaagaagttattttatactactgagaacaaagaatcatcatatcagtagctctgggacacagttaagagagtgttaagagaaaactttatagcactaaatgcctgcatcagaaagttagaaacatcttaaattaacaatctaacatcacaactaaaaaaaaattagggaagccagagcaaacaaatcccaattataacagaagacaaagggaaaca

SEQ ID NO: 571270 - DNA, 314 bp, Homo sapiens
  misc_feature (64)..(64): n is a, c, g, or t
  misc_feature (71)..(71): n is a, c, g, or t
  misc_feature (81)..(81): n is a, c, g, or t
  misc_feature (133)..(133): n is a, c, g, or t
  misc_feature (135)..(135): n is a, c, g, or t
  misc_feature (141)..(141): n is a, c, g, or t
  misc_feature (150)..(150): n is a, c, g, or t
  misc_feature (158)..(158): n is a, c, g, or t
  misc_feature (193)..(193): n is a, c, g, or t
  misc_feature (264)..(264): n is a, c, g, or t
  misc_feature (267)..(267): n is a, c, g, or t
  misc_feature (273)..(273): n is a, c, g, or t
ctggacaggccgttggttggccaggatgagtttttcctgagagcagaccaagaagaaaggagtngaagcgncacagcacgnctcgcacaccaagccgtcccaggcgcccgccgtggaggtggcgcctgccggnancttccnacaatccancctttgangaccaccagaccctgctctcagcggcccaagaggnggagttgcagcggcagaaggaggcggagaagctggagcggcactggccctgcccgccacggagcaggccancanccaggngtccacattccaggagctgtgcgaggggctgctggaggagg

SEQ ID NO: 571271 - DNA, 163 bp, Homo sapiens
tgaacggcatgacattttactgtcgcggctgcagcgctgtagtgtatgggctactgggcacggagtgattactcgtggccctacttttcctcctgccaggcctcctgatcacttgccacgtggcacgcatccctctgccagccggatacagagaagagattgt

SEQ ID NO: 571272 - DNA, 924 bp, Homo sapiens
gtgatgtgaaagagtgggtggtgtgggccgcaggaaagtgggagagactcatcggagcgtgtggatgtgagccgtcgcattgtagaaccctagatctcgaaaatgcatacgtgattcctgattccattggagctgtatggtttagtggtaggggccaataccttggagaacaattggcagatccacacgacgggattggaacggctcttagggttatctatggaccactccgaagtgtgtgggatagctagagagtccagccggcgtaggcttaagtagaatcttggacggatccccgagatgcaagctgatgtccgttcgcgagagcctggatggagagaacactatgttggtttgccggtggtaagaaagtggccatcggtggcgaatggtcgatttagaattgacatgtatggacttgccgtggaccgatctcctcttttggggtctgtcggccctccgagatcgattatcgtgagggagggagtccatccacactcgtccgtacgtatcctccaaagaagggatgaacgctttcttgtcgcatccgggagtcacggtccctgtatctagagatatggagaccgcgatagctcgatggcctcgggagatggaaatcagaaggcggcgggatcctttcctctaggtctcgaagtgcgatcgaggtcaactcacaggcagtgacgacagctgcgggacaagtggtgtcggggaacatacctcatccgacagcgtgtccgaaacctcagctgttgagctcttagcatggcgcttgagcagtatccgcgaaccccggctggacagggccagcgcacctgctggagggacgaggcttacacgagcgtcacgccgcacataggggatatgtacgaaaccagcccggggcacaaacggaaacacgcgagctaaccgacacgccacaac

SEQ ID NO: 571273 - DNA, 515 bp, Homo sapiens
  misc_feature (262)..(262): n is a, c, g, or t
aatgtgctccctgtgggcaccatgcctaaggggtacaatcgtgtgctgcctggaggaaaaacctgaagaccgtggcaaactggccccgggcatcagggaattatgcccccgttatctcccacaacttgaagaccaagaaaacccgtgtgaaactgccctccggctccaaaaaggttatctcctcaaccaacaaaactgtggttggtgtggtggctgaaggtggcccaatttacaaacccatcttaaaggctggccgggggtnccccaaatataaggcaaagaggaactcctggccccaagtacggggtgtggccataaatcctgtgaagcatccttttggaggtggcaacccccagcacatcggcaagccctcccccatccccaaaaatgcccctgttggccgcaaaatgggtttcatttttgccccccggactggaggtttccggggaaccaaaactgtgcagaaaaaaaaaaactagtgctgagggccccaaaaaagtttgtgtttatgccca

SEQ ID NO: 571274 - DNA, 572 bp, Homo sapiens
  misc_feature (37)..(37): n is a, c, g, or t
agcctatctggctccctattctgccactggctacatnttcaggcaataacagaggaggtgcaggcattgtgtggtaggccaaataatcctcccctcccccaaagatgtccatgctataatccctagaatctgtaaatatgttaccttacatggcaaaagagactttgcaggtgtaattaaggttaagaaccttgagaggaggggattatcctggattattcaagtaggcccaatgtaatcacgagtccttgaaagtggaagaggaaagcagaagagttgctgactttgatgattgaggaaggggttcttaaactagggcatgtgagtggcttctgaagctggaaagaaccctcagctgacagccaccaaggaaacagagatttcagtcttacagactcaaggaactacattctaccaatgatcaatgtacaaggaaatagattttccctcgagcctccagaaaggaacctagccttgctgacactttgattttagactggtgaaattcatgctgaacttatgacctacagagttgtaaaataaataaataaataaatttcaaaaaaaaaaaa

SEQ ID NO: 571275 - DNA, 363 bp, Homo sapiens
cttctactcttgacgagggagtagatggcatctcattaccaaatgtggaccaggcatggtagctcatacctgtaactgagacattttgagaggctgaggcaggagaatcacttgaacccaggaggcggaggttgcagtgagccgacatcacgccactgtactctagcctgggtgacagagcaagactctgtctcaaaaaacaactgatcgagggagagatcactgcagagattgccatgagaggtgatgggacaggggacggagctgagggctggcctggggatgcctttgggaggtgggcccgctgcttttgggcctggatgggcctggagcgtgaggaccagggaggactctgtcaggccc

SEQ ID NO: 571276 - DNA, 714 bp, Homo sapiens
  misc_feature (106)..(106): n is a, c, g, or t
  misc_feature (115)..(115): n is a, c, g, or t
  misc_feature (123)..(123): n is a, c, g, or t
  misc_feature (159)..(159): n is a, c, g, or t
  misc_feature (290)..(290): n is a, c, g, or t
  misc_feature (311)..(311): n is a, c, g, or t
  misc_feature (363)..(363): n is a, c, g, or t
  misc_feature (401)..(401): n is a, c, g, or t
  misc_feature (405)..(405): n is a, c, g, or t
  misc_feature (520)..(520): n is a, c, g, or t
  misc_feature (547)..(547): n is a, c, g, or t
ataaccacacgagagggcaagagaggctgtcaacgagatttgtccctggggaatccacgaaacccatgataccctactgaacaccgaatcccctggaagcccacanagacagagnacagcaanagaagcagagataatacactcacgccaggagctcgntcgctctctctctctctctctcactcctccctccctctctctctgcctgtcctagtcctctagtcctcaaattcccagtcccctgcaccccttcctgggacactatgttgttctccgccctcctgctggangtgatttggatcctggctgcnagatgggggtcaacactggacgtatgagggcccacatggtcaggaccattgngccagcctcttaccctgagtgtggaacacaatgcccangtcngcccatcgatattcagacagacagtgtgacatttgaccctgatttgcctgctctgcagccccacggatatgaccagcctggcaccgagcctttggacctgcacaacaatggcacnacagtgcaactctctctgccctctacncctgtatctgggtggacttccccgaaaatatgtagctgcccagctccacctgcactggggtcagaaaggatccccaggggggtcagaacaccagatcaacagtgaagccacatttgcagagctccacattgtacattatgactctgattcctatgacagcttgagtg

SEQ ID NO: 571277 - DNA, 130 bp, Homo sapiens
gcctagtggagcagagagacacaaatatcttcatgaggaagagaagaacgtcaagaagttgtgcgagtctggaagactttgttgaagacttgaaggaggactccacggcagccagccgagttggttactc

SEQ ID NO: 571278 - DNA, 308 bp, Homo sapiens
agctgctaccgttaaggctgcagtgcattccagcctgctgtaacaaagctaacctgtctcaaaagtgaaaaaaaaaaacagaaagaaagagagtttctagaaaatggaagtttctgtggaaccccttggatggattcaccacctgtgcggaaaagggaaggaagcggggatgactgggagggaaaagctggactgggattaaggcacgaaaaaggcattcatctgatttgtaaaaggagatctgaagctgaaatagccctccagagttattctctatgggagggagggggcacagcctttcttactcc

SEQ ID NO: 571279 - DNA, 1073 bp, Homo sapiens
  misc_feature (1073)..(1073): n is a, c, g, or t
gggccgccgtcccgcccgccagcgccccagcgaggaagcagacgcgcagccctgctggcccagactgcaccctgcatgcagctgccctgcaagcatctgtcctgctgcacatgttccatgtgctgtgcctgagctgccccacagtgcagtgtggcccattgtgatgtgtgcacccctgctgactgtggctgaagaagtgagctgtgctactggacgaccgccacgacatgcggcctggactccatgaaagacgaggagtacgagcagatggtcaacggagcatgcaggagatccagctcgagccgcaggaggtgccagcgcggctcaggagccctggaagcagcagctcaccgaggacggggactcgttcctgcacttggccatcatccatgaagaaaaggcactgaccatggaagtgatccgacaggtgaagggagacctggctttcctcaacttccagaacaaactgcagcagactccacatccacttggctgtgatcaccaacacagacagaaattgctgcggcacttctgggagctggatgtgatccttgagactccgagactttcgaggaaataccccacactacaacttgacatgtgagcagggctgcctggacagacgtgggagtccttgactcagatactgaaacaccacagaagctccactccatcctgaaggctacagtaaaatggacacatgtgtctaaattagaatttatcatggattacttgagaatgtggagctattggatgacatgagtgatgatgtaatgatggagcctgtatggcggaatgacttaaaatgaaatgacattaaaatcttaactgttgtactcctgtgaaggtggggatatgttaagagatctaacaggataatactacattaacttgggcacataagaaggttcaagagtgagactgagttagacgtcaatgtgagaatgatgtaaggatataaataggatgggatagagagcagtaagtgtgtaagaaaaatagaaggagaaggagtttaatattaaaagaaatgttaaaagatgagtttgatataattatttgttgtgagatgn

SEQ ID NO: 571280 - DNA, 300 bp, Homo sapiens
tacagagtgaatgtgaagatcaacgccatacaactcacacaagctcgccaacctttcaccgttaagtaggcggggggtctggctcaagcgcagcaagatggccttgaccgaacgacgatgagacttggccagggctgcgacgtcggcgcaatcctgatacgcagacacgagccgttcatcctcatctgccggccacttactcccttgtgcggtcgcctcttgcgccggcggttccaccgttaccgatgctggtgctggtgctggtgctggtgctggtgctggtgggggtatcacggcatc

SEQ ID NO: 571281 - DNA, 256 bp, Homo sapiens
ccgcgagatgttctctgcatcttgccctgcacttaggcgggctaattagcgcccacagtgcctctggggcttatgccagccgttgcctcaggcctcgatgtctatctcacacaagctgccttccatagctggcgaggcatatgcagacaaagccattgacctcatcaatacaggtgcctccattctcacagcggctgcagaggctgccatgaatgagaatctcacagttctgtccggcgaagccctgatcacagct

SEQ ID NO: 571282 - DNA, 192 bp, Homo sapiens
cgccatggggtctgaaggcccagctacacgtaaggctgaggcaggagcatggcgtgaacggaggatgcctatcttcgcagcgagccgagaacgtgctactgcacttcagcctgggcagcagagctagactgcatctcaaaaaaaagagaggattatccaccgggcgcgggggctcacgcgtggcatcccagc

SEQ ID NO: 571283 - DNA, 308 bp, Homo sapiens
tagatcgagctcggtaccggtgtttatcgatgccaccgtgtgccggtggggagggagccgttacgctgataaccctggacctgaatcttccctttcttcaggtcggcgccctttatatctgttaccaggccaatgtctccagaacctctgtctgggttctgctctgctatgggcatctggatccaccatcaccaggatataggttgcgccgtccacggcctccgtgtacttgactatcgtctccatccaggatggtgatctctcgtgtcttgtgtcggatccctctagtatgtccatcgtgtcaggtg

SEQ ID NO: 571284 - DNA, 852 bp, Homo sapiens
ggtactcctaaccctgtagaaatgtatgacctctcacaaagttgagatttgatccaaagagaaatgcaagtataaaagaattagatacttattatcttttaaggtttttttttttttgggtagagatgggggtctcacggtgttgttggcccaggcgggtctcaaactccgtggccacaagtgatcttccgtgcctcagcctcccaaaagtgctgagattacaggcatgagccacgtgtacccagcctttccttataaaattcaaagagaaaatttctacacctttatccctcaaataaaacaagtgctcagttcttaccgtgccctggcaaggtctatatgtaacaagaacatctgaaaatttagctgtcagaataaaacttggataacataaaaggaagaaaagcttactttttctccagtgggttggctcttggctgtgttgaagtaataaaccgttttaaagagaaactactggcctgtaaacccccagtcgccttcaactctttgggcagactatttttaacgaaatccagaagcaaacttggaggtgctcaatggacacgtacaggcaagggcggtatactagtttgggcagaactgaacaggtgtctccacaggagaacatccatacccagggtgggttcggcgaggttttctaccaagacttaggagaagtggattgcctccgggggaggtgaacccgaacatttccatgaatgtcagtcgagaaataatgttctccgggtggtcatcatacagtcagacggggaaccacgtcggggagacatggctagcatcaggggaaacctattggacgacatgctatagaccaacacacgcgtttattcc

SEQ ID NO: 571285 - DNA, 948 bp, Homo sapiens
  misc_feature (33)..(33): n is a, c, g, or t
  misc_feature (82)..(82): n is a, c, g, or t
  misc_feature (84)..(84): n is a, c, g, or t
  misc_feature (86)..(86): n is a, c, g, or t
  misc_feature (113)..(113): n is a, c, g, or t
  misc_feature (117)..(117): n is a, c, g, or t
  misc_feature (129)..(129): n is a, c, g, or t
  misc_feature (137)..(137): n is a, c, g, or t
  misc_feature (155)..(155): n is a, c, g, or t
  misc_feature (173)..(173): n is a, c, g, or t
  misc_feature (187)..(187): n is a, c, g, or t
  misc_feature (193)..(193): n is a, c, g, or t
  misc_feature (223)..(223): n is a, c, g, or t
  misc_feature (273)..(273): n is a, c, g, or t
  misc_feature (277)..(277): n is a, c, g, or t
  misc_feature (284)..(284): n is a, c, g, or t
  misc_feature (331)..(331): n is a, c, g, or t
  misc_feature (352)..(352): n is a, c, g, or t
  misc_feature (597)..(597): n is a, c, g, or t
  misc_feature (626)..(626): n is a, c, g, or t
  misc_feature (777)..(777): n is a, c, g, or t
  misc_feature (844)..(844): n is a, c, g, or t
aaagcacaaaaacaccagcccaaagaaggcagnacagcaaggtgaagaggcggacagtcccgtctgcccccgaggagaaaancnanggctggggtggggtggaaaatgacgtncagnactcccaaatantcgggtanagcacgtgtcccttcagnaccttgacgggcaccagnaaggggttctgcanaaggtnattgtacaccatgccatggcagacgatganactgccgtcgtccgagcctgacgcaaaaagtgggtaccgcgggtggaaanccanagcccgnagagccttcttgtggtgtctcagcatcctgtatggcttggtggaaanatccaggtcaaaccacaccancttgctatcgtagctcccacagatgacgttgtcacctgcagggtgcaccgccaggctggacacccacttgcagttgggcatcagcttcttggtgagctcctggcgcacaggtggtaaaggcggacgctgcgctgggacgccaccaacaggaagggccgggcagggtggaaggccactcgctgcacctgtccgtggctgcggcggaacggactctggctgcggcgacggctcaactggtgaatcancacctgggtgtggccttgggtggccagcnccacggccaggtagtccccacgcccgtgccaggtcacctgcgtcactggcttcccgtggcagatgcgcagcgcaggcctactttggcgctcctcctctgaggcctccagccagcgggccggctgcaaggggggctcctcaggcgggacgangcgctcaacagctgatctgtgctgcccgccaccagccggtcccccagagctgggttcagcagccgcnccgagtcctccacggctgcggcaccaggcagacagcggggctggggttccaggcacactcttcatccacgcccccacgggaacagtctcacacagcggcagtgg

SEQ ID NO: 571286 - DNA, 749 bp, Homo sapiens
atcataatttctaatgcacgtttatccttagctttgtttgttattatgtatcggaagtgaagattaggtcagataatatgattacggtgagttctgtaacagctactggtaagtatttttgtacagtcacgtgaaagcattggagcaactgtcttggaaaatgctctttaaacttcaaaccccaggtatgttttggtagtagtggatattacacgatatatgctgctcttttcagtgttcttgttatgtgtgcgaaaacagttatttaagaacatttgatttattaagtaggatttattttgtaataggattgttaataggatttatttttctaggacagtgtcttgtaaacagcttggatgactttatactgtcttaagttctttaagtaacttttgtagactttaacaacaagcttcgtcgggacagacaagcgaagaaactaggaaacggatataagactttacttgtggcactttcacaggatctccgtgtcttattatccccgtcttattaggagtagtaaacgtcgaaagtcgtatttgtataccttcatctgattatggcattgagtgtgtattgagattccggatctaatctgaactgacctttgcataacacagtaaagatttaagtttccctggtcaagaagtaggactccgcaaagtttcgtgcaattgtctgatatcacgggtatccaggttaccctcaggtttcctggcaccgtaaaagctactgactaaccatac

SEQ ID NO: 571287 - DNA, 163 bp, Homo sapiens
catctgttgcgcttcagattgagtgctataagtttgacggagtttgtcttccagtccccaaagaaggtttacatatgtactaacttcacaaactggagaaataggaatttgtgaactcctaaaattgttggaactttgaaaggttagtgtaatatttacctta

SEQ ID NO: 571288 - DNA, 1105 bp, Homo sapiens
gtggcatggccccaacctgcggaggagcaggagagggcggaggccggctgggccatgccctggtctgtccctgctgtgctgccctccttcgtggacctggtcctggtgcgtgcttgggcacctgctgccttcctgctctgacctgtggcacctgacctgtgtggcctgcctgtccagtatgctgctctgtgcggcctgctaccttgtgtggctggctgcttggtgcttggctgctgcttgtgtgcctggcctccgtgtgctgcttgcatgctcttcagctttgctctggctgcgcgctgaccctgccctgtgcctgcacggggtcgcaggccccctgcggccgcttgccttggcggctgctgcgatctccgtgcatgcttggggttaccttgtacatggttgctgttgcagtgcaggcttgctgtgcatgtggtgcttgcttggttgttgtgcatgcatgggaggatgccgctctggagtttggacttgtggcctacgccggacttccttcgcccttggacatcaggcgtgctgcgtgctcttcgatgaccgttcttgggagacgtgcagcgacaggtcactgctggtgctggccagtcattgctgcagagttggcctgggctgaggtactaccagtgggttggcatctgcacatccttccttgggcatctctgtgggcactgctcggataccacgggccttgcgcacttgctcccctccaagcggtccttggggcctgggctcctccggtgatctactttcttgttggacttgtgtgttgtggcccgagtctggttgtggcctgtctaggctcttccccgtattgtggccttgcttcctgggcgtgtggtggactggtgcctggggcaggcgtcagggccgaattattgcgggacccagcctcgggttggttttccggttggcgtgtgccccccccctatatccctgggtaccgtggttgggcgggccccagggtggcgtacatatgtcgccctctggtaagtatctgggcgcgcgtagaagctgctgggaggcacccgggctggagacggggtccggcggagtgacacgaccatacgcgcacgagaggcgatagcctgtatgg

SEQ ID NO: 571289 - DNA, 890 bp, Homo sapiens
gtgcccatggaggagtactgggtgcaatcgcctgtaggagtttgaggggaagagtttagatgtcagtcaccaaataaggccttggaatgttccagagggatgaatatcgagaacagagaagcgggaacgcagaatgagagactataggtttgtaaaaacctatgagatagagatctttgagagtgagattatgggagacaaaggagttgagcatgtggtgtgggtcagaaactgtaatgtgagtgtagtatcgtggcgatgcatgtatgagtcacgaagcatcatataggcattgggagaggtggacattgcgtagaggatatctatcgtaggagactcgaggctcctggaccgcatgagaaggtcggacaaatggggttccatgggaagaaaaggtaaaaatcttggggataatagacacctagtagactagtatccattgtaatgagtaggagcatgtgatggtagaatagggcaagtagagtcgtagtataataggaagccagaaaggttcggtgaaggagtctggtcattctttgcttttattgaaagcatgcgctactcatgttacgtattcatggcttcagatctggtagagaatcccacgatgaaatatgcataagcgaggatcatatcaggatcgatcaataattggtactgagtgtattgactgaaagatgtaacctctaaatgactgattgattaccaagtgcttgattgtaaacctgaaggaaattgacaaccccgtttgaagaggatatgacggacacaattgacgcatgggaatgaaaagtaagaggtgtagatcttcttggctgagggggattggaccttaacccttgtttcatggtattcttggatgaattaccttcgtggatcaagtatagttg

SEQ ID NO: 571290 - DNA, 1103 bp, Homo sapiens
agcgggtttgcgcggcgagctggcgagaaaatggggtgccctcatgaacacgggacgggaacctcagggccggtgattgctccgtggccccgcgggtgggctggcaggtggcggtgagcctcttggagctgagatcggggattcgtggcacggtcgtctccgtggtatcgggtgtcgtccgtgagggtgctcgggctgcgcgtttcgagccccggtgtccgtgcggtggatgagactttgttgctggctatgcgtatgggctttattctggtggaagcatgttcgatcgtggtgaaatcacttgggcaggagcgaagtgagcagggctgacagaggctggaagagacggcgtcctctctggggatcctgcagtcgacccagaaacaagttacggccgacgttcgtggtgggacccttcgttggtaattccggagacgacggtaaaaggcgtggtgcccggggggtttcacaactgctctatggaatatcctgtgggagttaaaagcctggaggcacggctggagttggaaacactatgccccacttcaaggaacgggtgagcttaggctaattggcgaattgacaccgcgagaaaagaaccgggatggtagtccgaaggagctactttgacccaccagcgttgagaaccgtgcttcgacacgggctttttttgcgccctccaagtttcccctagtgctccaagaacagggtcgtaaaacatgatgttttgcccaaggggggatccccaacccaagggttgatgatgtgctgaaagcggtttgggacattttttacaccaccttgcggcgtttccccctccgcgtctgtgactacaactgggttacccggaccgcgccctcttaggctcagctccaactgggtggccccaccagtttgcgagttcccattgggtgggaacacggtcccatgcatgagccgggacacttgtattacgctttataaacagtttacttgtccacatgtgtgggccaggacgcagagccgccgcgtgttgccgcaaaaacaggcccttctttttgcgcacttggatgtaaaggagccacggtacaaacaccaagtccatgaacacatgtgactaaaac

SEQ ID NO: 571291 - DNA, 157 bp, Homo sapiens
tatacacaaagccacgcatgtgcgtaattgttactcttaaatcaatcattcagcaaatgagatcatctgtaatcgaacaaaaaagaaccacaaaaacaaaaaccccacaagaatatattatttcacctattgtaacctcatacgagagtggggatcc

SEQ ID NO: 571292 - DNA, 425 bp, Homo sapiens
atatgaaaacaccaagagaaaaataaatggcagctccaaaagtctttccttcctaggagagaaggagcacctgcacacatcaactcaccattcacgttaggtatttctcctaatgctatccttcccccagccccctaccccctgcctggtgtccaagtgttctaattgttcagttctcactcataagtgcgagttgaacagtgagaagacatggacacagaaaggggaacatcacacactggggcctgtcagagggtggaggtcacagggagggagagcattaggacaaatgccgaatgcatgagggacttaaaacctagatgacgggttgataggtgcagcaaaccaccgtggcacatgtatacctatgtaacaaacctgcacgttctgcccatgtatcccagaacttaaagtaaaaaaaaaaa

SEQ ID NO: 571293 - DNA, 200 bp, Homo sapiens
  misc_feature (16)..(16): n is a, c, g, or t
ttgggtctttactcanacatgtaaaggacctgtggactcgacagcctttttgcttgtcattattccttaaatgatacagtttaacaaatatttatatagcatttacattgcattaggtgttataagtaatcaaaagatgatttaaagtatacaggagtttgagaccagcctgggcaacgtggtgatacctgtctctactt

SEQ ID NO: 571294 - DNA, 606 bp, Homo sapiens
atctgcagcgggctgggtcgcaagaagaccctgaccgtgctccggcgctggggcgcgtgctaagtgaccgcggggtttcagctgtatctccgaacccctgtgcttggctgaggggttcccaaggctccactccgccttggagggggctgcggaagcccggaggtgacctgggctctgggaggggcgttccccaacgtcggggaggggagacaggggccctttgatagacaggcgcgggtactcggaggtggggtccctcccgacctcatgacgttggttaaacttgagggccgtgcgaggaagggaggcttgaggtccggggaacccagtgcgtgccccgtcagctgctccctccggacccgttctccccgcctgcgccttgttcggtacgggccagggctcggcgtgccgagatccagctgggctcgggggccagagcctgggccctgcgggcggcgctctacctcctccgcgctcgtctcccatgctcgccctccgcgtcgctcttcgtccgaagttgtcctccttccagagtagcgggtaaccgcggcggccttgtcgctgggtttcaaaaagatgcccccgctgtgcgcgggggccacgcgc

SEQ ID NO: 571295 - DNA, 582 bp, Homo sapiens
gtgattatcatcagacggccaattcatgtatataacctataccttccaaaataatgctcaggccactctttatgaacagagatccatcacagactcggggtaccccagctccatctcttcatcaccccgaaaggaactggattccgggcaagcaatggcttcagttctgtgcagagccgagcaggtacagaccacacaagtctgtaggaaggtgctacaggctctgtagggaaatctgattcagcttccacttactagcatccccccttctcaatgaaacggtatctgcagtttccttactgacgacaaccaatcagcattcatcctccttgggtggcttgagccacagtgaggagattccaaatactaccatcacacaacagaggagcacgttatctacgcaggagaataccctttcatcatcaacatcttctgggcgcacttcgacatccactcttttgcaccccgagtcttggagagtgaggcgaatcctccaaacttcctccagcactttttcccacacatccagccagtctctgcacctcccccagtggtcagggtctcctccagtctcaatagtgg

SEQ ID NO: 571296 - DNA, 352 bp, Homo sapiens
ctcgttacaatgtaggccaagatattgcttcctagaacagcctagacatggatttgcgatgtcattaaccatctgtggatctggtaaaagtgtagattcataatattggaaaattgagcacacgttttaaaagtaaactgtgtgttccttattgttgtattgacacggattctagcgctgtcgcccaggctggagtgcgggggtgctatctgggcgtcactgaatgctccttctctggggttcatgccctttctctgggctcagcctcctgagtggctgggactacaggtgcccgccaccacgctgggctaattttttttttttttttttttttgggttttttaagaaaaga

SEQ ID NO: 571297 - DNA, 452 bp, Homo sapiens
aagcagtaatacagactcatggcggcacccacatgcccagttgattaaagacaatggtgtttattaattcatccatttgttcatcaaggttgccttgcttttaatggtgccaagaataagcagaacactgctctttaaatgttcttaagtgtttacttataacaggttgttaataaagtaaaagcctgagttggcatatataaatttgggtttaaaatttgattttggttgagacagggtcttgctgtgtcaccagtgcggtggcgcaaacacagctcacaggagcctcaatctctcaggctcaagcaatcctcccgaactcaggtgatcaccctgtctcgggctcccaaagtgctgggattacaggcgtaacccatggtacccggtctgtttttggaattttggaaaccagtctgaagtgagtctgtattaactgcttggggtaccgagct

SEQ ID NO: 571298 - DNA, 416 bp, Homo sapiens
  misc_feature (4)..(4): n is a, c, g, or t
ggcnagcttgaagggcctgcttgaactctgtcgctaattgaacaaatgagccatcagcatagtcgtgtgttactctggccacttactagctgcctgactgcagcggctgaggaggctgacagctgggtttagacacggttagacagggccaaggcaagggagggggttgaaaatgtgtaccagcgggtgattaacatgacagccacacaatctgagtcaggcagaggccaaggccaacctgggaaggtggaagggtaggaaggagggtttggaggaaatattttggaggtcatggtggtgctgaacaactgttcagtgagagtagaggagggagtgaacaacaatgttggccagagggtgggatgcttcatattgagagtgtattttttggtggtaggtagagtttggtacttgca

SEQ ID NO: 571299 - DNA, 786 bp, Homo sapiens
cgttgaggctgccagccttcggttgtgtcatcccaggcgaggtgagccaagggggactgcctggggtccccctcagtgcacacaggagcccagtgtggcctctgggcctggagaagctgcccctgcgccagcctgggcctgagaagggggccctggacctgtgagaagccgcccctaccccagcctggggcctgagaagtggggccctgtgacctgggcctgctgtcccaggagggcgagtgcgtgcacacatgcagtggcttgtggggggccagcgggtgggtgcgtgtgcctcttctggtgcagcagactgacctatcagaccccagccctgtgcagcctgcgagctctgtccggtctcctactccacaagaaggccctggagcacaagggcacctccctggttggttggggggcggaggctgagcggccgtgcggaggcactgcaagcctcaacttgggggctggtgctggggggcagctccagtgacaacccgggctacctcctgtttgcgatgcgcgtgttcctggcagcgcttcacccctccctagcgactccttgggcacacctgtggcccacaagggcgtaccgaaccacgcctctcaagtaccttctgagggttgggctctgaggagtagaggattgaagaccgtccttgagttgaagctaggaggcgttgcaggaccggggacggggcagccgggcgtgcacggaaaggccacatgccgcatacaggcagccccaactctggagattgtctgcttctcctgccggttctctagtga

SEQ ID NO: 571300 - DNA, 280 bp, Homo sapiens
tgatctgcccgcctcggcctcccctttgctgggattacaggcatggtgagccactgcacctggcctttttttttgtatttttagtagttaaagtgggtttcaccccccatctctactaaaaatacaaaaaattaatcgggcgtggtggtgggtgcctttggtcccagctactcgggaggctgaggcaggagaatggggtgaacctgggaggcggagcttgcagtgagcggagattgcgccactgcactccagcctgggcgacagagcgagactctgtctc

SEQ ID NO: 571301 - DNA, 308 bp, Homo sapiens
gagacagagtttcgctcttgttgcccaggctcagtctcaaagaaaaaaaaaattacagatctggttgggcgtggtggctcacacctgtaatcccaacactttgggaggcccagaggcaggtgatcactggaacacaggagtttgagaccagcctgagcaacacgacaagaccccggacctaccaaaaaaaaaccaaaaacaaacaaacaaaaaaactagccaggtgtggtggtctaagcctatagtcccagctacctgggagattgaggtgggaagatcacttgagccctggggaggtcaaggctgca

SEQ ID NO: 571302 - DNA, 245 bp, Homo sapiens
ttccagggagactacttgcaggtagtccttgatctggtccttgtctcagggattacttctgggggagcccagccctaagaagcacttccatcctcttcccctttttcccctttaagccaataaaggctccccatcctgccccctgcccccccagacccccctaacccatattgacctcttcctgtttctgttaacgcaatttttgcacctaacttcttaggcaccccctctaagcattaaagctg

SEQ ID NO: 571303 - DNA, 811 bp, Homo sapiens
gtaacattactcaggtccagttcgcaattcgggctcacagtcgttactgtctttacccagtgaacctatattgagacagtgaaatagagaatgccgacttgtgtccagcatgcatcataccactgagagccagtcaatccttgttgcagtacatcacagtgaggcaaggcgagggataccttaggaagcagtacaaatcttcataatcactctgagggagagtatattccaggagcttgtagtgcttcaagtgtccaaaatggaatggcatggttcatacagactcttatgatccagatggcaaacatggcgaagatccatgaccatcttcaactttctgcagaagtcgtggaaggtagtagataccaggaagtcattaggcaatacagtattgagtggaaaacagagaggcagaggcatacactggtctttcaccaccagttccctcatttaactgtgacgtaccgagatgagttcgaagagttagattctgtaccattagtgaaaagttctgctgggatactgagtttggtccatcagaatagccaggaaatacagaggtcttctcaagatgaaatggttagtacgaaacaacaacatataaatactagccaggaaatgacagaccagaacattcagctgaagatgcagcctgtgctccagggcatattgtagtgaacgaaataccaatgataggggacagaaacatggacgtcttcctgacacaggtagtgaggcacaatgtacaacacttgtaagttccagcccgttgaccagacaacaggttaactagaatgggggaaccacaagt

SEQ ID NO: 571304 - DNA, 737 bp, Homo sapiens
  misc_feature (5)..(5): n is a, c, g, or t
  misc_feature (75)..(75): n is a, c, g, or t
  misc_feature (153)..(153): n is a, c, g, or t
  misc_feature (169)..(169): n is a, c, g, or t
  misc_feature (189)..(189): n is a, c, g, or t
  misc_feature (193)..(193): n is a, c, g, or t
  misc_feature (211)..(211): n is a, c, g, or t
  misc_feature (216)..(216): n is a, c, g, or t
  misc_feature (219)..(219): n is a, c, g, or t
  misc_feature (221)..(221): n is a, c, g, or t
  misc_feature (228)..(228): n is a, c, g, or t
  misc_feature (240)..(240): n is a, c, g, or t
  misc_feature (275)..(275): n is a, c, g, or t
  misc_feature (278)..(278): n is a, c, g, or t
  misc_feature (281)..(281): n is a, c, g, or t
  misc_feature (299)..(299): n is a, c, g, or t
  misc_feature (368)..(368): n is a, c, g, or t
  misc_feature (388)..(388): n is a, c, g, or t
  misc_feature (406)..(406): n is a, c, g, or t
  misc_feature (408)..(408): n is a, c, g, or t
  misc_feature (412)..(412): n is a, c, g, or t
  misc_feature (421)..(421): n is a, c, g, or t
  misc_feature (469)..(469): n is a, c, g, or t
  misc_feature (577)..(577): n is a, c, g, or t
  misc_feature (590)..(590): n is a, c, g, or t
  misc_feature (644)..(644): n is a, c, g, or t
  misc_feature (651)..(651): n is a, c, g, or t
  misc_feature (717)..(717): n is a, c, g, or t
ggggnttggttgtttctcttggctcttggctggggaattggtgttcgggggcatggtcttttgcgtgtgggtttngctttcaacattgtttcttcaatgtttttcatgtgggttctttctttttgggttcttgctgattggttctttctttgntgtggtgcttctgaangggcatcttttggaatctcntggngcattttcaaagaattcntgccnaanantctgtanttaaatcaatcnttggtgcaatggggaaagatttgtatgttacctcnttnatngggaagctggcctttacngccaaagttttcggtacaaattcaatcctaacctatccggaaaagcaaccttgtcaggtccaaaaatgnaagaaaacgggtcccaacantgccccacccagggatgnanagcnttcaaaaantgtttcagccttgccttaacaattaaagccagaggtaaattccagggngaatgctttcctgaaaggcccttgaatgactaccaattactccctcacttaatagaatgaatgcaccggggccccctgccgcctgggaatacgggcgacgggttttcntcaatttttgccnttttgccaagcgtctcaattccgcctgaggagggcaatagaccctttttttgantattcanttcccagggcttttaaagttttctttaagggagcaaaaacaaggcgttcccttgggttctttcttngttagcctttcaaactttta

SEQ ID NO: 571305 - DNA, 327 bp, Homo sapiens
cacgaggataatctcagtctgtactgtttatatggatatcgaggacaggactgtacagcttatgtttaccttcttccgaatggggaaataacttatttcattgcatcagttttatggctatttagttatgacgacagaactcagtgacactacctgtggcacacataatgtgtgaaatgccttgctatacatcctgactcaattaggattgcaagtggacagatatctggcgtggataattgtggaaggtctctacaaccacacgtcagagtgtgggattctgttactctatccacactgcagattattgggcttggaacttttgac

SEQ ID NO: 571306 - DNA, 262 bp, Homo sapiens
caggggtgggatacaggctgagccacgtgctggccgagtctctcaattcttagtcacttgtccagccttcacagttaagtgtgccatttcctagacaagtcttctgcaagtagaaaagttttcttatacagttcttctacacacttttactcaactctgtcataacatttgcgttatttaacaggtagttttccaattctcgagtgttatttctatttcataaaagtcagaagtcggggtggagagaagctagtggcggacg

SEQ ID NO: 571307 - DNA, 137 bp, Homo sapiens
tagagatcccaggcgtttcagtgacagtcggggtgcagcatgagggagatggggtaggtggagttgagggagatggggtaggtaggagttgagtggaactgtgcagtgcacagtcacatcctggctgggattcgtgt

SEQ ID NO: 571308 - DNA, 630 bp, Homo sapiens
ggcacgctgtacgcctctcacaggctgacgaccgagcaagtggcctgttcatggggagctgcatttttgctggattggtcgtgcagtggccactgggctggttgtcggaccgatatgaccgcgcgctgctgattcgctgcttcgccttgtgcctggcggtgacggccttgccgttggcaatcatgacgcaggttccgctggaagtgttgttcgtggcgggcttcttctgttcgctggtgcagttctgcctttaccctttggcagtggccttttccaacgaccatgtggaaggcgatcgtcgggtatcgctgacggccatgttgctggtgacctacgggatcggcgccagcgtggggccgctgttggccggtgtggtaatgaagctattcggcagccagatgctctatgcgtttttcagcctgtgtgcattgatcctggtgtggcgcattcgccccaaggcggtgaccaacctgcatcaggtcgatgacgcgccgctgcatcacgtggcgatgcccgacagcatgtccagttcgcctttggtggctgcccttgacccgcgggtggatgagcaggtggtacaggatcagatgcaagtcactgtgcccgatccagagcctgcccctgaaaacg

SEQ ID NO: 571309 - DNA, 134 bp, Homo sapiens
ctcggccttcttgtacggctgcccaagacgaacccaaacgatcacctgcgactcgaacctgatccattaccgtcaactccacatccacggcgccatggctcggcccccgagcacaacaaacgtgccttgcagta

SEQ ID NO: 571310 - DNA, 468 bp, Homo sapiens
actcccgtctcacagaaaacaaaacgcaaacatacagcaccaatatctacaccaacaacaacccagagctcacatgtgaggatgagacagttcccggagccacagagaagtgaaaaaacttggagaatcagacttccacatccatgactctccttcctcctattctgcccagcaccaagtgtatggaaaatctcccctcaactcagggttgctacacgggaaaaagtgacactgaggtgtgcaaccagcttctccaccttctggggttcccgggggggagatttgtcctggccttaacccacagaaaacatcatgactgtctgaaggcagaaatatcccagactacaggcagagacaaatgagggaggaaggactaccatccccagccctggaaattctgctctataattgggccaaagacatgcaaattcagaagggccgtgcagcagcaccatgctgtagcaggtt

SEQ ID NO: 571311 - DNA, 179 bp, Homo sapiens
gccaggaccccctcagcccctgggcctgcactgcctgcaggtgtggcccccttggcctggacctggggccttaattgtgggaagggggggttctttccttccctttttttcttttcctttttttttttttttttgggcttcggagacatcagaattaataaccctatttttgattttga

SEQ ID NO: 571312 - DNA, 976 bp, Homo sapiens
ggagagaactagtctcgagtttttctggatttttttaaccaggtcaaaaaaaacctttattacttttcatgattgccacttatgctttcttgccaaatgccttaggaaaccaggtgctttctgggctggagcttttggacccttctgagactttgggacgcaggcgctagtttcatggcctgatggcttatctgggcaggacaaccttctgggctgagagccttaataactcgacggagatgatctttatggctggacactttagcagcagacagcagcagcaagccgccacgcagcagatcaccctttagtcccaggttgacttattgagggaacaaagctatacaggaaaagcgtgccttagaaagcctatcttaaataacattctggataaatacggtaccatcatattacttggaccttctataaatctttcaaaaacgaattcaacactcgtgctaaatccctgggcaatttcccctatatcttcgtggcactatcaaaatcttatctgtgggagcccacatgcgatggtggactgggccccaatagttggaacatagaaatgtttctgccctttactgccagagacttgaccgagcaaccaataactatcatgggtgggagcaaccatgtgatgcgggaacacaagtttgaaggactcaaaacattccaggtgaaaccgtgacagtacaccattttgaacaagggacattgtgcacttgtacaatatgaaggacgacaaagtatacctcaataaagaccaattccaaggtgacaatacacagacgaatagccatgacagcgcaagaacagcaaccacctacaacagcacgaccaacgaacaggacagcgaagtgaccccattagatggggacaccacaacaagaggcccaacaaggggttggggataaaaccaagacacgcacagatcaccccagaagaaaaccccgggaacagtggaaacccaacaacg

SEQ ID NO: 571313 - DNA, 1591 bp, Homo sapiens
  misc_feature (1177)..(1177): n is a, c, g, or t
  misc_feature (1359)..(1359): n is a, c, g, or t
  misc_feature (1480)..(1480): n is a, c, g, or t
atgtcgcgctcatattttgtggggggcacccctcttatgttaagccacaccgttgcgtgtcgtccccaagaagaagcgcccgggcggtgtgggtgtcccggccgtctgccccggagatcttctctcccgcggagcgttttctctgttcgcaggtcacccaccgccggcggtgctcccgcccttgtgggctcctattgtgagttatcccccactgttgggcgcttctctccttatagggtggtttttattcttcccgtgtggtgtggacccgcacccccgccccgcagtgtgtagtggttgctacccccctatattgggggaattttatgtaccccgttttgtgtagcaccctccccccgccgggggcgcgcattacttgttgtcgcacccgcccctcccgccgctggttagcaccactagtattctccttgtcggtcggctgtctttgcccccccacacccccgggggcacgggttcccacgaaaagggtagatttgttgagcctgttggagaccttctgcccgccgcccgcccgacttgtcccccacccggggggaagcgccaatatatttgtgggacgaattgagtaatgccttggcctcgccacgaatcggctcttccttggggggccccccttttaagggggaatgttcgaataccgtggtttccgcggtgtgtccccgccccgcttgtaggggtgggcggccccttgaaacctcgggcgcacttttggtatatttttattggccccaaaccttcagctcccgctcttgttggagccacttccggttatcctataccactcgagcacacacgctagactaacacgctttgtttaggcctccacacttgtggcacacgcctatatggttcccctcatgtcccacacttatggggagagcctcgtgatattttggcccgcactctcactatagagagaggctcgttcactttgtgcacgcgtcgaggtgttgccgcgccctatattttctcctcacagggcatacacacacgccctattgagccgcacacacacctctatttcgccctctccacatagttcccccctctgtgcacacgtattctagatatatgtctaaatctcgcgcgccgtataaaatctctacacacctttcctttcctcccccaccacacacacattttctctctcgcgccnctattctccggagattgcccccccgcaccgtttatcctctcgggacattatcccccccgaatgccaataccacgcaccactgtgaaccactccctcattcactctctcgttaagggctcacatgtcactttctcttctataccacgccacgctataatataaataatttttccactgagatnttgaggaagcccctctcgcctttcgaaagccgcagaaaagttcctaataagtagagagaaccctcccactataaacctcggaggtgaactataatggagtgccccccacccctaccaccanactttcggagaacccgtatacacttaaattctagaccacacaaaaaggaaaggaatcgaacccccccaagctggtttcaagcccaccccctggcctccatgactttttcca

SEQ ID NO: 571314 - DNA, 641 bp, Homo sapiens
aatccccctccttaaaattgtcatttagagaaattactccggcaaaaaatttcttttacagtccataccatcatgaatgtattcattttgcgccaaatctgaatatgctgctgctgcttaaaaagaggtacctcatttcgtgattattattttaaaacgcagacttctttcaagaatgccgctaagcgtgagatcatcattttcaatagaagcgagcgtagaacttttctatttttttttccctaacctctcttaagtggaaaccaattctgtactatgtatgcagaatcagctatagcagaagcagtcattaatatagattcgctagtgccacacaccagacaccagtcagcttttaactgagcacttcacctttttcattcttttaaacatatttgatcatgtttttatgttctagtcataaccctatacccctatacgttatatagagctttagtgtttctaagcagaataaatcatttccctatctcctaaacaactacattttctcatatatctagaatgattttttttcatattttaaatttgtcaggtcagaatgtctcctgtagttggtgatttctcagcaccattttctcagcatatttctccagtaagttacatcaaataatgatgtatct

SEQ ID NO: 571315 - DNA, 216 bp, Homo sapiens
ccgtgtgcatgtagttttaaatacatagacagtctcctctcctctcctctcctctcccacgtccacgcccacggccacggtctcctcttcctctttttccccggttctcctctgatgcaaggggaagttggactatacttgcggcatctcgggtccattgaaactcccttgcttgattctcctgcctcggcctgccaagtgcctgcgattacaggt

SEQ ID NO: 571316 - DNA, 248 bp, Homo sapiens
atcagtctcccgtttctgggcccacagcgcacaccagcctcctttctcgcctgcccttctactcttatcccgacctttcatcgactgcctacctgcccatgctggacatgtgctgctatcctcacctcagtgccagtgctataccacaggcctcaatgcctctgccggagccctctctagcttcatgaacccagaccagatctcgagctcccttgctcatgccccagatattccgttctctctccact

SEQ ID NO: 571317 - DNA, 641 bp, Homo sapiens
acctgatcgtgaatgttgacctgccttgtcgaagttggtgaagtttcctggataatggataatatgctgaagagtgttttccatcttggttccattctccctgtaactttcaggtacaccattcaaacatatatttagtgttttcacatagtctcatatttcttggaggtttagttcgtttctttttactcttttattctctaaacttctctttacgcttcatttcattcatttgatcttcagtcatctgtcttccacttcaatgaatcggctgctgaagcttgtgcatgcgtcacgtagttctcgtgccgtggctttcagctccatcagttcatttaaggtcttctctgcgctatttatcctagttagccatttgtctaatcttttttcaacgtttttagcttccttacgatgggtttaaacatcctcctttagctttgagaagtttgtattaccgatattctgaagcctacttctgtcaacttgtcaaagtcattctccgtccagctttatttgattgctggtgaggagctgcgatcctttggaggggaagaggccctctggtctttagaattttcagcttttctgctctggtttctccccaactttgtggttttatctactttggtcttgatgatgtg

SEQ ID NO: 571318 - DNA, 190 bp, Homo sapiens
tcaggggccggccccacggggttatcgaagcagctgtcaagatgctggggcccctggcgttgaggagaaaagcactggcgccacttttactcctccggttgctcagggccccaacgctccggggccatggaggtgcttccggccggagtgcgactactgggcagctcggggagccgcaggggcctggggt

SEQ ID NO: 571319 - DNA, 419 bp, Homo sapiens
cttactaaatgaatgatcaggaggaaagcagtgagtggctctctaaaaccattttgaaatattttgaaaattcaggatttaattctgaccagttctgaaaatggcatgtctttctggttacattatataaaaatattttctggccaggtgcggtggctcatgcctgtaatcccaacgctttaggaggcccaggcaggcagatcacgaggtcaagagatcgagaccatcctggccaacaggatgtacaacaggatgttctaaaaatacagaaattagccgggcatggtggcgcggacctgtagtcccagctactcgggaggctgaggcaggagaattccttgaatacaggagggggaggttgcagggagccgagattgtgcccctgcactccagcctagcaacagagtgagactgtctca

SEQ ID NO: 571320 - DNA, 205 bp, Homo sapiens
gagaagaagaaggaggttcctgctgtgccagaaacccttaaggaaaaggcgagggaatttcgcagagctgaagatcaagcgcctcagaaagaaggttgcccaaaagatgcttcggaaggcaaggagggagcttatctaattaaaaggccaaggacctattcacaagggatattgggcaggtgtacaggacctaaattcggattgc

SEQ ID NO: 571321 - DNA, 1130 bp, Homo sapiens
  misc_feature (85)..(85): n is a, c, g, or t
  misc_feature (88)..(88): n is a, c, g, or t
  misc_feature (297)..(297): n is a, c, g, or t
  misc_feature (851)..(851): n is a, c, g, or t
cccccatttttttattagtttttacatttaatttttttaatggggtctcaaaattctgtgacaaatttttgggctcaagttgtgnttnccatttaaaaagttacgtgatttttaaaacacttaattaactttaaaacgtgccacacgcaaaaaagaaagaccaaagtgtggctccacaaaacatttcctccttttccttctcgtgagaggttttatacgagtgcattgtgttattcattataaccagtctcttttatacttagcttaacactttaaatgtggccatagtgtaaaacnaaacagtttcgtgagcacgcgttctttccaccactgtgatttaagaagtgtgggggtggcaggcgtatttagggagattaatatattctcatttatacgccttttgtgacgctttcctgtggcgcaagcacttttggggtggacctttttgcccaggctctcccagcaggccttctctgtgtgttccactgtgctttgtgattagacgcccaccacccgaaaacctgtgctctgtgtttctcatatatctccacagaaaacagacaaaagccagaaccccaaaagggtggattggtctctgtgaagagagcttcttcaacacaccatgtggggcttttgcccagggaaccccattttgtcaacccaaggtggggccgaggcgattaccaccaggagtttctcagcgcaatttttagcgcgccatatcttttccaaggcttttttatcccccagagaaaccgggcagactccaaactcttttgtccccctttcaagactgtcaacgaccaacacactttggcctttgcaaaatgtggtagagcccgggtgttgtngcaaatccccagaattaacagggggcgccattaagcccggggcgtccttaaatttggggcccctgggaatggggtcctcccgggaattaagttcccaccctgtagagccaggtgtggagagccccctgtgcttgtcttctcctccactgggagcggggccccacctatttggcgctgatccccacctggcgactgtgttgcccccaccacaggaacacctctctgttagcgccagcctctctcttctttgacattttgaatgcccccccattgttcccc

SEQ ID NO: 571322 - DNA, 423 bp, Homo sapiens
  misc_feature (38)..(38): n is a, c, g, or t
  misc_feature (156)..(156): n is a, c, g, or t
  misc_feature (283)..(283): n is a, c, g, or t
  misc_feature (308)..(308): n is a, c, g, or t
gggggccgggcggaccaagggagccgggcgcggggatntggaagaggagggcaagaagggcaagaagcctggaattgtgtcgccatttaaacgagtattcctaaaaggtgaaaagagtagagatttttaagcccatgaaaaggttttgtttatgtnccgtgtgcacactgtggtgttgtcattgcctgagcgcgtcgagcagacagactgtgagcgactatattgagaaggaggtaaagtatttaggtcagttaacgtccataccaggatacctgaatccctncagtaggactgaaatcctgcatttnatagacaatgcaaagagagcccaccatctttcgggacacttgactcaggagcacgatgctgtgctcaggctgtttgtgtacaacgtcaagctggcctggagggaccgggaggata

SEQ ID NO: 571323 - DNA, 1172 bp, Homo sapiens
gagtggcctgatccgggcccgtgggcgggcgtcacagacgcttcgctccggtcctcggatcccgaggcgcggggagtgcagacgcagacggtgagctgcttgtccccgatcgctgccggctcgctccgtgggggaacgacgagagccccgtccgttgtgtgtcgccggggtagttggtagttggagcgcaggatgcttcgacttcgctctcgtcgtgggtcccgtgccctctgggcccgtcctgagtctactcttgggccgcacgtcgtgcagtcccgccgcgcgatggtggcgggcccatggtgttggctggtcggcgtggcatggttgagaggtgcccctgcggtgtgggacctgggggctacgcggtgctggggctgctagaggcctccttggggggcctgtccttgtcgagatgtgatccgctggtctagcgaccgtggcccttgggggcacactcagggattccgtcacatctgccgaagaagtaggcagtatgctcgaagacggggagggaagaatagatgactccatggcaccctagaaccaagactagaaagcgggggtagaacgcctcgagaggacatggaccggggcaaccatcatactcggggggatcctcgagagcagagaggggtcgtgcaccgtatgcggcatggggcacccggtggctgggctattgagttgaagcgacagctgggaagcgcagttggctcggacgctccgagacgggaaggccagagggggatccatcgtttggcgcgaacggttaggggactggtgacaaacatcttgcggcccccgggaaacagagtgcgccgcagaccacacggaatggcacccgccagaaggatgagcggttcgatcaagggcgaagagtaacgctgtccctgccaagtggtcgcgtccagaagagtcgggcacaactgggatcgggtgggatcgcacatgaaacgaactcaagtgaaccacgcaagggcgttgatgcgagaccgcagtgggaagaaggcggtagcgggggactagcagtttgttggcaaacggggggacctcaaacggtaacaaggggggcgggagaaagcgctcaaaggggggtcggaaggcaccccaagggaggtagcaagaaaggggagggaatggagctggggggataggcagcaacgaggggaggc

SEQ ID NO: 571324 - DNA, 463 bp, Homo sapiens
tcattatgcatacaactcaggactgattttacgtttcgattaattttaccgcatactgagttattcccaaaagacgttgggaaatggtcagcctatgaacagctcacgcatgacagtagttgtgactctgaaaacgccctagcgcgtccagaggcgcaggatccagcgcagccatgcccattcggctcaccaaaaaaagcttggaagcactgctgcaaagaacagcgcggattactcacatcacctctaggttcactaaagtcaggcactttggggggagttgagagtcagacttccgtgtgctgctgggaatccaggggcgggatcgtcacctcttcgaagtggccgtcgtccccgctctcatagtcactcatcatgacctcggactccacttcgcagcaggctgacacgtcagagcaggaggcggtggaggcgtacacagacatgggcatgctctcgacag

SEQ ID NO: 571325 - DNA, 312 bp, Homo sapiens
  misc_feature (144)..(144): n is a, c, g, or t
  misc_feature (162)..(163): n is a, c, g, or t
  misc_feature (167)..(168): n is a, c, g, or t
  misc_feature (173)..(173): n is a, c, g, or t
  misc_feature (178)..(178): n is a, c, g, or t
  misc_feature (186)..(186): n is a, c, g, or t
  misc_feature (230)..(230): n is a, c, g, or t
  misc_feature (238)..(238): n is a, c, g, or t
  misc_feature (262)..(262): n is a, c, g, or t
  misc_feature (275)..(275): n is a, c, g, or t
  misc_feature (288)..(289): n is a, c, g, or t
ggtatatgctggtcactttcgaagagccgccctatgctatcaaggctggatggaaagaaaaccatgcaacgtttatgaatgaattgaaaaaccttcaggctgaaggacttacgactcttggccaatccctaaggacagcttttnatttattaaatttttttnnattnnttacntgcanagacaacnatgggcaggtaggttgaataataaggtggcaaaatagttgattntcattttntggaaaacacagtccagtccaaanctacataacatgnatgcaagtataanncattccaaattaaaatagaatat

SEQ ID NO: 571326 - DNA, 176 bp, Homo sapiens
tcaaggatccgtactgtggtgtacgtctttatgaaggctcatccacacaagttgtaaattatgtagatgataaaatttgtaagtttgagctaataggatttgggtaagattttggacttaagttgattctgtaatgacatgagaccttataggaacctttgggaggacgtaaggta

SEQ ID NO: 571327 - DNA, 367 bp, Homo sapiens
tcaggtaggcaaacctgtggggcaggttggaacctgcaaaaaagcctgcagtgagggtggggtctgcactgagccttttcaaagggatgtgttttacaggcttctgtcatatacacaatcagggaataccttctggattcttgggcgatccgttgttgttgagacacagtctcacttcacacccaaactggactgcagtggcatgatcttggctaactgcaacctgtgcctcccaggtacaagcaatgctcattcttaagcctcccaagtagactggaattacagacacatgccaccatgcctggctaatttttgtatttatagaacagatgggatttcaccatgttggccaagctggtcgtgaact

SEQ ID NO: 571328 - DNA, 325 bp, Homo sapiens
  misc_feature (66)..(66): n is a, c, g, or t
agcaagaaaactattaagggcccttaagggttagccgaaggggccctggggttgggtgaaatttcngggcaccgagggggttcagggggcaacatatcaagaattcgggaaccaagcagagggcgctggggagcggcatgtaccatcactggctctcggtctcatcgccctggccagtactcatcactgctgggcgcgcggtttggcggctaccactggcagatgcagcagtatggagcagaggcgagcggaaattctccccctactgaggccagctgaggtacaggcaggggcaggcaggaccacaagcgcccgctgcccagcc

SEQ ID NO: 571329 - DNA, 140 bp, Homo sapiens
tttcaccatgttggccaggatggtctcgatctcttgacctcatgattcgtccggccttgctccccaaagttctgggattaaggcgtgacacccgcggcccgccgagtggtggtattttttaagaagcacaggccatacct

SEQ ID NO: 571330 - DNA, 424 bp, Homo sapiens
ttttttgagatggagtcttgctctgttaccaggctggagtgcagtggtgcaatctcagctcactgtaacctctgcctcccgggttcaagcgattctcctgcctcagcctcctgagtagctgggattacaggtgcacgccaccacaccagctaatttttgtatttttagtagagacagggtttcaccatgttggccaggatggtctcgatctcttgaccttgtgaactgcccgcctcaatctctgaaagtgctgggattacaggcgtgagacaccacgcccggcctattacacactcttttatatgcttgttggactctttctccaactggattttaggctccttaaggacagtgactaggagacacagtaggagttcaagacatacttgattgatttcttgattgttggacactttgggtggga

SEQ ID NO: 571331 - DNA, 175 bp, Homo sapiens
  misc_feature (167)..(167): n is a, c, g, or t
caatgggaacagtggctgctgggaaaaccttcgcacctctgcctctgggcctgccttggtgaccaaggacagtgtagcagatccacacaacttaaagatctgctgcccgagtgaatggggaagtcgtccagagcagcaaccacccaacccagatggtattcaaaggncaggagga

SEQ ID NO: 571332 - DNA, 742 bp, Homo sapiens
agcctgcagtggcctgtagtgcatgccatggctgcccagccggaatggcatggtcttgaatgccccacttccacaatggacttggcatgctgtgctgctgtggccactgtggttcaaccatgcctggccctgtaagatcctgcatgactgtaatgtgcccgtgcaatgccaatggctgcgccgcatctgcccctgctgcccctgctgtctggtgtcccatcctggcccatctgtgctgctgccccactggttctggtaccacactgaatggtgcgcgcctggccgctggcttcagcctggaggagctcatgggtgtgccaggcattcacaacgaaggtggcccggaccatcggcatttctgtggatccgaggagtgctgtgaacaagtccactggagtccctgcagaccaacgtgcagctggctgaaggatgtacctgtccaaactcatcctcttccccagtgaagccctcgtgccccaatgaagggagacagttctgctgaagaactgaaactggcacccagctgaccggacctggtcatgcccgtccggaacgtctataagacaggagaaagctcgagtcatcactgaggaagagaagaatttcaaagccttcgctagtctccgtatggcccgtgccaacgcccggctcttcggcatacgggcaaaaagagccacggaggccgcagaccaggttgttgaaagaaaaataagtctcctggggactctggatcagtcggcaa

SEQ ID NO: 571333 - DNA, 1067 bp, Homo sapiens
gacggagccgagctgagtgctcggcttcctgctgatggtcagtgctttttggcaactccccgtgtgtgagaggggtagtggagtgctcccgtgcgtgcgactgtgggcctgagttcaccagcctgccggggcagtagtcgaaggccctggctgcggcatgtcctgtgtgtgccgcggtgcgggcagtgaactgctgcgcctgtgtgcggtggatgtggcctggctgcctgtgtgctgccagagctgtacctgggctcctgttccctgttgtactgctgcttcagtgtcgatcccagcactggtgctgctcatcgctgcgtggctggagggacggctgccgacaatgacatggcataacgaatcggctgttgcactttcttgcagctagagctgattactcgtggctgcttgagtgcctccttgcttgaacatcccatgacacagagacactgtggaccaccatgaacttggcacttggctggtgacatccttgctgcagggcaggatgcccactgtcagctcctgcgcttccaggcacatcaacagcagggcaaacaatggcagagaaggcctggttccaaaggatgcaggggcctcgacaaaggaacgggaggcagccccagcagagaccgacatgtggccgcggaaacccacacacgaggggctagaactcagggtacgagaaatttgcaggtggtgcagaccaggactttagatccgatccattgaggacagcttgctgtgcttcagcaggataaatacgcctgagttgccacgttggcaggaaccaaggatgggtaacgtccggagggactggcgaagcggttttgcccgcaacggtgggggcgcgcaggggttccgtcggcgaggttagcgaaggggagaccagaagaaaggcgtggcacatctgggacgacccgggggaatagagaggggcgactgaatgggacacacgttcgggtaacacaggggtgagccgcgggaaacaaggagggccacactggaggtagggcaagagaggggatcaaggagtggacgcacagatgactggagaggggcgacgacaa

SEQ ID NO: 571334 - DNA, 401 bp, Homo sapiens
  misc_feature (174)..(174): n is a, c, g, or t
  misc_feature (190)..(190): n is a, c, g, or t
  misc_feature (256)..(256): n is a, c, g, or t
  misc_feature (291)..(291): n is a, c, g, or t
  misc_feature (318)..(318): n is a, c, g, or t
cctcccccacagtgaggggagcaacctcagcctttacctgatgtagatactggtgctgattttggtacagcctatagaattgtgacctaaacaaacctccttttctttataaattacccagactcagattattccttttatatgtaacacaacacagattaagaacacttcccnacccgagttgtctctnacagacctcatttacgggttatctctctcttacattgtgtctccacttatagcggctgtgggtccnccattgcttttctcacacacacagcgctggtgctnccttcttgccttgtgcattgtcgtccncctctcctgggaacatgcctcctttagtgacctgaatggctcaccacttcacctcctgtaggtctttgcttgggtgtcacctt

SEQ ID NO: 571335 - DNA, 506 bp, Homo sapiens
aataaacgcctcttgttttagagtcagagtatttggggttcagttctagcttcactacttgaaattggagtcttgtggtatgcacattaaagatataggaattcaagtaaatgtgttcagcagagggagggaggaaggaaggcagggaggaagagaggaagggaggacacatgattctgcctgtcatcccatataatgaatctgacattgtacagtcatgtgccgcataatggcattttggtcaatgacggactgcatatatgacagtggttccataagattatattggagctgaaaaattcctatggcctaggacattgtagcatgatgcattgcactcacatttgtggtgatgctggtgtaaacaagcctactgcactgccagttgtataaaagtatagtacatacaattatgtacagtacatatttgataatgaattaaatgactgttactggcttatgtatttactatattttttaaatcattattttagggtatacttcta

SEQ ID NO: 571336 - DNA, 351 bp, Homo sapiens
gagtgcagtggtgggatctcggctcactgcaagctccgcctcccgggttcacgcattttatactgtttaagtgttaaacaccaaccctgtctttctttgggttgagcttttttagaaagtcgaagtgaatgtggccaggaaaatggaaaagccattgtataaattttttttgaggcagagtcttgctctatggccaggctggagtgtagtggcaccatctccacttaccacaacttgtgcctcctgggttcaagcgattctgctgcctcagcctcccgagtagctgggattgcaggtacccatcagcccatgcccagctaatttgtatttttagtagagatggggtttcac

SEQ ID NO: 571337 - DNA, 896 bp, Homo sapiens
taatttcactctgggaatcaaaaagcggggtattctgggcaaatggtccttgtgccctccccactcatccctggtctggtcccctgttgcctatagccctttacccttgaatgcaccgacccccataaagatagcttgtggaccaatccaccaattcgacgctttcacgtgttggtatcttcccctacaaaccccttttataaatgtgggagtgcgaaatcgtacgatgagggggaggtggacctcgtgtcccgcacctcatctcaaggctctcatggtgaagagcccgcatgtgccccacaaatggtggattaaaacctctatacgccgtgagcgggggatcctcttatctaccccgcggacaagctattgtgctcttcacatgtatacgaaacaccgtgagagtattagaatcctacacgacgtttttaatatatatggtaatagacaacagacatagagaaacaggggagcgcgcggggcgccttgctaacataaaaagagaatttatccccacgcgaagagagaggctcccccaacgtttttacaccggcccgatctcccccgccgtatatctttctgtgtcaacgcagagggagtgggcccccccccatatatggaggaagcggaagacgtgcgaatactatcttgtttagcacaggcgttaagaaggagcaacgcgtgtgcgccccgtcctggccttaatgtacagcagaacgcgctctcgcgaggtagcatagtgtgcccaaaaaaaggaaggggcagatggcttcctctggggggcacaatccttgttcggtacagagagcgacaccccccctatagtacattcgtggtgggcttgtgtgcccccctcaaacgagggggccaaacactttcacgccttgccgacaact

SEQ ID NO: 571338 - DNA, 561 bp, Homo sapiens
tcgatctagaggatcccgtgctcatgaatggtgatactcttctatgataggggaagtagcgtctgtagacctacttgcgctgcatgtgccataccggacatcgtgatcctcgaggatcacgatgtccgtctgcggccggcggtgtagacgccccttcgccgggacctggcacccgaatccggcctgccggtgttacctggaatgtcagagagctgaaagcagtcatatttggggatcatgcacctacggcggcagtatataaagaaagataattaagtatgcacccaagaagtagctgcgcccctacccatcacaaacggtatagaaggatatctcctaaggatcttatcatgtgaaacccttctgatataagtgggctctattaagaaatgcagctaagatgcaggatatgggccagcagctatacactacacacttgaacggcggacatattccttgaccatgtcacccaaacagcgtgatgctaatggagcacctcggccaactagacaagaagcacaaacccttttgtatcagggctcagaggcagcaggtgccatg

SEQ ID NO: 571339 - DNA, 1452 bp, Homo sapiens
  misc_feature (128)..(128): n is a, c, g, or t
  misc_feature (201)..(201): n is a, c, g, or t
  misc_feature (343)..(343): n is a, c, g, or t
  misc_feature (665)..(665): n is a, c, g, or t
gccttcgcgttctgtagcatgctccgtgcgtgcttgtgtggacagcgaggccatgctttttgagagccctatctgctgttccagtcgtgggtccttcactggagttacatgcttgaggaccagcgaanagagatgggtgagagtccaatgagcgtgcatgaggttccgacagtcgacacactatatgcataggactaattnttcgtgaccacgtacaccatcgattggcatggctaccgtcggacatatgcgcgtacacgacaagccagagcctcgcaacaagctgaccctcttgccccgcatcgatctcttgtctcaactctcccagaggtgatccatagcnagatctcatgtcatgcgtgagatcagataggcagaagaatgatggcgttgtgcacgcgacgcatagagcgagaaggcaggagcgacccaagaggccggctcgtggggacccgtacttacaaaaggagttgtatatagacaaggggattcccactacgcagcaccgccttactgcgtcaacgcacatagtacgcctgagatgcgcgtgcgcgtatgcgcatggcatgtgttcccgtaccgaatggtacggggtagcgaagtcgttgtaaggcgcgttgaccatatcgcaaactgactttgtgtgccctaatttcattgcgttngggcagtgccattcgggacgtgccaaccagcaagaaggtttagagggcgtgtggtacaatgttaaccccgagggggaccatgtctgcagctaagacggcgattcgcccttggggacacggtgcccgtaccatgaagtggcatagcaaggatgcatatagaaggccaccgaatggaatttcgccaattgttccccggaggaaacgcacaaggttaaaagccgaaggtgttcccagttgtagggggtcttcacccgggagcatttgtgcaaggggcccgggcatcgatacggaatagccgggttggaggcacgcaacggcgacgcacaattttcggaacgaaaaagttcatccgaggtacgcgtggggtttcccctttcgaaaggcaaccgccaatctgtgggaccttcgcgtttgtgcttcccttggaagggccgcggatattggtagaaggaactatagattgagatttggcggtatctaaattggcctgttctgagcccatgttgaccagttgtttgccttaccaccatgtgtgtgtcgtccccttgtagagaagctggtaacatagcggcgaaaacccacattggaggtggcagtcacaaagagcaagagtctcaagagggttgttgtctcacaacagggtggatcggccccccttggggagcacacatcggggccaacccagatggtgaacgccccacggcggcaaaaaggcgcccataagaccgaacatgttggttacccgatagaagtgtcccattgtacaaaacgagcagtccttcgacac

SEQ ID NO: 571340 - DNA, 1600 bp, Homo sapiens
ccttagtgcttagtctgtcgtgtctctttctgttgttttaggttgttgggtgtttttggcgtacggtgtctcgtcggtgttcgtctctgttgctgccctgctttagtgtttgcttctcctggtttggtcgttgctctctgttggtggggacgttgtgtgtttcgtattcctttgtggttcttggttactgtgtggctgcctgattggtgctcagtttgtgcctgcgtgggtaggggctgcgtagttgtgcgtgcgcgtcgggtagctgacaaatcggggttgtgttccgctaccgttgtcgcatgtgtgtgcctcctttgtgggttcgcaccgtacgattctgtgtatgtggatgggtttgacgtgcggacgggacgcacgtatgtgtctggttggctccttttagtgttggtggatccgctccctctgtggtgatcctgtggtggtcctctgtgttctggcgccaccgcagatatgtggtgtgctgttgttcctatttaagtcgtctggggcagttcgtgtgtgtgttctcctgtgtcgtggtatgtttgctcccgtttgcggggcgtttcgtcggtcgatctacacggcggtttgtttgtatgtacttgtatttgcgcctcgcccacttgttatgggcacagttgggggttcaacgggtggtgtgttaacatgggccgtgcttgttgtttcaccagcggggtgtttattggcccctgtctcacggtggaccccttttttgccgttttggaatgagtttcgttctcgtgcttgcccacggaaccaattcgtcctgttgttcgaagtgtgggaataatgtgtctgtgggttgtccacgagaactcgttgtgtgtttcacttcgcggtgatgaattctcttttcttttcggtgagtggtccacttgaggatgcctcctcagacacttcacgggatttccaccaggcgttgaaaagaatgtggaaagtgttccacggtgaattgagaatggagaaatattcacacgccccaataggaggtgccaccctgaatagggacgtatatatgaatccaccccacgagtctcgtttatttcaccgtcttactctttgtgacttccactgtgtttttacctggggatagtgtgtttaatagctgtgttgtgtgtcaacacaggcgtcattttattggaactgtaatttaagcatctgtacaccacgcctggaaggcgcccacccacggacgcaccacggcttgccacctgtttcttgtaacacgcttctgtgtgccccttgaacactcgcctgaaaatgagatttatctgtttgaaagaagaatgccctctgtcggtgtgtgccacgcctggtgatggaagaaatgcacgcctggcacagctgttatggagcacattatgtccacccttcacgcgcccgggttctctggccgcggtctgactcacgaaccctctggtactcgcccctctggccccacgtgcccacgaacccactgttagccccctggctcctgcactttatccccgaatatcctcgcttttaatctgtgcccttaagctgggaacttaccccctgtaatcacctaaattaacgtgtttataaaccatga

SEQ ID NO: 571341 - DNA, 144 bp, Homo sapiens
gatgcaatagactttacagaaagacttccggcgcatgcaggtctgtgtcatcgaggctcaagctgtgtcgatcagtggaggtctttggtttccgacatatagtctgtggaagagaatcagtactcgggccacgaagcttaacaa

SEQ ID NO: 571342 - DNA, 104 bp, Homo sapiens
  misc_feature (19)..(20): n is a, c, g, or t
gcggggggggggccccccnnccccaaccctttttttacaaagggggtttggggcgggggaaattttcggggtttggggtttttaaacccttaaaaaaatttgga

SEQ ID NO: 571343 - DNA, 844 bp, Homo sapiens
cgtgtctggactacaagtaccaactttgagcccttctctcatgatgatcgccacgtccatcgcctcagttcgttctgtggactgctgcgcctcagagcagaaggctgttcaccaaaagtggtttgcgccactgaaacaagaacttcaacatccatggaacgaacaagcactggttaattaggcaatgccaagactccgatgactaacttcttcacatactagttccatagatgatgcatattaggaacaaatgtgtggcaaactctcctctcagttgatgaccttgtggagaaactggtcaagaggctggagttcactggtggagctcaacaacacttacatcttctatacctcagacaatggctatcacacaggacagttttccttgccaatagacaagagacagctgtatgagtttgatattcaaagttccactgttggttcgaggacctgggatcaaccaaatcagacaagcaagatgctggttgccaacattgacttgggtcctactattttggcattcgctggctacgactaaattagacacagattgtgggatgtccttatttgcccttttgagaggtggccgcacttgcctggggatacgagtccttggtgggggaacaccggggaaggccggcgaggtgtcttgcaccagtgtcgccccagtagtcgggggatccagtgtcccccaggtgtgtgtaggctcttatacacccttgccgttgtaggcagttcgctgtggacttgattcgcgttgtcccgcggttgtaacttattcggtggccacgactaattgtgtcacaaccccgtagaactgtatatcacttgccacgacggtgaa

SEQ ID NO: 571344 - DNA, 384 bp, Homo sapiens
tctagaggtccccgagccgctcagtactgatcattctatatcccctctatttgacccccacctccaaggtatctcatcgacaaccgacgaatcaccaccccacaatgactaagtccatctaatcctctaacacagaatgatagccatacactacactataggacgaagcttatcgcttatactagtatccttaatcatttttattgccacaactaagcgctcctcgggactcctgcctcactcatttacaccaaccagcctactatctattaacctcgccatggccatccccttatgagcgggcgcagtgattatgggctttcgctctagattaaaaatgccctagcccacttcttaccacaaggcacacctacaccccttatc

SEQ ID NO: 571345 - DNA, 578 bp, Homo sapiens
  misc_feature (432)..(432): n is a, c, g, or t
agaggaccctcttgggtgataccacgacttgctattgtgaataatgctgtgataaatgtatgagtgcaggtgtctttttggcaaaatgatttcttttcctgtgggtagatacccactagtggaattgttgaattagtagttctgtttttagttcttgagaaatctccatgctgttttccatagagatggtactaatttacagccccaccaactgtgtataagtgtccccctttctccacatcctcaccaacatctgttttttgactttctaatggccattctgactggcgtagaagatggtatctcattgtggttttagtttgcatttctctgatgattagtgatatctgactaagtccccaaaaggaaacacagcagaaacaaaaatagacaaatcagacttaattgaactaaaaagcttctgcatagcanaagaaataatcaacagagcaaacagaccacctgcagaatgggagaaaatatttacaaacaatgcgtccaacaaagggctaatatctagaatctacaaggagctcaaacaacaagaaaaaaataaccccattaaaaagtaggccacg

SEQ ID NO: 571346 - DNA, 1238 bp, Homo sapiens
  misc_feature (98)..(98): n is a, c, g, or t
  misc_feature (124)..(125): n is a, c, g, or t
  misc_feature (269)..(269): n is a, c, g, or t
  misc_feature (330)..(331): n is a, c, g, or t
  misc_feature (340)..(340): n is a, c, g, or t
  misc_feature (342)..(342): n is a, c, g, or t
  misc_feature (356)..(357): n is a, c, g, or t
  misc_feature (363)..(363): n is a, c, g, or t
  misc_feature (385)..(385): n is a, c, g, or t
  misc_feature (393)..(393): n is a, c, g, or t
  misc_feature (395)..(396): n is a, c, g, or t
  misc_feature (423)..(423): n is a, c, g, or t
tgggctcacgtttttactcgcttactttagcagaagtagttctggtcgtcgcctaccgtctcgctatagccgtttgagggaagaaggaggaaaattanccggtatcgttagagctacaccaaanntgcattgagccaaacttgccaccaagagcccaacaatcaccatgatgctgagcacggaaggcagggaggggttcgtggtgaaggtcaggggcctaccctggtcctgctcagccgatgaagtgatgcgcttcttctctgattgcnagatccaaaatggcacatcaggtattcgtttcatctacaccagagaaggcagaccaagtgnngaagcattngntgaacttgaatctnnagaggnagtgaaattggctttgaagaangacagagnanncatgggacacagatacgttgaagtatncaagtctaacagtgttgcaactggcatcgcggtgctgaagcatcacaggtccgcaatcagccctgcatactgccacacgatggcttcgtcacggcttcagaggcatcccattgggctgtagcaaggcaagagcatgtacaagttatattacagggattggaacattgtgccaaaatgggatgacactgacagttggaactttcagggtgcgaagcacaggggaagcctttgtgcagttgtgttcacaggcagatagctgacaaggcttaaagcaaccacaaggaaagaataggggcacaggtacattggagatcttacaagagtagaccgagctgcaagtacgaaaaacagtatgatgcacacgtgaaacggttactgggttatgccagcggacaaggttccatatgataaggcagggggtatgcaacagggatacataggattggaaagaaggcaagcagggttagacaggattaaggtagagagccctagtgcatagcacgagagaaggaagtgacatgacacgaccaagcgacggccaatccgtcaccgacacggcgacaaggcacccaaaacaaatagtcgaaaaagacacacaccacacgcgaccgaacgtcagcagcaccgcaccagagccagagaagcacgaaaacgacgccacacgggcacagaaacaaaaaacggaaacacaaaaccagaaaagaacaaaagagaacaccacacaacaacacaacagacacaacacaacagacagcaaggcccccagccagccccccacacacacacaacgacacaccaaacggaccaacccagcg

SEQ ID NO: 571347 - DNA, 1868 bp, Homo sapiens
  misc_feature (1693)..(1693): n is a, c, g, or t
cgcccgggcaggtcctttgtcaagtcatcccctcttctcctcaggaactgctcaaacctgtgccccaaagatgagggcccaggaggacctcgagggccggacacagcatgaaaccaccagggacccctcgaccccgctacccacagagcctaagtttgacatgttgtacaagatcgaggacgtgccaccttggtacctgtgcatcctgctgggcttccagcactacctgacatgcttcagtggtaccatcgccgtgcccttcctgctggctgaggcgctgtgtgtgggccacgaccagcacatggttagtcagctcatcggcaccatcttcacgtgcgtgggcatcaccactctcatccagaccaccgtgggcatccggctgccgctgttccaggccagtgcctttgcatttctggttccagccaaagccatactggctctggagagatggaaatgccccccggaagaggagatctacggtaactggagtctgcccctgaacacctctcatatttggcacccacggatacgggaggtccagggtgcaatcatggtgtccagcgtggtggaggtggtgattggcctgctggggctgcctggggccctgctcaactacattgggcctctcacagtcacccccactgtctccctcattggcctttctgtcttccaagctgctggcgaccgagctggctcccactggggcatctcagcttgctccattctcctgatcatcctcttctcccagtacctgcgcaacctcaccttcctgctgcctgtctaccgctggggcaagggcctcactctcctccgcatccagatcttcaaaatgtttcctatcatgctggccatcatgaccgtgtggctgctctgctatgtcctgaccttgacagacgtgctgcccacagacccaaaagcctatggcttccaggcacgaaccgatgcccgtggtgacatcatggctattgcaccctggatccgcatcccctacccctgtcagtggggcctgcccacggtgactgcggctgctgtcctgggaatgttcagcgccactctggcaggcatcattgagtccatcggagattactacgcctgtgcccgcctggctggtgcaccaccccctccagtacatgctatcaacaggggcatcttcaccgaaggcatttgctgcatcatcgcggggctattgggcacgggcaacgggtccacctcgtccagtcccaacattggcgtcctgggaattaccaaggtgggcagccggcgcgtggtgcagtatggtgcggctatcatgctggtcctgggcaccatcggcaagttcacggccctcttcgcctcgctccctgaccccatcctggggggcatgttctgcactctctttggcatgattacagctgtggggctgtccaacctgcaatttgtggacatgaactcctctcgcaacctcttcgtgctgggattttccatgttcttcgggctcacgctgcccaattacctggagtccaaccctggcgccatcaatacaggcattcttgaagtggatcagattctgattgtgctgctgaccacggagatgtttgtgggcgggtgccttgctttcatacttgacaacacagtgccagggagcccagaggagcgtggtctgatacagtggaaagctggggctcatgccaacagtgacatgtcttccagcctnaagagctacgatttccccatttgggatgggcatagtaaaaagaattacctttctgaaatacattcctatctgcccagtcttcaaaggattttcttcaagttcaaaagatcagattgcaattccagaagacactccagaaaatacagaaactgcatctgtgtgcaccaaggtctga

SEQ ID NO: 571348 - DNA, 247 bp, Homo sapiens
taacaaagaacaacttaaaaacgagtagacactgatagtttcaccttaagagaaaagaactcttaagcatacaagttacaagacaaaaaacccaacaaaccaaaaacaacaactgagaaaccaaaatcagctattaggaaacaggtaaaaaagaaagcaaagcaaatgaaaataccctttcatcatgagtagtaagtaatttcagtcatggtcacgtaacagaagtagcagagcagtccctacctat

SEQ ID NO: 571349 - DNA, 4709 bp, Homo sapiens
aaaggaaatgattttttcatcgatgactctaaactagccagtgcagatgatattggtactttgatctgtaagaacaaaaaaccgctcatacaggaggaaagtgacaccattgtttcttcttccaagagtgctttacattcatcagtgcctaaaagtaccaatgacagagatgccacacctctgtcaagagcaatggactttgaaggaaaactgggatgtgactctgaatctaatagcactttggaaaatagttctgataccgtgtctattcaggatagcagtgaagaagatatgattgttcagaatagcaatgaaagcatttctgaacagttcagaactcgagaacaagatgttgaagtcttggagccgttaaagtgtgagttggtttctggtgagtccactggaaactgtgaggacaggctgccggtcaaggggactgaagcaaatggtaaaaaaccaagtcagcagaagaaattagaggagagaccagttaataaatgtagtgatcaaataaagctaaaaaataccactgacaaaaagaataatgaaaatcgagagtctgaaaagaaaggacagagaacaagtacatttcaaataaatggaaaagataataaacccaaaatatatttgaaaggtgaatgcttgaaagaaatttctgagagtagagtagtaagtggtaatgttgaaccaaaggttaataatataaataaaataatccctgagaatgatattaaatcattgactgttaaagaatctgctataaggccattcattaatggtgatgtcatcatggaagattttaatgaaagaaacagctccgaaacaaaatcgcatttgctgagttcttcagatgctgaaggtaactaccgagatagccttgagaccctgccatcaaccaaagagtctgacagtacacagacgaccacaccctcagcatcttgtccagaaagcaattcagttaatcaggtagaagatatggaaatagaaacctcagaagttaagaaagttacttcatcacctattacttctgaagaggaatctaatctcagtaatgactttattgatgaaaatggtctgcccatcaacaaaaatgaaaatgtcaatggagaatctaaaagaaaaaccgtcatcacagaagtcaccacgatgacctccacagtggccacagaatcaaaaactgtgatcaaggtagaaaaaggcgataagcaaactgtggtttcttccacagaaaattgtgcaaaatccactgtcacaaccaccactacaacagtgaccaagctttccacaccctccacaggcggcagtgtggacatcatctctgtaaaggagcagagcaaaaccgtggtcaccacgacagtgacagactccctgaccattccacgggaggcacactggttacatctatgactgtgagcaaagagtattccacacgagacaaagtgaaactgatgaaattttcaagaccaaagaagactcgttcaggtacagctctgcccatcctatagaaaatttgttaccaagagcagcaagaagagcatttttgttttgcctaatgatgacttaaaaaagttggcccgaaaaggaggaatccgagaggtcccttattttaattacaatgcaaaacctgctttggatatatggccatatccttctcctagaccgacctttggcatcacttggaggtatagacttcagacagtaaagtccttagctggagtgagcctgatgttacggttactgtgggcaagtttgagatgggatgatatggcggccaaggctcctccaggaggagggactacacggacagaaacatccgaaactgaaatcacaacaacagaaataattaagaggagagatgttggtccttatggcattcgatctgaatattgtatcaggaaaatcatttgtcccattggagttccagaaacaccaaaagaaacgcctacacctcagaggaaaggccttcgatcaagtgcactgcggccaaagagaccagaaacgcccaagcaaactggccctgttattattgaaacctgggtagcagaagaagaactggaattgtgggagatcagggcatttgctgagagagtggagaaagaaaaggcacaagcagttgagcaacaggctaagaaacgactggagcagcagaagccgacagtgattgcaacttccactacttccccaacaagcagtacaaccagcaccatctctccagcacagaaggttatggtggcccccataagtggctcagttacaactggaaccaaaatggtactaactactaaagttggatctccagctacagtaacattccaacaaaacaagaactttcatcaaacctttgctacatgggttaagcaaggccagtcaaattcaggcgttgttcaagtacagcagaaagtcctgggtatcattccatcaagtacaggtaccagtcagcaaacctttacttcattccagcccaggacagcaacagtcacaattaggcccaatacctcaggctctggaggaaccacaagcaattcacaagtaatcacagggcctcagattcgccctggtatgaccgtgattagaacaccactccaacagtcaacactaggaaaggcaattattcgaacacctgtgatggtacagccaggtgctcctcagcaagtgatgactcaaatcatcagggggcagcctgtctccactgcagtctccgcccctaacacggtttcctcaacacctgggcagaaaagcttaacttcagcaacgtccacttcaaatatacagtcttcagcctcacaaccccctcgcccccaacaaggacaagtgaagctcaccatggctcaacttactcagttaacacagggccacggtggcaatcaaggtttgacagtagtaattcaaggacaaggtcaaactactggacagttgcagttgatacctcaaggggtgactgtactcccaggcccaggccagcagctaatgcaagctgcaatgccaaatggtactgttcagcgattcctctttaccccattggcaacaacagccaccacagccagcaccaccaccaccactgtttccacgacagcagcaggtacaggtgaacaaaggcagagtaaactgtcaccccagatgcaggtacatcaagacaaaaccctgccaccagctcagtcatcaagtgtgggtccagcagaagcccagccacagactgctcagccttcagctcagccccagccccaaacccagccccagtccccagctcagcctgaagttcagactcagcctgaagttcagacccaaacaactgtttcatcccatgtcccttctgaagcacaacccacccacgcacagtcatccaagccccaagttgcagcacagtctcagcctcaaagtaatgtccaaggacagtctcctgttcgtgtccaaagtccatcacagactcgaatacgtccatcaactccatcccaactgtctcctggacaacaatcccaggttcagactacaacctcacaaccgattccaattcaaccacatacatctcttcagataccttcccaaggccagccacagtcacaaccccaggtggtgatgaagcataatgctgtaatagaacatttaaaacagaaaaagagcatgactccagctgaaagagaagagaatcaaagaatgattgtctgtaaccaggtgatgaagtatattttggataagatagataaagaagaaaaacaggcagcaaaaaaacggaagcgtgaagagagtgtggagcagaaacgtagcaagcagaatgccactaagctgtcagctctgctcttcaagcacaaagagcagctcagagccgagatcctgaagaagagagcactcctggacaaggatctgcaaattgaagtgcaggaagagctgaagagagacctgaaaattaagaaagaaaaagacctgatgcagttggctcaggccacagcagtagctgcaccctgccccccagtgacaccagctcctccagcccctccagcccctccaccttcacctccccctccacctgctgtgcaacacacaggccttctgtccacgcccaccttacctgctgcttcccagaagaggaagcgggaagaggaaaaagactccagctcaaagtccaagaaaaagaaaatgatctctactacctcaaaggaaactaagaaggacacaaagctttactgtatctgtaaaacgccttatgatgaatctaagtgagtagatctttttgagctctagttttttgtcttgaaagtttagctattaaattggattttgaagaaaatgaatattttgggagtgatataaatgaaaatattaaatttaagagtaatgtttcatccatggtcttgcatgtgatattcttaccattgacgctagtaaagtaaaatttgctatttcacgtgtttgtgattgtcctttgttatattcttttctgtcaaaaacaagctttctgttgctcctttgctttctcttcttccctctgaattaactccaaatcagtgagtaattgatgtctggagaaggaggtgtattactgttgcccaaaatggagagcatcctttctgggatctgttcaaagccctgcgaatacatgaaatcctggaaaccagttgaacatgaatggtcagaggttttgaatttgagtggttcggtttcttaattgttttattttaagcagttgttttttttgtattaaaatactgcaactc

SEQ ID NO: 571350 - DNA, 700 bp, Homo sapiens
  misc_feature (98)..(98): n is a, c, g, or t
  misc_feature (124)..(125): n is a, c, g, or t
  misc_feature (269)..(269): n is a, c, g, or t
  misc_feature (330)..(331): n is a, c, g, or t
  misc_feature (340)..(340): n is a, c, g, or t
  misc_feature (342)..(342): n is a, c, g, or t
  misc_feature (356)..(357): n is a, c, g, or t
  misc_feature (363)..(363): n is a, c, g, or t
  misc_feature (385)..(385): n is a, c, g, or t
  misc_feature (393)..(393): n is a, c, g, or t
  misc_feature (395)..(396): n is a, c, g, or t
  misc_feature (423)..(423): n is a, c, g, or t
tgggctcacgtttttactcgcttactttagcagaagtagttctggtcgtcgcctaccgtctcgctatagccgtttgagggaagaaggaggaaaattanccggtatcgttagagctacaccaaanntgcattgagccaaacttgccaccaagagcccaacaatcaccatgatgctgagcacggaaggcagggaggggttcgtggtgaaggtcaggggcctaccctggtcctgctcagccgatgaagtgatgcgcttcttctctgattgcnagatccaaaatggcacatcaggtattcgtttcatctacaccagagaaggcagaccaagtgnngaagcattngntgaacttgaatctnnagaggnagtgaaattggctttgaagaangacagagnanncatgggacacagatacgttgaagtatncaagtctaacagtggtttgtaatgagttgttgaagcatccaagttcgaattagccttgttcttgccaacgatggatttcgtccgggttcagatggactcccattttgactgtagcaaggttagagattggtcaagatcttttcatggttcggtaattgtgccaaattgggatgaccattgccagtggacttttaagggtctaaatctcacgggcctttggggaagttggctttacaggctttgtgtactttaagtagtcgagctgtatttcgcccct

SEQ ID NO: 571351 - DNA, 851 bp, Homo sapiens
  misc_feature (676)..(676): n is a, c, g, or t
cgcccgggcaggtcctttgtcaagtcatcccctcttctcctcaggaactgctcaaacctgtgccccaaagatgagggcccaggaggacctcgagggccggacacagcatgaaaccaccagggacccctcgaccccgctacccacagagcctaagtttgacatgttgtacaagatcgaggacgtgccaccttggtacctgtgcatcctgctgggcttccagcactacctgacatgcttcagtggtaccatcgccgtgcccttcctgctggctgaggcgctgtgtgtgggccacgaccagcacatggttagtcagctcatcggcaccatcttcacgtgcgtgggcatgttctgcactctctttggcatgattacagctgtggggctgtccaacctgcaatttgtggacatgaactcctctcgcaacctcttcgtgctgggattttccatgttcttcgggctcacgctgcccaattacctggagtccaaccctggcgccatcaatacaggcattcttgaagtggatcagattctgattgtgctgctgaccacggagatgtttgtgggcgggtgccttgctttcatacttgacaacacagtgccagggagcccagaggagcgtggtctgatacagtggaaagctggggctcatgccaacagtgacatgtcttccagcctnaagagctacgatttccccatttgggatgggcatagtaaaaagaattacctttctgaaatacattcctatctgcccagtcttcaaaggattttcttcaagttcaaaagatcagattgcaattccagaagacactccagaaaatacagaaactgcatctgtgtgcaccaaggtctga

SEQ ID NO: 571352 - DNA, 4344 bp, Homo sapiens
tgagctggtccaacctcggacagtgggagtggataggctccacagctgcctctcccagtggacaaaaacatccaggtaatgggtaaaaaaaccaagtcagcagaagaaattagaggagagaccagttaataaatgtagtgatcaaataaagctaaaaaataccactgacaaaaagaataatgaaaatcgagagtctgaaaagaaaggacagagaacaagtacatttcaaataaatggaaaagataataaacccaaaatatatttgaaaggtgaatgcttgaaagaaatttctgagagtagagtagtaagtggtaatgttgaaccaaaggttaataatataaataaaataatccctgagaatgatattaaatcattgactgttaaagaatctgctataaggccattcattaatggtgatgtcatcatggaagattttaatgaaagaaacagctccgaaacaaaatcgcatttgctgagttcttcagatgctgaaggtaactaccgagatagccttgagaccctgccatcaaccaaagagtctgacagtacacagacgaccacaccctcagcatcttgtccagaaagcaattcagttaatcaggtagaagatatggaaatagaaacctcagaagttaagaaagttacttcatcacctattacttctgaagaggaatctaatctcagtaatgactttattgatgaaaatggtctgcccatcaacaaaaatgaaaatgtcaatggagaatctaaaagaaaaaccgtcatcacagaagtcaccacgatgacctccacagtggccacagaatcaaaaactgtgatcaaggtagaaaaaggcgataagcaaactgtggtttcttccacagaaaattgtgcaaaatccactgtcacaaccaccactacaacagtgaccaagctttccacaccctccacaggcggcagtgtggacatcatctctgtaaaggagcagagcaaaaccgtggtcaccacgacagtgacagactccctgaccattccacgggaggcacactggttacatctatgactgtgagcaaagagtattccacacgagacaaagtgaaactgatgaaattttcaagaccaaagaagactcgttcaggtacagctctgcccatcctatagaaaatttgttaccaagagcagcaagaagagcatttttgttttgcctaatgatgacttaaaaaagttggcccgaaaaggaggaatccgagaggtcccttattttaattacaatgcaaaacctgctttggatatatggccatatccttctcctagaccgacctttggcatcacttggaggtatagacttcagacagtaaagtccttagctggagtgagcctgatgttacggttactgtgggcaagtttgagatgggatgatatggcggccaaggctcctccaggaggagggactacacggacagaaacatccgaaactgaaatcacaacaacagaaataattaagaggagagatgttggtccttatggcattcgatctgaatattgtatcaggaaaatcatttgtcccattggagttccagaaacaccaaaagaaacgcctacacctcagaggaaaggccttcgatcaagtgcactgcggccaaagagaccagaaacgcccaagcaaactggccctgttattattgaaacctgggtagcagaagaagaactggaattgtgggagatcagggcatttgctgagagagtggagaaagaaaaggcacaagcagttgagcaacaggctaagaaacgactggagcagcagaagccgacagtgattgcaacttccactacttccccaacaagcagtacaaccagcaccatctctccagcacagaaggttatggtggcccccataagtggctcagttacaactggaaccaaaatggtactaactactaaagttggatctccagctacagtaacattccaacaaaacaagaactttcatcaaacctttgctacatgggttaagcaaggccagtcaaattcaggcgttgttcaagtacagcagaaagtcctgggtatcattccatcaagtacaggtaccagtcagcaaacctttacttcattccagcccaggacagcaacagtcacaattaggcccaatacctcaggctctggaggaaccacaagcaattcacaagtaatcacagggcctcagattcgccctggtatgaccgtgattagaacaccactccaacagtcaacactaggaaaggcaattattcgaacacctgtgatggtacagccaggtgctcctcagcaagtgatgactcaaatcatcagggggcagcctgtctccactgcagtctccgcccctaacacggtttcctcaacacctgggcagaaaagcttaacttcagcaacgtccacttcaaatatacagtcttcagcctcacaaccccctcgcccccaacaaggacaagtgaagctcaccatggctcaacttactcagttaacacagggccacggtggcaatcaaggtttgacagtagtaattcaaggacaaggtcaaactactggacagttgcagttgatacctcaaggggtgactgtactcccaggcccaggccagcagctaatgcaagctgcaatgccaaatggtactgttcagcgattcctctttaccccattggcaacaacagccaccacagccagcaccaccaccaccactgtttccacgacagcagcaggtacaggtgaacaaaggcagagtaaactgtcaccccagatgcaggtacatcaagacaaaaccctgccaccagctcagtcatcaagtgtgggtccagcagaagcccagccacagactgctcagccttcagctcagccccagccccaaacccagccccagtccccagctcagcctgaagttcagactcagcctgaagttcagacccaaacaactgtttcatcccatgtcccttctgaagcacaacccacccacgcacagtcatccaagccccaagttgcagcacagtctcagcctcaaagtaatgtccaaggacagtctcctgttcgtgtccaaagtccatcacagactcgaatacgtccatcaactccatcccaactgtctcctggacaacaatcccaggttcagactacaacctcacaaccgattccaattcaaccacatacatctcttcagataccttcccaaggccagccacagtcacaaccccaggtggtgatgaagcataatgctgtaatagaacatttaaaacagaaaaagagcatgactccagctgaaagagaagagaatcaaagaatgattgtctgtaaccaggtgatgaagtatattttggataagatagataaagaagaaaaacaggcagcaaaaaaacggaagcgtgaagagagtgtggagcagaaacgtagcaagcagaatgccactaagctgtcagctctgctcttcaagcacaaagagcagctcagagccgagatcctgaagaagagagcactcctggacaaggatctgcaaattgaagtgcaggaagagctgaagagagacctgaaaattaagaaagaaaaagacctgatgcagttggctcaggccacagcagtagctgcaccctgccccccagtgacaccagctcctccagcccctccagcccctccaccttcacctccccctccacctgctgtgcaacacacaggccttctgtccacgcccaccttacctgctgcttcccagaagaggaagcgggaagaggaaaaagactccagctcaaagtccaagaaaaagaaaatgatctctactacctcaaaggaaactaagaaggacacaaagctttactgtatctgtaaaacgccttatgatgaatctaagtgagtagatctttttgagctctagttttttgtcttgaaagtttagctattaaattggattttgaagaaaatgaatattttgggagtgatataaatgaaaatattaaatttaagagtaatgtttcatccatggtcttgcatgtgatattcttaccattgacgctagtaaagtaaaatttgctatttcacgtgtttgtgattgtcctttgttatattcttttctgtcaaaaacaagctttctgttgctcctttgctttctcttcttccctctgaattaactccaaatcagtgagtaattgatgtctggagaaggaggtgtattactgttgcccaaaatggagagcatcctttctgggatctgttcaaagccctgcgaatacatgaaatcctggaaaccagttgaacatgaatggtcagaggttttgaatttgagtggttcggtttcttaattgttttattttaagcagttgttttttttgtattaaaatactgcaactc

SEQ ID NO: 571353 - DNA, 632 bp, Homo sapiens
  misc_feature (457)..(457): n is a, c, g, or t
ggcctttacatgtgcttatttaattttccagctccatttatctacatttatcatttctccattatcatttcaactttacagatgaggaagatgaggctcagtgatttgtcccaggtgaacaactagcaactggcagaattgggacttgagcccagagatagggacagagataggtttgagacagggctttgtactgttcctttgccatagctgcacaagaggaagtccctcaactctgctctccagattgggccatgacacccattggcccttggcctattccacaggcattcttgaagtggatcagattctgattgtgctgctgaccacggagatgtttgtgggcgggtgccttgctttcatacttgacaacacagtgccagggagcccagaggagcgtggtctgatacagtggaaagctggggctcatgccaacagtgacatgtcttccagcctnaagagctacgatttccccatttgggatgggcatagtaaaaagaattacctttctgaaatacattcctatctgcccagtcttcaaaggattttcttcaagttcaaaagatcagattgcaattccagaagacactccagaaaatacagaaactgcatctgtgtgcaccaaggtctga

SEQ ID NO: 571354 - DNA, 4399 bp, Homo sapiens
aaaggaaatgattttttcatcgatgactctaaactagccagtgcagatgatattggtactttgatctgtaagaacaaaaaaccgctcatacaggaggaaagtgacaccattgtttcttcttccaagagtgctttacattcatcagtgcctaaaagtaccaatgacagagatgccacacctctgtcaagagcaatggactttgaaggaaaactgggatgtgactctgaatctaatagcactttggaaaatagttctgataccgtgtctattcaggatagcagtgaagaagatatgattgttcagaatagcaatgaaagcatttctgaacagttcagaactcgagaacaagatgttgaagtcttggagccgttaaagtgtgagttggtttctggtgagtccactggaaactgtgaggacaggctgccggtcaaggggactgaagcaaatggtaaaaaaccaagtcagcagaagaaattagaggagagaccagttaataaatgtagtgatcaaataaagctaaaaaataccactgacaaaaagaataatgaaaatcgagagtctgaaaagaaaggacagagaacaagtacatttcaaataaatggaaaagataataaacccaaaatatatttgaaaggtgaatgcttgaaagaaatttctgagagtagagtagtaagtggtaatgttgaaccaaaggttaataatataaataaaataatccctgagaatgatattaaatcattgactgttaaagaatctgctataaggccattcattaatggtgatgtcatcatggaagattttaatgaaagaaacagctccgaaacaaaatcgcatttgctgagttcttcagatgctgaaggtaactaccgagatagccttgagaccctgccatcaaccaaagagtctgacagtacacagacgaccacaccctcagcatcttgtccagaaagcaattcagttaatcaggtagaagatatggaaatagaaacctcagaagttaagaaagttacttcatcacctattacttctgaagaggaatctaatctcagtaatgactttattgatgaaaatggtctgcccatcaacaaaaatgaaaatgtcaatggagaatctaaaagaaaaaccgtcatcacagaagtcaccacgatgacctccacagtggccacagaatcaaaaactgtgatcaaggtagaaaaaggcgataagcaaactgtggtttcttccacagaaaattgtgcaaaatccactgtcacaaccaccactacaacagtgaccaagctttccacaccctccacaggcggcagtgtggacatcatctctgtaaaggagcagagcaaaaccgtggtcaccacgacagtgacagactccctgaccattccacgggaggcacactggttacatctatgactgtgagcaaagagtattccacacgagacaaagtgaaactgatgaaattttcaagaccaaagaagactcgttcaggtacagctctgcccatcctatagaaaatttgttaccaagagcagcaagaagagcatttttgttttgcctaatgatgacttaaaaaagttggcccgaaaaggaggaatccgagaggtcccttattttaattacaatgcaaaacctgctttggatatatggccatatccttctcctagaccgacctttggcatcacttggaggtatagacttcagacagtaaagtccttagctggagtgagcctgatgttacggttactgtgggcaagtttgagatgggatgatatggcggccaaggctcctccaggaggagggactacacggacagaaacatccgaaactgaaatcacaacaacagaaataattaagaggagagatgttggtccttatggcattcgatctgaatattgtatcaggaaaatcatttgtcccattggagttccagaaacaccaaaagaaacgcctacacctcagaggaaaggccttcgatcaagtgcactgcggccaaagagaccagaaacgcccaagcaaactggccctgttattattgaaacctgggtagcagaagaagaactggaattgtgggagatcagggcatttgctgagagagtggagaaagaaaaggcacaagcagttgagcaacaggctaagaaacgactggagcagcagaagccgacagtgattgcaacttccactacttccccaacaagcagtacaaccagcaccatctctccagcacagaaggttatggtggcccccataagtggctcagttacaactggaaccaaaatggtactaactactaaagttggatctccagctacagtaacattccaacaaaacaagaactttcatcaaacctttgctacatgggttaagcaaggccagtcaaattcaggcgttgttcaagtacagcagaaagtcctgggtatcattccatcaagtacaggtaccagtcagcaaacctttacttcattccagcccaggacagcaacagtcacaattaggcccaatacctcaggctctggaggaaccacaagcaattcacaagtaatcacagggcctcagattcgccctggtatgaccgtgattagaacaccactccaacagtcaacactaggaaaggcaattattcgaacacctgtgatggtacagccaggtgctcctcagcaagtgatgactcaaatcatcagggggcagcctgtctccactgcagtctccgcccctaacacggtttcctcaacacctgggcagaaaagcttaacttcagcaacgtccacttcaaatatacagtcttcagcctcacaaccccctcgcccccaacaaggacaagtgaagctcaccatggctcaacttactcagttaacacagggccacggtggcaatcaaggtttgacagtagtaattcaaggacaaggtcaaactactggacagttgcagttgatacctcaaggggtgactgtactcccaggcccaggccagcagctaatgcaagctgcaatgccaaatggtactgttcagcgattcctctttaccccattggcaacaacagccaccacagccagcaccaccaccaccactgtttccacgacagcagcaggtacaggtgaacaaaggcagagtaaactgtcaccccagatgcaggtacatcaagacaaaaccctgccaccagctcagtcatcaagtgtgggtccagcagaagcccagccacagactgctcagccttcagctcagccccagccccaaacccagccccagtccccagctcagcctgaagttcagactcagcctgaagttcagacccaaacaactgtttcatcccatgtcccttctgaagcacaacccacccacgcacagtcatccaagccccaagttgcagcacagtctcagcctcaaagtaatgtccaaggacagtctcctgttcgtgtccaaagtccatcacagactcgaatacgtccatcaactccatcccaactgtctcctggacaacaatcccaggttcagactacaacctcacaaccgattccaattcaaccacatacatctcttcagataccttcccaaggccagccacagtcacaaccccaggtggtgatgaagcataatgctgtaatagaacatttaaaacagaaaaagagcatgactccagctgaaagagaagagaatcaaagaatgattgtctgtaaccaggtgatgaagtatattttggataagatagataaagaagaaaaacaggcagcaaaaaaacggaagcgtgaagagagtgtggagcagaaacgtagcaagcagaatgccactaagctgtcagctctgctcttcaagcacaaagagcagctcagagccgagatcctgaagaagagagcactcctggacaaggatctgcaaattgaagtgcaggaagagctgaagagagacctgaaaattaagaaagaaaaagacctgatgcagttggctcaggccacagcagtagctgcaccctgccccccagtgacaccagctcctccagcccctccagcccctccaccttcacctccccctccacctgctgtgcaacacacaggccttctgtccacgcccaccttacctgctgcttcccagaagaggaagcgggaagaggaaaaagactccagctcaaagtccaagaaaaagaaaatgatctctactacctcaaaggaaactaagaaggacacaaagctttactgtatctgtaaaacgccttatgatgaatctaagtgagtagatctttttgagctctagttttttgtcttgaaagtttagctattaaattggattttgaagaaaatgaatattttgggagtgatataaatgaaaatattaaatttaagagtaatgtttcatccatggtcttgcatgtgatattcttaccattgacgctagtaaagtaaaatttgctatttca

SEQ ID NO: 571355 - DNA, 1457 bp, Homo sapiens
  misc_feature (1282)..(1282): n is a, c, g, or t
ctgaggatgagctggaaggagtgagagggggtttgtggaggtggtccaggagctttgttcctgctagcagcagccaggtcatgacctttacatggtgacttacggctgatgtttgcccttccaggtccagggtgcaatcatggtgtccagcgtggtggaggtggtgattggcctgctggggctgcctggggccctgctcaactacattgggcctctcacagtcacccccactgtctccctcattggcctttctgtcttccaagctgctggcgaccgagctggctcccactggggcatctcagcttgctccattctcctgatcatcctcttctcccagtacctgcgcaacctcaccttcctgctgcctgtctaccgctggggcaagggcctcactctcctccgcatccagatcttcaaaatgtttcctatcatgctggccatcatgaccgtgtggctgctctgctatgtcctgaccttgacagacgtgctgcccacagacccaaaagcctatggcttccaggcacgaaccgatgcccgtggtgacatcatggctattgcaccctggatccgcatcccctacccctgtcagtggggcctgcccacggtgactgcggctgctgtcctgggaatgttcagcgccactctggcaggcatcattgagtccatcggagattactacgcctgtgcccgcctggctggtgcaccaccccctccagtacatgctatcaacaggggcatcttcaccgaaggcatttgctgcatcatcgcggggctattgggcacgggcaacgggtccacctcgtccagtcccaacattggcgtcctgggaattaccaaggtgggcagccggcgcgtggtgcagtatggtgcggctatcatgctggtcctgggcaccatcggcaagttcacggccctcttcgcctcgctccctgaccccatcctggggggcatgttctgcactctctttggcatgattacagctgtggggctgtccaacctgcaatttgtggacatgaactcctctcgcaacctcttcgtgctgggattttccatgttcttcgggctcacgctgcccaattacctggagtccaaccctggcgccatcaatacaggcattcttgaagtggatcagattctgattgtgctgctgaccacggagatgtttgtgggcgggtgccttgctttcatacttgacaacacagtgccagggagcccagaggagcgtggtctgatacagtggaaagctggggctcatgccaacagtgacatgtcttccagcctnaagagctacgatttccccatttgggatgggcatagtaaaaagaattacctttctgaaatacattcctatctgcccagtcttcaaaggattttcttcaagttcaaaagatcagattgcaattccagaagacactccagaaaatacagaaactgcatctgtgtgcaccaaggtctga

SEQ ID NO: 571356 - DNA, 3844 bp, Homo sapiens
ggatcccctgcctcgatgtgctgccatcaaccaaagagtctgacagtacacagacgaccacaccctcagcatcttgtccagaaagcaattcagttaatcaggtagaagatatggaaatagaaacctcagaagttaagaaagttacttcatcacctattacttctgaagaggaatctaatctcagtaatgactttattgatgaaaatggtctgcccatcaacaaaaatgaaaatgtcaatggagaatctaaaagaaaaaccgtcatcacagaagtcaccacgatgacctccacagtggccacagaatcaaaaactgtgatcaaggtagaaaaaggcgataagcaaactgtggtttcttccacagaaaattgtgcaaaatccactgtcacaaccaccactacaacagtgaccaagctttccacaccctccacaggcggcagtgtggacatcatctctgtaaaggagcagagcaaaaccgtggtcaccacgacagtgacagactccctgaccattccacgggaggcacactggttacatctatgactgtgagcaaagagtattccacacgagacaaagtgaaactgatgaaattttcaagaccaaagaagactcgttcaggtacagctctgcccatcctatagaaaatttgttaccaagagcagcaagaagagcatttttgttttgcctaatgatgacttaaaaaagttggcccgaaaaggaggaatccgagaggtcccttattttaattacaatgcaaaacctgctttggatatatggccatatccttctcctagaccgacctttggcatcacttggaggtatagacttcagacagtaaagtccttagctggagtgagcctgatgttacggttactgtgggcaagtttgagatgggatgatatggcggccaaggctcctccaggaggagggactacacggacagaaacatccgaaactgaaatcacaacaacagaaataattaagaggagagatgttggtccttatggcattcgatctgaatattgtatcaggaaaatcatttgtcccattggagttccagaaacaccaaaagaaacgcctacacctcagaggaaaggccttcgatcaagtgcactgcggccaaagagaccagaaacgcccaagcaaactggccctgttattattgaaacctgggtagcagaagaagaactggaattgtgggagatcagggcatttgctgagagagtggagaaagaaaaggcacaagcagttgagcaacaggctaagaaacgactggagcagcagaagccgacagtgattgcaacttccactacttccccaacaagcagtacaaccagcaccatctctccagcacagaaggttatggtggcccccataagtggctcagttacaactggaaccaaaatggtactaactactaaagttggatctccagctacagtaacattccaacaaaacaagaactttcatcaaacctttgctacatgggttaagcaaggccagtcaaattcaggcgttgttcaagtacagcagaaagtcctgggtatcattccatcaagtacaggtaccagtcagcaaacctttacttcattccagcccaggacagcaacagtcacaattaggcccaatacctcaggctctggaggaaccacaagcaattcacaagtaatcacagggcctcagattcgccctggtatgaccgtgattagaacaccactccaacagtcaacactaggaaaggcaattattcgaacacctgtgatggtacagccaggtgctcctcagcaagtgatgactcaaatcatcagggggcagcctgtctccactgcagtctccgcccctaacacggtttcctcaacacctgggcagaaaagcttaacttcagcaacgtccacttcaaatatacagtcttcagcctcacaaccccctcgcccccaacaaggacaagtgaagctcaccatggctcaacttactcagttaacacagggccacggtggcaatcaaggtttgacagtagtaattcaaggacaaggtcaaactactggacagttgcagttgatacctcaaggggtgactgtactcccaggcccaggccagcagctaatgcaagctgcaatgccaaatggtactgttcagcgattcctctttaccccattggcaacaacagccaccacagccagcaccaccaccaccactgtttccacgacagcagcaggtacaggtgaacaaaggcagagtaaactgtcaccccagatgcaggtacatcaagacaaaaccctgccaccagctcagtcatcaagtgtgggtccagcagaagcccagccacagactgctcagccttcagctcagccccagccccaaacccagccccagtccccagctcagcctgaagttcagactcagcctgaagttcagacccaaacaactgtttcatcccatgtcccttctgaagcacaacccacccacgcacagtcatccaagccccaagttgcagcacagtctcagcctcaaagtaatgtccaaggacagtctcctgttcgtgtccaaagtccatcacagactcgaatacgtccatcaactccatcccaactgtctcctggacaacaatcccaggttcagactacaacctcacaaccgattccaattcaaccacatacatctcttcagataccttcccaaggccagccacagtcacaaccccaggtggtgatgaagcataatgctgtaatagaacatttaaaacagaaaaagagcatgactccagctgaaagagaagagaatcaaagaatgattgtctgtaaccaggtgatgaagtatattttggataagatagataaagaagaaaaacaggcagcaaaaaaacggaagcgtgaagagagtgtggagcagaaacgtagcaagcagaatgccactaagctgtcagctctgctcttcaagcacaaagagcagctcagagccgagatcctgaagaagagagcactcctggacaaggatctgcaaattgaagtgcaggaagagctgaagagagacctgaaaattaagaaagaaaaagacctgatgcagttggctcaggccacagcagtagctgcaccctgccccccagtgacaccagctcctccagcccctccagcccctccaccttcacctccccctccacctgctgtgcaacacacaggccttctgtccacgcccaccttacctgctgcttcccagaagaggaagcgggaagaggaaaaagactccagctcaaagtccaagaaaaagaaaatgatctctactacctcaaaggaaactaagaaggacacaaagctttactgtatctgtaaaacgccttatgatgaatctaagtgagtagatctttttgagctctagttttttgtcttgaaagtttagctattaaattggattttgaagaaaatgaatattttgggagtgatataaatgaaaatattaaatttaagagtaatgtttcatccatggtcttgcatgtgatattcttaccattgacgctagtaaagtaaaatttgctatttcacgtgtttgtgattgtcctttgttatattcttttctgtcaaaaacaagctttctgttgctcctttgctttctcttcttccctctgaattaactccaaatcagtgagtaattgatgtctggagaaggaggtgtattactgttgcccaaaatggagagcatcctttctgggatctgttcaaagccctgcgaatacatgaaatcctggaaaccagttgaacatgaatggtcagaggttttgaatttgagtggttcggtttcttaattgttttattttaagcagttgttttttttgtattaaaatactgcaactc

SEQ ID NO: 571357 - DNA, 238 bp, Homo sapiens
cacgagtgctggcagacgcaacggagagataggaacgcttgaggactcccaccagccccgttgaacattcctttgtctccacaaccttgctgacatctattatcttttaactttttattaatggccattctgactggtgtgcgacagtatcttgtggtttgatttacattaatagtgcatgatgagcattttttccatatatttgttggctgccacgttcgttttctgcgcaagctgt

SEQ ID NO: 571358 - DNA, 4828 bp, Homo sapiens
aaaggaaatgattttttcatcgatgactctaaactagccagtgcagatgatattggtactttgatctgtaagaacaaaaaaccgctcatacaggaggaaagtgacaccattgtttcttcttccaagagtgctttacattcatcagtgcctaaaagtaccaatgacagagatgccacacctctgtcaagagcaatggactttgaaggaaaactgggatgtgactctgaatctaatagcactttggaaaatagttctgataccgtgtctattcaggatagcagtgaagaagatatgattgttcagaatagcaatgaaagcatttctgaacagttcagaactcgagaacaagatgttgaagtcttggagccgttaaagtgtgagttggtttctggtgagtccactggaaactgtgaggacaggctgccggtcaaggggactgaagcaaatggtaaaaaaccaagtcagcagaagaaattagaggagagaccagttaataaatgtagtgatcaaataaagctaaaaaataccactgacaaaaagaataatgaaaatcgagagtctgaaaagaaaggacagagaacaagtacatttcaaataaatggaaaagataataaacccaaaatatatttgaaaggtgaatgcttgaaagaaatttctgagagtagagtagtaagtggtaatgttgaaccaaaggttaataatataaataaaataatccctgagaatgatattaaatcattgactgttaaagaatctgctataaggccattcattaatggtgatgtcatcatggaagattttaatgaaagaaacagctccgaaacaaaatcgcatttgctgagttcttcagatgctgaaggtaactaccgagatagccttgagaccctgccatcaaccaaagagtctgacagtacacagacgaccacaccctcagcatcttgtccagaaagcaattcagttaatcaggtagaagatatggaaatagaaacctcagaagttaagaaagttacttcatcacctattacttctgaagaggaatctaatctcagtaatgactttattgatgaaaatggtctgcccatcaacaaaaatgaaaatgtcaatggagaatctaaaagaaaaaccgtcatcacagaagtcaccacgatgacctccacagtggccacagaatcaaaaactgtgatcaaggtagaaaaaggcgataagcaaactgtggtttcttccacagaaaattgtgcaaaatccactgtcacaaccaccactacaacagtgaccaagctttccacaccctccacaggcggcagtgtggacatcatctctgtaaaggagcagagcaaaaccgtggtcaccacgacagtgacagactccctgaccattccacgggaggcacactggttacatctatgactgtgagcaaagagtattccacacgagacaaagtgaaactgatgaaattttcaagaccaaagaagactcgttcaggtacagctctgcccatcctatagaaaatttgttaccaagagcagcaagaagagcatttttgttttgcctaatgatgacttaaaaaagttggcccgaaaaggaggaatccgagaggtcccttattttaattacaatgcaaaacctgctttggatatatggccatatccttctcctagaccgacctttggcatcacttggaggtatagacttcagacagtaaagtccttagctggagtgagcctgatgttacggttactgtgggcaagtttgagatgggatgatatggcggccaaggctcctccaggaggagggactacacggacagaaacatccgaaactgaaatcacaacaacagaaataattaagaggagagatgttggtccttatggcattcgatctgaatattgtatcaggaaaatcatttgtcccattggagttccagaaacaccaaaagaaacgcctacacctcagaggaaaggccttcgatcaagtgcactgcggccaaagagaccagaaacgcccaagcaaactggccctgttattattgaaacctgggtagcagaagaagaactggaattgtgggagatcagggcatttgctgagagagtggagaaagaaaaggcacaagcagttgagcaacaggctaagaaacgactggagcagcagaagccgacagtgattgcaacttccactacttccccaacaagcagtacaaccagcaccatctctccagcacagaaggttatggtggcccccataagtggctcagttacaactggaaccaaaatggtactaactactaaagttggatctccagctacagtaacattccaacaaaacaagaactttcatcaaacctttgctacatgggttaagcaaggccagtcaaattcaggcgttgttcaagtacagcagaaagtcctgggtatcattccatcaagtacaggtaccagtcagcaaacctttacttcattccagcccaggacagcaacagtcacaattaggcccaatacctcaggctctggaggaaccacaagcaattcacaagtaatcacagggcctcagattcgccctggtatgaccgtgattagaacaccactccaacagtcaacactaggaaaggcaattattcgaacacctgtgatggtacagccaggtgctcctcagcaagtgatgactcaaatcatcagggggcagcctgtctccactgcagtctccgcccctaacacggtttcctcaacacctgggcagaaaagcttaacttcagcaacgtccacttcaaatatacagtcttcagcctcacaaccccctcgcccccaacaaggacaagtgaagctcaccatggctcaacttactcagttaacacagggccacggtggcaatcaaggtttgacagtagtaattcaaggacaaggtcaaactactggacagttgcagttgatacctcaaggggtgactgtactcccaggcccaggccagcagctaatgcaagctgcaatgccaaatggtactgttcagcgattcctctttaccccattggcaacaacagccaccacagccagcaccaccaccaccactgtttccacgacagcagcaggtacaggtgaacaaaggcagagtaaactgtcaccccagatgcaggtacatcaagacaaaaccctgccaccagctcagtcatcaagtgtgggtccagcagaagcccagccacagactgctcagccttcagctcagccccagccccaaacccagccccagtccccagctcagcctgaagttcagactcagcctgaagttcagacccaaacaactgtttcatcccatgtcccttctgaagcacaacccacccacgcacagtcatccaagccccaagttgcagcacagtctcagcctcaaagtaatgtccaaggacagtctcctgttcgtgtccaaagtccatcacagactcgaatacgtccatcaactccatcccaactgtctcctggacaacaatcccaggttcagactacaacctcacaaccgattccaattcaaccacatacatctcttcagataccttcccaaggccagccacagtcacaaccccaggtacagtcttcaactcaaactctttcatcaggacaaactttaaatcaagttactgtttcatccccatcccgtcctcagctacaaatacagcagccacagccccaagtcattgctgtgcctcagctgcaacaacaagtccaggttctctctcagatccagtcacaggttgtggctcagatacaggctcagcaaagtggtgtgccccagcaaatcaaactccagttacctatccaaattcagcaaagcagtgctgtgcagactcaccagattcagaatgtggttacagtgcaggcagccagtgtgcaagagcagttgcaaagggttcagcaactcagggatcagcagcaaaagaagaaacagcaacagatagaaattaagcgtgaacacaccctccaagcttctaatcaaagtgaaatcattcagaaacaggtggtgatgaagcataatgctgtaatagaacatttaaaacagaaaaagagcatgactccagctgaaagagaagagaatcaaagaatgattgtctgtaaccaggtgatgaagtatattttggataagatagataaagaagaaaaacaggcagcaaaaaaacggaagcgtgaagagagtgtggagcagaaacgtagcaagcagaatgccactaagctgtcagctctgctcttcaagcacaaagagcagctcagagccgagatcctgaagaagagagcactcctggacaaggatctgcaaattgaagtgcaggaagagctgaagagagacctgaaaattaagaaagaaaaagacctgatgcagttggctcaggccacagcagtagctgcaccctgccccccagtgacaccagctcctccagcccctccagcccctccaccttcacctccccctccacctgctgtgcaacacacaggccttctgtccacgcccaccttacctgctgcttcccagaagaggaagcgggaagaggaaaaagactccagctcaaagtccaagaaaaagaaaatgatctctactacctcaaaggaaactaagaaggacacaaagctttactgtatctgtaaaacgccttatgatgaatctaagtgagtagatctttttgagctctagttttttgtcttgaaagtttagctattaaattggattttgaagaaaatgaatattttgggagtgatataaatgaaaatattaaatttaagagtaatgtttcatccatggtcttgcatgtgatattcttaccattgacgctagtaaagtaaaatttgctatttca

SEQ ID NO: 571359 - DNA, 4505 bp, Homo sapiens
  misc_feature (4492)..(4492): n is a, c, g, or t
aaaggaaatgattttttcatcgatgactctaaactagccagtgcagatgatattggtactttgatctgtaagaacaaaaaaccgctcatacaggaggaaagtgacaccattgtttcttcttccaagagtgctttacattcatcagtgcctaaaagtaccaatgacagagatgccacacctctgtcaagagcaatggactttgaaggaaaactgggatgtgactctgaatctaatagcactttggaaaatagttctgataccgtgtctattcaggatagcagtgaagaagatatgattgttcagaatagcaatgaaagcatttctgaacagttcagaactcgagaacaagatgttgaagtcttggagccgttaaagtgtgagttggtttctggtgagtccactggaaactgtgaggacaggctgccggtcaaggggactgaagcaaatggtaaaaaaccaagtcagcagaagaaattagaggagagaccagttaataaatgtagtgatcaaataaagctaaaaaataccactgacaaaaagaataatgaaaatcgagagtctgaaaagaaaggacagagaacaagtacatttcaaataaatggaaaagataataaacccaaaatatatttgaaaggtgaatgcttgaaagaaatttctgagagtagagtagtaagtggtaatgttgaaccaaaggttaataatataaataaaataatccctgagaatgatattaaatcattgactgttaaagaatctgctataaggccattcattaatggtgatgtcatcatggaagattttaatgaaagaaacagctccgaaacaaaatcgcatttgctgagttcttcagatgctgaaggtaactaccgagatagccttgagaccctgccatcaaccaaagagtctgacagtacacagacgaccacaccctcagcatcttgtccagaaagcaattcagttaatcaggtagaagatatggaaatagaaacctcagaagttaagaaagttacttcatcacctattacttctgaagaggaatctaatctcagtaatgactttattgatgaaaatggtctgcccatcaacaaaaatgaaaatgtcaatggagaatctaaaagaaaaaccgtcatcacagaagtcaccacgatgacctccacagtggccacagaatcaaaaactgtgatcaaggtagaaaaaggcgataagcaaactgtggtttcttccacagaaaattgtgcaaaatccactgtcacaaccaccactacaacagtgaccaagctttccacaccctccacaggcggcagtgtggacatcatctctgtaaaggagcagagcaaaaccgtggtcaccacgacagtgacagactccctgaccattccacgggaggcacactggttacatctatgactgtgagcaaagagtattccacacgagacaaagtgaaactgatgaaattttcaagaccaaagaagactcgttcaggtacagctctgcccatcctatagaaaatttgttaccaagagcagcaagaagagcatttttgttttgcctaatgatgacttaaaaaagttggcccgaaaaggaggaatccgagaggtcccttattttaattacaatgcaaaacctgctttggatatatggccatatccttctcctagaccgacctttggcatcacttggaggtatagacttcagacagtaaagtccttagctggagtgagcctgatgttacggttactgtgggcaagtttgagatgggatgatatggcggccaaggctcctccaggaggagggactacacggacagaaacatccgaaactgaaatcacaacaacagaaataattaagaggagagatgttggtccttatggcattcgatctgaatattgtatcaggaaaatcatttgtcccattggagttccagaaacaccaaaagaaacgcctacacctcagaggaaaggccttcgatcaagtgcactgcggccaaagagaccagaaacgcccaagcaaactggccctgttattattgaaacctgggtagcagaagaagaactggaattgtgggagatcagggcatttgctgagagagtggagaaagaaaaggcacaagcagttgagcaacaggctaagaaacgactggagcagcagaagccgacagtgattgcaacttccactacttccccaacaagcagtacaaccagcaccatctctccagcacagaaggttatggtggcccccataagtggctcagttacaactggaaccaaaatggtactaactactaaagttggatctccagctacagtaacattccaacaaaacaagaactttcatcaaacctttgctacatgggttaagcaaggccagtcaaattcaggcgttgttcaagtacagcagaaagtcctgggtatcattccatcaagtacaggtaccagtcagcaaacctttacttcattccagcccaggacagcaacagtcacaattaggcccaatacctcaggctctggaggaaccacaagcaattcacaagtaatcacagggcctcagattcgccctggtatgaccgtgattagaacaccactccaacagtcaacactaggaaaggcaattattcgaacacctgtgatggtacagccaggtgctcctcagcaagtgatgactcaaatcatcagggggcagcctgtctccactgcagtctccgcccctaacacggtttcctcaacacctgggcagaaaagcttaacttcagcaacgtccacttcaaatatacagtcttcagcctcacaaccccctcgcccccaacaaggacaagtgaagctcaccatggctcaacttactcagttaacacagggccacggtggcaatcaaggtttgacagtagtaattcaaggacaaggtcaaactactggacagttgcagttgatacctcaaggggtgactgtactcccaggcccaggccagcagctaatgcaagctgcaatgccaaatggtactgttcagcgattcctctttaccccattggcaacaacagccaccacagccagcaccaccaccaccactgtttccacgacagcagcaggtacaggtgaacaaaggcagagtaaactgtcaccccagatgcaggtacatcaagacaaaaccctgccaccagctcagtcatcaagtgtgggtccagcagaagcccagccacagactgctcagccttcagctcagccccagccccaaacccagccccagtccccagctcagcctgaagttcagactcagcctgaagttcagacccaaacaactgtttcatcccatgtcccttctgaagcacaacccacccacgcacagtcatccaagccccaagttgcagcacagtctcagcctcaaagtaatgtccaaggacagtctcctgttcgtgtccaaagtccatcacagactcgaatacgtccatcaactccatcccaactgtctcctggacaacaatcccaggttcagactacaacctcacaaccgattccaattcaaccacatacatctcttcagataccttcccaaggccagccacagtcacaaccccaggtacagtcttcaactcaaactctttcatcaggacaaactttaaatcaagttactgtttcatccccatcccgtcctcagctacaaatacagcagccacagccccaagtcattgctgtgcctcagctgcaacaacaagtccaggttctctctcagatccagtcacaggttgtggctcagatacaggctcagcaaagtggtgtgccccagcaaatcaaactccagttacctatccaaattcagcaaagcagtgctgtgcagactcaccagattcagaatgtggttacagtgcaggcagccagtgtgcaagagcagttgcaaagggttcagcaactcagggatcagcagcaaaagaagaaacagcaacagatagaaattaagcgtgaacacaccctccaagcttctaatcaaagtgaaatcattcagaaacaggtggtgatgaagcataatgctgtaatagaacatttaaaacagaaaaagagcatgactccagctgaaagagaagagaatcaaagaatgattgtctgtaaccaggtgatgaagtatattttggataagatagataaagaagaaaaacaggcagcaaaaaaacggaagcgtgaagagagtgtggagcagaaacgtagcaagcagaatgccactaagctgtcagctctgctcttcaagcacaaagagcagctcagagccgagatcctgaagaagagagcactcctggacaaggatctgcaaattgaagtgcaggtaagagggcacatccttttcttctgtgtccagtgtttaacatctgaggttctgcttttttcccttgcctttttaataaagcttaaaatttcagtatgttttctaggaacttacatttgtgtacatagggttaaaaaggcagtgcagccttgtgtgttctttgcaaaaacaagttcagggctttttntaaacttaaatgt

SEQ ID NO: 571360 - DNA, 413 bp, Homo sapiens
ggacactgccagatccctccgagcaaagctggaatcagtccattgttcaactgtgccctttggggctgcggttcattaggctctgagtattcctatatgttctgtactccaacccccatagctccatcttgtctacaagattttgttagaagctgtcaaaatcctgctgactcgagatgcactgtgctgcatgttttccccgggcacagcaggctaataatcctgttacaaagagaaatgctagtacatttcgagcaccaccaatacaaatatatccggccggatataatttgtaattggtggttctggcccctgggactccaccgtggccttttctaagtacttacagactctctgtttaataatccattccagaaattttccagggctcatttttgagctaggtgttcgca

SEQ ID NO: 571361 - DNA, 1980 bp, Homo sapiens
  misc_feature (86)..(86): n is a, c, g, or t
  misc_feature (97)..(97): n is a, c, g, or t
tgtattcagtcatggaggtgatctcagggagggtgggtaaatccagttcatgacctgagattgagagtgggtccagaaccactttnttgaccttctnctgcaagtcattgtaactaactaccaccacgcctggccagaattctcaacttcagaagatttccttcagattcttctttaaccacagttttatgttccagagtaatagaaatggttcatctttcctttttacaggtacaggtgaacaaaggcagagtaaactgtcaccccagatgcaggtacatcaagacaaaaccctgccaccagctcagtcatcaagtgtgggtccagcagaagcccagccacagactgctcagccttcagctcagccccagccccaaacccagccccagtccccagctcagcctgaagttcagactcagcctgaagttcagacccaaacaactgtttcatcccatgtcccttctgaagcacaacccacccacgcacagtcatccaagccccaagttgcagcacagtctcagcctcaaagtaatgtccaaggacagtctcctgttcgtgtccaaagtccatcacagactcgaatacgtccatcaactccatcccaactgtctcctggacaacaatcccaggttcagactacaacctcacaaccgattccaattcaaccacatacatctcttcagataccttcccaaggccagccacagtcacaaccccaggtacagtcttcaactcaaactctttcatcaggacaaactttaaatcaagttactgtttcatccccatcccgtcctcagctacaaatacagcagccacagccccaagtcattgctgtgcctcagctgcaacaacaagtccaggttctctctcagatccagtcacaggttgtggctcagatacaggctcagcaaagtggtgtgccccagcaaatcaaactccagttacctatccaaattcagcaaagcagtgctgtgcagactcaccagattcagaatgtggttacagtgcaggcagccagtgtgcaagagcagttgcaaagggttcagcaactcagggatcagcagcaaaagaagaaacagcaacagatagaaattaagcgtgaacacaccctccaagcttctaatcaaagtgaaatcattcagaaacaggtggtgatgaagcataatgctgtaatagaacatttaaaacagaaaaagagcatgactccagctgaaagagaagagaatcaaagaatgattgtctgtaaccaggtgatgaagtatattttggataagatagataaagaagaaaaacaggcagcaaaaaaacggaagcgtgaagagagtgtggagcagaaacgtagcaagcagaatgccactaagctgtcagctctgctcttcaagcacaaagagcagctcagagccgagatcctgaagaagagagcactcctggacaaggatctgcaaattgaagtgcaggaagagctgaagagagacctgaaaattaagaaagaaaaagacctgatgcagttggctcaggccacagcagtagctgcaccctgccccccagtgacaccagctcctccagcccctccagcccctccaccttcacctccccctccacctgctgtgcaacacacaggccttctgtccacgcccaccttacctgctgcttcccagaagaggaagcgggaagaggaaaaagactccagctcaaagtccaagaaaaagaaaatgatctctactacctcaaaggaaactaagaaggacacaaagctttactgtatctgtaaaacgccttatgatgaatctaagtgagtagatctttttgagctctagttttttgtcttgaaagtttagctattaaattggattttgaagaaaatgaatattttgggagtgatataaatgaaaatattaaatttaagagtaatgtttcatccatggtcttgcatgtgatattcttaccattgacgctagtaaagtaaaatttgctatttca

SEQ ID NO: 571362 - DNA, 3311 bp, Homo sapiens
aaaggaaatgattttttcatcgatgactctaaactagccagtgcagatgatattggtactttgatctgtaagaacaaaaaaccgctcatacaggaggaaagtgacaccattgtttcttcttccaagagtgctttacattcatcagtgcctaaaagtaccaatgacagagatgccacacctctgtcaagagcaatggactttgaaggaaaactgggatgtgactctgaatctaatagcactttggaaaatagttctgataccgtgtctattcaggatagcagtgaagaagatatgattgttcagaatagcaatgaaagcatttctgaacagttcagaactcgagaacaagatgttgaagtcttggagccgttaaagtgtgagttggtttctggtgagtccactggaaactgtgaggacaggctgccggtcaaggggactgaagcaaatggtaaaaaaccaagtcagcagaagaaattagaggagagaccagttaataaatgtagtgatcaaataaagctaaaaaataccactgacaaaaagaataatgaaaatcgagagtctgaaaagaaaggacagagaacaagtacatttcaaataaatggaaaagataataaacccaaaatatatttgaaaggtgaatgcttgaaagaaatttctgagagtagagtagtaagtggtaatgttgaaccaaaggttaataatataaataaaataatccctgagaatgatattaaatcattgactgttaaagaatctgctataaggccattcattaatggtgatgtcatcatggaagattttaatgaaagaaacagctccgaaacaaaatcgcatttgctgagttcttcagatgctgaaggtaactaccgagatagccttgagaccctgccatcaaccaaagagtctgacagtacacagacgaccacaccctcagcatcttgtccagaaagcaattcagttaatcaggtagaagatatggaaatagaaacctcagaagttaagaaagttacttcatcacctattacttctgaagaggaatctaatctcagtaatgactttattgatgaaaatggtctgcccatcaacaaaaatgaaaatgtcaatggagaatctaaaagaaaaaccgtcatcacagaagtcaccacgatgacctccacagtggccacagaatcaaaaactgtgatcaaggtagaaaaaggcgataagcaaactgtggtttcttccacagaaaattgtgcaaaatccactgtcacaaccaccactacaacagtgaccaagctttccacaccctccacaggcggcagtgtggacatcatctctgtaaaggagcagagcaaaaccgtggtcaccacgacagtgacagactccctgaccattccacgggaggcacactggttacatctatgactgtgagcaaagagtattccacacgagacaaagtgaaactgatgaaattttcaagaccaaagaagactcgttcaggtacagctctgcccatcctatagaaaatttgttaccaagagcagcaagaagagcatttttgttttgcctaatgatgacttaaaaaagttggcccgaaaaggaggaatccgagaggtcccttattttaattacaatgcaaaacctgctttggatatatggccatatccttctcctagaccgacctttggcatcacttggaggtatagacttcagacagtaaagtccttagctggagtgagcctgatgttacggttactgtgggcaagtttgagatgggatgatatggcggccaaggctcctccaggaggagggactacacggacagaaacatccgaaactgaaatcacaacaacagaaataattaagaggagagatgttggtccttatggcattcgatctgaatattgtatcaggaaaatcatttgtcccattggagttccagaaacaccaaaagaaacgcctacacctcagaggaaaggccttcgatcaagtgcactgcggccaaagagaccagaaacgcccaagcaaactggccctgttattattgaaacctgggtagcagaagaagaactggaattgtgggagatcagggcatttgctgagagagtggagaaagaaaaggcacaagcagttgagcaacaggctaagaaacgactggagcagcagaagccgacagtgattgcaacttccactacttccccaacaagcagtacaaccagcaccatctctccagcacagaaggttatggtggcccccataagtggctcagttacaactggaaccaaaatggtactaactactaaagttggatctccagctacagtaacattccaacaaaacaagaactttcatcaaacctttgctacatgggttaagcaaggccagtcaaattcaggcgttgttcaagtacagcagaaagtcctgggtatcattccatcaagtacaggtaccagtcagcaaacctttacttcattccagcccaggacagcaacagtcacaattaggcccaatacctcaggctctggaggaaccacaagcaattcacaagtaatcacagggcctcagattcgccctggtatgaccgtgattagaacaccactccaacagtcaacactaggaaaggcaattattcgaacacctgtgatggtacagccaggtgctcctcagcaagtgatgactcaaatcatcagggggcagcctgtctccactgcagtctccgcccctaacacggtttcctcaacacctgggcagaaaagcttaacttcagcaacgtccacttcaaatatacagtcttcagcctcacaaccccctcgcccccaacaaggacaagtgaagctcaccatggctcaacttactcagttaacacagggccacggtggcaatcaaggtttgacagtagtaattcaaggacaaggtcaaactactggacagttgcagttgatacctcaaggggtgactgtactcccaggcccaggccagcagctaatgcaagctgcaatgccaaatggtactgttcagcgattcctctttaccccattggcaacaacagccaccacagccagcaccaccaccaccactgtttccacgacagcagcaggtagagctgtgggtttatcggaaatgtcggatgttactactacacgtggctgggctaacagaggccaacaggagaaccagtatttacctttggaaggatatgcctcaagccagtgagctcaacagttgacatagtcagcctcacaacgtctcgaagcttttgtaccctattcttacagactccctgttaccaccaccctctccctcctattaaaaaagagagagagagaaaa

SEQ ID NO: 571363 - DNA, 4066 bp, Homo sapiens
  misc_feature (3534)..(3534): n is a, c, g, or t
aaaggaaatgattttttcatcgatgactctaaactagccagtgcagatgatattggtactttgatctgtaagaacaaaaaaccgctcatacaggaggaaagtgacaccattgtttcttcttccaagagtgctttacattcatcagtgcctaaaagtaccaatgacagagatgccacacctctgtcaagagcaatggactttgaaggaaaactgggatgtgactctgaatctaatagcactttggaaaatagttctgataccgtgtctattcaggatagcagtgaagaagatatgattgttcagaatagcaatgaaagcatttctgaacagttcagaactcgagaacaagatgttgaagtcttggagccgttaaagtgtgagttggtttctggtgagtccactggaaactgtgaggacaggctgccggtcaaggggactgaagcaaatggtaaaaaaccaagtcagcagaagaaattagaggagagaccagttaataaatgtagtgatcaaataaagctaaaaaataccactgacaaaaagaataatgaaaatcgagagtctgaaaagaaaggacagagaacaagtacatttcaaataaatggaaaagataataaacccaaaatatatttgaaaggtgaatgcttgaaagaaatttctgagagtagagtagtaagtggtaatgttgaaccaaaggttaataatataaataaaataatccctgagaatgatattaaatcattgactgttaaagaatctgctataaggccattcattaatggtgatgtcatcatggaagattttaatgaaagaaacagctccgaaacaaaatcgcatttgctgagttcttcagatgctgaaggtaactaccgagatagccttgagaccctgccatcaaccaaagagtctgacagtacacagacgaccacaccctcagcatcttgtccagaaagcaattcagttaatcaggtagaagatatggaaatagaaacctcagaagttaagaaagttacttcatcacctattacttctgaagaggaatctaatctcagtaatgactttattgatgaaaatggtctgcccatcaacaaaaatgaaaatgtcaatggagaatctaaaagaaaaaccgtcatcacagaagtcaccacgatgacctccacagtggccacagaatcaaaaactgtgatcaaggtagaaaaaggcgataagcaaactgtggtttcttccacagaaaattgtgcaaaatccactgtcacaaccaccactacaacagtgaccaagctttccacaccctccacaggcggcagtgtggacatcatctctgtaaaggagcagagcaaaaccgtggtcaccacgacagtgacagactccctgaccattccacgggaggcacactggttacatctatgactgtgagcaaagagtattccacacgagacaaagtgaaactgatgaaattttcaagaccaaagaagactcgttcaggtacagctctgcccatcctatagaaaatttgttaccaagagcagcaagaagagcatttttgttttgcctaatgatgacttaaaaaagttggcccgaaaaggaggaatccgagaggtcccttattttaattacaatgcaaaacctgctttggatatatggccatatccttctcctagaccgacctttggcatcacttggaggtatagacttcagacagtaaagtccttagctggagtgagcctgatgttacggttactgtgggcaagtttgagatgggatgatatggcggccaaggctcctccaggaggagggactacacggacagaaacatccgaaactgaaatcacaacaacagaaataattaagaggagagatgttggtccttatggcattcgatctgaatattgtatcaggaaaatcatttgtcccattggagttccagaaacaccaaaagaaacgcctacacctcagaggaaaggccttcgatcaagtgcactgcggccaaagagaccagaaacgcccaagcaaactggccctgttattattgaaacctgggtagcagaagaagaactggaattgtgggagatcagggcatttgctgagagagtggagaaagaaaaggcacaagcagttgagcaacaggctaagaaacgactggagcagcagaagccgacagtgattgcaacttccactacttccccaacaagcagtacaaccagcaccatctctccagcacagaaggttatggtggcccccataagtggctcagttacaactggaaccaaaatggtactaactactaaagttggatctccagctacagtaacattccaacaaaacaagaactttcatcaaacctttgctacatgggttaagcaaggccagtcaaattcaggcgttgttcaagtacagcagaaagtcctgggtatcattccatcaagtacaggtaccagtcagcaaacctttacttcattccagcccaggacagcaacagtcacaattaggcccaatacctcaggctctggaggaaccacaagcaattcacaagtaatcacagggcctcagattcgccctggtatgaccgtgattagaacaccactccaacagtcaacactaggaaaggcaattattcgaacacctgtgatggtacagccaggtgctcctcagcaagtgatgactcaaatcatcagggggcagcctgtctccactgcagtctccgcccctaacacggtttcctcaacacctgggcagaaaagcttaacttcagcaacgtccacttcaaatatacagtcttcagcctcacaaccccctcgcccccaacaaggacaagtgaagctcaccatggctcaacttactcagttaacacagggccacggtggcaatcaaggtttgacagtagtaattcaaggacaaggtcaaactactggacagttgcagttgatacctcaaggggtgactgtactcccaggcccaggccagcagctaatgcaagctgcaatgccaaatggtactgttcagcgattcctctttaccccattggcaacaacagccaccacagccagcaccaccaccaccactgtttccacgacagcagcaggtacaggtgaacaaaggcagagtaaactgtcaccccagatgcaggtacatcaagacaaaaccctgccaccagctcagtcatcaagtgtgggtccagcagaagcccagccacagactgctcagccttcagctcagccccagccccaaacccagccccagtccccagctcagcctgaagttcagactcagcctgaagttcagacccaaacaactgtttcatcccatgtcccttctgaagcacaacccacccacgcacagtcatccaagccccaagttgcagcacagtctcagcctcaaagtaatgtccaaggacagtctcctgttcgtgtccaaagtccatcacagactcgaatacgtccatcaactccatcccaactgtctccactgtcgtcaaataccttcttactttatttcccagactaaattcttgaataagggctaggtgcggtggctcangcctgtaatcccagcactttgggaggctgaggcaggtcgaatcatgaggtccggagatcctgaccatcctggctaacgcatggtgtaaaccccgtactctactaaaaatactaaaagattgcctgggcgttggtggagagagtcctgtagttcccagactaattcagtgaggctgaatgccggagaatagcttgaggctgggaagtgggacggttgcaagggagctgagatcaacaaccaatggcacgaccagtcatgggtaacacattggagaatccggcgtcaaaacaaaagaaaaaagaaaaacgacaaaaacatatagacaacacaacagaacaagcacaaaacgaaaacccagaacaagacaaagagaacaggagaagaacaaagttaaatgagacagaaacagacacgacagcaagacacaacaaagcaccaacaaaacgagcaagaggaagcaagagaacaacgaaagacaaaacacgaccaagcaccacacaaagacacaagaagaaaaacagagagcagagca

SEQ ID NO: 571364 - DNA, 387 bp, Homo sapiens
  misc_feature (14)..(14): n is a, c, g, or t
ctgaggaaaatagnttagcaggtcctcaaaaggtcaaacgcttagctactgaatgactcagcaaggccactgctaggtatataccaaaatgaaatgaaagctcatccacacaaacacttacacataaatgttaacagcagcattatttataatagccaaaaggagaggcatcccaaatgtccatcaactgatgaacaaatgaaccagatgtgatctatccataaaagggaatattactcagcaataaaaagaaacgatttgctgatccacgctacaaaatgaagaaacgttgaaaatgcaatgctaagagagcctagacacgagggatcacacctttaatcccagcactttgggaggcccaggcagtcagaacgcttgagcccaagg

SEQ ID NO: 571365 - DNA, 232 bp, Homo sapiens
  misc_feature (146)..(146): n is a, c, g, or t
ctggactccacttttctttttccacaccacttatcacattctaacatacgggaaaggcttacttatatttatggtctgtgttcctctgatagaatataagctcctcaagagcagaacatcttttgggtttactgggtgtaacccanagaacctagaacgagcgtccaagggtggcattcaagtaaaacactgacaatacgaaatgggctacgggtttctctgcggccttagc

SEQ ID NO: 571366 - DNA, 315 bp, Homo sapiens
accaaacacgcatcaactgggagctttgaaaaaaaggcgcctggaacgggctatccgattcgcgacccagaaagcgctgctgaagacgtcagggaggagatgaagacgtggagtttcccaggaagcacctgactgggaacttcgctgaggagatgatctgtgagcgtcgcccctgcagagtacctggcctgctctagccatccgctgcgtgcgccgctcccgggagttctggacttcctcacgcggccggactgcgcaggctttcggctgcctgcgggcggccagtacccgcgcgccctggagctgctgctgcgc

SEQ ID NO: 571367 - DNA, 825 bp, Homo sapiens
  misc_feature (150)..(150): n is a, c, g, or t
tgggacaggggcaagccaggagggacgctcttcctagccacttggctcatctttcagtcagctctcctttgaagataactagcagctttctagttgttcttacctagtcttcattttgtttctagttgtcttagttgggtttaagatatnagaaaactcttgtttgcaactaactaaaactctcacgttaggctgaactgtggagctactttgacaagagtgggtagtgtaccatcttctggccagatcacacatttacatgactctaatgatagtcttgtattgtctttaattgacaacaggaagagctgaagagagacctgaaaattaagaaagaaaaagacctgatgcagttggctcaggccacagcagtagctgcaccctgccccccagtgacaccagctcctccagcccctccagcccctccaccttcacctccccctccacctgctgtgcaacacacaggccttctgtccacgcccaccttacctgctgcttcccagaagaggaagcgggaagaggaaaaagactccagctcaaagtccaagaaaaagaaaatgatctctactacctcaaaggaaactaagaaggacacaaagctttactgtatctgtaaaacgccttatgatgaatctaagtgagtagatctttttgagctctagttttttgtcttgaaagtttagctattaaattggattttgaagaaaatgaatattttgggagtgatataaatgaaaatattaaatttaagagtaatgtttcatccatggtcttgcatgtgatattcttaccattgacgctagtaaagtaaaatttgctatttca

SEQ ID NO: 571368 - DNA, 813 bp, Homo sapiens
gaggccggctcgggccgaaccggctccaaccgtggtgacaggacgggagcccagtgcagtcgtgagtccgagcccgagtggatgtggcgtctgggtcgcttgtgtctggcctcaaggacaccggtgaggggcagcctacggcctgtcgttggccgtatcatttctgaagatgaaacaatacaattaaaccacgaaagatattattagacaaaggccactttccctcataaacgagtagtcagccttccatatcgaaatgatgaccgatgggttgaacaacagacgattgcctttttgtggacccaactaagattagaggatccagctccgccggatccgcttcgtaagtgggagagagcaatcgcgcaggtaccttttgtcttgtgctacgacgactattaactatcatgctatgataattaatacacgcaatgtatagttccaacatgacgtaaggatcattatcctattacaccagggataccagatgcatgtggcagtggcacgagttaacggagtattgtacctgcaatgtttcaaggaacgtaccagagaggtgcgatgtgcgaaaggtggtggagcacatgcaagtcatcagagctttgattcatatctgaagaaaggagtcaaggttgctaaaagtatatgactttactggaacgagtccgttccaagtttcgttgcagaggtgaatgggaggtgtgggtgtctggtggagaattaaagtgttctggaattatgcctatggagttccaaggttgtgaaggaatggggggaatctggaggagaacaattcgattggagcttgatcta

SEQ ID NO: 571369 - DNA, 813 bp, Homo sapiens
gagagagagagaactagtctcgagtatttgggtttttttaattttcctaataacaaccttataattctaattgtgacccagggccctgaaagctgataacaagctgggttgaccagagggaactaggggtcggcaaaaagggatcatggggtcgaggaaaacacattgggtcccttacctaggagggatgtggatgctggggagaaagggagaagcgacgatgtgggctcagcctggcacggtaacataggcgctacgaaaaacgccacaggccaaaacggctagaagggcgagacgagcgcacagtccacgcatagtcacacgcctgggcgtcgagggatagaagggagtaacaccacattcatcccaggggccatatccaactaaatcagaacacaaaagaagccaataaggatctgagggaagccctagagggtcgagagacgggactagctagaagacatagtcaagcgagaaccgggagagactcatggacataagccataaggggagcccaacaacacctgagcgagaccacaccaaagggccacccccagtgtatacggaacaaccacaagtggggacagaaatggggcgacaacagaagaggacggccccatgcgcaccgaggccaaatgcgacaaaactcaacgccatgaaccagcagacaaccatgggggaacagaggatcagttgggcacccaaaaggggggagtgacagaagagaaaagagaagcgaccacgaagaggaacaccaaaggggacctcctacaacgggggaagcaaaacgaagcgaatacaacgggggacgag

SEQ ID NO: 571370 - DNA, 159 bp, Homo sapiens
  misc_feature (44)..(44): n is a, c, g, or t
ctcaatcgggcttatagaacgaggtcacaggcccgactgacttnctatttattgtgagcctcagtataacattagcgtgcctacagcagacagtgagatcgtgcactaacactatggacctaaggacctggtacacaatcttgtactaacatctttata

SEQ ID NO: 571371 - DNA, 1019 bp, Homo sapiens
gcaagatgtcgaagcgaggacgtggatgggtcctctggtgcgaaatctccggattgtccttgggtcttcgcggtaagaggtgtagtcaacttgtgctgacaacacatggatccaataacaccatgtatatcatctccgtgacacggggatcggagggcacggcatgaacgagcacattccgcgcgtgcatggtgtgggtgacgatggtgatggacatcagtcaagaaaggcaaagccagagctcagaagaaaggtaggatccagtagtgtggtcattcggacttatggagagagtcataccggtgaaaataagatggacgttgttattttggattttgcaagataattgtcacggagttgcatagttgaacaaataaagagggtagtatgaaaggcttcgtgtcattataggtatccagttagtcaacaggagtgtgcagacattgtgagaatccgagtatctgcatccgaatgctgtgagagaggatggctgtgattcttccagtatcttcggtgaagctttctcaaaaattcaagcacattacacagactccaactgataacatacgaggacgatgctgatagacggagatggacggtacgaatgaagcgcagggtggaaaggagggatcccatgggccattggccttgtgtctccttggtcccaagagtcttaccttgttgtccgaagaggcgaaagaggtctggcgcggatctcctcgaatgaggcgaagcggttatatggaattattgggaaatagtggacgaaggttttgcgcctgtggattatatgtaatgccgcggaaaataggaccacggccaacttttttttttgcgatggtccctcaaaagggaaggtaacccctgacagccctcgaggcccggaaggtgctgggcaccctggttcgttatccacctaacatacaggtttctgacgctatccttggttgcggattggaccatcgagcaaacaaccaaaacaaccgccactaccactcagagggacaccatacatctgg

SEQ ID NO: 571372 - DNA, 263 bp, Homo sapiens
cccacaatctcttctcgcgttctggacaacggagaacaatctaacaacatgcaggatcgtcgcaggcaacagcagctcccgactcgtgcacaggacgccgttcgttggtcgtatgcctgagccccgtcccctgggctccctcgggctggggtgaggcgggcaggtacgcgtggggtaggaccatcttacgctgggaccccgccaaggagccccaggaagtaggtgaaagggcaggggcgtggctctcggggcgccacccacgc

SEQ ID NO: 571373 - DNA, 194 bp, Homo sapiens
ctcgcatgtttgaccaccacgtatgtcgtcgtgaagcacgcgcatgttgaccacgacgtatgtggtcgtgaagcatgctgacgacgacgtacactgagcagggcagagtgctgccatctcccacgcagggcagataagcagagcgagttctgacaggtagttatgtcgtggtgaaacatgcgggtaccgacgct

SEQ ID NO: 571374 - DNA, 206 bp, Homo sapiens
atcgcagtggcatgatctcggctcaccgcaacatccgcctcctgggttcaaccgattctcctgcctcagcctcccgagtagctgggattacatgatgtctgccacttatgcctacactaaattttttgtatattttaagttggaagaacagaagtttctgcccatgtttgggccagggcttggtcggtgaaactccttgggccctc

SEQ ID NO: 571375 - DNA, 334 bp, Homo sapiens
atggatctacgcctgtgatctcagcagtttgggactgccaaaagccgtaggatctcttgagcccccgggagtttgagacgggcctgggcagcatagggagacccccatctctacacgaaaaagatagaaagattagccggacatggtgatgccaacctgtggtcctggctacttgggaggctgaggtgggagggtcgcttgggcccgggaatttggggctgcagtgagctatgattacgccactgtactccagccagggtgaccgagcacgaccctatctctaaaactatttttaaaaataaaacaatatgttgttcatattatcctaatgtag

SEQ ID NO: 571376 - DNA, 806 bp, Homo sapiens
cacagcgcgtaggagcaaatggacaaacagcggaacaacctataaatgtcggccagcttcgtggtactctatttgactaaggcttatttatggcacctggagtttaaactttatgcgtgggcaaagtgccgtgtaagcgtaacgggtgtgtagctaaatcggcggtacccaccattggccggttcccaaaccgaggtatatttttcggaaacgtgctactttcctttcagtttctcgacacgcctaaattggtggcaaatgggcaacccccactgtagaacgatgtttccccccaaagtggcaaatatcttcgaaacatgtctggcgactcccactgtaggaaatatcacttcccccggtgtaccgacagatacccccccatccctgccacccccgttagtacaccacttcctcatagcccccctagttttgcgcccaccaaacatcttaagtcaaactactgccaccccattttacacgaacattttctcccgcctctccctattctgttgcgagaaacatcatctgcaaatcccccgtagtgacccctatcataaaatttttctgtcaacccccgggcaactaatagttgttttatatgcgcaggcactattttttcttttccaccttcagaaataaccattacaaacagtttaacaactaacacatcaaaactttgggccaccccccagcataaagaagaaacatgttgtgttccaacaaatatgcccgccagataaattttgtgcacacaaagttgtagtgggaataaataatcacggaccttagcgcagtactcacaatca

SEQ ID NO: 571377 - DNA, 451 bp, Homo sapiens
agacggcctctatatctataaataaaatagtgcttgaggggtaacaatattcttcgcgctgacttaccatagcctggtggtagactcttagaagagactaaaatgaaaatggccccactattattgtcaatcttaacacagagcttgtgcgaaaggtccctatactgctgactgtcagcatctccaggtccacgatatgtactcttggtcctgataagtgacttcacgagcacaagcattgcacttacaggacttgttggtcgtaggtagaactctccattttcatttccagatttaatccgaaaagtattgctggtgtaggcatacatagttgtggcctgtatctggaagaatgtctgatggcacagacctatcagatcggatgctcatgtatttgtagactattgactggggcagttctcggcacatggcatttgagactgggcaaaca

SEQ ID NO: 571378 - DNA, 237 bp, Homo sapiens
  misc_feature (34)..(34): n is a, c, g, or t
  misc_feature (81)..(81): n is a, c, g, or t
  misc_feature (95)..(95): n is a, c, g, or t
  misc_feature (108)..(108): n is a, c, g, or t
ttgtttgctgtctaggagtgagctatagaattgnccaggtgagatggaaagattacaagagagaagatatgagaacaaaancctgtaggaaattngataatatcaagnacataaatagaaggcctggcacaaagtctcatgcctatgatcccagcactttgggaggctgaggcaggcagattgcttgagcccaggagtttgagaccagcctgtaacatagcgagaccacatctctac

SEQ ID NO: 571379 - DNA, 505 bp, Homo sapiens
  misc_feature (353)..(353): n is a, c, g, or t
  misc_feature (355)..(356): n is a, c, g, or t
  misc_feature (387)..(387): n is a, c, g, or t
  misc_feature (463)..(463): n is a, c, g, or t
  misc_feature (476)..(476): n is a, c, g, or t
atctgtatatgggccccgctacgagacacgcagcgatgtacgaggcgcgatatcgttgatcaatcaatatagcgactcgacttccggatcgccatagcggcactgaatgtagttcctcatggtattacatatttattcttaatatgaggccatgtagaataaaatacactagagagactagaagggctttgtccactaatttattccttttggtcgtatatgcttcatgttatttaaccagaaatgtcttatctctaaaaatttttagtagtaattatttaccaaacttaaaaaccaatttttctcccttaaatttaaaaaaaatttaaacttaaaacaagcccttttttctntnntatattcctaagacaaaatataacaggctangaatttgggttccttctctgtaacactaaatattttagtgtgaaattgaatttttttattactatagtcttttcanatctataactttnttgggttggggattcttatctctcaccac

SEQ ID NO: 571380 - DNA, 221 bp, Homo sapiens
gacgtattctaacattagaagtaggtggaagaggaaaactagcaaggaagctggtaagaaatagccactgaggaagaagagaaaccaagggagcatggtaacctgaaagtaaagtgaaaaaaaagtctccaggaggaaggagtgatatagtaggtcaaatgctgctgatgagacaaggaagaactgaaaactgattatcagatttagtaatgttagagata

SEQ ID NO: 571381 - DNA, 667 bp, Homo sapiens
caggcacatgtcaccatgcctgaataatggttttattatcattataattttttgtagagacggggtctccttatgttgcccaggctggtctaaaactcctgagttcaagaaatcgtaacacttatgctgggattacaggattgagccaccatgcccagcaaggtggttttgttttgtttgtttttgttttttttccattttgctgaattctgaagctgtaaaattcaggaacctaagaagccaggcaaagcacaatggagttcctggcagttgcacatggctgaggagtcaaggattagagttcagaacgtgacatgggggctggaacctcgggaagacccaggcttttagttggaacttaagcagctaagctctagagtggtagtaatacaaaggtggaaagaggcttgttgcagcggctcacacctcgtagtttcagcaatttgggaggctgatgtgctttgatgccaccagtttgtgaccaagctgggcaatgaaaggagaccctgtctgtacaaacaatgcatgcatttatcttgacatggaggcatgcacccgtcgagctaccgctttggtacctacctgggaggatggtttgggccaccaaattggcccttcatgaggtaggatgggcgccccacttcacttgggtagcaaagcggtgttt

SEQ ID NO: 571382 - DNA, 485 bp, Homo sapiens
  misc_feature (365)..(365): n is a, c, g, or t
  misc_feature (427)..(427): n is a, c, g, or t
  misc_feature (457)..(457): n is a, c, g, or t
  misc_feature (463)..(463): n is a, c, g, or t
cattgtatgggcttagacaaatgtatgatgatatctacaattatagaatcatacagaatagtttcactgccctaaaacttctctatgcttcacctgttcatccctttcttccctaatcccctggcaaccactttaaaaaaaaaattaggttcagggggtacatgtgcaggtaaactcgtgacaagggggtttgttatacagattatttagtgacccaggtactaagcctagtacccaatagttacttttctggtcctgtcccttttcccaccctccaccctcaggtagggccccagtatgttattcctttgtgtccatgttatttcactcccacttgtgaggaacatgggatatttgggtttccngtttcccatggttaggttttgtttaaggggtaatggggcttccaggcccatccctggttccnggcaaaggggcaagatcttttttttggggnaaccantttttaattttcggcctaggtg

SEQ ID NO: 571383 - DNA, 467 bp, Homo sapiens
gaccataacctaaattattatgaactttctcagttcccatgtatgatggtatttttctgataatgaatgatgttgagcaccttttcctatacctgttgacattggtatgtcttcttttgagaaatgattattattttgtccattttaaaatcagattattaaattttttttcctgtagagttgtttgagttctttatatattccggttattaatcgcttgtcagatgggtagttttcatatattttctcccatcctgtgggtggtctcttcactttgttgactgtgtcctttgttgcgcagaagctttttaaacttgatgaaatcacatttgtctgtttttgcttttgttgactctgcttgttgggtattactcaaaaaatctttgcctagtccaatgtcctggagagtttccccaatgttttcttgtagtagatttgcaggttgaggtctaagatttaaatcttta

SEQ ID NO: 571384 - DNA, 201 bp, Homo sapiens
atgcaggaggagttctcgcgtgatgggaaggctctggagacggttcctgcaggattactgtattaaagtgtaatcagttgtgctgggataacatttgaacagatacttgaaagactgtagagaattgggaagtaaatatctgcggaagatcatcccatgcagggggacttaccagtgcaaaagtcctagtaaaggaacgtg

SEQ ID NO: 571385 - DNA, 224 bp, Homo sapiens
  misc_feature (166)..(166): n is a, c, g, or t
gtaaagactatctcatttcttcccctgtctatttcttggccattcatttcatccatagccttaccagcggctccatctgtcttcaagcatgaacaattgcgtaatctttcagcttcgtagtactctattcgagttttccaagattcagacaaatgacttttcctgntattgctatctgtcaccggtagtcagccaaagtttctacacaaactaaaacttttgac

SEQ ID NO: 571386 - DNA, 166 bp, Homo sapiens
accatgccatgactcggaacacgtcaggcccccacctggctcactcctggaggatgtggcctccctccaggtcagtccccaggccccagaggcaggtggacagaggggactaagccagctgcttggctgctgggagcagactgagtcttttctaatggactggcat

SEQ ID NO: 571387 - DNA, 131 bp, Homo sapiens
tgatccagtgcacaccgctttctgatcatcgtcttcctccatgtgtggctcctctgcttcttccaggtcctcgagatcgtcatcacccctgtcccatccgggccacgatctcaggaattcttaaaccatca

SEQ ID NO: 571388 - DNA, 160 bp, Homo sapiens
ctacggaaaaattatctgggtgtggtgggaccccaacctgtgatccccagctactcaggaggctgaggtgggaggatggctggtgggaggatcaccctgagcctgcgaggtgggggttgcagtgagctgagattgcatcacagcactccagcctgggagg

SEQ ID NO: 571389 - DNA, 394 bp, Homo sapiens
  misc_feature (1)..(1): n is a, c, g, or t
  misc_feature (194)..(194): n is a, c, g, or t
  misc_feature (258)..(258): n is a, c, g, or t
  misc_feature (263)..(263): n is a, c, g, or t
  misc_feature (308)..(308): n is a, c, g, or t
  misc_feature (320)..(320): n is a, c, g, or t
  misc_feature (338)..(338): n is a, c, g, or t
  misc_feature (385)..(385): n is a, c, g, or t
ntcttaaccctgttgagacgccaagctctcagctgtcctagtcaggtgttttttcagacagcaagtagaagaggtggtggccaactgcggtgctgtttcctggggggggtccgggtcagcactgggcaaggtaggtagctagctgcctgacccctagtctggggttgggacttctgtttgcctgggtaaagggntgtcagtcctaagatttctccacattgtgtctttcttctgcagtggttaaaaggctggtccttnttttntcctgcatggtaccctaaggcaggcccactggctctttttgatcnagggttctgggnaaagctgcccttgggggnccttgggttaacgtggggggcggggtgggtgctcgagtcgtggctgncacagtcca

SEQ ID NO: 571390 - DNA, 192 bp, Homo sapiens
  misc_feature (100)..(100): n is a, c, g, or t
  misc_feature (105)..(105): n is a, c, g, or t
acccgtctaccagcccagaaccaaccagcccggcctgagtttcaccccacgtgtcggctaccgttccctgtcccttggaggctccaatgagctggcgtgntcgtntgttgccggcgtcgtttcgtggcgtcgggttttgggtcgaccaggcaaaagtcccggtcggcaagaagggccagttgcacgaatacc

SEQ ID NO: 571391 - DNA, 594 bp, Homo sapiens
aactgttttactatactttattgatttaaatacagcaaatttgagtaagcaccagttaaccaaattaccactactcatgagaaacaaagtcttgccaattatatattaaggcaaagggtaaacacagaaggctttcacttccactatagtcctatttaacaaaacatcctacatactttggacaattggcttataattggttaaatatttgatttgaagcaaggttgatttttacttaaacttctatttttcagtgaaaaaggctctcttcatcagaggtggttgcgttttcccggcatgaaacattatttccaaaggagggttattgagagaacaccaattaggtatacggcccgtctgattataatattcctttgaaacataacggctcccacagatatagtgtcatgatccaaaaatagcccgtgccagccaggccatacaattagcttttgcaggtggtgtatgaattcgaaatgtcttagtgccaagggcttttttatatttagggttttttaccaaataccttatttcttgaagcaaactgtggagaaatcctggcaacatagaagtgcctcctatgactacccaagt

SEQ ID NO: 571392 - DNA, 522 bp, Homo sapiens
cgaatacggctagtgctggacatatccaaactaaaagcaacgtaaatcctcttcaaatctaatattaatatagggaataagattattgaaaaacaatatttttcctgatattcttatacctgaaggtaatttttgtagaaaccatggtaagaagggaaaagaaacctttgactggcgggggcagggggaatacaaaaaaaaaaatccctatgcatctcaacaattatcacttgaatatcaaactcagacagagtactcttggtgaaagaggcaaaatgggtcttgagctgattcaagtctaatgtctgacggttttcctgaaatactggcccagtattaggagaaacattcacagaaaagtcagcatggtagatattgagaaggaaactctgaggtggtgattttctccaaggtcatggttataaggctcaatgagggcctgaatgggtacttccacagaccccaatagaatgagcgcccatttagcgatcttcctgaaagaatttaaaagcctccactgaa

SEQ ID NO: 571393 - DNA, 271 bp, Homo sapiens
ggaattggagacccgcctgagcaacatagtgagacttcctctctacaaaaaataaacaaaattagtggggtgttctggcacgtgcctgtaatcctagctactcaggaggctgaggcaggataattgcttgaacccgggaggcggaggttaggatgagcagggatcgtgccactgcactcaagcctggacgacagagtgaagctccgtctcaaaacaaaaatcccacaaagaataaaatcaaatttgtttcatgcatcatctgtttgcacaa

SEQ ID NO: 571394 - DNA, 544 bp, Homo sapiens
  misc_feature (434)..(434): n is a, c, g, or t
  misc_feature (495)..(495): n is a, c, g, or t
  misc_feature (504)..(504): n is a, c, g, or t
agaacgtactttgatagagagagacccacattcacataacgtttattacaatatattgttataatttttgtatattactactgtcaatctcttactgtgcctaatttataaattaaactttatcataggtaaatatgtatagaaaaaaaagcatatatagggttcagtactatctgaggtttcaggcatccactgggggtcttggtacatatctcttgcaggtaaggggaaactactatatttgtctttttcttattttattgtcgttctttgtgtatcatcttatacgttgcaggtaattttatcctaccatattgtgatttttattttgtttttagttataatttagacacttgaaaattctcctctgtttgtgatagttttcccttccttatatgccccaagattatataatattcttttgatttttttcnaatggtccatagcaggggtttttacatttacaaccttaagcaacctgattaactttaaagnccatatttnaaaattaggaaacctcgagttaaatggggaaatatatcca

SEQ ID NO: 571395 - DNA, 1937 bp, Homo sapiens
  misc_feature (375)..(375): n is a, c, g, or t
  misc_feature (453)..(453): n is a, c, g, or t
  misc_feature (997)..(997): n is a, c, g, or t
gaacagaatggtctactccatcataaaacatgcacacataacgcatgaattgagacatacataattaccctagtatagtatcagagtcgtctactggagcctcgtcacgttccacttatagtgaccagtcttaccataacgtcaccacgctgtattacgaaggtgcagtacgtctagtgtgccctaggactcaagtggctaagcgctttacttgacgggctaaaaaccggatgctacgacttcttataacggtctgatcgttgcatcacgacgcatatgctgtgcgaataggtcattcattcctatcattggctaactgcctcatcattacacatacgcgcactggctgggagctatatcttgtatgtcatgctntgcctccttagattatattgcgggttgtaccctcgcgaatcattgggacgatcttttcctccgtttattaagagcaancaatacacggctagctgcacctggcttcagcaactgaatctacgcgcttatcttcctcgtggacttctgccaaattaatgtcttattgagggtcgcgtacgtgggcccaggtaagccaatggtagagccagggggttatcgcacatggatggtgcttaagcgccccttcgcactttttagagcatttcgaggaagcattagcttcactcaacctcaccgtgagatagtccatcccaggtaagtgaaaccagaaaaggcgccacatgcgttaagcctctgcctgttaactaaacccataatgaacatgaggtgtggtttacctcctcagtgcgtaactactaaagggggagaactctatgttcacaaattttttacacattcacctaaattcaatgtgtacatcctcaagtatttaaaaaattcggccccctctggtctccggtataaaccccccaaactttacacggataaacggggcgccggggctcagatatccagggggcattcggtatttctcccagtttctccactcaaacttcatacnaatggctcaaagtacacacaattatacccttgcctgtcaacagttagatactctccttgctcaacctaggtgttctcaattataccacacttagagcgttcggagcgcattttcccacatttaagttgacctattaagcgtgaaaaaacaagtggcattcctggttgagaacccggtaaaaagagttagcttcggacctcggtatatcacttctctgttagcccccctctgatgggctggggaccgcgatattggaggaagggccccctctggaatacaaaagtattggccccagatataaaccttttataattttctctagacattctcatgcgcacgggtgtcctacaacccccattgagaccgctctagaggatatatttcctagtaaatgtccataaccaaacggggtcttgtggggacaccttcatagtaccacacgaggatattcagttagggctaacatatcacgcgcgtggggggacaacaaagcgtggtatgcgccgacatggggggggatcaccacaactgaacaacgaggcctatggagggccaaacctgatagtagacaaaaatgcgccatgacgccacaggggggtacccacatgactagtcgatccccccccccagccgattattactaggccgggagggaaataacagcggccccaacaatccacgagcgggaactaatcaaaaccacggagagcgagcagccacactggaacaccaccgccgaccgcgagcgagaacaaatagagatgcaaccaagacacgcgagacaaactaagagaaaacagcgggacgagacaaagcacagacatacgcaacatacagcgaagagcagcgacgacagacacacagaacgacacagccggcatagaacagccgaacaacaagagggtccagcaactacgcacgacgacgccacacactagac

SEQ ID NO: 571396 - DNA, 1082 bp, Homo sapiens
  misc_feature (885)..(885): n is a, c, g, or t
gagtctgagcggcgatggcggacggtggtggtggaggtatctagctgcgggggcttgcgggcggtcggggctccggggcctggggctggcgtgagcctaatcttgtgcccgtgtggccggtgtgggacgtgccgcgtgtgtgtgggtccccggggggcgcagggggactacgggaacgtgcctggagtctgaggatctgtgacgcctgtggtgagctggtcttgctggaagcccctggaggccggaaggccggatgcgccggattgatgggatgctcggtcccgtggcccccggtgtccgcccccgggggggcctccatggggcacttgggcgtcactgttttcgggtagctccggcggcatgcacatgtggatgtggagggatcccggggtagttggatccggatagggtatggacccgcggggctgaacccggtggagctccagttggatggaaccccgttgggccatggagacgtcctttattcaacgtccttcgaagtttaaggggcagtggtggtgacgggagagaagcctgtgaaagttgctttggagggaggccttcaaaaaaatgtgcgcctagggaagaatcgtcatatctcgaaagtatttgatgttcacgtcgtactaagtgctaatggcttggtccccggggtggcttcgtggtcccctgtttggacgggatgaaagggttggcacagggctggagatagctcggattcacatctgactggttgggccatctgtatcggagctattggagttgcgaccatcgccgtgagataaggcatggggatgactgcaacgttttgcaattggggcctggtggggttgcaagttcacaacgcggtgtgtagcccagttacttgcgatgttgactaaaganttttatcgttgggcgcattccctaaatcggggcttctgcggatagttttaggaggtcttcaaggatccaaggtgacgttcaggaagaggtggaactcacctttggtgcatttaggattgaagttcccttaaattaggaaggagagggacaaagtccagaaggggtggagtccccagcagagggaaagcaagcagggc

SEQ ID NO: 571397 - DNA, 223 bp, Homo sapiens
gtcgggaagggtgacttccagagatgtcctgcatcttgctgaataccgctaacttcttctgctggccaggttggggcgccggcttgatagtaggctgtggggcagggttgtcgctgccatggggtttgggcagatactgggacgctccataaggctgggtgtgatacatcacctccgcacaactcatggcatccgaagcatgttgcggggtaccggagctcga

SEQ ID NO: 571398 - DNA, 1276 bp, Homo sapiens
  misc_feature (1)..(1): n is a, c, g, or t
  misc_feature (799)..(799): n is a, c, g, or t
ncgcctcgaggctgccgtgttgagttgtgttgcggccgagagggggtgcttgtgtgcccctccgctgtgtgattaggcgctgttgcgtgcgcaatgatgtgtggagaatcgttgagctgttaggggaagagtgtgacccggtgtgtggcccaaaaggggagggaaggccccccgaaaggcgtttttatgagccccgctcctccggttgtgtcctccccgtgtgcccggagaggcggtttatctgcctttagtaggggcgagctgaggccgtttgtaatataaggagtgccacccacccccccccgttgtgtaatatggagaggcgcccaacgaaatattagtgcttgggggggagaaaagaaatttttaaataaagcgatattggagaggccgggcgcacaaaacacgcggtattcgccggaggggcgccttgggtgtagtataatagcctggggtgttggtggtcccacaagaggtaataggatatttctttatagtgtttcacaaacgtgtgtaagaaagttttggcgccccgcacggagagccccgttctatagagtgtccccgctcttgtatagaatgtgtataagctcgtgtatagtgtcccacaaaagagaggagaccacagcttcttctttgggacacacactatagggagaaaaaaacccgctctcgtatagagagagggagagtatagaaaaaagttgtagacacacacccaccttagagttatagggccgctataagagagcaccgccctcgccacactgtattaagaaatagggcgttttacacaagngctctcacacacacaccccactcttaacctctataaatatatctccccacacacacatatataacttgagaactctctctctcacacacacccaccactttggagaccacatctctattcacacctcttatatagaagaaatctataatgtttatgtatatatagtatacacacatgtagaaacacacattttcctcccgccactataggcctgtgcgcttcacgaattataaacacacactgtagaactgtaccacacattataccacgcgcccacacatatttctacacatcacacccacccaagtcacttattgaacctccacctgtcacaaccccaacaccacaggcactgcttcactaaaggagaaaggttataaaaaaagtataaaaggaaactcggccaattcttaaccccccctgtttacccaaaacatcacctttagcatcacccagtattagaggcaccgcctgcca

SEQ ID NO: 571399 - DNA, 240 bp, Homo sapiens
aaaccttgtagagagagtaaattacaccatgtaggctaagagcaccaattagaagcgtcaagctcacaccactacctaaaatccaacattactgactctacaccaattgaccactttacctttagagactatgtagttagtacatgaacatctctcgcatagctcgtcagataaacactgactgacattacagccatttttcatcaccacagtcattttacctactgtcacccacacagc

SEQ ID NO: 571400 - DNA, 266 bp, Homo sapiens
tcccaaggctgagaaagtgtagagagtgagtgagcatagttgtgatttttagggcctctaaaattattaaagcagcggcagccacgtgcacgcggacctgagggctaggctaaaacagtaaggtcaagttgttgggacagaaaggctacagggtgcggtcccggctcttgtgtaagaattctgaccgcactaaccatgcctaggaaggaaaggagttgtttggtggaagggattgaggttggggagcaattcctcatccgtgggag

SEQ ID NO: 571401 - DNA, 1157 bp, Homo sapiens
gtggttagttattgtacgtttgggtgaattctgggagttttgggaattgtaatatttgaataagcaatgtttgtatactagatgaaggttgttaataggggcggatgaagtatgttctgctcgatatctggggatgcccttggttagttaatatgggaacgggggttctaaattatagtttgttcgctatttctaatttggtaagtgacaagtctaaagggattaatcgttctgtattaatttttcggttagaataactattaattgctgagggtccttgtacttttgtatgacttgctttgtcgggattacgtataaactctgttcgagggccgtacagtggctatttctgcagtcatatagagcccctctagtcatgcggcctacagttgaggacatcaccctcgacaatgctcggcgctcgacctcaggctgtcaaccaggcgactcgtgcgtagctatgtaccccctcttcgccataccctaacgactcgggtttaacctcaacctgaggcctcctagttattctaggccacgtattagcctagccgtgttaactcaatcctctgattctagggatgagcatcgaaagctctaaagcgtagcgcctctgatcggcgcactgccgagcagtaggctccaaacgatctcgataagaaagtcaccctagccatcgattctactatcgacattgacgtgaatagagtggctcctttaacctcgtccacgcgcttagtcaacaacacggagacaccgtctgatgttgactcctgccatgcatgaccattggccataagatgatttatctccacactagcagagaccaaccgtaccgcccttgcgacctgcacgaaggggagtccgaactagtgctcaggctgtcaacatcgaatacgccgcaggccccttcgccctattcttcatagccgaatacacaaacattattataagtaaacaccgctcaccacgtacaatcgtttcctaggaacaacatatgacgcactctcgcctgaactctacacaacatattttgtcaccaagaccctacttctgacctgcctgttcttatgaattcgacagatacccccgattccgctacgaccaactcatacaccttcctatgaaaaacttcctacaatcaccggggattacttata

SEQ ID NO: 571402 - DNA, 316 bp, Homo sapiens
gtagactaacatgtatgaggtggtatctcaagtagtttgatttgcattttcctgatgacggtgatattgagcaccatttcatatacctggttggtcattttctgtcatctttgaagaaatgtctattcaagtcctttccccacttttttttaatcaggttatatgttgtcttgctattgagttgtatgagttcttcctaaatcctgaatattaaaaccttgcctgatatatggtttgcaaatattttctccttatctgtacattgccttttcattttgttgattgttttcgttctgtgtaggttaggtctacctgg

SEQ ID NO: 571403 - DNA, 214 bp, Homo sapiens
agcagtgatggcagtcagtgtaggaaggagtaggccggatacatagcggttcaagacctgctgcacttcggctgcagtgctccggaagagttcaggtgtacgcctccggaggcctgccctacacgtgcaccattagaaagacaatccttgagctttctaggggagaaggcagcagcttgacattacggacccaacggtagcgtttggccccaac

SEQ ID NO: 571404 - DNA, 115 bp, Homo sapiens
ctatacattgtaggaggtagacacaggagcattggtgctcagagtgggtgtctggtgagaggaacaacggtgcttaagagattttcaggctattgctgtgggacacgaatgtcga

SEQ ID NO: 571405 - DNA, 791 bp, Homo sapiens
  misc_feature (605)..(605): n is a, c, g, or t
agtgccaaatctgaaacctagattcctctgtgactcctcccctttctttagccctaaagtctcttctactaagtcttctccaaactcaccaaattcctcacaaatccatcccaccccttcaactgccttagttgatccctcttatcatcacaaggttggctctatctcatttcccagatccagcatttcattctccaaagccatccttttcactggggccaaagttatcttccctataacccagacctgactgcgcactctcctagtctgcattctttagcagctcactgaagaattcacctgtaagagttcaaattcctactctaacctcagcctaccttccagctttatcctgtggcgctccatggctttgctaatttttcacctcagccacattagatttttcctaccccacaatttcacacagctgcttccaccctctatgtctttgttcacactactttctcagcctggtatgaactgctcttttctgcctatcaaattcatccttcaagatgaggctcaaatgtctttttttttcctgggacaagtttcctaaactctctaagcctgtctcccctccgccctttccacagtcaaaagtnagtgctcctactataacttatgtcaaccagcaatataactcttatctctgttacagtcataaatgcaagtctcccctacaaaattctgagatcttcagggaaaggagtgtaataattttgaattgtcattttctaccacaatatatggtacttggtttagctcaaaaaaattgttctggactgatt

SEQ ID NO: 571406 - DNA, 730 bp, Homo sapiens
agcgggggttctgccggctccgtggctgaggaggcggtttctttccggccgcgctggctccgtggctgaggaggcggtttctttccggccgcgccggctccgtggctgaggaggcggtttctttcgggttctgccggctccgtggctgaggaggcggtttctttccggccgtgccggctccatggctgaggaggcggtttctttccggccgtgccggctctgtggccgaggaggtggtttctttcccgttgtgccggctccgtggctgaggaggcggtttctttctggttctgccggctccgtggctgaggaggcggtttctttccggccgcgctggctccgtggctgaggaggcggtttctttccggtcgcgccggctccgtggctgaggaggcggcttctttcgggttctgccggctccgtggctgaggaggcggtttctttccggccgcaccggctccgtggctgaggaggcggatttctttccggccgcgccggctctgtggccgaggaggtggtctctttcccgttgtgccggctctgtggctgatggaggcggattctttaaggtcttatgctgtgctggatgctttgaaggatcagcgtgagaatggaggcgcttagtcacacagggttcaccattggaactgtcctggggctgatctgatgccgactgggctccgagttcaagtggttctctaacggaccatctcagaagatctccggggga

SEQ ID NO: 571407 - DNA, 281 bp, Homo sapiens
acaggctagtggaggcggggtttattggacgaggcgcgccgtcgctgtacgcttgctctgcggcgccgaggcccgcgcgctcgccagtgttccggccaccgccaccgcgggtcgcctcgggtgctgggcaccactggagatggggctgccgctatggacgcgcccgctcagcgccgcggccgtgcgcgcctttactggagcgtcgggtgacaaccgagactggaacacggaccgttcagtgtacatggcgagcgtgtcgcagtcctgagaaaccaattccc

SEQ ID NO: 571408 - DNA, 391 bp, Homo sapiens
  misc_feature (60)..(61): n is a, c, g, or t
  misc_feature (96)..(96): n is a, c, g, or t
  misc_feature (134)..(134): n is a, c, g, or t
  misc_feature (160)..(160): n is a, c, g, or t
  misc_feature (172)..(172): n is a, c, g, or t
  misc_feature (175)..(175): n is a, c, g, or t
  misc_feature (202)..(202): n is a, c, g, or t
  misc_feature (235)..(235): n is a, c, g, or t
  misc_feature (289)..(289): n is a, c, g, or t
caaaaagaagacagtgtggaaaagaaaaggaataagagagaaaggagggggagcactccnnaaaggaagaacagcaagcgagaaggagagcgcaancagaggaagcacagaagcagaggaagcacacacagggnagcaaacaagggaggtctctcaacanaggagagccgcngcnaagaagcaaaaaaaagtcaagcaagcngagaaaaaaaggcccaccgagagccaatcgcgnagcagaaacccaagccaaaagacagccccgggggcgggagcaccagccaaaacnacaagcggaagaaataaccccctccaccccctcccctcccctcctcctcttctttctccaaatggagagagttcttttttttcttcttccatctcatctatt

SEQ ID NO: 571409 - DNA, 322 bp, Homo sapiens
  misc_feature (21)..(21): n is a, c, g, or t
  misc_feature (76)..(77): n is a, c, g, or t
tgagggagtttcactcttgtngcccaggctggagtccaatggctcgatctcggtgtcaccgcaacctctgcctccnnggttcaagcaattctcctgcctcagcctcccgagtagctgagattacaagcatgcaccactatgcccggctaattttgtatttttagtagagacggggtttccccatgttgaggctggtctcgaactcctgacctcaggtgatccgcccgcctcagcctcccaaagtgctgggattacaggcgtgagccaccgtgcccggcccaagaactcaaattcttaaagacacaatctcagaataacaaat

SEQ ID NO: 571410 - DNA, 408 bp, Homo sapiens
gttcgaggccagcctggccaacgcggtgaaacccatctttactaaaaatacaaaaattagctgggcgtggtggcgggcacctgtaatcccagctacttaggagcctgaggcaggagaatcacttgaacccgggaggaggaggttgcagggagccaagatggcaccactgcactccagcctgggacacagaatgagattccatctccaaaaaaaaaaaaaggaaggaaatattcactcggggtttcattcaataagcactcagggccgggtgcattggctcacgactgtattcccagcactttggaaggcagaggagggcggataacttgaggtcaagagtttgagaccagtgtggtcaacatggagaacccacatgtctactaaaaatacaacaattagctgggcatg

SEQ ID NO: 571411 - DNA, 118 bp, Homo sapiens
cagaagattgtagttaggaagcaaagcttagcaggagaagggaggccagagaagtgacgggaagctaaggttaaaacagatttgtgaactcagccaagcacagtggtggcagggccta

SEQ ID NO: 571412 - DNA, 654 bp, Homo sapiens
ttttctaaggaccccaacttctttattcattaacaaatataagtttcaaaaattgttgtaatgatgtaaatggctttttgaatccagttgagtgttttcccatcaggcacttcaaatgataatgatgctctaatttgcatgcattgttggaggagtcatccagttgctggcttgatccctgctaaaagagcataccagctgcaaattgacagaagaatctgatacacgtgaagatggggacttggaggctttatctggagctgcagctaccaggagcccccttctggtcttctccaagaactgcaccttggcttcatggccttaccttggcacctggaacatggactccttcagtatcttccagtacctggatccacagtgacacaggatgttcgtggtggacagcgagtgtcagacgtagggatcaaagacacacctccagacctcactccatactggccaccccgacaggagccttggatgaggctgctcatggctgtagatgacacaccaaggaactagagcttttcagatgccacctggccactcctgttctcggccatagcagtgttacttggtactgtcaatgtccactgcattctgtcaaatgtgtgtcatttaaagaccacaagacataacaaaaattaattcgtt

SEQ ID NO: 571413 - DNA, 609 bp, Homo sapiens
cacaggtcgtcggggagggggtgtccgaggcgacctgaacgcgaggatttggggcaaaaaggcacttcaaatgataatgatgctctaatttgcatgcattgttggaggagtcatccagttgctggcttgatccctgctaaaagagcataccagctgcaaattgacagaagaatctgatacacgtgaagatggggacttggaggctttatctggagctgcagctaccaggagcccccttctggtcttctccaagaactgcaccttggcttcatggccttaccttggcacctggaacatggactccttcagtatcttccagtacctggatccacagtgacacaggatgttcgtggtggacagcgagtgtcagacgtagggatcaaagacacacctccagacctcactccatactggccaccccgacaggagccttggatgaggctgctcatggctgtagatgacacaccaaggaactagagcttttcagatgccacctggccactcctgttctcggccatagcagtgttacttggtactgtcaatgtccactgcattctgtcaaatgtgtgtcatttaaagaccacaagacataacaaaaattaattcgtt

SEQ ID NO: 571414 - DNA, 518 bp, Homo sapiens
  misc_feature (223)..(223): n is a, c, g, or t
  misc_feature (283)..(283): n is a, c, g, or t
  misc_feature (448)..(448): n is a, c, g, or t
  misc_feature (481)..(481): n is a, c, g, or t
agagcacccggaacgaagagagctctgagcacgacctgctgggggacgaacccccgagctccaccaacaccccgggaagcctgcgcaagtttggcctgcaaggggacgccctgcagagccgggacttccatttcagcatggactctctgctggcctgagggggcggggctgggacgggggcgactgtcccgggcctcacggatgaaggagtatgagcgctacncgtgagctccttggagatcaagtgccacctgtgagaaacggcaaaccagcttggggcctnccctctttccccggtgcctccgtgaggcaacatgcgcccttggacgtcaaccgcaactgagagccctgggccaccgaagatgggcccaatgctggaggggaggagcttaaggcacctggacattcacagtgccgcagacatactgcgtggctgcagaagatgcangcagctgctgtgagcgctgcatgaagcgcctgngctgctggacggaggagacgccctctagcgacctagg

SEQ ID NO: 571415 - DNA, 1060 bp, Homo sapiens
cctgcgcggtcgttctctggagcagcgttcttttatctccgtccgccttctctcctacctaagtgcgtgccgccacccgatgcgaagattcgactggacactggcacactgcagcccccttgaggccccagaacctatcttcttcggttgtgaactaaacgcgccgaccaacacgcattactcactcttaacgcgctggcataactgactgacaacactgagccaccacgttactcttctaacgacacggctcagctctccacgcggcccctggcctgcacacagcgcacctgagcctccgccaacacttcgctccgcaacccccacgcacgcgcccacacctgcacacctttcaccccacacgggccacgctcccaaactctacaccgcctacacaaacctggcccacaccttttctcgcacccaatttgcctccctgcctaccccacggccccaccaccgcgcctcttcccaccctctggcaccgcgccgccccccctgcaccacacttaacccccccccccacccccacagctggcgctccctttccacccgcgcttcgcccacgccaagcctgccgactcacaaacacaggaccccacacacacgccccactcacttcaaaacgcatgcgcaccacagcccacccatccaaccactaaccaccctgcccgccgaacgcgcaacaccccacctgccccacaaccccccccccgacacacgcactcgcaccccccacaccacacgcagcaccgcgacacctgcccccgccaccaaccctccccatacaaacccgccctacctcaactcccttggcccacaccacacgacccggaactccacatggcccacccccccgctgtgcgacacgcgcgccattgtcgcctccaccccccacacaaggcggccctatcaccaccaaccaccaccaccaacaccatcacccaccactcctaccgcaaacaccctcttcgtacccccccccccctagcatactcacaaacccacgcaccttggagacactgcacccgcacaaccacgccccacccgcacacctgcc

SEQ ID NO: 571416 - DNA, 389 bp, Homo sapiens
gtagagtagcctcatttcatttgagttccctttatagcagcaacttttttcctgggatccttcttcgtgcgcttctaagtcagtgttagttttggaaggtttggccctgcataagttctgcatagcatctaatggcaaaatagaaccaactggtaatcacagtattatttagtgtggtttccatgacaacaaaaatacatacgaagaaaacttctcaggttactatgctgaaattccaaaatgtctgagttttgaatagcgatcactttgttctggtattgacgcaattatattaggaaaaaagttggttgactgtttttgtttaattgacttctaaaatgttcaaagtgtctagctctaaaagtttactaaatgcctagcgcagttaa

SEQ ID NO: 571417 - DNA, 869 bp, Homo sapiens
cagtcgtaattgctggtttgcccagagctgctgtgcaatgacttgatcatggcttctagcactggtcgtcctctaaactcctgggtactcaaaaacggaatgattgctcctatctcaatcctcttgagtgaatgcaaccgccagccttgtgccaccctctcctgactattttctactggtactctttgtagacgcagtgcgtttggttagtgcctatcgttgtgcgcctgtggcctgctctaaggatccttctggaggttcgaggccatctgcctgtctggtctctcccaggaggtctgacgaatggcgatggtgtgagcgactcacatactgatctgtgtcgaattctctataccttgtcatgcatcttgcggaatatatgcatacacctatagttctcctctggtgtagaattgcctaaagcgtgtcccgaactacaacaacaaagtgactatattatcagtccagtccttaaggttttcatctcctatagaaacagaatggctgcccccaccattttttctgtccagctcataatgttgtgcccttggtaagagtttgtgctgactactttaaatcctttaactatccctgaaaaaagtatttgaggacttagtaccactttcgtcccaagtacgggagtagtatttggtgcctgatccactcggtgtcctacaagtataggttgtgacttacacgagatactagagataagttacggttgcaacattcaccgaaattgcactgagaattatgcctacataattcaaacgcatcaattactttgacagagcctaccattaatcacaactgtttttagaccaattgaaaaggaaaaaaacacttctcgagtaatacagaaaaaaccg

SEQ ID NO: 571418 - DNA, 575 bp, Homo sapiens
agcggagtgggctgtgtgtgcgtgcgcagcgtggcggaggcggccgtgggccgcctgggcagaatgtcacgatggacgagggcggctacgcccctgctccccgacatgcctggtctaccagatcttcctgagcctgtggcccggccgaccgtgctggcctgccgggctaggtgtgcctgccaatggcaggcctgtgtcgctgggactgagttcctgtgcgagggagcagttactaccagctactaccaggtggcccgcgtacgtgctcccgacagcccagtcgagcatgtcctggtactgaggagttccagctggctgtactgacacggtgcccatgcagtggaggtgcagacagctgcagggaacacacagaccaggtcctgcacctcagacttctccacattccgggtaccagattcgtcgtcctggttccaaaggcactgcacctgatgaaggagtcatggaagcaaacgaccccttgaaccatctcgacttgccttgcgacacgcagctggacccattgctgagacccttacaaaccatgcgaggcctaccaagcccaggattcgtccaca

SEQ ID NO: 571419 - DNA, 422 bp, Homo sapiens
aaacccctggtctatacacgtggtattttggcctcaattcttcaccaggagtcactgagtatacatgaaatgacaattggatactgtatttgatagagaactatagttttgataccggggtatacatagaagcacgttgtttataccactaagtgactttggcggggctctcccatggaaacggatggcactacctgaagctccctggtcacaggaggatgaaaacgtgtccgtgggtgacatcaggtggtgtctccaccaccaaaagcagttagaagccaaggagattccttcatgtacctaggagtcattttgaaatgaaaatatagactataatttaaacaattaacgttctattgtacacattgcagggacttgatatttttaaagagctctactggtaggatatccttttgcttttg

SEQ ID NO: 571420 - DNA, 308 bp, Homo sapiens
  misc_feature (306)..(307): n is a, c, g, or t
cttcttaagatgaagactgctgggctgggaatgatggctcacgcctgtaatttcagcattttgggaggccaaggcagaagcattacttaaggtcaggatttcgagaccagtccaggcaacacagtgagaactcatccctacaaaaaataaaaaattagccaggcatggtggcacatgcctatagtctccgctacttgggaggctgaggtggaaggatcatttgagcccaggagtttggggctacagcatgctatgattccaccacagtataaaagcccccgcaacagagtaagaccctgtctcatnng

SEQ ID NO: 571421 - DNA, 274 bp, Homo sapiens
accacagctcagtggcagcaagcggtcggaaaccacagctgcctgcagcatatgtactcatatggcatttaacttacactgccttacgacctccactggtaccttcatttaacctgaactcacactcatccctatacagctgtgtccaggtacaggaagggaggacaagactattggatggatggatggatgtggagagcagctagatgttccttatagtaaggaagactctcagatttgcatgtcagtttctaccttggacaacattcagtca

SEQ ID NO: 571422 - DNA, 132 bp, Homo sapiens
agtatgtaccgggtcatggcctaattctggtacaccaagacacgagccctgctggccacactggtcctgacacagcagacaggccttgtcgatcacccatgcgaaggcgatgtgacccgggctgtgtggggt

SEQ ID NO: 571423 - DNA, 530 bp, Homo sapiens
cacgcagcaggtcagtaacagagacaggatgggaatccagccccatctaactccagagctggcctctttccacatcccctcgcttagagccaccagcatgaccgagaagccaaaacccaccaggatggcaagaggggacttcctgaacctgcctgccttccacctgctgggccccgcttggtgccgcttttctagtttactttaaatatgaggaggggcaggaaagaagccaaatgtctctcacaataagaaaagcccatcatctgcaagatcatcctcaggttggacagttccctagaaggattcacagaacaagttatgggctgttacactcacagttatagtttattacagtgaaaggatggagattagaatcagccaagggatggggcacatggggcagagtccagaagagttccaaacatgaagcttgctaatgtcctcctccacaaactcatggacagactaacttttcctagtagcaatgttcaataatactcatgaaatactgtcaatcagagaaggttaaa

SEQ ID NO: 571424 - DNA, 298 bp, Homo sapiens
tttttttttttgagatgggggtctcactctgtcacccaggctggagtgcagtgtcatgatcttggcgtaccacaacctctgcctcctgggttcaagtgatcctcctacctcagcctcctgagtagctgggattacaggcacctgccaccacacctggttaattttttgtattgttagtagagatggggtttcactatgttggtcagggtggtctcgaactcctgattacaagtgattcacctgccttggcctcccgagccttagcccttttgattccctgacatcaaatgctgtcgac

SEQ ID NO: 571425 - DNA, 338 bp, Homo sapiens
cgcatctccaggcttctccaagatctcccggaaattgctgttgctattcatcaggctctggagggtgcgtacctgataggacatgcagagtctggaagtgatgataatacttgaaaagtaccatacattgttatagacaaaagccatgaaagttatcaagccccaagcaatacattcctgctggagaaaactgcccagatgttgtgcatgacttcacaggatttacgacaaagctaaccaaggacatcatgaaagagatagtgaatacggcaaaataacaaaaaaaaggtaaagaccagaggtttaaaaaaagggaataccacaaaaaattaaagggg

SEQ ID NO: 571426 - DNA, 317 bp, Homo sapiens
aggatcctccttgctttgggacggcgtggacgttgtcatggagcgagcgagcactcgaggtatgccacgcgcgcacggactcgccatctctggccctgtggtaggtcacaggctcccatccggttcttcggagcttgttcaccagtgatttgttcttgcgccggtcagtcttgcaggccacggacgataatgggtaccttcttgcagaaatgatttcacttcttgggtaccacccggttaaagatgttgtcaaagcttgttcgggctgggtgaacaatcgaagcaaagccaacagaacgctggcatcaggggtagaa

SEQ ID NO: 571427 - DNA, 196 bp, Homo sapiens
gtactgtagatcgagcgcggtaccgactgcagtctgtgcctctcaactaaggcccagtagtgacatcaaccagttttttattctttgtttttgttggtcaatggggttgggtagttctccctcactgcagtgcatggtacaggctcctattatacaaagcaccccagggcatagttctgtactcaaaaatacaaag

SEQ ID NO: 571428 - DNA, 619 bp, Homo sapiens
  misc_feature (57)..(57): n is a, c, g, or t
  misc_feature (61)..(62): n is a, c, g, or t
  misc_feature (98)..(98): n is a, c, g, or t
  misc_feature (185)..(185): n is a, c, g, or t
  misc_feature (294)..(294): n is a, c, g, or t
  misc_feature (296)..(296): n is a, c, g, or t
  misc_feature (299)..(299): n is a, c, g, or t
  misc_feature (306)..(306): n is a, c, g, or t
  misc_feature (308)..(309): n is a, c, g, or t
  misc_feature (326)..(326): n is a, c, g, or t
  misc_feature (337)..(337): n is a, c, g, or t
  misc_feature (352)..(352): n is a, c, g, or t
  misc_feature (354)..(354): n is a, c, g, or t
  misc_feature (357)..(357): n is a, c, g, or t
  misc_feature (386)..(386): n is a, c, g, or t
  misc_feature (394)..(394): n is a, c, g, or t
  misc_feature (397)..(397): n is a, c, g, or t
  misc_feature (405)..(405): n is a, c, g, or t
  misc_feature (425)..(425): n is a, c, g, or t
  misc_feature (432)..(432): n is a, c, g, or t
  misc_feature (447)..(447): n is a, c, g, or t
  misc_feature (460)..(460): n is a, c, g, or t
  misc_feature (468)..(468): n is a, c, g, or t
  misc_feature (471)..(471): n is a, c, g, or t
  misc_feature (474)..(474): n is a, c, g, or t
  misc_feature (505)..(505): n is a, c, g, or t
  misc_feature (536)..(536): n is a, c, g, or t
  misc_feature (542)..(542): n is a, c, g, or t
  misc_feature (556)..(556): n is a, c, g, or t
  misc_feature (595)..(595): n is a, c, g, or t
gttgttttgggcacatcaatgttgccacagggtcctcgcagcagctctgccagttgngcanntgctgcaccgtgctcctcctgtaacggtgagggggnagtgcagccaagctcgctgcgcaggctccgctccaccatgcggcccagggcccgccgacagctccttcagcaagccgcacggtacgngagtaaccctccagccgcagaaaggtcactgtcagctcagatgagatggtggcccggcgcccgtcatcacggatgtgcaacagtaccccgtcggtcagcagcagcaaananagngggtagnanntgagaggagtcccggangaagacgctgncattggacttgaatncnatnaaatacagatcagccatcggctccgtaancgtgtggnctncctagatnaatggtacgattgtgcaganaggaatnttgcctgaattggtncttaatgtgaagntgttgggnttnaanttcccctgccgggtgaccttgccctgcctcnactggatgaagttggggtaaaagccggccancaacangcccttctacaacncctcctcctctatgttatcgttgcaatgggcggaagccnaggtgccatccggaggcttccccc

SEQ ID NO: 571429 - DNA, 663 bp, Homo sapiens
attgattttaaaaaaaaaaaaaattaaaaaaaaaaaaaaaaaaaaaaaaaaaaaaaaaaaaaaaaaaaaaaaaaaaaaaaaaaaaaaaaaaaaaaaaaaaaaaaaaaaaaaaaaggaaaaaaaactttgtggcccccttggcccaagcgatttttaaactgggccaggttttttcctgggggccgaatttggggccatttggcccatttccccttaaggggggccgtttaaaatttaatggcccgggttttaaaaaggtgggactgggaaaaccctgggggttccccatttaaacccctttggagaaaatccccttttccccagtgggggaaaaaccaaaaggccccgcccggacggcctttccaaaaagtggccaaccctgaagggcaatgggaattggaaggcgtaaaattttggtaaaaatccgcggaaaattttggtaaaaccgcccattttttaacccaaaggcccaaattgggaaaaaccctttaaaattcaaagaattaccccggaaaggggtggggggttgccccatttggaaacaggggcccctttttaaggaacggggcttccaccttaaaggggggaaaaccggtttttaagggcatggcccctttaggggaccctatcccttaaaaaagtttttgggggccaaggggcccg

SEQ ID NO: 571430 - DNA, 285 bp, Homo sapiens
tggatacactgctgcatttcaagtttattttctaaaaggaattcaagtttattagttccattccccacaaaatacatacatttctacgcatttctaagtagatagtttcctggacagataaccccagaccatgctggtgcacaggaatgggtcctgtctacctgtgcacaaatgagaccccccgtctacagcaaagcgaggtttccaccgcccaccccccaatttaaattcacagcatttcgcatggtggaaacagattcatgctcttgatttgtccactagttc

SEQ ID NO: 571431 - DNA, 190 bp, Homo sapiens
tatgactgagcttcgtgtatgactgagcttactagaagtgtgaaaactgtaggcttggattaagtgcgacagtgatttctatggatagtcatgtagaatttagaattgtgaagattgataagtgtagaagggaagggtaaatggttgatattgctagggtggcgcttcccattaaggtgctgagtagggt

SEQ ID NO: 571432 - DNA, 313 bp, Homo sapiens
  misc_feature (184)..(184): n is a, c, g, or t
  misc_feature (193)..(193): n is a, c, g, or t
  misc_feature (235)..(236): n is a, c, g, or t
gctaccgggcctgggtagtagaatggaaattaaaattaaagggggaaaaggataagatgcaacattggactgcttttaaaaaatgaacttgtcgggcatggtggctcacacctgtaatcccatcactttgggaggcttagcgtgggcagaattacctcgaggtcagagacgttcaagaccagcnctggccacncatggacgaaatcctgtcgtactactaaacattacaaaaatnntagccaggcatagtaggcgcacgctctgtatatcccagcgtatcccaggaaccgggggatagggtaccggagctcga

SEQ ID NO: 571433 - DNA, 102 bp, Homo sapiens
gctgcggacacggccgtgtattactgtgcgagagaagtccatgtacatacagtgctactgactgcaataggagaatcgcgctatgatatctggggccaaggg

SEQ ID NO: 571434 - DNA, 284 bp, Homo sapiens
  misc_feature (20)..(20): n is a, c, g, or t
  misc_feature (83)..(83): n is a, c, g, or t
  misc_feature (117)..(117): n is a, c, g, or t
  misc_feature (135)..(135): n is a, c, g, or t
  misc_feature (139)..(139): n is a, c, g, or t
  misc_feature (158)..(158): n is a, c, g, or t
  misc_feature (170)..(170): n is a, c, g, or t
  misc_feature (174)..(174): n is a, c, g, or t
  misc_feature (210)..(210): n is a, c, g, or t
  misc_feature (221)..(223): n is a, c, g, or t
  misc_feature (255)..(255): n is a, c, g, or t
  misc_feature (261)..(261): n is a, c, g, or t
  misc_feature (276)..(276): n is a, c, g, or t
tagtgggggctgcagcagcnggacccaggtgcggaagtacgagggcccaggtggctgaaggggccgtaaggaacatccaaccngtggggcacaggcagacccccgacctgacctggnccacccttctcctcttgncccncccctccaactcgcctccncttaggtctggnttcnccccgccccctgacctgagcctgcgtccttcttcangcactcacccnnnacctccggtggctcccccatctctcacgcgcnacggcnacgggcgcggatctncgggacat

SEQ ID NO: 571435 - DNA, 698 bp, Homo sapiens
taaaaccctcatcaataaatggaaacatacaaaaatagtcaaaccacatctacaaaatgccagtatcaggggggggtttcaaacccaaagtgatgttgggatgtaaagtgaaatattagtggggggatgaaccaaatagtgaggaaagttgagccaataattgacgtgaagtccggtggaagcctgtggttggctacaaaaaatgttgagccgtaaatgccgtcggaaagtggtgaagggagactcgaagttactctgaggcttgtaggagggtaaaatagagacccagattaaaattgtaataagcaggtgcttgaattatttgggttccggtgtgttttctattagactagttggtgagctcggggtgatggacactccctgagtgcgagataactacggagtgtgttaacggaggtgggacttctaggggatttacaccggcgtgactgccttgtggggggccagtgccctccatagttgggggggctaggggcataggcgggaggggtcaaagggctcagaaaaacatccggcgaagaaaaaaacacttcggaggtcacaaactaggattatcccgtatcgaaaggccttttgggacagcgtggctgtgtggacggcctgggaatgtgccccccggtgtaacatcgagcccacaatggcacacgggcacgcgtgtgggaacacaggcctcaaag

SEQ ID NO: 571436 - DNA, 196 bp, Homo sapiens
cacagcgctgggatactggacttgagcacgtgcccagactgtaatcctcattactagtcctttggagtctcatattacgctgctattgtgtccaaggtccgtgtctagctgggtggaggagtctagaccacaactttggagttcactcagtgcctcatcagtccatgtctagtctggctatcttggagctgaggag

SEQ ID NO: 571437 - DNA, 360 bp, Homo sapiens
  misc_feature (36)..(36): n is a, c, g, or t
  misc_feature (194)..(194): n is a, c, g, or t
  misc_feature (203)..(203): n is a, c, g, or t
tgcgtgttggctcatgcctgtagtcctaatactttngggggctgaagtgggcggttcacttgagcccaggagtttgagaccggcctggacaacatggtgaaaccctgtctctgcaaaaggtgcagaaattggccgagtgtggtggtgtgtgcccgtagtcccagctacctgggagggagtttgaggtaggaggntcagttaancccaggaggtcgagggcggtgagccgtaatcacaccactgcactccagcttggacaacagagcaagactctgtctcaaaaatgaaaaaaaagtataccagcactattgttcagcagttgggatacagtggacaaaaccagcaaaaagccttgccttt

SEQ ID NO: 571438 - DNA, 149 bp, Homo sapiens
gtccctctcatccccctgcctgggtatggtgtttgacacatcttcccagtataggtgccctcgtccctatagcaaatcatgaaaaggacccaaactaaattttgggcccccagaggtcccgtggggggaaaggggctttttggggggaa

SEQ ID NO: 571439 - DNA, 113 bp, Homo sapiens
taattacgtatgtcacttctaggagttagatggtgtcctgtcgtatatttaacgtctttcagccatttggagtttatttttggtgcatggtgtgagggtgtgttctcagtttc

SEQ ID NO: 571440 - DNA, 360 bp, Homo sapiens
aatctgcacattacactgaggatgagaaaggaaaaaaaaaagactcccaggctaatagggcatatccttccatacacacacagtcttcgctgtcctctacctctcgacaaaaaacaaaacaaaacaaaacaaacacacccataaatagaatggccaaggctaattaatggacaggaaaaagggtagcacaggataacatgcacatcctgccaaagaagccttcatctcctctggcctaatatagatagggtaactcaagtacatggatgggtcatggatgatagttgcaagataggataaatcaaagagtcatcactaaaatataattgtattctaaggacagtttgcgtgcaatgaagc

SEQ ID NO: 571441 - DNA, 1097 bp, Homo sapiens
cactccataacgctcctcatactaggcctactaaccaacacacataaccatataccagatgatggctgcgatgtaacgacgagaaagcacataccaaggaccgagcacataccaccttgtccaaaaaggccattctgatacagggataatcctatttattgacctcagaaatttttcttcttcgctacggatttttctgatgccgttttaccactccagcctagcccctacacccgccaattgagggatgggcactggacccacaaatcaggcaatcaacctccgctagattgcccgcatagaaagtccgcacatgctctaatagacatccggtaagtcactcagcatcatggagtagtcaatcagactagagctcgccataggtcgtatataggaaaagagcaactcggaaaagacgaaataaatataccatatgcagttagactatagtgtcaacaaattatgtaactggtgggatctctatatattaggcacatgcctcatcaaggcactacagcagatgaagtgtccgagattttggcttgtgcaccattgtgcccagatgggatgatgacgagagtgctaaaagattttttggtaaggcacacgaggggcttgcaaacaggaagtatttcaacgtacgattcatgggtggtacgaaagtattggctgcatctgattctagtctttgtatccggaggcaatttgaataattttcacttttacatctctaatcaatctacttcgaggagatcagatcggcgcgccaggctggaatacctgagtcattttcgcatcacttgtagggatatgacttattaactggtattgtttaccgaatctgactttgactggaaggaggggtccattggaatgcaaggaaccttgataccagcaactgatttaggatactaaagaggggacataatccggggggggagacacactcttggagccacgctggtaaaaaaatccgtttttaataacaacaaacgttggttgtggctgttcccgtgatctggctagttaaatggttatccagtggaaagacagtagaatatgtgtaacttttcagatcaagggaatctgttctgctg

SEQ ID NO: 571442 - DNA, 115 bp, Homo sapiens
caaatttgactgtgacttaatctaaattactatgtaagcacaaagtagatagtttcactctttaaaaaatccattactgtttgcattcaaagttgattaaagggtgtactgacta

SEQ ID NO: 571443 - DNA, 351 bp, Homo sapiens
ataaaaatatcagctaccatttaacggggcctgtccaagataaccagcatctctgcgatcatcggtgctggtctaatacttccacggtcatcctctcaacaacccctcgaggggcacatactactgtcatcatcccccacagtacggatcgtcatgggaggcacaaacaggtaatgtaacttgaccaaagacattaactagtcttgtgtcagaacacacattccaactcgtgcacgtgttttcaaatccttcacttgggcatgtaattgtatttcttcacatcttttcatgacacttaatcgttatctttttctcttctaaaacagaaacagggtcccgccctgccacctg

SEQ ID NO: 571444 - DNA, 522 bp, Homo sapiens
gtgccagtggtggatccccaggaggaggagcgaaggcgggcaggtggcggggcagagagatcccgtggccgggaacgtcggggcaggtgcgccagtccccgagggggttggccctctctatcctgctggatcttaatgatgagaacagcaaccagagtttccattctggaaggttccctgcaaaagggcacagagcccagtcctgggggcaccccccagcccagccgccctgtgtcaccctgcccggacccccagaaggggtccctgaggaggctcaggccccacggctgggcccaagagagagatcccgggggcataactgctggcaagcaccgacgaacccccaattgctgaccaaaggacggaagccttgttttccaagaaccttgcttggaaacgctggaggccccccgaagctttaccctggtctttgagccaggtgccaacctgttccccttgaaggcaagcccaagggttgaccacagaggacctcggagggttgccccccgactcaagcgcatt

SEQ ID NO: 571445 - DNA, 304 bp, Homo sapiens
actgactcctttaatgtctcttcatgtatctcatacatgcctttgacaaacatagtataggctgctggcttctggcattctgttatcccctgggtccttgcaactccagcctgattgctctgttcctcaatttcccttttattacaggagtttaaagcttctttatcgtcttccaattatgcaaactctattaatgcatatccctttaaatatgcctatttggttctggggtactttgattaaagttgctgtgctctaactcggtaacggagctcacattcgttatacctgtcgtagtctcttt

SEQ ID NO: 571446 - DNA, 121 bp, Homo sapiens
tcactggtcgcagcgggctcaccaagaccctggcttcccctatgcagccgagctccccctctgcatagatcccagtattcctttgccaaattgaccacaaaggatcctttctctgtttcct

SEQ ID NO: 571447 - DNA, 371 bp, Homo sapiens
  misc_feature (14)..(14): n is a, c, g, or t
  misc_feature (17)..(17): n is a, c, g, or t
  misc_feature (94)..(94): n is a, c, g, or t
caccttgacgagtncanaaacttcccaaagctcacccaaaatatgctccagaactggcaaattcccttctagcctcagatgcttcaatgaaatnctcacctttcttcttgcatactgaaacactagatttttctgagaataccaaaccccttccaccctctcacaaagtggctgtatattctaccctcctcccctgcacttcaggactcagaagtggagtactgtcctccttaatcctcattactattcctagattactaggccaccacttccctcacgccttagcactgattactacattcttgttatgcctggagtttggtccacaagtttggttccttttgattacatccaagttcaaaagtaaaagt

SEQ ID NO: 571448 - DNA, 489 bp, Homo sapiens
atatcttcctgtaaaggagagaaagaaacctatctctgatactatctcaaagacgaagggctaaacaagttgtctagttatgaagcaacaaaagatcacaagcagtttggaatactactgtctacgccttcttatagatttgagagacatacaacatgctgtcgtgaccagcggataatcctgtggtggacctggagacccttcaagctctctatgagaatagagcacagtcagacgaactcgaaaaaatagaaaagcatggccgatcttccaaagacaaggaaaatgccaagtctctggacaaacctgaacagttcctttatgaactgtcactaatccccaacttttcagagcgagtcttttgcatcctgttccagtccacattttcagaaagcatttgctcaattcgtcgcaaactggaattactacagaaattgtgtgagacattaaaaaatggcccaggggttatgcaggttctaggttaggttc

SEQ ID NO: 571449 - DNA, 114 bp, Homo sapiens
gcacaccgtgccacactgcatgggaccccagaatcacacagctccacccagccatgccctgtagagtccatgcacaccgtgccacactgctagaaccgccatgaatcacacatg

SEQ ID NO: 571450 - DNA, 1279 bp, Homo sapiens
ggtcgagccagcaggagcagtggttggaataggccctacgagacaaggaagggcttcaatcgatctaagcgagactgcaacggtaggatggccgccatgatcgtcgtctcgcggcgctgttagctgcacgcagggatgtatggtaggaaccgaggaccagtgtcactgtacggttggtgctgagaagcattagcattggtacctatcatgatgaagcaatgccggactcacttctccaaagctatgttctatccagaggatcctttactcagcgcttatcaataaagcagggcaaggcggatgataacatatgttgcgcactggggagaactacaacttgagggatcgcaggccgattgtgctagacgagtgtagcaaggccgctcctgttgagaggttgtaccatggtagcatgccatgaggttagctatcctgtgacgctggaaagcgctcaataaaccgatgatttctcgactcgtgggattagcagtccagaccatcggagggaaccgatacgccaatgtctgttgtctcgggcgtacctcattcgggaaattattccacttactgaattttccatgtcgggatgaaaattcccttgaagcaaacgagagcaacgcaatctcggggtggttggggaggggcttgggggcctcctggggcccaattccatttgccaaagagctccaagtgggtttctccttgccaggcacgcacacgatgcatgccttggattgggacacggaagattgggcgcgattgagccataagagccatttccggggaacgcggaaggttccattggggcatctctgggaaaccaacgtcaaggaattgggcttagggaaaacggaacgaaaggtaacaaaccgggagacctaccaagaaccttgggggcaaggggggccaaccaaagttgcaaacgcccacatccgcagacgaaggccaagcggtcggggactctccgtcgggaaattcccgttaaccctacggcaagatggaggaataagggggggaggaagtaccacagggggaaaggaaaaaacccaagagggctatccggcccgaaggggtcccacgacatgggcgcccgccaaggcgcagagagcaccccgggtgaaaacggcccaagggtggcgccacacagtgaggcaaggtttgcctgggggcccaactaaaggcaaggagcaagcgcccttccaagagtaggcggccatggggcagggacacagtggggacattcagccagaggtgcgcccagagggggcagccaggaagg

SEQ ID NO: 571451 - DNA, 1579 bp, Homo sapiens
  misc_feature (234)..(234): n is a, c, g, or t
  misc_feature (388)..(388): n is a, c, g, or t
  misc_feature (496)..(496): n is a, c, g, or t
  misc_feature (782)..(782): n is a, c, g, or t
tggcactaatgctgctttataatggcggcgcaatagaaaagtacaaggttttcacttagcctttgagcttactagaaagggtgttaaaagattgcccgctgtgacacttaccaagttagccctcttaattagaaaaagtgtaaaaaatattacaggaacacgggtgtggaaagtgagcctcttgaaattatactagaggggtgacaaaagaagtttaaacgtgccaacacccgngccactactcgatgtggtcacttgtgtttgtggagagaacaacatcgtggttgtgtggtccgtgggtgaatgaagtgggtttatatcttctccctttttaagagtgtgggtgtgggcacaagttaaacgagaacaaatatttgtgttctctccnccagaaaaagttttgtgccacatatctctctcgtgtgtgtttcatatcacacagcgtttctctatttctcagagttcaccgacagtggccccaagcgtgtgtataaancgctctgtgtacaggagaaaatctcctctcactgtgggagtagtatatttctccctaggaacatagtgtgggtcgctagtagggtgtgtcgccaatgtgtgtgtgtgtgctctgtagacagagcgctcctccaaagacacagcggcttttggcctttctctatatacaacgcaaatctccgaaaacgtgtgtgggtgtggagcgccgtatataatgtgtgcgttttaagacaagacgacacaaaagtataatttaataagcccagaggtgtgtgtaatcttccccnttttttcccggtaggtattttctccgccgctattataccacatgttcggaaaaagcccccattttttaaagagcatctcctttaaagagatctcccctttggtctcccacaggggtaaatttcctcgggggggcgtttctaccacaacaagctgttttggcgggggggcacacgaactgcggcgggctaactggttgttttacaacaacaagaaacaaccacagaggaaacaagagcggtcttctcctttgtgggcgaaaaaaaaaaacaaccctattctccacaaagagggttgcccccactataaaaaggcgccaaatttgggcgggggccataaatattggtttgcggaaacgaaggccttcccttccttttctcccgcccagaaaaagcaaacagcagtgatttttgtcccccccccacttggtgtgccgcaggctgtggaagcaaatctctcatcatcaacagaagagagtcttgttgggggcgcccccacaacatttatgtgacgctgcgttattacacaccagcgcggcttctctgggtggtgattaccaaacaacacacaactgatgacgtcccgcatggggtgagtcaattttatcacactccccccttgtttgtctccgcccccaaacaaggagacacaacggtgctgcccgtctccatagtttgttcccgccaaaacaatatatctacttacatatttgttgggttgctccaacaccaaacagaggcggcacaacagatgagtagtgttgaaccaccgggtgattgctcacccttctgattgataa

SEQ ID NO: 571452 - DNA, 412 bp, Homo sapiens
gagtcagagtggagagctcagtaagccgtctgatgcactgctgctggcggtagccatcgcggcgcatgttgccctcgtttttgcggtatccgttccttctggatctcggaagtagcccccgtaggtgccctgcttgtggtcaaacacccgttcgttgttctccaccaggctgcccagcttctcggccagctgcagagccaggttctgctgggcagtgggctcagtgcggtgcatcaccactgtctgtgttggctggtccagggaggccatcagctcctcattaatgatcattttgctgatgatggagtgcacagtgggcagatccagctcaaacatgtctgacagcgtctccatgctgatggagtcatagacactgctgtaggtgaagaggtaggtcctcagtgactcttcc

SEQ ID NO: 571453 - DNA, 407 bp, Homo sapiens
  misc_feature (115)..(115): n is a, c, g, or t
  misc_feature (135)..(135): n is a, c, g, or t
  misc_feature (143)..(143): n is a, c, g, or t
atcgttcgtcagtcgagctgctctaagaagggaacccccaaatttagttcaagccttaagcacaattaattaaaagtgaaaggtaattgtacaagcagttaatcacccaccatanggcatgattaacaaagcaanctttcccntcccccgagtgattttgcgaaagcccccttttgcccttcaggctgcgttagcatgttccgaaattctagaaaggcttaaggcggccgtacagaaaaaggaaaaaaggccacaaagagttccctctcacttgtcaggtaacaaagtaaataaaacagcagcagcaaacaagataagaatgaaataagagaaacaaatgaaataaatatggtgttgtgcagcattaaaaaaaaatcaagataaaaattaaatgtgagcaaaggaaa

SEQ ID NO: 571454 - DNA, 352 bp, Homo sapiens
tactaccattaacaaacaacccccacaaaaaaacaattataattcaatatcttccatactaatcatgttacttcttacttctatgtctttagctataatcatcattgtactttgtaaattcttaattaaaccatttttaaatgatcaaaattgttcatttatatctccatttgcttatttagaaaccccttacatttgtatggataacatcagagaaaatgaaatatccacaaaacgtacatcaatcatttcacttacaccctggaaaccaagcaaaagcacacttttagcagatgacttagaaattaagttgtttgaatcaagtgaaaacattgaagactccaacaacccc

SEQ ID NO: 571455 - DNA, 184 bp, Homo sapiens
ttttaaaaaagttttaaagttaaaaaaatgttttttgcagtaaaaaaaaagttttttgggccggggggggggggtcacccctgtaatcccagccccttgggagggtgaggggggaggatcattttaggccaggagttttaaacccgcctgggcaaaaaaaaaaaacttcctttccagggagaga

SEQ ID NO: 571456 - DNA, 438 bp, Homo sapiens
aagcgcacgatggcgtctgctgtcaaacaggccactcggctctaccaatcagcaggatgtgggtggggccagataagagaataaaagcaggctgcctgagtcagcactggcaacccgctcgggtccccttccacactgtgctttgttctttagctgtttgcaataatcttgctactgctcactctttgggtccacgctgtttttatgagctgtgagactcacatgaagatcagcagcttctttcctgagtggagaccacgagcccaccgagaggaaggaacaactccagacgctctgccttaagagctgtaacactcactgcgaaggtctgcagcttcactcctgagccagcgagaccacgagcccaccagaaggaagaaactcccaacacatctgaacatcagaaggaacaaactccggacgcgccatcgtgcgctt

SEQ ID NO: 571457 - DNA, 296 bp, Homo sapiens
tggcattggaaatatttcaacacagcaagtacaaagtagatttcatagagacgaaggcatctcagaaccctgagagaatagtcaagctacacagcataggtgacttcattgatgtgagtgagggccctcttattcccagaacaagtatttgtttccagtatgaagtgtcagcagttcacaatcttcaacccacccagccgagtatcatacgaagattacagggtgagtctttacctattcacttaagagcacatttaacaaaatgggatacgctattggaaagatctcggaaaatg

SEQ ID NO: 571458 - DNA, 247 bp, Homo sapiens
gacctagaggatccggtaggccggagacagagggaggggacgccaggaagatttaaggcctacggaccatcagaagtgcggcgaccagaggccattagaggtggtggtaacagcaggcactagaagtacgtggtacccagaggtgctacggggagctgacgccttccctgctgaggcaagggaaaaccaatcatcttgtgcgtcctcggcccttaccggggtaccggaggctcgaaattcggtaaat

SEQ ID NO: 571459 - DNA, 398 bp, Homo sapiens
ggacgagcatccttaacagccaaagatggtaaaggcatccttgactcccacacaatcggtaatagggcctatggcttccatgggccaaaggtatctggacacaaaccagtctggtcctttctgcagatctccatagccactgggactacggtggccgctcccgatttccggttctttcctctctccacttccttcggcatccagcggtcaatacggtcatctgaaaatgcagatcacatggctcggcccggcttccatgactacttagaatacagctcatctccagtatggtcggcggggtctcagttcataccactctcggtggtgtactttgctccagcctcactggaagaaaaggttggcttgctataaacactggtaaggatgctggtgcgggg

SEQ ID NO: 571460 - DNA, 946 bp, Homo sapiens
ataaacttcgccttaatttaaataatcaacaccctcctagccttactactaataattataacattttggactaccacaactcaagggctacatagaaaaatccaccctttacgagtgcggcttcgaccctaatatccccggccgtgtgtccctttctccataaaatcttcttagtagctataaccttctaataatggatctagaaatggccctcctttaacccttaaccatgagccctacaaacaataaccttggtgccactaaatagtatgtcatccctcttataatcatcatccatagccctaagtctggctaatgagtgactacacacagcggactcagactgaaccttaaaaaaaaaacaccccacatcacccaaaaacttttgtgcggccgccagcggcaccccgaagaaggctcatcaaccccctcgcgttgggcccgcgggccccctaagagacaacacaacaccgtggcccaaacgggtccacacaagaaataacgcgggacaggacaccccagggggcggaatctccccaccaaaacaaaaaaccgggcgcggggacaacccggccttgttctcggacaccacccgaagtggcagtccagagagcaccaaacggggtcacacaccacgggcgcacaagcgacagaaataataccacagctcggtcggtgagaatctcacaccgaaacagcagagcatatcaaagcgcagcacaacacaacggaagccagaccagggaccacaaagagccaacagcaggaacagaagaagcggagcaaagagggcaaagcacgcacgacagcgagaaacggaagccgacaaggagagcgagaacacaagagacaggaaccagacacagcagaaagacaggaagaaagagcaggagagaacggagaaacgaagaaaacaagacaagaaaaaaaaaacgggcagaaacag

SEQ ID NO: 571461 - DNA, 991 bp, Homo sapiens
ttttgtatgctaaattcatcagcagcgctcagctcatactgatattttaccgtgagcaggtcgctaaagataatgatgttagccttttattgccaggttctagaccattacatacacacatcaaactcctcgattccacagacacgctgcaatacggagtattgacctcatcggcattgcaacacggatcctataattccttcttatcagctgatcctgcttccagcgaataataccgtcgtccaggacatagtgaagccgataaccgaaatagtaccaatacacaattcatacagttaatgatcattaaatgtgccttagttagcattatcaacgtaggacatagccccacatttcgacatctcctgagtccgcgagtagggttaccctaagggcacccgatctaatcatccggccctgctttcttcatctacattgaacatacacaactaagcttcgctatttcgaatcgattattatccatatctctcccatcattaagacgtaagccattgcatctcgtccacctctcctgctaatctttatcctatcgattaagcagtgccgtttgagcgtgggcattactacccatgagcgcagctgacgcgataaatcttcagcatactaccgtcaattaccgcgacgagtgatggatgcacataattagcgaaggtgccttacctgtagcaaacctcataccatgagatcatctctgttaatttacctatttagtattatccgtaaacgtactaccgtcattcctacatagtcaatttaaactccaggacaacgagcctactactatctcgctaagtgagaaaaagctagcaatgagtaaggacccttgatgcgattcaccttggtctcctaggaggcctgccccgttaacgggttttgcccaatggcttatttgagactttccaaaacaatagctttaatccgaacatataaagccccataacctctttagcttaatttcaagggaattatc

SEQ ID NO: 571462 - DNA, 384 bp, Homo sapiens
gagatcacatgcggtttaattgtgggaggctgagagcagcatttttaccaaattggtgtaaaaatgaaacggggtccagacgtgtacactgacagttacagtaaatttcaaaatccaagcagcaatttgaatcatttcttgaaaaacaaacacagacaaacaccaaacatggagttggtgcccggcgccgggcataagggcagcaccccacgggtggctgtgcggggggccgctgggtgtggccggggaaatgggggcagagtgcgggacccacacgctgcctgaggagtcttggcagggtggacaggcctgggggtctctaccagcaatgcaataaatatgcaaatccaagcacagaaagaccaagcgcagaccccacgggcg

SEQ ID NO: 571463 - DNA, 373 bp, Homo sapiens
aggagcttaccggttagaggaggaagcggaaagtagtttgagtaactacttggttcatattaccccccttttgttctctcagtttctcggcccctctaccaatagggcagtagcctcctgccctggatgggtataaggtgggcttggtccaacaggttcccagagggtacatactcctttctggggagagaatgctccctaccatatagttgacagtggttaggaactctccctttccctacctaccttccttttaatagcagaattcctatttttcccttgattatgtgtatggatcaccctgcaatcctattatgtatctgagtgtgtgtgtgtgtgtatgtgtgtgttatgggggtggggataccagggg

SEQ ID NO: 571464 - DNA, 425 bp, Homo sapiens
cgtcgtgaggcggcatgggaatggcctggctgcctgtggggcgttcaagaagagcagcaaacccaaccggaagtcgggtggaatatccgctcccttggggacctcacccaggccctactgggccgggatgttctggctcaagacacactcgcacagttcacagactttggagcctggcctgggggaagttttggagcctgccccgggggaggccgaggttggaagaacccttggtgggcagccagggcaggttttctggcacctggcacatagtaggtgctcaaaacatgtctgttggaaccgaacttgccacccctaaggcagccctccccatctttggatgtctcaccttgggggtctagaaaagccccgctgcgcgaacctgcgccctttccttgtactctctgctttgaccttaagcagaa

SEQ ID NO: 571465 - DNA, 114 bp, Homo sapiens
ctagcctcattcaggtcttgcttatgtcaccccatcagataccctttctggaccactgtatctagaatagcatcatctatgctccttattcccttatctgatcatccttatgtg

SEQ ID NO: 571466 - DNA, 123 bp, Homo sapiens
tttcatcccgctcggtaccctaggctaggtgggaggattacccaatccctgtggagtcgaggctgcatgtgagctgcacaccaatgcactccagcctgtgttgagccaagatcacaccattgc

SEQ ID NO: 571467 - DNA, 1411 bp, Homo sapiens
  misc_feature (175)..(175): n is a, c, g, or t
  misc_feature (313)..(313): n is a, c, g, or t
  misc_feature (943)..(943): n is a, c, g, or t
tggtcccctttaaaacaacaaaggaaaaaacaaataaccaaaaatagacaatcgaggctctacacccgtgcggggttcccgtaggacagtgctgcatattgaagaaacgcggtgcagcagccccccaaaggcagacgcggcgcgcattgcagaggtcagagcagactccaggcangcatacatcgggcctccagtggcctcctcgcggccgacaggtgagatgcattgcgttgcggggagacgccggggcgcgggtggcgcccaagacaatttctcacacggcaggggactggcctcttcacaaagaagcatnttccttcctatcacccacacgggggggcgcaagggagctcagtgttcgcccttgagaagtgttgtgtcatatcaggatgcccatatgcatttcgtagacgacaagtgttttcacgaagggcgtcttgaatcgagtgatggaagcgcgtttccactttcacgcgagcgcgtgtgtgtgaccacttcgaaagatgtggggtttctcccacaaaggtgagagcgcgttataacgcgtataatatacaaggggggctctttaatcacacgaggggatctccagcggggtgtgagacacaaaagtcgttgggggacacaggtgctggttttgatgaaggcgtaggagagagttactccgatgcaagcagcgcctttcactatctgtttccgaagagtacacagtttttccgaaaccacatgtgctgtgatgggccagcgtgttctttcaaatccacgttcacgagaaggcggggacaacaggcggaggccttccacggacgcccacaatgttgacctcagatacgtagtgagaacccccccagggtgggtgtggtgaccaacggcttttgtgggatatttgacccccggggggagcaccccaaaggagaaagtaccgctctaccgaaaacactgngagggggggacataaccagaagggatccccccagacggcagaaataaacacgggggggtattagcaactcgacaagaggtgtccccgctttacaaaaaagggagtcccccatcagaggagcgtaataatgtaataccagcagcaagcacgtggggcatccgcacggggcaaaaaaagctctccccgaaggggagggcgcccagagtgagaagacctcgtgtaggacaaccctcataacacacggaggggggagtagaacaaacgcgccgatgtagagaactccccagcagatgtgagaccaccaaagtgcaaaaatgtggggcgaccaactcggtggggccgccaaaaacatgaaacaaaaacaggacgaaggaaataatagtggcgggcacagacaccacaccaccagaagtggtgcgcccacaacaagagcaaatctccccacgaaagggggcgctctttcaccaa

SEQ ID NO: 571468 - DNA, 888 bp, Homo sapiens
  misc_feature (1)..(1): n is a, c, g, or t
  misc_feature (98)..(98): n is a, c, g, or t
  misc_feature (123)..(123): n is a, c, g, or t
  misc_feature (131)..(131): n is a, c, g, or t
  misc_feature (133)..(133): n is a, c, g, or t
  misc_feature (139)..(139): n is a, c, g, or t
  misc_feature (144)..(144): n is a, c, g, or t
  misc_feature (155)..(155): n is a, c, g, or t
  misc_feature (235)..(235): n is a, c, g, or t
  misc_feature (240)..(240): n is a, c, g, or t
  misc_feature (283)..(283): n is a, c, g, or t
  misc_feature (287)..(287): n is a, c, g, or t
  misc_feature (294)..(294): n is a, c, g, or t
  misc_feature (302)..(302): n is a, c, g, or t
  misc_feature (323)..(323): n is a, c, g, or t
  misc_feature (393)..(393): n is a, c, g, or t
  misc_feature (396)..(396): n is a, c, g, or t
  misc_feature (423)..(423): n is a, c, g, or t
  misc_feature (458)..(458): n is a, c, g, or t
  misc_feature (476)..(476): n is a, c, g, or t
  misc_feature (486)..(486): n is a, c, g, or t
  misc_feature (488)..(488): n is a, c, g, or t
  misc_feature (490)..(491): n is a, c, g, or t
  misc_feature (503)..(503): n is a, c, g, or t
  misc_feature (515)..(515): n is a, c, g, or t
  misc_feature (517)..(517): n is a, c, g, or t
  misc_feature (533)..(533): n is a, c, g, or t
  misc_feature (577)..(577): n is a, c, g, or t
  misc_feature (703)..(703): n is a, c, g, or t
  misc_feature (721)..(721): n is a, c, g, or t
  misc_feature (731)..(731): n is a, c, g, or t
  misc_feature (733)..(733): n is a, c, g, or t
  misc_feature (747)..(747): n is a, c, g, or t
  misc_feature (750)..(750): n is a, c, g, or t
  misc_feature (754)..(754): n is a, c, g, or t
  misc_feature (764)..(764): n is a, c, g, or t
  misc_feature (766)..(767): n is a, c, g, or t
  misc_feature (784)..(784): n is a, c, g, or t
  misc_feature (805)..(805): n is a, c, g, or t
  misc_feature (813)..(813): n is a, c, g, or t
  misc_feature (881)..(881): n is a, c, g, or t
ngcgagccgggctgcgggtgccaaacggttcccggcggggggcaggggacggggcgccgcaggaggccgggactcctggacggaggagccccaaggangcccgcctgacgactgaccagttgncatggcancntactangaganactagaagtgncgcgaagtagcgtccgctgaatgacaatcaagaaggcagatatcggcgcaaggctctccaatggcacccagacaaaaacncaganaataaaaagtttagctgagaagaaatttaaggaagtggccgangaanataaaangctgtatnacaagaaaaagagggagattnacgaacgctatggccgggaagggctgacagggacaggaactggcccaatctcgggcagaaacaaggcagnggnaggcactggcttcacctatcaccttcngcagcacccgaggaggtcttccggagaattctttnggagtggagacccttttncagaactctntnannacctgggccccntctcagagcttnanaaccggggttcccganactcaggccccttctttaccttctcttcctccttccctgggcantccgatttctcctcctcatctttctccttcagtcctggggctggtgcttttcgctctgtttctacatctaccacctttgtccaaggacgccgcatcaccacacgcagaatcatggagaacgggcangagcgggtggaagtggangaggatgggnanctgaagtcagtcanaancaanggtgtcccanannacctggcactgggcttngagctgagccgtcgcgagcancagccgtnagtcacttccaagtctgggggactcaggtccaacagaccctgcctcatgcccttggacagcgactctntgaggat

SEQ ID NO: 571469 - DNA, 1013 bp, Homo sapiens
acaaagagtacagaatcatctcagttacactagaagctctgcaacatcttagtaatctgaaaagtcttgacctgtgtaacctgtgagatcacacaacctggaagattatagagaaagtatttttgaactactgcagcactagtcacatactgtatgatggagtttgactcatggaggattatgcaagacgccgtgatcgtctgagacagtgaggagtgatgaggatgcgcgatgaaatatgatggacatcatggagggaggataataagaaggctggtcctagcgtgaagtattatgaggtaagaggcaggatgcagagggcgaggaggatgaggcatgaggatgaatgatgaagatgaagcatgttccgagttggcagagtggaaagaggaagtgggcctctcatacttaatgaaagaagacattcaggatgaagaagatgatgatgactatgttgaagaaggggaagaagaggaagaagaggaagaaggaggtcttcgaggggagaagaggaaacgagatgctgaagacgatggagaggaaagaagatgactagatcattctaagaccagattctctaatgtttctgggtgtgcaatagagtgatcacatctttgtttcttcatgtacgatagctatccctacagaagataatgtgtaactttttataggaaaagtgtggtttactattttttgccttatcattccaataagaagctagtctgttactgatctctggtctgtcgacgaaaactttcctgaactccatgtggacttccctagcattatttagacttatcttttaaaattccagcttacgtataatcattttaggcctattaaaacttatccttttataaaaacaaaaaaaaaaaccaacaacaacaacaaaaaaagagggggaaaaacccagaggacaaacaccccttgtaaggctctggtaaaaaaacgaggaaacagtgggaaacagaccgagcacactggaggagcacccaaacacgaaaaagagaagt

SEQ ID NO: 571470 - DNA, 511 bp, Homo sapiens
tttggcttaggattggcttggcgatgtcgactcgagtcaccaggtcactgcggacgaactgcggatccgatgtgtgggcatatggggcgatgtcgactcgagtcagtgcggatccgatgtgtgggcatatggggcgatgtcgactcgagtcagtgcggatccgacgtgtgggcgtacggcttaggattgacttggcgatgtcgactcgagtcaggctgcggatccgatgtgtgggcatacgggcggatccgatgtcgactcgagtcagtgcggatccgatgtttgggcctatggggcgatgtcgactcgagtcagtgcggatccgatgtgtgggcgtttggggcgatgtcgactcgagtcagtgcgaattcgatgtgtgggcttacggggcgatgtcgactcgagtcaggctgcggatccgacgtttgggcgtacggggcgatgtcgactcgagtcagtgcgaattcgatgtgtgggcgttcggcttaggattgacttggcgatgtcgact

SEQ ID NO: 571471 - DNA, 131 bp, Homo sapiens
tgctccacgctccttccttccttccttcctttctcttccttccttccttctttcttttttctttctttctttctttcttactttctttctttctttctttctttctttctttcgcgatgcgtctccctctg

SEQ ID NO: 571472 - DNA, 257 bp, Homo sapiens
tgggcgtggtggtcccccaaataaaaaaattaggtgaaaggcctgttttagcccaggtggcataggttgcagtaagcttaaattttcccccctccacttcagcttgggcaaaagaacaaaattttttcaaaaccaaacaaacaagcatgcaaggatatttgggtaaaaaggtttatagcattggttttaatagcaaaaaatgaaaaccagtttaaatgtccaataggtggcagggtaaataaattatggtccctcca

SEQ ID NO: 571473 - DNA, 191 bp, Homo sapiens
gtcgattagcaggcatccctttttctcctcctttctcggtttctgtttctcctcttcccttcctcccatccccatcgcctggctctcatccctgccctaggtatggctcgcattgactccgcccactcaggcagaggtgaagcaccaagtcaatctatatgtcctcattacatgccatgggtcacgagctc

SEQ ID NO: 571474 - DNA, 283 bp, Homo sapiens
ggggggggggaacccctaaaaaaaaaaaattttttaaaaattggggggccccccccagccttttcccccattttcccctaaaaaagtttttttgttaaggtcccaaaagaaccaattttaaaccaaaaaggtgaaaccatttttcccccccccttttctccggttcaggacccaaccatgaaaccccttttggggtatttcaaaaatttttttttctttttttcaattccccaatataccccccctcaaaaaaccttttttaaagtgggggttggtggggcca

SEQ ID NO: 571475 - DNA, 1268 bp, Homo sapiens
ttggggcccctcggggcgtattctcccgctccctgggttttgctctagggccccgcggggctgtgctacagtgtttccacgacgcggtatctccttttttgtgcaccatttggggcctattgtttgggggtgcaccctctagagcgcccacgtgttggtgacaaagtataccctcgctctgttgttcccgttctccgcggatttttccccggggttcctctgtcggtgtcgaccccagtcgccacgtggtgtcttgtcttccgccggtggagttttggttccccgcactgagcacagcccgtcctccgtgcttttgtgtttccgcgccggggcttattttgcgccctaattggcttgcatctctcctcgatgcccacttgtgggcgaaccctccggcgtttctggcgcccgtgaatttggggtgggctttctaaatctccacctcggggtcgtagtgtccgcggtggtgtgtgccgacccaccccttgggtcggcgtctcgcgaggggttggatctccccctcagggctgttgtcccccccccggggggtgcttgcaatatccccaggcaaaaccacaatgttttgttgtggtggaaaccaccggggcacaaacaaaagtgttgggcacgaatctccaggttgtaatcacacggggggatggcccactctggagaattgatatattgtcctgggaacgcgttgtgaaacacgcggtttgttctgcgctggatgtctgctataccgcgcgcgtttttgttggttatagggaaatcgaattgttggtgtgcccccccctgtgttgcaataacaccgcgggccggcgttgtggagagtttccacaatgagcacaactcttctggaaacacacgcgcccggggtgaaaccttctggcgcgcgcgccgtaacggacgaacgaacttgttttttgtcgggcccctgcctgggcacacgagatcccacctcgacaggcacaggcccagagttcaccgagggcaggcccacagagcgcatttgttgtgcgaacccctgtcgggagtccggcggaggtgttcggattatagatcgaccaagaaggcgcctgggttcgcgcttgggcttctatacctcctttttttttttcgcgagatgtaacccacagattcgtacggtttgtaaaacgaagtattgctggtggtagggccgagggcccagccccaatttaggccgggtgcgcccggggccttttactcccccttttttttacccgggaaaatgtttttatgggtta

SEQ ID NO: 571476 - DNA, 1335 bp, Homo sapiens
gctcccaacacgctgaaacccgattcctaccgggtgacgctgagacctgtacctcacccccaatgacagtgtgcctgtacgttttaagtggctccagcaccgtacctgtttacacctgcaaggaggccactgacgtcatcatcatccacagcaagaagctcaactacaccactacagccagtgtgcacagtggtgtgtcctgcgtggtgtgggaggctcccagacccccgacattgacaagactgagcttggtggagacacaactgagtacctggtggtgcacctcaatgggctccctggtgaagtgacagccagtatgagatggacatgttcgacgtacgagggggagttcggcagatgacctggcagggctatctaccgcagcgagtacatgctcgggcaactgtcagaaaacgtggtggacagtacacagactgcacgctgcgatgcccggaacgtcgcagcgcagtgattcgactgacgcgcgggcctgaagcggcgacggacggagcactcggcgcgaagtgcaagcccaggaggaaaccggacaggaccagtggaccaaacaaggcgtcacacaagagggacgcagagagcccgcgagagagcgagacagagacccaagcgggaacaggtcacctgcagagaccaacaagccgaaggcacacacagaaatgtccacgcgtaatagcgatggcacaaaacaagagaacacgaacacgcacgcaacatacggtgtgaggaacgcgaggaataccaaagtggtgtgcctagaacaccggactcagggaccggaacaccgagagggacgaataggacggagcgaccacgcggaacgaaagaccatgcccccggtgaacagcggatgaaccggcagtgcgctcccaagtacggaagacaccgacggagcaacgcgacggccgccagaaggcacgacaggccaataacacaggagcccagcacagcacacccgagcccaagaacataggcgacaggacggacaagccagacagacggacaggatggaagcagttggaaacaaacgtggattcaacagtgggggcacacctaacaccgggtgacaccaacggaccctaggccggatggagagaagcaccgaccagggggaacgcgcagacacagggcacggaaagcaaagagaagaacagaggagggcaaaggagcgaaaatggaccaccacaaacgcggggtaccacaacaacgaggcagacgtgaaacacgggtagagcacctaaaagggcgaacgacggaacactgagggaaacacagcaggcaagagcgaaggcagaacgggcaagctgacgcgagacaaag

SEQ ID NO: 571477 - DNA, 176 bp, Homo sapiens
gtgagaagtgacttggttctggagacatatgaaggaagatgttcaggcaggccgggcacagtggctcatgcctgtaatcccagcaattttagaggctgaggtgggaggattgcttgagctcaggagcttgagaccagcctgggctacatagcaaaacctcctctctacaaataaaa

SEQ ID NO: 571478 - DNA, 101 bp, Homo sapiens
aaagcctaattacgcatcatctcaatggtgaaaagctgaaagaattcctgctgagatcaggaacaagatgaggatatcagctctctccaatactcttcaac

SEQ ID NO: 571479 - DNA, 1535 bp, Homo sapiens
gttcctgtgggaagggccctggagctggggtggtgccctgtgtgtgagccctgctgcgagttccccatttccatttgtgaacaaagtgaaatgtcttgtctcctgagtgcatctgtcactcccagtgcttggccacatggaatgctggtggctgctgtgtgtgtgcctggctgcccctgtgagaaatgttttgttcgctgcctgtgtgaccctctgtgtgcatgtgcctgaatgtgttgatccaatgcctccctgctgtgtgagaatgctgctgtacgtctcctgggtgcatgtgtgtgtgctgtgaccaaaactacttgtgatgttcattgtgtgctgccatggtggcttgtgtgtggggcgtgagtgtgactgtgccagctcgagatgtgttgtgagatgcgccagtgcagccctgaacccctcacagccacacacctccattcccacccccacaccacgcacaaacaccccacatacagagcgcggccgacgcgcccgcccacgggcacgacaacggagccacgccagcccagccatacctggtcacgcgacgcagccgccccccgcgcacagcccccccagcacgacacgcgcgcaccgaccttcgcccccccaccgcaggctacccgccccgcacgcagagcagacacgagacaacacggccccaagcaacacaagaagagaccgcgcaaagacgtgagaggggagagggacagtcacgaaccaaccaccacccacacaccaccagcccggtacgagcaccagctcctcaaagcaacatcaacacaaggacaagcaaacaccacccagcagcagggaagcaagacgaacagacaagaagccccagacaacgcagcaccaagcagaagcggcgagcagagcgcgagccgccccacacggagcccacacgcgacacagagacccacccgagcccacgcggcaacccccgatagcgcccatacgtcaccgcaggccgagcctagccaacagggccgacccccgccgtagccacccgggcatcgagacccacacgagagtctgagcgagacgctgcccgacgcgaaggggctagaaggaggagcgtctaagtagcctacatcgatctcgacgagcagtacaacggccatgcgcggagtacagaaccgcagaagacccagcaccccagagcgcagggctgcgccagcacagcgcgacggcaccacacggcggtggatgagccggcaagaggcggaggtagctgtaaaaggaccctcccccatccacccactcacatcccaaatccatctcacccaatacccccacccacacaccagctatttggtcacagctccaccctccctcactccactactcactccaactactaccaataacctctgaacacattaccactacacacacacctaccacaccaactacacctcaccctgccaacactccactcccacctacaccccccccccccctttccttctctctccttcctctttctcttcacccactctcccacccctcctctcaataactactcc

SEQ ID NO: 571480 - DNA, 788 bp, Homo sapiens
tcagcgcatgggccggtaaagacatggattgcttgcgtgagaagtccgcagacggagcgcgacgaagcgcgctgctatatcttatcccgatcgacagtaagctgctgtcccgaacggtcggctgccgcttaggatcaatggaacaatcaattgattacatgcggaccgttacgaccatccctagagggatgtcgcattcctatacggaggaacagaatcttgagaaacgatctgttctgatccattggcctattgtcgtaagaacgctaagacctagaagtcgctgtaatacgaagctcattgctcgcggccgaggttctgcgtcgatgcaacatgcttcatgaacgctcgtggagatctgacttgtcagatcgaagtgagccgctaatgtggcgagaaatggctatttgacactgggtttgtaaagcctagtggtgtgggtggacagcacggtgctcattaattgtgtgacgaacaagggaaaagaagccagtagaagcttgaacgaattgacacgaatacgtgccagtacaagagagaagatgacaacacagaaagggactcaagcaaacatcgtaggtaggattatcgtaagactctggacatacgttcggaggcaggcactcaacgtagaaatgggcaaggcattgtcaaagtgaacaacagaacgtacttggaagatctaggggcacctatacggacacaagatgagatgtacaataagacaagaaacgcctagacaaaactaagagaaggcatgagagagatttaacattcactgccttgag

SEQ ID NO: 571481 - DNA, 385 bp, Homo sapiens
  misc_feature (297)..(297): n is a, c, g, or t
  misc_feature (374)..(374): n is a, c, g, or t
  misc_feature (385)..(385): n is a, c, g, or t
ctaggcatggtggctcatgcctgtaacccagtgctttgggagcctgagataggaggatcacttgaggtcaggagttcaagaccagcctgggcaatgtaatgagactctatctctacaaaaaatttaaaacaaaacaggctgagcatagatgtctactggggaggctgaagctactggggatgccgcaggaggatctctgttgcccaggctggagtgcagtggtgcgatcttggctcactgcaacctctgcctcctgggttcaagcgattctcctgccgtagcctcctgagtggctgngattgcaggtccccgccaccacacctggctttttcttatttatttatttatttttagtagagatggggttttgccgngttggccggcn

SEQ ID NO: 571482 - DNA, 117 bp, Homo sapiens
aactgtgctacggtgaggaagatcttctcagagtgctattcaggagttcttaacccatatgccagagtacttgtaggagccttaaagacgacagtattacagtctactgggtactgc

SEQ ID NO: 571483 - DNA, 287 bp, Homo sapiens
agctatcggttcaacgtctatgtataagcctgaattttatcccataggtctataccttaagattttgtggccatgcacagtggctcatgcctgcaagcccagcaccttgggaggccgaagcgggcggactgcctgaggtcaggagtttgaggccagcccggccaaaatggtgaacacccatctctactaaaaatacaaaaaaaatcagccgggcgtggtggcgtgcacctgcaatcccagccacctgggaggccgaggcaggggaactgattgaaccggatagcttg

SEQ ID NO: 571484 - DNA, 500 bp, Homo sapiens
agagagatagagagagagagagagagagagagagagagagagagagagagagcgagagagctatagcctctgcgagagcgtctcctctatgatgccccatggagctcttttgcccctcctgccatgtccggcctcccctcgatgctaccatctgtgacccacttatcctctctctccatccactctctctgcttcatccaccatcttgtacttcctcctctcccttgctgttctatataattgcctgttgtttgctttaccttttctcctttcctatttcttctcttttctcccttctggcgcttcccttttccgattccctcctctctcgtcctcttttctccccactctccccctttctctcacctctctttctgtctatcccccttctttacccctcttattctcctcccttcacttcctcttttccctcctgcctttttcccctccagtccctccctttccctctttccactacctccctctcttcctttccctgc

SEQ ID NO: 571485 - DNA, 168 bp, Homo sapiens
acccggaatgcataaggttatgttgggaaactctctttgtattgatttatatgtggactgggttttagtttcgaagtgcacatagtcagtatctctctctcacttttctactgatgtgcccttagaaacgtgtgcaggggatgggttgacattcaacttgctgaatct

SEQ ID NO: 571486 - DNA, 139 bp, Homo sapiens
tctagaggatcccgtatactggctccacatgcctatgctgctcggggggcattggtttcacccggttccgggcttacgacacacagcgggtccgggggaaccggaagcacaccatcagccccgaggaccacatcacggg

SEQ ID NO: 571487 - DNA, 766 bp, Homo sapiens
agactgagttgcacactggcagggagaccaaaaacattacttccatacttgtgtcattgattcttgggttttggagcagagtctcagtctgtcgccgaggctggagtacaggggcggatgatctcggctcactgtcaaccatcttgcctccctggggtgtcaagcgaattctcctgctctcataccacccaagtagctgggactcacaggtgctgtgccaaccaacggacctcaagcgtaaagttgggtatatatgtatgaggtggagcactggggttattcaaccatgtttaggcgctagtggactggtcatcgaaatactcctgtacccgtggcaggagtactgctcctagccctcatgccctcccacataagtgcgatgcgtgaattagcagtgcgtagatgccaccgggggaccttggcctagtctatatagtagatatcttaagtaagttacttgagttctaaccaatcacagttttagattacatatccttcgtggaaaaagtctgagaaacatgagtctacaggaacatacagcggcaagaattatacgatataagagggtagactgcaactgtcaccgtagttgcggtcatccttcaaagtgtgcaaacgtatgacagtgtatatgtcgtcatggctgcaagtttttctgtgcggcaagttaatctttagaaaagacccccaaaagggctttggtggactggtaaggcacgtggtcatggatccacaggaaatgccaagcttctggggtacccatgaa

SEQ ID NO: 571488 - DNA, 482 bp, Homo sapiens
cgtgaacattgacatgcagacgtataatttaccttgaagtgacaatagctgcactactattatgtaatgataaaataatgtatatcactagtagaaaatgattatagcactactgtgttaggacttttcatattccatattgaaacatagtgatactgtagctggcatcagctgtaccctgtacttcacatgcactggcctggaggggatcatatttataacaccaggaaatccagtgtgcaattagctgagtacttaacattcagtgtcacagtgagcattcttaactcaaatcacagtagtcatgaaagaccgtcctgttggtcaatccaaaaacatacatcaaaattcaatggtgaggttgaaggtagtagtctagtcccaactagtgtgagttctgggcgcatatcgaaatggtgcaggcatgtactccctttctgaggacttaatactgatgggacggatgcagtacagagtaacaa

SEQ ID NO: 571489 - DNA, 106 bp, Homo sapiens
ttccgagagaacatgcgtgcgagagtctgacgagtgctgcactaacgcaggatccggcatgccgaaggtcctcgccaggattaagttaaaggaagtagatcgtaca

SEQ ID NO: 571490 - DNA, 1284 bp, Homo sapiens
gagcggggctggcggctgcactggctggcagctggaggtgtaatagtgcgggtatgtgggtttgtgagaatgttcctgaggcggcgtgtgtgcgcctgtgtcagcgacaaggatagctggaacctgcggccctagggctattgtctgctcaccatgcctgatcatgtagacggacgctttactctgcaaattattgtgcatcctagtgcctgatgcctactgcgaggcaacgctgctgccatgccagtaccatgcatgccctagtcacacgctgcactactctgcgcactggctgctgcacaacggctggctacgtaacgcgcacaacaagccgactctacgccacgccctctacacttcttactttcacagcacaactctcgtctctacaggccatctctctctcgacgcacacttctggtctgactatcttggctactccaaagatgacaccatgcttagcacccgtcctgggtgcaggcactgcacacgcatgctccctcttatttccggatcgctcaacaggccagactttaaacggcaagctagccctacaaacatttcggcgcaccctggcacgcacacacactcgcttccctctgcacgtttgggccagcataactacactaaaacgcagatcaaaccataattcttgcctcagaaaccacgcaatgcaaccttcctgcctagtcacacgtttttaaatcgcctaaggctagaaatcagactgtccctccctaatttaaagggctaattacatttctacacacacttggggacctagtccacaacatggggcgcacctttgtaggtggcttgtgcggcttggtgacaacgtctcgagatgtgtttagtcttcttccaagccgcggcacgggaagtccggacgctaccttcggcttcgaactgcaacgtactaacgctggaacgtcccaaatctttaagcatcacttttacctcccttctttcccttaaagtgcataacatgtcactcctatttagcgacggcaaccctttttttacccgctagtggaaatttgcaagatgtggtttcctttttctgttcctcgatctggtgtacaacgtgtctggccgcgagccgggaaggtcccgttttacgtttagccctttactctcccgttgcgaacactatccccccaatcatcgatagtggcttccctgtacggcaagctgtcaatatggctggaccttgggtgttgttcatggaacagtgtgtggacgtccgtacttttgctttggcaggtaagctacctggttcttggg

SEQ ID NO: 571491 - DNA, 220 bp, Homo sapiens
ggaggttctagcaggggagcgcactactagtatacccttgaccgaagaccggtcctcctctatcggggatggtcgtcctcttcgaccgagcgcgcagttacgggagggacgcacatggagcggtgagggaggaaggggacacccgcctagccagccagatcagccgaatcaaccctggcgatcaatggggtgacagatgtcgcagccagatcggtcgacg

SEQ ID NO: 571492 - DNA, 286 bp, Homo sapiens
cagcccaagccttgcggtccataatgtggcctcaccatttatggagagaaggaggcatttgggtctggaggcccctggagccagatggcaagagggtgccagcttcctttcctgtgtgtattctgttcagttcctttaaaaaaaatggatgcccagaggactcccaaccctggtttggggtcaaaaaacagccagcaagagtttggggccttagggcactgggttgttgttccattgaaaccgattttggccctggccctacttggtttttttagctttttgggcc

SEQ ID NO: 571493 - DNA, 742 bp, Homo sapiens
ctatgcgccagccccggggcgccgcgctgcgccgacgccaccgccgccgcgccgtgaacattttccggctagactaggggacctagtcccacctaggcggccatcgtacatcctgctgctgaagatcctggaagacgcgctcctgcgccgggtacttgctctgtacacccaggctagagtgcagggatagtagaccacagctacactacagcctcagcctcctggagtcacgcaatcctcccacctcaacctcccatgtagctgggaccacaggtatattctgggaaaagccagctatctgttatgcactggtacttcacaactcgtatacctggatctttttacttcatttatttcattagtataacacatactatagaaggttatctacctatgcctgctcctatgccacagtgtacctgatctacctgacatttaaggcaacctacgatggaaatacatgatacctatccgagtggagtttctggtggtccctgtgggaggcctctcatattttagttaatcacgatattctctacctcttgagatcctctggacctatctccatactacctggagtaccgtggctatccttccgcagctgtatatgatcagcaagatggggaggccgaacctcacaccactactgtcttctggccttatcgtgcttgatttgtacatgcttggctcactggggttttactaatatggggcggtacaactctatggcctactgcattaa

SEQ ID NO: 571494 - DNA, 130 bp, Homo sapiens
  misc_feature (110)..(110): n is a, c, g, or t
gttgagttggaccaactgtgacatcaatcaacaatgagtgtgaatccaatcccttgtgtcgaacggcggaacctgcaatagacatgaacagtggctacgtggtgcacctngccgggtagggcttcatgcg

SEQ ID NO: 571495 - DNA, 297 bp, Homo sapiens
gccaatatgcaccgcagccacagccatgcaggatgcaacctacaccacggctcacggcaacgccggatccttaacccactgagcaaggccagggatcaaacctgaaacttcatggttcatagtcggattcatttctgccgtgccattgtgggaactcccttgtgagtcttgtttgttttatttttaagattccatacataactaacatcatacagtatttatcttttatccatctgatttatttcacttggcatgataccctccaagtccatccatgttgtggcattgcagggagct

SEQ ID NO: 571496 - DNA, 594 bp, Homo sapiens
aaaagctgcagtatatccttgcaagcgtgtcaaagctggctatggtacggcaaaggagagttgtatctcacaaagccataaacactaaacaacttcattttccagtaccagaaaatcagctgtcatccagacagcccttggtaatacatataagatttgtgataatatcaagtactgcagtggcacgccgggtgggtctccacttggaaaccccccattactgtgaccctgtcatatgattgagctactcagcaagtggactctgaggtgacgtgctttcggaccaacatcgtcttcttggaccttagtggagtggtgagtatgctctagagaagcagcagtgcatgcactgaagtataggggcacccggttgggagaagaatgggttgtccgtgtagcgtgcattctgggcaatcctgtgcatcaggagcggtctggagaatatgcagaaacaccgagaatgtgaccagaaagatagctgcatatttgctgtagtactccatggcgctcgttgctctgggcttatcgcaggatgtgttcagggcggttgactgtggatccgaagagggattgtagcttcgtcttatgagttct

SEQ ID NO: 571497 - DNA, 548 bp, Homo sapiens
  misc_feature (28)..(29): n is a, c, g, or t
  misc_feature (254)..(254): n is a, c, g, or t
  misc_feature (479)..(479): n is a, c, g, or t
  misc_feature (529)..(529): n is a, c, g, or t
  misc_feature (536)..(536): n is a, c, g, or t
ggcgttcgatgtgttaggcttcccagcnntgcttgtatcttaccaggggccacaccttcattcagaggccacaaactggaagcccgggagccctgcactggctccctcacccccgctgatgtggctttcacggtgtcctaagcacttttgaatgggaagctgacattgcaaaactggaagatttcactttcacacacacacacacgattcctcttgagcaatcagaagacagagtgagatgacactgctctgcnattcctgcaggtgatgagaagctaagctgaggagagcacgaagcccagcatctgaccatttagacatgctcaccaaagttcttagaagaagcagaggaaggagaaagctcacaaaagaaaacaaatgctattttatctgacttctcacttctacggatagttgttttcacttaaaaacaaatccccaaactgtttcatgatagggccaagtgacttttaaacacnatctagtttaggtagatagtatactatactattttaaggggcagccttgnggatacngctgtaatccta

SEQ ID NO: 571498 - DNA, 89 bp, Homo sapiens
gcggccgcctactactactactactgctcgaattcaagcttctaacgatgtacggggacatgtggcctttcgtgtctgacttccttcac

SEQ ID NO: 571499 - DNA, 126 bp, Homo sapiens
cgaggtcacatttggtcccggcagggctctgacctgcgaccactgctcgctgccggggcttgtcccgaggaggagaaggcggcggtggccgtcgcgtctgagtcaccgcagcggggaggagtacca

SEQ ID NO: 571500 - DNA, 1055 bp, Homo sapiens
gacctagctagtggatcctgcggttaatcgggagagggatcgtaccagatgacggaaggacgggagtccccatgcatgtggctcggtcccggagcctcagtcccggacgatccccagtatccttagtcagtgaaatagtaatgatgaatcatgtttacaatagaaagattcccatagaggctcatgagcgctcagagagctcagaaggtggcttctgtgatgcagctggtgaaaaagctgatgattatcattgcccgccagcatgtctcctggaatgcctgcgacgtttgatcccttgaagtagattctaccaaccttttagaagcagcgtgatgggccacgcctaaagagggacaagggattaacatgtgacattccccgtctacatcgttagccaggtgggactcacccgggatcccctagaagaaatggtccagttgagcagctgtgacagtcctgagcactccagagacagatgattctattgagggccatggggcatctctgccatctagaaagagatcaccctctgaagagggacttcgagaccattaagctcatcagacaatggcgcctatggggctgtattttctaggtgcggcaccaagtccacccggcagtcgctttgccatgaagaagatcaagtaagcagaacctgatcctacggaaccagatccagcaggcttcgtggacgcgtgacatactgactttcggtgagaaccccttgtgtggtcagcatgttctgctcctttgataccaaagcgccacttgtgcctggtgacttgagtccgttgacggcggcagactgtgccactctgctgagaactatggggggcctgccttgtggcctgggcgcgcctctcacttgcggcacctgtgtgcgctgggtattacacactatggctgggccgtggccctaactgaacctccttatattctgggcccttcgtcggctttgtcgtcacagtgctcttgtttcgccactgttggggcctcacggcccggtctgccccttggcccattgcgcgtgtttcgtatcccctggcgctcttcta

SEQ ID NO: 571501 - DNA, 149 bp, Homo sapiens
tacctgaggacccagggttgcagtaagctgagatcgcaccattgcactcctgcctgggcgaaagagtgaaatcctgtctcaaaaaaaaaaaagctaggtggtaagtatatgggaggtaccataatactattctctactacttcacatgc

SEQ ID NO: 571502 - DNA, 843 bp, Homo sapiens
  misc_feature (843)..(843): n is a, c, g, or t
tcctactgcctggctgagtgcacatcgtccgtggtaatacagcttgagtcggctgacgtcggacccgtgggtcctctgatccgtgagagcgaaggagaaagcggcgagatgactgaccgttacaccagccagtaggaccaggctggagtagccttgacagggtcgcgactgtaacattcggcagctggaggccaggtgtctcgtaaatagacatctcgaaagtgagcgaagctgggcttggatgaaatcgcaaacatcgctgacgtaactgcgtataccttgacgtcccataacactgggtgcacatactttactgtataccttttcttcacatctatcaccttttcgggcgccaattgctggcggagaaggtacactgcaggaaggaccgacgcgaaggacagccagagggtttcgccaaggtttggtcaaaccccgtttggcaattagccgtaacaaagaatgaagtggccctattccacgactcctaattagtattggggacacacggggacttagagaccgtgaaccaagagtgctccggtatgggcaacgtatcacctggtggacagttaagcagtaccagtggccctcctgttgtttaacacgcacgaattcggccttgggaacttaaaggctaggatggcgcgggatatgatgctagagcgtcaacctctcacgaaatacgagattaccaacagccgaaatggggccaggggttcattatccattcaacgtggtggtatgattcggttgctagcagttcgccgttcggtacaaaaagagttaaggtatgccccttgttttcaatcgcgaagacgagggactactgcgacgtcggtn

SEQ ID NO: 571503 - DNA, 255 bp, Homo sapiens
  misc_feature (250)..(250): n is a, c, g, or t
cggttctaaatcagaactcggatataccgggagcaatggccgatctggctgggtgttgcaagcatagtcagggcgcaaatacactggcggtgccgaaccgcgagcaatgtcgccacacattttattttttatggcggcgcaactttctttgtctccgcaggagcttgataaaatcatcgataaaatggcatcgattggtgcaaccattaaataaaagcacttggacagcataactgtacgggggatcctnctaga

SEQ ID NO: 571504 - DNA, 107 bp, Homo sapiens
tcgataatcttacgccttaatacttttgagttttgttatattttgaatgatgaggcttcgtgcccccccttcccccttttttgtcccccaacggtgaccggcgactt

SEQ ID NO: 571505 - DNA, 265 bp, Homo sapiens
ctccctctactatatatcagaacagatactaggtttcctcataggtaaaacaggataataaatgactttgccagtattcgatgaggattccctgagataatgtacaacaaagtgcctggtaaaatgcaggtagctaaacaaagtgtacttgctgccactgtcgtcatcagctcctgcccgtttcagcagtcagacacctgcctgatcatcccccatggcagagaagtgcgcctgggtgcgcacccaggcacacttctcacaagtc

SEQ ID NO: 571506 - DNA, 411 bp, Homo sapiens
gtccgacttgggtcgacattggacaccatgattgagactggctgagcctttttatatcctgacgacagctaccacacagtgaactatgagatgctaacggtggagcacgaggcggatgagctagtggcgcacaacagcgaggtttttgagacgttcaccgagatccacatccagagtgcgatcttagtgcgcgaccatgtgaaagtgcccctggtgaacactctatctatgaaccagtgctgactggacttaatagcattggcctactcatggaggtatcaggataggacgatgggatggcactgtgccgagaccatcgattagcggttctcagcaagtgtctggacatctggataatgttcctggtcattctcaagaccctactggtatcctaattccggttcttgccct

SEQ ID NO: 571507 - DNA, 181 bp, Homo sapiens
gttagatttgtaacaggtgatgcatcaattcttctttatttgaggaggcgtagaagtcaaataaaatatagagaggcatctctcaacttaaaatgttttacttgggaagcaagaatagcaatctgaggcatacacagaccagtggtcttcagtatgtctgaagaacaaagacgagattgcg

SEQ ID NO: 571508 - DNA, 579 bp, Homo sapiens
accccgagtgtttccgcgcgccatcatttttcaaattctgcccgccgggtccacaatcctcgcataaattttgcggcttggccaaactccacttgctgacgccacttccacattctgcctccacatataccctcttctccaagcacctccaacttgttactcccccccaaaagactgttttaaagaaccttcttgacacaagccttcgtcttaataacttcgcgtctttatcccccccctcttttaacccccttgggaaaaatctctcttttgtttataacccccctttttctcggtccaaaatccctctgtcctttttgctcacatcttacaatactatgccgtcatgcccctgaattcctctggataacacgtatcacccaccacccaacgcgtggtacacaatccgaccgccccacctagatcctaatacaatacgacctccatcctatttatgcccgactagactaccacccccaatatctcgttactaaaccgctgttgtcccccgcattcaactcgcctcgtagcccccagaccccacaacttcctacggcaatttcattatacaaaaataaa

SEQ ID NO: 571509 - DNA, 432 bp, Homo sapiens
  misc_feature (26)..(26): n is a, c, g, or t
  misc_feature (123)..(123): n is a, c, g, or t
  misc_feature (125)..(125): n is a, c, g, or t
  misc_feature (181)..(181): n is a, c, g, or t
  misc_feature (222)..(222): n is a, c, g, or t
  misc_feature (225)..(225): n is a, c, g, or t
  misc_feature (266)..(266): n is a, c, g, or t
  misc_feature (340)..(340): n is a, c, g, or t
  misc_feature (400)..(400): n is a, c, g, or t
tcatataagttatgctagggtgagtngtaggaagttttttcataggaggggtatgagtgggtcgtagcggaatcggggggatgcggtgcgaattcataagaacagggaggttagaagtagggncntggtgacaaaatatgtggtgtagagtgcaggggagagtgcgtgatatggggtgccnaggaagattgtagtggtgagggggtgtatgataataatgtntgngtatgcggctatgaagaatagggcgaaggggcctgcggcgnattcgatgttgaagcctgagactagtgcggactccccttcggcaaggtcgaagggggtgcggttgggctctgcnagtgtggagagaaatcatatgatggccaagggtcatgagggcaggagtgatcagaggggngcttgggtggtgataagggtggagaggttaaa

SEQ ID NO: 571510 - DNA, 357 bp, Homo sapiens
cattctcacatagtgaactcctgaatgatccattgggagactccgaggaaacagaagtggggctgcagtatctccagcagagacactctgcatctgagccacttttcagcattctcttttctctccaccattctgtgtaaaagggtctcaccctgtgttaactagttagcctccaatacgggaaagtgctctctccaacttcgttttccaaaaacagctcatatgtcatattctatttcgtggaccctcagcttagtcaagtccacttgaatctttagaaaggatgtcttagtgttataaagcaatctctttaagaagtgcaagtcatctgacatgggagtggcagaagttgtcaaa

SEQ ID NO: 571511 - DNA, 131 bp, Homo sapiens
gatggcgtttgcagcgggacaaaaaactggactttcgccgaaaggtgggacaaagatgaatatgagaaactcgcccgagaacgaggctcacggaaggagacgagaaaacgaaagatggaaaaccacgtgca

SEQ ID NO: 571512 - DNA, 646 bp, Homo sapiens
ggcagagtgctggctgctgagagccgagcccagcaatcccgatcctctgagtcgtgaagacatggaggcagcgagggaggtttcggagtagcgtgtgcgctgaggcaacgcccccatggctccggttcttggcagagggaccaggagacattggttcagaaaatggactgtgtgtgctgggcctcacttcggcttccaggcctgagtgcctcctgtagaagacatgctgccttgcttatgctatgaccattgattggacgtgccagtccagagagtctcaggaacgtgctccatccgtatctaaaccatgtgccaccagcatgcttgctaggatcaccccaggacgttcaccaaagtccacacaagagttgccaaattgaagaattgtgcattgacaattcaaggttatcagagcatgttagccagctaagggccttaaggtcagcacttctagaagtccatgcaagtgccaccacaaaaaaggccctaaatggtgtactatgattctctctcaggctccataaatggcctaaggatcgtagccccaacgacgcaggaccaagggcaagcctttaaggtcccaagaaattgcgtaccggccaaaagggtccacaagtgcttgccctattgagttccattccccagg

SEQ ID NO: 571513 - DNA, 747 bp, Homo sapiens
gctgctggagcggcactcgaaggggcctctgattgtggacacagtctctggctgagtctctctcagatgctgggtgaaggtggatacgtggtagtcgtgtgtgatgcaggcgcccacagacaggtcgtgtgacatcctacatcagactccctcagccccgatggggcaaggtagcatgtagtgctctgctcgagcgtgtgcgcacgaatggatgacccatgcactcactcgttcgacaagctagaagcgccgtgagtgcaacatgcgacacgttagtggcaagttccacatggggtggctacaggcggtggtggctcgccgagttggtggcccgaatggtcgaccgagtaatgcattactgagctggaaggctgccctcaggtatacgtgccaatgctatgcctctcagtcagcgtctgacccaggtcgcgccaccagggacgcacgagcagtggacgtagagaggcaaatgccagggatgccgctggaagggatggccacgtagaaccttgccacatgctgaagcgaggactagatggctggaggcccaagcatgctgacgccaggagaagatcagccttggtgccgagggccataaccatgaccacagaggaagacagtgggcctaggaggaagggcaggaacgtgggcccaatagacagcacaaaccacgcttggtagaacatgatgcaaagagcagtggacgaaggatgggttgtggaactgctcatgggaagataatcttga

SEQ ID NO: 571514 - DNA, 265 bp, Homo sapiens
atttttttacaagatacgttgtctggggggtcctatatttggttatgggtcgtctcccttgaactccatgacatatgtgctgagtcaaggaagaaatgaacccatggccattgaaactgactgtttcaactgagacttataagtggtggttgatctaaactgagaacttaagtcagtttcctgcttagatgctggtgtgtgaaacagaaagttcaaagttgggaaagggactctgttccctgcaacagctgatgcaattctgtgg

SEQ ID NO: 571515 - DNA, 302 bp, Homo sapiens
tccgcacgggtgatgcggttggaggaccacggccattggactcactgtggctggactggaggggacccgtggctagggggggctctggtgtcctgattggcactggtcccacctgctcctcagtgcatgccggtgctggctggtatgggccgagcttcaggttccaggatgcttctctggaacctcaaggcaggcaggccagtgcctgggcctgatctctaagcccgtcatgctgctgctgagcacagccagccaacctgtccctccctgatcctggggccccatttcctccagggaccagt

SEQ ID NO: 571516 - DNA, 289 bp, Homo sapiens
tcctcttaagcatggggagagctggggagtcgtgcctgtagggctgtggctccactaaggcatggatgtgctgcaccaaagctgaggctagtccagagggctccggcccaggtcagcgcactcaggagctacactccctcatgtcctgctaacccctggtgtgcacagagtttacacagccatcggtttttatcaacgaaaatataattcacctaccagaagacagatcatgttctgttttattatattttatttgatttgtactatctgagacggagtctcgctgttg

SEQ ID NO: 571517 - DNA, 205 bp, Homo sapiens
cgtcatccatcaggtgaagaaatagtcacagctctccttgctcgaattacttcctacaggagcacggcagttacaccactggaggcattcctcagtgcacagcgcaatttaggtgcaagagtggtgctggggtactggcgttggtctggctagctggctggcaaggtcataggcacagacacacaggggcaatatccgttctggg

SEQ ID NO: 571518 - DNA, 356 bp, Homo sapiens
gttttccagctcgttccactgccgacgcgacgcgaggtcgatgcgtcggaacatcgcattgcgcaccatgacgcggaatgcgcgcgggttcgccgagatgggactttgattgtcggcgccgaacgcaacctcttccgtatctgcctcggctccggggtcggtgagtgactcccattcgtcgagcaggctcgagtcgacctgacggatcagctcgcccaaccactcgatgatgtcttcgagttcctcggtgcgcgcttccgtcgggacggtctgtcgcagcgcgcggtaggcgtcggcgaggtagcgcaggacgaggccctcggaccgggtgagtccgtaatggcttatcaactcgg

SEQ ID NO: 571519 - DNA, 174 bp, Homo sapiens
acccctctctatatgcctgtatcttcagtgctgccactaatcgtgcattttacttctttggtttaagtactgaagcatatgatgaaagtgctctgctaagtagcagctctagaaattcaattatccgatatgtatttaacatctccgaagaacactcagggtgaccgagctcga

SEQ ID NO: 571520 - DNA, 196 bp, Homo sapiens
ctctagaggatcctgaggtggttgtgggtaggggtagaacatgggctggagtccgaaagacagagtcaagtcctgatactccctaatgggatatttcttcccctttttaaaattttctttgtggttaaccaggttttgtgttgttactgctgttgtagtagttgtagtagttgttgtttgagatagagtctccctc

SEQ ID NO: 571521 - DNA, 164 bp, Homo sapiens
atgccttttgccccattttactgatcaaggcaacttacaagggtagcccccattcaaggggaggcgaagtaaattcagcagttgatgggtagaaccatatgcatctataaagggaaaaattgctcatagccctcttagcagatagactgtgtttcattccctga

SEQ ID NO: 571522 - DNA, 1264 bp, Homo sapiens
  misc_feature (293)..(293): n is a, c, g, or t
  misc_feature (393)..(393): n is a, c, g, or t
  misc_feature (405)..(405): n is a, c, g, or t
  misc_feature (459)..(459): n is a, c, g, or t
  misc_feature (1264)..(1264): n is a, c, g, or t
gggctgtgctgcggaaacgcgaccggtccggttccgcgtgcccagtgcatgagggactctgtcaagacaactggcatgcgagccagctgctctgtgcaatgagccggtgccgtgactagcttgcgaggacgccagctgcctactccagcatagtctcgtgcttggcacgccttgccctcctagccgttgagcagcgtatactacttgagactttgatcgtgcatagggaccgtagcactgagccgagatggtgtatcatacggcggagtcatcgaactcgtggttaccctaantgcacatagtaaccacagagcgtgcaagagggtggagcatcgcggtggaactctatctctgattgatacctcgccatgcctcgggtgtatctgctcgatnacaagttcattntcaattgcgcggtgattgtgatcatcaattggcgccatcccaagtcagtagcgnctacttgatcgattcacgcgactgtgcgcacaaggtaatctagtcgtttgtcgacgttgctagcttcttatcgcttgagttagcccgtatgactgcgttggtggttccgttgcatccttagtcactctatggagccctcggcagacggctatctctcctactttcaggtccatgtgtattacttcctactgctgtcgtagtccgacgcttcgtttagcacgggtgatccatcatcgcgattcttgtgtgctagcctgctgggcgttcattcaaattcgacccaggttgccgcccattgcgttgctgacctcttccctcagataatcaatccctcctagtcttggtcgcccattcggctgtggcgcctgggggtctgcgtgcgttatatcagggcctggactaggtcgtctgttgaacatgacatgctgctgttcttcggcccctggggattactgttctcttcatccttcaccgacagtttcgggctatccgctggggtaccttcccccaaaggcttgggaatctgctgcttgggcctttcaggattggtgctgggtgttgctggacccttttcctgcatgggagagaggccctcaggcgggcttatccttgtccccggcttccattttagactcctttggggccggcaggtttcttgtgtcccacctggggacatggtgaaccctgggttggctttcactccccctagggagaggctgcctcctttaccttggcaattgcgagtgcctttcgcaccttgggcgccttgtgtgtacttggccccactctgggccctggatccttn

SEQ ID NO: 571523 - DNA, 136 bp, Homo sapiens
tgtcttcgtgaagtctgagagacacggcgtgcagtccctcagcaaatacaaaccttccagctcattcagggtgtcaaaagtgaaagtgcaggatttggactgctacacgacctgtgctcagctgtgcccgtttgaa

SEQ ID NO: 571524 - DNA, 643 bp, Homo sapiens
  misc_feature (590)..(590): n is a, c, g, or t
agaaatgctatctatcaaaatagactagctcttgattacttgctagcagctgaaggaggagtttgtgaaaaatctgaccttactaattattgtctacacatagatgatcaggggcaagtagttgaggatatagttaaagatataacaaaactggcacatgcacctgttcaagtgtggcacggactcaatctgggagccatgtttggaaattggttcccagcaataggtggatttaaaactcttataataagagtaataatagtaataggaacctgcttactgctcccttgtctgatacctgtatttctccaaatgataaaaaacttcgtcgcttaaccttagttcaccaaaatgcttcagcacaagcatactatataaatcactatcaatctattgcacgaaaatacataagtagcaaaaataagagtgagaactcccactgataaaaagtgagagtctcaaagaggggaaatgagggaagagagagaccctctcatattgttttatattgttttatactcagtacctcttttaagaaaaaaacaacaaggaagtagaaccaaagacaagcagcccagcgccaggcccanaaccaggcctggctgcctggtctaaaccagtagttaaaatcactcatacttag

SEQ ID NO: 571525 - DNA, 199 bp, Homo sapiens
ggaagcgggagcgagccaggcgcagtttgattcctttggcagcagttttaggtctgtcagtactgcactgcagattcgcagatttgggatctctgctggccagtttgtcgcaagtgtcttggataagtcaatcccagttgaggctcttaaagtcttgtgatagcctcagcgttaccgcaataggccgcgtgctttgaac

SEQ ID NO: 571526 - DNA, 113 bp, Homo sapiens
ttttttttttcccccccgggggccattggccggttaaaaaaaggggacttcataatttcttccccaaacccccagggcttttttaaaaaataaaatttaaaatggaaagggga

SEQ ID NO: 571527 - DNA, 159 bp, Homo sapiens
acaggatcttctgtatgatgctcacgtcaggttttagcccacttgtggtagactggaggtggtatcatttattctatttataaacaatgttatagtttgtatgacagttatggtataaactatgttataaattaagagttagtgttggggataacatca

SEQ ID NO: 571528 - DNA, 199 bp, Homo sapiens
tgccagcgctgggcctggatggcaccaagatgcaggagctgggcctggagaggctgccaagaagcatgagctgggcctggctgagtgtctgacttagagaaagttcagtggcctggagcgcaaggctgggagtgcagtgagctggtgtctaaacgaggccatatgtaactgatgtgagcatgtgccctgtgtgagtgct

SEQ ID NO: 571529 - DNA, 211 bp, Homo sapiens
accagttctgtatacctgtgtggtgatatgtatctaccacatccgccatcacgcatcatcttcttcaatgatagcttccaattcatctgaatattccatctgttgcaccgttaatagcacggcacatttttggttaccaaaaattgtttgcctgtgggtaggtatgccttcactttcaattcttcccctgtagcccattgccatgttggac

SEQ ID NO: 571530 - DNA, 907 bp, Homo sapiens
tgcccctcattatagcgtaaatattatagctagcatttaccatctcacattctaggaatactagtatatcagctcagaccgtcatagtcctccctactatgcctagtaaggaataatactatctgctgttcattatagctacgtctcataacccatcaaacacccactccctcattagtccaatattgtgcctattgcacagtaactaggtcgtgtctggcacggctggctcacagcaagggagagagcatcagggcttgtcatggcgaaactcggctaccctgtcttgcaggaaggtagaatcagagcgacagtccaaagggacagcaaaggcaacaggcatgaccggggtaccttcgggatcgccgatggcatagatggctgacaaatgcaagtatagcagtacagcgaagaacacccagagaagaagtaaagagtgaacccaagaacagtaccagcaagagtacgtgacccagacggaggaccacaaggacactggacaagaactgggcgccacaagcacgacatgagggagacagaggatcagcgaagggaccatacccggcgcaggaaaacacgcaacagaaaagaataacacgcacaggtaacacgtgcgctaaggatagaaggggaaaagcaacccatggtgaatggaagccacggtcggcccttaagaagaaatgccacatctatgggaaactattgaagaggcgtcaaagcacccaggcgtgtcctagagtaaagacagtgcatcaagtggactaagtgggcggtataacaagtatatatacccaaataataaaaaagttaatacacaacggtgcacacgtctcgcacaatacaggggagaaagggaagagcacagtaagaagcaattacgagatggataaaggaacagttgagaaac

SEQ ID NO: 571531 - DNA, 582 bp, Homo sapiens
catcatccgcgcgctcgcagcttctcggtctcgcctgcctgccgctcccttgcttgctcggcgctttcgctcgccctctcctcgaggatcgaggagtgactctgaccagcagcctgtggctgggaagggagacagaggcggcggcggtcaggggaaacgaggctgcagtggtggtagtaggaagatgtcgggcgaggacgagacaactggagcaaagctatcgctgaggacctggtcgtgaccagcgtatacacgatggggggcgacatcgctcaacagggtacttcggtccttggtggagcgcatctacgctcaggtgtgtcggtagcgtgacgccctgtgttgagaaaggtgagtgccatgagttactggaaggaatagcactgcaagagtctggcagtgaaagaaccagtgatcctgaagaagggtcgcttgcttcacccagccaggcattgccgggtaccataagctgtgtatctgagttctcccctttgagggacgcgaacaggagtcactttttctcacgggatggtggctgtgggtataggctggactcggcggtccaggttggctggggtaccc

SEQ ID NO: 571532 - DNA, 848 bp, Homo sapiens
  misc_feature (299)..(299): n is a, c, g, or t
  misc_feature (524)..(524): n is a, c, g, or t
cttaatgtgccactgttcggccgtggggcactttcttcggattcccttcccccgaggtctccggggcaggcttccgttttgtgtcttccaaaaaagtgcccctggtaaggccgccccagctctgtgagcccgtcactcccctggaggtctccaaatattgtcgagtggccccccaacgggaggacgcgcgtggttgacccccggaaacccgcccccgagctccctccgcgcaccccaccttcaaagaggtgtcctttcacaaagtcccacgatttatggtccagagggcgtcttccccntctaagaatccgcccattggggggattccaaatttttccgccgtttcctttcacacgcagagctttcctccgtggtaacaccccacccagggtttttctgtcaaagggcccaacctgaggggaaggtaaccgatgtgggtgacccgattttctcaggtcccgcgggatccacccctgcccccatgtacaatcgggcacttactcggcattgtttggggcacacancacattcttggccaccaaaacttttaacgaggaggagtgtcaagcaagccgtgaacccggaatgcgcatcccacccttcgtgggaggatcgcgagaaacccaccatttggaagggctgcgaatccccaatccttacatttgaaaggagaacaaaaaggcctagaacatctgatcctctggcctcccgccactcgtttaggaggctcctcattaggtcctcaccagggatatgctccctccgttgcgtggtcccctccggtttccggaaaggctatgcggaaagagaacccctaaaacctaaacactccgtatttccccaccccc

SEQ ID NO: 571533 - DNA, 174 bp, Homo sapiens
ttttttttccaaaaaaaagggcccccccccccgggggggggggccccccccggggggggggcccctttttgccccccccaaccctttttttgggggggggggggggggccccccccccccgggttttttggccccccccccccccccccattatgggggggggttttttttcca

SEQ ID NO: 571534 - DNA, 958 bp, Homo sapiens
ggagaaatactaactattctcgcactcacctcatatcctccctactatgcctagaaggaataatatctatctgtctgtttcattactagctactctcagtagagcgcgcgtgcaagcacccactccctctgtagccagagtattggtgcctattgccatactagtcttggcgcggcgtggcgaagcagcggtgggcctagccctgagctagtctcaatctccaagcacatatggcctagactacgtacataacctaaacctactccaatggctaaaactaatcgtcccaacaattatattactaccactgacatgactttccaagaacaaaaacaaaacaaacatccgagagagagtagatcctgctcctcctctactccgtggtgccgtggtggaacacttttacttatcccgtgggagggctgacccggaatcttggcaagacaccctcggggggcaactggcgcgcgaaacaacccgcacctgggggacagcgccaccacaccagcacacacatgcggcccaccggaacccacaccatgacacagacgggacaccacaaatccggcaatcggaaccgccccaggcaccgaagaaccccgcgggcacaccccacaaaaccacccccgcccacccacgtgggcccacccagtgaaccccaacacaggacggcaccacgacagaaacccgcaaatccccccaagcacacacaacacctcagggccccaaatccagggcaccccctaaaaccagcgtggcaaccagccgaaacggaaagaaacaaagcacccaacggacaatcgagaccagcgcgcaacacacgaggaacacaccccaaaacaccccggaaccaccgaaacgccccaacgagaaaaagcccaaaacacacgcccccccagcataaccaacacacgacactgcccgtgaacaccaaatggatgcgcacacgcaacaaaca

SEQ ID NO: 571535 - DNA, 180 bp, Homo sapiens
cattctctgtttacagtgttctcgcagtttggccttctgtattcagtccgagtcttcccaaacgctgcagtggcccgccctggtttctacgccatcatcaaattttactcatcgagagatgcgcagagagcccagaaggcatgcgacggcaagcccctttttcagacatctccagtgaag

SEQ ID NO: 571536 - DNA, 203 bp, Homo sapiens
atagaagtgtgccatgaccctctccctctctggatgcgcaccatcattgacactcggcgtcatcggcgtctcttgtgctgttggcgtgctacctggaagatccttctgtcctggacacgtcggcctccggccgcgcattttctgttttaagcacaggcagccacgcagcagctacaacaacagctgagatcacttaatccatg

SEQ ID NO: 571537 - DNA, 286 bp, Homo sapiens
ccgggtttttttttttccccggggggggggggggttaaccccttttttccccccccggcccccccccccccgggggggtttttccaccccggggaaaaaaaacgggtttccccttttttttcccccggggggggccccaaaacccccgggtttttttgccccccccccctttttgggggggggggggtttttttttttaaacagggggggggggcccccccctttttttttttttccccccgggccggggggggtttttttcttttaaaaaaaaaaaaggtcccca

SEQ ID NO: 571538 - DNA, 226 bp, Homo sapiens
tggactggaccggtgaggtctgaccattagccatcaaaggtaggtgtagttctcactcttaggtacacaggtgaagttaaagacatccttattctccctggggtttaagtggtggatggtgatgtagggcttgggcagcttcggaaggagattcagggtgcctgtttcactgcggctggcacttcactgggttccgtactttcacatccatagggtcctgaagtat

SEQ ID NO: 571539 - DNA, 259 bp, Homo sapiens
tagatcttttcatccacttcaagttttttatttttatttgagagacagggtctcactctgtcactgagggtgcagtggtatgatcatagctccctgcaggttgaactcccaggctcaagcgatcctcccggctcaagctcccgagtagctgggactattcgcacataccaccatgcctgggaaattttgtcttggtttttttgagacggggtctcgctttgtcacccaggctggaatgtacacggctaatgaaattttt

SEQ ID NO: 571540 - DNA, 402 bp, Homo sapiens
  misc_feature (53)..(53): n is a, c, g, or t
ctggggaaaaaacctgggcctaagcccaataatgtaagaaaaagcctgaaaanctgggaatcccctttcctttaccacccttaatacaaaaaatcaaattcaagatggattaaagacttaaacgttagacctaaaaccataaaaaccctagaagaaaacctaggcattaccattcaggacataggcatgggcaaggacttcatgtctaaaacaccaaaagcaatggcaacaaaagccaaaattgacaaatgggatctaattgaactaaagagcttctgcacagcaaaagaaactaccatcagagtgaacaggcaacctacagaatgggagaaaattttcccaacctactcatctgacaaagggctaatatccagaatctacaatgaactcaaacaaatttac

SEQ ID NO: 571541 - DNA, 719 bp, Homo sapiens
aacgacaatgtacgaggcgtccccgttttgatttcagacgggctgggtttacgttgtacgtagtggccgtggtctctacaattgatacattcccggagcttacttaaacgtggacaatggctacttggagggactaggtgcgcggcctgaaggccggggtgctcagccaggccgactacctcaacctggtgcagtagcgagacgctagaggacttgaaactagcatctagcagagcactagattataggtaacttcctggccaacgaggcatcacctactgacggtagtcagtcatacgatagaccggctcaaggagaagataggtggtggagttccgccacatagaggaaccatagcctatgagccactacgccagcttacctagacttacattactataacagttacatagatacgacaacgtagatacctagctacatacacaggcacgctgcaccagcgctccatcgctagagctcgtgcccaagatgccacccacataggcagcttcgagcagatggaggccgtgaacattgctcagacacctagctagagctctacaatgccattctggtggacacgcctctatgcggcttttttccaggactgcatattcagaggcaggacctagacgagatgaacatcgagatcatccgcaacaccctctacaaggcctacctggagtcttctacaagttctgcacctacagggcgggaca

SEQ ID NO: 571542 - DNA, 925 bp, Homo sapiens
taagttgggaaaacccaagggggtttataaattcatgtggcccacaatcttgtgggggagaaaaaatttggggggtttcaacccccattacaaaaaactaattttggaaaaaatgttttttattatcagtcgcaaaagagcccccacgcctcattttccccaacaaggccctggaagattcaaagagtcctaaatatgcaaagaaaaccaccttgaaaaaagagcgcaggcttgtgtactccacatggctggtaaatcccccagatctttgggggaaggttgagaggtggcgcggatacactctgggagtgtacaaggattttttcggagaacagtctggggccaaacacgagggtgaaaaaacaccccctatctctctctatacctacaaaaatatcaaccaaaaatattaaagcccgggcgcgcctagagggggggggcgatggccctttattatacccccgcgagctatacacatcgacgagagaggagagctcgtcgacaagacacacgagagagaaatatcactcgtcgtgtgaaacagctccgaggagagggccagagagagtgggcggggggcgaagcgcctgaagaatacggtggcccatgtggaggctcaccaacgcgcgggggtgacagcagagaagccaaacagatccatctgttggctcccataaaaaaaaaatacaacagagtcaacacagaagatcgaatcgacaatccagctagaaacgacatcgagaaattcaggacaccccccctgtggagagaaagggggcgggcgccacaaccacatgatcaaacacccctctttggtggtgcaccccgacaggtattacattcctctcaccacaacagcgtggggcactactcccggggaggacaaccctcctcgggggaggacaccctctaaatctccccaaga

SEQ ID NO: 571543 - DNA, 348 bp, Homo sapiens
ggaggcagtatactgtgccactgatatacatggtctggagggagtaagaggctggagagctgcaaacactgggaggcgagcttcacgggctggactcagagcagtcagagctgctggattcagggcccccaaggtgaactgctccattcagttgcaaggcagctgcttgcgctgtgcggtggcggaagaagcagcagcagcagtgtttggcagttggattccatcgccttctgccagtttggcaatgcgctgacaacttccacctgctgatcccagatccagctcctggtccccatcaggaaaagtgatgtctgtgcaccatccagtcgctcagtcacatgaccactc

SEQ ID NO: 571544 - DNA, 638 bp, Homo sapiens
ggggggggaaatgtggccaacggtgccatcaaaaatacgcatacagctgtgtgtcaggctttactaaaatatgaatttagagtataacatggtggagatgtaaattcttttcctcaatctcccaccaggtcttttaaggaacaggagagaagtcagaaaggtctaggatcactttacactctcaagagtatgttcggggcttgaagagatgaatgattgtgtatagtaaaagaacaatctgggattcgggtttagaattggatgagctagatgcggtgtacaggagttactgaaacaattcacacattggcgggtttagtgatgacaggtagacacacagttttcacaattacgtaacagtggaacaatagagcagtaatttttcctctcgtgtattcagatgagttgggaggagcacaaacctttattggaggtaagggtgtgggcaattgtgcccgagggaaacttttacattagcatgggaaagaacctttgcgagtttatttaattcagccttaatctcttggaggagtttattacacatcagtctggatagaaaattctgtactgttttaaagatctccaggggatttgcagcaagttttcttctatagcaatgtgcttattattccatgatt

SEQ ID NO: 571545 - DNA, 185 bp, Homo sapiens
ccagccaggcccttactccaagacctatgagtttggcgtggtgaattttgtggattggtacagcgagcggatgctcaacaacctgggcgcggcgccggcgccttatctcaaaggcgtagctgctcacgaataacgcttgtgtgggagcgggcttgcccgcgatggcattgtgtctgtcaaagcct

SEQ ID NO: 571546 - DNA, 525 bp, Homo sapiens
gccgactcatgtctccagtctacccaaatctctaggtggccaaggaaatacaaatgctggagacatttaagaaatacatttcggccaggcgcggtggtcacgcttgtaatcccagcactttggaaggccgaggtgggcagatcacctgaggtcaggagttcaagaccaatctgaccaacgtggagaaacctcgtctttactaaaaatacaaaattagccgggcgtggtggcatatgcacctgtattcccaagccacttgggagactgaggcaggagaatcgcctgaacccggaaggcggaggttgcagtgagccgagatcgcgccactgtactccagcccgggcgacagagtgggactccatctcaaaaaaacaaaaacaaaacaaaccaacacaaaaacagttatggaatttgtctgacaaccactcattgccttccactctacccaaagtctagtttggcaaaaaaatttaaatgctggagacatttacgaaatacatttcgggcaggcgcggtggctcacgc

SEQ ID NO: 571547 - DNA, 741 bp, Homo sapiens
cttgcagcacatttaattctaactagccagatttggtgatcaacagccaccgctgactgtggccaccatactggatagtgccactctaagaccttgatactcaaagtgccccatgaacagagagcatccacatcacctgtgagtatgttcgttgtatcaaatctcaggccttatgccaggcctactggatccaaatcttcctttcaacaagatcccgaagttactggatgcacattaaagaaagaaaatcactgcatttctggtttcccaaatgtatagaacattggtgttaatattactgcctatgacatagattcttttccaaacagctttattgagataaaattcatattccttataactcacccttttaacatgcaaagctcaatttttttagtgtattcacaattgtgcaactatttcagttatctaacttgataatatttttcttaccccagaagaaacacttctacccatgagcaatcactcagcacttccttctttgcccagtgactgacaaccactgatctactctatctatggaattgccaattctggacattttatataaatggaattatttaaggtgtggtctttcagtctgtctcgtttcacttagtataagtacattgatctgtagtctttatttcttttgatgcctttgtctagtttttattaacagaaggtttaaaaatgcttcttcttccaggttttgcgaagagtttgggaaaacttggggtc

SEQ ID NO: 571548 - DNA, 189 bp, Homo sapiens
tgtaacagtgtcaagaccattcacgtgtggcaaggcagtctttccaacaaatggtgctggacaaagctggacatctacactatagaaaaaagctggacccttacatgatattccaaacttaacaatcaattaattcaccaaagatttgtgaggatggtatagggagtaccgatgctcgatattcgatac

SEQ ID NO: 571549 - DNA, 127 bp, Homo sapiens
agtcgattctagaggactccccctcattactacttctgccttagcacactctaactacgaacgcactcacagtctgcatcataatccctctctcaaaggacttcaaactctaacggtaccgagctcg

SEQ ID NO: 571550 - DNA, 590 bp, Homo sapiens
gatctagaggacctctgtgtgcccagaaccggagaaccaaaaaagattggaacagcagacagagaactgattcaaacgtcagccttaattttcttactcctttaagaaactttatagaaggcgattacaaaaccattgctaaagaacaggaactatttgcaaataagagactggatttggatgctggaaaaacgagactaaaaaaaggcaaagctggcgaaactagaaattcatctgaacaggaattaagaataactcacagtgaatttgatcggcaagcagagattaccagacttctgctagagggaatcagccgtacacatggccatcaacttcgctgtctgaatgactttgtagaacgccagatgacttactatgcacagtgttaccagtatattgttggacctccaggaaacaaactgggaagttttccatcccaattatcttagtaacaacaatcagacttctgtgacacctgtaacatcagttttaccaaatgcgataggttcttctgccatgggttcaacaagtgggctagtaatcaactctccttacaagctcagtgaccttaaggagtgtagtggcagcag

SEQ ID NO: 571551 - DNA, 766 bp, Homo sapiens
tgacgttccccgcaggaactgacgtcagaccccagtctacaggggcctgcacaagataggtgcctggctctaaggcgtaggaccctacggccacagccctggcaccgatactatgacgggcgagggttactagtactatgtacccaaccatacagatagagaaagctagagactcagtggccagcaacccgggtcccagcggagcgcccggcacacgccgacactatacagcaccagtggcggtggccaccactgtgcgcggagataggctgcgacgcgtgcgcagatctcgatcccaaagctccctacctgccagaatactggacccgaataccacccatatgcccgtatttactagctgccgctggagagaatactctagaggtaccccaggagagcctgcctgcacggaagagacgcctacctacggtataggaccgccccggagaggagcgattaaggtagcagacctaccatgttgctcttgagccctgagcggctatcagggagccatagtttagtatactaggcagggcggccgaactcactgagcatgtgcagccctggccgggcggactacaagttctgacatacacagggcggtacctgaagtggacgtagtatgtacgagctagttattaacgacaatgctctgtgtcagggcctctaatctggaataggatattcggaaaggtcggcatcaggccctggttcagaacctagcatatgggtaacaggccggcaggcatctctgggttgagaaact

SEQ ID NO: 571552 - DNA, 260 bp, Homo sapiens
gctcggcctgctgaatccacctcctagactcggggcatcaaggctcatggaggtagtacccagacctgctccccgagtccagcgaccctgtgacaccgtgactgcagggagttggggactaagggactaccagagagaggctgaaaacgactccaggcccctgggaagactgtactgttcctgaaaactggccttggcacacatgggcttcggacacggacggaggagagcaccatgatatcggatcagcacgaggatcc

SEQ ID NO: 571553 - DNA, 388 bp, Homo sapiens
  misc_feature (1)..(1): n is a, c, g, or t
ngtgagctctcatatctctggtatgtttcacatgctatgacatatgtggccaattccgttgaggtagtcagtagcaacactgaatgctgctccggtacaatagtttgagtgcctaggccatagcacatccagtcggtacagaatttagtcagttctgcacagaaccaatgatgcacgatataaggcagccatgtctctgcagatacagaatctcgccatggcatacggtaagtcagtacaggcagggtccacagagtgtctggggcagtagctgacagcatcgggctgctgcggtctgtactggcacacaggtgtgtgtgccggcactaatggccctctcttaggtttcagcgtcctgtatgccagagctttgagtacgacacggaat

SEQ ID NO: 571554 - DNA, 822 bp, Homo sapiens
  misc_feature (77)..(77): n is a, c, g, or t
  misc_feature (822)..(822): n is a, c, g, or t
catcagcatcggcgcggagactgcggggcgggccatggcggcgaacctgagccggaacgggccagcgctgcaagagncctatgtgtcgggtggtcaccgagaagtccccgaccgactgggctctctttacctatgaaggcaacagccatgacatccgcgtggctggcacaggggagggtggcctggacggagatggtggattgagctcaaacagacgggtgaagagtgactgtacgccattactgacagagtgacagggacacccacaacatctggaactgacccaaagtttgctccatcaatcaaactgggaacagtgcggacggggcgctgacacggacgaggagccgcgaaacggggacgcccgtggtgcccaggacacaacagagcacgcacaccactaggcgcaaagaagtaccccatggacacgcggcgcaccccaatggtaggacacgcaggtcaaaacaggcaacccaggagaggcccaggacggcaacggggaatagaccagagaaacgccccgtggaaaagatggacagtacgaatagggaaagaaaccgggaagggcaacgaaaacggggcagaccacaacaaaggatcggacacacaacagagataaaacacaggcagagcgtcgacacacgcgagcgacaggggaaaagcacacggactgcgcgacccgaggacgttggagacccaagaggcaaacaagacgaaggaacagaacaaaccccagccaagaaggccagcacccacaaacgaactggacacgagcgcacccgatcgagaacggtctaacagacacagggaagaccgccaacn

SEQ ID NO: 571555 - DNA, 239 bp, Homo sapiens
  misc_feature (20)..(20): n is a, c, g, or t
  misc_feature (27)..(27): n is a, c, g, or t
  misc_feature (53)..(53): n is a, c, g, or t
  misc_feature (79)..(79): n is a, c, g, or t
  misc_feature (230)..(230): n is a, c, g, or t
ggccatgcttcagggtcttnaggtacntgccccgggccagtctgccaagaggnacccccttccccagcctctcgcctgnactgatgcagacaaaatctcacctggcaggcccaaccccccccacccctcccccgccgtgtgtggctcctcgccgcatcgttggggttttgttatgtgaaaatatccctggaaataaatacatgtttctgcacttagagcccagaaaaagnaaaaaaaaa

SEQ ID NO: 571556 - DNA, 122 bp, Homo sapiens
ctcatattatcagtgttttaatctagacgcaggcttatgcggaggaggatgtattcatgttacttatactaacattagttcttctatagggtgatagatatgaccaattgggtgtagaggag

SEQ ID NO: 571557 - DNA, 799 bp, Homo sapiens
  misc_feature (55)..(55): n is a, c, g, or t
  misc_feature (57)..(58): n is a, c, g, or t
  misc_feature (385)..(385): n is a, c, g, or t
  misc_feature (451)..(451): n is a, c, g, or t
  misc_feature (534)..(534): n is a, c, g, or t
  misc_feature (547)..(547): n is a, c, g, or t
  misc_feature (550)..(550): n is a, c, g, or t
  misc_feature (559)..(559): n is a, c, g, or t
  misc_feature (563)..(563): n is a, c, g, or t
  misc_feature (572)..(572): n is a, c, g, or t
  misc_feature (578)..(578): n is a, c, g, or t
  misc_feature (592)..(592): n is a, c, g, or t
  misc_feature (604)..(604): n is a, c, g, or t
  misc_feature (612)..(612): n is a, c, g, or t
  misc_feature (619)..(619): n is a, c, g, or t
  misc_feature (621)..(621): n is a, c, g, or t
  misc_feature (631)..(631): n is a, c, g, or t
  misc_feature (643)..(643): n is a, c, g, or t
  misc_feature (645)..(645): n is a, c, g, or t
  misc_feature (648)..(648): n is a, c, g, or t
  misc_feature (657)..(657): n is a, c, g, or t
  misc_feature (660)..(660): n is a, c, g, or t
  misc_feature (693)..(693): n is a, c, g, or t
  misc_feature (696)..(697): n is a, c, g, or t
  misc_feature (701)..(701): n is a, c, g, or t
aaggctaggtactgaggctgggtttaattcgagcacaggagccagatgagttcgntnnagaagtaccggctgcggagtaactgcaaagatgctgtccgtgcgcgttgctgcaggccgtggtccgcgcccttcctcgtgcgggccggactggtctccagaaatgctttgggttcatctttcattgctgcaaggcaacttccatgcctctaacactcatcttcaaaagactgggactgctgagatgtcctctattcttgaagagcgtattcttggagctgatacctctgttgatcttgaagaaactgggcgtgtcttaagtattggtgatggtattgcccgcgtacatgggctgaggaatgttcaagcagaagaaatggtagagttntcttcaggcttaagagggtatgtccttgacacttggaacctgacaatgttggtgttgtcagtgtgnggaaatgataaactaattaaggaaggagatatagtgaagaggacaggagccattgtggaccgttccagtggtgaggagctgtngggtcgtgtagtnagntgcccttgngtcntgctattgntggagngggtcctgttggtnccaagacgcgtnggcgagtnggtctgnangcccccggtntcattcctcgantntcngtgcggganccntgcagactggcttaaggctgtggttgttggtgncanntggncgtggccggtggaccgtcttggtgcccgcgatgggcgaccccctgggtgttggcgcgcttatccgaaggttcatgtgcttttggagaagggccggttg

SEQ ID NO: 571558 - DNA, 817 bp, Homo sapiens
  misc_feature (55)..(55): n is a, c, g, or t
  misc_feature (57)..(58): n is a, c, g, or t
  misc_feature (385)..(385): n is a, c, g, or t
  misc_feature (451)..(451): n is a, c, g, or t
aaggctaggtactgaggctgggtttaattcgagcacaggagccagatgagttcgntnnagaagtaccggctgcggagtaactgcaaagatgctgtccgtgcgcgttgctgcaggccgtggtccgcgcccttcctcgtgcgggccggactggtctccagaaatgctttgggttcatctttcattgctgcaaggcaacttccatgcctctaacactcatcttcaaaagactgggactgctgagatgtcctctattcttgaagagcgtattcttggagctgatacctctgttgatcttgaagaaactgggcgtgtcttaagtattggtgatggtattgcccgcgtacatgggctgaggaatgttcaagcagaagaaatggtagagttntcttcaggcttaagagggtatgtccttgacacttggaacctgacaatgttggtgttgtcagtgtgnggaaatgataaactaattaaggaaggagatatagtgaagaggacaggagccatagtaggaacgataacaagaaggtgaggaagacatgtaagagagatcagtgtagtaggatgaccattggtaactgctattagatggaacagggtcaaataggtaccaaaaaaagagtaaagggaagttgaggttgacatgacccaggatatcatatcctacgaatatcagtgctgggaaccaatgaagaatggaataatggtagtaggatagatggatgaaattggcagatggaaaagagaagtgatatggtgacgaaagatgggaaactcattgtatgaaaacattacaaagttaagagactgtgaaaaaagg

SEQ ID NO: 571559 - DNA, 209 bp, Homo sapiens
ggaaggaagggaaggtgttaggcggggccctcagattcatcggctaccccccagggctaaaacgccatgacttcatatttacaagcaatgttaaaactggacttcaaggatgtacctttttgagggcccaaaccgataacccttagtgtcgcagtgaggtggattcaaacgaatacctttccattgcgatccagagcaatcattcgggt

SEQ ID NO: 571560 - DNA, 337 bp, Homo sapiens
gtactcgaccgcgcggctgacggtgctgtcctgagggaagtcaggttttacggtgtcagcagtttccagatggaatctgtcaaaatcatccttgtcttggacactttatccctggacttctgctttgctgttggcagcttcataggctaagtacaatttttattagttctgcagctacagacagataaggtcctggtgcccctgtcctcagcaggctcacagctgagtggaaacagatacagaatgaaatggttctgatccgctatgataaaggcataatgaagggcacacacagagcgaagggagctggggagcacctgctggagggggccgcgcg

SEQ ID NO: 571561 - DNA, 145 bp, Homo sapiens
cgaaatgcgtagtgatggtatatactgttgctgtgtgaaattgtgctcctgaagcttaatgaaatctgtgtgtgtgtgtgtgtgtgtgtgtgtgtgtgtgtgtgtgtgtgtgtgtgtgtgcgcgcgcgaggaataagttaggggg

SEQ ID NO: 571562 - DNA, 158 bp, Homo sapiens
ggccgacggttgtggaggtccgtcatgggccagacttgcgttggccgtgagcctgtggtgggcagctgcggcgtagtgggtggctgcggcgtggtgggcggcatgcagggcacgcacaccgccctcctcgtggtcgaatctttctcctcgttgttttt

SEQ ID NO: 571563 - DNA, 368 bp, Homo sapiens
taattcaatctggaatcaaaaagcgggggattctggcaaatggtccttgtgccctccccattcatccctggtttggtcccctgtggcctatagccctttaccctggagcccaccccaaaaaattggggaccagccccctcgcttgcctgtgtttttccccaaacgcctttttagaatggggagggaaagatggaggacgaggggagagggacctgcccccctcctgtcaggcattcttgggaggggcccttgcccccagtgggcttatactcctctcccgtgggggctttttcttccccgacacattttggttaatacatcaacaccgtgatataaaagctatacagaggtttaactatgaagccccc

SEQ ID NO: 571564 - DNA, 283 bp, Homo sapiens
tttttttggggttccccccccaaggccctttttccgtgggggggcccccccccggtttttttttttggtgcccctgggttttgattttttaaggggttttttggcccccccgggtttttttttttttttaggaaccccctttggttgaaaatttttttttgacctgggggggggggtttggggggcccccctttaaatcccggggccccctggggggtttttttttgggtcccgtttattttcccttttttgggggttttttttaaaaaaaaaacccccccca

SEQ ID NO: 571565 - DNA, 194 bp, Homo sapiens
ctgccgtgagaggcggcatacacagcagacgagagacctatggagctttcattcattcatgcaacagtactacagaccacaggtctctactaccagacctgcattaccatttcggttgggcgactcggagcagagccacctcgagcagtacatgcttaggacttcaccagtcaaggcgactactatactcgatt

SEQ ID NO: 571566 - DNA, 223 bp, Homo sapiens
  misc_feature (5)..(5): n is a, c, g, or t
  misc_feature (7)..(7): n is a, c, g, or t
  misc_feature (39)..(39): n is a, c, g, or t
  misc_feature (41)..(43): n is a, c, g, or t
  misc_feature (56)..(56): n is a, c, g, or t
  misc_feature (59)..(59): n is a, c, g, or t
  misc_feature (90)..(90): n is a, c, g, or t
  misc_feature (97)..(98): n is a, c, g, or t
  misc_feature (125)..(125): n is a, c, g, or t
  misc_feature (129)..(129): n is a, c, g, or t
  misc_feature (131)..(131): n is a, c, g, or t
  misc_feature (146)..(146): n is a, c, g, or t
  misc_feature (167)..(167): n is a, c, g, or t
  misc_feature (218)..(218): n is a, c, g, or t
gtccngnggcctgaaaagaatgcaaaagacggcctgaangnnngtgttaaatatcngangagcaagtagcggaagagattcttttccccnggtcatnngaggatagaactaggaagcagatttcngctncnggtgaagaagttaanggatatatagcttcctctccngttttcggatccagtatccccgggttctgacctgatatttcatagccgcgnggcac

SEQ ID NO: 571567 - DNA, 113 bp, Homo sapiens
acctgcagatgtggcaggttattcatttggcagctttgccgacagacttccagcccgtgacggccgttctgagctgtctaccagtataccttctgcccaacttgtcgacgatt

SEQ ID NO: 571568 - DNA, 138 bp, Homo sapiens
tgaagcagacgccttgtgccctgctgttcaggttgtcgaagcgcaccttcgagccgcagccgagttcgccgtcatctttagcccagtcgatgagcacccacttgcctttacagctgccgttcggtggcgctgagggcg

SEQ ID NO: 571569 - DNA, 115 bp, Homo sapiens
taggtggaaagcagtatgtcttccctctgcctaaggcattatcctcctccaacggtgaggcaaaataatgtttcttcaggcccccatgttattcccccaaactattccaggcaac

SEQ ID NO: 571570 - DNA, 257 bp, Homo sapiens
aaattataagcattcccccaggaaagccacctggaaaagagccatactgagctcctgactgtcgtctggctgtggtggcctccctctgggctctctcatgctcttctcgagccttcttaactcgttctattctttctttgatctctcgctcttcacgttttcgctcatactttctccgatgttctgcaattttctgtgccctaggttgaacttctttcagccattgcactagcatcttcatcataatccaatttaca

SEQ ID NO: 571571 - DNA, 443 bp, Homo sapiens
gattgatatcatgtctatcagattcaactgagcctcgggagagggatgaggaggtagatactaggccacataagcagaggcacattgataaagctagggatctctcctattgatcaagtcaggcattataaaggcaagctcttggctagcgccaagataattgaagttggtgacaccccaaaagaccgagctctcgcggcggagcccaaaagttatatggcatgatcattactatcggccagtctatcgtgtatgtgatgaccgggatgtatggggacccttctgaagtgggtgctggaattggcctgctaatcaccattcagctctttgttgctggcttatttgtccaacttttggatgaactcctgcaagaaggatatggcctaggatctggtatttctctcttcattgcaattaacatctgtgaaaccatcgtatggaag

SEQ ID NO: 571572 - DNA, 678 bp, Homo sapiens
tggttatttacggcgttcacctgcgtctatactgcagttcacatgaagtaccaagtcactgatgtcgggtgcagtggcctaggcgtcctaccactcatatgtacggctatctagtgcggtactgccgaacatactctgcattagagactgtcaaagcttccggatttcggagagctcttgtaaggcacagccgcgacggcacagtagctcgagtcagtcagggaatatccgtctctccatgatctgcaatatcccagtggcgttctctcagcttggcatccagaatgcagccatgcgctaatttcatcatgcatcgtagatgttcacctaggtctgtaacaggaatgccccttaagcagtagcaggcggaaggtgccatgggtcaagacctcgtgcttcatgcgatatccttgtttgtcggtacacacggtgattcggaccacatgtcccctccattcttcacgcacagcctcaacagcaacgtctggagccatacgcttctcatagtaagtttgaagtcagcgttcatcgtccacttcaatcagtttctggcacccactgacttggaagtagatgttcagctatagccgtcatcatggagtgctgacattcagacaacgccgcgttctaggacccaactcacgctctgcaaacccagtctgccactcgccaccatcg

SEQ ID NO: 571573 - DNA, 208 bp, Homo sapiens
cgcggatctaccagatatgctgggcgcagcgtcatagcgagtcttttgatcttgatgtcgctcttctatcatgtgagcagatcacagcgtgatgtcaccctataggacgtgactgggtagacgtcgtgagacagtagttttacctatgatgatgtgtgtgcatgtatcctgtcatagagaggacgcagttcaacattgtgtatgtgct

SEQ ID NO: 571574 - DNA, 335 bp, Homo sapiens
tgttcgccgtctgtgatgctctgagtatccccgactgttctgcaagaacatcaccgtgtcaagcttagctttgttacagaaaatgaggtagggtgcggtgcgctcacatctgtaatctacagcagtatgggagggcaaggcaggcgcatcagctgaggtcaagagtttgagaccagcctggtcgaaatgatgaaaccccatctataccataaatacgaaaattagctgggcatagtggcacacgccccgtgatcccagctactcaggaggctgaggcactagaatcacttgaacccaggaggcggaggtggcagtgagctgagatcacgccacta

SEQ ID NO: 571575 - DNA, 230 bp, Homo sapiens
gtgcccgtctggtgtgtgttctatacatcctcaccagctggagcttcttctcctctgtcacgtattcggaattcagtagtgcccactagtgttggtctctaggatcccgacgctgccaccatggcccagtctgctgtgtgttcttacatcctcagcacctgtctcttcttctcctctgtcacgtattcggaattccctattgcccactatttgtcgttgctggacctctg

SEQ ID NO: 571576 - DNA, 180 bp, Homo sapiens
  misc_feature (1)..(1): n is a, c, g, or t
nctcatcaacccttcatcaaaccctcatcaacaccctgtcatcaccctactctgttgaatgggaactgtaatcttgtcatttgagaaggcatttacatttagcagctaagattcaagtgacaagtccctgcttccagcgttctaggaatatcagtgctgtggctctgcagtggggtctaa

SEQ ID NO: 571577 - DNA, 105 bp, Homo sapiens
ggcccccggtaccctttttgggggggggttttttttggggcctttttaaactgggtttttttttttgaaaaaaaataaacccagttggagggggcccaatgccca

SEQ ID NO: 571578 - DNA, 611 bp, Homo sapiens
  misc_feature (290)..(290): n is a, c, g, or t
  misc_feature (611)..(611): n is a, c, g, or t
agcatacaggacacttccttgtggtctgtggtggcaaagggcaagtaccactagtagggtgtatctcagaaagtgattggaataagggaaaatgaggattttctgtcctggttttagaaggatggtgcttgatgcccttgatgcccaggagagattctctggactattcacgtgtcaggcatttatggaaacggaagcctatacagatgtggggaatcaaataattgcgtgtctcctgctttccccgatgccatcagcatagacttgaccttccttaaaccgagagtttngatgtggcctgtggaaccctaaaatcagctgtgttaggtaacaaaactcaggctttctgttgatgacatcgagatggtgtcacttaaaagagccaagattcctgttttcaagttgtggattcatcctgctggttttactttagtccctccatgtcaaagtgggcctgagaaaagctcatacatgcctcatgtgaagtgtccaccctctctgaaaatctttctgtgttcaaaacagcaacgaatatctgtgttaacttttacggtgacttttgaggaggggagtttgcaaattgtcacaatgttatagatttgttgcctatn

SEQ ID NO: 571579 - DNA, 181 bp, Homo sapiens
  misc_feature (8)..(8): n is a, c, g, or t
gtgcgcangataggaagtggctagggtataattgtctgggtcgcctaggggtctggtgagaatagtgttatgtcattaaggagagaatgaagagaagttagccgagggcgtctctgattgggcccttgtaacgggtggaaggtgattttatcggaatgggaggtggttcctacggggttgt

SEQ ID NO: 571580 - DNA, 115 bp, Homo sapiens
catcatatagaggtcacgctctaagactcctgagacaactttaatgtaactggctatccgaggctggggattgaactaagtacagacgccaaggagtcacagcatctagcatagc

SEQ ID NO: 571581 - DNA, 748 bp, Homo sapiens
ggaacagagtaaatggacgaacaggcataatgagcgatgggcccgccctcctgctagatgacagtaatggcactttagcactcgcttaatgcagataccgaacagagaagaaggcgaagagtatgagagataagcatggatgttttcgatgacagacggagatgtccagcccttctgggcaccttaagaaatatccactcacctgcatttttgtttattcctacaaggcttctcacagcagatgagttgaccattgaggaacatgaggtgttagcaagtgattgacgatggagatcatggacagactgggtacaggctcgaacataacagttggcccagtgggtatatgtgcccagaaaagtacctacagtttcccacctcgaacagcgctcctgagcatgctgcagaacccatggacgcttaggacagacggacacacaacgtccagcaatccacggaacgcagaactcgtattcaggcagcctcaacggagatgccaggggtatgttcgtgcaagcacctcactcaaataatccaccgggccaggacaagacaggatgcaagttaatcagcgcccctgaagggccgcacaaaatcccgaatcattgacacaaccgacaccaccacagatgaagcatggctcctgtggaaggcgaataccaatgagcgcatggaatctaccactcgggccaacgcaagacaacaagcaacaacaaagatgaaacccccaggatgagaacgccagaac

SEQ ID NO: 571582 - DNA, 1083 bp, Homo sapiens
  misc_feature (21)..(21): n is a, c, g, or t
  misc_feature (54)..(54): n is a, c, g, or t
  misc_feature (59)..(59): n is a, c, g, or t
  misc_feature (67)..(67): n is a, c, g, or t
  misc_feature (75)..(75): n is a, c, g, or t
  misc_feature (90)..(90): n is a, c, g, or t
  misc_feature (111)..(111): n is a, c, g, or t
  misc_feature (156)..(156): n is a, c, g, or t
  misc_feature (201)..(202): n is a, c, g, or t
  misc_feature (207)..(207): n is a, c, g, or t
  misc_feature (246)..(246): n is a, c, g, or t
  misc_feature (262)..(262): n is a, c, g, or t
  misc_feature (286)..(286): n is a, c, g, or t
ggggaattgtaaaaaagaaantcaataataggggggaattgggcccggaagttngcaanggttcccnggccgccnatgggcgggcccggnggggatttggattaaaaagtngcgggaagtaaccaacaaaattatttttcggaaaaaaggaaaagnatttttaatggacccagccgtggaatgtgttagggttggcagctnntattntcccaaaactgtaggaacttggacttggcgttagagtgnaacttctgaaaccaantcgtctctggccgcaggagtctanatgttttcgtaatcttcatcaagaagtttttaaaaggcaagcaaaaacagaagcaaatcatatcaaacggggatagaatggtttccactgaggacattcagcctgggaaggaggaagtcaccagctcgaggcgtgtggattggtttccacccggaacaggctctgtgatggctgaatggaaagaaacgtaaaaagctgtgccaaaaaaaaagcaaaatgctgtgataaaccaaacagggaagggggaaaaaccctcctccttgggattttgtgttctggtatcccctaacaattgggacactacgatggctctcacaaaggaggttcaaagaccagttggtaccgatgaaacgcgcaacttgtgtaatcccaacactttctattgttctagaatcttcttggtcagtcgggctggtttttcagtcggctggaattctatcttctgggggccttccgtctgagatggaagctgtctggggcttgttgtctcttccttctgtggctccctgcccctcccccgtgcctttccacgtctgtctggtgagctctgcttttacagtgcaccatcaaggagatgcagccccgtggacattgaaggacacaagtctcccagcggagcagctttcccccttccgccgtctcccaccctctcctccccttggctcggcctcgctttctcactggagtgctcactgtcgtctctctctctccctctgtacctttctcatagttgctgcagatctaaggtctcaagggcacttgggcgcgtagtaacgtgcttatgtaacaacggccgg

SEQ ID NO: 571583 - DNA, 133 bp, Homo sapiens
ccccttattaggagcaacagaaagctactctctatagttctgttcttgtgatgtgacaaaatgtaagaagataggagaagagaatattttattacgtagatgcttttgttcccaagtgtgagagagatcctct

SEQ ID NO: 571584 - DNA, 765 bp, Homo sapiens
caagtaccggtcaggagaaccatgaggcaagtgggcggcgttcttctcacagataggagagctctacgtggttgcaccatctctgggcctataaagacctgcatgtctcgcggaggagactcgaaacgctgcctggtaggaagagcaggcgtggagagattgaaaatagtctacgtatacaagtccccgcgtggtgcgacgtcatggagtcttaaggatcaagtgatcgccccttggaaaatcatcgcacttcatgctatgtgataggcttggcacttacgatccgtcgcaaccctccttgtcccacattcttccctcgaggcaaacgcccgaacaaggacagtggcaactctctggtcctgatgacttggtatttggctgggctctggggcaggatcgtctagatgaggagcacgatgctcatgattacatgacaagggcgggatagctggagaggctgatcgaaggtgtctcgatgtgattacagcatctgaaccaggctcctttactactgtgcctctgactgcctcccactcctccctgggctaggaaaggggtatggaggttttccttggccacttttttcccccctgggacactgggagatggaattaggttgactccatttggtacgggcccttgcggttattagttctggcctaaaaaatgccccttcagtcgtcgaaggggccgacccaggggccccaaggtaggcaccgcgttgggagcccctcgtctgaataaagcggtaaagttgcgcaaaag

SEQ ID NO: 571585 - DNA, 215 bp, Homo sapiens
  misc_feature (210)..(210): n is a, c, g, or t
acgaggagcggatgtctaaagttccatctacaggctgaggtgggaggatcaactgggtctctccagttacctaggtctgaaggtaaatctgcttcctcactgtcttctcttaacactagaccgtcttcttcctggatcttcttactcaaaacatcatttttgagaatcttttcgggggagttgctatgatgaggggcagcagtgataatnggaaa

SEQ ID NO: 571586 - DNA, 263 bp, Homo sapiens
tgtccagtatgattccacgcatggcaaattccatggcaccgtcaaggctgagaagcgggaagctgtcatgaagtggaaatccgcatcacgcatcttccaggagcgagatccgctccaaatatcaagtggggcgatgctggcgctgagtacgtcgtggatgtgacaggagtcttcgccaccatggagaaggctggggtgagtgcaggagggcccgcgggaggggaagctgactcagccctgcaaaggcaggacacgaatgttca

SEQ ID NO: 571587 - DNA, 395 bp, Homo sapiens
atccatgttctaatgcctccactataaaagtattgttagttgtttgttttttagagactagagtactatctactagtacagcccaggctagagtgcagcagcacaatgcgtacagctacactaacaacctccacctcccgggttcaagtgattctcctgcctcagcctcctgagtagctgggactccaggaacacgccactacacctggctaaattttgtatttttagtagagagcgaggtttttctccatgtatggtcaggctggtctcaaactcctgacctctggtgattcgccctcctcggcctcccagagtggtgggattacaggcatgagtcacggagcccaacctacttttttgtgttttagtagagacagggtttcaccgtggtgccc

SEQ ID NO: 571588 - DNA, 676 bp, Homo sapiens
  misc_feature (15)..(16): n is a, c, g, or t
  misc_feature (19)..(20): n is a, c, g, or t
  misc_feature (624)..(624): n is a, c, g, or t
  misc_feature (634)..(634): n is a, c, g, or t
  misc_feature (637)..(637): n is a, c, g, or t
ggaaaatcctcacgnnagnngaagcgcaggcgagtagggccagacatggtggctcatgcctgtaatctcagcactttgggagactgagatgagaagatcacttgaggccaggagttcgagaccagactggcaacatagtgagaccctgtctctacaaaatgctggccaaggagcagggcctgcgcccgtggtctcatagagcctggcctgttctggaagagcacccagttgttccttctaggctgcccaagccccactgatgatggctgagagggaagaggacgacgacactgaggaagcctggatgcagctacggcccacagaacccttgccttcccagtgctgcggcagtggctgctcaccctgtgtgtttgacctctatcaccgagatctggcaaggtgggaggcagcccaagccagcaaggacaggagcctgctgcgtgggccagagtcacagagctgcccctccaagctgaacccagagaccttcgtggccttctgcatcattgccatggacaggctcactaaggacacctaccgtgtccggtttgctctacccgggaacagccagcttggcctgcggcccggccagcacctcatcctacggtacactcagggatagtngatgacttanaanattcagagagcctatacgcccatcagccctgccaacgcc

SEQ ID NO: 571589 - DNA, 519 bp, Homo sapiens
  misc_feature (15)..(16): n is a, c, g, or t
  misc_feature (19)..(20): n is a, c, g, or t
  misc_feature (467)..(467): n is a, c, g, or t
  misc_feature (477)..(477): n is a, c, g, or t
  misc_feature (480)..(480): n is a, c, g, or t
ggaaaatcctcacgnnagnngaagcgcaggcgagtagggccagacatggtggctcatgcctgtaatctcagcactttgggagactgagatgagaagatcacttgaggccaggagttcgagaccagactggcaacatagtgagaccctgtctctacaaaatgctggccaaggagcagggcctgcgcccgtggtctcatagagcctggcctgttctggaagagcacccagttgttccttctaggctgcccaagccccactgatgatggctgagagggaagaggacgacgacactgaggaagcctggatgcagctacggcccacagaacccttgccttcccagtgctgcggcagtggctgctcaccctgtgtgtttgacctctatcaccgagatctggcaaggtgggaggcagcccaagccagcaaggacaggagcctgctgcgtgggccagagtcacagagggatagtngatgacttanaanattcagagagcctatacgcccatcagccctgccaacgcc

SEQ ID NO: 571590 - DNA, 807 bp, Homo sapiens
  misc_feature (15)..(16): n is a, c, g, or t
  misc_feature (19)..(20): n is a, c, g, or t
ggaaaatcctcacgnnagnngaagcgcaggcgagtagggccagacatggtggctcatgcctgtaatctcagcactttgggagactgagatgagaagatcacttgaggccaggagttcgagaccagactggcaacatagtgagaccctgtctctacaaaatgctggccaaggagcagggcctgcgcccgtggtctcatagagcctggcctgttctggaagagcacccagttgttccttctaggctgcccaagccccactgatgatggctgagagggaagaggacgacgacactgaggaagcctggatgcagctacggcccacagaacccttgccttcccagtgctgcggcagtggctgctcaccctgtgtgtttgacctctatcaccgagatctggcaaggtgggaggcagcccaagccagcaaggacaggagcctgctgcgtgggccagagtcacagagctgcccctccaagctgaacccagagaccttcgtggccttctgcatcattgccatggacaggctcactaaggacacctaccgtgtccggtttgctctacccgggaacagccagcttggcctgcggcccggccagcacctcatcctacggtacactcaggtagcgggaggaccaaagcttcacagccctgctttgctatttgctagctgctggccttgaccaactagcgtactctcccttaagcctccatttgtcatcttcaagatagacatagtgacacatgactcagagagttcttgggattgaactagataatgcattttcataataaataataacacaatcaaaaa

SEQ ID NO: 571591 - DNA, 151 bp, Homo sapiens
agatgacgcagtctgctcactcagcagtgtccgcacgccccaggcagcaggcggcccctcctcgggcaacactggtcttcctgagggcagcccgtgctgcggtcccacgcttcgtccatacttgcgttgtggggtctctagaaactacagt

SEQ ID NO: 571592 - DNA, 103 bp, Homo sapiens
ccgttgtgcgttcccggcgatcggggtccgcgctcgaccttcgtactcctggtcgctcgctgtttcctgcgtgtacccggccggcccgtgccctccgttctcc

SEQ ID NO: 571593 - DNA, 187 bp, Homo sapiens
  misc_feature (148)..(148): n is a, c, g, or t
acatggcgatgcctcatctcttctctcaattggaatatctgatttgccgggcgtggtgttgggtcttgtggttccatatgctcgggaggtcggggctggagagtggcttgggccctgtgaggcggagccttgcattgacgattgcacntattgcattccagtcctggagcaacggagtgagaccccg

SEQ ID NO: 571594 - DNA, 159 bp, Homo sapiens
atgatgtggatcatgggaagaaatggactattcgtgtaatatatagccatatggatcattccccaagaccctcaattcatcattaattcatatataaaacaaaagcagagtacaccggtatttgctccagatcagctcacatcacctgggcacagtacc

SEQ ID NO: 571595 - DNA, 991 bp, Homo sapiens
acgacaccagcccctgctctatggagtatttagtctccaggaagctgtgcctttctggttctgacagtgactacgtcatctctgccattacatcatcacataaagaacacctctctctgctcagtcccagaatggctttccctcccagtcccttggctatggaatatgttaatgactttgatttgatgaagttcgaaataaagcgggagccttctgagggccgatctggagtccccacagcctcgttgggctccacaccatacagctcggtgcctccttcacccaccttcagtgagccaggcatggtgggtggtggcgaggcccctaggccaggcctggaggagctatattggctggccaccctgcagcagcagctggggtcggatgaggttctcgggctgagtcccgacgaagctgtggagctgctgcagaaccaggtcctgtctctatggaagggcctcttggctactattcagggagcccgggagagacaggagcccagcatgtccagctgcccgagagattttcggacgccgcgctggtctcgatgtctgtgcgcgagttgaaccggcagctgcggggctgcgggcgcgacgaggctctgcggctgaagcagaggcgccgacgctcaagaccgggctacgctcagcttgtcgctccagcggctgcaacagggcgcgggctggaaggaagaaggcgctcgcctggccgccccagtggatgcccttgcgggccgaggtggaccgcctggtcggaagcggactctatagcgcccgtgtgaccgtgaactccggggcctggtccgacgaaccaacacctcttctctgagcctagggcaggggtgtggcgtgaggggtcggaaagagataagagagaacacaaccaacaaccggtggttgtaaaacacagagcggagaaaaagaccggaaacacttgcaacaaagagcaaatacacagccggaagtcaaagagaacaaatacacaaaactac

SEQ ID NO: 571596 - DNA, 925 bp, Homo sapiens
actagttctagatcgcgagcggcagctactgtctgtaatcccaacacttagggaggctgaggtgggcagatcacctgaggttgggagttcgagaccagcctgaccaacatagagatggagacagagtttcaccatgtaggccgggctggtctcaaactcctgacctcaagtgatccacaagcctgggcctcccaaagtgctgggattacaggcatgagcaactgctgcccagctcttgtgtaccgttatgtgaggaagtcctgctcaagtcaggatcggtcacgcaggccctgatcttgctacatctggttccagtgtcctatggaagaccagagtttaccagagatagatttttcccttcatagtggcagatagtgttaacccgctggacctatctgtaactcagaaatccccatcatttcttcccacttgggcttcagaatagaattgcctggtttctctgatgagtcagcatggttccttaaaaaccaaatcagcaggaatgaacaagtttacgttggcatggatgaaacttagcactgatttggcctcgttaggccccaggcaggcaggcacctgtaagtgtccaccttgcatatactaggtcttcagaagcattgccttttgtcctactggtaggtgacatacgacaagtaatcagggcatctggggactctaactcctgaaaacagtgagtctgatactgcttgtagtaacatcagtgtccaccccaagtggagtcttcctgcttattctcttcacttaagtagacccctccaatggccatctggagcccagttggcaaggaatgtgcacaggcctagcgtacacttcggaaaacctgcttgacaccattctaattccctggatacgttagaagatcagttggggttgcacgttcgggctccttggaccctcaagcatg

SEQ ID NO: 571597 - DNA, 262 bp, Homo sapiens
cccccccggggggggggttttttttaccccccctttttaaaagggggggggttttcccccccccccattttttccccttgggggggggcccccgggggggctttttttttttttaaagggttcccccccccttttttggtttttgtttttccccccttggggttgggggggggccccccaaaaattttcgggggaacccgtttttttttttgggcccccctggggttttcccccttttcccctttggcccttttttttttta

SEQ ID NO: 571598 - DNA, 149 bp, Homo sapiens
ctctggttctacaagagcagcctgtaagttcacacttttcttgttccacttgtttctttattttctccagttcatggatacgtttccctccttctgcaatctgttccgtgaggtcagaaatctcctgctgtaagtgattgttccccgct

SEQ ID NO: 571599 - DNA, 1513 bp, Homo sapiens
atttgaagtattaagcatcaaacaacaaattttgaatacagagaattgggaagtggacagaatgtgaaattcatgaaagtgaaaagatgaagtctaactgttgtggcatatataaatagggaatagttttagcatagttagggctggtagattagtgatacaaggagggagccagatatatatggaagagtagtggtgctgagtaagatgatagcatattgatagagtgtgataaagagtatgaaacagttgataagagtataagtaggacgttaaaagctgaactgacatatgtgtggaagaaagatagagaaacataggataatgtttgtaagatgaagaagacaagatagaggaaataagagataatttaaggaaggtacgagagaacaggtaaaacgcaaatacactacacagcaacacacacaatgataccgtgcacaaagacacacagtcaacaacatacacaacaaccattacaaagcacaaagcacagtcacacgcacgcgaaaaagaaaccaaacgcagacagtagacgaaggaaaaaagaaggcacaataaagcgcaaaaaaaggagaacaaagacaactgaaggacagacaaaacaagtgaacccgacccaaagtggagtcaaataagacacaacaacctaacaaaaagacataggagtggaacataggaacaacaccaggaaacggtacaaagacactagacacaaccatacagaaagaaaccgcaacagtagcaaacaaatccgcaatagggacaaataaaatagaaagtaacagaagagacacaagatataaacaaaagaaaaagaataacataaaaaaaagaagaaaaccacaatacaaaagagaaagaaaacgaaacgcacacaacaacacataaaacaaaactcaacgtacacatggcaacatgacaaaaaaaccaatgagagaaacattacacacaccaagaagccatacactggagacaaaacacaaagaagcgacaacacaaaagaaagaagaatccatcaaataagcataacacaaaaaagaaccaagaaagcacaacaatgaaaaaacccaaaacacaataggaaacaaaagcaagaaaaaatgaagacaaacaaagaaacacgcaacataaaaaccagacagcctagcaccaccaagaaggaagcggaaaacaaaacaagagaacaagacaaacagacaggcgcaagaaaacaaaaaaaccacagcagaacagaaagacaaaaaccacaattaaagatagtgaaaagcaagcacgagtaaacacagacgaacggtaacgcgcaaacagcaaacgacgcgagagattgcaccaaaaaggaaaacagagacagacagaccaccgagacagcacgacacgaccaaccaagaaggaaagaagagtacataagcgcgcgacactggagaaggaacaagagggacaaaagacagggacatgaaagagaaaaaggaaaccagaagggaggcaaaaaagagagagacacgcggacgcg

SEQ ID NO: 571600 - DNA, 262 bp, Homo sapiens
agaacgccccccacttttggagatgcgtcagacattgcccttgaattactaaattctgaatatgaatttgatgaaggctccatcatcttaaatgaaatacaattctgtcctctcctataagacagacgaaaagcccatcttgtcccttaataccgtcaccaaagtctgacagcataaactatctatgacgatattgatgctgacggtgcttgcaaaattaccaagaataacaatctggccaacatcatctattactctctag

SEQ ID NO: 571601 - DNA, 621 bp, Homo sapiens
ggactagcgaactagctgtgcacaaggtgcatgatccaaccgattggaacctgaatgggcatgtgctgaggtttagactcccactatcagtcaaggtctctagattacttgggctgattcctaacctcatgcgtatacctgtgcggaatgcagaagcttcaaaatgaagtggtctccatttaaagatttccagctaagtggcttactacaatatgaatcaatgtcgcaggcttaaacctgcccgttaacgagagacgcattatgaagaagttcacaataagaacatggtgtgaagtcccagaaattatgactatacaatgaccatccctttgcttctactatcttgcgctgctatcaacgttacgcattgtctgtatatttactttgctctttctatatgatgatatttagtacggtcccccttacgtttattaccctcactcttattgttaacttgcgttcatatttactttgtaacataatacctctctattatcataatgtccaagattgggccttacaaatagattctcatcgtaatgttttactttggcaattaatttaatgactagccacatgaactatcattcatgcaatctcttaaattgtaacatgagagga

SEQ ID NO: 571602 - DNA, 712 bp, Homo sapiens
cggcagtgccggccgaaacccggccctgctcggacccggaaggatccgaatccgcccccctgacagggtcctctcggccgaggtcaccccagctgggccagaggcaggcgcacgcggctctacaggcagcggcgtcggtttcggcccggccctgcccccaacggctccgctctcccgcgctcaccccgagcccagtccgccatcgtgccctgccccggctcctcgacgcggacaccgacgcggccacagccgcctcagacgtggccacagccgcctcagacgtggcgcagtcgcggggaaagagcttccggccccgcccccagctagcgatggccccgcctccgcaccgaccacgcccctagatagcccagccccttccgcttcgggctcgctgacttccggcttagggccgagggtggggaactgccgggcgcggaagcgatgggcatatctgtggcttattttcagcactgtcgcgcagacagtggcgcgatctcagctcactgcagcccccggctgccgggctcccaaggtgctgggattacagcagcaccgcggatgtgacgtatggtgttcctgtgaacgtggggcggggcggggccgtttgcttgctcagtgcctagacgatggtggtggaaagacgcttctgtgggttaggtcctaacggctaggaacggattcacaggcgggtcatgaggaaggagcagacccc

SEQ ID NO: 571603 - DNA, 677 bp, Homo sapiens
gtttcatcctcaaattacagagatcttgtttttcatttttttaaactcttattattctcaatcacaatcataatacatgatgcaatgtaaaccttaaattatttatttaatcttactacactaatcagctaacaagatctctgtcttcttagatcttggagcctggaaaaacccagttattaatccccactatcccttcccaaaattctctggttagctgacatgttaataagattccaagaatgttctaaagaaagcaaaatcaccacaaaaaaggactgtgttctgaaagtaaaaactgtgtttttttttccttctctcataatttatttttaatttaaattctgtccttgaatgtgtatacataattatttggtcaggctgcgttcccttataatcaaatataaccactgcaagccgtacaagatattcctttttttttttttgagacagctctgcacccacgctggagtgcagtcggattgacctcgcttaactgcaagctccgccttccggttcaccccattctcctgcttaccttctgatagctggaatacaggccccgccaccaacccggctaattttggatttttagtcacggtttcaccggcttaccaggaggtctcaacccctggactaaggatctcccccttggctcccaaggcctggttcagcct

SEQ ID NO: 571604 - DNA, 133 bp, Homo sapiens
tgtgcgccttctccttgcctcgcagtctgcaggctgtctcactccagagtttgttcatgcccaccgggccctgggctcctgtgtccgtgcgctcctgggctgtgtggtggctcctctagagtcgcactgctgt

SEQ ID NO: 571605 - DNA, 386 bp, Homo sapiens
  misc_feature (160)..(160): n is a, c, g, or t
atctttttatttcatgagcagctttgtgagtacattctcaggtctaaagtcctcaccctcttctcctattcccccagggcccccagtgaaacacacacatacattaaacagtgcagtttgttatttcaggcctttttctttgcatttatgaaagtagcgncgcatgctgcctcacacctgtaattccagcactttgggaggccaaggtgcgtggattacttgagcccaggagctcgagaccagcctggccaacatgatgaaaccacgtctctgctaacactacaacaattcgccaggagtgcataccacgtgactttaaatccggatccccgggacgctgagaactcggcatcactagcaaccaaggcgctacagcttgacgtgag

SEQ ID NO: 571606 - DNA, 354 bp, Homo sapiens
  misc_feature (106)..(106): n is a, c, g, or t
  misc_feature (160)..(160): n is a, c, g, or t
  misc_feature (209)..(209): n is a, c, g, or t
  misc_feature (261)..(261): n is a, c, g, or t
  misc_feature (276)..(276): n is a, c, g, or t
  misc_feature (326)..(326): n is a, c, g, or t
agctaatctgaattctgtaggctaaaaaatattcatgtagcaaatctgagaattgaaaaactgcagattaccggccgggtatggtgactcatgcctgtaatcctancgctttgggaggccgaggtgggtggaccacctgaggttaggacttcaagaccancctggccaacatggtgaaaccccatctgtactaaaaatacaaaaatttncctggtgtggtggtgcatgcctctggtcctagctactcgggaggctgaggcncgagaatcacttgancctgggaggcggaggttgcagtgagtcgagataacactactgcattccancctgggtgacagagtgagactccacctc

SEQ ID NO: 571607 - DNA, 438 bp, Homo sapiens
acctttgcctcaacagatcagaaactgcattttcgtcagtcatgaacgcttaagtataagggcatttcggtgcttatgtccgctgaaaaactagctgacggacaaagttggctgtgtgtctggtgctgcagatgcttggtatctgaagatcttaagtctccttcacttagctaagaaaaagctgactggatgcttgccgcatcaatttgctcttttaactgcgcttctctcttctaacttaccttagttctttggggtactaaaggctaaaatctactgtacttatagctaggatttctctttcccacatctttctgataacctaatatcctcaagtggagagtctgggggcatgggaaagaaaggagggcgctttagaccttagaccactatggtagaagcagaggaagtcaggtgtaaggcccctaaaacttttgg

SEQ ID NO: 571608 - DNA, 1034 bp, Homo sapiens
ggcagagccagccggctaacgtcgctcggaccgggcacgcacgctcagctgcaggaggaccccccaaagatttttatcgcttaggtatattgaccaacagtttaacgagcaagcaactgctgcatcagcctgcggaggcatcgcctgcacaggcaactgcgaagttagcctcactcagcttcactgcctgaactgaaccgaacgcactacaactcacactacgcgtgaacgctccaccacggcccacgctcactcctcccgagctgggccgacgcactactcggacgcaccgcctctcgctcgcgcccaccacgcacgcgccctgactgcctccggcgaccacccccacgcaccgacctcttcggtcgacacccgcctccgtggctctcctggcccgacccacgccctcgcccacggcgccccctccgtaccccgccccctcctggccttgccgtcccccaagctcctccccctctacccgctccactcgcttctcgggccgcaccccacctctcgtccccgctcccactgcccggccactccgcctccccctgctcgctggcctcctccactccggtagcccctccccctcccccctccccccgctccctccttcccctccctaccgcctcgcccgctggtcccccctctccccccgaacccgccgcccgccccgccccccccgcccccccccctcccccccccccctcgcccgcccccccccccgtccaccgccctctcctccccccccccccccctccgcccctccgcccgctgcccttcgcaccgaggccgctctcgcaccccctctccctctcccctccccccctcccccttactccgtcccgcccctcgcgcctcctcttccccccgctccctgccttcgccctcgcccgccgacccccccgcccgcttctccccccgtcacacctcgctcgccgcctcccccgccctcctgcctctctccccctccctcgtctcctgctgtctcccgtccatctctccctctctcgcactcagcactgcgcacgtga

SEQ ID NO: 571609 - DNA, 1378 bp, Homo sapiens
  misc_feature (1302)..(1302): n is a, c, g, or t
tctcaaaaaaaaaaaaaaaaaaagccacaaatagaagggggactcggtcaagaaaaagcccaaaatattgcgtaaccagaacacgcaaccaggagaatgaacacaaagcagggatgtgggggaaacaaaacagaggagttttcagctttctgtgacccttccttcgaggatttagaaagtgtggggatttcagaggcgtgggaagggtgtgaaagcatgtgatttcttcaagaaaccagcctcggtgctgtgaaagtcttactgtggctctcacctttcctgtggtctctcagggaatgtgtctctcctgtgaatgtgcataatgtgacgtctcggtggtgaatctcatgtggcctctatagagtgtgttctgtgcatgtgcctgtgaagcccgaagccttttatcctctctatgtggagcccccctgtgtgtgatagtgccagaggcttgtggtgtggtctctctataactctccccacactctcacacacagagaatagagaggagatacagtctcctgaggaggctctcacaagaaagacactgtgagagtataacactttctgtgtgaggaggagttttcacacacacatagtcaccacacacgtgagagaccagaggtgggtcgtccatatataagaagagaggcgccccttaatagtagagagaataatatcatccctatactcaccgagaactctccgggagctttcattagaaacaatcttcacaatactctctcagtattaaaggcgcgaccaaagacgcttgagggggcgagcacttctccacacccaccgaggtggggaaaaacccaagccgctgctaacaacgagtggagaccacgcggtgataaacaaaccccaagagaagagaggcccaacccacaggtgatgtcatacaacacatattgtagtggggggcatactacacaccacattattctaccctggtggggtgtatggtggtggacttcccccacacactgttggggataaggaggatatatgtagcaccagttcgatctgcaaacaaggtatctacacagatcattgttagagatcaaacaccagtttttgttgttataataattatattttaaacgacgaacgccgacaatacagaggaagatcaaatttaaagtatatacctccttttggtgagaacggctggttgggggagaacacaccaatatattaaaaagaaaacagggcgcacatggttgagaacaacatttttttgtagtgaacaaaagaggctgtttataacagacaaaacgatgttgtggtctaaacagcganataacttaatgtgtggggggcagcacccgcctttattgtagtaacccatgttagtcacagactactacaaacttaa

SEQ ID NO: 571610 - DNA, 670 bp, Homo sapiens
gattgaaatactatgatacagatatgtctctgtaataccgttgctattgaagcacttagtttagaaaagttaagaacagaatctcgctgtgtagcccaggctgaagtacagtggcacaatgtctgctcactgcaagttctgcctccgggtttcaaccaattcttgtgcctcagtcatccaagtagctggaactataggcacgggctactacccccagctaatttttggtatttttaaagagacagatgtttcaccattgttggccatggctagtcttagaatttctagccctcaatgtgacccacctagactcggcctccctaatgtagctgggattataggcgtgagtcactgcgcccggccttctgaagcatttgggatgctttggtaaattgggttatgctttgggtaccaaaatattagcctggggtttgggcagttatttacttttctttccctttttttgaaatggattttggcttttgccccccaggctggagagcaatggcgcattcttggctcactacaacctccgcctcccaggttcaagtgattctcctgcctcagcctcctgagtagctaggattacaggcttggaccaccacgcctggctaattgtggtattttcagtcgagaggaggttcaccattttggccaggctggtctctaa

SEQ ID NO: 571611 - DNA, 194 bp, Homo sapiens
  misc_feature (118)..(118): n is a, c, g, or t
acgatcctcatacacggatccccctatcgatatgtgcttcagaggtcaatgagcgctacactgtgaagaacccaggaatatacggggtctgtgtgtattagaaaattcacgagattcngactgggcgcctcgattcatgcctgtcatccctgtcactctcgcgtgaggccgaggtatgctagatcacctcgagg

SEQ ID NO: 571612 - DNA, 144 bp, Homo sapiens
gatccccgtcaccaaaccctaacatttttaaatggtggtattatgtttgcacaaactgattaatacattaaattaagccaagatcttagaagactggcaaagttctatcattctattctaaaaacaaagatagggtttcgatga

SEQ ID NO: 571613 - DNA, 1264 bp, Homo sapiens
ctctaaatccccttgtaaatttaactagtatagtccaaagaggaacagctctttggcacactaggaaacaaaccttgctacagagagctaaaaaatttaacacccactagctacggcctaacaagcagccaccaattaagaaagcgcttcaagctcaacacccactacctaaaaacatcccaaacatataactgaactcctcacacccaacttggcaccaactctatcaccctactagcaagcacactaactgattagctactacagtaacactgaaacaccattctcctccgcactaagccctgcgctcacgatcaaaacactgcaactgacaacttaacagcccaatactctacaatcaaccaacaagctcattattaccctcactgtacaacccaacacaggcatgctcactccggacacaggttcaaaaaaacgtacaggaactcggccaaatcctctaccccgcctgatataccaaaaaacaccatcacctctacgcatcaccagtaatacagaggcaccgcctgcccagctgacacactgtcctacaccggcccgcggatacccctaacccgttgcaacacggtacccataattcacttgatacccttacaatagcggaccctgcatactgacatgggcttccacggagcggctcacacccctgcccgctcctctaccgcccacaacccccaggcagacacaactaggaaacgtgccccggctgcaacgcagcgccggcggccctgccaacccgccaaagcaacgacagaacaagaacgccaatatgggaagccacatctaacgactccactcaaacatgcccacaggcacatacgcacctatacccagggaagcccgaacgcaagggactcccttacgcgcgcataccccaacacacgactgggccagtgttcgagacgaacgcatcttcgaggcaacatagcggcggcggaaacccaccgcgcaggcacgccgccaggaagaggcccgaccagcactccgccgacaaagcactgatgactacccactgcggcactagcaagacactcgtccgacccacagacatacaacaggcgcgcgcatgcacatacaccgcaaaagccgagcaaccgtggagacgtcgccacgatatataccattgtgagtaccacaaagcgaacacagtcacgagtgatcacaccaaagagggggaatagaacgaacgggcgaacaggctagtcacgcgctcagggaaccccacgaccgctcccagacgaaa

SEQ ID NO: 571614 - DNA, 685 bp, Homo sapiens
  misc_feature (1)..(1): n is a, c, g, or t
  misc_feature (218)..(218): n is a, c, g, or t
  misc_feature (221)..(221): n is a, c, g, or t
  misc_feature (522)..(522): n is a, c, g, or t
  misc_feature (633)..(633): n is a, c, g, or t
nccagcgggggaaatcctgtgaggggcaggcggagcttgaggaaaccgagataagtttttttctctttgaaagatagagattaatcactacttaaaaaatatagtcaatagggactaagatattgcttagcgttaagtttttaacgtaattttattagcttaagattttaagagaaaatatgaagacttagaagagtagcatgaggaaggaaaagatnaanggtttctaaaacatgacggaggttgagatgaacctccttcatggagtaaaaaatgtatttaaaagaaaattgggagaaaggccttcagacccccgaattaataccaattaaaggggatggctttaagattaaaatgaagtgaccttaacagcttaaagttaagttaaaaggtgtgggtgataaaataatttgaagcgatcttttaaaagagattaaaccgaagtgataaaagaacttgaaatccatgacgcagggagaattgctcattaaagcctattaacgctttactaaaccaaccaanatgggagaataatgggaaggggagatgaaacaattggagaaatagaatttgaaggggaaaccgggaaacaaataccgggaaggcaaaaaaatattaggaagttgggaattngaattttaccttcctttggaaaaaagtttatttaacctaaaagtggcctatt

SEQ ID NO: 571615 - DNA, 895 bp, Homo sapiens
gactctttctgtggataagagaattccacaataaaggatgttttaatttcctctgcgtaaatatttttggctttttgccacccaaattgagatgcttgttagaaagtccctttggagcccatttcgggtggataaccacatctagaagaagatattttctcgaaccacatgtaattttcgcgtaagcaccttaaaatgggaagtccaaaactttctaagggagtcttaataggcaaatagttaaaacatatctttgcttggtggttcttggaaattcttctccccacagaaagtgtgacacacgttaagaatatagcacatttaaagttttcttcgtggcccccctctataagaccccaccttttataggaaaaaaaaactaccacaaaaggagtaaaaaatgtatgagaggagaaatatggagaaatgtgaattcttctgtcacatgagaccacatgttgtgagataacacaaatgtttccaatcacatgttaaatgagattcacccacacttttcccttgcacattaaatattgaaatttaaagcacatttaaattcacaaagaagaaaggggaagcacatccacattaattgaaaacaatgtgggcgtttctaaaaaactccacatccctttaataaaataagtcaaaggtttgggccaccaccacaagtaaaatttttaatcactggagaaaaatttcaaactcctcaaagccgtaaatgttgaacagaaattggaggtaattttctttataaattttttgaaacacaggcacaaatgaaagcttaattatatatgaaatgcatgtattttcttttatctttggaacatcagcaccagtatattgctggcagctattgtaattaaaaaataaagtaaattttcactatcca

SEQ ID NO: 571616 - DNA, 416 bp, Homo sapiens
ggcaggaaacattgacgggcgctctttgagccagcgcttctgtcattcctgtgcacactcagtcctgtgacctcccagtgtgggacaaagctccactcacgtctgcattttggggtggaatttaagcaccgtctggactaagaaatcattgcagagacgttcgttcccagggatctgaatgaagtagaaaagtgcagatgctcagggatgattcgtcctgctcttgagtgacaccaggtctttctcatctttgactcaggaggtgcagcccacggtgtgtgcagcttagcacacctgggcagggcacaatctgagggcacacggaggcccattaacaccagccgtgtattcagtgatcagattttatgtgggaaacatttcttgaccaccatttaataccattcactacactggaa

SEQ ID NO: 571617 - DNA, 756 bp, Homo sapiens
caatgtccatcgatgatagaatggattaagaaaatgtggcacatatacaccgtggaatactatgcagccataaaaaatgatgagttcatgtcctttgtagggacatggatgaagctagaaaccatcattctgagcaaactatcgcaaggacagaaaaccaaacaccacatgttctcactcataggtgggaaatgaacaatgagaacacttggacacggggtggggaacatcacacaccggggcctgtcatggggtggggggaggggggagggatagcattaggagatacacctaatgtaaatgacgagttaacgggtgcagcataccaacatggcacatgtatacatatgtaacaaacctgcgcgttgtgcccatgtaccctagaacttaatgtataataataataaaaaaaaaaccagacccaatgatatgttgcctacaagaaatgcatttcacctacaaaggcacacatagactacaagtaaagggatgaaaaacagattttccaggccaatggaaactaaaaaagagcaggagtagctatatttacatcagacaaaatagatttcaggataaaaactttagagagacaaagccattatataactgataacaagggtcagttaagcaagaagatataacagttgtaacatatgtatgcatccaacattggaggaccttgctttcagcattggtcagatcatccagacagaaaatcaacaaagaaacataggacttaatatgcattatagacca

SEQ ID NO: 571618 - DNA, 1165 bp, Homo sapiens
gcgaccagccgcgggccgcagggtcatggaccttcaggccgctcggggcccaggcgcagggggaccgtcgggagccagatcatcagggtgcacctgtcactgtcttgctcttaagcgcgtcgggtgggctgccccccaagcccggaaggcttggcatttgctacagtctgaccaacatccgagtcaggtagagagagactgagtaatggctatggatctgactagcccgtggaacacagatcattcctaatgacagttcctgtccccggggtgaggggcacccattctgaagaggaaggctttgccatggatcgaggaggacgtcgtgactggagaagctgaactaccgtggggagctgtctagaagggactaaactgtctcgacccaatggtaacagcctggcgatctttttactgaggactgggacctcggaggttgcaaagcagatcaagggaatccatatgatgctgacgacatccaggagagcatttctcaaggagcttaagaccttgggtgtgctgtgccccacaaggtagacatgagtctatgaccccagatggcaccatccggctccacttgataccctattattccaagcatggtctttgaaacaggacagtttgacgatgcttgaagattgagtgtggagctttctgccttgtaagtgggcggggcttccacgtcaagatctcttttcctgtcttggaggtgaacaggtactatctgagaaaatgtctgcgagtgaacccctaattctggggtacacaagaccagtgttactttattgagcatgttcataaggccccgtgctttttcgccagtctgtgtatggtcttaaggggacctccttgaaattgtgctgtcttgcgttccagagagatgaggatccttgtaaaacaaggttaagggagcacatcacacactacagacaactcagagcaataatataagggcgcgaaaaagggatattaaagggcacgtacaaatgtcttctgcacctttttcccgtggaattgcgcccaaaggactattggaagagtcgatgtatataaaaataagaactgacacacaataattatagcgtgagatcaagaaagacaagtaacacacgaatataagaagatgttgatgtgacataaacttattatgaacagaaaatatgaa

SEQ ID NO: 571619 - DNA, 1004 bp, Homo sapiens
  misc_feature (485)..(485): n is a, c, g, or t
  misc_feature (491)..(491): n is a, c, g, or t
  misc_feature (565)..(565): n is a, c, g, or t
  misc_feature (567)..(567): n is a, c, g, or t
  misc_feature (638)..(638): n is a, c, g, or t
  misc_feature (653)..(653): n is a, c, g, or t
  misc_feature (676)..(676): n is a, c, g, or t
  misc_feature (687)..(687): n is a, c, g, or t
  misc_feature (754)..(754): n is a, c, g, or t
  misc_feature (853)..(853): n is a, c, g, or t
  misc_feature (883)..(883): n is a, c, g, or t
ccagccttctccctgagtggctgctcctggtgttgcctgctgccttccctgccctacaacccccaggagaagattccaactatgtcattcgcccacacgatacagccactgcacttcttcagaacagaattgacaaacaaagttcggcacatcctccacggcatatcatccctgataaaggatacatgtatctaagtagttcactgtgtgaaagcagtaaatgaggcacctggcaagaaaactaaccgtgaactcttcgcataagattggcttgaataatagattggaccgccttctcctctcctcggtatgtcacccagttgtcgtagacgtacgaccctcggccgaccatgcctatatttacctctggatccactctcggttccttatttcgtccgctactcactccatcattccctcgcctaatccacacaagtcgtgtctggtatcaacccacacgagtgtcattcattatgaggttgttntattantttatatccacgtcgtgcgtctcgtttgcttagtcgcttcacaagtttattgtgtattagtttgaattattgtnantcctgtgctctgtagagtgctggtttctctttattcagtttgctccaattgcgattatcagatgcgaagancgagcaatgatgcgnacattgtgtcacactattatagntccagcagtcnccacactcctctgctacccgccgcctcatatcatctgtgttatcattcattacttctagtacgcgantctactacacacctcactcgctcaatcttcttctcatatcctactacttcatacccgatagtattttaaccaccgcggcagtcatcgccgtcgcagtgntgtcattatgatcttgccagctatcatatnacatattatttgttgctccctattgctcagttgctcttattgtcgtctctactctgtatgtcctgacgtcgccccgtcaccgccttctcgcgcccgggagcgcagttctggattgtctgtt

SEQ ID NO: 571620 - DNA, 172 bp, Homo sapiens
cgcacagcttctcgagtagctgggagtacaggcacgtgccaccatgccagccaatttttgtatttttagtagagacggggtttcaccacattggccaggctggtctcaaattcctgacctcgtgatctgcccgccttggcccgacacagcttctctggccgccacagcttct

SEQ ID NO: 571621 - DNA, 188 bp, Homo sapiens
catgcgttcagtcgaaaggccatatatcacacatgcacacacagcacacacacaaacgcacagcacacacaaacgcacagcacacacacacacagcacacacacgagcacacagcacacaaacgcaacagcacacgcacacgacatagcacacacgagacacacacagctagacacacatgcacacac

SEQ ID NO: 571622 - DNA, 346 bp, Homo sapiens
  misc_feature (43)..(43): n is a, c, g, or t
  misc_feature (307)..(307): n is a, c, g, or t
cgaaatcatggactaggacaaggttagcccatgagtgttaggnaggccgaggtgggtggatcagctgaggtcaggggttcgagaccagactggccaacatggcgaaaccccatctctactaaaaatacaaactttagatgggtgtggtggcacacgcctgtaatcccagtgggggtcacccagggagcatatctcctggtgagaagtacaggagcttcacattccctggatacgtcccagcccgaaatgttcaccgtgaatcccggcaaccttgttgaagctgattttccatttctaaggaaattangggggggatttgggaagaaacccccccaggacaaagaac

SEQ ID NO: 571623 - DNA, 302 bp, Homo sapiens
gaagaggaacggcctaaccctaacagtgattaaggttattaggaggccgggaatggtggctgacgccagcaatcccagcactctggaaggcggaggcgggcagatcacccgaggtcaggagcccgagaccagcctggccaacatgatgaaaccccgtatccaccaaacacacaaaaatcagcccggcgtggtggcgggcacctataatcccagccactcgggaggctgaggcaggagaaccgcccgaacccggaacgtggaggttgcagtgagccaagatcgtgctactgcactccagcttg

SEQ ID NO: 571624 - DNA, 271 bp, Homo sapiens
caacagagtgaagagacagcctacagaatgagagaaaattattgcaaaccatatgataatggtttggctctgtgtccccacccaaatctcatttcgaattgtaattccccatgtgtcaatggagggatctgataggaggtgactggatcacgagggcagttttccccatgctgttctcatgatagtgagtgagttctcataaggcctgatggttttctaaggggctcttcccacttcaccctctcttcgctctcctgccagggtaccgagc

SEQ ID NO: 571625 - DNA, 109 bp, Homo sapiens
gtatgacatgagcaccgcaccagcctcaaatctttcttgcagttagttcaaatctttttcactacagctcaaagcccttagcctcttggatcatcatcctcccatttct

SEQ ID NO: 571626 - DNA, 316 bp, Homo sapiens
  misc_feature (12)..(12): n is a, c, g, or t
  misc_feature (54)..(54): n is a, c, g, or t
cgttccaaggcncccgtgaatattccggctccaggatttccccttcccactcgntccgtttggaaatccgttcgctgttctgtctcctctaatcatagtggagctttggctccagggtcgggctcttgcgaaatccagacctggttttcgctccagccaaagccaggcgccttcgttccgcccggctctcgcgcttagccgcctccgagcctcaggggccctcagtcgtttccgtctgctggcgatagtcccggccgggtcgctggtgttgccagttccgcccaaagcagcttctaatagcatcaactgaaagaaa

SEQ ID NO: 571627 - DNA, 449 bp, Homo sapiens
  misc_feature (356)..(356): n is a, c, g, or t
aatgtggtccgtgttcacatgtgtctctgtgtgtgtgagagagaggggtcagctgggacgctggggtggcagggacagtcctggctcacccctcatcctccctcgacctcgactccctccacatgaggagcccccccttcctggctatcctgtgagttgagcttcctctgctgggagggctttgtcagaggttcctgcggttccagaaggaaagctggctgcagggagggccgggcactggacaccgtgtgctgacctgtggcgggggctgcacagctgggttcccagcccccctccttgtccccaccccaccgcactgggaggcctgctgaggggccagagtccggctgcaggtnccacgggtgggggtggggcccctcattagcactgcagctgacactgagggcttccacctcgctaattgattaaactgtttagaaaccaggaaa

SEQ ID NO: 571628 - DNA, 202 bp, Homo sapiens
gaatgagtactgatacatcagacagcgtctgcagaggaaagactaaagcatgtatgactgaagactaaagactcagtagcccagagtaagaaatgaggaatagcggtctaggttcccggtaccttcacatttgtaattccaggttctgtgaggtcttcacctaaatccatgagagattcctttttataataaatatctctca

SEQ ID NO: 571629 - DNA, 344 bp, Homo sapiens
  misc_feature (15)..(15): n is a, c, g, or t
tctacaggatcccangttcgacggacgactctcatgtcattacccccttcagacgaaaataccaaatgcatggagagctcccgtgattggttaatagggtgatagacctgtgagtccattcgtgatgtcttgactatatgagggaacgtgtgggctattaaggctttctggccctgtagctagtaactaaactgctccgtctactgttcatttctttctaccccctagtgcttttgggcccggatccgagggagagtagcgctcttgttgcgggatattgatttctacggatgatggtggtctagggacccctatctgaggggggtcatccatggtgacgagaa

SEQ ID NO: 571630 - DNA, 286 bp, Homo sapiens
ctgactctagaggatacaacttatgctctgacccaccgagaaggaacagctagtcatttaacaggctcttcttacaccaagcattgccgtgacagacctgaggactctgactcaaagcctggcacaccagcaaggcaagggattgtctcagtatgtaatgaccatatgttcacaggccatgtgctggtgtaggtttatggtctgagagggcttaaggctggagaacaggttctttacctgctgttttattggaaaacacgaagatttcctaactagaatagaagaa

SEQ ID NO: 571631 - DNA, 248 bp, Homo sapiens
  misc_feature (24)..(24): n is a, c, g, or t
tttagaggcagcgtgggtccatcngttgaaatagttaaaaagacatattcaaggataaaaatgtagtaaaactttcactgattgatcatagacattcttttgagttttgagacagggccttatcctgtcacccaggctgaagtgcagtagcatgatcacagctcactgtagcctgcaccttctgggctcaatcaatcctcctgcctcagccttgtaagtagctgagactacaggcatacaaccaccat

SEQ ID NO: 571632 - DNA, 1644 bp, Homo sapiens
tattgcgagtcagtgcagatcgacctgcgagaacataaatagttgtgtcacattccgatgcactattcagaggaacgaccgttacttgtgacgcatgagagagacacagtcgtgaggtgacggtaggaaggacacacctgcgcattcacaagcactggaagtggacacttactagtctgagacttgcgaccactcacgcgttaggcagtagaactctgccgagacaataaccacgtagtaggagtcagtacactacttagtgacacaagataaagtggactcgtcactacagaaacgcacactcgcgagacatggcttgggtcctgcacatgcgcgataggcacggcacttggccacggtggctgaatgtaccatgtatgtcttcaattccatacaatagaaagactcgagtgcgagccggcccctatcaatcttgctgttcgcggggtggcacgcagtggtgtaattcaattcgcgccataggcgctgtctacatgggttcccactagggaggtgaggccctcgcgtaactgacgcaagaacgccgcgttcactatgacttaaagtggcaacagggtgcctatccgcgaggcccttggggaggtttttcaaaacagaagtggtggcggtccgcattatgcgggagcaaaatacatatgaggaacatcccaaacggggggggaccaccacatagtaacgtggagacgcgagaggtggcggccaacgcttgcacgttgcccgggcgggtggaccacacaaaaggctagggcgggcgcagaactatcactcccaattgatggggagacgttccataccgtgctccgaaagttgcgtggccagatctataaataactatatgggttgggggccattcccaagggggttgtgggccagggagcagcattacgcatatgaaataggggtgcggatcccgaatgtcgaagaggaggttccccgtggaaaacaggcccgtcaagagctagagaaacaaccgggataggaactcctcctagacctccggcatcagagagaagagcatatacaaataaagccggggcccgtggaccccaggtccactttccaccacctgacacccattggcaccaacaattggctagggcctccccatgagcggaagaccatcaccatgaaataaacccccctttcctatccggaccaagggatggggacatccccagggaccgggggaaggggccaaaagcccccacatagggccatatctcaaaccagtgagtaatagcgccaagaaaaaacaaaaggaggcacccaaacatagaggcgcacccacacatatggacaccacgaaacaactacaccatacgcacagagaaacacaaaaccactggaataagagaaaaaaaagagacgaaaaaggaaaagaaacaacgaaccaaagaagacaagaaaaaaaagaacacacataggaaccaacgggacagcaaaaacgagcacgaaagaacaaagaaaaaaaaagaaaaaaacaaaggaaaggaaacaaaaaaaatacaacaccacaaacagacaaaaaagaagcaacagtaaacacaacaagagaagaaaaacaaaaaatcaaacaaacacacaaaaaaaaataaaacagccgacaccgcaaacaacaaaaaa

SEQ ID NO: 571633 - DNA, 157 bp, Homo sapiens
atgcctgttagtctgtctctagagttatccccacccgtgcaccggacagatcagctattccgacgcgcatttattcagtatgattaattaacataagctagagtcaacaccattagagtgtaacagacattgtggacttatcgcggtaaaaacgcat

SEQ ID NO: 571634 - DNA, 244 bp, Homo sapiens
  misc_feature (109)..(109): n is a, c, g, or t
  misc_feature (225)..(225): n is a, c, g, or t
aaatagttgggtgcagtggctatgcggtggcactataggaggctgaggcgggcagatcacctgaggtcaggagttggagaccagcctgggcaacatagacccctatctntacaaaaaatttaaaatatgaaaaattagccaggtgtagtggtgtgcgcctgtggtaccagctactcaagtggtcctcccacctaagcttccccaaatactgggattataggtgtnagccactgtgcccaggctt

SEQ ID NO: 571635 - DNA, 288 bp, Homo sapiens
taaagggtttttgccccccaaaaggggtaaaatggaaatgggggaaaaattgttgggaaagggaacccccccctgctttgaagggtttggaaaagccccatttaacctttaaaaagggtttgtttcccccaaaccctttggggggaaaaaccctatttttgtttttttaaagggccaggaaaaattgtttttttctggccaaaaacccctttttttttttttgccaattccccctccaatttggaattaagccccggttttgttttcaattaaaccaaaaaatcctta

SEQ ID NO: 571636 - DNA, 247 bp, Homo sapiens
aggattcacggccaggagatatatcacatggctggaatgaaaaacaggtatacaaccataagcatgagatccacatgtcccaaagacttactgaagtccagttgttgactgcatcctcagcacagcacgggccatggcaccataagagctgcgcaatgaggatgagcggtatgagaacaaaaatggagcttgtgatcatgagggtcagctcattagcatgagtatcaatgcatgacagtctaagcag

SEQ ID NO: 571637 - DNA, 119 bp, Homo sapiens
tgcttgattctggtacgggagtggtaatgcaagaaccaaacaatcctacactcaaagagaaaggttggccctgcccccttaagatcagtgtagcataaggttaatgaaaaatatatata

SEQ ID NO: 571638 - DNA, 238 bp, Homo sapiens
  misc_feature (57)..(57): n is a, c, g, or t
tttcttacataatatatttgttttgatagagatgtagagttgggtgggtgtttttgncactctgaactttacacctcattaaatttttgacatctacagttggataatttagccgcttagttgtccttttttttatacattataacatagtgagagaaatttatattactggtcattttatttttggcagtctatttttgtttatgttcctcttttttttaaacttaaattgcttaat

SEQ ID NO: 571639 - DNA, 316 bp, Homo sapiens
gtcccagctacttaagatgctgaggcaggtcgatggcttgagcccaggagtttgaggctgtagtgcacaatgattgtgggcaggaaacaggacctcgactttggaccagattcaagactggctgaaacagggaagaggcacagaaagaacttctccgtaagacacgcccaccagcacgacagtttaccattgccatggcgacacccagacgttactgcctttttccataacaacctggaagttaccaccccttttctggaaatttctgaatagcccactctttaatttgcatgtaattaaaagtcaatataaatgt

SEQ ID NO: 571640 - DNA, 276 bp, Homo sapiens
atggatagcggatgaggggctggcgacaataacgggcggatgtctggacgtgtgataactgtgtgcttcgtctcatttccacccgccaagactacaacttctcgtcagtctgctcagcggtgagtgagtcctgcctgatcactgcccatgggctggcggggccacctccgcagtgaggcgcctccatctagcgtgtgtgtgtgtgcgcgtgaggttgtgtgtgagcacttggcgggaggagggaggggacgcatgtccagctctctgtcctctggg

SEQ ID NO: 571641 - DNA, 184 bp, Homo sapiens
tcgaatcgacggtttctccagaagaattctctaagttcatttcagacgcaccaggatgttgccggttagatggctgcattccacacccgcctcatggagccatgccgtggagcctgacgcaagctttaaaggcagtcgacattaatgaagtctcgtggtttcttgtctacatccaacgtcccac

SEQ ID NO: 571642 - DNA, 330 bp, Homo sapiens
gagattggttctataagacataagttgtcaatcttgatcgcatgcgtaaccatgcacagccataccttgagacggagctattcttaggttaagaaccgtgagtgagaacgggatctgcgactgtgattactaggcacagctatgacttgcctgtgactcataccaatcaatgtggcgtagctgctgaccattgagctatatattctatgaatgtgctcctgcgcccagggtgtgtttacacagagcgcgcagtggtgagaacctgttatctactgttgagggaccctatgatagctggcgaatgtgatgtatggctatgacaggttggtg

SEQ ID NO: 571643 - DNA, 133 bp, Homo sapiens
ggctggttaagcccccgacacatccgcttgcattgaggttcagctcagtgagtacaggagatcctgagtgagtgctcctgtactcaccgctccatggtcccaaacagacagtggggctccttgtgtgaaagtg

SEQ ID NO: 571644 - DNA, 852 bp, Homo sapiens
  misc_feature (98)..(98): n is a, c, g, or t
  misc_feature (210)..(210): n is a, c, g, or t
  misc_feature (326)..(326): n is a, c, g, or t
  misc_feature (527)..(527): n is a, c, g, or t
  misc_feature (576)..(576): n is a, c, g, or t
  misc_feature (601)..(601): n is a, c, g, or t
  misc_feature (723)..(723): n is a, c, g, or t
  misc_feature (753)..(753): n is a, c, g, or t
  misc_feature (812)..(812): n is a, c, g, or t
cgggaaacggggaggcccaaacccaggcaggcagcaaccgcccctccgcatccagacattcccagcagtcaggaacacagaaggcaaccgcagcaccnccccccaccgggccggggcccaccagcggtcccagcacagggcccaccacccacgagccccccaagcacccagaaggagccccccagccaggagcagggtagggggagcccngcaaggccccaaggaacagagaaagcaaccccaccacagccttggggccctgggtgaggcagaagaggccccccccgccagccccacaccccatgtcgggggggcccgctttaacnggaagcacaacaggcagtaacagcacccccaccagcagggccagggggaagccgtcgtgcaggccttgggtgcggcactcgtgaatggacagaaccccctgcaccagggccagcaggaagagggcggggccaagaacacaagggacacacgaagggagaaacaagacagagtcccagaaacacagcacccaccagcataancacaaaggagtccagggacagcagaccaacggggacctggggcagcagncccacgtaggcgagcgcatggcagnggacatgcggagggccctcttcagctccctgctccgacaagacatcaccttctttgacgccaataagacagggcagctggtgagccgcttgacaactgacgtgcaggagtttaagtcatccntcaagcttgtcatctcccaggggctgcgantgcacccaggtggcaggctgcctggtgtccctgtccatgctgtcgacacgcctcacgcngctgctgatggtggcacacagccctgatgggagtgggacc

SEQ ID NO: 571645 - DNA, 543 bp, Homo sapiens
  misc_feature (477)..(477): n is a, c, g, or t
  misc_feature (486)..(486): n is a, c, g, or t
  misc_feature (492)..(492): n is a, c, g, or t
  misc_feature (500)..(500): n is a, c, g, or t
  misc_feature (514)..(514): n is a, c, g, or t
tgacacttgatgtggtatcttttctaacactactccagttctctagataacaactgggcattccataattcagtttaattctgacactatctgcctggagttagcatcaaatcctacaagttaaagggctcagtgtcacaagactgacccaacttaagacaccagttgtaagtcctgggctacctgtgtttctgaccaatggctgtacatcagtggttcccataactccctctttggatttgataattttctagaatgattcatagaactcaggaaaacactttacttacattttgacttacgtggtttttttataaaggctacaactcaggaacagccacataggagagatcacagggccagctgtgggaagtgggggtggcatggagtttccgtgccctctctacttgcaccaccgtctcaacgcctctgtgtgtttaataacccgaagctcttcaaatcctgtcgttcaagggnttctttttnattttnatttttantttttttgagacancttgggcgacagagcgagaccatgtatca

SEQ ID NO: 571646 - DNA, 146 bp, Homo sapiens
gagtgatcgtccggtgccttgagatcccttcctgctcagctctgagtactagatgtagggtcaaccctacaggcttagggggtgtctccctatgtgcagagacaagagattgtaatcaataacagacacaaggacgaagacgataa

SEQ ID NO: 571647 - DNA, 894 bp, Homo sapiens
agcgtgtagtaaaaataccccttgacatcaattttgaggagagtaggtgctaaggaatgatgactccgtatttcaaccacttaaccctcagtatcatttctttctttattttttgttttttataagaagacaagggtctcactatgtggcgcaggctggtctataaactctgggcctcaagggaatcctcctgcctcagacatcccaaatggctgcaacatacaggcatgagccaccagtgctatatcatttctgatatggtatgggctcgtgttgttccccacccaaatcttatctcgaaatgtgtaatccccaagtgtcagggaccgtggtgggaggtgatgggatcagtgggggatggtctctcagtgctatctcgtgatagtgaggtagttctcattaaatccgagggttaaacaacgtggtagttccccgtggtgttgctggacctctcatctccgtgatgtgccttgtgaagcaggtactgtgttcctaccttgggccttctgccagtgattactaaggttccccaagggttccccagctgttgtggaccgtgtgagccaattaaacctctataggtttataacattatccagtctcaggtagtatctttatacgcagttgtgaaaacggactaaatacacttttttaaatccagagttgtgcaacggtgggtgtcgaccagcaagtatactcccttttaccaaaacttgttagccacacccttggactgacatctttccacatgaaatcttgattagccccagggatatatgggggacccaaataccttgcaacaccctcaaccgcggcatttacgcgccacaagaccgcacctatcctcgtgcttgcccttcaccacatttgaacaaagcacatgcacatgactgc

SEQ ID NO: 571648 - DNA, 743 bp, Homo sapiens
  misc_feature (547)..(547): n is a, c, g, or t
gctccctccggagaaacagcgtgcatggtttattctggagtgttggtgactcgtgtactcattgaagcagatctctgcttcctcttatttttataggaatagacgaagaaaggtcagatgcgtgcccagctcttcaccccccaatctcttggtggggaggggtgttcctaaatatttatcatatactcgccctcgagtgctcgtcatagagaaagagaactactcaggcatctcacgaagagcagccacttgactgtcacacacacctccgcacatgcagcgtgacggagcccacactgtctccttgtggacgcctgagaccctggcgcaccccgcgccccccacgcccctctttttacccttcatggaaatagacgcatacaatatcatcctcctttatgggatcacaaagacagagtgtggggtcagagactcaaatgaggacacagtggtttcccccgtgttcaatagatctacgagcacacatgcacggtgctgcatgacctaccaagacagaactctcctcgattacagggtgactcacagncgcattggtgactcactctaatgtgtcattatcagctgctgtgagtgagcagaggacacactaggggggggtgtgtgagagagacaagcacatcggattcaactaccctcgagatattgctgtcccaccacccacaaggtacgggcagagatggatgttgcacttttttagggcagagggcgggattgctttaccc

SEQ ID NO: 571649 - DNA, 901 bp, Homo sapiens
  misc_feature (1)..(1): n is a, c, g, or t
nacctcttttgctgctcgatgctgtattgctctgtgttgctgtttgtgtcgtgtgttgcctctttggctcccttcgtccgccatttacccttggtgccgccaccggcctcgcttgggcccgctactgtttcaccattcaattcccttccggtccgcaaatccggctgcctctcgcggggcgcttgtgccgcaccccacggttttttaaggccaccgggcttggtgcaccgccaaaggtgtttttctcggtgaaatagggtttatcccccgtgcctttaaaatctcccatagggtccaaaaattctcctaccgggtaaagtgtacacgaaagtatatatagcctcatactctttaaaggaaattttatagtcctttgagagtttccattcttgtaggagataaattaaagggggttcttaaaacacaaggccggagggttttaaatctatcctttttccttgtgggttaaaaaagttgtctttaaaaaaaaatctgtgtgaaagggcttccccgtgcgcccccggtattaatccccattagaagccgccagcgctcttttagagagtttatatataaaggtggcgtttaccccgccgttaaatgttataggtataaaatgtgttaggtgtgatatatattaattttgaagccgatctcttttcaaaaaaaggagtgttaacacgcgaaggtgggatttataaaacacgttgtaactcctgaccccccgggaggaaatgcctgcctttataaacgcttgtttaccgtccttttccttacccccgaccggatatgggaaaaaataaattttggggagtggtaaggagtggacacccaattttggagagaaaaaaaaattttaaggggaaaagggaaacaaaaatcggggagggcgaaaaaaaaa

SEQ ID NO: 571650 - DNA, 844 bp, Homo sapiens
  misc_feature (37)..(37): n is a, c, g, or t
  misc_feature (49)..(49): n is a, c, g, or t
  misc_feature (54)..(54): n is a, c, g, or t
  misc_feature (82)..(82): n is a, c, g, or t
  misc_feature (90)..(90): n is a, c, g, or t
  misc_feature (234)..(234): n is a, c, g, or t
  misc_feature (251)..(251): n is a, c, g, or t
  misc_feature (288)..(288): n is a, c, g, or t
  misc_feature (366)..(366): n is a, c, g, or t
  misc_feature (372)..(372): n is a, c, g, or t
  misc_feature (378)..(378): n is a, c, g, or t
  misc_feature (388)..(388): n is a, c, g, or t
  misc_feature (408)..(408): n is a, c, g, or t
  misc_feature (410)..(410): n is a, c, g, or t
  misc_feature (414)..(414): n is a, c, g, or t
  misc_feature (431)..(431): n is a, c, g, or t
  misc_feature (443)..(443): n is a, c, g, or t
  misc_feature (446)..(446): n is a, c, g, or t
  misc_feature (470)..(470): n is a, c, g, or t
  misc_feature (487)..(487): n is a, c, g, or t
  misc_feature (496)..(496): n is a, c, g, or t
  misc_feature (504)..(504): n is a, c, g, or t
  misc_feature (506)..(506): n is a, c, g, or t
  misc_feature (516)..(516): n is a, c, g, or t
  misc_feature (547)..(547): n is a, c, g, or t
  misc_feature (585)..(585): n is a, c, g, or t
  misc_feature (591)..(592): n is a, c, g, or t
  misc_feature (598)..(598): n is a, c, g, or t
  misc_feature (656)..(656): n is a, c, g, or t
  misc_feature (660)..(660): n is a, c, g, or t
  misc_feature (664)..(664): n is a, c, g, or t
  misc_feature (666)..(666): n is a, c, g, or t
  misc_feature (675)..(675): n is a, c, g, or t
  misc_feature (685)..(685): n is a, c, g, or t
  misc_feature (696)..(696): n is a, c, g, or t
  misc_feature (700)..(700): n is a, c, g, or t
  misc_feature (704)..(704): n is a, c, g, or t
  misc_feature (743)..(743): n is a, c, g, or t
  misc_feature (749)..(749): n is a, c, g, or t
  misc_feature (754)..(754): n is a, c, g, or t
  misc_feature (758)..(758): n is a, c, g, or t
  misc_feature (778)..(778): n is a, c, g, or t
  misc_feature (822)..(822): n is a, c, g, or t
taaattttttatatttatttattgcagaaaaatatanaaagatatttanaaaanaatcataaaaatatgaatgcatttaganaccggatntatttgcattttaccatgggtcctcaataaataaatagaatgttgttttttgtattttaagtttttttttgtttttcccctcagaggaaggatgaaaaaaagaattaactgactatggttttgcaggccagtttgatcccagtntttttatttctaaaggngttcttatagttcctctgattgttaccattttaaaanagagaaagtccatagtgatgcctttcctttcagtggctgattggcacgacctcttgagaatgcatgcatgaaaaaaanaaaaanaaaaanattcttcgtnaaaaaaaaaaaaaaaaaaananaaanaactgttcagacttctntcagaatgcagnggngtgagggtggggccgctgcccgtntgggaatcactgtccangggcctgtntcgctttntnttttaaaagngcgccccacgccctgtttctttgaatttggnttttgctcttctaatttccaagaaaatctttggcatanattttnntttttngttatccagccccagagtctctagactgtccattttctccttctctggaaaaaatganatcnaggncnccggccctnctgagggggnggggggctccncctnctantgggacgcggacatggaccaggccccctccatcctccanaccganaaggngtantgaagccgctcgtgagcaanaaagctgcagcttgccatcttggagtccagctcgtcgctctggnggacctggtagaggaagtcgat

SEQ ID NO: 571651 - DNA, 316 bp, Homo sapiens
  misc_feature (192)..(192): n is a, c, g, or t
ttaaagaaatgcagtttgaccttgccagtgcctccagaagcccagccaacaaaacgcgtccagaacgtacgggcctctttccagccgtgggggctgctacggtgactcttcataaaagctaaacagatattttgttgaccttctaacaagaataaattctactagactagtactttagagaaagtactagcnaagggagagctcctctccagcttgcaaacaggactcaatcattcccacacacgtggcggggaagaaagatcccaatgttgcttgaatggcaaaagctatagggagaatttcccaatgtcagtta

SEQ ID NO: 571652 - DNA, 801 bp, Homo sapiens
  misc_feature (801)..(801): n is a, c, g, or t
cacgcgtcgccacgcgtccgagtaaaagcacgagatgatgctagttataaataataatagctattattattatgtaatatgggaaaccagatgattataccaggacttgtggttgacgtctgggttgagacctatattcatagtgctttttttttcccacttcagacgacgtaagggtgctgatagcataaccaggttggaggggggtccatttcacacgtgagcttgaaaacccaatcatacgcttctggcatccagggttttcaacatgggtgtttctgtagccagacctctgagctggttttctcttcgggtgaaagggcgcaatgatcattatagggggccctctgggttatggggaggaaagaaccgggccgggcatcaaagaatattcagtagtggtactagcaacctcagtccccagttattcacatttcaagcgcattacagtatggtgtggaatggatacggccttattggtgaaatgtggtttagaaaaaagcccgtttggcttaggggtccaccaaattaatttcgaaaagggtaggtccaggggaaaaccggggcggtgtgaagatatttgggacgcagacgatgtggtttgggccaagaacattctttccctggggggcccggggtatattttcacaaggagctctctttgttaaccatctcaaagggccacagtgtgtgtggtttggcaccgttcaggtaataatgtgcaccataattcgagggttaacgaacaaagtttaattgagggtcagacacatggggatattgaagggtgatataatgtgn

SEQ ID NO: 571653 - DNA, 479 bp, Homo sapiens
  misc_feature (56)..(56): n is a, c, g, or t
  misc_feature (114)..(114): n is a, c, g, or t
  misc_feature (227)..(227): n is a, c, g, or t
  misc_feature (237)..(237): n is a, c, g, or t
  misc_feature (251)..(251): n is a, c, g, or t
  misc_feature (255)..(255): n is a, c, g, or t
cagacacacacagacacatgtgcaccctctcacacacttttctctttctacaactntggggtcagaagaccactgacagctgcagcaggatcactaaaaagtgacacaaggtcncggggctctgtggccccagcttcctcagacccccagggtctctccactcccagagccccctgcctgaggggccggagccctgtggccaaggcctttcctcctgggcccatctnaggcctgcangtggaccccggccnggcntcctctgagggccgtcttccgtgctggctccgcagccctctcctgtgcccgcacctgtgcagatgcttgttttcacccgggcgtctgcaggcacttggtgccaggctcctccggggctttctcagaggcagccgagtgccaggccctgcacacgacaccctcacccgagccggagagcttcacatctgtggaaaactctaattaaagacgttttgagaaacgct

SEQ ID NO: 571654 - DNA, 850 bp, Homo sapiens
  misc_feature (13)..(13): n is a, c, g, or t
  misc_feature (65)..(65): n is a, c, g, or t
  misc_feature (72)..(72): n is a, c, g, or t
  misc_feature (77)..(78): n is a, c, g, or t
  misc_feature (85)..(85): n is a, c, g, or t
  misc_feature (95)..(95): n is a, c, g, or t
  misc_feature (133)..(133): n is a, c, g, or t
  misc_feature (139)..(139): n is a, c, g, or t
  misc_feature (143)..(144): n is a, c, g, or t
  misc_feature (166)..(166): n is a, c, g, or t
  misc_feature (168)..(168): n is a, c, g, or t
  misc_feature (172)..(172): n is a, c, g, or t
  misc_feature (193)..(193): n is a, c, g, or t
  misc_feature (201)..(204): n is a, c, g, or t
  misc_feature (220)..(220): n is a, c, g, or t
  misc_feature (241)..(242): n is a, c, g, or t
  misc_feature (245)..(245): n is a, c, g, or t
  misc_feature (255)..(256): n is a, c, g, or t
  misc_feature (264)..(264): n is a, c, g, or t
  misc_feature (266)..(266): n is a, c, g, or t
  misc_feature (271)..(272): n is a, c, g, or t
  misc_feature (275)..(275): n is a, c, g, or t
  misc_feature (287)..(287): n is a, c, g, or t
  misc_feature (292)..(292): n is a, c, g, or t
  misc_feature (294)..(294): n is a, c, g, or t
  misc_feature (306)..(306): n is a, c, g, or t
  misc_feature (330)..(330): n is a, c, g, or t
  misc_feature (333)..(336): n is a, c, g, or t
  misc_feature (340)..(340): n is a, c, g, or t
  misc_feature (342)..(343): n is a, c, g, or t
  misc_feature (345)..(352): n is a, c, g, or t
  misc_feature (365)..(365): n is a, c, g, or t
  misc_feature (376)..(376): n is a, c, g, or t
  misc_feature (388)..(389): n is a, c, g, or t
  misc_feature (404)..(405): n is a, c, g, or t
  misc_feature (432)..(432): n is a, c, g, or t
  misc_feature (434)..(434): n is a, c, g, or t
  misc_feature (446)..(446): n is a, c, g, or t
  misc_feature (452)..(452): n is a, c, g, or t
  misc_feature (456)..(456): n is a, c, g, or t
  misc_feature (463)..(463): n is a, c, g, or t
  misc_feature (468)..(468): n is a, c, g, or t
  misc_feature (499)..(499): n is a, c, g, or t
  misc_feature (522)..(522): n is a, c, g, or t
  misc_feature (525)..(525): n is a, c, g, or t
  misc_feature (568)..(568): n is a, c, g, or t
  misc_feature (570)..(570): n is a, c, g, or t
  misc_feature (574)..(576): n is a, c, g, or t
  misc_feature (578)..(579): n is a, c, g, or t
  misc_feature (581)..(582): n is a, c, g, or t
  misc_feature (606)..(606): n is a, c, g, or t
  misc_feature (841)..(841): n is a, c, g, or t
  misc_feature (849)..(849): n is a, c, g, or t
aacaataaaaaanaaacaaataaattaaataaaaaatggtatccataaatcctccgccaaaaaantaattancaggnncatcacnaacatcaacncccggaagcccaacacttcgcgcaataaatgcaaaacngatatnctgnncccaggtacaacgacaagatcntnctcnaaaaaagaagacttcacatcnctcccccnnnnaaaaaaacaaacacancccaaaacccttccgcccaanncancttagacaanncctggaanancaganncgngacaacccagantcccngnataaagttttantaaaagaaataataaataagcatnatnnnnaaananntnnnnnnnngaaaaataaaatnagaattaagantaatctgaaaannttatggttcccaagnntccgcaccatggtacccagatatgctnantatgtgctttgncttatntttnaaaaccnaccancaggtaaccaaaatggaccccactctgaganttccatgatgaaggtgtttaagnttnacattaaccccaagttaaggtagttgatgaaattttccatttntntttnnntnngnnttttttaggtgagactacattggnaaatggggaaatgacaccaatcatttgattacagaaaatggttttataaatcctcctcttgaaattatgttcaggcccagcatggtagcttatgcctgcaatcccagcacttggggaggccaaggcagaaggatcgcttgagcccaggagttcgacaccagcctgggcaacatagtaagaccccatctctgtttttttttaaaaaaaagaaattctgttcaaaagtatttcagancaaaaggng

SEQ ID NO: 571655 - DNA, 206 bp, Homo sapiens
aaaaaaaaaaaaaaaaaaaaaaagaaaaagattttttttaaattttcccccgcccccctttttttttggggggggggcccctttttttccccgggggggggggggggttttggggggttttttttgggccccgggggtccccccggggttttttccccccccggggcccgggccaaaattttttttttccatggcccttaaattta

SEQ ID NO: 571656 - DNA, 118 bp, Homo sapiens
tgaatcagatgccaagtagagtgagccaagctggaagcaatgcgagaacatctagactccatatgacagacagctccagcagcaggcagctaataccacagtagagactatagaggca

SEQ ID NO: 571657 - DNA, 1253 bp, Homo sapiens
  misc_feature (932)..(932): n is a, c, g, or t
ccgaaggcgggccagacgatgatgagaccaggacagctgctgatgaccgtctaaggaaggtccagactactatgacgcaaagatgtttcaaacgtgggggcctcattgtccttctaccgcgtgcctgtgtgagcccacgaacatgggccatgttctgggaggccatgcccgtgcccctggaccaagaccctgcccttgaattgtgaaattccaaggacaccatggccaccgtctgcaggttcacaaacagggctctttgcaacggaatgctctgatctaacatgcactcttcaggcaaaatggccattgacatgtcgtcggcgggagcctatgatacggagcacttatcatgagaaataacgcgttttcacggcatccctgggacactcccatgaacagcccttggcagcagacgcgctatcttatcttggatgggctcttcacattggcgaggtaccttgcatatgagataacacgtggaccggatcgtacgattgaattgcccctgaggccctttgacaaccacagccagtcaattcagcagcaataaacacagtgatacaaccatgggagtcgcacccctatgttactgaccatcgccaacatgctttcgatgcaacagtgcggtgccaacgacagtcccccagttggagacttggcggacgctaacccagtaagacactaccattaagttgaggttgaagcccaatgtaccaccattacattgcgcgccccacttcaaatgtggtcgtccccacaccggttgaataatcttagtcgagcccaccgactgtgggactatcccgaaggctggcagaaaaggttcctagggagctggagggcgcacttaggagacaatcgctgggaacagcgcctagcgacaccggagttgcatccatgagcgcaggcagcacagacttactatttaatgncacctggactgcgatccaacgtaatctctacacgccaaccgaggaaatgcaatagcgtgaatatccgcacggaccctttggggtttgcccatcagtcaaccttcgtacctcatgaccacaaccaccagagattttttgacacacgccactggacacaaaaagtgtcgcatttgcactaatacattgtgttacataacgattggagtagtgcaaagttggtaacaccttcatgactcgctaatcctcttcacaaccacaattacaactaagggggtatcatcgtaccttggggaaacttcaagtgtatccattcatatacaa

SEQ ID NO: 571658 - DNA, 140 bp, Homo sapiens
tactcggggtcatgctttgaaatttgtggagcaaaccccccagtttcatgcccatggtcctaaaattaattcccctaaaaatttttgaaaaaggggcggtatttaccctaaagcccccctctctaccccctttagagcca

SEQ ID NO: 571659 - DNA, 1029 bp, Homo sapiens
gtgcgcgggtctcgggatcacttcctcagtgcggtgcacgatcccgcctgcagcagtgggtgtgggggcgctgcggggctcatcccgaatctcagagagcgtggggctggccctaggctcggaatgagtctcccactgagtccgcagctcctcactcgctgccctggggcgtgggtcttcccctggaccttgcaataggcgtcgggggtgtcctggacgtcccagctccctagtgcacctcggtgggaggcacctggccaaggacaaagcttggtggttaacgtacagcagactgctgcaagcatgcgccccggcttaaggacatggagatgatgtgacttgacaggggcggttcgcgcttcactccaaaggggacaaatggaaggaggctcatggccacagggcctcggaagaggctaatgaacccaagactcagggatggaagctaatcttcaggtggcctccaggagggcagctggggagaagggcaaggctcaaccagtctctcaacctttttttatttccacaactaacatctgtaacatttttaagaatgaggttctcttcagacttctacagtacaaatggaatgagtacaccgttcagaatactattaatatgctaagttgacaagtgagaagatgactagcctgtctggtaagttacctccacaagtacctcgtctcgctcttggatgcctcctctggctgggcctcccaatttggtagcacttgaggatgcccttcaagccctgacactggcacttgttggggaaagcccctttcaagagggtggccaaaaggcggagcgggtgccctcaagttgctggggaagcgtgtgggagggaagaaaggggggtgggaacaaggttgaccgcggtgattggaagcagaagaaagtacaggtgggaaggggctatgagggcccgatggagacgagataaaccggagcagggatagaggtaaactgaacaagaggtgagcaatacaggagcaaaggtccgaagaaggggacaagcgaaaaagaccc

SEQ ID NO: 571660 - DNA, 170 bp, Homo sapiens
cggttcctgccttaactgatgacattaccttgtgacattccttctcctggacaatgagtcttagaagctccccactgagtaaaaggatattaaccccagaggcaacaaaagaaattaaattagtggaagaaaaaattcagtcagcacaaataaatagatcccttagtctc

SEQ ID NO: 571661 - DNA, 286 bp, Homo sapiens
  misc_feature (28)..(28): n is a, c, g, or t
  misc_feature (137)..(137): n is a, c, g, or t
  misc_feature (185)..(185): n is a, c, g, or t
  misc_feature (195)..(196): n is a, c, g, or t
  misc_feature (221)..(221): n is a, c, g, or t
  misc_feature (267)..(267): n is a, c, g, or t
ggagcgtgcaaccgtctgggaagacagnccactaagctcagaaatggcgatgccctcctcctagcagctcaatggtcccaggttgactctggactgctgtgctggcagtgagaaatttcaagccaatggttcttagncttggctgagctctagtgggagtgggacctggctgagttgagaacagncctggctccnnctggcttcatccccctttccagggnaagtggactgggttctcctgtcgtcggtggcgtttccagaatgccnactgggaatacgaaaaaaa

SEQ ID NO: 571662 - DNA, 292 bp, Homo sapiens
  misc_feature (240)..(240): n is a, c, g, or t
  misc_feature (268)..(268): n is a, c, g, or t
tgagtcaggagttcgagaccagcctggccaacatggtgaaacctccgtctctattaaaaatacaaaaattagccgagagtggtggcatgcacctgtcatcccagctactcgggaggctgaggcaggagaatcgcttgaacccgggaggcagaggttgcagtgagccgagatcgcgccactgcactccaacctgggtgacagactctgtctccaaaacaaaacaaacaaacagaaagattntattaatagatacttttgtttccctcancttgactgatgggcaggaaaaaca

SEQ ID NO: 571663 - DNA, 214 bp, Homo sapiens
gaggatccccatcttgcaggcgcacacccaataatcagtcatgtgtaatatgcacaagcttgtttttgtttttggtttttttgtaggatgggttgatcttttgctctaagttgcatgatctttctgcaggaaataggcactcatcccactccacataaggggtttagtaagagaagtctgtctgtctgatgatggatagggggcaaatcttttt

SEQ ID NO: 571664 - DNA, 427 bp, Homo sapiens
  misc_feature (91)..(91): n is a, c, g, or t
  misc_feature (202)..(202): n is a, c, g, or t
aacccttaaaagacctggctccaacattaccttaaaattggagaatagggttagggccatcctatcccaatcctcccccatgcccagtaantcctacagaaacagattaggttagcctagaataagccatgtttaccaattaaatttatgcctgtatcccttcctaatcacccactttcctcatcaaaatgcctcacaaatncatcctgccatcattgtcccattctttaaaaatgtataaacccatctctactaaaaatacaaaattagctgggcatgatggcgcacgcctgtaatcccagctgttcaggaggctgaagcagaagaattgcttgaaccccggagacggaggttgcagtcagccgagattgcaccattgctctctagcctgggcaacaagagcaaaactccatctcaaaaaaaaaaa

SEQ ID NO: 571665 - DNA, 383 bp, Homo sapiens
ggtcatctggaccggagtatggctccgagggcaggttcactttcactatcccatacccctagtgagcaccagatctgtctgcacgtgccaattccaccaagttctccctctttgctggaggcatgctgagagttcacctggacatccaggtaggtgaacatgccaatgactatgcagaaattgctgctaaacgacacgttgacgtgcgttgccgctacgacgtgcgacagctggtggaacaagtggagcagatccagaaagagcagaactaccagcggtggcgagaggagcgcttccggcagaccagtgagagcaccaaccagcgggtgctgtggtggtccattctgcagaccctcatcctcgtggccatcggtgtctgggtc

SEQ ID NO: 571666 - DNA, 1356 bp, Homo sapiens
  misc_feature (340)..(340): n is a, c, g, or t
gcttcttcatagtaatacccatcataatcggaggcttggggaaccttctagggtaacgagcagatgtacaacgtgatcgtcatcagcccatgcgtttgtaataatgcttcttacatagtagtacccactcataatcggaggctttggcaactgacgtagtttcccctaataatcggttgtccccgcgtatataggcagttttccctcggtgataaactgacataagcattcatgactcttactctccacttctcatccgtacttcctgtgtgcgcgatctgcttatagtgggaggccggaggtaggcaactaggtctgcaacaggtctcacgccttcgcntctaagtcaggggaaccttagagagaatgggaaacccatgaagaccctaatggagaatcatacaacaaacgcgagacaccaaacgagcggagggacgaatataagtagaggcacattagcgcaagggcaattgtggcgtggagggtgtgagacataatcttccgtctgaacaaagccgggcgagaattctgtcgttctggggattcgtccgagacatcaaaagcgcattcaaagactaaaatggaaagtaccaccctgagggtggtggtggccaaattaacagctggttcccacacgaatgaggccgcccagactcaagcaagctgggggttgtcctctggtgtcccgctttccgttcgggcacaccagacaggcaaggccgcagagcccacttacttaccactccggtgcttccacttggtagaggcctgtgtgggcaccagacaggacttgggtccaagagggggtcatgcgaaaaccgcattgtgggtcttaacaagcttggcaaacggcctcggaaagtggaagcgccacaacagccaacagacattgtgaggcgccaaaacaacaagggggccataattccgtaggaaaccagcgcgtggcaacctttggttcttccttaccccagggaattggagcactcccaccagtcccatggaatagggcagtactcgtagcggaacgaggccacaaccgcggcaatgggagcgcccgaaggaggccacatcggctcaatgagggggaatccttcacacagcgaacagggggcacaaaccaagcccttttctaccagcacacataagaaatggggtaggagcgaaccaatcgacatcacagacacggggcccaggttgaccgtccaaagaccccgttaacacgggataacacgcggaacagagagcacggcttggcaccaacacaggggccagcagcggacactcacgacgcacagcctggggcgaataccacaggacgcggggacaacggctccactcagggcagcgccacgcaag

SEQ ID NO: 571667 - DNA, 509 bp, Homo sapiens
tctccctgaattccttactactgtctgactgcctgtaggggtgacacatcaggatgagataaaagatgcctttttatactggatagttacacccactaagattgaaccaagattatatccagaagcaaagaggcaggataggcctatttgcttggcaggaggagaggggaagcagccttgtagctccgtatgacttggcacgtttaccagagtttaggaatcacgttagatgtctaaactaaagtgctctttagcctttgtacagaaccaaaataatactaagtccatttgattatctatttctagagtatctaattctccctactgttactaccttaatctgagtagccatcatctctaaactacattgctatatgtcaaccttcccacatggcagccaaaatgatcttttaaaaacataaatctgatatgtcacttccctactttaaaagcctttattgggtcacagtcaaatctaaatcccttattatattctttgggataggaac

SEQ ID NO: 571668 - DNA, 683 bp, Homo sapiens
  misc_feature (1)..(2): n is a, c, g, or t
  misc_feature (7)..(7): n is a, c, g, or t
  misc_feature (15)..(15): n is a, c, g, or t
  misc_feature (20)..(20): n is a, c, g, or t
  misc_feature (42)..(42): n is a, c, g, or t
nngaggnatccgaanccccnaccaccacaacgcgaacctctnccttttctcaagggttagagccagaccaataaattcatctcaactaatacaacccccttcacccttttataaaattcaattaacccaacccaattataacctttataatcactcattacccataaaaaacattcacaacataaccctacttacaacattttatccaacactttttacagtgtttaccctccttacacctctcaaccaccacaaaaaacaaacccccaaaaccttaatcactccatctaaacctattttaaatatctcatcacacactccattcctctcaaaccctttcataaaaacctcattacccctgtacctgccatcatacaattaccccaacttctatcaaatattttctaataatcccaacttcattacaaattactaaccaaatctaattcatatccacatcaccaatatctaattctctcaaaaaaccccccactctacccaataactctttttatcttaactacacttcacctactacttttattcccagcctcttcaacccctcattattttatctaaataacaattctctaaaacttctccatcttatcaaataccaccctaaccctttacttttcccattaaaaaactcacacttacccaaaccatcaataaataccaaa

SEQ ID NO: 571669 - DNA, 248 bp, Homo sapiens
gaatgggtagagtatgataccgagatccagaaactattagatcatcttgaaaataagaagaaaagtacaattcatgatgaactctagcacagacgatgagaacgatggaaatctgccacctgctggaaatttgtggaactgctaagactagtaggccattcgttccaattattgacataaggttggctggttttttataagctttatttaaaacacatgtaaagttttaaaataaacttaatttatgt

SEQ ID NO: 571670 - DNA, 126 bp, Homo sapiens
  misc_feature (33)..(33): n is a, c, g, or t
tgtaaccgattgcaccgtttcgactgttggtgnttatcacacatgcctcatgcacaggattctggggtagaagtgggagactacagagttggggctccccaacccccaggggcaaacatggcgaaa

SEQ ID NO: 571671 - DNA, 118 bp, Homo sapiens
tatcgagcagcgtccccattggttgaagttgacatctgcacgacgtgcaggagcagatttacacactggccaagaagggcgcgggctccttcacagatcggtgtacctcctgagagat

SEQ ID NO: 571672 - DNA, 102 bp, Homo sapiens
ctgtcttgaaagtcctgcgcgatctctacgcaccagtacgctgaaaaggcagctttctgatcagcggctcggtggacttccggtagcggcgaatctcgggca

SEQ ID NO: 571673 - DNA, 395 bp, Homo sapiens
  misc_feature (1)..(1): n is a, c, g, or t
  misc_feature (331)..(331): n is a, c, g, or t
  misc_feature (375)..(375): n is a, c, g, or t
  misc_feature (389)..(389): n is a, c, g, or t
nttgcaggtgagctcagaatggcagccactgcactccagtctgggtgacagagtaagactccgtcgcggaaaaacaaaaaacaaacaataacaactacaaaaagagttaagtctctacctcaaagtgaacatgggttgtatgttacatgcatgtttgttcaataagcatgagtcaggatgaccttcataattattcatagctcctcctgtaacctgttgaatatgtatgtttagccaacctattcagcatcaagttcctacccctgctcctcctttggaagtgcctgtcttctgggtctttggccagaggattgtacttcctggggctgtngggatgggccaccttggcagggccttttaacccttttataaggnaataaagtctcctnttccaa

SEQ ID NO: 571674 - DNA, 492 bp, Homo sapiens
  misc_feature (6)..(6): n is a, c, g, or t
  misc_feature (87)..(87): n is a, c, g, or t
  misc_feature (100)..(100): n is a, c, g, or t
  misc_feature (118)..(118): n is a, c, g, or t
  misc_feature (120)..(120): n is a, c, g, or t
  misc_feature (122)..(122): n is a, c, g, or t
  misc_feature (124)..(125): n is a, c, g, or t
  misc_feature (144)..(144): n is a, c, g, or t
  misc_feature (211)..(211): n is a, c, g, or t
  misc_feature (213)..(213): n is a, c, g, or t
  misc_feature (216)..(216): n is a, c, g, or t
  misc_feature (237)..(237): n is a, c, g, or t
  misc_feature (241)..(241): n is a, c, g, or t
  misc_feature (243)..(243): n is a, c, g, or t
  misc_feature (250)..(250): n is a, c, g, or t
  misc_feature (256)..(256): n is a, c, g, or t
  misc_feature (273)..(273): n is a, c, g, or t
  misc_feature (275)..(275): n is a, c, g, or t
  misc_feature (282)..(282): n is a, c, g, or t
  misc_feature (326)..(326): n is a, c, g, or t
  misc_feature (364)..(364): n is a, c, g, or t
  misc_feature (372)..(372): n is a, c, g, or t
  misc_feature (421)..(421): n is a, c, g, or t
  misc_feature (474)..(474): n is a, c, g, or t
acaagngcactcgaggctgcagtgggagcccatggggacactaaacaagggcacaagtattccaactatgaactcctaacctaatcnacttcttccatgngagacgcatcctcatcgngntngnngggggggatctcatcaggnactgcagcattgggttcctctgctgccacttcatcttcatcaatacctagacctagcttgatcatgngntanatgcggtttttttttgttctngggntntttaagntaaaantctagaagatatctggntngtttcanacagcagcaccaaccaggtccttaactgccttatcattcttgtnggcctcagccttcttccgcagcgtctccacaatggggnggtcaggnttaatcaacaaagttatatttggccatcatatagcccatggtggagttntcccgaagtgcctgggctttcatgatccgctccatattggctgtccagccggnagtgctggtcacaatgca

SEQ ID NO: 571675 - DNA, 268 bp, Homo sapiens
ctggtactggtgatggagcatgataatggtgagaaaaaagaatgcatgcatgttgtgagccacatgggaagtccaaaagaatgcatacatgtatgtgtgactgggtcaccttgctgtgtagtagaaaattgacagaacattgtaaatcacctataatggcaaaaataaaaatcattattaaaaaaaaagacctacatattagaaatgtgtccagcttcatagatagatctagttaggtggggttttggcagtccaggagcctggtaaa

SEQ ID NO: 571676 - DNA, 508 bp, Homo sapiens
cactgggaggattcccctgtgaggacagaaacaagacaatacgatgcctactctcaccacccctatgcaacatagtactggaggtcccagccacaggaatcaggcaagagaaagaaataaaaggcatccaggaaggaaaagaggaagtcaacttatatctcttcatttatgatatgattctatacctagaaaaccctaaagactcaaccaaaaggctccgtagaactaataaaaaaagcttcagtaacatttgggttacaaaatcaacgtgcaaaagtcagtagcatttctacacgccaataacgttcaagctgagagccaaatcaagaacacaatcccacgtataatagctataagaagaataaaatacctaagaatacatttaacgaaagaggtaaaagatctctacaaggagaactacaaaacactgctgaaaaaagtcatagatgacacaaacaagtgggaaagcagtctatgctcatggattggaagaatcagtatcattaaa

SEQ ID NO: 571677 - DNA, 117 bp, Homo sapiens
tctgcaggttgtagccatttaccaagcatagttgtaggtaaagaagggcagatttattagacgaaattgtgaaacatatgttcgcacgtagggcaagctcagacacgagaacagagg

SEQ ID NO: 571678 - DNA, 101 bp, Homo sapiens
tattgttatgactgtctgctttttagtatctatgatgtacagcaacttgcaccttctagctcatttaattttctcagcataaagaaggcaaataagcaata

SEQ ID NO: 571679 - DNA, 672 bp, Homo sapiens
gactgaaatgtcacatcatgtatggactaatgtcctaatccgttacaataatatcacccacctgaaggaatccaacctttatccacagggagacccaccaactagttaactccggcttaactggaattcaatctcattgcggaactctccacccccaataagtgttccctcccagcctcggagatggcttcactcgtgtgttccggtgtctaccagacattgattcatggtgcctcgtgcagtccattgaggaaagttctcttcagaggagcatccatgggtgctgttccccttgtcagctgtaacactgtgccgtcattctgcacacagattttcaagctccaggacttcttcaccttcctggatccagtgggtcaccacatccaggcactgttcttcagggctgcggcactgcaggctctagtgccggcccctctcacagctcatgtctgatgagccacaggaaatgcattcgaggtaacggcttcgggaataggtgacagcccggcctgtttggaagagggggaggggagtgagactccatggggacagtcctggagccccagctctgcaaggactcactcacaatcaatttctccttatcccaccctgcagccagtcattgagcctgcctattctgctgctgatcttctagaatcaccctccttcagc

SEQ ID NO: 571680 - DNA, 327 bp, Homo sapiens
gaggattccgtaggacaggagtttgaaaccagcctgctaatacggcaaagtcccgtctctactaaaaatacaaaaattagccaggtgtggtggcacacacctgtagtcccagctactcgggaggcttgaagcaggagaatcgcttgaacctgggaggcagaggttgcggtgagccacgattgcaccatctcactccagcctgaaaactatcttcaggttacagaagtttgtaaaagggaacttcttcccctctcctgctgtcaggccgaatgtcagctatcactgggatttcttttttttgtcttgttttgagtgtgattctggccg

SEQ ID NO: 571681 - DNA, 878 bp, Homo sapiens
tggggctttgagctgtgtatttcctcgacggtaatcacatagaaataggggaaaacattcacatgcaatgatagaagactatgcccctcttccttctctctgcaccccttcacagcaattcattgtatttgctgttgtctacttgtccttcgtccatcctgtctctcatttccctcttcttttttttttttttttgaaatggagtctctctttttttgcccaggctggattgcaggggcacagtttctctcggccttcactgtgcaaccctccacctctccttaggtttcaagtgtgatttctcggtgccttcagccctcccaagttagcgtgggatttacagaacattgcccccacgcgaactctcccatatggctatatctttcttttgtgtgatatttctctagttagaggcagggttcttgtgccagtgtgtgtggcgcgaggctgtgggtctcttttgaaactttcctgtgtgccccctccaagggtgttggaatcttcccaacgctgtggtctctttcgggcctccctcccccccagaaaaatgtgtctttggaaaactataaccaggcgtgtggaacgccatctctatttggcccccagaaactctctatttttattctcgctctctttctctctcacacaaaaaaacagccgtttttgccacaagacgtttgttgagaaaacataaccagcggcgccaacaagtggttggtgaacgcccccccccttgttctacttccccataattctttctgttttctccccagaaaatcctcttttttttgtgcggcccccccccgttgtggtcaacccctcttccccgctactcttattgttctacttctcttccgctcttctcttcttcgcctctc

SEQ ID NO: 571682 - DNA, 277 bp, Homo sapiens
caagggggagtgggcaactttgtagcccagtcagtcagatgtacgggtggctggatagtgggataggcatctgaagtggagtggagtcatgggactgagccctcaacctgtaggatctgacatggtctctaggtagataaacatccaaatggaattggattcatcaggcatcacccattgggagtcctctgggagcacatggcttggtgtggggcaacagccccccagagatctggtcacaaaagtgtgccgggcggagcgaaagtgggtaccgagc

SEQ ID NO: 571683 - DNA, 204 bp, Homo sapiens
ggaacgctggaggcatacctaccaacaggcaaacaattgtggtaacctaataatgtgccgcgctataatgcggtgcacgacagcatggcaatattcagcatgaattggaacgctatcacttgacagacagatgactggtgactggcggcatgcggtagacaacactacacactacgggctgcagaaacttcaatgcccgtcaaa

SEQ ID NO: 571684 - DNA, 118 bp, Homo sapiens
  misc_feature (70)..(70): n is a, c, g, or t
ctctcctcctggacccagggcagccaagggagggataggcgcagtggtcagatgaagcagcccagagagnacctcccagctcttatttcaccctccccacctcaccaactttggttcc

SEQ ID NO: 571685 - DNA, 87 bp, Homo sapiens
  misc_feature (41)..(41): n is a, c, g, or t
  misc_feature (44)..(44): n is a, c, g, or t
acaactgggacattaaagcctgacgacagggttgtggttgntgncaccccgctggatagtcgttcctttttctggaatgtgggccca

SEQ ID NO: 571686 - DNA, 1610 bp, Homo sapiens
  misc_feature (573)..(573): n is a, c, g, or t
  misc_feature (1242)..(1242): n is a, c, g, or t
ttggggaaagggcggacaccggtataattgggcaggaaaaagaaaccattccacggctggcccagaggggggcacgggtgggtctttaactcctctcctctccttggtgtggtcttctcgagcccgcagccccacctctgtgtgcccttttgtgtgggtattctgttccttctattcacgcggcgcccggggtggtgcacccgcgcggagaggggagaggagaggcgccacagagagagaagagaatcgacagagtgtgacatctgctgtgggagaaactctcgcaggagcggaaacaaaagagaagagagacagcgcgagagagtgtgtccccacacacacgcgctggcgtgcgcggagacacccgcgtgagaagagtggcgcgcgagtgcgcggagactccagcacacgcgcgagacagcgagtgagggcggagagctgtgagaactgtggcgccaagagcgccccaagcgcgtgtgagaaagacacgacgagggcggaccgtgcgaggcgaggcagacctgcctcaaagagaaaaaactccccaaaattaatcaagaagagcccccacanggggatgtggagaaacctcacacgccttgctaacctatgtggcgcccctgcatacacacccagggacaccccccaaaaagtgcgggggacacacagcccgcggtcagcgccaacaacacggggaccaggaataccgcatatgacgcgaaaggacacacaacaagaccgcgccgggaggggagcactccctttttcctagacaatatacaagaggcgcggtggtcgaaacaacgaagaattctccccgaagagagaggcgacgccccatgtgcccgggaagacataccgaggaggcgccaccacgggggggccaaaaaaattagaggggaaccccctgctcacgaaaaaaagccacatcacaaatagcagaatggggacgtcacccgggagagaagcgccaccccaatataaacacgtcgcgacaggagaagatacccacgcacttctgcacagcccccacaatggaggggaacaacgagcaaacccgacgacaaacatatctatcccctagaagcaaaagggggggcagctctccatccacgcggcgggggggggggggcaccaacaacatttatacaaagcaggatatatgagggcgcaggcagacacaaacacaacccccccacaaaaagagcctccgcgggggggggcacactaggcggtggcgtncccacaatgtctgcatgcgagcacacctgcgccggaccgccatcaccacagatggtcatcaaacagacactacgccgcgacaacaacagcggcgccatccagcacctcaatagaaaggaagcggatacactccaccctccatgagaaggggggggggcaccaccaacgagacgattacaagcgcagcggatatgcccccacagacctagtcgccagcgggctacccaaaaggggtggggccccccacaaatagtcgagcgaccaacggcatatacatacagagcaaagacgacgtgctgccccagacgacgacataaaaacaccggccaggagcaacgcggcgcaaccaaagcggcccgccgcgggga

SEQ ID NO: 571687 - DNA, 186 bp, Homo sapiens
  misc_feature (14)..(14): n is a, c, g, or t
cccccaaaaaaaantttttttggggtaatgggggccccatttttcccctttgggaaagggggttcccaggcccaaaataaaaaaaaccaaaagtttttgggtttgggttgggattgggaaattttctgtaaagtcctggttttttaacccgggggatttaaaaataaaatttaatgttaaagggga

SEQ ID NO: 571688 - DNA, 842 bp, Homo sapiens
cgcggctgctcgtcggctcgtgcgccaacaacgccttcgccttcggtccggagctcgaggagcctcatcacgccgctcgccatccagacccacaactttgccgccgtggccgccgccgcctactaccgccagtcagcagcagcagcagcaatgcagggccttggctgccccccgtcgcagccgccggcgccgcccagcgcgaccctccccggcggggccgactgtacctccctcgccggcccttcagcttcccagcgtgccagcgccgcctgtccgacgtcggccgtgttcggacgcgccgcccaggccccctggactctgcgtgtcaggaccggcgacaggcgtaccgtagagcggcgtccctgagctccggcaggctcaggcggcttctgatgtctcccagcctcggatccttggccgcagccttgccaattcttcagcctgcctcttccattctccgaggactgaggccaagagggcgccagtgacggatggacgggaaagggcggtcagagaatgtaggaaggacaccccctcgccatctcgaccttgcttggggggccgggagtgggggggggttgacattgggcccctaggcagactgctaagcccacgaccgaagcactttggaactcgaactcatgtgccggggaaaggggcccacaaccccatccataattcgggatccaacaggcataattaataaattaaaataacacaagtataattcattatggacgcacaaaagataacacttatcatgttgaaaaacttataccaaggagcagtgtgtaaacgaatatgacaaaacaacaaacggagcatattagggtggaaaaaat

SEQ ID NO: 571689 - DNA, 296 bp, Homo sapiens
ataatttttacattttggctcccccaactcagggggtacatagaaaaatcccccccttaggggggggggttggcccctatttcccccccccgggtccctttttccataaaattttttttggggggtattcccttttttttttttgttttagaaattgccccccttttcccccccccatgggccccccaaacaattaccctgcccctaatggttaggtcccccctttttttattcttcttcctggccctaggtttggcctatggggggctccaaaaggggttaggttgacccgaata

SEQ ID NO: 571690 - DNA, 416 bp, Homo sapiens
ccgaggtgtcctttgcagagcgccgtgatcactctgctgcacataaggctgtccagcagagctcgactctgaatagactggatagaagcagcttcacgattgtggccaatactggagtgtatgcttcgctatcgcatataccttagacgagtgtctatactatgacagagaagtttgatccgttaactcatatgctgctcttagctaactgccagagcgtattgataggactcagaccctgagagcatttgccacagttgcccacttacttcctctttgaccatgagtgttatgaattcagtgtccattttacgtgtcacacatgcctctacagtggatgctgtcatcatagtctgcgtaagctctgcagatcaggctatcttaacatcggcaatactagtagccatagaggtgcc

SEQ ID NO: 571691 - DNA, 776 bp, Homo sapiens
  misc_feature (569)..(569): n is a, c, g, or t
tcctgggccccaaaaatccttaactggagaatccacttgaaacacttcggtccttaatctggtaaactgattggacaggctgatggctgatctaggtaaaggttccacggtaccaaaaacatcttcctgcctataatactatcaaaacgggtctccgtgaatgtggtggtggtgaattatcatcagggctcctcgtgtcccaatcttctctcagggttctcgatataagcctcctcaaatttgtggtggactctgacggagtgaaaaaactccccattaacgccgtcgcgaccttggttgctccgcgagtggtggactcagtgctccttatcaagtgttagaagctcaaccctcgtggagggcgtgcacgtgaaaaatctccaccaactccgagggccgtgagaaatccaccggctgtggtctcccacacgacagggtctcctcccactctggggtgtttgtgaaaagaacagagaagagccgtggaaactcgcggaaaactctcccgtgcctcgtggtgaagggctcccgaggaaaagccccgaagcacgagccttgtggcccaccangcgtcatgtgggtgggtgttaaagagcttctcaggaaaagccgtgcgcgatgtgggtttagaaaaacgcgtggcgccgtgcgtgcttgatacttccactcagaaaaaacaacctttacagcgtgcttgcagaaaggggcctcttggcgggaagatgggggttgcccaattctccataagttggggcacctacgggcgacaggaactg

SEQ ID NO: 571692 - DNA, 440 bp, Homo sapiens
  misc_feature (194)..(194): n is a, c, g, or t
  misc_feature (204)..(204): n is a, c, g, or t
  misc_feature (208)..(208): n is a, c, g, or t
  misc_feature (210)..(210): n is a, c, g, or t
aattcaatcggtcgtactcatccccttctacagttacatcttgcatcatctactacatcaaactcctctatctatcaccaattctcatgttcctcggtcttcctcatcttctccttcttcgtcctcctcctcttcatccagcaccatccacctcggcatctgagtcacgctgcttcctggtcctctcggtcatngcttctctcntttntnaaactggggcaggagcttgaagacactctctcggtagtcattcaggttggtaacctcacagttaaagaggtccaggcttttcagacattctaactttttcaaaggttccaaggtgctgatatctttcagtttatttccacataagtttagatgtgtgagatttggaagtttttcagctaacatgtccagacctccaaagattctattttcactgagttcaagctttttca

SEQ ID NO: 571693 - DNA, 235 bp, Homo sapiens
ggtgactctagaggacccccagtggtgacgtgtaggcgtgtgtgcacataacacagggtcgcagtctcacacaccacactcctacacagccacatgtgcacataacacagggtcccagtcacacacatgccacactcctacacagccacgtgtgcacattacacagggtcccagtcacacacacaccacactcctacacagccacgtgtacacattacacagggtcccagtcaca

SEQ ID NO: 571694 - DNA, 384 bp, Homo sapiens
ggcaaaaaacaatcatttattggtttattttggctttactaaacacattagtcatttatcatttaaatcccggccttctttaaaaaccgttggaacactttttttccctcctgccataaaaatacagtaagtaatttgcttaaaaaaaacaccccaccccttggaacaggggttctggttttttttcactgaactaaagacatttttcagggatttcagtttgtaaatcagaaaaacagggcaggctacaaatcattgcaggctgaaaactgaaattaaatgatcttccacttaaaagtgctgggctttggaaccgggtttttttttacccttccttttcctaacatttttaccactggacccccctgtttttaaaacctatta

SEQ ID NO: 571695 - DNA, 153 bp, Homo sapiens
cactgtgctgtgacgtgacgggccaggacctaactgctccttctgctgcctggacccttctggacgaccgggctctactgggacgggccccacacgcacgaggtactggggttacggggccaccagacggacactccactactatactgacac

SEQ ID NO: 571696 - DNA, 90 bp, Homo sapiens
  misc_feature (8)..(8): n is a, c, g, or t
  misc_feature (89)..(89): n is a, c, g, or t
ggggttgnttctcttactttcctctgcctgcctcagtttaattattttgtcctacagaaatatcattaaaatatttttttgttaaaaana

SEQ ID NO: 571697 - DNA, 180 bp, Homo sapiens
gacgatacggacccccctgagtgtcaaaagagatctcagagtactctacagtattataactagttattaagattttacactcattcataagattatatatggtggcaaccatttagtccatttaataatgcccccactctgtcacagttgagacaaaagtagaccaacctagtataatcc

SEQ ID NO: 571698 - DNA, 214 bp, Homo sapiens
agcattgggtggccaattgatttgatggtaagggagggatcgttgaactcgtatgttatgtaaaggatgcgtatggatgggagggcgatgaggactaggatcatcgccggtcacgagatatctcgtgaccggcgattattggtaggatcagcgatggatagtaatagggcaaggacgcctcttagtttgttaggggcggatcggagaattgtgt

SEQ ID NO: 571699 - DNA, 367 bp, Homo sapiens
ccccaatggaatcctgtatgaatgattctttttggcacgtgtgtggtttgctatgccaggcagaggagtatactggcattttgcaagtagaagactcacgtttctatacgtgttgacaattagctagtgcaggacaattatcataaatggcaaagcctctctagtagtattataaatgacaggtcactttcatagtctatacaaaattaggaatgcaccccaatgctgttactaaggcctgttaatgcactcaaaacaacaaggacaccgagataactgtttccgattctctatatcaggcaggcgttgaataattatttcttcgatgatgaggatgtttggcctatgaatgcaattcacttagatt

SEQ ID NO: 571700 - DNA, 950 bp, Homo sapiens
  misc_feature (22)..(22): n is a, c, g, or t
  misc_feature (38)..(38): n is a, c, g, or t
  misc_feature (157)..(159): n is a, c, g, or t
  misc_feature (196)..(197): n is a, c, g, or t
  misc_feature (628)..(628): n is a, c, g, or t
gcgctttctcccgggaaccggnctgtgacccaagtggnccggacagtttggggctgcgtgcggctgcctcaagcaaccaggtacgtaggtcggcggccagctcggcgctgcggtgggagccggagggcgaagtcagagccggggtgccagcgggacnnnacgcagatccacttaggaccccgtcgtctgcgaaggnncacgtctgagtcccggggcctcctcgtgctgcagatgtcgccttaggacctcggccaggataccctctgccatgctcttgtgctgcccgtgatcaccgattgcccttgtaatgcaccttcgcagcaggaagcccagagctgcgctgcccctttctgaaggctgtggaagaggttggagtgggcgcatcttagcgttgcgccaatccccatttgagggtctgtcggaggctgcccttcagtgtgagcatccacaatgggtaccccagcctcggtggtcagtgagccacccccttgtagggccccgattgaggccgtggccggaaagcaggcctcgggcaagatcttccaggagcgcgagctgctggggatccaaggcctgtttcaacgcaggggggaaccagctggccgaggaagggggcacagatcatctnggaatgtgcatggggaccaccgtgtgctgaggcgctcaagaggcttgcgcagaaggaggccccaaagagaaagccttggcatcggtaacaagttgagcgctagaatctggagcccagttctgagttggcagccaaggagtgcacggagaagctccgtggaagttttggctctaggagaaaaaggcgggtcgcgaatggggagtgggccaaagactcaccgtagctggtctgagagcgaggggttcttcaagctggggcgaggagaataggccaggggataagacgcgggccaaaaagttgtgctaggcaccggggaggggca

SEQ ID NO: 571701 - DNA, 399 bp, Homo sapiens
  misc_feature (38)..(38): n is a, c, g, or t
  misc_feature (42)..(42): n is a, c, g, or t
  misc_feature (386)..(386): n is a, c, g, or t
  misc_feature (388)..(388): n is a, c, g, or t
  misc_feature (392)..(392): n is a, c, g, or t
caggaaaatccctttaacccgggaggtggaggtttcantganctgagatcacgcccatttcactccaacccgggcaacgaacgaaactgtctcaaaaaaaaaaaaaaagtggggggaggctgggcacggtggctcactcctgtaatcgcagcactttgggaggccgaggagggcggatcacgaggtcaggagatcgagaccatcctggctaacacagtgaaaccccgtctctactaaaaacatacaaaattagccggacgtggtggtgggtgcctgtagtcccagctacttgggaagctgaggcaggagaatggtgtgaacccgggaggcagaggttgcagtgagccgagatagtggcactgcactccagcctggttgacaaaggnangaantgtctca

SEQ ID NO: 571702 - DNA, 919 bp, Homo sapiens
ggcacttttctaccctctgagcttggttcttaataagcataatgtgagggtgaatatgtagtatctcctaattatgagcactgcatgagaattaaaaaactcatgtaagtaaaatagttgaaaaatcagtatgttctctgtttttaaaatgtcaaagtttatgtcagggttaatttagttataacaaagtgatcataatggtgaaatttaataaatatactctagtatgatcagcctatgtgagactacattttgattttttgtgtggcatgcagatgtcatgaactatagtgcagcttttagtgtgttctaattttaattggtttatatcctggaaaaccaagggtggaaaaggttaatttcattggaggggtggcttttccaatggctgtgagatagagcttaaaggaatatctgtgaatatatggagacatcttcatttatatctttcttatataaaatatatgtgggtttaattggtgtgaagagttggggtctctttaaattcagattgggtcttaggacagtaaaacccaggttgagttgacccaaaaaaaagaaaaaaaaaaaaaacagagaacgaagaggttgtgttggggccagacgtggcacacctcgagaaaagcgcttacaaacacccgatcggagtggagaccgcgagggcgcacaaagagggaaaagcacaccggtgcgccaacacgacggtggccccagagagggaaacaccgggggcagagaacaacagcagggcagggagaaaactacaacagaattaacaaaacggccggggggtgaaacacaggagacgcagttctgacacaaaaactcacaagaagtagagtatccaagaggcaaaaacagcggggcaccaaaaaaaacaggagacgacgagaggaagaccaacaaacagaaaaacgcg

SEQ ID NO: 571703 - DNA, 768 bp, Homo sapiens
  misc_feature (411)..(411): n is a, c, g, or t
  misc_feature (697)..(697): n is a, c, g, or t
gctcacacctgccattttatcactagaggctgttattacaggtgtatgacgagggagcttacatggagatagcgctgtccagcacagggaaaccccatttctactactgagaattagccaggcaggatggcgcgttcctgtaatcctagctactcaggacgttgatccagtagaatatgatagatcccagtagcctgagactgtagtgagcggagatcgcgccattgcactactgcctttgcgcgtgagataaactatgaaccagaattaaagcttagcaagaggctatgcaccctgtatataaatccatttcttatgacgcacatgttaattacagtgggaaagctattcacgcacaaagcatgtgtgacttagagagatagctatgtatgctcgattagtagaatacantcacctcctgcttggagacgtatgtgcatggaaacttcgaaagctcgtctatcaagacatgttgactttttagttgaccctgaagaccttgttgcagggtctggtccagttaaccatatgcctatgattattggacttgatgtccattcgcgttggctcatggctcttaatcccaataattttgggaggcctatgttgtcccattattacggtcagtatattgaaacttatctctgcaacacatttatacccctacttttgcaattcccaataatctaacttgtanctatttattggtttctagttttccaacgtctcatgttggtgtctcctcgtgggtcaccttgttcttggtcg

SEQ ID NO: 571704 - DNA, 377 bp, Homo sapiens
tgcttacctgtgcagttatatgacatggaaataattgcaagcaagcacactttcttggcttggaaagcaagcatataaccccaagcagtttccgggaaaaggcaaggctttgttcccaggtgaatccagtggctaaccctggttagaaactgctgcaagcacagcaagcaatccgaggcaagcaagctgactcaaagacaccagccaacagccttacattgtgcaaaacatactgttgctatgatgtaactgcatttgacctaaccactgcgaaaattcattccgctgtaatgttaacacaatatttaaagcagacacacgtccagttcaggcatttccttctgctataaggtatcccagcacgtgtaatgtcttaa

SEQ ID NO: 571705 - DNA, 129 bp, Homo sapiens
acaaccatgaagcagatcctgatcattggcgcgggttttgccggcctgtggagcgcgctcagcgccatccgtcagcttgacctcaacggcagcaaggatgtcgaggtcaccctgcttgcgcctcaggcc

SEQ ID NO: 571706 - DNA, 467 bp, Homo sapiens
  misc_feature (283)..(284): n is a, c, g, or t
  misc_feature (307)..(310): n is a, c, g, or t
gatggcttctagctagcccagtctgtgaatgtggaagcttcatccccctatagctcttccttgctgatacttgtttccttctgcttgtgccagcaatagccctagaattgcacaaatccaaccatccaagggctaaccagcaggtaagacagtcacccagatgcacatggtcacaggaggcagtactgtggggtgagcaaaaacagtaccagaggagactcaaatgcccggggtctcgctgccaaccacttgagcttgggcaagttgctaatcattcctttcnntttttttttttttgttttttttnnnnttttggattttaagaaaaatttttccccctttggcccccaaaatattgtgagagatgatgaccgcagcctcgcatccttggggtgaagggagaaaatggatgtgactgtgttattaactgtgtggatctgtacaaatgaaagggatcaatattaaaa

SEQ ID NO: 571707 - DNA, 1482 bp, Homo sapiens
cgccacgctggtgcgccaccagcgcacacacacgggctgagaagccgtactgcatgtggctgactgtgtgactgctgcttcagctgagagttccactgctgctgcgccatctgtgcgcagccatcagtggctgatgcgtgccacatgctgtgctgccacttgctggcaagggtttcgggcagcgctcctgacctggtgtgtgcaccagcgcatccacacgggctgagaagcccttcgctgtgcccctgatgtgctggcctgctctgcgttcatggtgacctgctctgtgaccatcaccaatgcacctgtgctgcactgcacactggtgcgatgaatgcccataccggctgctgaacttgtgcgtgcaatgctggttcacagtgctgttgtccaagtctcaatctgttgcactcgagcgcaaccaatgcctggccacaatgccacaacaaattgcccctgatgttgcatgcaatggcccttcagctggtcagccatccaatgctatgcactttgcaacctggcaatgactgcaccttgtggctgaactgggccaaggcgggagtagcggcagaggtgctggcacaggttgcttcagaccaacatgccgctcagcttggtcacaagacattcaagctgggtgccccaagcaatcagctggctgcccctgacacccggggatcgcactggcacaggatttggccgaatacccatgttccctggcaatgatttgtgcaacattggaccatccaggtcttattcgagggtggtgtgccaggtgcttagacaccatgtggaaagatggccggaggagggagtatacataactttaggatagatacacttaaaggatttacgaggtgggaatgggcttattggcagttggaggggggctattcttccttaaaaaggggtgtaggggtattggtggcaaaatggcaagccttattaataagtaaatcagcgaggtgtggaaacgagactgtagatgtgagacaaagattccgatacgcatttgtgacaggaattttagtgggggaaaacgaagggaagcggacatgggttgggggcccttcgcattaccacattattccccaaggtattacaatgagatgggggcacaagcacccccatttacacggattatggaccgatctcatggtcaccatatgggacactacttataacggaccgattaactaaccccacgtgtgattatgaggcaccccactattactagtccaatagtgctgtgatccctctcggatcaaataagcaatcggggataatacgataaatcagctacagggcggcaacagggattgctccaggcgcaagccaacagggggaaaaccccgctttaataaacatctcctcgtgtggtgtagtgcaaagatagaagcacagtggttgtttcggagctagctttccccccatgatagtagagaacaggagagtgaccacgtcaggagagaagtagaagac

SEQ ID NO: 571708 - DNA, 174 bp, Homo sapiens
ggtctgtggaaaaatactacatcccctgtataactgcagtgttcgccggtcacctccgcattatgtaaaagagatgcatcatatcccagaaatgacttggctttccttgcataaataacctctgatagtgctggttgtatgaataaaggagaacttctaagcaaattcatagtt

SEQ ID NO: 571709 - DNA, 709 bp, Homo sapiens
cggtcttgttttcgcccatatgccttttcgtggggagtgcgctgctccggacgttgttactctaatcttcgcccccgtcttttggcggcaacccgcccacgtttttcgcatgtggctcctcctgggagacccctcgagacccttctttttctctgtctcctctgcgcgctcaccaccacccactcagctccaacaggtgggctgcagcgatctaccatcctcgcacacactccgtttgctgagcccgtcgccattgccgcaccagccccctcccctaggggcgccccactttggcccaaaagcgatgccatgccgccccacctctgcgtgtgccccttagtccaacgtgttgtaccctagtcgtgtgtgtgctgtcttctaggggggtttgggggtgggtatctggggcattgggccctctttctcccccagtggaggaaaggtgtcgcccgtgtacttcgccccgttaaacttgaaaaacatatatatcataatatatttggagagtccactaatttcccaatgggcgggaggccattaagcccccgaccctgggtccctaggccccgcctggcactcagaccttgcccgagattggctcccagaatattttgcccggcttaccaggacccaccccctgtcctagaggccctttttaaggaacccggggctggatagcctttcatccccactattctctgtggtatga

SEQ ID NO: 571710 - DNA, 768 bp, Homo sapiens
  misc_feature (14)..(14): n is a, c, g, or t
  misc_feature (82)..(82): n is a, c, g, or t
  misc_feature (87)..(88): n is a, c, g, or t
  misc_feature (92)..(93): n is a, c, g, or t
  misc_feature (98)..(98): n is a, c, g, or t
  misc_feature (100)..(100): n is a, c, g, or t
  misc_feature (102)..(102): n is a, c, g, or t
  misc_feature (144)..(144): n is a, c, g, or t
  misc_feature (174)..(175): n is a, c, g, or t
  misc_feature (182)..(182): n is a, c, g, or t
  misc_feature (187)..(187): n is a, c, g, or t
  misc_feature (191)..(191): n is a, c, g, or t
  misc_feature (194)..(194): n is a, c, g, or t
  misc_feature (196)..(196): n is a, c, g, or t
  misc_feature (239)..(239): n is a, c, g, or t
  misc_feature (247)..(247): n is a, c, g, or t
  misc_feature (325)..(325): n is a, c, g, or t
  misc_feature (558)..(558): n is a, c, g, or t
  misc_feature (569)..(569): n is a, c, g, or t
  misc_feature (620)..(620): n is a, c, g, or t
  misc_feature (667)..(667): n is a, c, g, or t
  misc_feature (681)..(681): n is a, c, g, or t
  misc_feature (686)..(687): n is a, c, g, or t
  misc_feature (700)..(700): n is a, c, g, or t
  misc_feature (758)..(758): n is a, c, g, or t
ttttttgttctctntttcttttttgtttacctttttttgttgttcttctcttcaaagattcgagaattgcgtacaaaaaaanccttnntttnnttaancntnaatacatttacaggcgtaaatgcaaaccgcttccaactcaangcaagttacagccctcggtgttctggccanngacctcngctcngccnggnanctgggtcctccggcttgggctttccccccctgcccgccccgcnaggcgaancggctggttcttgccggcctctccgccgcccctccccggcccctcagccctgccccgttggtcccctgcccccgctcnggggctcgctggccacccacgccctcggccaccgccccagacctctcgtcttccgcaggcgcgtgtgctgtgcctctcgccccgcccggcccccgccgcccgtcctcccggttgggctcttgctctgtcccgggtgttaccccctccccgggggggcgggttggcctctccgtgctgggtcgggctgcggcgacacgttctcgcgggtgcgcggtgctgttgctcagatacangctttcaaggnacaatttctatttcgaaggcttattccagtttcgtgaggctagcatgaggngtgtgcatttgccaggggcaaatttctattctcaattaacccatgcngcaaatgctacgcntctgnngggtccgtttagnagcatttgcggtgggcgatggaggggcccgactcgtcgtactcctgcttgctaatccncatctgctgg

SEQ ID NO: 571711 - DNA, 1399 bp, Homo sapiens
  misc_feature (638)..(638): n is a, c, g, or t
accgtggcgtggttgtgtctatgtcatgtgcatactattataatcggccaagctgcgctccctcttacctttcaataagtgagggtgtgcatcattcgctcggtatgtgtgattgcaccattgcttgtggtcggtgcagcacagcgtcccgcttgttgggcgcgccggagacttagttacgtggcgaggatgttgtgttgtattttgctgatacaatgttggtcccacctctcgtgggagaggtcttctcctgccctcgtccttgtctcctctgcgcggtacaccttgcctcttggggcccctctggcctgtgtttcccttttgccagtagacccccattagcccaccgttgggccttttgtgctttaaataggggcaccacacaccgtcctcccggttatatgtgatttaaggccccatgtgggccaccacgtgttccacacgcccaaagttttagtgtgaaagctccactttgagaagcccacgaatgtgccccgtggtacttagtaccggcgcccacgggtttatagggagagtccctgtaataggatttctcggtcttgtcgttgataaatacccctaggtaaggatagatgtcggtagagggagaccatattatataggaaagctgggctagnccccccctaaattttatggagtgagggaacggagttatggaaaggattcgtccaacacagggagagttcttcccacgcccgctatatgtttgcgggaaaatagttatgcccttgttgtaacctgggtctttctggtataaatagctatactttcttcgctgtgaaagaagagtgttctaaactttcacgggttttttcaccctcgcctcgggttggggagagagagaggcttcttacacgtggctgccactggagttgggcccacgctaggagaaaaagccccaccacggagcgcgtgggctttccttcactgccacatttggtgggtgagcctggagtgatgttgtcccaccctctgtcacgagaaagagaagatggagaaaccacgaataggaaagaggaagttctccccggagaaagattgaattgccaagaaaacccaaccccgagtccgcgaggtgaaacgcgagccacactggggaatgctcgtccaccacgctggagaaatgaaaattctcggagaaacacacatgtgaaggaaggaggcctgagaaatccacaggtctgaaaaccgcggcacaccacactggaaggggaccacctggaagggctggaagactacccacattgtaaacaccctgccatgtttaagaagggggccccgaccctcctccccagggaaagatgtttttgtaaataaaggtatatttttcacttttggaggattctttttgtataaccttccaataaagattgtaacc

SEQ ID NO: 571712 - DNA, 116 bp, Homo sapiens
cgggctgccgtcgccgtctgtaccagcagtctcagttctccagtatattccaaataaatatatggcccccgatgagtcctgtgaaggcactgatgcacacggtcaggtgccgggca

SEQ ID NO: 571713 - DNA, 1783 bp, Homo sapiens
  misc_feature (1495)..(1495): n is a, c, g, or t
gggctgcgtcgggctgcaggagaagatggcggtctccacaggacgttaaagttcctcgtaattttcgcttgttggaagaacttgacacgaacggacaacaaacggacgtacggcgaccggtaccagttacgctggtggccttgaacgactgaactgacacgactactgaccaccttaccaacggtgggaccagtgcactgaacttactgggggaccaaccaaaggggaccaacacttacgtgacacaaccacgacagtactattacggccgtgacaaagggtacgaaaacgtgctgggacacgtaaaaatataccgcgcagacacgggctcgcttcccggtacaggtctacgactttgggtacagcacaaacacactgtacacatatgtgacacgcggacactacaccttacactttcccaccgtggggaatggggtgggaattgccccgggaagctattaccaaggttgatttagccacaaagtggggcaaaaagtgtcagtaatcagccattttaacaggtgtggtacatttcaaaggaaggcttaaggaacggtactacatggatggttccaaaggaaaacattcttggcacaggcctttcccaacaaggatgcaacaccgaagaaacaggggaccaaataactaatacacacaacccaaactctccacaactcgtgtcaacgggtggggcagttccgtcaaacacagcagttggggcccttttaaaagagtcacaacaaaaagacgttatcattaacctacacatgtgtgtcaacgtcggtcattcgggacgttcaaacttactttcaccgcaaacgtggcagaaactcattaccacaccattttacagggttacaccaaagggaaatgttcccaaggacttgggggtaaacacaacattgtaacgcgtgatggcaccaattttgtgtgatacggaacattaatatctttcacgttcacttacttgggttagacgcacgcccagtttaattgggtttgtccagagggaacaacaggggaggggacgaacattggcaggcaaaaagatagtgtgtatcttgcattggagaagggggcgctggtgtctcttgaacaacagttaaaccagtgtggagagatatcgggagcagctagaacatgccacgggggttaccaaacagacgtacaacgccgtgtgtggagcgaccacgcgtcacaacggagaccggcgaacgcaggcggcgtgtccccccaaggaaaacagcccaccacacaccacaggcgagcgcggctcaccccactatgacgtagccgagccgcgacggacacagtgacacaacacgagcacgcaagcagctagcggagacagcatacagccagcgcgcgacgcaccacaccaaacagccaggcgcactgccgacaacacaggagagacgaaaccgcaatgtatgaaagacgatagatacaagtatttaggtggttgtctcttcgtagtgcttctctgtttcatcgntcgcacgcgtacgacaggtgcaagattgacgcggaaggatagagatcaactaggcgacaagtagcgtatacgtcgcaaggagataggaaatgacagaaaggtaggacgaagatcagcgtgaaagaatgcacatacagcatcgaacaatccgaaaatggccagagtagaaaacggatcgaaacaggtcagagaatcaagcagatcggatactgaagatcgtactgaccataagcgaagacgaagatgcagacgattggagaaagagacgaaagtgtaaagagcgagccg

SEQ ID NO: 571714 - DNA, 104 bp, Homo sapiens
ttttttcttgtttttataaaaggttaaaattacgattttatgggtaacaaggggggaccccaccaaggcagggtcagggacccccaaggaggggcggagggggg

SEQ ID NO: 571715 - DNA, 441 bp, Homo sapiens
  misc_feature (37)..(37): n is a, c, g, or t
  misc_feature (82)..(82): n is a, c, g, or t
  misc_feature (395)..(395): n is a, c, g, or t
tgccttttaatgtgccataagaaatatcctatgaatnccctagtaaacaagggaagggagctggatgattgggagggaaaantccctgttcacccatcaccttgttttgtacagtttccctttttgtacccaagtatttgtattaccctaactttaaaaatgctctgataggctgggtgcagtggttcatgcctgaaatcccagcactttgggaggccaaggcgggtggatcacttgaggtcaggagtttgagaccagcctggccaccaaggtgaagccccatctttactaaaaatacaaaaattagctaggcatgtaatctcagctacttgggaggctgaggaaggagaatcgcttgaacctgggaggcggaggttgcagtgagctgagaattngccactgcactccagcctgggtgacagaggaagactttgtctcaaa

SEQ ID NO: 571716 - DNA, 1123 bp, Homo sapiens
gggctgcgtcgggctgcaggagaagatggcggtctccacaggacgttaaagttcctcgtaattttcgcttgttggaagaacttgacacgaacggacaacaaacggacgtacggcgaccggtaccagttacgctggtggccttggagcatgatgcaagatatgcacacttacaaggtggcacagcacatgcatcatggggccacccaagggacaaattatgaacaaccagaatatatagcctgaaaggtacgaactgtggaccctaaattacccagaagctcctccgttcagtaacgatttgtacccacacaattaactatgaaccgggaatacactcattccagtgggatggtggatgcccggagcataccagttgtcagcacaaatgggcaacattcatatagcattacacagtcggtacttcaagcagctaaagacgtctaatgatgtccaacgaacacatatgaaggcttccacgagcccaccagacggaccaccacatacaagaataaacttacaggggcatctcaaaccttgtctttaacatcaccaaccttctactcagtgtcaatggtcttgcgtaacataatacacaatggcaacataccacattaccgtacacgcaattccagctggtaaaacattgacctggcccattgcgtaagcactatctccatatatgtaccccccatacggtcccagggcaacccgggcgcgacacaactggcaggcccgaattagatgcactcctggcaagcgcactgtgccatttacagcaataaacctgtggggtcgctgcacagagcacttacggcttacacgaatcaacgggtgtgtcgcactgtgtcaatggcatgtcacccgtggtgttgcataaacagggaaaaacttcggaaacacgcgaaggggggttagcccacataaaaatggaacaggaccgtgggagaacatggtgacacgcagcgggcagacactgcggaccgggtgtatgaacaccacggggtggaccacgaaagaaaacagtagcacgagcgccagtaaaacaagacggggcacgcgcacgacgcgatgtgagatcacgcaagcgagcgcgaccgggacaacgacgcggcgaccacaccaa

SEQ ID NO: 571717 - DNA, 1242 bp, Homo sapiens
  misc_feature (365)..(365): n is a, c, g, or t
  misc_feature (382)..(382): n is a, c, g, or t
agcttagtgacgtcttgctctatacaaatcttcttactattggaacccaactcgtaagtattcatacctcgtggaaagcttgcatgacgataatgagcaatacaggcatggatggtcagaagaccgacgagttgtattgctggcatctccatttgtgctgtgtttggagtgtagagcgcatgcataatttccttgaggctgttgttgatcgagtggtctcgacccatgtactcacgtattcttgtgaaaacacacaaagggcatacagtacatgggtaccatctgattgctatataccatccttatatgagagaaattgcgataggacagctagagacaaccagagagggtaaccgctcgagganagccatgctattcgttnaactcgatgtaaactcggacacagcacgtttctaccctacactcgcagcgtatcgtctccttccatttgtgagacgctactctctgtgttggctcaccccttcacataggagaggcatgtaccctgtttgagcgcacgctagttgatggacttcattggcgccaattggaaactagtaaattgaccttgggatacgtcccttatttcacatgtgtacataggccaaggagcattgtcctggcgagagaacttgtcgggtttcaagcatggctcttagacccgggttggagcgcttgttctagtaaacctccacaagaggggcaatcgaaacgctgtatagacgtcatttgcctttataatcccttgtgcgaccgtacatcgcgctaatttgggcacgagggcagctcgaatcttgctttgtatctaggaaagtttcaacttgaactcgccaattgagcacgaggggcttgaaaacgccaccagtctgggggccacttggcaagaggctctaaatggggtctctagaatccataaagattgtgccacgccgcacacctattgaaggcttttcctttcgctgagtcgtgacgattaacaaacttcacagatttaggacatgacacgagagggacccttctttggaagacttgggacctttaatattggtgaaagttaccccgttgttatggcccctattttaaccctcgaacttctctctgggcattaaggtgtaacgcggtcgacttaagtggataaaccaattcccaagagagggatgggcctcgccagatggcgaacattcctatattggaacacttttacttataccaacaggtccatacacaaacaaaaccgggtaa

SEQ ID NO: 571718 - DNA, 333 bp, Homo sapiens
  misc_feature (320)..(320): n is a, c, g, or t
gtatgcacaaccttagggtcagttttgcaggtggtaagccatttaccaagatagttgtaggtaaagaagggcagatttattagagaaatagtgaaaatatgttgcacgtgggcagctcagcagagaaggggctacctgcaaagaggcaagggctggaggaaagttttatagggtcctgctgaagggtgctacgtgtggaatgaggtcattgtgcccgcaggttgtttgtgattagctgtctctaacaattgttcatacaataattgttcattattgttctcaacttggggctctccccaacctggggacccttccttatngttgctacccaca

SEQ ID NO: 571719 - DNA, 347 bp, Homo sapiens
gtccttcacacaggggttaatagtggtcagctctccaagcactaaagatttgtataatggggccgggcgcggtggctcacacctgtaattccagcactttgggaggccgaggcaggcggatcacctgaggtcgggagtttgagaccagcctgaccgacatggtgaaaccctgtccctaccaaaaatgcaaagaaaaattagctgggcgtggtggcgcgcggctgtagtcccagctactcaggagttcgggaccagcctggccaacatggtgaaacccgtctctactaaaataacaaattagtggtgtgtgggccctgtatcccagtaccaggaggtaagagggatca

SEQ ID NO: 571720 - DNA, 280 bp, Homo sapiens
tgggcccggccctctggcgctaccatggggtttggcaagagcaaccgggatccctacgcgacctccgtgggccacctaatagaaaaggctacatttgctggagttcagactgaggattggggcccgttcatgcacatctgtgacataattaacactacccaggatgggccaaaagatgcagcgaaagctttgaagaaaaggatggccaaaaactacaatcatacagaaaagcaacttaccttgccacttattgacatgtgtgtgcagaactggggcacaa

SEQ ID NO: 571721 - DNA, 1494 bp, Homo sapiens
  misc_feature (214)..(214): n is a, c, g, or t
  misc_feature (224)..(224): n is a, c, g, or t
  misc_feature (234)..(234): n is a, c, g, or t
  misc_feature (239)..(239): n is a, c, g, or t
  misc_feature (267)..(267): n is a, c, g, or t
  misc_feature (280)..(280): n is a, c, g, or t
  misc_feature (416)..(416): n is a, c, g, or t
  misc_feature (419)..(419): n is a, c, g, or t
  misc_feature (443)..(443): n is a, c, g, or t
  misc_feature (525)..(525): n is a, c, g, or t
gggaggcttggggtcgttatctgcagacgcggatacttcggtgtgttcggacggtgctatggaccggtggctgggtacttgcacttcataccaggccctatcctgcgcattgtgcatagctcaagcccatacgccgggaggggaaagaaggacacatacgtctgcaaccggggaaggccgcagtgtgatctttgacgcgagtcctcgtgacggnactcccatcnatgacactgntgtcnctatgtctaccatgtgtcctacgttccnatgacacaccaancacaaaacagacaaaaacgtaccctacgacaaaaagagtagatcctataaaccagaggaagggaaagatgcatattgcactctagggtgcaccagtgcagagtccgaagaatgagcgcagaacgtggacagagtgnaanctatagaggtatgggtcaaacganatgggacaaaaacggagagatgcgaaggggcaccccatacgcttcactacgcctgcatgcgtagagggaatagcagtgggcnctccatgtgcagtcaacgaagaccacgtggaggaaaaagggctatagccacaagacggcaccgctcaccgcaagggggaccctgagcggcagcggcactcagatgagttagtgctccttgcactagcggtggtgattctctctgaatgagacagtgagcggcagaccaggtgggggcccagggtgtcactcgcaagggcgctgggcgggagacagcccactcagtgcaaatatcgagggaagtcagtacatcacacagagtggcgaggaatatccgccatttcagttgaaggttcgcacttgccctggggagtcctcacggggaaatttttcgctggacatatggctgcgtggcccacttgcaaccaacaaacgaccatttaatggggcacctttgggcactttcggggcatacctactggggcgacgtttggagaattcaaattgagggcgtagagggtttcccacaattgattagggtgaagggccaaccccagggtggaacggcccacattcgagtatcgtgggatgtctccaaatttcgcactcccaggggaagacccccggaaaggggttcggccccacgacacggggtcaatacccctcctacaagcatcgccacaccacacaggccacggcctaacaccacggacgggggcacccgcaaacacaactaggttgctctcgccaggggttgttgattgacccgacacagcgaggacaagcaactaccccaggccggtagaaaggcaaaatacagccgcgaggacacaccacaaccaacgggcgagacacacaaacgaggtggttacccacgagggacgcacggcgtcaacgcccagtaacaatggtgtgcaccacttgccaaaaagccgaggaatacacaagagcagggggtgagagccaacacccactaacgcggtcacacagacagggaaccccagcgccacgaccctctaccagaacgcca

SEQ ID NO: 571722 - DNA, 135 bp, Homo sapiens
agaagcgaagggagtggcattcacaggactactttatattaaacgtttattacatttgtgaaaatctactgtacaggggaaaaaaccattgtgatataagtatgagtttttggcacacagcacaaagactattac

SEQ ID NO: 571723 - DNA, 216 bp, Homo sapiens
cgatccggctgtttctgtacctcacttccgttttcggtacatcactttcctctttccattcataaatcttttccacgacatggctgtgctggagtctctgaacctactctggctcgggaggctgcccaatttgcaaatcattctttgctcaattaatccattaaatggcatggtggctcacggctggtaatccgatgcacgttgtgagaggcccga

SEQ ID NO: 571724 - DNA, 765 bp, Homo sapiens
agcggaatgcctaacaaagcagaacgactcacgctgggtcccagagctggccagtggaagcactgagacctccacatactgaaggcatggactattgaccgctgttggtattggtctcatcattgactatcattaagtgttggctgtttgcatgcttcctgcccagtggcaggttcaaagaagcccgcaggaagcgtgctcctttctttcccagggcccgcaattgggctggaagatagagcaacaaaaagcgcccatgtaactcatgggaacattcatgtgtgctgaatggcaggtgaaggtgccacagagaggctgaggatttcagagggcaccatgaactggagtgaggtcgcagagcaggaacccaagaccttcacttggttggtgtgagcactccaggaggcaggcaccctccctcagccctcaagcaagcaaaaatgggtttaacaacaaagaaggagaagaagcagcagcagcagccgccacagagcttgtgacagctacagcctaagggcaacaggcaggggagaccaaggaccagaaagagcagaggctttttcaaagaaagagatccctctcccagcacccagcgatggcggcaaaccccaccacagtgcctgctaagaacaagtcccacgtgagaacaacatgggcccccgagatgccacaggggaccccgagatgctgcagtgcttggtctcccgctggcagtgcccactggctcaggcccagtactcaccctggtcacactgggagaggagg

SEQ ID NO: 571725 - DNA, 170 bp, Homo sapiens
  misc_feature (106)..(106): n is a, c, g, or t
cctttcaaaggaacggtatatttctatattggaaaagagtaagatgaaatctaaatatttgaacttgctaactaatcatcacaatcgtcaatcggcccaggctcangaaaaacataggacctaagcctcgaacacgcatctctaaatggaattggaagacactccaagac

SEQ ID NO: 571726 - DNA, 1222 bp, Homo sapiens
gtcgtagtctatcatcgtatcacttactgatgtctgaagggcgttcgcgtatatgttgaccgagcgaaatgttctgacggctatagtacaacatatgcaaacgagcctgcaactgtagtacggcgccctatcggacgtaatacatagtccttatacagactagaactgccataaactacatactatcatcagatagtatgctcacttatgattcgggccattagtctactcaatcggactctctatgaatcagccgccactcgcacactttaggcgtgctccacctactctgccatcatttcatactactagacaccccacccatgcactagtgatcccgaacgcgacgcttgtgtacagactccttctaaaccattacggggcccttcagtcattctagaggtgcctaggcacgacccctttcttagttcccgttagccacgggacgtgagcgccctctttcccttcttgcactgcatgcggttcgccatcgattccctatacctcccgctagcgtcccacaccgccttgtacttccggggcaggctacctttgtcgctaggtccctgctcatctcctccacaaacaatccccctctagttaaatgggagacgcctccacacaccagttaaacactgacgtccatttaccttaacagtgactctgcatcaccactgcggagtttacccctcacatgtcagtgccccactgggtgtcctatgctgcattttctcccccaacaagctgtctacattgccatgccacatctgaccttgaccaaaagggaaccggcccgctggggtccacactttgcccattgacaccaagtgcggacttgtaccccgcttaatcgagccccctggtctaccgcattagccactcctaggagtcgttatccctaaccctcgtaacgccaaaataagacatcgcgaaccttgtaccccaccccacgcaatcgcaaccgcaaaagcacgcgctagagcacaaacgaaaaaccccagagccaacaaacgcacgcccacgggcagctcaccggcccccccggccaaaccacccccaacccaccctcccggcgcgcacccgccccccgcaacgtgcgaaacgaacccgcgccaaacaagcccccacgacaccatccaccaaccccagcccctacacggcgcccgcacacgaacagaccccccaaccatccccccctaccctcccgccaccccccccccgc

SEQ ID NO: 571727 - DNA, 874 bp, Homo sapiens
  misc_feature (874)..(874): n is a, c, g, or t
gtatcaacgcagagtggccattatgccaggcgcggtggctcacgcctgtaatcccagctctcagggaggctaagaggcgggaggatagcttgagcccaggagttcgagacctgcctgggcaataatagcgagaccccgttctccagaacacaaggaaacaaaaaaaaaaaaaaacaaaacaaaaaaaaactgtggtgtgggccggcacgctagccaccggaagaaagtttttaataacaacaatatctcgttggtgggcaccacgggcccacacaaagggtacaaggtgcaaacatgggcaccaaaagggtgtgtccccaagaggaaaaccgcggggccacacgacacataggtgtgcggggattctccccacactatataaaacacagcgccgccggggtaacaaccgagagcgtctccggataaaaacatcttccaagagggcggagttacgaaggggccacacacgcgggggctttatcacgacggggcgcccagaggaagaaacacgaatatactaacaattaaagaccgggcgcgtggggaccaagatggaacaccatacacacaagacacagaaaggaaacacagacgcagcaccaacagccaccaaaagccacaccaacaggggaaaccattcggagaacaacagcaagaacaacgagcgcgaaacaccaaccacaacatgacaacaacatagaaccaacgacgaagaaaagcacaaccagcgagagagagaaaccaaacagccacaacacacacatcacaaaacaaaaatccaaccgcgagaagcaccgacacccgaagagagaagagacaccacgcaagaaccgcaacaaaccaccgacacaccacacgaaaaggaaacaaaacn

SEQ ID NO: 571728 - DNA, 153 bp, Homo sapiens
cgagctcggtaccggaaagcacactgcaacagagtgagactctgtactcaaaaaaagttacagcaagacttttctttttgagacagggtctggctctgttgcccagtctggagtgtggtggcatgatcatagctccttgcacctttaacctcc

SEQ ID NO: 571729 - DNA, 316 bp, Homo sapiens
tggggggggtttgttttttggtttttggtttttttgaatccaaaaattttccccggggtttggggcccggtaggggggaaaaaaaaaattggcccggcccctgggcaatttttcagggggttccccccaggggccttttcaaaaaattacatgggggggcctttccgggggggggggctgggcccctttttggttttctttggggcccaaaaagggcccccctggggggctttgtccccttggccccctggggccccctttttttttttaaaggcccgcccttcccctccttataaaaaggccccgggttttggga

SEQ ID NO: 571730 - DNA, 231 bp, Homo sapiens
cgtctagaggtcccatcagtgacacaagcatatcttaatgtattttagatttagattaattgataataaatgtaaatattttttctttaaaaacatcgagaccatccggctaacaaggtgaaagcccatctctgctaaaaatacgaaaaattagccgggtgtggtggtgaatgcgtgtagtctcagctactccggaggctgaggcaggagaatggcgtgaacccgggaggt

SEQ ID NO: 571731 - DNA, 547 bp, Homo sapiens
  misc_feature (204)..(204): n is a, c, g, or t
  misc_feature (244)..(244): n is a, c, g, or t
ggaaactatacagtacacatacgccgacatggaacaacatgggctggtccatggataagcgaggtcgagccagaccatatcgacgaccacgatccgcctggtgcgccacaacgaattcgtgatgggcggatcattgatgctcgggcgcatctttctcgatgtggtttcggccaaccgctctcagttcctgttcctggctcgcgnacagtacggcggctgcctggccgtgcgccaagccatcgcngccctgcgcgatgacatcactcgcgacctggccgccgacctgacactgatgcccaaacttcagcacttggatgccgaaggtttgcacgtgatggccgacctgatcgtcaagagtgtgttcgccaccctgcccgatatcatcgacccaccggcccacgccttgccggcccaccttacgccccaggcgaaaatcacccagcagctgcgctttatctttatcggccttaaacattggcaagggctgggcagtaccgagtaagtcaatcaacccgccgtgtggaaccgttgggcggtggactcaggt

SEQ ID NO: 571732 - DNA, 208 bp, Homo sapiens
gggtttttcccgccccaaaaccaaaacccctttcccctcttggggggacccccaaactcccttaagggggggggggccttgtccgggggttttttccccccctttttaaaacccctgggcccccccggggggggccatttttcttttccttttccttttgccaggggggttttttaaaaattttccctccccccccctcccctttgga

SEQ ID NO: 571733 - DNA, 227 bp, Homo sapiens
agtctccactccacctctccttttgagtctccttctccttcccatttctctacactaagtgggtatgttccctcttgtccctttccctacctttatatttgggtgtcctttttatacaggaaaaacaaaacaaagaaataatggtttttttttttttttttttttttttttttttttttttttttttttttttttttttttttttttttttttttttttgttttttg

SEQ ID NO: 571734 - DNA, 275 bp, Homo sapiens
ctctttctatcatatccgataataattaagtcaacaatggatggatgattaaggattggatggggactggattattttaggaaaccacagaagtcgtgactggctaggacttggtgattttgatttaagaccatgtcatgaaacaaaagtacacattgttcataagaagcatacaaaaaatatatgatgggtggtagcctaatttgtattatgtctactttaagtgaatattggattttttttaaaagatcacttttataatgtatatacaagag

SEQ ID NO: 571735 - DNA, 662 bp, Homo sapiens
  misc_feature (39)..(39): n is a, c, g, or t
  misc_feature (147)..(147): n is a, c, g, or t
  misc_feature (259)..(259): n is a, c, g, or t
  misc_feature (346)..(346): n is a, c, g, or t
  misc_feature (364)..(364): n is a, c, g, or t
ctttttttttgtaatatttattttaaatagtgaccacantaccaaagcaggtatattatttgtatttgctttttattaaaaaatgattgaaatgccaaacatcaaattcaaaaagtttagagcataatctacatcaatgcctacctnctatataagacataaagtaagaggataaaatatgatgaatccaagaactaggattctcaaagcagaacactaggtctttgacagatatttacattacctaatactgtttttntttttaaataaaaaaatatatttggtcaccatcactttccacacttcatttgagaaaatgccaagttcaaagctgaccttcccctgntgttcttgcttgagtctntccaggtaggatagcagaggaaaaggacttgattaaaataaattatcctaagggcagagcagtgaatggatctaacactgggaaaagtatgggagaggaaaagagggaactgtgccacagagaggtgggcaggctcttgagaaagggctgagaagtggggctggcgtttccttcctcctcccctgagctccatcctctgccctactttcatgtcttccccttccagctcttcctacctctacccacattccttttttccttccactccaaactcaattcttctttcatcagttttttg

SEQ ID NO: 571736 - DNA, 114 bp, Homo sapiens
cgtcctagctcgcaggtgtccagatgtgtgtacactagcctcatcagagtgtccagtgtgcgctcacctagcctcatcatagtgccccagtgtacgctcacccggactcatcat

SEQ ID NO: 571737 - DNA, 711 bp, Homo sapiens
gaaaggaaatcgcagcctgattcggtccatctgtggtaaggcggcagagactgcaagtggtgtccagcgagagtattgctgaaccgaatctgggagatagagaaggctgctggacaagctttgtacggttctgtgtgtccgatcttgctcgaccaatatgaatgtgtgtcgccgagagattgatattcacatagtcattctgtatgcagatgggctgcccttatgtcatacagcacgtcgggactcaatgagactctggcatatagtgagacgtatgctccgataaatatcgtggtagccatgtggtgtactactgctgcatgtgcttatatagaaattcatttatttcatcctgtagtccactagatcataaaatgtcttttgctgcttgttattctgccatctctaaagatgattgttgtgcgtataaaggattgatcagaaggaaacacgtccaaaaagttgcagatgagatgttggttgcggccgagtatagtcagtaatatagttaacaagcaaaaaaagtgctgccaccttttatgatgattttctaaatggagaaacatttggctgcatccacatagacctttatgtgtgtctcagttgaaaacttgcctcctttggcaacattcgtaaatgaagcagaatctctcactcttatccccaaatatgttagtttgtcttgtaagcatgttccatgggtaatggggc

SEQ ID NO: 571738 - DNA, 187 bp, Homo sapiens
ctagcggtggggaaggtacccttaggactgcgtgcaatgaggaacggggaatcattaattaattctggagaacgctgctgttagattgcgggagacttgaggtcttccagagccttatgttgagcctggccccgttctaaccactactcttgcaccaataaactgatgcaccatgacccatccatga

SEQ ID NO: 571739 - DNA, 149 bp, Homo sapiens
gacactgaggcagctactgagaagggcagaacatgtctcaatccatagaggtcttggcaggcgaacccagagagacttgcagtacgtgagaagatggagaaccaaataaaaggactggagtccagttcaaacaaggagggagtggtagt

SEQ ID NO: 571740 - DNA, 881 bp, Homo sapiens
gagcggttggcagacgcatgctcatgcaccgcagcggggtccttgtgcttcctgagcattagcttcacatggtctaaccattgttctatatgtgcattgcaattacctcacttggctgtcactcaagcgtgactcaatgtcttgaactgctcacaagtacctgtttaacaaggtagactgataggtaacatgcacatccccttctggtgaactgtccctttgtagtttgaggtttctatacggacatggcctgtccgtctgaggacgtgaccctatgtactatacgttccagcgccctctggacggctaggaccacttccctggttaccttttagttccaccggcggactgtgtcggaacacgacgggacgtaacgacggacaccgggctgacacgggcccagcggactctctttgcctatgctactcctctcaatttgcttcgccatgaccagactcgggcttgtctaccgacctgaattataaccccatgcagggggtcccttcctagagagaaagcccgctcccctcaaccggtaaagacgttggcccgttggttgtttgaccactatgttggggaaccaaaacagtttcaccttcagttcatggggcccaacatcgaagttcctctacacggcctgtgtaacacggcaccacattggccgcgggttggaacgcccaaccccttgtcactccggcaagttaccacaccaatcgctttaagcaacgggcccttatagtttcgaaccctcttctaaaggcccccttaaacttttcttggttaccaaacatatacgccagtctagccggtccgacagttcacaaccttggcaattaggcggcaactaacccacttccttacggcggcacccccactttggc

SEQ ID NO: 571741 - DNA, 318 bp, Homo sapiens
cttgttgctgtttttctcctcccgttcgcttggcgggcgctacggctagggcgaccgccgccgccctacgcccagctgtccatgttttcttcgggcccgttgccggcgacgggaacccaccacaccaggaatcgtgcaaacagtcggcgcaagtctggagaaaccttaggccctccacaacgttacgcctaagtgatgcccaaaacacggtacagctggttgcggatcgttcctcctgctgtggccagtgatgccaatttcaagcggcgccaaaaaaacagggagcggggcaactagttgcgccaaggcccgctactg

SEQ ID NO: 571742 - DNA, 756 bp, Homo sapiens
catttattacttgggagtcccattgtggacactaataataaaatcatggcaatgctaaaaaaaaaaaaaaaaaaaaaaaaaaaaagcgtcggcgggcgcgcgcgccgcgcggcccccgcgaaaagagcctctaccaagaaccaagtcgcgcgtggggcgcgcgcgcggggccaccgaaagagcgaaagagggaaacgagtgggccaaacaaggtggttcccaagaggagaaaccgggggcacgaggacaagagagggggcggggaatcttctccaacacaaataaaaaaagacgcccgcgggaggaaacaacccgagagggacttggggcaaacacaaactccagaagagtggacagtctccgaggagggccatcatcaagggggagctacaacacccacagcaggggcggcactacacaacaagcacgagcgcccgcagaatatacacacaaagtatacacagccccgcccgccctcggtggggaaaaaacaaaaagcgacaaaagacagagcacgcacacataaaccaaccccgaacacaaaaaaaccccacaacggagcgacaaaaccgcagcggcaaaacaaagcccacacaacaacaaagcagcaagcgagagacacaccaccaacacccccacaagaaccaaaccacccaccagcaaaaggacgaacgcccaagacccagccacccgacaaccaaacaaccagggcgcgcccaccacgcagagaagacagaccaaccacccgcgcaaacc

SEQ ID NO: 571743 - DNA, 322 bp, Homo sapiens
gcgatcaagacgattattttgttccaggccatgggggtttactccgaaggagttgttcagcaaccgcctgcggtttcgcaccatgctggtggcctggtcttcggcgttttgcatcatgctgttcatgtaccagattctgcagatgttcccgcagttgagcccgcgcaacctggtgttctggtttatcaccagcctggcgctgttcggggtggagcggatggtaatgctgcgcctgtttcgcaacctgatggcgaacggcaaatacctgcaacgcacggtgatcctcggcttcaccgacaccgccgtgcgtcgacgcggccgc

SEQ ID NO: 571744 - DNA, 224 bp, Homo sapiens
  misc_feature (7)..(7): n is a, c, g, or t
  misc_feature (22)..(22): n is a, c, g, or t
  misc_feature (60)..(60): n is a, c, g, or t
  misc_feature (64)..(64): n is a, c, g, or t
  misc_feature (74)..(75): n is a, c, g, or t
  misc_feature (79)..(79): n is a, c, g, or t
  misc_feature (95)..(95): n is a, c, g, or t
  misc_feature (108)..(108): n is a, c, g, or t
  misc_feature (115)..(115): n is a, c, g, or t
  misc_feature (124)..(124): n is a, c, g, or t
  misc_feature (206)..(207): n is a, c, g, or t
  misc_feature (215)..(215): n is a, c, g, or t
  misc_feature (222)..(222): n is a, c, g, or t
aattaantgatgggaagaaatnatgataatcataaactgctaataacctccattatttanatantcagcccttnncctncctcattctactcatnctacaatacaganaaggccntcccttatntagttctgttttacgtcataaaggaaactggggccgggtacggtggctcacccatgtaatcccagcacttagagaggctaanntgggtggntcacctnag

SEQ ID NO: 571745 - DNA, 985 bp, Homo sapiens
gttggtcctttcagccttccactttgtatgtctaacacagcgaaatgtctctgtataagctagaaggaggtacgcaaggagtactggatccctcttccatgaaaagggcaggtgaatgggttatggctgttagaggcggcactatgggatcgtataagaaggtacggatcaaactaaaattacttgtaggttatttagttgtcagatgagcaaaggtcattgaccaagggacaatgtgatgaggtcaagttgcttgtgtaagcaggagttggggtcaatagaagatactgtgctctggattgtgacagatgaagttaaagggagtgtagtcaaggggatgttgggctaagtagaataggcatgaatgtcaagcgggagagcatggtaccaactgatgaaactctcttgaagtagctagcaggttctggtatcacgatcctggtgttgtggagccactggctcttgctaatcaccatgaaccataaaacttggaagccccatgtgataattctctacgaagaaatccgtcttataatagcatactcaatggggattagacgatgggatgttctcgacgtgtgtcacccaggggcgtggtgcagagcgggtggatctcggatcaaatgctagcttccgctcctggtgtgcacgcggatttctctgatatacgccttgcaaggtagctggtgctaccagggagtgtacaacacaatccggcaaatgagaaagccttggaaaaaatggagtaaaaacgccaggaagggggcaacgaatcccacgtgaaatcgcacctcggatccaaactgagagtacagaatgacgagggcaacgagggccacttaacgggaacactacagaaacagagggagaactctcaggatattaaagcagacctagaaacaaattacatcaccaagaggagcaatcacaagggcgaccaaaaaagggtcacacaaaagacgggcaacaggcgagaaaaaaacag

SEQ ID NO: 571746 - DNA, 139 bp, Homo sapiens
ggccccccccttttgggcccccccaggtgaggcctggccctgcccccccattacctgggggttttaagcccccggttcccccggaactgacttttccggggggcctgtgccccccattaaacccggggtttttttccca

SEQ ID NO: 571747 - DNA, 448 bp, Homo sapiens
  misc_feature (241)..(241): n is a, c, g, or t
  misc_feature (335)..(335): n is a, c, g, or t
  misc_feature (384)..(384): n is a, c, g, or t
  misc_feature (407)..(407): n is a, c, g, or t
cggaatagaagcttacatcctttgtacccctcacaggaacaccaaattgtaacaagtatctgcacacagaaaagcaccatcacaagaaccaaaaatcaggtgagcaatcacagcacctgatttcatatctctgaaaaaggtattgaggagggtccaacagacagtcttgaatcaccaacaccaaccctcccctatcccctgggcaacagctgtacagcatgggagagtatctgcacttgcngaggtacaccaactgggggacatttacatttgaactcatttgctcccctgttcattagtgggcaaggcaaagccagggctggggcttcacccanaaccccacacacacagggagcttttgggaccagccttagccagagattnacccttttcgttggtcagaattngagggggggcccgttacccattttggcttttgttgagttgt

SEQ ID NO: 571748 - DNA, 131 bp, Homo sapiens
gtcgattctgcaggatccccccgggtacagtagatgtccagttctacgaaggcctggaaaaagcccagccggtgcgcgtgcgtttctctggcgattatgtggctgagctgtcctcgctcaatggctccaag

SEQ ID NO: 571749 - DNA, 157 bp, Homo sapiens
atgctctattcataaagttaaactgcctgctggtattaatgagtttagccgtgctctgaaacatggcaaagagttagtcaactgcttaagctggcccacaaatacagaccagagacaaagcaagagaagaagcagaggctgttggcccttatccgag

SEQ ID NO: 571750 - DNA, 410 bp, Homo sapiens
agcgggcggctgccgccgctgctcttggctcggggacgcgggcgggcgctccgagaggctctggtgcctgcggctgctgctctcctccggcgcccggggctgcggcgctttccccggggggggtttcccccccgggtgaccccccctgtcccggcatctctcgggtccctgagccccggccccgggtcccgcgtccggccggagagaacgcactcagctgctcgagccgccccgggctcgcgcccccgggccatgaagaggggcccgtgaggcgcgcgcggagtcggaggaagaggagggaggagggaggccgaggaggagggcgcgggaggcggaggatgccgccgcgggctgctgccgcgccgccacccgcgggtccccggcgaccctgactccaggaccccgaggat

SEQ ID NO: 571751 - DNA, 201 bp, Homo sapiens
agggtacacagctggctcacagacttcctcatcacccttctcgtactctggtccagcatctgcagcagtggtacccaggacatggtataggctggttaggcgtatgtcaaagctcacccataacttagcaaatagcttgtcattgatagtgtagagcttctcctagatgtcatatcccagcatggcctataagaggcagga

SEQ ID NO: 571752 - DNA, 148 bp, Homo sapiens
gaacccagccagcacagcagcagcagcctttgcctctatgagatcaaacagtttctggagtgttccccagaacccagggtgacatcaagctcttttgaggggtttcaattgaggggctgaaacagttccgacttgcaaacggattggc

SEQ ID NO: 571753 - DNA, 1376 bp, Homo sapiens
  misc_feature (254)..(254): n is a, c, g, or t
  misc_feature (319)..(319): n is a, c, g, or t
gacgagagcgccggaatgcggtccggagactgaagagtgtgatctaccatggcatagtcattcagaagagaggcagatactgactctcgagtgtccgagacgcttcaaggtgcacaggcgggtactgaagctcgttcgtggagggccttctcatgtagaggcgccagcgacgcgcgccggcagtgaagccctgctagggcgaacgggatggactcaagctggcagcgcaagagggcagggggtcgctgtgaagntactgtcgagcacacggccgattaatcggaaagacggacgtaatgaacgaaagaagatgccaaanatggaccgtcattatgggatgtgcagaaggacgcgagacggcgtgctggcctcgtgggtgaacatgttatgaccaggacgcatgctagtagaataacgatgccatgtgttccatcccatcatctcattggaaactcttggaataccatgttacactcagggatctcgtgtgcacgtaggggctcaaggccaagacaacagctaagggaacaaggattgatttccaggggccaaaggcttccttaaaaggcgccaggatatcttccaagaggggggctttaatttattatactacggtagacgaagacatccgggaaatgcgcgccattcttagtgtggggcgtaattggacaggggaaagtctcctttacatagctcggggacaagggccactacgggcagcaggttttctgcaggggcactggtacgtccgagcccgagaaggcataaggaaccctgggacctggggaatagcgtttgagtgcccctcaaatggggcttacaaactcttcgcctggtggttacctacgttggctgggggaaaaacccggattggggccttctaaattgttccccataaaagcaatttgtggaaagcaggtgggaagtgcagaaagagtgtgccccgaggagcgttattccggacggttcccaaaaaggtttggaataaccgggaggtttcttagggcggaaaaaaggaacaagggtttacacaaaaagggccggaacaagcgggggcacaacctcgcaatttaggcaccccgccttggcgttgggaacagtttccctatctttcggaccccggggatccaatataaaaggggggcaaagggatggggatatcaaaggtgcgcaagcaacggcctctggggtacatagacaaactgtgggaggaccacacatatcgcgcccttaaacagtatttggtggtcccgcaggccactgttttgaccaaagggtatggaacaaccggcaagcatcataccagggtgtcacaaggggccacaaaaatttcccgaattgttaacatcaagacaccccacacactcctttcccaa

SEQ ID NO: 571754 - DNA, 151 bp, Homo sapiens
tcctccctctcatcccaaagaaacaggtcagctgggagcttttgccccccctgcctagggaccaacaggggcaggaggcagtccctgaccccgagacgtttgcatcctgcacagctaaaggtcctttattaaaagcccactgttggttttt

SEQ ID NO: 571755 - DNA, 81 bp, Homo sapiens
gtcgaggacacggctgtgtattactgtacgagacctggaggtggaattgtagtagtaccagttgacttctggggccaggga

SEQ ID NO: 571756 - DNA, 886 bp, Homo sapiens
cctgggtgtcagccatcgaaggaggctcagagacgctgtggggaggaaattgctgttcagtgtgcgcggacatggtgaaggggaagtctctcacgggggtgtgaatgcccaggcccttaccagtgccttctctccacacaccaagccttggattggtctggcagaagctctgggagaacacttgatgcgagcctgggctggtggtgcccccaataggtggaccatccaggtgataactaacatgtggaatctatccctgtacatgcatatgctgggagatactgtcgcctagagcgcactcgactagctcagttgtcgcggctgcctgaatagggaggcttccaatgctaggcctggagtgtagaatcgtttgcgtcgagacgcttaaagccgtgcgtgcgtgctacacgcaggctgggttgcctcaggatgtcaccttcggagtctcacgcaacaggctccttgcctgcagccagaggtggaagcaaggggcttccgtgcggcatagtgcgctcgctgggcccgttgtgcccttggcgaggcggcctcgccattatccagtgctggtgggcgccgttggggtcccaaagggcaactaactcccttgttagccttgcacgggggctcgaatgggtgggctgtcgtgtccaggcctaaaaggttgccttctcccgcgagagggagcgtgcccgcctgcatcggtaatatcccgggactcacgaccttcttgacccttgacacagtgcatgccctagcgcatggattgggcgctcccttgggcaagaggcaatggcgtttggtggttgttgatcataccaagagtgcacttgggttgtccagaatggggagaggacccttggccaccgtaattggggcaattttcctc

SEQ ID NO: 571757 - DNA, 132 bp, Homo sapiens
ctatgccgtccagacggtatgtcagagagtaatgaagacgatggggggacacacttggcgaggaggtgggctatgccatccgctttgaagactgcacttcagagaacaccttgatcaaatacatgacaacgg

SEQ ID NO: 571758 - DNA, 132 bp, Homo sapiens
tgcggtgctctcacaggctcccgcagctctctctgtggggcacaggcacctggtcccatggccttctccagccactccaccacacatcctggtgggcaggccatcgcagcacagccatgtgctggcaaggca

SEQ ID NO: 571759 - DNA, 144 bp, Homo sapiens
gccggtccacacgccacgggagaggattatagtggagcccattagtaccagataattaaaaagttttttctttgagcaattcaattatttttataaagatgaagtattagctgtctttcatttgtgtgatgtgcaagttccctt

SEQ ID NO: 571760 - DNA, 678 bp, Homo sapiens
  misc_feature (3)..(3): n is a, c, g, or t
  misc_feature (78)..(78): n is a, c, g, or t
  misc_feature (84)..(85): n is a, c, g, or t
  misc_feature (87)..(87): n is a, c, g, or t
  misc_feature (102)..(102): n is a, c, g, or t
  misc_feature (157)..(158): n is a, c, g, or t
  misc_feature (177)..(177): n is a, c, g, or t
  misc_feature (179)..(179): n is a, c, g, or t
  misc_feature (182)..(182): n is a, c, g, or t
  misc_feature (184)..(184): n is a, c, g, or t
  misc_feature (193)..(193): n is a, c, g, or t
  misc_feature (201)..(201): n is a, c, g, or t
  misc_feature (223)..(223): n is a, c, g, or t
  misc_feature (230)..(230): n is a, c, g, or t
  misc_feature (273)..(273): n is a, c, g, or t
  misc_feature (276)..(276): n is a, c, g, or t
  misc_feature (282)..(283): n is a, c, g, or t
  misc_feature (288)..(288): n is a, c, g, or t
  misc_feature (295)..(295): n is a, c, g, or t
  misc_feature (346)..(346): n is a, c, g, or t
  misc_feature (355)..(355): n is a, c, g, or t
  misc_feature (433)..(433): n is a, c, g, or t
  misc_feature (492)..(492): n is a, c, g, or t
  misc_feature (503)..(503): n is a, c, g, or t
  misc_feature (675)..(675): n is a, c, g, or t
aangttgctcattgggggtttccaggaagaaaaccagctttgggggatttcaaggcccagggagggtgggaagttgcncacgcnntnaggttgtgcccagtntcatgctcaccatttttttttatggccaaagggaagttgctggacgagggaggtnnctttgctgggatgagtagnanagnanggttggggntccaggtnaaagaaatgggtgcagggattntgggacntgggctggatgggcacccgctttgggattttttttgctttagnttntgtatnnttcanggaacantttaggaaggggcgtggcatggggtggggctgccatgttcggggtttttgngtagccagnaaagatgctacaggaggaacaggaggagagggctgggaggggtttgggggaggaggaggagatggggctgcagttaangccttgctcattgcagggggtgtgggaggccaggcagggtcacctctggccctgcaganagagggacggnagtaggcgggctcaggcctgcgcctccagggcacacacgtgcacactgggcaggcagaaccaagagggtggcagctccttgctggtgctgtcctcgtggaaccggatgtggaggaagaagtctcccgtgtagaggaagaggagggcccgaggcaggccgactggccggacgntgc

SEQ ID NO: 571761 - DNA, 294 bp, Homo sapiens
cgccaataggaactttttggaccaaggctacacgtatcgctgcgcgtaatcttgagcatctataccatgtacatattcattaaacctcagaatcttcctgacagggagatcagcgacagatgccctttgactgagctgaaggaaacgtagcctctaagatcaccgagccaatacttaggcatcaatcaagcaatcaaattgcctctaacccagtgcttcaatcttcattggaatcacctggaggagctctagacactattgatccctgtagaaccctccccggaattcgtagat

SEQ ID NO: 571762 - DNA, 447 bp, Homo sapiens
ccgaccctccagaagaggagatgcatcccagtgatgtgagggggacctctggggactgtcattctcagtatcatgtaggaatttaaaaagccaaaatactaattctttctttgtagtgtgtaagggagtgtttttaaaaacaaaacccaactctttgtgtatttttaatcaactctttactcagaatcacgctccaatgcaggtcactctccaattatgatggaagatattttttatacttaattgctgtagggactcattcccagacaaagcaatagtcatgatgtcatggaaccgatcaatggattgtttttaataaatgaagactggcaataaagctgtccattcaattccaaatattggttataaagtagaaccattgataactttcatgtttagaaactccttctcttactattcaaaaaatgtttttaatcatgctaataa

SEQ ID NO: 571763 - DNA, 193 bp, Homo sapiens
  misc_feature (27)..(27): n is a, c, g, or t
  misc_feature (62)..(62): n is a, c, g, or t
agggtggtgagctccatacatatttgnctttcccctcctatgtgggtgtgttacaggaaagncttgagcggggcatgcgttcttcacagtcttaactgggctcctcccttgtgtggagacatcgttttgaagactcataaatgtgattcaacaaactggacggcttaggggctggggattgggcgctgctgct

SEQ ID NO: 571764 - DNA, 1638 bp, Homo sapiens
tttatactacattcgtaagagaatatgcacgtgacaacttcagcactttataaggtaaaaatgaggttaccaagactttaataatctgatcaagcttcttgttatttccaaatagcaatggactcgagtctagtctaagggctacaggagaagagcgaagactaaggcttaaacagtcgcttaactgaccaatcacattctaacaagacaatgcaccacaaaccaaagtttcatctttccaagcccttcagacacctcatttcaaggcaatagcaacacacatcgattctcgctcacaatgccatcatccatcttgctgcagcacattacctccatacacactcatccctgcaatcgatgtccattgcacagcataaaggcattcacaccgctctcgcactccgcatcatgtcaatcatcaggcacaagctacctatctctcactaggctccgaaaaccatgctctgccaatagctatgcgtcacagggccttcccactttcaagcttgtgcacacactcatcacaaggcattgcacaccacacagacatccctaacaacaacaagataccacatacaataaagagagatcacagcgcgcacgcatccgcgacacaccacatcggcataacaacactaacacactcacaaccacacctagaaaagaccagccacaccaaggcaagcctcagcaactcactagctcaccagcgaacaaacaccgacagaaagctgtaaagacacacctggcccacaatcctggacacaagcgcaaacggcgacaccctaggcgtgacaccaataaaacaataagtaaatcccacacggccaccacttggcagctaagacaactacataggggccaacacaaagcaatcgcggcgaatccgaccaacacaagagccaaatacgacaaccgaaacgcgggaccacaaccaaccctatgagtacacgacacaacaacaaagcgaatcgaccaacccaatacaaatacacaaccaacagcacactagcaaaccgacaaaccaaacaatacaaaacgaaggaaaaccacaaggacacacacacatcacaaaaacaaactcccacacaccaggcacacaacaacaataaccacgcgaagcccgacgacaaacacaaacatcagactaccgcacacacggcaaccatacaatgaacacatacacacaaagcgcacaaaacatcgacctaacacacaacacaaaacacccacaacgcacaaaatatagagctcaaccaaaactacccccaggcaaccactacacacaggacgcaaaaagaaagaactacacaacaacgagccgcagcagcacatataacatattataacatacaagacaaatacataaaacgaaataacttattatcaccactacatacatactaaacaactcaatcatacatacctacaaatcacaatatatacatataaatataatacaaattaaaacaacaataaaacataacacatatacaacaaaccacacacaacaactacatacaagaatataaaacaaacaaaccataaaaaaaacatatataattcacacatctaaccatatccctaataacacacactaaataacaaatcaataatatcactactcacacacataca

SEQ ID NO: 571765 - DNA, 450 bp, Homo sapiens
caagcctggcaggatgagtagctggggctgcggtgtgttcggcctgggcctggtgtggccgcctgcgccccagttggtcccctgtctgtgtacatgttgcactcaccatgctgggatcagccgcagtgctgggcattctggggtatgggccagcgtgtcaggtgcctggtctggctcatgtacacgccgtgcattgtggagccctccaccgatccggcagggctgaaggtgctggggaagctggctggtcccgagtggctggtagagcacacctccggctgcggtcatggcctggagctgggcgtaggggcagcggggaaggcgggcatctgcgcgcgcatctggaccgtcgtgcttctgctgctccagccggatctgccgtgccttctcctgctcctgcaggcgctggatggccaggtgcctctgcacctccaggtacccctgcttctt

SEQ ID NO: 571766 - DNA, 168 bp, Homo sapiens
tgacggcccgctcctacggagaggacggtggctggaattaagggttgttagtcatagcttttgctggtatgtaacgagatagtagtaggtcgtggtgctggagtttaagttgagtagtagaatgcggtagtagttaggataatataaatagttacccgtacatgcaag

SEQ ID NO: 571767 - DNA, 446 bp, Homo sapiens
  misc_feature (243)..(243): n is a, c, g, or t
  misc_feature (286)..(286): n is a, c, g, or t
  misc_feature (292)..(292): n is a, c, g, or t
  misc_feature (302)..(302): n is a, c, g, or t
  misc_feature (329)..(329): n is a, c, g, or t
  misc_feature (352)..(352): n is a, c, g, or t
  misc_feature (371)..(371): n is a, c, g, or t
  misc_feature (395)..(395): n is a, c, g, or t
  misc_feature (416)..(416): n is a, c, g, or t
  misc_feature (444)..(444): n is a, c, g, or t
tgagaagggtctgttcatgtcttttgcccactttttaatggggtttattttttatttgttgaaccatttaagttccttatagattccctccctccctcccttcccctgctttcttttttagttccttactttttttttttttgagacggagtaggttctttccctcaggctggagtgcagtggcatgatctcggctcactgcaagctccacctcccaggttcacgccattctcctgcctcagnatcccgagtagctggggactacagggcgcccaccaccacgccnggggtnaattttttanaatttttgggtaggagactggggttgncactgtgttagccaggggtgggncttcggatctcctggaccnggatttatcccgcccatctagggnctcccaaagtgctggaggatnacagggtgtgaggcaacaaaaccaggcntc

SEQ ID NO: 571768 - DNA, 84 bp, Homo sapiens
agccccttccccttgtttttattttactgttaaaaaaattattaacttccttgtaaaaaaaaaaaagtttgtacttggggttca

SEQ ID NO: 571769 - DNA, 405 bp, Homo sapiens
ggtaccggggagggcgggaggcatttggtccccaaaattacggcatatggacatctgcacaggacagtcctattgttggatgtcctttcctttctgaacaatcacacgttttgtgcttcggagaatgactcgctgagcacatctttagggaccaagagtggctatctgtaaggagtgacccgtggcttgccttggtctcttgggaatacttttctcactcgggttgctctcacctgagactattctccacccgcggaatctcagggtcccaggctgtgggccatcactgacctcaaactggctcctagtctccagctttcctgtcatcgagagcttcggacgtttactggctctgctcccgcctgctccgctttctgactctatctggcagcccgatgccaccca

SEQ ID NO: 571770 - DNA, 249 bp, Homo sapiens
aattggctttgccgcccctaattttgcccccctttagatctgtataaaagtgggttgtggtgaaaccacaaaccccagaggggcggccttttggaaatttagttttttttttagttccccccccccatggggggttcctttttcccctttaatatttgcccccctgttgtgggatggataattttgtggtcttttttttccccttggtttcctttttagcctttaaataaatttctgttttgtgcttta

SEQ ID NO: 571771 - DNA, 186 bp, Homo sapiens
agacatacccaactgaacacgagtaacaagagatgcgagcaactgagtaaaccagtatctgcagatactcactccaaggaaaaggccccaaacatcacgcatgagtttcacggacaagatcaaactcctaaaaagagattcagagaaataaatggagtactcaggccacagacataatacaacaat

SEQ ID NO: 571772 - DNA, 305 bp, Homo sapiens
acgaaaacaccatatacaagatgattaaaaatggaaccagacaccttgaaacatatttatagcaccacatgatttaaactttagaaaaataaaacttataatacttacagagataacatgatagcaaacgttagcttgttggcctagactttccaggactaagaccctctgggaatacaatggggctcggtgacatggcgtaacctgctactaggggtagtaggtctcagacacaaaatcacactggatgttaggactacagaggcaggattctctcattgctggataactctggaaattaagcc

SEQ ID NO: 571773 - DNA, 312 bp, Homo sapiens
  misc_feature (307)..(307): n is a, c, g, or t
agcacccgggacattcccatcggccaggccgtggacgatgccaccctgttgctgctgcgccctgacggacagccgtgcgaggtggatgaacccggcgagctgctgatcgccgggggcggcttgtccccgggatatctgggggatgccgagctgacccgggagcgtttcatcgatctgccatggcagggccggacgctgcgttgctaccgcagtggcgacctggtttcccgggatggccaggggctttatcacttccatggccgcagcgatgaccagatcaagctgcgtggccagcgcctgtcgctgnccgag

SEQ ID NO: 571774 - DNA, 206 bp, Homo sapiens
ccgttacgctcagccaacggctctctcgcctcagcagcttgcggtaggtggcgatctcgatgtcagtgccagcttcacgctcatgagcttcctggtactcacgcagctgccgtgccatagtctgcttgtgcctgctgcagggcggcttccagctcctcctgacgtggctaggagcgtgacatggggtacctgagctcgaacttcgt

SEQ ID NO: 571775 - DNA, 597 bp, Homo sapiens
ctgattctagagtaacccgtaatccgcccaggccaacagagagagatcagatggtactgtgtctatgttgaaagaagtagacataggagactccattttgttcgtgtactaagaaaaattcttctgccttgggatgctgttaatctataaccttacccccaaccccgtgctctctgaaacatgtgctgtgtcaactcagggttaaatggattaagggtggtgcaagatatgctttgttaaacagatgcttgaaggcagcatgctcgttaagagtcatcaccactccctaatctcaagtacccaggtacacacacaccgtgggaaggctgcagggacctctgcctaggaaaaccagagaactttgttcacgtgtttatctgctgaccttctctccactattatcctatgaccctgccacatccccctctccgagaaacacccaagaatgatcaataaatactaaaaaagaaaaacaaaaaaggatttctgcgctcccacgttggtggcagcattgttggaaatagccaaatttcagaggcaaattaagcttccatcaacagataatgggaccccgggaacccccgggaaggtccagga

SEQ ID NO: 571776 - DNA, 252 bp, Homo sapiens
cacgaggtccatctgagcctggtggcggaaacgctgcggccccgcgccacagggccggtggctcctccgggtttctgaggacccgcagggagcgggtctcatcatttctgtctcctgtttctccacttccttctctattggctggtccactgatgtacggacctgtccatgattcactgtgaccttctagccacatgtagtgcccttgggtacttggtgggagacacttaccattgggaaccagattgctta

SEQ ID NO: 571777 - DNA, 274 bp, Homo sapiens
ctgacgactattgcagttaccggcgcctacgccgcccgggttggtagcgggcttgtcatatctttggcagcagcagcaaaggcccgctatgactcgatagttgccacgcacagcgcacgatcgtcgcagagcgcccagcaacactttcggcagcagatgcagccgcacaagtgcaagtcgaagcgctgtcgccgatcaggctgcagcgtgggcgactgcgcagcggaccttgtgctgaatattgctgcggccagagccttccaggccaaagagc

SEQ ID NO: 571778 - DNA, 152 bp, Homo sapiens
tgtaacctcgggcccattatttccggaatctgatattcatatatcctccaggaataccggccagagggctgtgctgaaagatacgctgctgccactggtagccagctccaaattgctggccgcttcactcctggaaccttcactatcagcat

SEQ ID NO: 571779 - DNA, 193 bp, Homo sapiens
gggggtggggttttgccccccccccacccggaaagggcttttttttttttccggggttattatttggggggggcggggccccccccctcccggggtttttttgttttgcaaggggtttttggggggggccccctttttttttttttcgggggccccggggggggttttgggcccccccccccccctgggggga

SEQ ID NO: 571780 - DNA, 163 bp, Homo sapiens
tatactagccagtcttccatcgcgacatatatcggacacggctctacctcactcacacactattgcacactggcttctttctgctccttgcgtcccctgaatgtatcccacccaggcctttgtatctgtttcctctctacctaagcattcttcctctgctctc

SEQ ID NO: 571781 - DNA, 122 bp, Homo sapiens
agtggagagtgagtggtagatggtagaaggcagaaaacaggaagctgttatagttttccatttattttttgagacagggtcttgctctgttgcccaggctatagtgcagtggtgcaatctta

SEQ ID NO: 571782 - DNA, 257 bp, Homo sapiens
  misc_feature (50)..(50): n is a, c, g, or t
  misc_feature (90)..(90): n is a, c, g, or t
tccatagaaattcaggattagaagagtcccccctaatacaacattcctcntcttataattgagaaatctggggtcccagtaaggttaaanaaatttgttcaaaatctgagggctggttaataaacagcaaagatcacctaaggtagtattatgggaagacaatatgctctaagtagttttttctagtagtttacacatgcaataaaataaagcagtttggataaacaacatgaactcgattaaaaattctatatttt

SEQ ID NO: 571783 - DNA, 105 bp, Homo sapiens
  misc_feature (61)..(61): n is a, c, g, or t
gagaccatctaagcatactgatctactcgatagtctcggctatgctatcgtccatatcaanggatgtagcttgagactcgggatatctacaggatactgatcata

SEQ ID NO: 571784 - DNA, 1074 bp, Homo sapiens
  misc_feature (193)..(193): n is a, c, g, or t
  misc_feature (1069)..(1069): n is a, c, g, or t
tagttctagatcgcgagcgccggcccttttttttttgtttgggggcttaaaaaaagggtttaatttcttaaagacaaaagcttttgggtttaaatacacaaactaaagtgaggctcctggcaggctcttccacctttccggcccaaccccttccaagggttgggtgggcgtgcagtctcgtgggtggccaagngacagaagagctgtgggcccggcttgcaggggcctcaacagcctcggtgggctcgggagttccagggcgtggacagaacgggccaggagaagctcatccaggagaaaggtcacttccgggggcgtcgtgcccccttttctatggcgtgtccacccagggagggcgtcggggtccgggggggactgggacttcagttcaccgtaggcaccgtggctggtggtgcaggctgaactccttgggccttgaaacggaggctggcgatgctgtgggccattgttgaccccgtggggttgcggggcctgagctcccagggctgtaggggggcactgtgctgtagggggacgaggctgtccaggagagataatcgggactcagggcggggggccggggagccacgggctgctcgagtgggggcctcctggctgtaggacttgagcagcgaggcagagcggctggccagcatgggccctttcattccgtgcggaactggggcgcggggggtctctgaaaccagactgaacgcgcgcctcgctggaaggttgacgccgcccggaaaagcgcctcgcgccacaagggtcggggaatgggtgggctcgaacagggctcaaggcgctgactggcgtcgtctgaccgggggggcccccgaggatttctacagtaggggagcaacgagccggggtgaacccactctgggggacacaagacgagtgtccgagaacccgagtggcaccacccagatgcacggggcccacgaccgggggcactagcaggggacaaaaatatcgggcagtcccctcacagggcgaaccgaccaccgcacgcacaaatctaacataaacgagtaattattatgatgtagatgatcacgaagggggnagaga

SEQ ID NO: 571785 - DNA, 497 bp, Homo sapiens
gggatataggttaaaggtccaacaaagacatatagaatgaagtgtaggataaaccagacacaaaaattctaggtgtccccttcccagggagtcccacatggggagaggggttgcatttaattcttcagtactgatgtgatatgtggcaatacatgctaagtctggccatctggggaagcccaccaagccttggttaccaggttttattgaggtgtcagctgtgactgaaattagctattcagtctcctatcccccagaggtcggactcgcaggcatattaaaattcatttaatatgcagttaaaacagatgaaaggtgaaatttatagtatataaattaatcttaagaaaaaggttaaaaattttaaatcttacaaggaattttaaaattacctttaatgccaccatttagatataactggtgttaccattttgatgtacatatttctccagttgttttttctttttttatcttcacaaactcaggatgcttcttga

SEQ ID NO: 571786 - DNA, 168 bp, Homo sapiens
gaaattgtccccgcagttgccaatcatgtctgaacccaatcagagtacttgtgaccggagcagctggtcaaattgcatattcactgctgtacagtataggaaaaagaactgactatggtaaagaacagcctataatacaatactgttggatatcaccccatgatggtg

SEQ ID NO: 571787 - DNA, 361 bp, Homo sapiens
atacaggttttcgctctgttgcccaggctgtagtgctgcagtggcgtgatcatagctcactgtaaccatgaactctcgggctcaaatgatcctcttgtctcaccctcctgagcagctaggactacaggcacatgccaccatgcacagctacttttttttttttttttgtagggatggggttccactgtgttggctaggctggtcttgaactcctcccaccttagtgtcccaaagtgttgggattacatgcttgagccgccgaccctggcttgtttctgaacctaaccaacactctctgttacggttcgaagacataaatataggacctttttcgtcaaacggaaggggtgtttcagtatgc

SEQ ID NO: 571788 - DNA, 343 bp, Homo sapiens
tatcctaagggtaattatttttatgcccatcttattgaacagcctaatttgaagttatcaggaaactttgaagaggcccaggtgtagtggctcatgcctctaatccctagcactttcggaggccgaggtgggtggatcacctgaggtcaggagttcaagaccagcctagccaacatggtgagaccctgtctctactaaaaatacaaaaactagccaggcatggcggtgcatgcctgtaatcccagctactcggaaagctgaggcaggagaaacacttgaacccaggggatagaggttgcaatgagccgatatttcaccactgtactccagcctgggttgcaga

SEQ ID NO: 571789 - DNA, 149 bp, Homo sapiens
ccttgccctcctgtagtcctatctatgttttcattttttatgtgacaaatctttagatattgaacaagaattatgtcagttctctttccagttatgctgcaaaagctctgtctgccctccctccctctttgatgtgatttcagaccctt

SEQ ID NO: 571790 - DNA, 199 bp, Homo sapiens
cacgaggcggcacgagggcgatgaagtagccgttgttcaggatgttgtggtgcgtcagcgtcgcgcccttcggcgcgccggtggtgccggaggtgaactggatgttcaccgggtcgtcgaattgcaccgtcgcctccaccgcgcgcagccgctgccgcgccgcctccggcgcgccgagggcggagacgctctcgatggg

SEQ ID NO: 571791 - DNA, 209 bp, Homo sapiens
  misc_feature (11)..(11): n is a, c, g, or t
  misc_feature (35)..(35): n is a, c, g, or t
  misc_feature (66)..(66): n is a, c, g, or t
agtgtgcagtngtatgatccaccattctctatgtntacttaaacatccaaaacaacaggggacatnttggaacaatctgtaatattcttctggaatctttctagataaaacacacaggaataaaaaaatgaacatccccgggaaagcatggctgactgtgaagaggtaagctgtaaccactgatgcgtgcacaactggtcgacgattcg

SEQ ID NO: 571792 - DNA, 383 bp, Homo sapiens
ttccacatcaggagccacatctgtcaggctcagtgacgtatccttagtgtctggcacaggatattttcaatagaggctatgagatttactaaataattgattctcctctggagaatgtatagtggaatagttgttctcgatccttcgtagataaacttatttctgaatctttgtcaagtagttgcctttcttgttgcccttataaattaaagcataaattcactgattttatatgatatatataacctatgtgctaaaatatatgggatatgaattagagttcaacaaggatgttatttttaaaaaccaaaccagaaacacatacaaacatgttattttaacgcagtggagaaagctcaaaataataacctgtatccctgtca

SEQ ID NO: 571793 - DNA, 420 bp, Homo sapiens
caggattaatccacggcaccccctgctcctgtgggtaatagtcagcacttgggtggggacttcttgaacttgcagggagaataacttgatacaccccactttgcgccggtgctttgcgccagcggagctgcttcgccatctccgagccccaccgcccctccactcctcggccttgcccgacactgagacgctgttcccagcgtgaaaagagagactgcgcggccggcacccgggagaaggaggaggcaaagaaaaggaacggacattcggtccttgcgccaggtcctttgaccagagtttttccatgtggacgctctttcaatggacgtgtccccgcgtgcttcttagacggactgcggtctcctaaaggtcgaccatggtggccgggaaccgctgtcttctagcgttgctgcttccccg

SEQ ID NO: 571794 - DNA, 135 bp, Homo sapiens
tagctcggtaccacgccgaaggtcatactgcacacgccgaatctccagactttagtgtcaggtccggatggacgaagttgttgcctgagcctccatacacttcttaaaatcaagtcgtaatggacgaagttgttg

SEQ ID NO: 571795 - DNA, 100 bp, Homo sapiens
ctccccatcattggttttttttagtgtgtcaactgtgccgattttattatattcattatattttcccccttttcacagagaaataaaggtctagaagtta

SEQ ID NO: 571796 - DNA, 172 bp, Homo sapiens
tgtatctccgcagctgagaatttagcagtctgtgtcctgtacctcgtacacctgtttgctccctgctagtccgcagaaggcaggtgtccaggtgtggcttggagccaatgggaaggtggctgtgattgtcagcaatgaccatgctgggaaactgtatggtcgctcggcgtga

SEQ ID NO: 571797 - DNA, 736 bp, Homo sapiens
tcggactagccacgaaccttgctgttggcttcctgggcgagtgtttctcgttgggtttgggcccgccccaccgcctctgttgggttgttccatgggtgtcgcgcgggggcctctctaattgcccttccgacgccggtcggtgaactgttgttcttcccgtccgggggatggtgtctctctcgaatggggtgccctttcgccactcatattaccctcgctgctcgtgtttgtggtgtttcttcccacggcggcgccggggtcttgtgactccacgccgcgcgatgggttggtcaattatccctcccatccgcgcgctcatgtggcgcgccgcacgcttccctcgcttcgtgtggcgccggcgcatcggttcttgtctgccaccgcacacaccccgcccgccgaggctgctttataccctggcactggtgtgcatctgtgcacagcccgtgcttcgcacttgtatgcgctcgccgcgtgtagagatcgttcgttgcgcattgtcccggactatgtaagttccaaggattttcctgtgttatgggacacgccctctgtttcggtatgtctctttcaggaacaaacagcgaacaccaacatcttttggtcttttggtctgattgtactttgtgacgcaaccgtctgagcgcccccacgccatccctcgtcccagttgtgtagaggaggaaaacagaacaggtggccatcgtcaccccacaaacaaaataacaaacaaaca

SEQ ID NO: 571798 - DNA, 508 bp, Homo sapiens
  misc_feature (370)..(370): n is a, c, g, or t
  misc_feature (449)..(449): n is a, c, g, or t
gtagatcataaatgatatctgtagcggtttcatgagtgaagaactgcttgcaaaaattgcaatacaaggctggtatgcgaattactgattctgaagatgcacttttatgtatttttcattagaaagtagaactaattttagattttcagcttgatggattttcattttttcctgaagaattttctttaccattagtcttcaaattggattctgttgtgcagtggtgtactgttatacttcagagaaagggtaagagtacatctagttcagttcctatgaggtagctgtaacccttaaaaatgaaacgtcaactctagggtacatttgacattgaaagaatagttaggaaataactttgttttgatagggncatgattaagaaatgatatattggtttatttatggaattgttttatagtgcatacaaatcagcgatcagccagcaaatnatttttctttgagcttgtgaaagctctgtgttctttttgccttcaaatctgttgtcttc

SEQ ID NO: 571799 - DNA, 141 bp, Homo sapiens
ggtggctgttactgaactacactttagacagtaagtaactggagactactatctctatgaatcggacgactcataaaaatatctgttttttcaaacatctacagaataccatgataagtccaatgaaccatactaagcagg

SEQ ID NO: 571800 - DNA, 936 bp, Homo sapiens
gctcttcaccctggcgtcgtgtctaagtcagagtctcctaaagagcccgaagagctgaggaagctcttcattggcgggttgcgcttagaaacacctgatgagagcctgaggatccatttttgagcacctggggaacgctcacggactgtgtgcgtagtgagagactccaaacaccaagcgctccagtgggctggtggtgtttgtcacatatgccactgtggaggaggtggttgcagcctatgtagtgctcggccaacgaaggtggatggaaacagttgtggaagcaaccgtagagctgtctccagagaagattctcaaagaccaggtgcccattgtgctgtgaaaacctgctcttggttgtgtggcattaccgaaccgacattgagagaacatcactaggagattattttggaaccagttctgggaccacttgtggtgcttgcaatcatgactgaccgaggcagtggcactgaaaaggggctttgccgtttgtaaccttgacgaccatgactccgtgataagcatcgtcattcagaaatctcatgactgtgaatgggccactaacttgtcgcggtaagcatagcccttggtgatagctagagaatggcctatgtgctttcgtcccacggccaacgacggacgaccgtggtccttggagaccgttggtgcgtggtcgtggcagtgtggttccgcgtggtgacctgtcgcttgcgttccgttggcgagacacttgcccccggctgtggttgcctatcggcgcacacccgtccgcggtgcggcgctctggggggcgcggcgtttgcttaggcgcttgggcccagcgggcgcactttggcggggtcggcgcccccgtttcgggctaccccccacttccttttggcccccggggattggagcgactcccctcggggccctcttcacccccggttgtgcccc

SEQ ID NO: 571801 - DNA, 603 bp, Homo sapiens
gagctcggtaccgggagtgctcgtcgttggaccgatgagttactactatgatagccttcatggagactgactagcagtgagagagaatcctactgaacccggcagcgacggcaccgatgacagacaaggaaattactcatgatgtcaaagctgtttgctcgctagtgagagcgatgacggggccctgccgggccgtgatgcctcgttggtacttcgacctctccaagggaaagtgcgtgcgctttatatatggtggctgcggcggcaacaggaacaattttgagtctgaggattattgtatggctgtgtgtaaagcgatgattcctccaactcctctgccaaccaatgatgttgatgtgtatttcgagacctctgcagatgataatgagcatgctcgcttccagaaggctaaggagcagctggagattcggcaccgcaaccgaatggacagggtaaagaaggaatgggaagaggcagagcttcaagctaagaacctccccaaagcagagaggcagactctgattcagcacttccaagccatggttaaagcttcggagaaggaagcagccagtgagaagcagcagctggtggagacccacctgg

SEQ ID NO: 571802 - DNA, 1405 bp, Homo sapiens
taagccttcttcgggcctcggcagcggtagcggctcgctcgcctcagccccagcgcccctcggctaccctcggcccaggcccgcagcgccgcccggccctcgtgctgccccgatcgccgtgcctgggctgcggctgcagccccgggctcgcgtaggcgcgacctgtcccggccctgccccctatgggccccggctagaggcgccgccgccgacggcccgtggagccccggattgctggcccgggaggaaggccgggttgctgccggggggctcaccgatcaaagccctaaccatcggccgaggggccccatccccataacccagcggaagggcgcctcggaggccaaagaccgtggtgggacctggcagacagaaaggctgggaggggagctgggaacttttgaccggagcaggcagaaatgaaagcgtggtgggaaagccctattgctcaccccagaaaatgcgcaagggtcgggcgaaacttcaaaagacggatgaccttcgacagagggatctccagaagcttgggccgcgggcgcaaacgggcggcggtgggtcaccaaaatgttccaggccacaggacccgtcggggccctcaatccatgggcccagggaacgcttgaatccaacctttggagcatcaaacgccggggcgccattcgtgagacaccccgaggaatcaattccgggcgaaggcttgcagggggctccttggccacgtgaaattggccaaaccttccggcccgggaaccaaatccgctgggccgcctacctacgcgccgcgccctttcataaccagggtgcacgcgcggggcccaatccaggccatttggcgctggggaaccccactttggggaccgcgcgcgcggcacccccgcgggacacccgggtggtggttgacaaagcagcgccacgcaggggaatccccggagagcacgaacccggggcgcgacagcgcaaggcagccgcggggaccaccggggggcgcatgggagcagaccctcccgggagagaacgcgacaaagataatgccccgagaaatgttgacgcgccccagagaacctccgggaaccccacacaggcggacgacccccgctggggggcgacccccgcggggaacggccgcagcccaaaaaactcatgggcgcgtcactactggggacacgcgccaacatatgggcgcagacggagcggggcgccaaactcggaggggcgcaatagaaagagatccctaaggaggcagagaagacaaacccccacaaaaagaattgtcctgcgtcagagagagaacaacacacaggacgagagataagagaagcgtggtgtgtttacacaaacaaggcttgggcgtcttctcgcccctggcgcgtccgtcgttcgtgtcttctggtttttatagagggga

SEQ ID NO: 571803 - DNA, 664 bp, Homo sapiens
ctttagtgaatatttgaaaatccagatgtggacgtatgaggaatttttaggagtaaaattggtacagtgtggaaatatataaaacaacattcatgaaagttattttgagtatgtcataaaagtgtttttcagccaggcacaatggcgggcacctacagccgcagctacttggagggctgagtggatctcttgagcctaggagttcacatccagggcttttcacaagaatattgaccaaatcttctggtagcacacttcaacaagatgtcccggttatcttattgtagcaaatacaatgaatgattagttacaagtttttcccattgagtttctagtacttaacactgcacgaggcacatggacaactatttgttgagtgagtgaatgggagttcactgctgcagtaaagatctgcctttatacatgaaatgttaattccaggtagactttgctaagcgaaggatgcataacctaattccctagagcaaccactaaaaacaaaaatgtagctaaaaagccaatagcagatataaagtaggattctagatgctttcttaaattcatgaaacagcagaaaagggcaggtgggggaaagaaaaaatgggacaaataaaaacaagatcgtagacttaaacatctgtcaaataattacttaatgttagag

SEQ ID NO: 571804 - DNA, 357 bp, Homo sapiens
tctagcggcgataaccatgggaacgcttttattttgcgtgtgtgtgcgagactgagtcttgctctggtgcccagggtgcagtgtactggcgcgatctcagctcaccacaacctccgtctcccaggttcaagcgattctcctgcctcatcctcccgagtagctggcattgcaggcatgggccaccacggccgactaattttgtatttttttagtagagatggggtttctccatattggtaaggctgagctcgaacccccaacttcaggtgatctgcccgcctcggcctcccaaactgctgggaccacaggcatgagccaccgcacgtggctttttttttttttttttttttggagagg

SEQ ID NO: 571805 - DNA, 142 bp, Homo sapiens
gatgagaatagttatcgccacctgggtacgtggaggggcagagaatcaagatgctacactgcactccagcctgggcgacagagtgagactccattatacaagaaatagatcactaaataaataaaataaacacagaacacta

SEQ ID NO: 571806 - DNA, 841 bp, Homo sapiens
atacctgtctagacgactgggctgggagcagtcctcggagggtatcaggtgtcaaaatcgcgccgatccagagacgacacatcgtattcagatctactgcaagggacacagtggcagagcgtggaggaggcgttcccccagatctagctcccacggtgtgtcctgaaggatgtcatgcaggtgagtgcaccagcttggtgggagacgtggtgcgattccacgtcgaacagagcgtggacgtcctcgacactacgccacgacgcagtcgtcgagacccaatcccgtctacatctcctaagaccaggactcttgacattcaagtgacagccccaggtgggcaggcctccaggaggcaccaggcaggccctgtatcaggctaggacgctcgtgactgtgcgtgtacatatatacagtagtataagatacttttgataagtatatagcacatcagtctatatatttatattacactgtttcctggccccagagctcatttgggttcaggcgcacttcaaaaccctccctgggggaggctgtttcttctcaaggattccttgccaggaggaacggggagggaacagggtgggttttcttcactgaagcagagaaagcagaatggttctagatcctggcacagactgatcccatgttcccatgctcttctccgtccccagggaatgccgaacgggagtttcccttccccagtggacgtctaggtggggacagggtatcttgggtccagctggacagagtgcctgtttgccttctgtcttccctttgtggggactcaagcagagaagctttgggaatctggaatggcgggtccccggggagaccccac

SEQ ID NO: 571807 - DNA, 878 bp, Homo sapiens
ggctgcgggccacctaccaccggctcctcgataaagtggagctgatgctgcccgagaaattgagggcgttgtacaaccatccagcaggtcccagaacagttttcttctgggctccaattatgcaaatggggcgtgctgtgtgctgcatgctgatatggccagatctgcagaacacacttagcacagctcactctgctgtctgatggctacagggtttatccgtcaagatactcacttgtaattattccaaaaaattgagtctgtcgctgtcaactctcttgtgggggcagcaggagcctctcagcttcccgtattggagatataaccaagaactacacagctaaagccaccccaaataccacgagttccctgattcaccctgaaccaactctagatggttgggacaaaacacatgtggaccctagttctataattcggcccatgataacacgcacacgctaacgtgtgtgttcagaaggcacctgtaacctggctagctagttcctgtgattcactagaacaccctgccgcacactctcaactaccacgcttctctacaattgacttacgcgaacttatctactggcttatccagccacctttctcctcacccattgtggtccggtaaataaaccaataacttgggctcgtttatacccccctggcctcctttttgtcccagtcacgcaacctatgtcttaaacgaaccccaacttcacggacgggcaccttcacctacctgccattacgggtagaggccgccagcccccatacaggcacggacttggggaaactcgaccgcgcgcgcgcacaaacgcccacccttcaccttctgccgacactctggcggaacgcacaccccccctcaagctgccacc

SEQ ID NO: 571808 - DNA, 349 bp, Homo sapiens
tagtttgtgacttctataatatgctcatataacaaatagattaaatggggtcagagtaaaatctctcctaaaagctacttgggattcttaacttaatttctcttgacatttctggaagtgaacaaaagctgccctattcattactttctgaaaattttacttagatgcataactttatgaactataaatctctcatctcttcgaaaagccctcaagacagaagctaaataatgtatctgggaacagacactggtccccaattaatacagatacaaaatttgtaaccaaatatttatatccttaatttgtggttttgggggaaattcctttccccaaagggaaaggcctg

SEQ ID NO: 571809 - DNA, 405 bp, Homo sapiens
cacagtgccctggagctggacaggcgctgggctcagatcccaaccttagcgtcttgttcctgtgccttgacctcccagcttcagactcctccaggagctgaggaccaaatgaaatattttaaaaacaaaacgctgcatcccatggcctgccagggtgaggtgcccaatcaatgtgaacttttaattttcaacctcaacacttcttcatcctagatatgtgtgttccccaggaaagaggagaagccagatttaaatgagcacctatcaataggccaatcgttcctacaaattctcttggaccacaccggcctgtgagatagtattttagcaccatttcacagatgaggactgaggcttaaagaggtgaagagagacctgcttagtaagggacggtggcaagagaag

SEQ ID NO: 571810 - DNA, 143 bp, Homo sapiens
gacaaagccacgtggctaacacgagtatttatgcatgccacagaccaaggggggctagtcggctgtggatgcctatcgagatacacgtccacaggcgcccccaatgggtatagggctactgcaatgttacaaggccacagttt

SEQ ID NO: 571811 - DNA, 842 bp, Homo sapiens
tcaatcgccctttcttgccgtcattaccacccaccgcggtaaacctctgccccccccacccaccggctatggttcttaaaaaggttcacccgcccccaccccacttgtttctttcctcgaaacaagggtgtacaaaagcaatacaaacatatcctggcagcagttggagacacccccgtccccccccccttcttgaacccttgggtacagacagccttttgataccgccctcgtgatctataattctgtctgacaaccacacgagggtcaatttttgtcaagaaatgcaccccacgtgtgtcttatacaaaccacccttcataatttctataagccatctaattacttgtcacgcagtagttcatatatatctgcgcggtgtccccctcgttcgccccctccttcttcctcgaacaccccccctcctttttctgccccttagattcttgtcccaccacaccccggctttataatcaatgaattcaacattcccccaacaatcaatctgtgtgttgtgcaaatatgccaccagcgagttaatatgcacctatgaagatggcatctttatgtaaaccatttatacaggcattcatacacccccgtctaggagatacttcctcctcttggagaagaagcctttcactacgctgcgaatattacagatctgaggagagtaaagtgccacaagtccactcgataaagggaggtcgtaacgtattatgccccaagagctggggcaccgggtggtccattttgaatcctcagaatgatacccccgcggttatctctccccgtttgtaaaataccccctggaccccttttccaaaacagcccacaaaaca

SEQ ID NO: 571812 - DNA, 464 bp, Homo sapiens
  misc_feature (6)..(6): n is a, c, g, or t
  misc_feature (17)..(17): n is a, c, g, or t
  misc_feature (25)..(25): n is a, c, g, or t
  misc_feature (28)..(28): n is a, c, g, or t
  misc_feature (30)..(30): n is a, c, g, or t
  misc_feature (80)..(80): n is a, c, g, or t
  misc_feature (142)..(142): n is a, c, g, or t
  misc_feature (184)..(184): n is a, c, g, or t
  misc_feature (195)..(195): n is a, c, g, or t
  misc_feature (228)..(228): n is a, c, g, or t
  misc_feature (249)..(249): n is a, c, g, or t
  misc_feature (283)..(283): n is a, c, g, or t
  misc_feature (451)..(451): n is a, c, g, or t
gtcacnatgcctatctntgggttgnagntncccttgtgggagagcacagtgcaagagacaggaataagcagggttaaggnagttcggaggagggtccagtacgccaacagaaagaactcttgggcagtggtgggcccagggnagcccctcactccacgttacggtacttggtgaagaggttgtncaacactcgtngtgtagatttcaggtcacagttgattatgtctnctggccgcggtttgggttttnccacccctccatcttgcatgagctcaaaggcaanggagacattcaagaccttctgttcaaagttgtccggggtcaggaagaagttgtgcaggggaacaaagtagccctccaggagccccatgagcagcaccaggtcaccccatcttgcaaactgggtttccagttcttgtgacctccaggttcaagtttattcaggtgcttngtcacgaaagtga

SEQ ID NO: 571813 - DNA, 911 bp, Homo sapiens
  misc_feature (12)..(12): n is a, c, g, or t
  misc_feature (65)..(66): n is a, c, g, or t
  misc_feature (68)..(69): n is a, c, g, or t
  misc_feature (89)..(90): n is a, c, g, or t
  misc_feature (94)..(95): n is a, c, g, or t
  misc_feature (107)..(107): n is a, c, g, or t
  misc_feature (109)..(109): n is a, c, g, or t
  misc_feature (126)..(126): n is a, c, g, or t
  misc_feature (129)..(129): n is a, c, g, or t
  misc_feature (133)..(134): n is a, c, g, or t
  misc_feature (179)..(179): n is a, c, g, or t
  misc_feature (187)..(187): n is a, c, g, or t
  misc_feature (189)..(190): n is a, c, g, or t
  misc_feature (194)..(194): n is a, c, g, or t
  misc_feature (202)..(202): n is a, c, g, or t
  misc_feature (208)..(208): n is a, c, g, or t
  misc_feature (226)..(226): n is a, c, g, or t
  misc_feature (229)..(229): n is a, c, g, or t
  misc_feature (231)..(233): n is a, c, g, or t
  misc_feature (244)..(244): n is a, c, g, or t
  misc_feature (256)..(256): n is a, c, g, or t
  misc_feature (259)..(259): n is a, c, g, or t
  misc_feature (264)..(264): n is a, c, g, or t
  misc_feature (267)..(268): n is a, c, g, or t
  misc_feature (271)..(271): n is a, c, g, or t
  misc_feature (276)..(277): n is a, c, g, or t
  misc_feature (279)..(280): n is a, c, g, or t
  misc_feature (285)..(285): n is a, c, g, or t
  misc_feature (290)..(291): n is a, c, g, or t
  misc_feature (297)..(298): n is a, c, g, or t
  misc_feature (300)..(300): n is a, c, g, or t
  misc_feature (312)..(312): n is a, c, g, or t
  misc_feature (315)..(315): n is a, c, g, or t
  misc_feature (319)..(319): n is a, c, g, or t
  misc_feature (321)..(321): n is a, c, g, or t
  misc_feature (324)..(324): n is a, c, g, or t
  misc_feature (328)..(328): n is a, c, g, or t
  misc_feature (331)..(331): n is a, c, g, or t
  misc_feature (336)..(336): n is a, c, g, or t
  misc_feature (346)..(346): n is a, c, g, or t
  misc_feature (352)..(352): n is a, c, g, or t
  misc_feature (358)..(358): n is a, c, g, or t
  misc_feature (360)..(360): n is a, c, g, or t
  misc_feature (363)..(363): n is a, c, g, or t
  misc_feature (385)..(385): n is a, c, g, or t
  misc_feature (395)..(395): n is a, c, g, or t
  misc_feature (400)..(400): n is a, c, g, or t
  misc_feature (407)..(408): n is a, c, g, or t
  misc_feature (428)..(428): n is a, c, g, or t
  misc_feature (436)..(436): n is a, c, g, or t
  misc_feature (446)..(446): n is a, c, g, or t
  misc_feature (450)..(451): n is a, c, g, or t
  misc_feature (460)..(460): n is a, c, g, or t
  misc_feature (466)..(466): n is a, c, g, or t
  misc_feature (468)..(468): n is a, c, g, or t
  misc_feature (470)..(470): n is a, c, g, or t
  misc_feature (474)..(474): n is a, c, g, or t
  misc_feature (495)..(496): n is a, c, g, or t
  misc_feature (511)..(511): n is a, c, g, or t
  misc_feature (516)..(516): n is a, c, g, or t
  misc_feature (519)..(519): n is a, c, g, or t
  misc_feature (637)..(637): n is a, c, g, or t
  misc_feature (778)..(778): n is a, c, g, or t
  misc_feature (908)..(908): n is a, c, g, or t
ggggggaatttnggggcaagttgtttccattaaaaagtactgattttaaaaactaataactaaanncnnccacacgcaaaaaaaaaaannaaannagtccacaaaanantctcctttccttcgganggntttnngatgcattgttatcattaaccagtcttttactactaaacttaaanggccaatngnnacanacggttcngggacngttcttccaccactggtnccncnnnggggggcgggncttgggggtggngtnggttnggnnttnggggnntnnggggnggggnngggggnntngcgggcgccggnggngttntngtncacngcnttggngagacccacngcaacngtgtgngnggnatggggggcggcaagggggccngggggggggnggggnggggggnnctgaacgggggtgggcttgnggggggcngtgtgggcantggnngcgtcaccngggttnangngttnggggccatcttccagcttttnnccagagcggcgatcnatctnttngttcagctcagcaaacttgcatgcgatgtgagcggtgtgggaatccaataggggggcatagccggcgcttatttggcctggatggttcaggataatcacctgagcagtgaagccagcngcttccattggtgggtcatttttgctgtcaccagcaacgttgccacgacgaacatccttgacagacacattcttgacattgaagcccacattgtccccaggaagagcttcactcaaagcttcatggtgcatttcgacagantttacttccgttgtaacgttgactggagccaaggtgaccaccataccgggtttgagaacaccagtttccactcggccaacaggaacagtaccaataccaccaattttgtagacatcctggagaggcaggngca

SEQ ID NO: 571814 - DNA, 665 bp, Homo sapiens
gacctcctgcgacttccgagttgcgatgctgtacttctctttgtttggggcggctcggcctcgtgcacgagatgtgggcaagctggtcacggatggccagttcagggctcagcacagaaaagcagacccaagacatcagaactggggaagcaaacagggtgctggacaggccaggagagcctgtcggcacagtgatcctgacgatgtgggaagtggctgcagcagggcagaaggacggggcagggtcggtggccctggaggctccatgggctcagagaacttcatgcaagccgagtctgcgctggagggccctggggtcctgttgctgaagcaacaagtactcggagggattatccatggctaacgagatactatgcggggagcaggagagttggtggcatagacaacttcgagaatcgcttcgctgcagaggccgtcaccgaggacacctagtggaagcgccattggtagcgctcgggatctccagggggaacggctcgagggaaggtaaaaacaaggatcacaagggcccgtaacaagcacgcgaggtaaccacgaaggcacgaagacctggggcccggcgcctaacaactaggaaccctgaaatggagacagactcaaaccgaaccgcgatacacagatgggcagggaagcttgagacggaa

SEQ ID NO: 571815 - DNA, 136 bp, Homo sapiens
atcccctgcttgtcatgctctgccacaaaggtcctgagtatcaggataacaatgtgttctctgcttgtcctgcctcggctgcttgtctctgcttgtcctgcctctgctgcttgtctctgcttgtcctgcctctgct

SEQ ID NO: 571816 - DNA, 1210 bp, Homo sapiens
  misc_feature (459)..(459): n is a, c, g, or t
  misc_feature (906)..(906): n is a, c, g, or t
tgggagagatgggatgtctcactctgtgtcggcccagggttgggaatggcatggggcagcagatctctggcgtcactggagaaggctcaaccttccggggatcacggccatttctcctgggctcaccctcccagagtagctgggagaccacagggccctctggcacagcaccagcctgggctaatactacgggagtattccacaggtaaagaagacggggtgttcacaccactgggtgtcacaccagagatatggggtctcagatctaccgggaccatcatggatcccggcccgcttttggagctctcacacacaatgtggctggggatcaaccaggcgctgtagacgcccaacccggcggcccgagagcacaaagaacttgtgcgggcctattttttacaagagtgtgtgcaaaccacacttagtgtgtaccaagagtggacatgtggggggcacacncttgcttgggagaagtaaaaactgctcataaaggtgtggggccccttacaaagctaaggagggttgaattctactactatttgttatcaactgttgtggaagagtattcaagaatttagacgagagaattattgagtctgtaaaaagaggccttttaaatatgggacgccaagtgtagtgtttccaaatcaacagtgtgggaatccatgggaaattggggcaagaaattaaactgtgtgtgggatgtgtgtggcacttttgtcggaaaaacgcagcgacgtgtatgtggctcttactcgtggggaagaaaaagaacacggtgggcctctttctttcgaaagaggctgtccttatagaagatgagcagacacccaagattcacaggtgaccaaggggaaacaattctggggcacggaatagtgcttccacatttagtgggaaccagtnccgattcactacggaggattagcaccacaccaaacagatttcgctattctaaaacgacgcggtagaggggagtctaaacacgtattttgcggaaacaccctttatttctaccactctagaaagggccagccgaatttaaggctcccctgtgaagaagattgatgatccccgttcttagctaggtgctggggcacacaaagtgttggtctagacacacagccggagacaaagcttgcagttccagcgtctcgcatataactaaggatcgagacacacatttatcagcatggggaggtctacacca

SEQ ID NO: 571817 - DNA, 283 bp, Homo sapiens
aaggatctgcgagacaggacagcaggtcacaaggaggagcccagtattagggatgaggaccgcaggtcacaggaagagccagggttcgggagtggctgccgcaggactgttgatcatcctggacgcacggggggtgtcagtggacggagattgatcccaggggttgggatggctgccgcaggactgttgatcatcctggtagatggggggtgtcagttggaggagcattgagccgggatggggatggctgccgcaggaccgttgatgatcctctacagtcgat

SEQ ID NO: 571818 - DNA, 281 bp, Homo sapiens
atagcgacaccgtacatcaatgaagggctcacccaggaacaggtgctcgccgccgcgctcagccataaccctaatgatcggaagaccgcgtagatgaatcaggtcaaacacctttttacccgctacaagatgctcgcgctagtgatcgccgtggcgttcatctggttgtttttcagctggcagaccgagggcggttttctcaccccgcgcaacctctccaacctgctgcggcagatgtcgatcaccgggatattggcctgcggcatggtgctggtgattat

SEQ ID NO: 571819 - DNA, 204 bp, Homo sapiens
gggtgtggtgtgtgtgtgcttgcaaaagtctctgacttcccagagcaatggatcctcatcgggaaatgaggaggtgggctgactatagatcccggtttctttcctttttgactcttggccaacctatacgtgggcagtgtcttagggctgtgtggcatggcctcacaccttactagccccgtgtccggggcacacattatggag

SEQ ID NO: 571820 - DNA, 113 bp, Homo sapiens
cattcccaaaaaagttcagcccagatggaaggtgttcagggaaaggtgggctcccttttccccttgtccttatttaaggaagcccccgggcatttaacacccacttggacttc

SEQ ID NO: 571821 - DNA, 685 bp, Homo sapiens
ccaacattaggctcgcgagctactatagactcccttgcagggccagcggctcaagcctataatcccagcacttagggaggcaggggcagacagatcacctgaggtcaggagtttgagaccagcctggccaacatggtgaaaccccgtttctaccaaaaatacaaaaattagctgggcatggtggcgggagcctgaaatcccagctactaaggaggctgaggcaggagaataagttgaactcgggaggcggaggttgcagtgagctgagattgtgccactgcactccagcctgggtgaaagagcgagactcagtcttcaaaaacaaacaaacaaaaaaagactcccaccaacaaccccggcttgaaggtttactttctactttgtcctcaactgtcccagctctggccttcactctcattaaaaggcatttttatgtttaaaaacactcagtaaatagaactggggatacagaaccacagtctaaacgagagaagcagaatgacagctggtgagtgtggtggtctggaaaggaactacctactctgtacgaactcagtaattctgattgaaggcatccaaggctccgggaatagccataagagaaggagctgaccgaaaaaggttccttcggtccagtctgttcgggacctaataggtggctcataattaatacatctggcggtgg

SEQ ID NO: 571822 - DNA, 677 bp, Homo sapiens
gttattgtggcctcccagacagccaacaaagaataagagagtttactcgagactagaagtagatttgcgataatttggaacttagaaagatattgtacatcacaccagagtatcagatctggtactgaagatcatttctggatgattgatctgctccatgcctttccatttatcctgactaaagcagatcattattactatataggtattgattgctaccctgaccatagctgctttggtactatgagaaacttcttagattttctatatgtaaatgctgtggaccactggtgagctactagatggcccgactatcatcttcaagaagagtgttatgtgctagcatttataatcactgtggtgttccttgttaagctaaaactagcacatggtgctttgattctctattcgatgactattgagtagccatgatcgttcataaaaccttattcgcaaattaagtagaaggtacgctgtttcctttctcaatattgaaaataggcttctagtcgtaagaaggctgacgccagaatacgtacgatccttgtcgctagtggatcagccccactgtctttatctttgtataactaaatctgcattttcaaatgtcgtcaatcacatttttcttagagctgaatatccaggctgtaaatgctctaaagcctttttccttgact

SEQ ID NO: 571823 - DNA, 489 bp, Homo sapiens
ggccccaaaagctaggttagcaagggcactctggtgcaaacgaaggcccccggtgtttctggctcctttaactcaacaagaagggcagcctccgggggaaccaagcccaaggttaaaaaggcgggcgggaccaaacctaaaagcccagttggggcaccccaaaagccccaaaaggcgggtgggggggcaactctccaaaaagagcgcttaaaaaacccccaaaaaaaagcaaaaaaccggcccgggccccgtgtaaccaaaaaagtggttaaaggcccaaaaagggccaaggttgcgaagcccaagaaagctgccaaaagtcttgttaggcttgtaaacccaaggccccttaagcccagggtggccagccttaaaaggcggggccccaaaaaaaataggcggacgccttctttttaaaccccaaagggtttttttcaaaccccccccggtttccaataaaagagcgggatattttctttaaaaaaaaaa

SEQ ID NO: 571824 - DNA, 329 bp, Homo sapiens
cagctcggtttcctctgcggctggaaggaagtcatccacccgtccctcatctgcggctggaaggaagttatccacccgtccctcatctgcggccggaaggagggcatccgcccgttcgtcatctgcgaccggaaggaatcatccacccgtccctcatctgcgtccgaaggaagtcatccgcccgtccctcatctgcgtccggaaggaggacatccgcccgttcctcatctgcgtcctgaaggaagtgatccgcccgttccttatctgcgtctggagggaagtaatccgccctttccttatatgcgcccgaaggaagtcattcacccgtc

SEQ ID NO: 571825 - DNA, 584 bp, Homo sapiens
cgctgttttccccgcgggtttttggggccaataggaactcgaggggggcctacgtttacgagcaagggggggggggtaaccggaaatatcggtgaggtttttatggcgggtccccgggggaaggtttaaccgggtttccggtgagaaattcccggcgtagtttgggtgatccgcgcggccgaaaaattaaaagggcccggcagattttgagcggagaccgatttccgcccagggaaccgctcttgccctgtgttcccgcaaggcgccaggagcgtggcgaagctttttttttttttcccgggaagcgcgcccttttgttgggtcccgggaattcggccctttaggccgggggggcaaagaaaaggggggggggtctggggaaaattgccctttagttccttggcccgcccgcccagttttggcctggccgctttcagtccatgggagggggaaagagccttctcggggcccttgaagagagccccgagggcaaaaaagggatggggtttaagcgcggcgcaggattgcgaattgggggggggtccctcagggggggtttcccgtgggaaggaaggaagaaagga

SEQ ID NO: 571826 - DNA, 1394 bp, Homo sapiens
gttctgcggcacggcctttcccagtgtcccacgcggaaggcaactgcctgagaggcgcgggtcgcaccgcccagagctgaggaagccggtgccagttcgctgggtgctccagtggccggacacgtcatagtctatgtagcgtacgtgcgcgggccccctcccgaatgtggatgggtatgacactcccgtcaaggctggacaatcctggatctaccggaaccttcagctccgagtacgcgtgaggctgacgtcgttcgagaaatgatactgggacgacgattcggacgacgttcgttacgagttcccgcgtggaatctgctatcacgctagaggtagtcgccgtcggacattcagcctgtcgtttcgcttgtcaggaacgaagcgcgacgcttgagggactgctattgggagtagcccgatggatctggagtgccagtagcgtgggactgggccagcagatgctcgctggggttgcagcaattgggcgcgctacaggccagcgccccacgggactcagcaccaacaagcctgccgggggacccggccaacccccggcaagggtaccggaggggccggtgggctaccggaccgccagggagacccgacagacccctaagggcggggagttcggccaggcaggccagaatcccccggaaggtccgggaagccccgattccccaggtcctcagcaagccggaatactccgctttacagaccgcgtccgaaaggctcctcgggttcccgggaacatcccgttcttccgaaatcttcgggatcaggaagcgtcccaaagttccaagaatccggagccgaaaggggttcccacgtttccaaagtttccttcggtcgggtccttcccagaatctccggtatcaggcgggtaccaaagtgtacccggtacttcggggtaccacgggaggttcctccagccaagtggtccaaggagggggacattcgagaattcccagggtacggcgattccgaagagacattcccacaaaaaggttctcccttggacggacggacgggaaccagggttggtccttttacggacacaatgattagattcgagagcagagatagtcgtcaaaccgggaagggacatgcggggcacacgagcagcccagttgaccatcgccgaggagagccgcaccccagccagtgcaaatgaaacggccatgcacgctggccaacactaatgaataacaggacgacgggaccaccccacaggcccacggggcggccagccaccggccacggaggacaacgagaatcgaggaggacaagagcaaacacgacgacggcggcaaggacaagaagaaaacgacgacaaagcgcggagaacacagcagagtcgaccagcagtgaaacgcgcacgcgccaccgcacccgcg

SEQ ID NO: 571827 - DNA, 438 bp, Homo sapiens
  misc_feature (16)..(16): n is a, c, g, or t
  misc_feature (20)..(21): n is a, c, g, or t
  misc_feature (25)..(25): n is a, c, g, or t
  misc_feature (29)..(29): n is a, c, g, or t
  misc_feature (32)..(32): n is a, c, g, or t
  misc_feature (36)..(36): n is a, c, g, or t
  misc_feature (38)..(38): n is a, c, g, or t
  misc_feature (68)..(68): n is a, c, g, or t
  misc_feature (188)..(188): n is a, c, g, or t
  misc_feature (270)..(270): n is a, c, g, or t
  misc_feature (288)..(288): n is a, c, g, or t
  misc_feature (303)..(303): n is a, c, g, or t
  misc_feature (420)..(420): n is a, c, g, or t
  misc_feature (436)..(436): n is a, c, g, or t
gaattcggcacgagcnctgnnatcntgantgngcangnactgatcatgtgccgggagccggggaggcnttccactctggacaaaggtcatgaggaaggaggctcggcatacgcaaatgcgggatcgagcctcaggagtccacccggatattctcgagcatctcccccccaaaaaaaccagagtctgcntactgtattgctttgtgctctcacctctgatttcactgggggctgtccccaccaccatctcgctctctctgtcaaagagttnacttacagctccaattcnttaagttccttgtcnttcttccctttaacttccagctgagtctccatctggagcgcggaacccaccacgtttactaattatgcctgggctgctaagacccactcgagggggggggcccggtaacccaatttngccctataagtgagtngg

SEQ ID NO: 571828 - DNA, 829 bp, Homo sapiens
aaggctaggtacgaggctgggttttaattggccgagggctgagcctccggtcccgccggcccgctgctgctcctcggtgctgctgctgctcggctccctggctggcccgtggcgccggcccagagccccccgtgctgcccatcctgttctgagaatggagcctgctgccctgttcggggagctggcagtgctgcacacttcgtgctgtggaagtgtctatgccttgtgactgatgactgtggcaccctgtgacctatgtggtggatgccatatcgtgtggtgatagctgctgcagtgcattgtgctgcctgcgagtgcgcctcagtgtggtgtctgcctgtaccatgtggtgccctgtgcagtggtcagctagcaagaacatcaaaccagaagtgcccaaacccctggcctgtgtgtgcatgcctgctgccatgctgcctgtggacactagctgccagacctgcccccatggatgctcaggcaggttctggatgcagtgcatgccagagctggacttgtccttctgatgtatcctgcgggacccctgtgatgcactctgcacgttatagcgaccgctgggtgagccagtgctgctgagtgagcgggcccggtggtgacggcacacactggacttctgtttgcgctgcttgaccggggccgaggtcgcaggcgggtggcacggagccccgagtctcgctgctgcgctctaggcctccggcttctctatctcctacaggcgggctggaccgcctaaccaggatcggcttctcagactctatggcggtgtcctgtttgagcacctggagcccacccagatggctggactggg

SEQ ID NO: 571829 - DNA, 116 bp, Homo sapiens
ccgcggtttatgtctacgaggctaagggtctaattggagctgtagccaggctaagggtataactggagctgtagccaccggcctacaccagcaccacagcaagtgcgggatccgag

SEQ ID NO: 571830 - DNA, 938 bp, Homo sapiens
agcggacgagtctttccgcctccccagcccgcccgggagctgcgagccgcgagctggattatggtggcctgagcagccaacgcagccgcaggagcccggagcccttgcccctgccctgcgccgccgcccgccggggggaccaagggaagccgccaccggcccgccatgcccgcccctcccagccccgccgggagccctgcgcccgctgcccaggctggtcgcgacgtgcccgatgtagcgggctccggatcccagccgtctcccctgctcccggtgctctgcgagatctcccctgaccagatctccacagcccggacccgggggctggcccatgggccctagcatggccctggcgtcctgatgccccccaatgctccctctacctgaaaagcccaccagcatgcaacccagaacttgcgggcgcaagcgcgccagtgtacggacgtgggccagtgcagagccccagaaggggcccagaaaggccggagggcccaacaatggacccaagcccactgccatggagtcctgctgtggatgggcacgggcaatagctgccatgacccacaggaacccatgaaacggcaatccgagctggacccctgcgcagctaaaccaggaggggcgaccccacctgggggcatgcgggatgaccccgagggtgaacctgaacgaaaatgaaggccccagaatgggtaaagcacccgtgtccgataatactggtcagtcttttttggttcggaaccaattggtagcacccaatccctgcaaagcgtcgcaaacttccggtagcaataggagatctatactatgtttgtaaacaatttaaactgatggtgacatttctactctccggaaatacagtcaccaaatagatccttgcatggactataatacggcagtctgtagaactgtatgtggtttgtattgctatgcacccc

SEQ ID NO: 571831 - DNA, 262 bp, Homo sapiens
acaacagatcacagaggtcagagagtcatagaacccgtgatccggaacgagaggacaggaggaggcctttgagaccatagatactactgaatatagtagaaacctaagctcgcaagaatccaggactgctaacaagcccctccccccgcataagttagagacacagcagggccaaaacctgtatctaatttttcagccagtgttcactacagagtatcctatatctccagtccttgtgaagttatttttcagtcctttactt

SEQ ID NO: 571832 - DNA, 309 bp, Homo sapiens
caatttgtgagcagacagtagtatgccttcgtgtactataggcaatcaaaatttaattttactcatgcccgtctcacaggcttgtgttataattgtaagcccatattacttgtgtcagtagttaagacactataggtaacataatgacagtggtgtaaagtttctgttcaagaaacatatgttgtaaagttactttatacaagatacctgccataggaaatggtcttactttcaaatgactttgaaagcatgtataattgcaaacagagcaggagaagactttaatcagaatttctgtgcccatttcaa

SEQ ID NO: 571833 - DNA, 130 bp, Homo sapiens
gaggatcccgtatttatccccaatcacccatcccaggtttcagcaccaagatgtagaagtaaagaaagagaaaagaaacatgaaaagtggctcaacagtcaaagacaagtttattttggagaataaacct

SEQ ID NO: 571834 - DNA, 109 bp, Homo sapiens
caggatcttatccagcagagaagaagctcaggaagataacgaaggtatctgctggtcatgactggtcatatcctctttgggctacagccacaccttgggttaccgagct

SEQ ID NO: 571835 - DNA, 359 bp, Homo sapiens
ctcaaagatggcacagcataattcctctggtagcatggacctccggagtgctcaaatgtattataccaggaaattgggctgatggtgaagtgcaaggggtttggaatgtatggcattttaaatcttaattatctgagcggctatcatttaccagggatgctttagtctcagagggggaggacaagcaaggtgtagtgcactctgcagggcatcccatagcacattcaaggtcggggaaaggttcttggttggacaagttctggtatcaaaggggtggctgcagtagcttggtgccccggtcagtctgggtagccccttaagattgggaacgtaaatgcaaggaaatctggtatgcaatg

SEQ ID NO: 571836 - DNA, 526 bp, Homo sapiens
ggtcgacgtgaggcaagatggcgccagtgcactcaagtcttaggacaagagtaaaacaccctctaaaaaaaaatggccgaggggctgtgggaagagacagaagctcgggggtccttgctcagcctggtcgtggctgtgtctgagagatgcctctgacccgctgatttccctcatacagaacagactttctgattcctttctggcagaggtggacagggatgaggagaggcgagagagggagaccttgagttgaaggctgtggggtgggcagaaggggtggtgagggggcaggggagctggggtggtggtcctggagccctgcaggacacctttgaggtaacccaccagggaagttccaccatcctcccagccagggactcacgccctccgaggctgcctctgcccgccaagccttgacagatgagacctcctttaccccacctggacatgttgggagagaggtacaggtggggaggagctgatgggagagtttcaagggctggagtgatgaactctgtggagtcga

SEQ ID NO: 571837 - DNA, 157 bp, Homo sapiens
acctagggatttagggcgagtatctgctataggtgaggagaatagggcatgacagacgagaagtagaagaaggcgaggttggaagagagctgcggtgggaatgtaggcactgcttgaaatacctacatacatacacgaatacatacacaagatcatg

SEQ ID NO: 571838 - DNA, 240 bp, Homo sapiens
  misc_feature (6)..(6): n is a, c, g, or t
  misc_feature (74)..(74): n is a, c, g, or t
  misc_feature (110)..(110): n is a, c, g, or t
tttttngtgaaaattttcttagcaaattgaataataatcataagaaaatgtatggaacactcacagacacactngcaggttagctggggctcctactctgcaatcagctnccacttccaccagggcacctgagtacagccctccactgccaccagtgatgcagggtcatctggcttttgcatcctctcaggcattaaaaataataatcaaacagtcttaggggacactcatagaagccct

SEQ ID NO: 571839 - DNA, 110 bp, Homo sapiens
ccgattatttgcaggattcagacattgaagggagaaggatggcatccggaaggcccgtgaggtcctgatgcggttgggcctggacacgatctggcagatccggtgagtgg

SEQ ID NO: 571840 - DNA, 316 bp, Homo sapiens
aatggaatgcaatggaatggaatccttcccggaatgcaatggaatggaatggaatggaatggaatggaatcaaccccgagtgcaatggaatggagtggaatggaatggaatggaatggaacaacccgaatggaatggaatgtaatggagagtaagggagttgaatagaatcaatccgaatgtaatggaatggaatggaacggaatggaattgaatggaatggaatggaatgcatggaatggaatcaacccgagttcaacggaatggagaggactggaatggaatggaatagaaactacccgaatggaatggaatgt

SEQ ID NO: 571841 - DNA, 368 bp, Homo sapiens
caagttggcggcggtggcgttggtggtgatcaagccgttttaagaataagaaatctcttatttattttttgctgatttattaattgttttgcggcggtatgtatcagctgcgctgaaattaatttcatggtcatttatcccggcgactttatttgatcgtcggcgattccgggttggcgcatttctgcgctaactattcttctgaaaagttagcgatgtgtttggccggtcgttcagaattatctgaatccgtatgcggggccaatggcgcatccattgttcttgcgctagatgcgtctggtgttgaaggttctgagtcttgacactcggtgcggcgctacctcatcaatctcgtgttcgccaacttg

SEQ ID NO: 571842 - DNA, 1663 bp, Homo sapiens
  misc_feature (387)..(387): n is a, c, g, or t
  misc_feature (678)..(678): n is a, c, g, or t
  misc_feature (741)..(741): n is a, c, g, or t
  misc_feature (1134)..(1134): n is a, c, g, or t
  misc_feature (1250)..(1250): n is a, c, g, or t
ttggctgcttttcctaccatttccagtaagaaaaggggtgttttggaagaaaatcattggcctttgtcttcacggaaattctgatttaagccctgtggcctcttgatggtatagagtcatggtgtattattccagttaccttagaatatttccctttgagaatttggatacaatttgagggaggcagaagttctgcagttgtgaagaaaaaaaaattaagttcgtgttgtggtcattattttaagttagccgtggtgccttatttttatatacgtgattttggatattcagtgtttctttttcattagctcgtattttgtgccaccggtaaaccattaaacagaacaacaaacaacaagagaatttctcacaaaatagtggcgcgtnttttacagaaaaccgcgtgggttttataatatgagccagttattgtgaaactgtgtgtatagagcttatagatatagtgtgtgccgaaaatatgtgtgaacaccacttgaggggtgggccactctcgagttatattctttataacgaggggggaacagttcacgtgtgcatctcaccaatgtgtggtgtgacacttttcttcttttttatcacttatgtgtgtgttaagaaaaatataccccgcaaagaacattgtgacaacagagatatgtgtgtgtcgtgtggagaatncaatgtgtgccgtgtgttttgtgtcgttgagaacatatactctctggtggggccagaagagcncgagaaaagaggacattttcgtggtttcaacgaaagaggttggggtggaaactcttgaaaatttctctccacagaagagagtttcaaataaatacagctgtggttgaaggtcttaaccaaatttgtcgggggagggggggcctctaatatataagcaaccccgtcttttaaaggaaatattttatttttctttcctaccccatctttgctagcacacgttttctacaatattagagacacaccgctgtgtggcgtcaaccaccaactctatcaacacactcagcttgtgggctctcgtgaaaaaacacaggccccgctttctttgtgcacaacagcatatatagtttcccccatttaaagagacctaagtgggggggcaacacagcgagaggngaaccgcgggcgattatataaacgaacaggctccaggtgtggaaaaacacgaaatggtgcggccctcacacaggttttcccgtgggaagcgggaaaagacaagacgcctacaccgngcgggaagaaaacacgtatcacacgattcaaccgatcgtgctccggctggtgaccaaacgaaagcacgcgaacaaaacaaaaacacagggggggggcgcgcccggctctacaagaagagtaatccacccaggcgagagggggcgcacagagtttttgcagggaagccacacggattttcttgttggcaacggagggccccacaatagagacggaccaattaaaaggaaacgagcagcgggcccgcgatttcacaaccgagtgggcggcggcaaacagggtccatctggcactcttgtggagaagagccgacctgcgtcggacgaaatagagagaacacccgcactaaactccggcaaataacaagagaatgagtgtaacgccagctgtgcagtttacatcagagcagcaagag

SEQ ID NO: 571843 - DNA, 280 bp, Homo sapiens
cccccgttttttttttaaaaaaaaaaaccccttttataagggccccttgggggattcttcccccccccccttttaacaaaatttaagggccttccctttttcccacattttggaaggggggacccccttttttttccccccccccttttttaaccccttccccccgattttttttttccccgggcagtcggggccccccccaattggggccgttttggccaaaatttttcttttttttgggggggggttttttcccccaaaaagggggttggaggtttta

SEQ ID NO: 571844 - DNA, 191 bp, Homo sapiens
tatttgcgtgtgtgtggtatgtatgacgtatagctatgtgtggtatgtgtggtatgtgtggtgtgtgtggtgtgtgtgtctgtgtgtgttgtgtgggtgtggcgtgccctatgcgtagtatgtgtggcgtgtgtgtgttatgtctgcgtggtgtgtgtacatgtgtgctgtgtcgctatgtgcgtgtgtgt

SEQ ID NO: 571845 - DNA, 502 bp, Homo sapiens
agcggggtgtgagactgcgtgcggcaggcagtggcgcggacggcatatatgccggctgtctggcccgagccgccgacaacaaaaagtgcgcgggcgctcggcgggcgctcgagacgggcgcgagaggcttgaccgcgcaatagcgaaccgagcgagcgactaaataacagaaagtgcaaccatgagatcaacaaaaatgaccgagtaacagaggacatcaacgacaaacaggagagcagatgaacatagaccgaatccagtcataatcgaaaagtgacctactgtcacaccatgaaacacggccaagccaagccaagcggacggcacaacaggaggacccccgggttcccaataaatagcggtacaacccggaaagaacggcatggatgacagaacaggacgacaagcaccaccaaacacgagaagtcggggcgagaagacaggaacgcggggcatcgactagcaaaagaagacatggaaggcaagagaccaataacgcctc

SEQ ID NO: 571846 - DNA, 483 bp, Homo sapiens
gtacctcaggattgaagtctcttttgactattgatgccaatggtatacttcaattgtctctgctgtggacaagagtacggtaaaacgagaacaagattactatcactaatgacaagggcctgtgtgcgcaaggaagacattgaacgtatggtccaggaagctgagaaatacagagctgaagatgagaagcgtagggaggaggtgtcatcctaagaattcacttgagtcctatgccttcaacatgaaagcgactgtagcaacgataagaaacttcaatgcaggattaacgatgcacgacaaacagaagcattctggaccagtgtaatgaatttatcgactggcttgatatgaatcatgactgctgagaaggaagaatttgaacatcaacagaaagagctggagaaagttcgcagagccccatcatcaccaagctgtaccagattgcaggaggcatgccaggaggactgcccgggggtaggaggt

SEQ ID NO: 571847 - DNA, 724 bp, Homo sapiens
  misc_feature (644)..(644): n is a, c, g, or t
atggtcagcttcatcttccttttttttttttggaaatggagtttcgctcttgttgcccaggcggagtacaagggtgggatctcggctcactgaaacctccgcctccggggttcaagtgattctcctgccacagcctcccaagtagcgggggattacagggtgcctgccaccatgcccagctaattttggtattttatagtagaaagggggttttaccgtgtgggccaggctgggtctcgaactcctgacctcagtggatccgcctgcctcagcctcccaaagtgctggggcttacaggcctgagccaccacgctcagctcagcttcaccctgtctgcaaagacaaagtttataccaagaccagaagtgaactatgacatttcctaggtagtggtaactctaacactagttcaacaacgtcatgtggctctcagatggcctatacttggttcacaaacgttggtgattaaggatatgacggattctagaagtgaccccaatttggtgtaaatccctagactccattcatgaacgcagactttataccctgcggtggcttcctgaaagaatttccgaaatcagagcaaatgtgtctcacggccgatcagctccttttaaatatttcctctgtggccattcttttgnctcccccgaaatctgtggtggtacctataagacagatctaactccgtgcccctggtagaagctcttttgggacacatctg

SEQ ID NO: 571848 - DNA, 734 bp, Homo sapiens
cccccggaattttccaaatttagtcaccgagtcccggaagccaactcgttaggcgaatctatcctatgaggaccacccaattccttggtccctgtcccctgtctggaatcattcacgcactctcttctggtccctcactcccccccgcccatctctgaagatcattcccgcacacgtctacaccctattaacaaaaggactgcgtgcataattaataaacgacggaacccttctttatgaatagactcccccacttattcctactatgctgtaccgacctccactgtgcggttgaccatcacgtccggatagtccccccacgtcgcacttccggagactgtgcaccagctgtgcgagcgtgcgacagacttcgcctccgcatagtgtctatagaggggtcattgggcagagccacccgagtgcgctacactcgatgtggataaatacacacggtctgtggcttgggtatgctcacatagatgtcataaagactaggtccacagccgagtcgtggggggcgaccgacacaccacctccggtaggttccgcagatcatgttgtggcgcgttgtgtccaagagaagttttactctcccacacccgagtgagtgtcgaggggcgtgcccacttgcgacgtgtgcgacgatgtaggcgcccgcacgacgcgcgcccaatgtgagcaacacctcgagtgcaagagaccctgtcctggccatacaaatagacaagacaaat

SEQ ID NO: 571849 - DNA, 906 bp, Homo sapiens
  misc_feature (314)..(314): n is a, c, g, or t
gggcgccagcaacacaggtgtcgtgaaaactacgcctaaaagccaagacatgggaaaggaaaatgactcatatcaacattgtcgtcattggacaggtgtattcgagggaacgtgcatcattgactgggcgatctgtatctataaatggcggtggcatctgaggaataagaacgcattgagaatagatttgagaaggaggctgctggagatgggagaagggctccgtgtcaagtgatgcctgggttcgtcgggaataacactgaacagctggaggcgatgaacgatggctagtcagcagttgagtatcgtccttntgggcaagagttcagaggaccaggcacagtagctatgtgcactatgcatgtgagtgccgccagggactagcagagacttgtagtctagagaagacatggatgtacaggggactatctcgagtgctgagctgtgcgtgtccgtgacttgttgcatgctgggtgttggtgaactttgaacgctggtagtctccagggaactgggcagacccgatcagcatgcccattctggcttacgacacatgggtgtgaaagtaacgtcacaattggtcggtgttgagacaatagatggattccaggtgaggccacgcctacgagccagacagagatatgaggacaattggttacgggaacgtcagcgctgtccttgagagacacttcggatgacagagccaccgagtagctggtatcacttgtgtcgcacagatttactgagctggggaaatggtgaagatagactgcatgggtagccagggtgcctagaaatgccattgggggtcacacagggaatggaaaacgttaacccgtgaaggggatgcgaattgcttgtgggactggatagttgttgaagggtttgggatgggtcgataggaag

SEQ ID NO: 571850 - DNA, 474 bp, Homo sapiens
gagtcgggttatggtatcctctccaaccaagctgaagctgaagcgacagcgtggagtatgaatgagcaagccttccagtgacctgagcgggggggagccacctggtgggagcacctcacatttgatgtggaaagggatgaagaacctcaggggtgggagctgccctttgatgccgggacaagccactgcgcgcaaatgtacccgaatgataagttcactcaaaaccccatgaggggcgtgggcctgtcccctgagcatatctgcctgttgccgactagcctccatctgccatcgagtcccggggcgaacgagcaagagcaggttccccccacagtgctatgcctaccagtaccaggactagagtctgtcgtgaagccacacggtgtcaggccttgccgttatggtaccaacccttctttcaggcatggcaatgccggctgctcgggccctcatttgagtccatacccggactcg

SEQ ID NO: 571851 - DNA, 132 bp, Homo sapiens
gttatcaacactgtgaaaatcctaaaatccaccatatgaaaaccattttaaagtggttaaaatggtcaattttgtggctgtcgtgcttgtgtgctgcatgccgtgataacccagacactttgaggcggcggg

SEQ ID NO: 571852 - DNA, 162 bp, Homo sapiens
aagacaacaataatcagcacatagtacaatggatagcagagctatccagattattgaacaatgttacagacaaatcgcctgaatattaaatgagcgtaaaagggcctctaacctatgacaggtttccccacttatgcatatagcaacatgctagtatgtttt

SEQ ID NO: 571853 - DNA, 271 bp, Homo sapiens
ggcacagtgtccgctcccttgtatggctgtcaaggaacaccgatctagatagaaacccacattggaagagaacacaggtagaggtagctgccatacatatgagatatgcgtccttaaggaacctgacaagcagactgaagggatggtaagtgtgaccagcctgatcaagtatactcaaagcccagtgatacagagccagtgttttctgtacactggcagcactccagtaaggcccaatatcgaattcccacagccaggtcggaagtctcat

SEQ ID NO: 571854 - DNA, 479 bp, Homo sapiens
  misc_feature (202)..(202): n is a, c, g, or t
  misc_feature (425)..(425): n is a, c, g, or t
  misc_feature (479)..(479): n is a, c, g, or t
cgtccccctgtggagatgaaggtgtgtgctgatccctcgatgcccctgtggagatgaaggtgtgtgctgatcccccatctccctggtgtagatgaaggtgtgtgctgatcacctattccttcagtgtggtagattaataggatagtgtgtgtttcactcttgtaccttacatgtggattggatgtgtaatgagtgtacgtgngtgtatatgtacatcgtgtaacgttatagttatgatagaattgtactggtaagctgtgagtaaatagagacttatgatgttaacataagttttatactaagaatgtcactggtagtagctgtatgagctacactgaggatctgactatgatcagcacactgtggctactagacttatctgtggatgtctcgttgtagcgataatctagactctgatctgagancagacacactagagagctttcaagataacttagtttgtgcacggtctagcatan

SEQ ID NO: 571855 - DNA, 1029 bp, Homo sapiens
tcggagtgagcgttatattggcacgattacaacatggggacaaacccaggggaaatgagcgagtctagggttcctaacccaccccggctgacaaggggtggccccgaggggccggaatgcccagccccgaagggggccctaactcgctcctccttctcccgaaagaactctctctcgaaacgtgtaggcctatgaagcaagcgtcgggtctctgggggacaaggggatgccccggtctcacaattctcaaagcccaaaaagcttgaaggtctcggacgcaagggggcctcgtgtccttcggggtctctgggtggaagcaaagtgaaaactgtggctcggctctcgcaagagtgtgcgcttctctcgagggaaacttccgaggaagaacactgtgcaaagacgtgttccttgtgctgtccccctctgggggcaaggcgggcacggccgcgggagatcttcgaagtgttagaaggctgtgccggccagtctccagggcgcggcggggtctccgtgagctctccgtgggggcttctcccacacgagtgtgtctctgtggggcacaggggaacacacagaaactcccgggggggaaaacactctttctttacccagaaggccctcgcggaacagcggcacccctcgcgaaatatcccccctcttacgcggtgttttgggcaaaacctactcgcgggggaggaaccaccactctatgtctcatcggggggcgcaaattatatcacaatgtagggtctccatgggggaggaaccctctgtggcccaagaggacaccgccggcgttatacaaagggcggggggataataaggcactccccattttcttggggaccccaaaaagcaccgaaacacccaagttggaaggctcatccccccacagagaagtttttcggagtcacgaaagaaaaaattgtcatttttcccccaccacgtcaagcgtgtttgagagaggcgcccacggacgcgtatacaaaccacggccccgtgggcgtcccaacatttgggggataaccc

SEQ ID NO: 571856 - DNA, 2552 bp, Homo sapiens
  misc_feature (347)..(347): n is a, c, g, or t
  misc_feature (404)..(404): n is a, c, g, or t
gaagaattcgcgaaggcgtagacatcctgataacccatggaccaccactgggcttcctggactgggtccccaagaagatgcagcgggtgggctgtgtggagctgctcaacacggtgcagaggcgcgtccagccgcggttacatgtctttggccacatccacgaagggtatggtgtcatggcagatgggacgaccacctatgtgaatgcgtccgtatgcactgtgaactaccagcccgtgaacccgcccatagtcatcgacctccccacaccccggaactcctgactgctccccactgcccctgccctgcccgcccgtgtcagctccacaggcctggcccggccactngttccttccatgctgagttgcctggacgacccatctggctgcgggggactggcctancaggcaggtcagggccttggaacgactctttagccttctgtcacctggagttgggaccctgcgcatccccatcaggggttctgtgctcatttaactttattcctggcgtgttaacatcctgcgtgtacctcgttcaaaggacctactaagctcatggccctgtcatgtttgggaaatgactaaatcttcattcttctcccttggacgccctcctggtttgggaagctgctgctcttgaatgggttttggaagttacacaaaatctccctctaaccacgggtctgtgtggcggcatgccctgggttggggtgggtgggaggattcgtgagctgcacacagacagtccctttctctcctcccaagtgagggaggagacaggcccaagggggaggccctccgagggagcatttagggacatctcaggaattcagaccgcacctggccaggcccacagctgtttgcctggcattgttcccccctttttcttcccataggcatttttgttttacttgaacaatgacctgagtgtcctaggcattcactcggagcctggatgatgggggctggttctacagaatgagccactggcattcgtgcccaggaccagtgagagcgttcccagtcatggggggatgacccttggtcccacggggaacacactgctctgtagaatgcggtagcctggatggagggtctgcaggcttaggctgcagcaggcctgccatgggtgtgaacccatgtccaggcacgcaccgacacacatgcacgcacgcacccctcttaattgaaccaagtgggtcctgtgtttctcttttctgccccgtagtgaggttctgttccttggtgcggcttcccttgcaccgttaggattctgtctggcatgcctgcagccgaggaagcccaggaccagccggccctgtgaattggagggtggcacagggaccgagcgggccccaggctccagcagccccaccttggacagcttctttttcttctttgaattaggactggagggggtggggccagggcggtggtgggaaccggtagggcctagatgaggggcaggcagtcaggcagaaatgggcaagttcagggtcagattctgtcgttatttaatattttgttcatcatggactttttctgcatttattttgatttttaacgttgcattaaagtagtattatttgtcctgattggtgactttttttgcacccctttccgttgtacatctgagagaagggtgtcactccctcacccaggtcccagccctgggaaccagcctaccgtgagcccttttgcagatatagactcatttcatcctcagatggtccttcaaggtaggtactttagtcccattttagagatgagacgattgaggccagaggggtgtggtaacttgcctgggggctcacagcacaaaaggagccgaggcaggatctgacccttgttctctggcctcactgccctcactttgccatgacccgaagttatgtccctacaaagcaatgcatggtccaaggctctttttattgtatttttatttttaagggtcctgttcaaaactggtgtgagctctgaggagtcctgaaccctgggtgcagcatcctagcatcctgggagtccttttctgcccacactgagctgggctcctcgaggggtggggctgctgtccctggaagcctggcagcagcactgtatcgggttggctgaagctgagcgccgtggggtgcagggctccaggaatcccgtttggctgaaggggttcctgtagccagggatgtttatgaggtctctctgatgccccaggcgcaggacatgtgtgcgggtggagaaaagcaggccctttcagtgccagctccactcaatttctatgtggaccaagaacgataaacttaaaaaattttttttcctaaggtatcttcagaatatggtgtatttttatgtggaaaagaaaagttatgaaggcagctgttactttaagagaaaattcattaaaagtcctcgaggtatgaagatgacggcgtgcttctcaatcattttggcataacttgattgtggctgtaatttttttttttttttttgtcaagcatgtcagacaataaagtctttgtaaaaaaggggaaaaacctcgttgccgaatcttgggcc

SEQ ID NO: 571857 - DNA, 387 bp, Homo sapiens
ggttttcctcagctttgggtggtggcctggtgccgggcatcggcttccagtccgtggagggcgaggcggcgtggacttgcggccccggcatccagcgacccgtcgcccgcaagccgagcgccctgtccgactgagctaccgagcccgaccgcgttccagtatctcagacgaccctgaccgacgagcgatcgagagaaggcagtgatagctgcaaaattagtgaacgcaggtgcatggaataacaggccaattcaaaggtggtgctgagtgagtgaagaaaacgaaaagcatagtgagcctagaacattgtccgtgacctgaaaactgaagtagagaacaatgaacgcattgaccgagacacaataatgaacagaatttgtgaaatac

SEQ ID NO: 571858 - DNA, 216 bp, Homo sapiens
acttctaggaccccaagaattgctgggagaaggggttcactatcttggagaggagctgcaccaccagaattgagggcacacaggcagataccagagagtctgacaagatgtggcttgtccgccacctggaaattataaggaagtacgttctggatgacctcattgttgccaaaaacctgatgattcagtgctttcctctccactatgaaatgttta

SEQ ID NO: 571859 - DNA, 194 bp, Homo sapiens
  misc_feature (36)..(36): n is a, c, g, or t
  misc_feature (46)..(46): n is a, c, g, or t
cccccccccttaggggggcgccaggtttaagtgttngtgctttctnatgggggaaccgggcccttggggggccccccgaacagcctttgttttttgctttggggggggtgggggaccccccagggcatttccccccccccccctgctgcccagttggggctttagctccaaattaaaaaaaaccctgtttttca

SEQ ID NO: 571860 - DNA, 2819 bp, Homo sapiens
  misc_feature (46)..(46): n is a, c, g, or t
  misc_feature (60)..(60): n is a, c, g, or t
  misc_feature (614)..(614): n is a, c, g, or t
  misc_feature (671)..(671): n is a, c, g, or t
agcacagatggtctggggggcgccagcagttactgagcaccccacnccaagcgcctggcncatgctgagctctttcaaggaggccctcagtgcagccctatggaggaggggggtgaggctgcaaggtcctgaatggtttcagtccctgaagcctgaggcagggcagggttccggagagcttgctaggggagagtggtgcaaagccggagtccggaagccccatgccttctccaggctgcagaagctgctgctaggcgtggggcagtgaggggctgggacagaccgcgtcatggcctcctgttgtctcccccataccaggcttcctggactgggtccccaagaagatgcagcgggtgggctgtgtggagctgctcaacacggtgcagaggcgcgtccagccgcggttacatgtctttggccacatccacgaagggtatggtgtcatggcagatgggacgaccacctatgtgaatgcgtccgtatgcactgtgaactaccagcccgtgaacccgcccatagtcatcgacctccccacaccccggaactcctgactgctccccactgcccctgccctgcccgcccgtgtcagctccacaggcctggcccggccactngttccttccatgctgagttgcctggacgacccatctggctgcgggggactggcctancaggcaggtcagggccttggaacgactctttagccttctgtcacctggagttgggaccctgcgcatccccatcaggggttctgtgctcatttaactttattcctggcgtgttaacatcctgcgtgtacctcgttcaaaggacctactaagctcatggccctgtcatgtttgggaaatgactaaatcttcattcttctcccttggacgccctcctggtttgggaagctgctgctcttgaatgggttttggaagttacacaaaatctccctctaaccacgggtctgtgtggcggcatgccctgggttggggtgggtgggaggattcgtgagctgcacacagacagtccctttctctcctcccaagtgagggaggagacaggcccaagggggaggccctccgagggagcatttagggacatctcaggaattcagaccgcacctggccaggcccacagctgtttgcctggcattgttcccccctttttcttcccataggcatttttgttttacttgaacaatgacctgagtgtcctaggcattcactcggagcctggatgatgggggctggttctacagaatgagccactggcattcgtgcccaggaccagtgagagcgttcccagtcatggggggatgacccttggtcccacggggaacacactgctctgtagaatgcggtagcctggatggagggtctgcaggcttaggctgcagcaggcctgccatgggtgtgaacccatgtccaggcacgcaccgacacacatgcacgcacgcacccctcttaattgaaccaagtgggtcctgtgtttctcttttctgccccgtagtgaggttctgttccttggtgcggcttcccttgcaccgttaggattctgtctggcatgcctgcagccgaggaagcccaggaccagccggccctgtgaattggagggtggcacagggaccgagcgggccccaggctccagcagccccaccttggacagcttctttttcttctttgaattaggactggagggggtggggccagggcggtggtgggaaccggtagggcctagatgaggggcaggcagtcaggcagaaatgggcaagttcagggtcagattctgtcgttatttaatattttgttcatcatggactttttctgcatttattttgatttttaacgttgcattaaagtagtattatttgtcctgattggtgactttttttgcacccctttccgttgtacatctgagagaagggtgtcactccctcacccaggtcccagccctgggaaccagcctaccgtgagcccttttgcagatatagactcatttcatcctcagatggtccttcaaggtaggtactttagtcccattttagagatgagacgattgaggccagaggggtgtggtaacttgcctgggggctcacagcacaaaaggagccgaggcaggatctgacccttgttctctggcctcactgccctcactttgccatgacccgaagttatgtccctacaaagcaatgcatggtccaaggctctttttattgtatttttatttttaagggtcctgttcaaaactggtgtgagctctgaggagtcctgaaccctgggtgcagcatcctagcatcctgggagtccttttctgcccacactgagctgggctcctcgaggggtggggctgctgtccctggaagcctggcagcagcactgtatcgggttggctgaagctgagcgccgtggggtgcagggctccaggaatcccgtttggctgaaggggttcctgtagccagggatgtttatgaggtctctctgatgccccaggcgcaggacatgtgtgcgggtggagaaaagcaggccctttcagtgccagctccactcaatttctatgtggaccaagaacgataaacttaaaaaattttttttcctaaggtatcttcagaatatggtgtatttttatgtggaaaagaaaagttatgaaggcagctgttactttaagagaaaattcattaaaagtcctcgaggtatgaagatgacggcgtgcttctcaatcattttggcataacttgattgtggctgtaatttttttttttttttttgtcaagcatgtcagacaataaagtctttgtaaaaaaggggaaaaacctcgttgccgaatcttgggcc

SEQ ID NO: 571861 - DNA, 295 bp, Homo sapiens
tggcacagcgacgggtgattgtagtgctagtgtactatacggctgtggagctgacctttaaactgacggtggatgtctcctgggtggcactgcaggctcagcctctgtgaggaagctcctcatgtccctggccagcagcatgccgtccgcgcaggcgcaggtaaacttgggcgagtgggggtatgatctgcggggcaagggaggcacagatactggcagccgccattgctcagggtggtcctctcacaccagttcactcctacttgggctgagtgaggtagtggaaagaagaacc

SEQ ID NO: 571862 - DNA, 110 bp, Homo sapiens
tattcccaagcatgggttattccaaaactggggacggtgaacattaaaacgaaagaggggactcgcgtggaacctgaaacacggacgccttgcttccaagaagggctgtg

SEQ ID NO: 571863 - DNA, 663 bp, Homo sapiens
gtacgaggtataagctctgcaaaatcttaaaaatttgaaaagtcttgacctgtttaactgagagatcacaaacctgtgtaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaattaattggccgtcgtttaaaaacttttaaaatggaaaaactttggcgaaaccaaattaaatcgctttgaagaaaatccccttttcgccagttggctaaaaagcaaaaaggcccgaaccaatcgcctttcaaaaaattgccaattttaaatggcaaatggaaaatttaaagcttaaatattttgttaaaattcgcttaaaatttttgtaaaatcagttaatttttaaaccaaaaggccaaaattggaaaaatcctttataaataaaaagattaaaccgaaataggtttgagtgttgttccattttgaaacaagattccattataaaagaacttggcattaaaattaaaagggtaaaaaactctttataaggctcaaggcccaataacggaactattacctaaaaaaagtttatggggtcaaggtgcctaaaagaattaaatttgaacttaagggggagcccccattagctgtacgggtctcttagcttggcg

SEQ ID NO: 571864 - DNA, 670 bp, Homo sapiens
  misc_feature (55)..(55): n is a, c, g, or t
  misc_feature (76)..(76): n is a, c, g, or t
  misc_feature (82)..(82): n is a, c, g, or t
  misc_feature (102)..(102): n is a, c, g, or t
  misc_feature (124)..(124): n is a, c, g, or t
  misc_feature (135)..(135): n is a, c, g, or t
  misc_feature (143)..(143): n is a, c, g, or t
  misc_feature (172)..(172): n is a, c, g, or t
  misc_feature (185)..(185): n is a, c, g, or t
  misc_feature (234)..(234): n is a, c, g, or t
  misc_feature (274)..(275): n is a, c, g, or t
  misc_feature (289)..(289): n is a, c, g, or t
  misc_feature (303)..(303): n is a, c, g, or t
  misc_feature (388)..(388): n is a, c, g, or t
  misc_feature (394)..(394): n is a, c, g, or t
  misc_feature (407)..(407): n is a, c, g, or t
  misc_feature (498)..(498): n is a, c, g, or t
  misc_feature (510)..(510): n is a, c, g, or t
  misc_feature (555)..(555): n is a, c, g, or t
  misc_feature (557)..(557): n is a, c, g, or t
  misc_feature (568)..(568): n is a, c, g, or t
  misc_feature (583)..(583): n is a, c, g, or t
  misc_feature (606)..(606): n is a, c, g, or t
  misc_feature (609)..(609): n is a, c, g, or t
  misc_feature (649)..(649): n is a, c, g, or t
aggctcatggaaaagagcatagggatccaggaccatacaacgtggtggtgctggncagggctctgcatcccctttnctcagnacagcaccatcttcaccctnctgggaaagcagaattggagcntaaaccgcttnttcttttntcaccagggtaagaaatgcaagtatttgnagaggggagttantttggaaggtggcagagaaaaactagggcaagaattaagggaacttgtnggaagagtaactgtggaacctacctatgctctcttgaccnnaaactccccaaaanccctcactgaggantgtttacccccgcgggctcagaataaactgcttactggaagatgggtgacttaaggcaaaagggaagagctgcctcctgggctcnccaatnccctgctgcaganctggtctagtgatactgagaaaaacacctgcattttgccctttcagccagctccctcagaggttacagcagaaggggatggtgggagggtnctatttcacttnaaccctacaggcactttccaccctcaaaccttctgcacaggagantnaacaggcacanccttctttccccgtngctttagacggccccgcgcgtanacnctgagcaggagggcagcaaagaccacagccacccccagcnctcccaacacagtaacagtgt

SEQ ID NO: 571865 - DNA, 706 bp, Homo sapiens
tgcactggccaccatgcccagctaattttttgtcattaagtagagatggggtttggccatgtgccaggttgttctcactcctcagtcaagcaatctgcctgtgtgagcctcccaaaggtggggcaatcacagcgcgtggcccatgcgcgtggcccaagagagacgatttcttgaaacaacaacttggcaagtgatttgtcattcacatttggaaagtgattcttcacttcctagttcttaattatagtatactataagatctgtaagatcctgaagactatagagatcatgaagccatataagaatgaggatggaaagtggagcaaaatttcgggattgggggaaacattcttagctgtgctatctgctaaaattattccttatacttctctccttggacagattcaagttttcttcatagccctttcaaagttttggagccatccagagtaaaatcatttctaaatgatagttctgtatatctccaactcgtctaaagtgtattggcctgtgtgcaaggtatgggtagattatgaactcttcagcatgggtgtggataactttaatgtgtcctgagtaaatagccttcaaaggacaaatcggtttcttgtgagatagttcgtaaactcacatggagttatttaatcatattgcctttttattcctgcccctcttaatgccattgtgttaagagactgcatttagg

SEQ ID NO: 571866 - DNA, 132 bp, Homo sapiens
ttcaggaggcgctcggtcagcagcactggagtgctcctccggggccacgcgcagctcgttgtataaggtgtggtgccagtatcttactaccatagtcgtcccagattggatgacgatagccatgctacaatg

SEQ ID NO: 571867 - DNA, 337 bp, Homo sapiens
gatccccaagcagttaatacagactcagtctcctgagtatctagggattacaggcctgtgctaccatgcccagctaatttttggtatttttagtagagatggggtttcaccatcttggccacgctggtcttgaactcctgacctcaggtgatccacccgcctcggcctgccatagtgctgggattacaggcgtgaggtgccgtacctggcatgtataccagacagcttctatcaaacaagggagaacctgaggtttacttattttttacttaatatttacctccaaaatcccatttatccggtctggccactaaattgagtctgtataaccgtgctg

SEQ ID NO: 571868 - DNA, 155 bp, Homo sapiens
tcatcatgtaggacagttgggatatttctgcagcagcattcataatttgagtattatccaaaagacagtttcatcagccggatactctctctgtaaatttcctgaagttctttccatggacttgattaattctaattgttgtaagtgttcataag

SEQ ID NO: 571869 - DNA, 452 bp, Homo sapiens
cctcttgggttcaagccatcctcccacctcagcctccccagtagctgggactataggcacatgccaccatgcccagctaatttttgtatatttttgtagagacagggtttcgccatgttgcccaggctggtcttgaattcctgggctcaggcgatccgcccatctcggcctcccaaagtacttggattgtagacatgagccaccgcgcccagcctccccctgcccttttaacagctgcttatccacttatttgaaagctcttcccctggggagggtgggggtttggggagaaactggtgtgtggcttggaggtgtggggagcactttcaggaaccagccctctgctgccccgtctcacatggccaccagcgacccagcccctggatcctgccccactaaccatcgctatcttcttttcttcctcctactccagcatacttccacaggctgca

SEQ ID NO: 571870 - DNA, 234 bp, Homo sapiens
  misc_feature (36)..(37): n is a, c, g, or t
  misc_feature (40)..(40): n is a, c, g, or t
  misc_feature (146)..(146): n is a, c, g, or t
atctcagagcttagaaatagccgagcagcgtgtctnntanctccgtgtgggaagtgtgcggtgggtcaagcgcagaagtttcattctgacacttctttgatcctaagtcatggagtaatgtttggaaatttcatttatcttaattnggtcttcgtcttgcgggtggggaaaatgagttcgcattacatcagtgcttttcagcctgaccccgtcggctaagttttccgggtaccg

SEQ ID NO: 571871 - DNA, 162 bp, Homo sapiens
gctggtgcaaatctagggccatcagaagggactgcaaagacccaagggcagagccctccaagctcccggtgtgtttggcgacgtagggcttgcgcgcctgccagctgactctcagagtcgcagcccctggtaccgggttgaagacgccacgcccaggcgaca

SEQ ID NO: 571872 - DNA, 148 bp, Homo sapiens
ggtttgcactgatgcatgcaaacaggattaaactaaggtttggttccttcagccctctaaaagcatagtggcttagcctgcaggcttccttgggctttctctgtgtgtgtagtatttgtaaacactatagccatctgttaaggatccc

SEQ ID NO: 571873 - DNA, 339 bp, Homo sapiens
tccagtggtgtgatcatggctcactgcagcctcgacctccttgactcaggtgatcctcccacttcagcctcccaagtagctgggagtacaggtgcacaccatcatgcttagctaatttttgtattttttgtagagacaggtctcgccatgttgcccaggatggtcttgaactcctgggctcaagcgatctgttggtctcggcctcccaaaatggtaggatttcagaggcatgagccactgcgcctggctgaacttttttttaaaaaagaaatgcagtttttattttttcccactgacgtacttggaaaaaaaagttacatgtaatgagacacatagttc

SEQ ID NO: 571874 - DNA, 856 bp, Homo sapiens
  misc_feature (4)..(4): n is a, c, g, or t
  misc_feature (344)..(344): n is a, c, g, or t
  misc_feature (360)..(360): n is a, c, g, or t
  misc_feature (366)..(366): n is a, c, g, or t
  misc_feature (404)..(404): n is a, c, g, or t
  misc_feature (408)..(408): n is a, c, g, or t
  misc_feature (417)..(417): n is a, c, g, or t
  misc_feature (490)..(490): n is a, c, g, or t
  misc_feature (495)..(496): n is a, c, g, or t
  misc_feature (505)..(505): n is a, c, g, or t
  misc_feature (520)..(522): n is a, c, g, or t
  misc_feature (524)..(524): n is a, c, g, or t
  misc_feature (538)..(538): n is a, c, g, or t
  misc_feature (554)..(554): n is a, c, g, or t
  misc_feature (684)..(684): n is a, c, g, or t
  misc_feature (692)..(692): n is a, c, g, or t
  misc_feature (718)..(718): n is a, c, g, or t
  misc_feature (780)..(780): n is a, c, g, or t
  misc_feature (855)..(855): n is a, c, g, or t
tttntacatttgtcatttactctttgaagtgtacatgtattttgcttcaaattctgtgatgagtacgtttttatactaatcagtatcataaataatttaaaatattagtcttatctctggaatcaccaatcaatttactcagatgatctcactgtctaattctactacatttaaagactgtagaacatttgtgattaagcaatttctttttcaaaactgcaaagatgggcagtgcgagagctgattccataaatttcaatgaattcttagaaaattatgttgttctttatttctgatctattttcttgaataatttgggtaattatctgatcagttacctttgngaagaatagtaaaagnacctcnaatctcaacattttagctactgtaaaatgtcataagcntccntcaaatatnagtggtacataattacctcaataagaaaaatttaccaggggcgagggggagggggcgccaccccatgggaatntatcnntgggtaaangggtagggattatannncnggtgaggggacagngcggccgccggcctcnctcaaggaatacatagagctgataaacattaaattccataatccagaccagatcttttataaatggtaaataaaaaggcaaaaatgaaagacaaaagtcctgtgatctttgagaaaagacatttatccancatctccnactgtgggcaaataaatattcgttcntgtattttaaattactaccaaaatattttatctttctacaaacaacaaaaaacaagcaaacngtatctagaaattttttttcctctgacaagaatgtcaagtctttgaagttaccctaaattttttttttttttccng

SEQ ID NO: 571875 - DNA, 195 bp, Homo sapiens
gaacccgatgtacgtagccatagctggagcctgagtccgctgcaggcagagtctggtgtgggtcttgacgacgtgacagtgaactacctagatagggagacttgagagaatacagtctccttccagaggtcgggggtcaggtagctgtaggtcttatacctggcctcccaggtgaatacgcgaatgtggtaccga

SEQ ID NO: 571876 - DNA, 389 bp, Homo sapiens
  misc_feature (1)..(1): n is a, c, g, or t
  misc_feature (63)..(63): n is a, c, g, or t
  misc_feature (98)..(98): n is a, c, g, or t
  misc_feature (114)..(114): n is a, c, g, or t
  misc_feature (124)..(124): n is a, c, g, or t
  misc_feature (137)..(137): n is a, c, g, or t
  misc_feature (160)..(160): n is a, c, g, or t
  misc_feature (215)..(215): n is a, c, g, or t
  misc_feature (256)..(256): n is a, c, g, or t
  misc_feature (292)..(292): n is a, c, g, or t
  misc_feature (361)..(361): n is a, c, g, or t
ntccctcactgtctatgatatttatattgaggtttttctagtctctgggtatatatgcttgtnattaaaataaaggaaattaaaaaatccaatagtgnattatacatttttcantcatttgccntactgtcagtgtnaatataaatctggactaaatgtncagactctcaagctataatgttcagctttcttcgtcctccatgctaagagttgtnaaagcttatagggtcaaacaataccaattgtataggcttcnaaaactatttaagttaggggattctctagttttagnttagatacttttggtatactgtcaagtcatcatcttacttattttaatgtgtttttttttttttgtttnttatatttttttggaacaatcctgaagg

SEQ ID NO: 571877 - DNA, 449 bp, Homo sapiens
  misc_feature (142)..(142): n is a, c, g, or t
  misc_feature (145)..(145): n is a, c, g, or t
tgcacacgccgagagtccacacagaggctgagacaggagatttgcttgaaccagggagtcagaggttgcagtgagccaagatcgcaccattgcactacaacctggtgacagagcaagactccgtctcaaagaaaaaaaaaangangattgatattttagacatcaacggaatggggactgtttaaaagggaataccttacacagatcacctgaggtcaggagttccagaccagcctggccaacatgatgaaaccctgtctctgttaaaaaaaaaaaatgcaaaaggttggccaggtgcagggctcatgcctgtaatctaagcactctgggaggccggggggggcggatcacttgaggccaggagttcgagaccaacctcaccaacatgaagaaacgctttttttactaaaaatacaaaactggccaggtgtggggcctcggcgtgtgca

SEQ ID NO: 571878 - DNA, 392 bp, Homo sapiens
  misc_feature (173)..(173): n is a, c, g, or t
  misc_feature (301)..(301): n is a, c, g, or t
  misc_feature (371)..(371): n is a, c, g, or t
ggactgcccgtttgtttatgagacagggtctcattctgtcactcaggctggagtgcagtgtcatgatcatggctcactgcagcctcgacctctcaggctcaagtgatccttgcatctcaacctcacgagtagctacgactacaggtatgccccactatgcctggataattgtnccttttttttttttggtagaaacagggtctcattctgttgcccaggctagtctcaaactgctggactcaagtgatccttccaactcggcctcccaaagtgctgggattacagatgtgagtcacaatgnccagcatggattgtccttttcagacccagaccaaagaacaggacttatttgtcccaagaccaatctaggnaaagtataagctgtgttgtca

SEQ ID NO: 571879 - DNA, 286 bp, Homo sapiens
ccgagatgctcagtagactgactcattgaccatcactctcctactcataaaggaacaacgccacagatgaactagacggacacagcaccagtagccggaaggagcagcaagggcaagtgagcagagcaaaggaatacataggcagcgtacaaaagcgcacggacgcaagacaaggcaggtccgtagcaaatcaacgatagccgcgacggacaagacgaagagccggaagcaacatcgaacacaggacggtcacaaccgacgacaccatcaaaacatccacaagtaa

SEQ ID NO: 571880 - DNA, 419 bp, Homo sapiens
ccattaaaataacatcaaattgatcagaaatacagtgtagacattgttaatgttgtaaatgactatcgtaactattgaaatgacagattttttaaaatggaatatcgacataggcgtacagaggcccatttatcagcaaccatcagtcctgtgttccaatggcacgttgtgttagctaatccaagtgtataattttagaaggctaattgatcattagaaaacctgtttgcaattatgttagcacagataactgttctgattaaagaaacaataaaactggccttcttaagactagttgagtatcgggagcatcagcatttgtgggttcgattacaggctcaaaatggccagaaataagaactttcttaaactcgtcagtctattcttgttctgagaaatgaaggctattccgtcgacgc

SEQ ID NO: 571881 - DNA, 262 bp, Homo sapiens
gatatgaacacatacatacacatatgtacacattcatagatacacacacctcaacaataacgttatgaaaacatcaacaacaacgttatgaaaagttcaacaacagtgttatgaatacactcattcatcactagtactgttctcctgaacatgatatgtgggggggaggggatctatgtatcatgacctctccacatctgcccgcagactacccctttttcttctgcaccacccttttccgtaccctcagtgcttggcagtg

SEQ ID NO: 571882 - DNA, 855 bp, Homo sapiens
gttgggggtcaggtggaaggatggatgtagttctcaccgggggtttcttatctacagcttacaccattatagtgatcacagctagtctgtgaagtggaatttgcatgcaatcagcattcactcagagccctgtgctattaatagaacaacatgaaggaatcataaatcagcctttgctcaggattagactagcaagttctgtactattacaaagaaaaattcaagtggagaacaagaaggtgaatgctaaaacaaatctctggcttccaatcaaagcttcctggccaggtgtggtggctcatgcctgtaatcccaggtggatcacctaaggttatcagttcaagaccagcctggccaacatggcaaaaccgcgtctctaatcaaagtacaaaacttagccaggcatggtgtcacatgcttgtaatcccagctacttgggaggctgagatggaagaatcacttgaacccgggaggcggagattggcatgagccaagattgccgcccctgcaactccaggcctgggcaacagagtgagattccatcacaaaaaacacaaaaaacacacacaacaaaacaacagcctgagcaacagtggccccgaggaaaggctataaaaaaaacaaggataggaacacggggcaccacaaggaccggaaacatggccataccgaggacacccaagaggaacacgcggggtaacgacaaaagacgggtagggagacgcccccccgaaattaaacaacggcgcggcgggccaccacaggcgggtctcgaacaacacgccaaaataagcacaggagcgaatacggcgagcttacaaaagagagtacacagcgaggcagcatacaaataac

SEQ ID NO: 571883 - DNA, 560 bp, Homo sapiens
gggcccccgccccgttgaggttgtctagtcccccgctcggagccctgccgtcccagggtcccctgccagtcggtcccggttttcggacccctagaagcaccagcgaccagctttggccccactgccaacccggccaatggtctcatcaaggtgaacgggcggcccctggagatgattgagcccgcgccacgctaccagtaccagctgctggagcccagttttgcttttcggcaaggagcgatttgctggtgtagaccatccgtgtcccgtgtaaagggtggtggtcaccgtggccccagatttatgctatccctccagtcccatttcccaagccctggtggcctatttcccagaaatatgtggatgaggcttcccagaaggagatccaagacatcctcatcccgtatgaccggaccctgctggtagctgaccctcgtcgctgcgagtcccaaaagtttggaggcccctggtgcccgcgctcgctacccagaaatcctaccgataagcccctcgtgactccaaactcacttgtataataaaccgtttttgagggattttta

SEQ ID NO: 571884 - DNA, 139 bp, Homo sapiens
gtgattgtttccatttgatgacgacgcttcccgttctcatgccttgacggtgccatggaatttgccatgggtggaatcatatggaacatgtaaccatgtagttgaggtcaatgaagggtgttattgatggctacaatat

SEQ ID NO: 571885 - DNA, 310 bp, Homo sapiens
  misc_feature (304)..(304): n is a, c, g, or t
agatcctctgtgactattgtggagaagctgtctatgtatctgaatttaaaaagccaacttttctaatatcaaactccctgctggattaattctccagtttagatccttcaccttccttttgctttaagttgtcatataatgacattgctttttctggaatcacattggagtctacagctatggctttttttcgttagacccagggacagattggaaaggtatgcctttcttacagcaaccctgcaccctacataaaagctgaattttcaatttgataaaaatgtattttgcaacaaatagtcangcagca

SEQ ID NO: 571886 - DNA, 229 bp, Homo sapiens
  misc_feature (168)..(168): n is a, c, g, or t
  misc_feature (215)..(215): n is a, c, g, or t
gaagatcgagctctttgcagacgttgtgcctaagacggccgagaactttaggcagttctgcaccggagaattcaggaaagatggggttccaataggatacaaaggaagcaccttccacagggtcataaaggatttcatgattcaagggtggagattttgttaatgganatggtactggaagtccccagtatttacccgggggccaattttgcagnatgaaaatttaaaa

SEQ ID NO: 571887 - DNA, 1024 bp, Homo sapiens
gctatattggacaggtccggcttcgcagcagaagtggtccgtgcgacctgcgattagccatagagtgccatccgcgtgatgtcgagaagcccgcatcgctccgatgactgagagctgttgccaagtgaccgcttcgtgtgaaagccgtgcgagggcgacgaaaacacagactgggtcacacctcgtataggtttctcctctcggcgcgttaaccagaagcgttgaggcctctgcgatattcttttagaataggcgcagtcattacagtgtgagaaggctgaatctgggagtagagcgctacatatggtgtacctactgggtgatctcccaggaatgtatactcccctgtgtgataaagactgatgccttgtctgcgctctttaatgaaccaaggaggacgcttgtccaggactctatgtagctggatgtcactgcagccgctcacgaatgcacgtcatacgtggggccacggccgtagatgtaattagcagcacgcaataacctgtgcgtctgttgactgtgtgaggtgttcccccctgtaaatacggtctcatagactcagaagttcacatcatgaatgccctgacagcaatattttagcgcggggggccgtgaaattaaactgagctgatctagaggctgcactgagtaatgttgcagtgctgagccgtttcacgagaaaaccaagaagccaatgcgacaccgggccccctcaaccgagactgaatgaatggtgaacagcacacgttcaggctgacaaccaattggtgtgagccaccaggaaactaaggcagaggtgacccacaatgaacgacggcgccgaagcacgacagccgggaagcggcgacaggcaagccaactaccgcgtcgggcgccaacgcctagacggaccaaccgtggccaccagccacacgaacgcaacggacagcacactcgacgacaacgctaccacacaaacacatgaacgcacacacacaagaccttactatcacactacgctgttaccccaccacccccacaaaca

SEQ ID NO: 571888 - DNA, 102 bp, Homo sapiens
gtggtgagggtcatggtgatggtgatgatgatgatgagtggggatgattatggtgatggtggtggtgatggtgattgttgtgatggttgagggtggtgaaag

SEQ ID NO: 571889 - DNA, 105 bp, Homo sapiens
tcggcccatattctgggtacagaatagactccgtctcacataaaacaaacaaaacaaaacaaaaagcacaacacaggtgattagggattacagtggaaggaactg

SEQ ID NO: 571890 - DNA, 464 bp, Homo sapiens
attactataaattacgatatttaatatggcacaattcacatcatttagaatccagcatagaccacgtttggtctatttggaatggccagtgaagggccaccttttgcatgacggattgactggccccttgactagtagaccatacttttctttcacaggactgttcctaacaaatgacaacagtgtggccaaaatcactcccacagctcccattgttgctaaggtgaaaacccttagagaggctgtatcaggcttatctgtggtgcctgaatgcgtccgtcgaatacttctctactttttttctttattagtcttgctagcggtctatcaattttgttgatcctttcaaaaaaccagctcctggattcattgatttattgaagggttttttgtgtctctatttccttcagttctgctctgattttagttatttcttgccttctgctagcttttgaatgcgtcgg

SEQ ID NO: 571891 - DNA, 438 bp, Homo sapiens
tgctccaagagagttctgcaagttcacatgtctattatgaagtctttctcaattaacagacgtcaggcccattacagcatctctgtgccattcgatgtattctgttgcacaagtcataggaatatcagctgccatagccaaaggtcgctgcaaatatggtcacataaaagtgttatccacgaccgcaataatgtctccatgcttatggacaatatgtgcacagcctgcaatgtcagtctacatgtgggtggagtttgtaagagtttcgatccatacaaggttggttcagggtgtgagggctgccgctagtaatttaatcttggatcgatcaccgatagaaatcttgaatgcgaatccagatgccacaggactgaagtacctgtgtgagcctccatgcacgtgatccagaccaataattcggtgtcctgcttgtaaaag

SEQ ID NO: 571892 - DNA, 1027 bp, Homo sapiens
gtcgcccacgcgtccggtgcaagtaggtctgcttgagcttgtgtgtgctgaagggacagccctgggtctaggggagagagtccctgagtgtgagaaccgcttccccggtccagccctcccagttcccccaggacggcattcctggtccccgacgcaaccatggctgaagaacaaccgaggtcgaatgtcgagaaggctgggcacgtgctggggccaacatggaagaactgacacatctcccagagacatgtccaagggatactgtggctcacgggagtcaccatacgcaagtaaacaccgacagacaaccaaaaggcggaccgcagacaggcaacaaagcagagcaccagagcgagagcagctaccaatcacatgccagcatggcacaagacggtgcacacacgacaacaacaagatagcaggacattgtcacgagcaggccagacagccacagtgcaccgatcccaagcgtacccccaggcgtggcagaatcatgacaccaccaggagctccaaacaccagagtgggacaggacagatcatagcgcacaagattagaagcacgtacacgtcccagagactcagaacccaggcaaaccagtgaaactcaaggaaagaaagggacacaaatgaaaagaccgtgacaggctaaagaccgaacaatagacataacagaccgacccagacagaaggagtgacacaagacgccagaagaagacggggacactcaaggaacgaacaggaaggcaccgaggtccccggcctgaaggaaccggggccaagcacacacgacagcgagagaagcagaccggatgcgcgacacggagcagcacggaggcggagatggacacaacacccgaacaccgcgcaagccagagggcggacgacagaaaaagcgacgcacagcgcaaggaccgaacgaaagacacacgtggactgaccgcacccacgcagcgagacgcgcccagcagaacgacgccaccgcgacagaccacaacaaagcacgagccgcacaccgccgccagacc

SEQ ID NO: 571893 - DNA, 152 bp, Homo sapiens
cggatcttttcgattggcgggcacttatgcacgcttaactatcttaacaagcttgaggtgccagagattgaagagttcaaatctgacaaggatgttgatgtgggataagagaattcgtctgctccccaccactaagttgcccgccaatcgaa

SEQ ID NO: 571894 - DNA, 275 bp, Homo sapiens
  misc_feature (12)..(12): n is a, c, g, or t
atctagaggatncccatgtggggcatcacgggcactgagaggaagcaatattaaggtaaattcagagctgaacccttcaaccggaaatcgatcaagggaacagagttcagaggcagcagaaacgggagttagtgaaaatgaagagaacccggtgaggattatttcagtcacaccggtaaagaatatggacccagtaaagaataaggaaattaattctgatcaggctacccagggcaacatcagcagggatgcccaacaggggggtaccgagctcg

SEQ ID NO: 571895 - DNA, 129 bp, Homo sapiens
tggccaaaaaagtgctttaatgattataaagtgtccaaaatatactgggcagaaaataagcggactctgagcgttttctctctttcaaaccctataggattattgcaggggtgtgaaagagcatgtgtg

SEQ ID NO: 571896 - DNA, 577 bp, Homo sapiens
gacctgtttcggcgagcgcacgccttgccgtcgggccgtataaatgctttggctacccacagactttcgccagatgagaccgctgtccagggtactggctcctcatctcactcgggcttatgccaaagatgtaaaatttggtgcagatgcccgagccttaatgcttcaaggtgtagaccttatagccgatgctgtggtcggtacaatggcgccaaagggaagaacagtgattattgagcagagttggggaacgtccaaagtaacaaaagatggtgtgactgttgcaaagtcaattgacttaaaagataaatacacattggagctaaacttgttcaagatggtgccaataacacaaatgaagaagctgtgtgatgcactaccaatgctactgtactggcacgctctatagccaaggaaggctctgagaagataagcacaggtgctaatcccgcggaaatcaggagaggtgtgactgttgctgttgatgctttaattgctgaacttataaagcagactagaccttggaccaccccttgaggaaattgcacacgttggtaccgatttttgtacggtgccg

SEQ ID NO: 571897 - DNA, 917 bp, Homo sapiens
tctggaatctatgaataacatcggtttctaagttatgagttgatttttaactactgggtttaggccaggcaggcccaggcctggtttcggggctggtgccgggctgcctgtctttggttttacttccttgtttttctctcaaaacaggacaagagaatgattcaacgaagaatgaaataaaaattgaaacagaatcgcagagctcatatatggaaacagaagaactttcatcaaaccaagaagatgccgtgattgtggagcaaccagaagtgattccattaacagaggacaagagaatgattcaacgaagaatgaaataaaaattgaaacagaatcgcagagctcatatatggaaacagaagaactttcatcaaaccaagaagatgccgtgattgtggagcaaccagaagtgattccattaacagaggaccaagaagaaaaaagaaggtgaaaaaggtttggatgacatacttactgcatttggatttagactcaaccacttcacatcaggtgcaagaacttccagatcctactgattgtgcaaaagatatatccatttcgatttggatttcaaatctccaggcgaggacacacctaggatgcctgggaaacagtgaaggctccagtgacctagaaaatactccaggtcctgatgttcgaactgaatagtccggttgacaaggtaaatgacgcagcagagagtccacaagaagatcactattagcatggcaccagatgaagcgacggaaccacagaaatggacttaatgacatctcagatcgcaagactttactgggtctggggactcgggaaatacagcacagcgtgagaaggtggggtgggggaaggcaccctggaagcgggaacttaccaatctccggttggtccgcttcgaaaaaaaaaacaaagggggctat

SEQ ID NO: 571898 - DNA, 291 bp, Homo sapiens
gggaaaaatttttattttatttaaaaataatacccaaaataaagagttcccccttccaaccttttgaattggaaccctataacccttgaaaactgaaagaaaactttttgcgggaaatcctttgaattgggacaacccaaaagggcctggaaaaaccgggaccgaataaaataaaatgggagggttgcctttgtaaaacaagaccgaatgaacctgattgggggggccgcaatggggggttacctggggacttcataaaaaactttgaaacaaaatggaaccctgttggaa

SEQ ID NO: 571899 - DNA, 333 bp, Homo sapiens
gcaggacagctatacgggccgcgtaaacagacagagaaacagctatagcagactgtctgtatcacaccacagtaaccctcgtatgaccggccatcgctcatccacaccccctgcagcttcaccgggcgcattctttctcataatcgcccacggtcttacatcctcattactattctgcctagcaaactcaaactaggaacgcactcacagtcgcatcataatcctctctcaaggacttcaaactctactcccactaatagctttgtgatgacttctagcaagcctcgctaacctcgcctattttacaccaaccccgccgttaggccgatctga

SEQ ID NO: 571900 - DNA, 409 bp, Homo sapiens
aaggccgagtttgtagggtgagtctagattcttgatataagtgcggggttatgcatggtggagagaataaacataagatgagtgttctagtctatagtagagcatactgacaggctgcttatgattgtggttcgtctaattactggtcatgttgttttagaacactatcaacttcagttttttctctttgtacattaatagtaaatttgtggggagatctgtcaatacactgttcattgtcgcagtttaccctcaagttttaagacccatcgatgagttaagcctgaatcggttgtaacagtgaatactccaaagtggttatattctaacttcatcattgtactgtcattgcatcatatgtatcattgctccctcattgcgtcatatgtatcattgcatatgactgtct

SEQ ID NO: 571901 - DNA, 208 bp, Homo sapiens
ctttttgtcattccccaatgcacaattgcatggataatgtttgactgggaaagaggaagggtaggaggatgcatggatgagtggctacagtggatctgctggcatgtatttgataaatagatagaagcagtcatcttgaagcaacttcaagaattgtagccttgtacccctatgagacttgtagataacagatccatggaaacattta

SEQ ID NO: 571902 - DNA, 323 bp, Homo sapiens
gggggggccccgcttcccccggggggccccccggttcaagggttgggccagccagccctgggtgggggcgctttttgggcccttggggaaaggagggcccccaaggcccccctttttccccccaaaaaaggtccccgggggtcccaggtggccggggtttgggtttttcccgggagcccccccggggggggggcccccccccccctgggaggggggggggggggggccctttctttccctttggaaaggggcccccccttgatggtttccccccaaccccccttttgggggggggggttttggtttaaaaggggggtttttta

SEQ ID NO: 571903 - DNA, 421 bp, Homo sapiens
cttgtatgaagaaattatgaactattttggttgcagacaaaaagtctcgctctatcaccaggctggagtgcaaaggcccaataattgtccactgtaacctacagctgcggagtcaagcgattcttctgcctgcagcctcctgagaagctgggactacaggcacatgccaccatgcccacgtaattttggcatcatgagaagagatagggtttgacaatgctggccataatggttgcaatctcttgacctctcgatccgcctgctttggcctctcaaagtgctgggattacaggcgtgagccaccgggcccggcccctgagggtctaatgttaatagaacagatcaacactttagatagtagccactaccataaggaggacctctgctcaaactggtatttacaatgacgtcccttatcaga

SEQ ID NO: 571904 - DNA, 900 bp, Homo sapiens
  misc_feature (500)..(500): n is a, c, g, or t
ctggggtggaaatatggtgcgcgcccggagggggcgccgtttcctatggtggaagggatgtgcgcccccccccccctgggggttgtgcaccccctggtgccagggaaggacccccagccaaaggttatagtaatggttgttttcggcgcgccgccctgtcgtcccccgcacttgcgccagctgccgctcccccttttagggagtgtttgctacctcggcgcgctgcgcttcgcgtccagcttctctcgccgcaaagcacagaatacttgggctcgagctcgcggtgagatccctcgccagccagagcactcggcaactcgctcgccgggggtgctgttggggaacgcacctcgcgcggcacgcgctctgtcataaccccgcgggtgtcttctctggacaaaaggggaccgcccgcgagccagaaccccacaccgccttcactgcacagcgcagccagtctccctcgaggtcgctgtacatctccgggccaactgcacagnggcatggctcccccacggagatgagacttcacttgcgcagagacacccctcgctggctcagtgacagccaagacacacacacaaacagattggggaggtggaaccgcaccacagcgcgcaacacacgcctcgcacggtgtctctctgtggggatagagaccggcacttggtctcggggcgacacaaacccgtgcgccacagccaccaatagacccgcctgcaagcgagggtccacgcacccccacacatgtggggaccgagataggggcactctctccgatgacacacaccagggcgacgagagtggacactagcatcactacaggctgttcaccatcacttgctctggcggcacacccccaaaaacagcacgtcccacccgtcgggaaaaacaaaacaa

SEQ ID NO: 571905 - DNA, 326 bp, Homo sapiens
cccagcccagctttgttgtgtagcacctgcttcaggcccggcggccgcggcagaccctccagcgtgtctcccgagtctggccgcttctgccgcggccgtgcctgcacatgtactggagggaagtggcgctggcacacgcaccgggtcaccttcatgctgctccgggccgccgtggaccacaccatcgggtagaatctcttgttcctgcagtcttgtgtgtcctgccacacctgtacacttcctgttcttcgaccgcggttagtctgccgtgccttgtcgtccggttactcgcctgtcatggagccctcgccgaaccgcgacaagca

SEQ ID NO: 571906 - DNA, 781 bp, Homo sapiens
ttttaaagtagagatgggatttcaccatgttgcccagcatgctctcaatgtcttgacctcgtgatccaccctcctcggccccccaaagtgctggaattacacatgtaaaccaccgtgcccactcctggagtgcattttctttttttttttttagacagagtcttgctctgtcaccaggctgagatcgtgccatgttggcactccagccgtgggcggtcaacaagaacaaaactccgtctcaaaaaaaaaaaaaaaaagaaagagaaaaccaggtgtggtggcctggtggatagcgggcctcccgtgttctcgtgaatattcacattcctgtgttacaagtcccttcccatttgttgtaccagggttttggtttgtgtgcgaccaatagaaatatgtggcagaagtgagggtattgtccacttcggaagatccgggttataaaaagactttggcgcgccaccatcttgggctcaatctctttggggcttatctctccatccccactttgggtctgggaagaaaaccagtttgccatgctcaagggcgacagttcagcggtgacaaacctttggccagcaaccctatgttgatggttgctgaccctctttaaaagagtgaaaaagccttctcagaaaggggtgtccaccagcccgggtcagggttccaaatgacagaagcccccagggaaccattctgatggcaccttatcagagatggtgagccagaactcatccagtgaagacagctcactggagggtccccaggactttgtgaactgatc

SEQ ID NO: 571907 - DNA, 224 bp, Homo sapiens
gacataaatgtgatcctataatactctactgcttatatcacctttaaacgctttgcatccttcacagggtcactgtataccagcttgatctttggattctcctctgaatagcctctcctttctgtgtacatgcctcctattcgagaccttaaggtcacccaaagagaaacattgcttaccacccacttttccttgtgctcatatttgttctctctgtctggtag

SEQ ID NO: 571908 - DNA, 843 bp, Homo sapiens
  misc_feature (72)..(72): n is a, c, g, or t
  misc_feature (76)..(76): n is a, c, g, or t
ggtaaagaatacagagctcttaatgtttctacaatgatttcagagctcttaatgttgcttagatgagggtgnctgncaagtacaatgatacgagatgccacactgggaagagatacgttcagacggactacaaatgaaaccaatggagtggacattgtcctcgtcgtggtagaagcagcgatgagatgaataagagtgctcgtcctccaccaaagatgtgttagactaggaggcaaatggagtgaatcagtgcatctataggcgcgctccaatggggtatcaggggtcgtcccggccgtctatatccccgtcttccccgtcgactccgcggaggttccatcagccacggtcggcgcgtagccgagtgctgacccgggtccgaggagctgcaggtgtgactgatgggaatgaagtggtcaaggcgccagcaggcgaactcctgggggagctaggcccaaccatcttctccgcgggatcctggacaagagcctcccagctgacattctctatgaggaccagaagtgttgcttgtgttccgtgatgtggcccctcaggctcctgtgcacttcctggtcattcctaagaagcccattcctcggattagacaggctgaagaagaagaccagcagcttctagagacaccttactcccttgttgggtcaaagcagacaggaaaggctgagggctgggaagatggatcaccgacttgtgatccaagatgggaagcttgggtgccccactgggtatcatcttgacatccatgtacttgggggccggaagtcaagtggcctcaggtgaactggcattgttaaaggaacagatctggtgttgattgaagggccc

SEQ ID NO: 571909 - DNA, 561 bp, Homo sapiens
  misc_feature (72)..(72): n is a, c, g, or t
  misc_feature (76)..(76): n is a, c, g, or t
  misc_feature (135)..(135): n is a, c, g, or t
  misc_feature (149)..(149): n is a, c, g, or t
  misc_feature (156)..(156): n is a, c, g, or t
  misc_feature (420)..(420): n is a, c, g, or t
  misc_feature (483)..(483): n is a, c, g, or t
  misc_feature (504)..(504): n is a, c, g, or t
ggtaaagaatacagagctcttaatgtttctacaatgatttcagagctcttaatgttgcttagatgagggtgnctgncaagtacaatgatttctaaggtcccagtcttgcttgtacttgacagtcaccctcatctnaagcaacactgggnaccttangaaactcattgtagaaagcacaggttttggacaaggaccaataccatgtctctaagccaactttaattgcttaaaagacatttttatttagttgaaaaatctagttttttttgtaaactgtatcaaatctgtatatgttgtaataaaacttatgctagtttattggaagtgttcaagaaataaaaatcaacttgtgtactgataaaatactctagcctgggccagagaagataatgttctttaatgttgtccaggaaaccctgngcttgctttgcccgaagcccctaaactgacacagcggacaaagttcagctttttcagagccangtgaaggagccacgtgaatgngcctagaactgtgcctagttcctgtggccaggaggttggtgactgaaacattcacac

SEQ ID NO: 571910 - DNA, 396 bp, Homo sapiens
aatactaatactctccccgagttactccctagctggaacagctaataatactgtccagtggttcgcgttctggccacatccaccaccatgatagttcgggtaacagaacaccatgttgccacactgagatagacacagacagaaagtgtgtggactgcgctgggccccagatggacgacatttggccagttggtggtactgataacttggtcactgtgtggcctagtgctcctggagaaggtggctgggttcctctgcagacattcacccagcatcaaagggctgtcaaggccgtagcatggtgtcccctggcagtccaatgtcctggccacaggaggagcaccagtgatcgacacattcgcatctagaatgtgtgctctggggcctgtctgagtg

SEQ ID NO: 571911 - DNA, 304 bp, Homo sapiens
gtttttgggttgggaagttttactggggtttgccccaaagccccccccccatgggcccctgaagtaaagataggggacccaaccattttttggggaactgtttccttgggggccaattggggtaggcttttagaagtttccagaagggttttttttttgtttaaaacaaccggttggtcttttttttttgttgataacccctttgggcagggggggggggtttgccctgttttttcctgggggtaccaaaacccccccgtcatgggcgggggttttcaaataaagcccttttgttgactcccca

SEQ ID NO: 571912 - DNA, 174 bp, Homo sapiens
atgtttaagtcaaagcatacttcatccatataagttcaaacactgatttactttgtatataattaatatttactgttttaaagtcctgccacaaatgacttgtctggtttaaatttcttcagtgccagtgcttgttacatacactaggatcctttcactttttgacatgtttat

SEQ ID NO: 571913 - DNA, 1217 bp, Homo sapiens
ctgggcgcctggggcaatgtgccctggtcataacggcgctcacgcccatgacggatccccgatgtgtttccgcacctgcctgctcatcgccatcacccgcaacccggtgttccctgctgctttatcaagattatcgaggttacacaatcagaagcttggttgagctgctgagaaggaaagtacgtctcgacccagccttatgtcgcgcgtctttctaaagagcagatgacacgcatgagtcggatgtggtcgagagcctggactgaaatctaccacacggcggacgtattgcccagatccatgagcatgccggaccttggggacaagctgcgcatgatcgtacatgggacacagaagagtccatatcagccagaccgctggcaggtggagcccgaggagccggaggcggagacacacagcacaaagccccgcaaggaacggtcacaagccggccgcaacgcaacggacggcgcgagggacgacctcgagcgcccaggcaccccggcggagctggacgatggagcccaaccctgagatcccggctgaacgtgctaccatggtggccggcaagcagaaccggtaggccccgcacggactacccaggcacacccgcaggaccgctgaacaggccctgactggccgcagaaccgagaaacacaccaacggggacaataatggaccagcaaaccacctctacaccgcaccgtccgggatgctggcccaacccgtaagcaccacgacagacaccacacagaagatgacaggcaacaactaccccccatagataccactgtcgcaggaacatgtgcccccacggctacaccgcgcggcccgcgaccacacgatgaatcagtcaaggacccgccagggaaagaacccgcagctaaccaacacgcgcgagcaccagggtccctacctgcttcaaataacaaactaaccaacacaacacagctactactacttacctactcattagcatctacaacaaacataaaccccccataaaacctcgaacacacacacttcaaattaaacacaaaacaatctatataatcaacaacaaccactaccaccaaaaccaaaacacgcagaacacacaacctcaccaatccattctaccatcctgaaaaaaatcacattagatgacagtatcgtaaatctacagcaaatagttccaactaacacagtactccctcacttcaacataaccaccaact

SEQ ID NO: 571914 - DNA, 556 bp, Homo sapiens
  misc_feature (252)..(252): n is a, c, g, or t
  misc_feature (290)..(290): n is a, c, g, or t
  misc_feature (358)..(358): n is a, c, g, or t
  misc_feature (421)..(421): n is a, c, g, or t
  misc_feature (462)..(462): n is a, c, g, or t
  misc_feature (474)..(475): n is a, c, g, or t
  misc_feature (479)..(479): n is a, c, g, or t
  misc_feature (493)..(493): n is a, c, g, or t
  misc_feature (537)..(537): n is a, c, g, or t
aatccagcaaaacattacggtacagcaatctctgagcctcatcgagatgcccccctcctcctgggagaaatatatggccacgtcttcaaaaaccacatgaccctgtgcagggtttatttctgccatcgccaggggaccctgaaggaagagggaaaccgtgagaaatgggcaacgatgggaagatcttacaggcagagttggaccaccatctcttcttcttaccctaaagcaaactgatctcaagttgattgnataaactcagctcctccgacttcactggtggctcttancagcactgtgactctagaaaagaactgaacctgctggagcttcatgctctcatctgtaaatagggtgnaagaatggctcccctcataggactcttaccggggcaaacactcgtgctcatcatatatatcanctattactggtcttggaataatgggtactatatgttttcangataaatgatgnngtanaaattcaaaactgngggggtattttaacttttaaaatttagaagagactaaaatttcntgggtggtgtaatataagc

SEQ ID NO: 571915 - DNA, 324 bp, Homo sapiens
  misc_feature (273)..(273): n is a, c, g, or t
  misc_feature (276)..(276): n is a, c, g, or t
  misc_feature (296)..(296): n is a, c, g, or t
  misc_feature (298)..(298): n is a, c, g, or t
gttcattctttgctgtttttgagaattagtacatggttgcagttttaacctacatattgttaacattgttaaatatttcatcaatttatttttgtagtttgtagttttgtttcaaggtgaagtatttggtttttgttgttgtttttttgacacaagagtctccctctgttgctgaggctggagtgtagtgctgcagtctctgtcactcaacctccgctcccgggtacaggagaactgcttgaacccgggaggtggaggttgcagtgagccganatngtgccattgcattccagctngngcaatagaatgagacatacataacgg

SEQ ID NO: 571916 - DNA, 158 bp, Homo sapiens
ctccaaatgcaactgagcagcaacccacaagcatcaaagactcactcacaacttctgaacacaaactccatggatgaagctgtttatgttgtttcctttatgtgtaacaagatgatatctgaaccagagagacttggaatgtctgactgacttctatt

SEQ ID NO: 571917 - DNA, 427 bp, Homo sapiens
ggccctgagcgagatcagcatggctacaacacatcattacctgggtaaaactaaactggctaattagcgcgcctgctgccttacttggatgtggtagccgtgaatcatgctccctctgcggaatcgaaccctgattccccgtcacccgtggtcaccatggtatgcacggcgactaccatcgaaagttgatagggcagacgttcgaatgggtcgtcgccgccacggggggcgtgcgatcggcccgaggttatctagagtcaccaaagccgccggcgcccgcccccccggccggggccggagaggggctgaccgggttggttttgatctgataaatgcacgcatcccccccgcgaagggggtcagcgcccgtcggcatgtattagctctagaattaccacagttatccaagtaggagcgcaacaccggt

SEQ ID NO: 571918 - DNA, 1206 bp, Homo sapiens
cctaccactttcgctatcttgaaaactaggacctaaagctaactcttctgaacaatgaggcacactgctattactatgcacagctgacaaagctccacgcacgaactcctttcagggcctgacactcgctctcaaactctgctcattcctgacacaaggctgactaacaacagatggaggcacaaacacattcaggcagacttccagcaagcaacggctgcaacacactgcttcagcaactcctggcttctaacgcaactacagcgacgcctaagcacacacagacacacaactcgactgactgccctgcactactgactgcttacctaaacctctcttcctacacttacaaacgcactggctctctactgccactgctactactgccccactcaacttctctcgctacgctctcagacccaactagctcctcccaagacccgcacaactcctcactacgcactacttctctatactgcctacctggcactcctactacctctccttccagcgagccctctcatccctcttgcacaggcactccttcaaaccctctcccgcacgcaactcggctctccggcacaacacctctccgcaagcaactcccacttgcaacacttctactgacttacacctctccctcccccaaccttcacttacagcaccccaccgcgcgccacacaacacactcaccccctcacttggctcacaccacaaaccccctctctctccaccacacttgctccaacacacctcacttcctcgcacggcaacctcaccgcctcttcccactaacccacaactccgcctccctctcacaagccctcactcctcacacacggcccccctctcaccactccctacccccttccacgtccttccctttccctttcctcctccccctctctccggaccccactcacccctctactccctcttgccctcgccgcaccccccgcccccactccacctcgccctctcccctcgcgcccccacgcgcagccgctctcccactcctctcgcccaccttcgccctccccttctcctcgcgccctctcacccgctcctcctcgccacccatctcccacccgcggcctgtcgctctcacgactccctcctcacgcgacccctctcccctcgcgtcgcgcccccctcgctctggcgccctctcaccacgcgcatctcgccctctcgtggctcgcccgg

SEQ ID NO: 571919 - DNA, 227 bp, Homo sapiens
ggctacatggtgggtctcgcttagcacagagcccagtgccttggccttgtttgtacatggtatacacctggtgaaagccatcagtgttctagtacctgcggcgcaaacagctgcacgtggtgcacagaaccgaggtaagtctggctgcgtggtgtcactgtgacatccactgcccagctgacttcagtggggcgctctgcacacgcagtcacacctgtggttttccc

SEQ ID NO: 571920 - DNA, 295 bp, Homo sapiens
tgactcactatgaggtagctgcaccagcaggtgacgcggctggcgcgattgggttctttcaccgccacccagttggacgcggcccacggcgcctgcacgttgccgccctgcaccaccgtcgccgcgaccagttccatggcggccgaatgccgaatccggtgccggttgcgtggcactgccaacgccgtggatgcgcaatacagcctccgggttctgccaggcaggctgtcccgacggaccgatgtccgcaacgccagcgacgatgcgcccacgcgcccggcaccggattcggcat

SEQ ID NO: 571921 - DNA, 302 bp, Homo sapiens
  misc_feature (62)..(62): n is a, c, g, or t
  misc_feature (65)..(65): n is a, c, g, or t
  misc_feature (108)..(108): n is a, c, g, or t
  misc_feature (195)..(195): n is a, c, g, or t
  misc_feature (200)..(200): n is a, c, g, or t
  misc_feature (249)..(249): n is a, c, g, or t
  misc_feature (253)..(253): n is a, c, g, or t
  misc_feature (286)..(286): n is a, c, g, or t
aggagaagacaaagaaggcagagagagagctctcggagcagattcagagggccctgcagctngtngaggagaggaagcgggcacaggaggaggccgagcgcctagagnctgaccgtatggctgcactgcgggcctaaggaggagctggagagacaggctggtggatcagataaagagccaggagcagcttggctnggaanttgcagaatacacctgccaagattgccctcctggaagaggcgcggagcnaagngaaggatgaagtttgaaagagttggcagcacangggccaaaagaagccc

SEQ ID NO: 571922 - DNA, 102 bp, Homo sapiens
cggccatgcacagttgtatcagttagtggagaacaaaacataattttatgcacatatacatgcactatataggtaaaatgtccatcatcctgtaaggtgaac

SEQ ID NO: 571923 - DNA, 117 bp, Homo sapiens
aggtggtgtggcagtaggctggcagtgcagtgtgactcaacccctagcctgagaacttccattggcagtgggtgcagccgaaaaaggcaaaaaacaaacaaaaacaaaaacaaaaat

SEQ ID NO: 571924 - DNA, 412 bp, Homo sapiens
accgccgctatccggtcaatttttacatgtcacagatactgacaaccatataaatctttaatatgccagtttctacctgaaaaagctccttctgggccaagcgcagccgctcacatctgtaatcccagcactttgggaggccaaagtgggcgaatcaccagaggttgggagtttgagaccagcctcaccaacatggagaaaccctgtctctactaaaaatgcaaaattagctgggcgtggtggcgcatgcctgtagtcccagctacttgggaggctgaggcaggagaatcgcttgaacccgggaggcggaggttgcgttgagctgaaattgcaccattgccctccagcctgggcagcaagagtgaaagtctgtctcaaaaaaagaaaaggctaagatagttcattgaaccgg

SEQ ID NO: 571925 - DNA, 244 bp, Homo sapiens
acccagcgcggaaaagtcaaaggttcatgacctacataggtcttaccattgacctaagatcaatttcaactatcatagcccagtcagggagatatgcttcctagaaaggcatctttggtcaggggattcgcctcaaggttaaggccgccattggaagatgaaaaattgcactcccttggtgtaggcaaaaaccagttcccattggtgttgttgcctataataaacactttttctttttaaaaaa

SEQ ID NO: 571926 - DNA, 88 bp, Homo sapiens
acggccgtgtattactgtgcgagagagggtatagcagcagctggtactgcctggcacttcgtcgacccctggggccagggaaccctgg

SEQ ID NO: 571927 - DNA, 165 bp, Homo sapiens
ctctgaggatctgtaggtctcttctcactgagttgtgtagtcatctacataataaatcaaagaggagcagttacatgactcatcaggcactggagatataattgctgtcatgataacagaattgaggggtacggatatttgagttatctggagaaaaacatctct

SEQ ID NO: 571928 - DNA, 275 bp, Homo sapiens
tatctagaagaatccccggtgggccctttggtgaacgaagcttagtcaaggtatggtacttgcagtgtgctggggataatcctaagagtgggcctgatttattagtcttgcatctggccttaaggatgtgcaaggttcaggaaattaagggaaaagtcacttactaagcagggtgagtcagacctagtatggtctgggtctggactccatctcttacccggtatctcagattacgttagaagggggacatggaaacgttctggtaaaggattgaa

SEQ ID NO: 571929 - DNA, 241 bp, Homo sapiens
ggggagccaatgcctagtgaactccagctgtagcccaccagtaaaaatggagggccgggaaacaaaccggcccctggtattgtcaaacccccccaggctttatttggatccccaggcaaagccaagggaaggggtgattttttgaggaaaaagtgatttttaaaaaaggacttgtcccattggggttggacccatttgcccccaaaagtatgggaatttatattattaaaaaattttttga

SEQ ID NO: 571930 - DNA, 854 bp, Homo sapiens
  misc_feature (623)..(623): n is a, c, g, or t
ggaacggcgggctgtgtgtgggtatgtgtgtgtgtatgtgtgtgcggacgcgatgctgtgcagtgtgtgtgcgcgcgcgagtgtgtggacaaggaggtggcggcagctaagttatacgatccgcaactcttggactccatatgctatatctcttctgtactcccccagatctcatccttgggttggggctagtaggtgcgattgcatatttttgcgtacctttcttcatctacagttatactaaaaatcgtcttaactagattgttggagcggttcgaggggccgtatggccgggacatggctaggaataaagcggtagcaacgtgcaggagtcacgtgagcttgagcgcaagcgagatggcaatggaggacggagtgggtgggatgaggaaggaaggattgagacccgtggtacgttgacatggagaagcgagaatccaccgcgcatgggagggatcgaccaagagcttaggtcactctgactcagatgtggccgatgtgttggtcataatgggggaaagatcagagaggccttgaatatgattgacttgtcgaaatgcatagttagaaatgtgctgaggtatggctgaacctgtgggagtgtgatagtctacgcccttggncgcgccgagcttgtgctcccagatctatcaacagtaagacatcgtttgcgtacacagaatcttggggacgctctaagtggaattgatattgagaatttgtgctcgggagcgcactttgttgggcattttccctgggactaggcaagaaaaaatcgcttcctaactattccttaattggtaaccctacgagatcctggaggttggtaagagcaaaatattaaaaagaattct

SEQ ID NO: 571931 - DNA, 574 bp, Homo sapiens
gatgcttggttttccatggtttatttgtgccacattttcttaatccagtctattattgaaggacttttaggttggttccaagtctttgctattgtgaatagtgctgcagtaaacatacgtgtgagtgtgtttttatagcagcatgatttataatcctttgggtgtatacccactaatgggatcgctgggtcaaatggtatttctagttctagatccttgaggaatggccacattgtcttccacaatggtcgaactagttaacagtcccaccaacattgtaaaagtgttcctatttatccacatcctctccagcacctgttgtttcctgcctttttaatgatcgccattctaactggtgtgagatggtatctaattgtggtttcgatctgcattcctctgatggccaatgatggatgagcattctttcatgtgtctgttggctccataaatgtcttccttttgcaaacaacatgatcttaaatttagaaaagcccagaaacttcaccaaaaactcttataacctacatatgaattttagaaaatgataggacacataataagtatgcaaaaatca

SEQ ID NO: 571932 - DNA, 385 bp, Homo sapiens
  misc_feature (1)..(1): n is a, c, g, or t
natgtggacttaataggtctgaggtgtggatagggcaatggatgttataaaaaaaaatcccaggatgattcttaaattcagacaagttgagaacctctgaactagggaatgcaaagaaacatgtcacaaagtccctatcttttggtcaccattttttatggtgtctctacactcattcttctaaagatccttttatcttacatatggcatagaaagattatttggggaagatgtacaattagctgtagtgcgtaggttacatagtgatgtcattaagatcacaggttttacattcttccctcgggagtttacatatataatgtggttttgaattattagtattattttggccatccatgaaacttcagtgtatggtcgggcttgg

SEQ ID NO: 571933 - DNA, 583 bp, Homo sapiens
tctagaggatcccaagtctactgaaattgcacacacagcatctcttatgagtgacccccaatggattgctgtgcgcaggaggagacccgcattgttaccactcaggctgccaagtggcccacacagtctctacctttcctggggagctacggagcaggctctgggtttggcattttgcttctgtccctcgagtgaaatgtgcctctgcttcatttctggaggatcgggtttgtgatttttgtgattctgctttagcccaggattcgaggggtcatgtccacatttgtaggccatccagggagcagagagaaacttttagggccgtgataaagacaagccaagtggaaaatagcctgtgccctcattggcacacctggtgtctttatttccattagccctgattgatcaagcgttgctggtctgtgggcacttcacgctcccagagagaccagattggagctgtcctgttgaatctgcctgtaccagatcatcactggagagtgggagggggcgtcttgttagattcctaggtaacccctggccgcatttctaacatatcactttccagtatttcccaagaggc

SEQ ID NO: 571934 - DNA, 292 bp, Homo sapiens
  misc_feature (131)..(131): n is a, c, g, or t
  misc_feature (271)..(271): n is a, c, g, or t
ggtcacggcgccccgaaccctcctccttgctgctctggggggcagtggcttgaccgagacctgggctggctcccactccatgaggtatttccacacctccgtgtcccggcccggcccggggaagccccgtntcatctcagtgggctacgtggacgacacccagttcgtgaggttcgacagcgacgccgcgagtccgaggacggagccccgggcgccttgggatagagcaggaggggccggagtatttggggaccgggagacacagatcttncaagaccaacacacagattta

SEQ ID NO: 571935 - DNA, 242 bp, Homo sapiens
  misc_feature (162)..(162): n is a, c, g, or t
gttgcggaccataggcggtctggtcaggatcaacaactgtagatgaaaatattcggaaaaagaaattgcacctgtactgagcgtgtacagatcttttttctgtcattattccctaaagaaaacaatacaacaactatttatacaacatttacattgtatganggtattataagacaatctagaagatgatttaacagcgtacagcgatgatgtacgcaaggtttataggaaatactaacagt

SEQ ID NO: 571936 - DNA, 770 bp, Homo sapiens
  misc_feature (15)..(15): n is a, c, g, or t
  misc_feature (195)..(195): n is a, c, g, or t
  misc_feature (214)..(214): n is a, c, g, or t
  misc_feature (235)..(235): n is a, c, g, or t
  misc_feature (351)..(351): n is a, c, g, or t
  misc_feature (402)..(402): n is a, c, g, or t
  misc_feature (511)..(511): n is a, c, g, or t
  misc_feature (562)..(562): n is a, c, g, or t
  misc_feature (608)..(608): n is a, c, g, or t
  misc_feature (615)..(615): n is a, c, g, or t
  misc_feature (704)..(704): n is a, c, g, or t
  misc_feature (744)..(744): n is a, c, g, or t
ccgcctcccaggttnaagcgattctctgtctcagcctccctagtagctgggattacaggcgagtgtgaccatgcctggctaatttttgtatttttagtagagatggggtttcaccatgttggacaagctggtctcgaactcctgggctcgagtaatccacctgcctcggtctcccaaagttctgggtttacaggnttgagccaccatgactgtnctggcttattttttaaataanagctttattgaagaataatttatatataaaaaatttacccttttggaagtccaagccatagcaatcaggcaagagaaagaaataaaaagcatgcatataggaaaaaaaataaaaanatctctgtggggtaaaaaaaaaaagatcggattgttactgtgtctttgtanaaaaggaagatataaggaactccattttgatctgtactaagaaaaattgtttctgctttgagatgctgttaacctgtaactttagtcccaaccctgtgctcacagaaanatgtgctgtatttgaatcaaagttcaatggatttagggctgtgcgggctgngccttgttaacaatatgtttgcacggatatgcttagtaaaagtcanccgccancctccattctcgattaaacagggacacaatgcactgcggaaagccgcagaaccctctgcccaagaaagcctgggaattgtccaaggttnccccaactgagacagcctgagatatggcctcgtgggaaangaaagaccttaccatccccagcccga

SEQ ID NO: 571937 - DNA, 677 bp, Homo sapiens
  misc_feature (4)..(4): n is a, c, g, or t
  misc_feature (10)..(10): n is a, c, g, or t
  misc_feature (56)..(56): n is a, c, g, or t
  misc_feature (80)..(80): n is a, c, g, or t
  misc_feature (89)..(90): n is a, c, g, or t
  misc_feature (96)..(96): n is a, c, g, or t
  misc_feature (102)..(102): n is a, c, g, or t
  misc_feature (105)..(105): n is a, c, g, or t
  misc_feature (121)..(123): n is a, c, g, or t
  misc_feature (125)..(126): n is a, c, g, or t
  misc_feature (132)..(133): n is a, c, g, or t
  misc_feature (135)..(135): n is a, c, g, or t
  misc_feature (137)..(138): n is a, c, g, or t
  misc_feature (149)..(150): n is a, c, g, or t
  misc_feature (153)..(153): n is a, c, g, or t
  misc_feature (168)..(169): n is a, c, g, or t
  misc_feature (174)..(176): n is a, c, g, or t
  misc_feature (181)..(182): n is a, c, g, or t
  misc_feature (189)..(189): n is a, c, g, or t
  misc_feature (191)..(191): n is a, c, g, or t
  misc_feature (197)..(197): n is a, c, g, or t
  misc_feature (199)..(199): n is a, c, g, or t
  misc_feature (206)..(206): n is a, c, g, or t
  misc_feature (223)..(223): n is a, c, g, or t
  misc_feature (234)..(234): n is a, c, g, or t
  misc_feature (238)..(238): n is a, c, g, or t
  misc_feature (284)..(286): n is a, c, g, or t
  misc_feature (308)..(309): n is a, c, g, or t
  misc_feature (321)..(321): n is a, c, g, or t
  misc_feature (327)..(328): n is a, c, g, or t
  misc_feature (332)..(333): n is a, c, g, or t
  misc_feature (338)..(338): n is a, c, g, or t
  misc_feature (340)..(340): n is a, c, g, or t
  misc_feature (348)..(348): n is a, c, g, or t
  misc_feature (355)..(355): n is a, c, g, or t
  misc_feature (360)..(361): n is a, c, g, or t
  misc_feature (364)..(364): n is a, c, g, or t
  misc_feature (367)..(367): n is a, c, g, or t
  misc_feature (374)..(374): n is a, c, g, or t
  misc_feature (394)..(395): n is a, c, g, or t
  misc_feature (403)..(404): n is a, c, g, or t
  misc_feature (411)..(411): n is a, c, g, or t
  misc_feature (413)..(413): n is a, c, g, or t
  misc_feature (416)..(416): n is a, c, g, or t
  misc_feature (437)..(437): n is a, c, g, or t
  misc_feature (439)..(439): n is a, c, g, or t
  misc_feature (442)..(443): n is a, c, g, or t
  misc_feature (449)..(449): n is a, c, g, or t
  misc_feature (461)..(461): n is a, c, g, or t
  misc_feature (468)..(468): n is a, c, g, or t
  misc_feature (481)..(481): n is a, c, g, or t
  misc_feature (487)..(487): n is a, c, g, or t
  misc_feature (489)..(489): n is a, c, g, or t
  misc_feature (501)..(501): n is a, c, g, or t
  misc_feature (516)..(516): n is a, c, g, or t
  misc_feature (524)..(525): n is a, c, g, or t
  misc_feature (528)..(528): n is a, c, g, or t
  misc_feature (535)..(535): n is a, c, g, or t
  misc_feature (538)..(538): n is a, c, g, or t
  misc_feature (544)..(544): n is a, c, g, or t
  misc_feature (550)..(550): n is a, c, g, or t
  misc_feature (561)..(561): n is a, c, g, or t
  misc_feature (575)..(575): n is a, c, g, or t
  misc_feature (580)..(580): n is a, c, g, or t
  misc_feature (590)..(590): n is a, c, g, or t
  misc_feature (595)..(595): n is a, c, g, or t
  misc_feature (599)..(599): n is a, c, g, or t
  misc_feature (613)..(613): n is a, c, g, or t
  misc_feature (631)..(631): n is a, c, g, or t
agcnagcacntggtgccccggcgggtcgtgcggcgcggcgctcggcgagagctggnggtcaccatggcaatgcgggagcnggtggaggnngaatgngggggngcnaacccgctcatgaagnnngnngggganntnanncaggacaaggnnctnggggtagtgaggganngaggnnnggggnngggggcncnggagcncnggtgggnggagggagcggccaagngggggggaggngggngggaagaggagggggggggggaaggggggcaggagcagaagggacnnngggggggcggggggcgggaganngggaagagggangagggnngggnngagangnaggagagngagcagngatanngtngcnatgcgtncctagagagcaccgtggtgnngcagacgnngcccggngngtnagaatgtgcgcccaggcaggngnggnncagcgngtagagtcgtgntgagtgnactgcatgtaggngaagtnanacgtacgtgcgnccaataaggcagcgngtcaaggnncanaccccgnttngtgtgncccgtnccgcgtggcgnaggaagagggtgancaagnagaggagaancgtgngcgnggagaaccgtaggnaacagccaccgagtgcgnggtgtagtaagagcagccgtaggaggagtgtcagcacacggccagg

SEQ ID NO: 571938 - DNA, 110 bp, Homo sapiens
taaagggatggccgcgcaggccttgcaggaccgctggggaggatgtgtaacgtaaagagccaggctgatgaggaaggtcatgagtcctttgggtataagcgggagttggg

SEQ ID NO: 571939 - DNA, 153 bp, Homo sapiens
tagagggtataagacaggctgaggagcgacgtatctgtgctgaggagcatgcttgtaacccaactgaggaatcacacctgtcccccagtctgaggagcatgcctgtcccccggcctgaggaatcgcatctgtcccctgaagcttgacgaagcc

SEQ ID NO: 571940 - DNA, 382 bp, Homo sapiens
taaagcacatcaatggtcagtctatgtcttatgttaattatgaggactaaaccctgatttttttttatcttgcccaaattcctatctaagcggtctgggagtcatgcccacagatgggttttatttaaccctgtatatcatgatttactttccaacctgactctggcataacattaggagagaaagaagaacatcaaaatattttaccctgaaacacgtttctttgccatgttatgatggccctgcaaagctgttctttgtggggaaaactttgcatctgtaaagaatctgtattaacacagctagaagatctttttcttccagaccctcccaatcctaaagagattaactaagatctgaataggaaacatttgtcacctat

SEQ ID NO: 571941 - DNA, 1276 bp, Homo sapiens
  misc_feature (256)..(256): n is a, c, g, or t
  misc_feature (658)..(658): n is a, c, g, or t
  misc_feature (893)..(893): n is a, c, g, or t
gcgacctcctgctactgataacacgagtcccttgtcattgagcttcatcgatgtctatgcatcgcgacgagtaaaacgggtacatctgagacgcgctagtagtgagccattcacggcgacctatgcggccatgttgccagatcgatgcccactacgtaatgcttagcattgagggcagtgcaatcgagaccgtgggagaggcaggctcgcaagtgaccggcgccgattgtcgaagacgaagagaacgagaacgagncaggagacgcacgttatgccatcgttctggccactacgtgcctccgccgctcgccagaagtcgtactaccgacgtgcacgtcaggggcgtggttgttggcatcgcggaggcttcttgagaggctgttaagacgcactgttgaagcggaaccgattttcgcggcgctaataggtcgaagcgactgccacggtctatagggaattgctaatgtcgactcaaaaataactacgaggttcttgaccacgaagcaattcgagagtcgagtgtggcccccactagtccattctcgcgcctttgagttcaccttattttcagcgaaggacactcagcaggtctcctcagattacggcataagagggatgtttactaggggatagagccgggttgtattagcaagtgtcnagagaccaaaagtgtcaaaagtgccatctcataagggctttctctacaagaccaattgtctccggtctatcatgtttggtccacgagaaaacgctgtgaagaaagcaagcagtgaatactgggggtggagtccccgatgaatctcctaaacgtgtttcgcagttgagaacaaggcacgaccgtggtgatcttggggccggatgccgtttgcgcttgcggctcgcagtaacggcanattgcagccaggcggttggccctcgaggtgtcgttcccttgggccccgtggcctcccttgcgggcaacttcattccgcggaggagggacggctatcgcgtggggttttagccccgtttctacatttgggagtcctcctgtgcgtaggaaacgaagccaagcttggcccttgggaaaacctgtagggggtcttctaatagggcttccgaggacactggcgcaattttccttttggcgaagaacatctcccccataggcccaaaggcaggagcccccttttaccatgggttaccttttttctcaccgcgaattacattggcgacgcacgataacgcggatggcccccgaaatacgtgtagtggtcctcgccaccgggcggcggga

SEQ ID NO: 571942 - DNA, 374 bp, Homo sapiens
gcacagctctccagtctgaagtcatacgacactattcaacaacaggccattaagcagtatgttgctctgcctcttggacttggatgtattgggaaatccatcttggtttaattagagaatttgctgaaggtgtagaagcatttctttactgaaccttaccagggagccatccaggatcctgaagagtttgtggaaggaatggcactaggacttaaggcactagttggtggagctgttggtggattggctggtgctgtctccaaaattcaccggtgctatggctaagggggtagcagctatgaccgatatgaagactaccaaactggaagagatgcggatcgccatggagacatactaagatgaggcgcattgtc

SEQ ID NO: 571943 - DNA, 156 bp, Homo sapiens
atgggtatcgaggctgagtgagggtgtcaggatgagtgagggtgcagggtgaggagtgagggtgtcaggatgagtgagtgagggagtcccggatgaggagtgagggtgtccagggtgaggagtgcgggtgtcagggtgacggagtgagcggtgtcc

SEQ ID NO: 571944 - DNA, 271 bp, Homo sapiens
atggtggggagagggtataagtatcgcggaatggaccttcctggtgtgctgagagtgtgaacctgctcatgtcccacaagggcaggtgctgagtgccatgttcggcgggtgtgataagagctacctgagtggatgcctgaatgcggttgggatgaatgacaagattgtattgaaagcagggcaaaggcacagctgatgaaacaagcaagagcgggaagcaatcaattgccattgatgactgcccttccacagtgtgtgcgactcacagttg

SEQ ID NO: 571945 - DNA, 132 bp, Homo sapiens
  misc_feature (43)..(43): n is a, c, g, or t
attcccccccaaggggaaatttaagaatggcccccctttattnctccaaacaatgctaattccaggaaaaatcttgggacaaaaatttccaaacaaatgggggtgtgtgaaaaaaatttaaaagtatggcca

SEQ ID NO: 571946 - DNA, 90 bp, Homo sapiens
tcaagccgttgaccaattacagttcggctgttgactgagaagtttgtggtgggaaaacgcttgccagactttctttgcatttgaacaact

SEQ ID NO: 571947 - DNA, 188 bp, Homo sapiens
gtgggtgactctagaggacctccaaacaccgcaatctggaatctttaagcttgacaggtcatagatagagaatttaacggcacaggtatggtggcatcacgcctagtagttcctaacaatttggaaggccaaggcgggtggatcacgaggtcaggagatcagagaccatcctgagattgcggtgtttg

SEQ ID NO: 571948 - DNA, 2807 bp, Homo sapiens
ggcacgagggccggtcgttcggacgtcttgcctgtcgctggaggagaggtccgggctctccaggaaggtggctgcggcgacaaaatgaagatattcgtgggcaacgtcgacggggcggatacgactccggaggagctggcagccctctttgcgccctacggcacggtcatgagctgcgccgtcatgaaacagttcgccttcgtgcacatgcgcgagaacgcgggcgcgctgcgcgccatcgaagccctgcacggccacgagctgcggccggggcgcgcgctcgtggtggagatgtcgcgcccaaggcctcttaatacttggaagattttcgtgggcaatgtgtcggctgcatgcacgagccaggaactgcgcagcctcttcgagcgccgcggacgcgtcatcgagtgtgacgtggtgaaagactacgcgtttgttcacatggagaaggaagcagatgccaaagccgcaatcgcgcagctcaacggcaaagaagtgaagggcaagcgcatcaacgtggaactctccaccaagggtcagaagaaggggcctggcctggctgtccagtctggggacaagaccaagaaaccaggggctggggatacggccttccctggaactggtggcttctctgccaccttcgactaccagcaggcttttggcaacagcactggtggctttgatgggcaagcccgtcagcccacaccacccttctttggtcgcgaccgcagccctctgcgccgttcacctccccgagcctcttatgtggctcctctgacggcccagccagctacctaccgggcccagccgtccgtgtcactgggagctgcctacagggcccagccttctgcctctttgggtgttggctatcggactcagcccatgacagcccaggcagcctcttaccgcgctcagccctctgtctcccttggggcaccatacaggggccagctggctagtcctagctcccagtctgctgcagcttcttcactcggcccatatggtggagcccagccctcagcctcggccctttcctcctatgggggtcaggcagctgcagcttcttcgctcaactcctatggggctcagggttcctcccttgcctcctatggtaaccagccatcctcttacggcgcccaggctgcctcttcctatggggttcgtgcagctgcttcttcctacaacacccagggagcagcttcctccttaggctcctacggggctcaggcagcctcctatggggcccagtctgcagcctcctcactagcttatggagcccaggcagcttcatataatgcccagccctcggcctcttacaatgcccagtctgccccatatgctgcacagcaggctgcttcctactcttcccaacctgctgcctatgtggcacagccagccacagctgctgcctatgccagccagccagcagcctacgccgcacaagccactaccccaatggctggctcctatggggcccagccggttgtgcagacccagctgaatagttacggggcccaagcatcaatgggcctttcaggctcctatggggctcagtcggctgctgcggccactggctcctatggtgccgcagcagcctacggggcccaaccttctgccaccctggcagctccttaccgcactcagtcatcagcctcattggctgcttcctatgctgcccagcagcatccccaggctgctgcctcctaccgcggccagccaggcaatgcctacgatggggcaggtcagccgtctgcagcctacctgtccatgtcccagggggccgttgccaacgccaacagcaccccgccgccctatgagcgtacccgcctctccccaccccgggccagctacgacgatccctacaaaaaggctgtcgccatgtcgaaaaggtatggttccgaccggcgtttagccgagctctctgattaccgccgtttatcagagtcgcagctttcgttccgccgctcgccgacaaagtcctcgctggattaccgtcgcctgcccgatgcccattccgattacgcacgctattcgggctcctataatgattacctgcgggcggctcagatgcactctggctaccagcgccgcatgtagggccatcctgggatggggcaccacagggagggagggagaaaacaggtgggtagggttacagatccaggttataactactctggcccatacctttcctggttgtggtttttcatgccctctaccatgtgggccttccccaggagatgatcctgttaagtgttcggcagtaacctactttgttccttcgcctcagcagcaaatcttgctactggctctagatctgcggtttcccctctaccctgcctcccgtctccccagaatgggaatttcttttatgtttttatttttttcctggctcccttttatttttgtgcgcgatatttaaggtcgtctggatggggaagcaacctgcagctgaggtcgccggcgcctttttctttttagatgggaaggaggccaggaaagggtcagcttaaccatttcctatgtgccaagctgtgccagcagtccagggtaccctgactgtccctctgtagactgttgagacgtccagggtaccctgactgtccctctgtagactgttgagactgagttcctgttgggacagtcagttggtatgtatccaagtccctgctgaccactaatgttctagctgatggtgagcggcacagtcccacttccccatctccccaagtaggtggtgttagaaaaccttaattttttttcccttttgtatggactacaaataaaacttggggcaatttgcagtttgg

SEQ ID NO: 571949 - DNA, 884 bp, Homo sapiens
ctggagaagggcgtactccaaatagaattctcggagcatggggaggtgcccaaggccatgtacgctgcatgtcgcactaagtgtgttctccttgtttgccaagcttgggctcatcatcatcataggtggcatgtacctggctctggccagtgtgctaggcactcctcagcaggcttgacgctggcggatttgcttccacgatcctcatggagagtacgagtagtctgtgcggcaacgcagaggccaccggccgatcgtaaatttggcaacagtcgccgaggatcggaatccgagcgggcttctagaaagtgccattggtagtgagaagggaggaagggggcctgcttggtgtgatagctggtgcttctcgccatgtcgatgtgttagccgcgactgtaagaactatacctcccgtcagagttggatcgttcccctaccacagcaataccctggagacacggggtaaaggaaatggcctagttcgagcctgaaacgtgcatggcgggggttctaggcgagtatggcctcgtcaaggctttaacctctagacaagcgaaggcacatttgttgcacgagcgcagcgcactggaaatccaccctcgaagctgccgctacgctggctggatgtgcaagtgctggcctgtggtgctgttctgacaaaggtggcataaagcaccattcggtggccagcggagtctagcaaggtacccacagggtctggtgcatgtgacttgtggtgcgagtcttcaagcagccacctgtggctgccctagcgcatgaaactgctaatatcgatgtggagggcccagtcacccgatcctggaggtcagtgtcctctgtactcaacagggcctctctcccgtctgttcagtaaaacgaaactg

SEQ ID NO: 571950 - DNA, 122 bp, Homo sapiens
tcatacatatcctgatgaaatgcaaatataatcacctcacctcaacattccccaatgtcttagctcattcattaaaattaactaagtccaaaatctcaactaaatatcaaaataaatatggg

SEQ ID NO: 571951 - DNA, 2766 bp, Homo sapiens
ggcacgagggccggtcgttcggacgtcttgcctgtcgctggaggagaggtccgggctctccaggaaggtggctgcggcgacaaaatgaagatattcgtgggcaacgtcgacggggcggatacgactccggaggagctggcagccctctttgcgccctacggcacggtcatgagctgcgccgtcatgaaacagttcgccttcgtgcacatgcgcgagaacgcgggcgcgctgcgcgccatcgaagccctgcacggccacgagctgcggccggggcgcgcgctcgtggtggagatgtcgcgcccaaggcctcttaatacttggaagattttcgtgggcaatgtgtcggctgcatgcacgagccaggaactgcgcagcctcttcgagcgccgcggacgcgtcatcgagtgtgacgtggtgaaagactacgcgtttgttcacatggagaaggaagcagatgccaaagccgcaatcgcgcagctcaacggcaaagaagtgaagggcaagcgcatcaacgtggaactctccaccaagggtcagaagaaggggcctggcctggctgtccagtctggggacaagaccaagaaaccaggggctggggatacggccttccctggaactggtggcttctctgccaccttcgactaccagcaggcttttggcaacagcactggtggctttgatgggcaagcccgtcagcccacaccacccttctttggtcgcgaccgcagccctctgcgccgttcacctccccgagcctcttatgtggctcctctgacggcccagccagctacctaccgggcccagccgtccgtgtcactgggagctgcctacagggcccagccttctgcctctttgggtgttggctatcggactcagcccatgacagcccaggcagcctcttaccgcgctcagccctctgtctcccttggggcaccatacaggggccagctggctagtcctagctcccagtctgctgcagcttcttcactcggcccatatggtggagcccagccctcagcctcggccctttcctcctatgggggtcaggcagctgcagcttcttcgctcaactcctatggggctcagggttcctcccttgcctcctatggtaaccagccatcctcttacggcgcccaggctgcctcttcctatggggttcgtgcagctgcttcttcctacaacacccagggagcagcttcctccttaggctcctacggggctcaggcagcctcctatggggcccagtctgcagcctcctcactagcttatggagcccaggcagcttcatataatgcccagccctcggcctcttacaatgcccagtctgccccatatgctgcacagcaggctgcttcctactcttcccaacctgctgcctatgtggcacagccagccacagctgctgcctatgccagccagccagcagcctacgccgcacaagccactaccccaatggctggctcctatggggcccagccggttgtgcagacccagctgaatagttacggggcccaagcatcaatgggcctttcaggctcctatggggctcagtcggctgctgcggccactggctcctatggtgccgcagcagcctacggggcccaaccttctgccaccctggcagctccttaccgcactcagtcatcagcctcattggctgcttcctatgctgcccagcagcatccccaggctgctgcctcctaccgcggccagccaggcaatgcctacgatggggcaggtcagccgtctgcagcctacctgtccatgtcccagggggccgttgccaacgccaacagcaccccgccgccctatgagcgtacccgcctctccccaccccgggccagctacgacgatccctacaaaaaggctgtcgccatgtcgaaaaggtatggttccgaccggcgtttagccgagctctctgattaccgccgtttatcagagtcgcagctttcgttccgccgctcgccgacaaagtcctcgctggattaccgtcgcctgcccgatgcccattccgattacgcacgctattcgggctcctataatgattacctgcgggcggctcagatgcactctggctaccagcgccgcatgtagggccatcctgggatggggcaccacagggagggagggagaaaacaggtgggtagggttacagatccaggttataactactctggcccatacctttcctggttgtggtttttcatgccctctaccatgtgggccttccccaggagatgatcctgttaagtgttcggcagtaacctactttgttccttcgcctcagcagcaaatcttgctactggctctagatctgcggtttcccctctaccctgcctcccgtctccccagaatgggaatttcttttatgtttttatttttttcctggctcccttttatttttgtgcgcgatatttaaggtcgtctggatggggaagcaacctgcagctgaggtcgccggcgcctttttctttttagatgggaaggaggccaggaaagggtcagcttaaccatttcctatgtgccaagctgtgccagcagtccagggtaccctgactgtccctctgtagactgttgagactgagttcctgttgggacagtcagttggtatgtatccaagtccctgctgaccactaatgttctagctgatggtgagcggcacagtcccacttccccatctccccaagtaggtggtgttagaaaaccttaattttttttcccttttgtatggactacaaataaaacttggggcaatttgcagtttgg

SEQ ID NO: 571952 - DNA, 195 bp, Homo sapiens
  misc_feature (57)..(57): n is a, c, g, or t
  misc_feature (88)..(88): n is a, c, g, or t
  misc_feature (120)..(120): n is a, c, g, or t
  misc_feature (151)..(151): n is a, c, g, or t
  misc_feature (177)..(177): n is a, c, g, or t
  misc_feature (183)..(183): n is a, c, g, or t
tacctgggcactaactcaacaggccctgcacccatggcccctccaagagccccaggnccctgagcaagcaggctctggcagcagcacnccatggaggtgcaggaaggctatggctttggntcaggagatgatccctactcaagtgcagagncccatgtgtcaggtgtgaaacgggtnccgctnaggtgaggggcg

SEQ ID NO: 571953 - DNA, 774 bp, Homo sapiens
catacactctccgcgcccgtctccgtgctgtcctcccgttcctgctgccctgccctgccaccatgacggaacaggccatctccttacgccaaagacttacttgtgccggaggcatcagccgccgccatctccacagactgtgcctgtgtgctccagatctgagctgtggtcaatgctgctgctgcagtgtccatgcactgccagcaatgcagatctgcctgccgacaatgcagtacaatggtgcatcgtggacttgcatttgtcctgcatccccaagtgatgcatgtggctgtgcttgtccttctggagtgtgtgcaaccttgccaacctgtcattctgctacttccccactcaatgccctcaacttctgccttcaatgtgataatgtacaacgcatgatcttcctgtggtgtgtgcgtggacaatgcacactgcagtttcttggagtgtactattgctgtggcaaaccttggcctcctgtgcctggtgctggcactgggctgcagaactcacctactgctatcgttgtaccctgcttggatttctgccagaaacccgcactggcagcgtgaccgtgtggaaatgttcatgtgcacatgagctgcgatgttcctgcaggcctggtcacgacttgcctggatgaagatcaccaaagtaccgacgggcatctgtggcctgtacccatggcctccagtgtctccgtgcatgtggcatcatcatctaccgggcggctacttcggcgtgtacatccgccatggcatgtacccgaaccaa

SEQ ID NO: 571954 - DNA, 359 bp, Homo sapiens
ggtcgacgtggcatgccgagcctagcgcgccggagtggtggggcaaagaccttttggttacttttggggcgtttgcaaaagtgacccgctgtaagagccacccctttcaaggtcttggtttaaaatcccctaaccaatccagtcaggacgacgaaactatgtgggaaaaggttttagaacggtttgaaaaacaggctccggccagcgtcatgaccaagttgatattagagcaggcagtagatgccgcttgggttgacaaggtgttcgatgatcaccgccaacggcagtactcacgtgagcttttgttttcaaccgttgttgagctgatgtcccttgtttcattgggcttgagggtcgac

SEQ ID NO: 571955 - DNA, 333 bp, Homo sapiens
  misc_feature (4)..(4): n is a, c, g, or t
  misc_feature (56)..(56): n is a, c, g, or t
  misc_feature (130)..(130): n is a, c, g, or t
  misc_feature (234)..(234): n is a, c, g, or t
caantatgataaaacatgtaacaacatttgcccttttttttttttgacagagcaanaccctgtcttcccaagaaaaaaaaaaggggctgggattggtggctcatgcctgtaatcccagcactttgggaantcgtggtgggcaaactgcttgagcacaggagttaaagaccaccctgggcaacgtggcaaaaccccgtctctacaataaatacaaaaatgagctgggtgtggtancgtgcatctgtaccccagatactcaggaggctgaggttgggaagattgcttgagcccagtgggtggaggctgcagtgagccaagattctgccactaccc

SEQ ID NO: 571956 - DNA, 289 bp, Homo sapiens
gccgcgcgaacggtagccgcgaactggtcatgaaagcggctgtaaatggcgttggcgcggatggccatgggactgtcgagaaacaccgcctgctgtggcaggcggccttcctgatagaagcggcctaggtaatagataaggtcctgggtgcggccgacggcgaaggaggggatcagcacgttgccgccttccttgtgagcctgctgcagaatgtcggccagctcctccagggtttcgtcactggggcgatgatcacggtcgccgtaggtcgactccatcagcagtacgt

SEQ ID NO: 571957 - DNA, 203 bp, Homo sapiens
cggcacgaggacagctgctgagcctgcctttccctctcacccacttcggttgtgggcttgtccctttgtttgcctgtacattgacacgtctgtatggtccagtcgtgcctgtgtgattgtttcttgttgggggggtaattgaaactgtccctggcaaccttcccagtctctccctgcatgttacctatatgacgtggccttta

SEQ ID NO: 571958 - DNA, 372 bp, Homo sapiens
  misc_feature (22)..(22): n is a, c, g, or t
ttcgggggcccaaaaagctcanaactgttcgagtcccaaatgaataggatttttgaataagagtgggggttgattagctaacccttggtttgtgttttttgtagattgccacccaaagaggccttttaaaaggagacggggttttgccctttcgcccgggctggagtgcaagtggctcgtttttggctccctgaatcctttggggttcaggtgttcctctcccctcagggtcctgaggggctggggctataggggtcccccccccctgtttgttttgtttttttttttaattttagtaaagatgggggtcttgttttgttgcccagactggtttgcaactcctgggctctagcgataaccctccctttccta

SEQ ID NO: 571959 - DNA, 116 bp, Homo sapiens
  misc_feature (26)..(26): n is a, c, g, or t
ctgtttctcatggtctcctgtctgtntctctctctctcccctctttctctctcctcgctctttctcatcccctccatttctgtgtcaatctcaatccatttatatcggtggccact

SEQ ID NO: 571960 - DNA, 561 bp, Homo sapiens
aatgtctcgtccatacctgaacgcacactgagaacagaaagatgttcactacaataagtgtaacagaaacgctattttctttttttaaaaagacataagaacaaagcattgtggcatgaagccatttaatataaactgccgcacacttaagctatttttttttttgagacagagtctctctgtagcccaggctggagtacagtggcgtaatcccagctcactgcaacctccgcctcccaggcccaatgattctcatgcctcagcctcctgagcagctgggaccacaggtgaatgccatcacgctcagctaatttctgtatttgtagtagagacgggggttccacaatgttggccagccctgtcttgagctactgacctcaagtgatccacctgcctcggcctcccaaagtgctggcattacaggcatgagccactgcacccagcctatgaacagactattacgggtgatttctagtgaggctccaaaagaaaagaggagatttgaaatcctcaaccagaatgttggtaaaactgtgaacagtaaagctattcttatgaggt

SEQ ID NO: 571961 - DNA, 528 bp, Homo sapiens
  misc_feature (521)..(521): n is a, c, g, or t
ggtagatcgataaaccccggatcaacctcaccacctcttgtttagcttagccacacccccaggggaaacagctagtgtttaaccttttagcaataaactgaaagtttaactacgtctatactacccccagggtggggtcaatttctgtgccagccaccgcgtgtcacacagattaacccaagttctatagaacgcgggcgttaaagagttgttttagattcacccccttccccaattaaaggctaaaacttcaccttgagtttgtaaaacaactccagtttgacacaaaattagactacgaaagttggttttaacattatctgaacacacaattagctaagacccaaacggggattagataccccattatgcttagccttaaacctcaacagttaattcaacaaaattgttcgccagaacattaggagccacagtttaaaattcaaaggacctggcggtgcttcatatccctctagaggagcctgttctgtattcgataaaccccgcaagtcaaaagaaantcgagct

SEQ ID NO: 571962 - DNA, 109 bp, Homo sapiens
  misc_feature (33)..(33): n is a, c, g, or t
  misc_feature (61)..(61): n is a, c, g, or t
  misc_feature (106)..(106): n is a, c, g, or t
ccagaacagtgcaatatgtgcttagatccttantcatcgatacaatcatttacatataatngtaaagatgaacatgtgctggcacagctagggtttacatactctntgg

SEQ ID NO: 571963 - DNA, 589 bp, Homo sapiens
  misc_feature (1)..(1): n is a, c, g, or t
  misc_feature (51)..(51): n is a, c, g, or t
  misc_feature (75)..(76): n is a, c, g, or t
  misc_feature (294)..(294): n is a, c, g, or t
  misc_feature (309)..(309): n is a, c, g, or t
  misc_feature (389)..(389): n is a, c, g, or t
  misc_feature (460)..(460): n is a, c, g, or t
  misc_feature (474)..(474): n is a, c, g, or t
  misc_feature (483)..(483): n is a, c, g, or t
  misc_feature (520)..(520): n is a, c, g, or t
  misc_feature (553)..(553): n is a, c, g, or t
  misc_feature (588)..(588): n is a, c, g, or t
naagagaagagctctctctactgcagagagaggggtccaagagaaatggantgctggttccgcagtggaatgcanngcgtttcatagatgagcttgaggaggcagtggctgatttacataggatgcaaaagattggttgaaccaggtgtgtcatttgcatagggcaccaaaaactgtttagggctaggtgtgtcatttgcatagggcatgaaaaagctggccaccccacactcatcttttattatgcagctggttctccacctgggccagcggccatgtttacctggttttccnttactggtaacatgntggtggcaaaagaaaaaggggaagagtggaagcctcccatgttaaaacataacctgggccctttaccgtagccccttttnctacctgggcaatagcctggccgggtggttcaacccggtggcaaagcctttcccaagcttttccttttatncttaatggtcctgncaggctttngaattttttccagaactggctccttttggtttaaaanaaaaaaaaggaaatttaatttggggggccttgncttttttggttaaaaaaggggaaattcctggttgng

SEQ ID NO: 571964 - DNA, 320 bp, Homo sapiens
acagacaggccgcattttttggctcatgtctgtaatcccggcactttgagattccaaggcaggcgaatcaagaggtcaggagttcgagaccagcctgaccaacacagtgaaaccccgtctgtactaaaaatacaaaaattagccaggcgtggtagcacacgcctataatcccactactcaggaggctgaggcaggagaatcccttgaacctgggagatggaggttgcagtgagccgcgattgcaccactgcacttcagactggcgacagagcaagactccgtctcaaaagaatgaggacacgacggacagataaacatgt

SEQ ID NO: 571965 - DNA, 118 bp, Homo sapiens
cataccagacctacgccaaaatccatttcactagtcatattcgtcggctcaatctactttcttcccacaatcgctttctcggctctatctggaatgcccctaagttcctcagactacc

SEQ ID NO: 571966 - DNA, 280 bp, Homo sapiens
ggaagaaattctgtacggattaactagagtattcagacgtgaagaaactgaagatgttgtaacatctgacaaagaggggaaatgtgacagttacgaaagttcgcaacagctgttctgacagcatgaaagcaggcaccgacttattgaagatcgtcggtcgcacaacgcagtctaagttagaaatggcaagttgcgtagctttgctgaagctagtagctgacgtagcgatacgatgaaataatgtaaatcagtcgtctgagtatagttgcagcatatcgat

SEQ ID NO: 571967 - DNA, 582 bp, Homo sapiens
aggtttatttaacgaaagggtatggagtaaaattggcagaatcggaaggagaaatccccagaagcttatactaagaggctgctcttaaacagggccactggggaatatttatgacaaaagactcatatgtgatgactcttgatatacccttactgactaactaaatagcacctaatgaccaattgtatttgaaatagttggcttgtgaaaaattttctctaacactatacctcttataagggaaaaaacagattcgttttcacctagacggctctgttttcactgtgtggcacaaagcattaatgatttaacttgtgaaagttgtatcaggtggagactagacctcttgccgaattcctggagacccggttattcactagttatagagcgaacgacaccctggcagagctgcagctcttgttgcttataatgcgggataagtactagcttggagtaatcatggacatagctgctacctgccagaaatcgatattccctcactatacacacagcctaccacccagacgtattattagacagccagggtcctctatgagtgcgctgcctccacaattttgtcca

SEQ ID NO: 571968 - DNA, 402 bp, Homo sapiens
gtttttcattatatttttctgtgtgttctcagattatatatttccctcaatttagagtttgctaagtgaaataaactggttcactagtagagaaagaattacgtcgcttaatacctaatatcatagttgtccaatatgaaaaaaagattaaaaggtagcagtaaaattatatactgaaaccaccaaaattttaaatgccttattgagttatccgtgaaatactcagtgtgcctttaataatccctggaccggccgtggggttaaataccaatcctcatattcaaggctactcttgaagatacctctgtcacaaatatatctcactcttctggtgagagctgtgtatatccactgatgtgcatatagcctgaatgatgagccttgtgcctgcctcgctggtgt

SEQ ID NO: 571969 - DNA, 269 bp, Homo sapiens
gagagatttgagagtcttttatagaggtgctgcaaagaagaaggtcgtccacatattgaagattactgggagacaggtttaaggaagtgacggtttcgggctagagcttgtccaaagaaatgagggctatccctgtaagccctgtcgggaggacagtccatgtagacgttgttgtgcactggagggtgtacagggtcagtccaggtgtcaagcaaataggtttatgggaatcagtggtgtagcggcaaatggtagggagacggcatccc

SEQ ID NO: 571970 - DNA, 541 bp, Homo sapiens
  misc_feature (419)..(419): n is a, c, g, or t
  misc_feature (449)..(449): n is a, c, g, or t
gcgtccgaaaaatttgccaggcgtggcggcgggcgcctgtaatcccagctactctggaggctgaggtgagagaatggcgtgaacccgggaggcggagcttgcagtgagccgagatggtgccactgcactccggcctgggcgacagggcgagactccatatctcaaaaaaaaaaaaaaaaaaattctgttttaataatggagagtcagttatgttttttaagcataggtagttggtatgagggacaggatcatattggtgttttcaaaatttcaaagttaatttcaaaagttcactcagccaaagtaagtgaactattaaagcttagagatctttcagagactattatagtaccaaatgccaaaactgattgaaaatactcagattttaagaaaatattttatgataatctgtagtatgnatttatataaatatttatttatttgtatgnatttttgtatctgcagaggttaccactattccaaggcacctagatgaccatgctactaatataataatgttagaagaaaggcaaatctaata

SEQ ID NO: 571971 - DNA, 721 bp, Homo sapiens
gggaccactgtttgctgctactttttcctgctgctctatcctatacattgaataatccaatcatggtccaactaggttcggaaaaattccatacaatcaaacagtctgccttaaaagtgacccacatttttccatagtctcctctactattgtctagcccttctgcaagagaaaaggcctcatggagtccacatggtgagaagttaagtttcctgtcagtgggcctctcaccctggcaaccatggagttgcagggactatcagcacgctggtagccctcactgaaacgtccatgcaatgtcttagccagtagttcagattatcgtaaacaacgtggaacagtgtctcatgtactatgatgttggagccatgccagagatctactggacacttgtcgagcacttttggactccattatccttatccttatcctaatctttcctagcccttcaggctagagtaggctatcgatcctgagaatccttgtctgttgctctgaggagatatcgttctgggagacagaatcttttataagaacagtacgagatcgttctctcagagggcccatctagaaggaagccataggagttcacaggctcagccacctaacgagctcaagcatggtcatcatgttttctatatggtatgaccagctagcagtattcccttccatacctgtgacctgggcagtgcttttctctctcccatgtgtagccttccaa

SEQ ID NO: 571972 - DNA, 824 bp, Homo sapiens
  misc_feature (225)..(225): n is a, c, g, or t
actccaccagtgaagccactgtaggcgatctctaagcagaacttcggctactcacctcgacagaagtagtcgaacgatccagaacatctccggtcacccgaaggagatctcgagtctcgcacatctccagtaactcgaagaaggtcccgctctcgagacctcacccacgtgacaccgcgtccgctctacggtcccggacatcctccacgcctattctggcgccgnctctatgcattctcgtagacgccagcgtgttatccaccctgcagacatcgttctcgaacgtcgcctcaccactttgcgtgagtcctgccgccgcttcctagatcccgtactccacggatcatgcttcggggtaaactggtccttaacaagatctactccatgccatccgcaagtgctgttcgtgaatctggaagtagttcgtgatcgttcatcgatctgctactcctccagcaatcaagaaatcagttctggttcacggtacacctccagtagcactcaagcagattccagaatgagctgcttcagtcgtcctagcatgtccccaacacctcttgatcgctgcagatcacctggaatgcttgaaccccttggaagctctagaacacccatgtcctgtcctgcgtgcaagccggcggctccagtgtatggatggtccaggtccccgagatcctgaccaccagagaacatctgtgccagacaaatcgtgctcagtccacgattgcacttgcctgggagctatcacgctggcccggtcggccctccggcatgttgttgttggcttgttgcgaatgtcccggtcacccggggcctctgagttc

SEQ ID NO: 571973 - DNA, 396 bp, Homo sapiens
tcatctacaaggggaagaaatcaacgctcggaaggagacggcgccgaacgaggtctacctgggcctgccccatcttccgcttttacatcaagtgcacgcgctgactggcagagatcaccttcaagacagaccctgaacacacagactataccatggagcatggagccacgcgaaatttccaggctgagaagctcctggaggaggaggcgaagagggtgcagaaggagcgggaggacgaggagctgatcagcccgaaaaggtcagagcgaacgcgatagatagcatctcctcatgtgaaagaggatgtgatcatcttcagagggggtcggtctcagtgtgaactgcccaagcaggggcctctgcagaatatgattacccataccgagacctgccagg

SEQ ID NO: 571974 - DNA, 117 bp, Homo sapiens
  misc_feature (2)..(2): n is a, c, g, or t
gntgaccgtcgaccctgccaggtacattaaccattcctgtgcctctaactgtgtggccgaagtcgtgacatttgacacagaggacaaaatcatcatcatctccagccgcagaaagag

SEQ ID NO: 571975 - DNA, 980 bp, Homo sapiens
ggaccgcgagaccgcgtccgccccggagcacagagctcgcctttgccgatccgccgccgtccacacccgccgcagtcaccatggatgatgatatcgccgcgctcgtcgtcgaaaggctccggcatgtgcaacggccggttcgcgggcgagatgccccccgggccgtctttcccctccatcgtgggcgcgccccaggccaccaggcggtgatggctgggcatgggtcacaaaggatcctatgtggagacgagaggcccagagcacagacgaggcatcctcaccctgaaagttaccgcaattcggagcacggatcgttcaacccaacctggggacgacatgggagcaaacatttggcaccacaacactttcttacaatgagactgcggttgtagcgtacccgaaggaacgcaaccaccggtggttgatagacacgggagggcccactctgaaccccaaaggccaacccggagaacacgatgaccccagatcattgtttgggacctttcaacaaccccaagccatgtacatttagttaatacaacgggcagagcatatcccctgtacggccctccgggcgacacccacctggcatcgtcgatgcaacctcccggcgtgaacgggaggcacccaaacaacggtgccaatactacaaggggaatgcctcccccaatgccaaccatgcggcatgggacgtggtggcccggacactgactgatccgtcaggaagatctcaccgaagcggtacaggtcaacacacggacgagcggaaaatgggcgtgacttagcagagcggtgaccgcccgcacttcagaaacatgcaggaggtcagcacccgaaaagcagcggccgagcagcacccctgcagacggcgagcaagaccctcacctcggagcgagggcacaacccacatgaggagcaccaagccaagtgggccactcacagaaaacacacagcacaccgcgcacaacccccacgcatgg

SEQ ID NO: 571976 - DNA, 93 bp, Homo sapiens
gcctttttatgaatctgtcatctcaaatccttttgtcgctgagtctgaagggacctatgacacctatcaagcatgttcccagtggaaagcttt

SEQ ID NO: 571977 - DNA, 429 bp, Homo sapiens
gaggttttactttattgcatgctggcctggcaccctgtggcctgggctgacttcatagggatcaccttgagtgccaggatttcaggcatgagccactgtgcccagctgaggtggttactttaatgtgtgaaaagcccccagattagagtgatgtcattattggtcctccatctgtgtggtgtcacccagctgagtgcatttaccaaacactttcctcttagccccgagagctcagtaaacagagctagatgacatagcttggtggccgtaggagctagcaggagtccctggcagggatcttcctccaagcagactgagctgggacagtgacaggaggcaggtgtgctgtagcatctggtctttatacagcacatcctctgatgacttctccaggcttctccagacttcttcttaacactgcttgcactt

SEQ ID NO: 571978 - DNA, 356 bp, Homo sapiens
gtcgtggtgactggcctgacctggtgtgcagctcggcccgggccccctggagctggactgacgggcgactggagagcttcaagaagcagtcgtttgtgctgaaccaagggttgagtacggataaattcttcgggtacgaaatgtgcggctaataatcagacgtcaggaagcgtaatgaagatgactaatgtagagctatgccggcgagagtcgagtctgacccgtgagagaccagtatgtgccgtgcatcagcatagtccgtcaagagagaaacgacacttctggatgaatccacatcaaagatgaaggatgaccacagaggcggagtgaatgatgacgagacggacaggcggatg

SEQ ID NO: 571979 - DNA, 250 bp, Homo sapiens
gaattatacagctgtcagctcacaagatgagatatgggacattttgaaataccagatcctatggaggatcaaccaccatcactagtgtcgtcttcaacatctgcttactctccctccctgtagatgttgtggttatgtacgagtcagccctaacagatcaaatttagctgtttaccagtatcagagtagatgcatgtaaagctgccatcctggatttggtgtttctcaaccgaggagactggagcttagg

SEQ ID NO: 571980 - DNA, 182 bp, Homo sapiens
ggtgttgctgaggcgctctagaggacccggtcacttctacacctaagtgagaacacacggtgttggttgtttgtcctgcgatagtttgctgagaatgatggtttccaacttcatccgtgtccctataaacgacattaactcatccttttttatgactgcatagtattccatggtgtatatgt

SEQ ID NO: 571981 - DNA, 178 bp, Homo sapiens
tgaatgtcgagatcatgttagagcattaatgttgagatgtttctgggatggttcctaccgtgtcacttaaagaggatttgcctggactaagtcctgtgtagattgttttccgcaaagcagctcctgtgttgaatagcaatccgcaatgatgtagcatgtgggccttgagcagaggagg

SEQ ID NO: 571982 - DNA, 807 bp, Homo sapiens
gaaatgaggtatggggggactcaaaatcccgttatatgcatatatccttttctagctacaagagttaggtggattataatttacattgttcgttcattgtgagtcgtctctttaacaagtaatgtcaatatagaagcgtcagtggatccataggaattacacttgtgctgatcatttgaaactgataggttgagagagaaaagtcattcaacagtggtgggcataaggttccctctctcttttctctttcctctcttggaccatgctagtctcactgtccacccagcgatggagtgccgctggccttgatctcactgcagcctctgcctcccaggttcgaggcaattcctcgtgcctcagcttcccaagtacgcctggcgccctataggcatgtgccatcaggcccggctaatctctcgtacatttcatgtacgacacgggggtcatcaccattgtcggccaggttggtgctccgaactcctgatctcggactcccaaagtgctgggactatagcgccttgagccaccgtgtcttggtctctccgttctcatacgcaacgcaacttcacgtactgctaaccacagtgcgccaagacccatgacccgaattgccgcagcaacaacaagtggcacaactccggtcaccttccaaccactcgggagtctctggccaccgtggataatgctacaatacctaggtaccaccgacctgtaagccattacagaggatcgtatatccatacaggaaaccttgttcgacccccgttacacgtttcggcctcaccacacaattgggctcaccttaaa

SEQ ID NO: 571983 - DNA, 427 bp, Homo sapiens
  misc_feature (204)..(204): n is a, c, g, or t
ggtctatatatgtacttctgtactttgtatgctgtagtaaatgccaaacagtactatctgctttacggagagaatgagtcttagaattaagacgtttgaagtcttcagctacatggtaactagatgtcgtcaatcttggattatttcacccttttttgtttatttttggccaaggcagcctccagaaaagaggggtttgtgtancaggtgttaaggaatagttaataacctttggtgatggatcccgcagtaaaatccaagctaaccccacaaagggatctataataataagaactgggtcttgagacatgaaacgagaattggctggctgcatcacttttgttctagtaccttattttcttctcatggtcttcatcaaagtcttaggatttgttgaatattctagtacttgacatgtaatttccag

SEQ ID NO: 571984 - DNA, 555 bp, Homo sapiens
  misc_feature (467)..(467): n is a, c, g, or t
  misc_feature (497)..(497): n is a, c, g, or t
  misc_feature (515)..(516): n is a, c, g, or t
  misc_feature (525)..(525): n is a, c, g, or t
ggtgatccgtccgcttggcctcccacagtgctgggattacaggcgtgagccgccatggccagccctgatggctctttctataggcgcatccctccacacccctttagtctggagcttgctgtgacaaatcctggcctccacgaactatttcttaattcttcccttggtctctggattttgattgaaattgttattctgttgccttcaacttcagactgtcagcctggacaggatcccagagttgatcaggtcagtctcctcattgtacatgtaaggaagcatggagcctatacctgtagctctctactcccaacttcgggcaacctttccttgaggctccttttcgggagtatttagggacactggtggatagtctctccccggctctttttcttcagatggcttggtgtaatgtcccctgagggagaaagataaactggatgacttgcgtaattatattattacanggcatttgcactataaagtttcctgccatnccacttttatctgtgttnnagagaaaanataattcttaatatgaccatcgcctcttag

SEQ ID NO: 571985 - DNA, 138 bp, Homo sapiens
ttgtagactaactgaactgttgacagtgtgctaaagtcgaacacacccgtcactttcagaggacagacagaagccatctttataatagtgattttgccagaccaagggagaggttaggtctacctggggggatcctct

SEQ ID NO: 571986 - DNA, 1041 bp, Homo sapiens
ctgtttcatcgagaaagcacgatcatcgtggcgttgaaactgtggagttgatagccgtacgtatcatgatcgagtttcataacaacatatatatatagggctgggtgcagatggtgcatcgatctgtaatgcccatgtgctttgggacggctgaggtgggtgaatcacctgcaggtactaggagttcaagacgcagcctggtcaacatgacaaatacccaatcatgtacaaagtgttacaaaaaattaatctgggcttgtgtggcatgtgcgctgtaatcccaggctactcaggaggccaaggtcgacggagatagtcacttgaaccctgggagtgcagagagttgcagtgtagccaaggatggtaccactgcattgccagtctgggtcaacagaggaagagacaactacaaaaacataaatatatatatatcatactggacagactacatatgtatactgtagtatacagatgtgtatatttatatgtagtgttgcagaacatgtatcctctaagggttggggcagaagtgtgtgaggtgtccatgtacatttcaatcaggctgaataatagggtatgtataaatctgtacagtcattggcaatagatgggtctaatgatgtataagagagaatgtctaatttgctactatggggggaggatatgccatttcgctttagttctgtcatgtggtgggtgactaaacaggtgtcatcattgacccctgggacaatgtacgcggactcgtcttcttactgtggggcctagacaatggtcgacagttgatgttgtgaaattggccacaggccgtgaatcggtgaagaagagaccttgtcatagaggtatactagtcgactatggggtgtgtgaggcccactaggcatcggaaggggtggggtaactttaacacgttggtaattaatccacagagatatgaaattgagaatgtgggtatagggtgagaaagggctatgagaaaacggacctgtgttggacaaaaatttgggggtgtaaaagagaaagaagagaggaaacactaaa

SEQ ID NO: 571987 - DNA, 1299 bp, Homo sapiens
ggctggactctgtcaactagtcctgcgcccggagaagctccacgagtacccatctccgagcccagcagacagggcgcagtgcacagcctctcagaggcatcccacactgccccctctccgctgacaggcgtagggtcctccaacattctgggcaggtcctggatttgtctcgcccactagatcggggggactctggatggacaggccagctccttgcctatactcttggaccccccacccaaggtggcggacagtcagcgccggatggcagttgaggacgtaggtggccagggatggccctagacggtgggcccatcgtggcgagccagcgcactggctggggcctatcgaccagggtgcatggtgcatgatgcttgtggggtgacggacggtgcgccaatgggacgtaccttatcagtggaatgcctcgcatacgacctgggagcttgtccgactcgtcgaacgcgcgaccggtcgaataatgcgaggtcggcgagccccagaggagcgtactgagtggtgcccacacatacgccgacattgactaggctactactgcaactcactgcgctggctgcgctggcagggggccatgctgagaccctaggtgtcacaccccagttcatctgggctacgtggccgtccaccgtgacccttattccagcggtcgctcggactcgtccgtgcttgcgaacgagcagtgaccttggaaccaagaatcatgccggatccaccccaacaacgagagagtgcacggacccactagaggaggcatccgggcacactggacacctcccataccctagccctccgtaatgtagcgcaggacggaccaggctacacaggacccctgggtcaaagcccggggcatcaggaagcacccgggggatggtcacaagcaaaaacgaccagggaggcaccccagcactggctacaccatgtccgataccctacgggacccttgcacacagcaagcaccaaaaaggggatccacgcagcaccaagcccgagacacgtcagggtaaatgcaagaaggacgaccacgagaccgcgtaggcacaaagaaggaccaaccaaacccgccagaacaaccccgccaacacacacatcgcgaccgacccacacccaccccacgcctaaagaccccatcgcacgccacacgcgccaagccaccagcaacaaaggggcagcccccgacacaacaacaccaagaaccacacacgaccacacacacaacaacacacctacaagaccaaccacaccacaccacccaccacaccagcgaaaaccacacccacg

SEQ ID NO: 571988 - DNA, 307 bp, Homo sapiens
gatgtgtcgtatggtagttaggtgtggtagaggtgtctatggttctcatattctcagaatgagggttagatttcatgaacttctatagaggttgtctgagaggcgtattccatctggctacatgttagtgtttatcctaaagttcctgactaccctaatcagggatatatccctcttggtaatattctactagccgctctattcgtctctagctctcgatagatatatgcggctcataactagtatgctttgtcaaggttcctctccctttggacctctcctagcggtctcgtcatttcatagcggt

SEQ ID NO: 571989 - DNA, 113 bp, Homo sapiens
ctcgaagcgtgtaaatctaatggttgttccgggctggctttgagcaagtagcctcagatcgtgggggtgaacgcaagcaatcacggggtaaccaccggtgacggggtggtcgg

SEQ ID NO: 571990 - DNA, 611 bp, Homo sapiens
  misc_feature (46)..(46): n is a, c, g, or t
  misc_feature (120)..(120): n is a, c, g, or t
  misc_feature (141)..(141): n is a, c, g, or t
  misc_feature (183)..(183): n is a, c, g, or t
  misc_feature (195)..(195): n is a, c, g, or t
  misc_feature (229)..(229): n is a, c, g, or t
  misc_feature (278)..(278): n is a, c, g, or t
  misc_feature (453)..(453): n is a, c, g, or t
  misc_feature (508)..(508): n is a, c, g, or t
ccctcaatggccaaaaccttaagaaaaaggccaacctggcaagaanccctttgagatggaatctacccaaccaaaagaatttgaccgggccaaggatgtggacgtcaaaaactttgccgnggaggctctgactgttctttnatatcccctgatcctggaagaggaccaaacactggcctctgntatcaaccctgnaaccctcaaagaagtccctccttttggggaaaanacggggggggcctttggctgtaactccctgtggatggactgaccccagnccccttcccccaggagggttcctcctctccccagcctgggaagatgtctcactgagccacctcccaacgggctaggggagcacggggttggacaggacagtgaccttgggaggaaggggctactcctcccacatcagggagagatgtgagcatcccgggtcactggatcctactnctgtaatgggaacccctcccccatttacttctccacctaccgtcctccccatcantggtttttttttgtgtgtcaactgtaccgtttttaatttattccttttattttcccccttttcacagagaaataaaggtctagaagtagttggaaaaaaaaaa

SEQ ID NO: 571991 - DNA, 520 bp, Homo sapiens
  misc_feature (204)..(204): n is a, c, g, or t
  misc_feature (271)..(271): n is a, c, g, or t
aaatcccacactggtcgagtcttatggtggagtgcagtgggcgatcttggtccctgaacctccgatccgggttcagtgatctcctgctcagctccgagtagctggattacaggcaccaacaaaccatgcctgggtaatttttgtatttctaagtagacgatggggtttcaccaatgttgaccatgctagtctcgaactcttganctctagtgatgtagccacctcgacctctcacagtgctgggattataggaatgagttatgcacctggnccctctgagcttctttatggacatcagataattgtattttattttaacagtagttttatttctctgattattgaggtatttatgtcaaaaaattggacttggacactactagtatgctacacttgttgatgacacaagtgagtcttttttcagtgactacacaatgtatcatctaaaggagaatcatatccttttacttaaaaacacattctttttctttctggcatccctatgatatcctcttctttg

SEQ ID NO: 571992 - DNA, 352 bp, Homo sapiens
cccgacggattccccacatcacgcaccacgatcaatacactttctggggctccaggggtgtcaggtgtgcctatgtgataagaatgtgggctagtggcattttttatcttagagcgcacagctataatcactgcgcccgctcataaggggatggccatggctaggtttatagatagttgggtggttggtgtaaataagtgaggcaggagtccgagaagattagttgtggcaataaaaatgattaaggatacaagtataagaaatcaggattcgaccttaagtgttgtgtatgagtaatcatatagtataaaggggtaagatagattaataatcgaggaatagcaaaatgtga

SEQ ID NO: 571993 - DNA, 990 bp, Homo sapiens
ggaagaactagtctcgagttttgtttctcatttgggcgaaaacagaagccaggtttctcttctcaaagggttcagcatccccaatcactcacgtggtggtgtgtgtaccctaaggtattggtgctcgctggagccatttaattctccctcactcttccgattcgggattcttctatctagcgatttgagtgacaccacgtcagacaacattgtctctcgatctgggctcaaagaaagaacatctttggcactttaggcaacgagtggtggcgtctcctgtgattaccattttgcgagtatgagcgttcttgcgcctcagaaacatcagacttgtataaaagaagaagccacaagtcttcgtgaagaggcttgccagtgaaagtggatgtgtgtcgtagccagatattccgttgaaaccttcgtggagagggaggactcgagctcttgacgtggcccttgggaagcctgaaacagcggccacgcaggggaagccatattgtgctctcaggtgtgctttcagaagaccgtgcttcgtgcaacagagtttcttcccgttcttgggtctccacttcaaacgaggcgttcacacttattccgattgtttccaccagaaagaaaccaattcaccgtgcgtggttctcgtgggaaagaactcagttccctctttacaatttgctctccttgggaccattaagaggcacacagccttcctttgaatgcgggacatttccgtggaaaaaggagcgtctccgtgaggagctccattcgtgcgagttccttttccgtgggtgcccagggacctggctgagactcgagaggaagctcgagaaaggcatccttagagaccgtgcgtcacgtgaacgtactttacgcacaaagtgattccagcactctggtgcgtgttaacctggcgcaaaggagtcccaggacagccctcttggtcctacagtgtgggcttttcctcaaaggaccgaggttacacagcagttg

SEQ ID NO: 571994 - DNA, 294 bp, Homo sapiens
  misc_feature (282)..(283): n is a, c, g, or t
tgactgaggacccaacacagcattcctcgctatctctattatgcaggctatcaaaaactcacttattatattcaggctcatataaagtacacagaagttataaaatgggcaatcacaatcctcaccatccaggtcattcaatctattaagggacacattcatttctgaaaaggttttaatactaacggtattcagaaaatttctgaaattcataaaaataaatttgctatgaaagtatatagtagagcatatgcggtgtttgggggtacccgagctcggaannttcgtaatcat

SEQ ID NO: 571995 - DNA, 916 bp, Homo sapiens
ccggtcctgcccatttttgtgtagtccgtatttcttatagatactaaaaggttctgttgggccgcacattcccggtttgtcgcctattctccggggacaaagttttggccaaccttctttcgtccccccgccaatgggccgccaaaggctttcgcgcgttattgcgctcagcccatagggtgaccccgctgggccctacttcgccacagggtccccacgttgaattactgaccttcgacttggcgggctgacaagaaaacgcgttcgtctaattcttgccgcgccacttgtgcatgcacgtgtcaaatatcttgcgaaccccccatcttcgtccgtggtggccgccctcgggataaaacttggtccctggccccgaggatgaagccccccacaataccagggggtaaagctgggtaaaaagccctcccccaattggggggttaacccccagggggaggccgtccccccaaaggctgggtacccacaaagcttctaagcaccttctaacgttccaggtgaccgccctctgacgactgtgcctccaaagccggacgtaaccgcgcggaacacaccccaaagtgtttaagaccccgcggcacatctacacacaaacagggccctcagggcatcccctcttcaaaaagcgtgcacaacgggagagtctttaaaagggagaacagcgccccccaccccgatcgtcaaggtcacacccgcaagaccaccactgcacaccctcggcccccgtgacacaccgtgtgtcccccggggacactgacccctactgtgcggtcgcgccgcgaccaatcatttgcacgcaccagcaccaccacgacctgcctgcctcggcgagtaaacaaagctaaagatggggggaaagaaaaaaaaacaaggaaatttgtgcaccccaaaaatgaca

SEQ ID NO: 571996 - DNA, 291 bp, Homo sapiens
ctatagagaatccccctttgggggtcttggctcatgttgtcaagggaacccaggaccagatgcatagagtgataaaacaatctaattgtatcacaaatgtataaaacaaccacagcgatggggtggatgaaattgttgtgggcctaagtaattttggaactggagcctataaacttaagggcaaaggaacctgtatataagaactgcactctagttgaaaagttgtttcctgcgggattggggttaccaattatgatcctgctgtacaggtatgctggggctgaacaaata

SEQ ID NO: 571997 - DNA, 118 bp, Homo sapiens
aaactccggtacttcatgacgtccactgtgcttcgggcgtccttatcacttgcttgctcacgttagaattttatgatgcttcgatgagcctaatttctcccctaccccatcctaacac

SEQ ID NO: 571998 - DNA, 129 bp, Homo sapiens
atcttatcctagaagcccattactcactcttacagtagcatgcctactaaactattgtgtcttgtttgtgcttgtccaggagaacagatgaggtggactgtgtgggaggtggggacgtaatgttctagc

SEQ ID NO: 571999 - DNA, 186 bp, Homo sapiens
atcacttaccactccaagccatgagtttggctttggatgtaacaagattgaggtgttcatgggttgacaagtgggaaaaacaaggaaggaggttgagtgtttaaggactgctggtttgaaggagaaaggctaggcctcaaggcaaaaggtcagggcttatcaagttgggaattggcacttaaaatt

SEQ ID NO: 572000 - DNA, 264 bp, Homo sapiens
gtttgaatttagctaagcagaatagtaatagaggatgtaagcccgtggacgattatgaaaatgactgcgccggtaaagcttcagggggttataggatgagaatggctgtaactacgaaggctatgtggctgattgaagcagtatgcgcatgagcgcattttagagatctgtttgtacgtcggcagatagagcttgttataataaatgcctcataagggatagtacaaaggcaagggtaggctaatatcgttttgtcaaggggta

SEQ ID NO: 572001 - DNA, 104 bp, Homo sapiens
ttgtgcagctccattctaggcctctctgaatatggctccacagctggaagggtacctcgagatctgatatgcagtaattaattttgctctctgaatggattgct

SEQ ID NO: 572002 - DNA, 115 bp, Homo sapiens
ttcgactctaaggatcagctcaaatttcttttgacttgcggggactctagaagatcagctctaatttcttttgacttgcgggggtccacttgatagatcctcaatagtccagcga

SEQ ID NO: 572003 - DNA, 247 bp, Homo sapiens
caagtggttaaccagtcctcacacttgaatagcactatgagacaattcatactacagcattcttacacataagagaactcataccagggcgaatgtcttacggaaggtgacgaatgtcgcggtcgtttaaatgcacctcaatcctttctaaatcataagatacttcataatgccgagaaactctccaatgtgaaacatgtgagaaggcttgcactcacacctcaatctgtcgtagacataagagtac

SEQ ID NO: 572004 - DNA, 128 bp, Homo sapiens
cctgccagcgcgaagggagtgtgaaacaggtcgagctggtcagtggacgcgggagcgataagttcctggtcgcaaagctcaagggtcttgatgaccgtgaagaagctcgccttctggccggttatgag

SEQ ID NO: 572005 - DNA, 391 bp, Homo sapiens
  misc_feature (122)..(122): n is a, c, g, or t
ccccttaggaagtagtgccttatattaagagttccaaatatgagtaggatttacccaaggtgaaatatgaggataaaaaaatctccccacgtgtcatgattaaagcactcccatgttgaccnaccgggccgtgagttgtcacgcctgtaatccccagagtgattacaggcacgaggctgaggcagggagatcatttgagatcaggagttcgagccctggccaacatagtgaaaccttgtctctactaaaaacacaaaacttaggtgtggtggtgcacgcctgcaatcccagctacttgggtggccaaagcaggagaattgctcgaacccgggaggcggaggttgcagtaagccaagaatcggccactgcactctagcctgggcgacagcgc

SEQ ID NO: 572006 - DNA, 131 bp, Homo sapiens
agattaagacttcaggagtatataaccgtctacagtatgcttcccatccaaaacactaggtcttcatctttgtttcttcgaccacgcatgtgcttcttttttagtaaagagtgtggtttaggtgtaaatat

SEQ ID NO: 572007 - DNA, 179 bp, Homo sapiens
caggctagaagtcaggtgccgccttggattgccaccacgttaagacctggccagagtgatctaacctgctccagggccagcagcgtgctacgggtcttcttcatctgcctcagggatgccagaaggaggaaattcctgggctgaccgcacagcattttccaggtcttggaacttgacat

SEQ ID NO: 572008 - DNA, 339 bp, Homo sapiens
gtctagaggatctccagaggcacaaggaggcagaggtggcagtgtgcaaggatcgcaccactgcactccagccggggtgacagtgagactctcacaaaagaagaaaaaaaattcccaaccttgccaacataacaagaccatgtctctacaaaaattttaaaaattaaccaggcataggggcgtgcacctgtagtcctagctactcaggaggctatgacaggaagatcactggtgcccagaagttcaaggctgcagtgagctgtgatcacttgtgcccaggagttcaaggctgcagtgagctgtgattacaccatggctctccagcctgaatcacagatg

SEQ ID NO: 572009 - DNA, 270 bp, Homo sapiens
agggggctggtgactcgccaggtcatggatctggctgcttggtgccatgcagtccgggctcctttcttctaggtccagcgtacggtggggtcaaagccactctcggggtttccctcgggccctccagctccttgatcagttttggctggcactccatctggtgatggttttcctcccagttccgagggcccaggccattcccagagtcaacaaatggctttttcgaggtcctggcacctggtcctgctgcggggcatccaatcgatttgg

SEQ ID NO: 572010 - DNA, 1147 bp, Homo sapiens
  misc_feature (203)..(203): n is a, c, g, or t
  misc_feature (257)..(257): n is a, c, g, or t
gcacgtctaaggtgttttctagcatgtgcccgctgtacggtaagggacggcagggctctccgtactaggttgctgctggtgtgtgatctcttcttagtggatgcttcctatccctactagatgatagatgacgcacttcccgccaagaagacctcctgtgtggagccagcggtgcctcggtcctctcttgtgtgaagcagctngtgagcactgagagctcgtggcgtggtcattcatgacatgcatgatgacggaangcgctatttcctggttaagcgataggcaggcgcgattccacgcgcgaagaagggcagcatgtgtttggtctgctgtttgggtaacagtcttcttcctgacacaactaccatgtctctaaaaatcaagaaggtcctggttttctcacgcgaagacaggtgtgtctagaggggagaaaggggccgatgtttgtaatccaagaagagcgatatgtatattgcaggtagtaaagtggtagccaataatggtttctaccagcgctgtatgcatggcacggtatcacaatatttatccttgctttgctggtggaaatagcaccagcctattctttaatgctgagtgtctttttaaatatgtagataatggcttatgggttggcttaatgcgtttctacacttaagcattttaacatgtttcaacgaaaacatgctaagcacaaaaggtaaatgacttacactttctatgaaattttgaccaagagtgttgtacgttaccccaacttggcgcgctgactcacgctcactcgggggcaactttctcggagaaatggagatttaaataggcacttaattggctcttcgtctggtgcttaaccctctaacactaccccacgtgaaaaccctttttccccacttgctttctcccataaaaacattggtgtgtaaaaaccccggtgccgcaatccggtgtgttggacaggagcgcaaccagtgttaagagcccggcgagaccacatctggccggttacaaccccggcggtggggtggttgggagaccacgcagtgggtcccccccgagaatgagccctcggagggggagcgttgtggagtccgaccaccggtgtgtctccccgaacaggaggcagtaagtacggggtggccgcctcttcgtg

SEQ ID NO: 572011 - DNA, 662 bp, Homo sapiens
actccagccgcgcgcacccccggggacttcggctccggcacgggtcgcgcccagctagacctagcacctgaggccgccggccagccgccgccatgggtagcctacctactacccagcccaacacggtgaagtagctaccggggacggggtcggcgccccgcgcctgccgctagccctaacggctatctaccgccatgcaaggctggcgcgtctaccatggaggatgctcacaacttgtatatcctgagctggacagtgagacagccatgtattcttgtactacgatggacataggaggggaggaagtttgccttgtcactgtgccaaatatacttcctgataatcatacaaaagatcagaaggcctacaaggaaggcaaagctacagaacggctttcagcacagaatgccttcttgggctattggaccgccaaaatggacccaactgcgagcacgctcattacccgagcctggcaacagcactggcacgggcgaaccccaacatggacgggcatgcaagcatcgcacccaggacacaacgtacgcccggactgaacagcactgctgctggcacacaggacggaggctggcacaggctgcatcgacgaaggcaaccagacctactgacgaccctgcaggaacggccaaccgggccaaaccgcc

SEQ ID NO: 572012 - DNA, 373 bp, Homo sapiens
  misc_feature (17)..(17): n is a, c, g, or t
  misc_feature (84)..(84): n is a, c, g, or t
  misc_feature (213)..(213): n is a, c, g, or t
  misc_feature (331)..(331): n is a, c, g, or t
cggtcgcggcgccactntactatggcatacctcgttttattacgcttcgcagatagggcattctgaaaacaaatggagggtttntggcagccctgagtccagcaattgtatcagcgccatttttccaacagcatgtgctcacttggtgtctctgtgttacattttggtaattctcaaaatatttaaaactttttcatgatttctgtgtctgtnatggtgatctatgatcagtgatctttgatgttgctattgtcattgttttggggtgccacatacagcgtcttttaataagacgtggaacttaatgttgtgtgtgttctgaccggtccanccacagaccgttccccatctctttccctcttcttgggcctcc

SEQ ID NO: 572013 - DNA, 111 bp, Homo sapiens
ctgggcctctatcaattaacacaccctcgtattagtaggtattcactatttgttttttgaatacctactaatacgagggtgtgtttaattgggtagagactgcttggttga

SEQ ID NO: 572014 - DNA, 122 bp, Homo sapiens
gaggctctctgggctggaggtggggttgggcagcaagtcagccactcttcacctggctccctgctctgggccctgcacagagctgccaccctcttctttctccccagccttctcatttcctt

SEQ ID NO: 572015 - DNA, 1006 bp, Homo sapiens
tattgggagaaaaaaaggttttttttttgcatatggtacactcggggaaatgtcccacaagatacactctgggggtgaatataaagggtatattatttgggaggctccccgagaagatatttcccccacgcgcaagatatgagtgtctggcgtgtgtcatactccaacgcggcgcttgtgagtatataatctgtctttatgatgtgggcgccccctttgtcccccctctttttgtttttgtgggaaagtcgcccgctgggggttttattagaccccctgttatcgccccgcgtgtgtttgtgtggcacccctttttttccggtgggtctttttgttgccacccctctttttttgcggttctttcttgttggttgctctctcgttttaatattcctttttctttctccctccccatatgtggggtgtctttgatataaattatgtttctctcaccacctcaaaaaagtgtgttcacacacgtgtttttgtagaagagggcgctgccctttacacaacgagagggttttttaaagagaattaggctccttggtttctccccacccacacagggagagggtgtgggggtgtgaaacgaccccccattgtgtttttttattggacgtcttctttgttatacaacagagagagagggccacgcggtgtttttctctagaacacaatttataaatctctctcttttcatagagaacacacccccctcccctctcttttgctccccctttctcttcccctcgtggcagcagcaggttcctcttttccgcggtgtgtgtcgcctctctctctgagtgttgccccgagtgtttgtttttttccccgagggtttttataatataacccctgcttggaatatttttttttctctctccctcttggtgtcgtctctctccggctttttcttttgtgggggaaatattttttctcccccccccctcccacacccccccgtggggtttttggagaaaaaaataacaaaaaaaaatgggga

SEQ ID NO: 572016 - DNA, 585 bp, Homo sapiens
  misc_feature (92)..(92): n is a, c, g, or t
  misc_feature (125)..(125): n is a, c, g, or t
  misc_feature (149)..(149): n is a, c, g, or t
  misc_feature (180)..(181): n is a, c, g, or t
caaatagaatccccaaatggattccccaaatggatccccaaatggaatccccaaatggaatccccaaatggaatccccaaatggattcccanatggaatccccaaatggaatccccaaatggatncccaaatggaatccccaaatggantccccaaatggaatccccaaatggaatcccnnaatggaatccagaaacaaatacacagtgccaagattatcaccagtagtattccaggactcagatgagaatgagacagttcctggaatcacagagaattgaacaaattttaagcagacagtaagggaatcagacttccatattcataatgcccctccatccaatctgcccatcacaaagcatgtggaaaattttccctcaacatacagtctctacactgaaaaaagtgacatcaaggtggacaatcagcttccccaccattcagggcaccctagtaggagacccttcccttttgcccacagaaactatcagtagtgtctgaagggagaaatattcctgagaacagccagagaccaagacggaaggtggaactaccatccctaagcctgaaaatttgctctggtat

SEQ ID NO: 572017 - DNA, 976 bp, Homo sapiens
gtgagagccgtgctcatccccatctcctggtgcaactctgttagcggctgtgggggccagtcaatggtcatgtgtgtgcagagtgttgcatagtgacgacacgcctgaggcgctagtcgcctgtcacgcaggcggccatcttgtggacggagctcatcggagttgtctgccccatacgtgcaatcagttgcatgggcgaggagagacatcatctgcggagaaggcacaggactgatggcgtggcagatgctaggccggacagatcgtgcggacgtcgatagggaggctagagtcgtcactagggtggcatccgcggccgtatatgcggacttcgtgtcacgccagcctggtggcattaggagagcttgctgaatcgatcgcgacatagtggtcctccgaatggcagggggccagcaggctcctcttgcgcggcgtggtggatattggggaaggactaggagcaaggttacgcgcatagggccaacccttcggcattggtgaatgatcctaaactaaggctagcatgtgtgacccttgaggcccgcgacccatctcgttacaacgaagacctagtactatgcaacccataggtacgtggcgctgactcgaggaggagtctccaataatgaagctagacttgcggtacgacaggactcggatgacctaggaagcttctctcgttgccattggcggtacctcccaggacatccccagaggtgtagagccgttacatagcgatggggcgatctatgtgagtgccacgcaccgagaatcacatctggaaaattgacgtcgctgactagcacctttttgaaaacccccgagtattccttttcaagctgtccaacattcgcgagggtggacccacaccggttgttcttcccgtcctccgtcaatcgtttagcttttccagtgtttcaccccctaaactctgttactaaaaccctggcgttgtgtggcacttctgggagaagac

SEQ ID NO: 572018 - DNA, 93 bp, Homo sapiens
agaatggcttgaaaccacaaggcagaggttgcagtgatgcctgtgattgcaccactgtactccagcctgggtgaaagagtgaaactccatctc

SEQ ID NO: 572019 - DNA, 962 bp, Homo sapiens
ctgtgagagaaggacgcggtccgacatgtgtagcgtgttcaggggcgagtcatttgggggcaatgtgttccgccaggggcgcctattaaggagtaggtcccccatggcgctaaccccttgcgggcactccacgccctttttgtgggatagccccctaagaattcgcccggggggaaaaaaccaaccgcatttgttggccaataaccacaaccgcaatatatgggccttactgggtatattgcactcgagagctgctttgtgctaatggtcgacccacccgcccgcccagtggcgggtggcatggccaccataagtccgttcccagacgaaagttcttctgaacggggtcctttcggtccagagggtgctcctcacgggcagagagcttttcttatggttgccggcctaggatgcccacactagggcatcatctcacttttgtgcggccccgcactgtctgcgtggttctttggacagggggacaccccgcgcacgttgttgttgggcgggcccctctccacacttctgctgtatgaaagaggagtgctcctctggatcattctctgtgtacccgcccaaatcgacgcgaggtattttgtcgcgccgcaatgcgttgatcagcattcatgataccaccggggaaactgtcataacacttctctcgacaagatcacaataccaccacaagcatttatcccattttaacaaaatgtcttcacacgaacccgtgtatatgttctcacacgagaccctatataattcaagtgatgtcacacgcagaatatatcacctcttcctgttgtatgtaaagcttgcatattcttcttaatataaaaattttgtcgccaacaccttctcttgttccctcaataaaaggtggtgataatcaccgtgtaatagaactatcaagacagaggaaaaacaaaaccaaaaaggccctttaacaccccgccaacaaaaca

SEQ ID NO: 572020 - DNA, 1519 bp, Homo sapiens
ggtttccctgctactgctgaactgttagcttagctctgtctgctagacctcgtaccccccatgtgggtactctggtggtcttttgcacctctcttatctccctggaggcttcgcctcaagacatggatgcagggtttggaatgttcgccgaggcttgtctgtggaatgccccgtcgatgtattcagccatgtcgtcgtgctatccttccgcttcttatagctggctcatggggtctacgtatttgtgatcctggaacatctatcctgttaggcgcacttgagccaagagtgttgccatgaaccaagcctaggaacgtttcatacttgagttccctttcactatgtgccgccagtctcacatcggtcagactggctttggtaccaccgagaatccccaagattatcgcgtgtgccgctctcaaggcgtgtggatttcctgtctgattggagttgggccccgaggtcccgtgttgtgtggccccggtgtggcccatttgctgtcagtgcccttgtacacctcggtgtcagtcgagtcggcccaagtgcgtgtgcccatgctgggtgttccgtcgcacaaccgagtgggttggctcccggtatgcaagagccgtcgcggtatctccttggacttgtttccgggaccggcgtcgggacttctatgtcacgaaaccgtttgttgcggcgtttgtgtccattggacgccacatgggcattttagcggcgtagagggcttagccccgccttcgtccgatccctttccgccgaggctcggggcgccgaatgagccccctcttgttgcctgtttcacgttcgtaattaaatacggtatccgccaaaatgaaagcatatagagttccgcactatcgagagattattcgctatgcaatttatgggcagtagcgcagtatttggaggacccgtatcccacgacgcctaacaagaggaacccccagctgtaacccgctatagcattacattactggagagcgatatcaaaggacgcccattaagagcatgcgtgtaggcggacccctttggatattgagatctcccccttttaagttaaagggaggatccaagccattcataacgtcctgtatacaaatgtaattcacaatacttttgactttgatgttaaagggcctacttatcgcgtaaagacaaacaatctcccagatagatttaaaaagaatattgagcgaccaaatatcagcggagattgataaagctaaatcatgcaacacacacttattgcaccaagaacagattctttgtgaacggaacaaaaacggtcgtccaacccaaaacctacatacaacaacccgcgaatattgttgtatgcgaacacatgaaaaacagagtacatagtagtatgaacaattgtcagagttaacatgcacccacagaagtcaaccacgacgacacctgatctactactcagcgttgacaacatgtctaatcatcgcccaccatgacgatgaacacagatccatactcatcatcaaataccaacagccaa

SEQ ID NO: 572021 - DNA, 355 bp, Homo sapiens
  misc_feature (6)..(6): n is a, c, g, or t
  misc_feature (13)..(13): n is a, c, g, or t
  misc_feature (18)..(18): n is a, c, g, or t
  misc_feature (37)..(37): n is a, c, g, or t
  misc_feature (190)..(190): n is a, c, g, or t
  misc_feature (218)..(218): n is a, c, g, or t
  misc_feature (303)..(303): n is a, c, g, or t
  misc_feature (325)..(325): n is a, c, g, or t
gctctncgtgctnggccnttctccatgatggtaaccnacatccttggttggtgagtgacgacactgttccacttcttgatcctcttcgtctgcctgccgacacgtcttgggactagtcatcccccagtcatggacttccaccatcggaatcaccgaggacacgtatcacgtcatggcgaccgttttgggnggtgcagccgggctggcggccctcgtcngactcatcgggctgttgtaccgcaggttcatgactataagtctggtgtgcctccactgactaacctacctatggactatctgtcnaccttatgtgctgcttcacttnttacagtcacgctggggtgctgggcctacc

SEQ ID NO: 572022 - DNA, 816 bp, Homo sapiens
ttacataaggaaacagatactctagccaaggccagagagacaccaagtgtgttggaagccaccatagctacgacagaatacgtgacggctagtgtcgggctatgacgttagataggcacgggcttggggaccataatgagaagggccttgtaagccacaggttgtgactttggctcttacgtctgcagggggtggaatagctgttagaaggttttaaaaaagcaaagtaagaaacagtatatcttgtcgtttaagagggtcctcttttggcttgtgatgttaaaacatatggtagagcaggacaggagacccatggcagaccatggtacgaatcccaggtgacggggtgatggaggctggcgagcattttttcatgctatgctccataagggtggtaagtaataaaaaatctacagacaaaggaggacacagaatagtagaatatctcactcactctagcccctctatctaacttgttagaatagttttggaaacagactagtacaccaatctagtcccattgtgggcttgtcctgctgggtttcaaatagcctctatctattatctataatactagacaggggacctggagaacattgctgcttcccccacatttatgtgatgtagctacatgattgagtcgtctactgacccgttttaaacttcacgttcttgtcccgtcgttctcgaacggtttacccacccgtgtctgaagtcgcctctaaatttcctcacaaacctggggcaccccctctttgcgcgcatataagcacggttcacgcgcgctcatcccgcccttcgtactattcagcgccc

SEQ ID NO: 572023 - DNA, 964 bp, Homo sapiens
aagcctaaaagataagtcggtgaccatctgtaatcatgatgcggtggtgaattcttggagcgctagcttacaataacctagacaaagagaagaatcaatcctttgtcctgtctctagtgtaaagtatctgtaatgaatgatcaaaagttcaaggtttaaatattatgaaaaactttaaacataaagtagtagaaataagacagtaaatactgtatcctaatatccagtcaggatacatgcaaaccaatatccatttaatcttgaacagcgatactaatgttgtaattataaaaaactgtgtaactgataattggtattaacttttaagagggatgaaagagagctatgatgtcctaggactgagagtaccccaggtaagagaataccccttgaagagggtctccccttccccatggtgaagtcaggcctaattggagagagtggctacagccgtactcagtgattgggaaattccctgtcttgcccgtggggccagagcgtggtgtagccctgcatggtggatcaggtcttgaacaatgcaagatgaaactcacactctacaactgataggccagaagcctcttgtagggtgtgagcaaaactctggacaggaactctcagtagatgttgtgtagtccagattctgcagaggaattccttaaaagggattggtttgtgttgctgttattaagtctaaccacgtcccatagagctggaagtgtgagagcatcgaggtggagacctcagaaagctgatggtggcaggccagtcccaagggatcgtgcggaggattccctgtcgggaaaaggcgagggttttactttcagacatttcctgatggtgaggcctaacatttgggggaaagctggtgaaccagggccggtggtaaggggggcctataaaacctccgaaccaaaatttggttaatggaaacggaggggatctaaaaaaaaacccgcttttg

SEQ ID NO: 572024 - DNA, 1040 bp, Homo sapiens
gctggtacgcctcggtttacccggtgatatcgtcgatccacgcagtacggtccccaaattggacatttgaatggactaaccacaaacaactggaaagactgaatttccgacacaaaggaatgatgagactcaaacagaaacgcagtgaggagctcttgagtactgtagctaccgtattcttattttaactctgcttcatccttgatctacctgcagacactaagcaagcgacaattagttttccaagagctcctttgaacctgtctaggactgtagttaaacctatttgccctatgggggttcttcacactcgaaaaactataaccttatcaccaacgacccacccagacaaggccaactgaggccaaactgtacaccactacctcaacactttacaatataactatctacacattgccacttaacttgtgaacagctgcacctcacacacgggctacgcaccatactcccaagcgcacgcacccgaacctggctgcccacctcccacggtaaatatctcccttcacactactccttccccacattcacacacacttccaacatccaaacccagacacacaactggccactattcaccaacctcttttcctcaccacacagggtaacaacgggcactcaatatactcggcaaaggcaaaagagcaacactccaactcattagccccgtctcaaacgaccatatacctggccccctctaacagacagcttagcctatcacccttcacccccctatcccacagaatttacaccctatactcgactaactcccgcagaccaatatcaccatgccccatctacccatacactgcctatagaaccccacgcaacccctgagcccacaccacgagccacaacatacatctcacctatatcggcccaccacagcacccccccactaactgcgaattcccccactaaccacgcttcacattacatctcaaacaactctttccaaaccgtctacactatacaaatttttggttgagcctacacccacatcgtatactaaaaacaaaata

SEQ ID NO: 572025 - DNA, 549 bp, Homo sapiens
ccagtttttttttaattggtaaagctcggccataaacttctagcgtgtgccaatggtcaccggccacactcgcaccaggtggtccgtgtagccagcaaacagagtctgggccatcagcaagaccaggccagggaggtgcactgggggtggtctctggcctgtgcgtgctgggtactggataacttctggctacagttcatctacaaggatctttccctctaaatcccagatcttgatgctggggctgtggagcacacagccagtagcggtatagggctgaagcacagggcgttgatgatgtccccaccatctagcggtgtaaagggtgttggcccttcgtggaagatcccataacagtggccgggccattccttgtgcctccagaaagcacagagggatccatctgggagaagacaggtcaaccgggggtctcagagattaggcctggtggtgggccaatgtgggtgggtctcacaagctttggcaggtataagcccaagggtctcccaatacctttgtgacccagcttggtccccaagccacagggag

SEQ ID NO: 572026 - DNA, 381 bp, Homo sapiens
  misc_feature (4)..(4): n is a, c, g, or t
  misc_feature (7)..(7): n is a, c, g, or t
cctnacntcaacccagtcaacctctctacaagaggagtattgaattctggtggactgtcagctttatttagctgacctagtgtttcccagaaaattgatccaccgtctaataaatccagaggtttcacattaaaattagaatttctggcctctctcgatcggtcagaatgtgtggcaattctgatctgcattttcagaagaggacaatcaattgaaactaagtaggggtttcttcttttggcaagacttgtactctctcacctggcctgtttcatttatttgtattatctgcctggtccctgaggcgtctgggtctctcctctcccttgcaggtttgggtatgaagctgaggaactacaaagttgattgggttgacgtcag

SEQ ID NO: 572027 - DNA, 205 bp, Homo sapiens
tctattttattattagtttgaacttgcgaaaggagaagtacttggccgcatacgattttattttattttatttatttattttgagacacagtcttgctttgacacccaggctggagtgcagtgcagtggcatgatctcggctcactgcaacctccccctccagggttcaagtgattctcctgcctcagcctcctgagtagctggg

SEQ ID NO: 572028 - DNA, 211 bp, Homo sapiens
aggtgtgcgagattccagctattccttggaaagttccctagagcttttacagaagggatgttggtacagctccatgctcctcgagtatcagtctatgagaaggggatgtaatttggctgtactcagggagatgggatttcatttcttttgggcctcgggaattgatatttgaaaaaatcggtctgttctccctgttttttctaggggtgga

SEQ ID NO: 572029 - DNA, 373 bp, Homo sapiens
ccaattttgttatcaactaaaactgctctaaaaaactattttaagtaccagtgttgaatcgtttcagggtaagttatttctcaatcaaaccacatatgctgtttaggacatatcagagaataaggaaagaaaaaaagcatttccattcttttaaagacactgacattttactgtgctgataccagacttgtatttgaacttctatcagaacttgtatatacatgtgtaggggcagggaatatatgggaaatctctgtaccttccatttaattttgctgtgaacctaaaactgctccagaaaataaaaactacaaataaattaattacattaaaaagtaaaatgcagcctggccaacatggtgaaaccccatct

SEQ ID NO: 572030 - DNA, 486 bp, Homo sapiens
gtgtgatcagacagaaatgatgccatagtcccacccccagctccaaaacttggtcagagattgcctgagtcagaggcagaagggctgggctgagagtaggggagcagccaggacaggaaacaaagcagacaactcctaatctcttcccagaggaactgacttcatttgcaacacacctagcaagagtccaaggctaagggtgttctcagaaacactggagatagtagcacaatgtacagggtccccctttatctgcaggggctgtgttccaagacctcccatgggtgactgaaactgcggattatactgaaccctatactgtgtttccctatatacacatgcctcttataaattttaattcactagataagtcacaatccgagattaacaatagctcataatagaacaattttcacaatacacgtgtactaatagttatatgaatgtggtctcccaaaatatcatgttgtacctgtatgcaccctt

SEQ ID NO: 572031 - DNA, 127 bp, Homo sapiens
ggactcaagcctctctttggctaactggaaatgcgcatgtccattaccatccccaggtgtctcgagatactcatcaacggcctcaggactacatggcagcggttgtatgcagtataacaggatcacg

SEQ ID NO: 572032 - DNA, 224 bp, Homo sapiens
ctaaccgacgacatgattgaactttctctttccccctgtatgatactactccattccaaactcatctcattctgacacccggagctacacattaccctaagtataacagcgaccctcttattctagaactgcatatcatcaatatggtttacgacctcgcatgttggatcatgacatcccgatggtgcagccgctattaaaggttcgtttgttcaacgattaaa

SEQ ID NO: 572033 - DNA, 196 bp, Homo sapiens
cgtatagttcagtgatttttttttagtggattacctagctattttcttgttacaaaattatgtcatgtgtgaatagataaccttactggtccctgtccaattgggatgcctcttatttcatggtgtacctaactacggttggtaattacctaattacctgacagaacctccagtacaaggttgaagataagtggta

SEQ ID NO: 572034 - DNA, 1033 bp, Homo sapiens
tcgtgccactgcactgcagcctgggtgacagagcaagacttcctctcaaaaaaaaaaaaaaacagtggctctggggatgccctctaaagtggctggagccatccttatgggcaccagcagcagtgacagtcccaccctccaagccctcaccaaggctggattcattggtctccgggacagtctgagggctgagcatttaagcctgtgggtcatcatggaccctccgtaccctgcggccattcaaaagcctgatggtttccttcctctcttatctgctgtcccttctcagcaccaggaaggaggaaaacacagcggagattggcaagaacgacaaggacgtgcaagggggcggcacaaagcaggaaaggacgcataaagacataacagcgtgatgagagagagaaggtgccaatgaagccaaggaaagaacactggaccaaataaccacaaggagttcaaaactaacggaggaagagaactaccgaggaacccacattagcatggagcaaaccaaggtggggccacacaagggatggcaagactcatagatgaagagaggcccctatacaagcggaaggaacaatacaaacaaaaacactaaaggtgatggaaaaacccaagagggcaaaagaaaggggcagagaggaacggattgaccaacgaaaagaaaggaagacaaagaacagaacgaaggaggcacccaacacccgacaatgttgggacagggaaccaggacggtgataggaagaaacgggcagagccaagggaaatagccaatacagagccaaagagaagagaaacgggacgtaaagccaagaaaaagaagtgcatgaaaacacaaagcaagagaaacagaagacaaacaggaccgagaacagagcacaaggcagaaaacgaagacagaacaagtgaacagaaagagaaaggagacacactgaaacgtagcaccagaagagcacaaagcaagaaacaacagaacagaagagccagacaagacaaaaagacagtacgtaataaaaaagcaaattaaaag

SEQ ID NO: 572035 - DNA, 657 bp, Homo sapiens
ggatgatttactgcctgaaaaatctcacaatatctgggtaacaagtatggaaatggaactctggatttgcagttatactggcaagtggaccctttggctgcgttcttcatactaaacgccaggtgaatttttcctgaaaacatctagtggctaaaagagataccaatagacctctaaaacttcgcacaagaccttcaagatcacagaaatgtttaaaatttgattccagttaataacagaggtgcgtgccagaatgcctggactgcagtggatgtgccccactctctttgcttaaatcaaaaaatatgtcaatagccaggcatagtggctcacgcctgtaatcccagcactttaggtaggccaaggcgggtggatcacctgaggtcaggagttcgagaccagcctggctcatacatgcgtgaaatcctgtctccactaaaaactacaaaaattagtcaggcgtggtagtgggtgcctgtaatcccagctactcgggaggctaaggcaggagtaatcacttgaacctgggagggggaggttgcagtgagccaagatcgctccattgccctccagcctgggtgacaagagcaaaactccatctcaaataaataaaaaggaaaaaaaagtcaataaactgtacaaattaattacagtatt

SEQ ID NO: 572036 - DNA, 538 bp, Homo sapiens
  misc_feature (399)..(399): n is a, c, g, or t
gagtcctttattagccggcagccgagagacagctagcgctcgaaattctcttggccccgaagaaggagctagattttcttttatactttggtttagacaggggagagggggagtctagttgaaacaatcttacagaagtaaagtaggcaaaaagttaaaaggataaacggttacaggaaagtaaacagttccaggtgcagaggctttaagtctatcctaaggtgatggacgccgggctttgggcgttatcaaccggacacaaacgcaggggctctgggtgctattaaccgggcgaattcctgggaactgcggatatagcttgccacagtatcttatcagttaattgcattcttgatgtgctgggagtcagcttgcacaagttaagtccttgaggaaggnggtgggtgaagggctgctaatgaaggagtcacgatagagtccgtctggctcttttagctaaggagagtcacttaaggtaaaacagggcggggctcacactagaagccctacattctcagctttagtcaggcaggccatt

SEQ ID NO: 572037 - DNA, 305 bp, Homo sapiens
aaaaaaacaaggggggggggccctttttgggggctttggcaagggggccccccccccccctttgtgtggtttgggggggttttcccctttttttttggaaggcccgggggtttctttttcccttttcccgccccccctgtcccccccaatttgggttttttggttggggggcctttccccttgttttgtggggaaaggggggaatgtggccttttcccccccgccccttcccccgggaaagggggggggggcccccccctttttttttcccatcgggttttttttttaaccctggggccccccca

SEQ ID NO: 572038 - DNA, 1200 bp, Homo sapiens
  misc_feature (1085)..(1085): n is a, c, g, or t
gtcagtctctcctgttttttgttcttcgttgctcttgtgactgtgcagcgtgatacgagatgatgatgatgatattatattgtgaatgtgaaggaagacaaggagacgaacgaagagaagagtcggaagtttagtatgtccgctctatttggtcgacagatgctgatctcttgggtgtaactctcccgttcggtaccagtgttgtacgtcttatcctgcgacggtacacactactgtgtgttgcggcgcgcaccatatgtgtataacatgcgaaggcaccacttgcgtgttaataggtgcgcgccggataggcgcccctcgagctattttgggccccgtgtaaagtcgtccttggtagagcgctggttgttgctcgttcgaaaattagggggatgtcggcgttgtgcgcggaggccgcacatgggtttctctgggtgcggggtctccctctgcgcggtgtgtctctctcggtccccgggtctccccccaggcgctttgtggtgcgctcgtcgccgcggtgagagtccggttggtttcttgcacaaagttgtgtcccagtcggactgttggctcggtgttgctcgcttcgagggtgtctccatgttgaacacgcgagcaattcccctggtggaaaaattatttggggtgaccccggattccctcggcagaggaggaaccaccttggttataagataagtggcgggcacgtcgtcggtggtcgccacctgttaattgaaaaatcatcgggagtgggcggttagatggaggcgggtagttttgtacaaccacacacaggcgtccacaacgttgcttgtgtacatttctttttgtcaaaagaggccgctcactcacgctggtgttgtttacaccgaagggggtctctctctttcaatggggctggtatatatcggtggtgttcccccccttgttgggcacaccaccacacgagggtgttccacacaattgtccggcgtagcaataaccaactcggccgcgggggtatagtcacaactgctcctttgcttatggacatgatgagagtagcccactccccaggaggttccccttgatttatgaactgtctnttcgtgcacgcaccagaatggatataagatagttacttatttaccctctgcttttctctagccattgaatataaaaaaaatgcaggggctgtactcatcattgatacaagaaaat

SEQ ID NO: 572039 - DNA, 707 bp, Homo sapiens
  misc_feature (407)..(407): n is a, c, g, or t
  misc_feature (707)..(707): n is a, c, g, or t
tgatgggtctagcaatcaatgatagcttactcagtgccgtccctagtaaggatcctgtgttgaacaaatagcctctgacatctgtcatctccagagagtggtgtgcaaaatcatttccccagctgatgctcatcgagaacctctgcctagctcttcgaaggtcacaaggaaatgtaacgtatctgaccctacaacggccaatgaccagtgatgatatgttatcccgcattgtggtgaggtcttgagacatgtccagaagtgtaatccctgcgaatatctccgggtctgcaagtcttgttccggtagcaactcaggcagctgggctgactctcgtccttgcgccctggaagtcgaaccaggtcgcctgacgtgcgtaaacctctccgatcaatgagcattctgtgcantgaagggttgcttacagtttgcgtgtacacctgagcttatgagacaccccaacgttgtctttctgcatgaggatatgtcgcatcggacatagatctgctgaagcgcttagcaggaaaacgccacatgttgcacaaggaaagccttggactgcctagtgtatggcttgatgcacgtcgcgcggggagtgcttgaacatgagccatgcttcctttgtgacccaagagaaagcccccagtttggggaaagtacagggggatgaacgctttcatggtgctgaggggcgttgcatggtacccccn

SEQ ID NO: 572040 - DNA, 980 bp, Homo sapiens
gcgctcgcggccacgccggcgtcgcgggtacattcctcgctcccgggccgaggagcgctcgtggctgtctgcggacctgccgtgtgcagtgtgtcggcggcggctggagctgggagtgagttggcggtggaggagccagtgtgaggaggagccaggtgagcatggaccctgtgctgggcgcggagtcactgcatgctcgaggaaggcagttggtgggaagtccagcttgggtccctgagaggctgtgagcaaggagatgcgtgtgttgctggccctgttgggggtcctgctgagtgtgcctgggcctccagtcttgtccctggaggcctctgaggaagttggagcttgagccctgcctggtcccagctggagccaggaagagcaggagctgacagtagcccttgtggcagcctgtgcggtctgtgctgtgggcggcttgagcggtggtggccactgggtacaaggagggcaggtcgactggcacctgctggccgtgtacggggcttggaggggcgcgctagagattgcgagtttcctacctgaggatgctggcgctaactcttgactggacgagggtccatgatcggcctgcagaatctcaccttgattacagggtgactcccttgaacctccaaggaacgattgattgacggacccacagttccatagggacccctcgaatagggagagtaccgcagtaagcatctatgtgggaagcgcggcagggatggagaagagagtggatgagtactggggaagacgtcagtcgatgcagtgagggaacgagggcaaagcgtgcgtaggtgaggcttcatgggaacggatggggattggtggaatagatgagttgtgaggaagtgtctgagggagatacgttgtagagggggcggccgtaaagagatggggggcgaggaagtgagggacgaaagggggagggttggtgggatgaaaggggggtaaaatgtggttttcttgggcgg

SEQ ID NO: 572041 - DNA, 152 bp, Homo sapiens
acgtgtcactgcattttatccttcaacttgtggatgcaggcaggtggcatgatgccagagctctcctacagagatgtggtgcaattgctgaacacaacccgatatagtagttgttcctccttaggaattctaggaaacaaggaaaggtactg

SEQ ID NO: 572042 - DNA, 898 bp, Homo sapiens
  misc_feature (200)..(200): n is a, c, g, or t
  misc_feature (298)..(298): n is a, c, g, or t
agcggaaaagtctcctaatcgtaggacagcgtgcgacccagcccttcttcacctgccgtccaggtatcgatccgtagtcgttaccctccggctctgggatgggaaacatcctcgtctagctgatggtgacgtcagtatacgatgagtcccagacgtgggaaaagtctggttcaagagttactcgttgagcatccttgagntttccgtgaggttgaaggggaactcattcttcagtgcacgcacaggcttgtcaacgcctgtgcgagcatcaaagtaggcaagcgcagcacgagtaatnaaccgaaacatcggcgaacacgctggctgaagagcggatgacgcagtcgatgtatctgcgattctccttatgctaagtgaattgccagccgatgcctggctatctgcctacggggaaagaggaggagtccatgggagaagtgggcagaagcaggaggcatatagcaatgtcagacatgtttaggtactagtcatacgactgacacaggagcaggatgctcgagatagtttatggtgacgagaaggatgaacgaggacaattcagcgagtactggccaggtggacaacagacaggagctacttcggtgactctcactttgcagaggaacttaccctggaaccaacttttgctgggccctggacttgtcaaaaggctgtccgcaacgaagagcttcgcggaatgcgtaataccttactagttctagctggaccgcggaagaacgcaaggaagacactaggacgaagttccaggggacgaaccccatgacggcacacggagcgtgactccacgacaggatactttaacccccttggcaaagccgtggcggcaagactggggctttcaacatccgtggcatcggcctcacaatgccacgggcaa

SEQ ID NO: 572043 - DNA, 189 bp, Homo sapiens
ctgcatgcgttggtcttgactctgggctcaggtgatcttcccacctcagcctcccaaggtgctgggattgcaggcatgaactaccgtacctggctgggctgataatttaaataggtcggctcaggccaggctggaaatgacagggctccagttgagcaaagacctgaccaacgcgacagctgacagcga

SEQ ID NO: 572044 - DNA, 650 bp, Homo sapiens
cctcggggaaaaggcctcgctttcgaagctttgccaagagcctgcgcgcacgcggtcgccccttttctgggggatctttccacacactttgcaccttttagaagaggcacattttaggggattttctgccacaacgaaatgtttcaatcccgcgggacccattccaagaggtggtccctgggttcttcccccccagaatatgtcctaatatcacactgggccacagagcacgtctagtctgtaaactggagacttgaaattataataggagggatcacggccccagcggcccacaggtggttcacaaccaccgtaaatcccacgccaccactttgggatagggctgagagtcgggcggcgaatcacccctgacggggtcacggggaagttgtgacgagacccaccagtgccccacaaactggcggacagaccccgtgtgtcctcccgccgaacaaccccgcaagtctacaccaggcctcggtggggcaccgacgataattccccgtgacttgggagggcgtgcaggccacaacaaccgggtgacacccacggaagggacccagggtgccccggagcacccagagtcaccaccccaatgcgctccacaccacggggcggcagaacagagcagctctcgtcccacaaagaca

SEQ ID NO: 572045 - DNA, 220 bp, Homo sapiens
gacgaggtttgccatgattttttctttacttcaggtcgcttctggatacccttgataggcgcataatgttaacttggcacatgcagtcctggtagactacccagtctgatactatcctgagttggcactgattggatcgcatgactcacagccctgtgtctttgaggacccaaatatcaacaccaccagtctggattttgcttcacatgaggtcctcatg

SEQ ID NO: 572046 - DNA, 452 bp, Homo sapiens
caagggtgctccttgcgtgggtcccttaacaaaatgccagtgtgggcggtttggagaaagggtccccatgggatttgagggggctgctgaactaccagtttttaaatttgggccgtgctgttccagtaaagtctctttagcctaacacctttgttaaaaaatggtaaagggctgggcccggtggctcacccctataataccacccctttatgaggccaaggcgggtggatcagttgaggttgggagttcccccccacccagaccaatatggagaaaccccctctttactaaaaaaacaaaattacctgggcctggtggggcatgcctgtaatcccacctactcgggaggccaaggcagaaaaatcgctttaaccaagaaggcgaaggttttggttaaataagatcaagccattgccctccagcctgggcaacaaaagttaaactttgccccc

SEQ ID NO: 572047 - DNA, 399 bp, Homo sapiens
  misc_feature (17)..(17): n is a, c, g, or t
  misc_feature (43)..(43): n is a, c, g, or t
  misc_feature (99)..(99): n is a, c, g, or t
  misc_feature (116)..(116): n is a, c, g, or t
  misc_feature (391)..(391): n is a, c, g, or t
  misc_feature (393)..(394): n is a, c, g, or t
ccccccccgggaacccnagtaccccctttccccccttggcccnccttttcccccttttaaagaaatgggaaatgtcctgcccccctatgccctgtcccnactgttgtaattttggnaaagtcaaataacttgttttggactttaacaggcttacagcccagagggaatctccccatagaatgaattgtacccttaagtctcaccccacatctgatttagatgagaccatggactttggaattttgagttggtgctggaacaagttaagactttgggggttgtctaagtgtggtgtttcatgcctgtaatcccagtgatttgggaggttgaggtgggaggattgcttgagcccaggagctcaagaccagcctgggcaacatagtgagacctnannctaca

SEQ ID NO: 572048 - DNA, 703 bp, Homo sapiens
  misc_feature (7)..(7): n is a, c, g, or t
  misc_feature (72)..(73): n is a, c, g, or t
  misc_feature (95)..(96): n is a, c, g, or t
  misc_feature (125)..(125): n is a, c, g, or t
  misc_feature (187)..(187): n is a, c, g, or t
  misc_feature (227)..(228): n is a, c, g, or t
  misc_feature (230)..(230): n is a, c, g, or t
  misc_feature (236)..(238): n is a, c, g, or t
  misc_feature (244)..(244): n is a, c, g, or t
  misc_feature (251)..(252): n is a, c, g, or t
  misc_feature (264)..(264): n is a, c, g, or t
  misc_feature (279)..(279): n is a, c, g, or t
  misc_feature (287)..(287): n is a, c, g, or t
  misc_feature (299)..(299): n is a, c, g, or t
  misc_feature (302)..(302): n is a, c, g, or t
  misc_feature (310)..(310): n is a, c, g, or t
  misc_feature (320)..(320): n is a, c, g, or t
  misc_feature (323)..(323): n is a, c, g, or t
  misc_feature (325)..(326): n is a, c, g, or t
  misc_feature (336)..(336): n is a, c, g, or t
  misc_feature (350)..(350): n is a, c, g, or t
  misc_feature (352)..(352): n is a, c, g, or t
  misc_feature (354)..(354): n is a, c, g, or t
  misc_feature (360)..(360): n is a, c, g, or t
  misc_feature (363)..(364): n is a, c, g, or t
  misc_feature (366)..(366): n is a, c, g, or t
  misc_feature (376)..(376): n is a, c, g, or t
  misc_feature (389)..(389): n is a, c, g, or t
  misc_feature (392)..(394): n is a, c, g, or t
  misc_feature (398)..(398): n is a, c, g, or t
  misc_feature (420)..(422): n is a, c, g, or t
  misc_feature (425)..(425): n is a, c, g, or t
  misc_feature (430)..(430): n is a, c, g, or t
  misc_feature (439)..(439): n is a, c, g, or t
  misc_feature (443)..(444): n is a, c, g, or t
  misc_feature (475)..(475): n is a, c, g, or t
  misc_feature (486)..(486): n is a, c, g, or t
  misc_feature (493)..(493): n is a, c, g, or t
  misc_feature (495)..(496): n is a, c, g, or t
  misc_feature (506)..(506): n is a, c, g, or t
  misc_feature (509)..(509): n is a, c, g, or t
  misc_feature (511)..(511): n is a, c, g, or t
  misc_feature (514)..(514): n is a, c, g, or t
  misc_feature (554)..(554): n is a, c, g, or t
  misc_feature (573)..(573): n is a, c, g, or t
  misc_feature (632)..(632): n is a, c, g, or t
  misc_feature (639)..(639): n is a, c, g, or t
  misc_feature (642)..(642): n is a, c, g, or t
  misc_feature (693)..(693): n is a, c, g, or t
caataanaccgatatcaatttcaatcaaaatgaattatatccagtgctcactctcagccttctatatctagnntgaggggggggggatatattannatgtctagccaattccatctgtgttgggngttttcagctgaatctgggggtaattacatgcagatgccaatatcttgtttatctacaaggnatttctttcataatgaatgaagtggagggatatcataagnncnggactnnngttttnaacaaanncaaattgaaggnacactttcagaaaangggttctngtatgtcttttnggnttactggncggttatgcngtngnngatgtcgggngggttatttgtgtntngnttgggnttnngngggggggggngctggtgttgtgntgnnngggnggggggggtgtgggggggtttnnngtnggggngcatatggntttnnggggtatcctttatatatatatgtgggtgtntatatatgggngtgtgtntnnagcggggggnttntntcngtcatttttggtctttttttttttgttagcttgcttcctnataacttgccatgcttgcntaatttattcagttttttggtttttagttttatttgtcctgtccctttagtaacaattntttaaanttnattctctatatcatacctataatgcacattaaaacactttatttcacacanaacatttaaa

SEQ ID NO: 572049 - DNA, 192 bp, Homo sapiens
gtgggacacgatcttcgtgaagacccgtgactggtacggagcatcaccctcgacggtggagcccagtgacaccatcgggaatgtcacggcaaagatccacgctaaggaaggcatccctacctgatcagcacgcggttgatctattgcgtgggaaacacgctggaaggcatggacgcacccttgtcgtgacta

SEQ ID NO: 572050 - DNA, 271 bp, Homo sapiens
gtggactgctcgccgcgtcattgtcacctcttcctggtaagccttcctgtatacccagcagccccgtctctagccttgatcgttctgtggtctgtagtttattctatggttctcgtgtggtcatcttcctgctccgctctcgacgacagcacactgtagagcccggaagagttagaagtatccctgtagttctgtaacatgcgatacgaattgtctagctactagatgcgtgcccgacccccgatggctaggaagggtggctccactttcc

SEQ ID NO: 572051 - DNA, 209 bp, Homo sapiens
aataagctggtgacgataaaacaatcacttatgatcaaaatgcgtatgaagtgttcgtcactgttgcggatgatggtaaaggccaattggttgcgactgtagaagatgcggatacagaacgtgtcttcacaaacacttatacagcaccagttccaccagctccaacagctacatcagcaacacttgaatttacgaaagaattggctggt

SEQ ID NO: 572052 - DNA, 1355 bp, Homo sapiens
atgtttgcccacctcgtttacaagacgcgctcctcatttttttgtccggggtttattctcccggtgtgtccctcttttgtgcccattagagtgttgccaaaaccggggttgtcgccgcatttccccgagtttttgaaccaccgagctgtgggccgcctttttggagcacctgataagctgtttgctccgcttgtgtgtttttcccacgggggccccccctttttggtgttttgtgccccgtgtttttccaccccccccctggtggggccctatgggcctatgactctcttgtccccctctatgtgtgcccccttcacgggtgaagaacaacaccaaaagttggtgtgccacacctggtgtgaccccgctttcacccagtttttgggggggtttcttaatagggggccctttcttcacactgtgtgttgtcccacaacacgaggagtgggcttttattctgtcaccacgggagatttttcgctcgggataaacggctgctgtttttttatgggggaaggattctccccccttgatggttagctacccccttgttttgcccccttttttgtatttgagggccccccccccgggcgcgcctcccaatgtgttttcaccccacgtgtttctcgcgcacccgcctgttgtggtgagagagagagtttaataatgggccccccacagcttctctctcaaagagaggttttctctcctcgagggaaacgccctcttttgtcttttgctcttttatatgagagaagaagcgccccccacgcggccccctctttccgcggaggagatgtatccctcaagagagagataccttgttgagacaacccctctgcggggagactcgttttcacacaataaggaggagaatgtggatgtgaggtgttgtgtacacacagaggatccccctctctttgcacccacacaagaggggatatttctatactaacctctcgcggtgttcgcaacaccccttctctctggaaacacacgtggagcgccacacatagccacaagagtgtgtggtttataatagaaactctctttgtttatatatatttttctcacgcgtagacacatgtgtgtttaatactcttttttatatattgttcaagaacacacctttccccacccctccttgttgaacctctcttgtgcgcaggccacctcttggtttttccgcccttggcctctcttttttttgtaagtagttttttcccgcaccctctttttgcccctcttggcccctgtgtaatatataccgcgcacggcggaaatggggggggggggggttaatttgttttgtatataaaaatttcgggaataaaaactcaccccaaaattgtgta

SEQ ID NO: 572053 - DNA, 927 bp, Homo sapiens
  misc_feature (267)..(267): n is a, c, g, or t
  misc_feature (295)..(295): n is a, c, g, or t
  misc_feature (304)..(304): n is a, c, g, or t
  misc_feature (307)..(308): n is a, c, g, or t
  misc_feature (310)..(313): n is a, c, g, or t
  misc_feature (328)..(328): n is a, c, g, or t
  misc_feature (343)..(343): n is a, c, g, or t
  misc_feature (359)..(359): n is a, c, g, or t
  misc_feature (363)..(364): n is a, c, g, or t
  misc_feature (382)..(382): n is a, c, g, or t
  misc_feature (385)..(385): n is a, c, g, or t
  misc_feature (399)..(399): n is a, c, g, or t
  misc_feature (404)..(404): n is a, c, g, or t
  misc_feature (410)..(410): n is a, c, g, or t
  misc_feature (414)..(414): n is a, c, g, or t
  misc_feature (416)..(416): n is a, c, g, or t
  misc_feature (420)..(421): n is a, c, g, or t
  misc_feature (443)..(443): n is a, c, g, or t
  misc_feature (452)..(453): n is a, c, g, or t
  misc_feature (456)..(456): n is a, c, g, or t
  misc_feature (475)..(475): n is a, c, g, or t
  misc_feature (486)..(486): n is a, c, g, or t
  misc_feature (490)..(491): n is a, c, g, or t
  misc_feature (493)..(494): n is a, c, g, or t
  misc_feature (496)..(496): n is a, c, g, or t
  misc_feature (500)..(500): n is a, c, g, or t
  misc_feature (506)..(507): n is a, c, g, or t
  misc_feature (510)..(510): n is a, c, g, or t
  misc_feature (521)..(521): n is a, c, g, or t
  misc_feature (524)..(524): n is a, c, g, or t
  misc_feature (526)..(526): n is a, c, g, or t
  misc_feature (529)..(530): n is a, c, g, or t
  misc_feature (533)..(533): n is a, c, g, or t
  misc_feature (543)..(543): n is a, c, g, or t
  misc_feature (564)..(565): n is a, c, g, or t
  misc_feature (568)..(568): n is a, c, g, or t
  misc_feature (574)..(574): n is a, c, g, or t
  misc_feature (578)..(578): n is a, c, g, or t
  misc_feature (581)..(581): n is a, c, g, or t
  misc_feature (585)..(585): n is a, c, g, or t
  misc_feature (587)..(588): n is a, c, g, or t
  misc_feature (597)..(598): n is a, c, g, or t
  misc_feature (603)..(603): n is a, c, g, or t
  misc_feature (607)..(608): n is a, c, g, or t
  misc_feature (643)..(643): n is a, c, g, or t
  misc_feature (660)..(660): n is a, c, g, or t
  misc_feature (667)..(667): n is a, c, g, or t
  misc_feature (699)..(699): n is a, c, g, or t
  misc_feature (817)..(817): n is a, c, g, or t
  misc_feature (900)..(900): n is a, c, g, or t
catcagagtccacacgattgttatatctgttcagcatgatgaagaggtttgtcctgatgggagcaccagtcttctcccatcagctttattggaatagtttaaaattacatttctattttctaggacttcagttgctctttccatctgacttttaaaaactgattacagcaaatgaaacacagttgtctaagtgatatagtatacaaaaataacatcttgatttctgtgaaaatgcatttctctgcaattcctgaatagctccaaatnatgctaactctgggcattgatgtttacnctgggtttncgnntnnnnctttggcaatcatgngttctaaacctttgncatcaccatctatgtntccnncatcaacactgtgatgangtngttcctgtttaggnttttnttccgntttngntcgnncagccattaacacgcatgtgtntgtttttgnntantcccactcaactgtatgtnctatgtggggnctgnnanngntgtnacttgnngtnatttagtagcnacngnggnnagngaatccaagngcatcattatactaaaattgnngtnatttgngggngtncatngnnacttccagnnttggntttnnctccgacatgggaacatgttcaaggaacccaggangggcttactggtctgantcaactnttcccattcatcaatccctattcaccagtggnacggaaagggggttctttaacaaagcattatacataacacctctaccaaactaaacataaacttttttttagttaaatgcagaaagtcggtttttttccacccctttcctccttttanacggcaagtaaagctcactggcctgggagttgcctctatctgccaacctttggccagtgaagaggattcagagaaaataatancaacatcaatcagaaaaaggggggggg

SEQ ID NO: 572054 - DNA, 130 bp, Homo sapiens
  misc_feature (76)..(76): n is a, c, g, or t
caagtgtttatttttatacatttttttgtattaaaaagaaaagcataattaccacaaattacaaaggtcctttgcnggactggtttaatgaatgaatcacttcagcctggaaagcagatcctctcactaa

SEQ ID NO: 572055 - DNA, 813 bp, Homo sapiens
ctgagtcccagcatggtgtctctgcagtcgagggcaaggactctgcgtgaattctcaactgctctgtctactcggccactccggtcccgacactcatagcctgcgggacatagaactaccctggaattgaaaggccaccgatgaagaaaagtgcagtagctcttaggacagagacaattttggttgttgaccaggactggccgctaatttgttttaccaccagtttgtggacaccattttaaatctccccttgcaaggtaaccctctttccgtgtaccgaagatggtgttcaatcacagtactaaagaaagggctgctagccgagtgggcaaacagcgaggggaaaaatctaagaacttatttaaagaataccccagatttttgcgtggcattttgactccttgtaggcaacctttacaaacgctctttgtggaatgtcccttatgggatttattggccctgagttgcgccagcccggcccatggaacagttttccgccgtacgacacttttggtggacgcaccgtcggttttttgcccgagatttgccatcatttgattgcgccccttgaattacagtgttttaccctcaagtggacccacagttgtgcatgtcggtgaaaccgcccccagtgtggtcccctgcatgttgtatgctcagccgcctccacggggagtttcaaacggccatatcccccatgattttgaacttttgtaggactgcattcacgtggcaaaggaatgcgtcttttgtcacttcaccacttgttagggcaagtggccgaacacgtgcctgggaccctccagcacttgt

SEQ ID NO: 572056 - DNA, 161 bp, Homo sapiens
gcaattagggaaacattgttattttaaatatgaagggctaaaattttctcttaatacgtacagtagagtcggtggatgtttaagaggttatttggagtctatccaccttaattaaagttccctctgttcaaaaatccaggattacatttcttatttagagg

SEQ ID NO: 572057 - DNA, 236 bp, Homo sapiens
cactgtgcgctccttgtcatgtaagcttcatccacatacttcttgatgcaggacaaattcgttctccatctctgtacgcatattgatctcatcctcatcctgggtccccgagcactcctctggcacagtacgggtctccctgctcacctacagggccttggcaccacactgttgccccgtccttggacatgctctccgtttctcctgtatctacctgcatactatggctacaaagt

SEQ ID NO: 572058 - DNA, 317 bp, Homo sapiens
tgacagcaaggcgatcaattctgtcttgaagagaatttgctctgatgtagaagttgttagcctcattaaacaactcaccaaatatgtcttcagcatgtttgctcagactgctcagctgcgtatgatagccgcaagagtactatgggtacacttcaaggtcgtggtaatccccttaaggcaagaagccccaattcggggctcaattgtcttctcactaagcttggtcacatcatgtatcgtaacttggtccaggaaatcccttaagtagcatcaccactttggctcagttatcagtagtagttaacagcaatcaaaac

SEQ ID NO: 572059 - DNA, 157 bp, Homo sapiens
gcgctgagaggcgtagaccttttagatatcattccaggcttaaagtctcttaaggagcaaaacagcttcctgggtcttcgtgtcgccttcaactttatcttcaactaccaaaggaagttcaggagcttcctcaatacgatgcgcgtaagggccagca

SEQ ID NO: 572060 - DNA, 714 bp, Homo sapiens
gcctcacggtcctgctgatatgtgacatcacccccggaggcccagctgtaaattcctctcttgtgtactctgtgtctcttatatttctcagaccagtcgcgacacttagggaaaatagaacctagcggctgaaatttggggggcaggttctcttgctaggtttcgaggatttagctgaacgatattcctgagagaatcatcccagggtgccatcactaaataaaatgatccagttgacagctacccctgtgagtgcatcttgtggactgagccagatgcattattccaatgctacaggcctgattccctttcagatggtgagtcttgtcaggcatcactggaagactgaaaatcggtacgacatgtattattctcaagcccatctatatgggaccaatgaattcggtagaggtggacctgaagtcatgcttacttcacttggaggggatcatatgggagtccaccccatgggtctcttctggtctcgtgaagacctgatatgctattaactaagactgttgaagagagatgtgatgaataggcctttccaggtccaagtaaaagtttatgacttagagttaatacgtgaacaataccagttgcctagtgcgtccaaaggccagcctgaactttgcagaggtggtatgtggcagctggtgtcacacgaattaaggtccgagaaggccgactacgaggagctctcttactgcgata

SEQ ID NO: 572061 - DNA, 441 bp, Homo sapiens
  misc_feature (29)..(29): n is a, c, g, or t
taagcagtgccctttttccaaaaagcccnactcccctcaattggttgaaattaataaattttaaatgagagaagtcctgatttcctaacaaccttaggtctcccttagaggttgatgtctcccaaacaaatgttcggaaagtgttgagattcaattcctatatccctagggtcctaatggagagagtataacacagtagaaaaggcacagatgtagagttgggcaaaccccaggttcaagtaccaactctgcctcttattagttggaaagctggtgacatttctttgaactttagagtaaagatacagcaataacaacatcacaggtgtgttgtaaagattaggaaggatgatctagcactgcacctggggcagggtaggaatgtgatacgtgatggttatcactgtggtaactttcacctctaacctccctcttccctgc

SEQ ID NO: 572062 - DNA, 257 bp, Homo sapiens
gatctgtgtggaaaacacattgaagacgacattgcccagtgtattgacactcttgacagtgccccttgtgggggcggtggacccctctcttctcccccagtctgtggagccccttcttctttctctcccccttctagaagagaggagaagagatatgagaagagggaggtgtctgaagacacatatgatgacatggtatgtgctctttgtgattataccccttctcccctacatataaactctttccacacatctca

SEQ ID NO: 572063 - DNA, 109 bp, Homo sapiens
ggttggggaagcaccagacgaagagtctgcctatgtggcaggagaaaagagtcagcatttcaggcaagatgtcattgtatctattgatagactggtgagacgtggattc

SEQ ID NO: 572064 - DNA, 445 bp, Homo sapiens
gctcgacgctggccactgcgctgaccatacttggctcgtactctcgcgcttcggtttgacttttgttcgctatcatgtctgaccaacccgatatggatgacatcgcgaaattcgcttggttgaaactgatgacgacagagacgcaggagagacatccactgccttccaccgaaacgattgaacagtagaagcacgcaggcgaatcgtattgaggcgtgcgccgccaatatgcactgtacattccacaagcattgacttcttattgtacttcttttagctgatgaactctgtaagatgcagagaggttgcatcaagtttaaatgactgtgctggccctttgacatcaaagagctactggcagcgaaggccgagcctgcctttcccatctgtctatctatctgactgtcagggaaggatagaacttgcatgttggtgaaggaagaac

SEQ ID NO: 572065 - DNA, 558 bp, Homo sapiens
atcttgatacttatacttgaatcagttttcagaattaccatctttctactggaactaatgtgctgttctcttgactgcctgctggcgcagcgctccgattgccagccagaaacgtcacactgcccaagatggccaggtacttcaaggtctggaacatgttgagctgagtccagtagacatacatgagtcccagcatagcagcatgtcccaggtgaaatataatcgtgctaggagcaaaagtgaagttggagacataggcaccaatccggatccacagagcgaagagcagaagcaacggcgagaggatcagggcagtgaatgtattggacaccacggtggggggcctcttctcaggctcgcggaacaggtgctgaatttcctgttttggagtgaaacggttctgggacaagacagtcgagggagcttcctcctcagggaacttgatgaccacatcagccacattccagaggatagggttcttccaagtggcatctccaatgattaagtagagagtgtaggtgcagaggcagagtcaattcaatcttacttcagaggtaa

SEQ ID NO: 572066 - DNA, 228 bp, Homo sapiens
tttctctgcctcccagattcaagcgattctctgcctcagcctctcaagttgctaggattacaggtgcctgctgtcacgcctggcatattttgtattttatagaacgagataggagtttcagacatgtatggccagtgctacgtctcgcaactcccacatcttgatcaacgtgattctgcccgcctcggaactcccagaagtgctagggattacagcgtgtagagccac

SEQ ID NO: 572067 - DNA, 134 bp, Homo sapiens
aaaactaggaaacatcattctgtacattgtccttggtacatttgtgacgtagtcctcaaaacagttgtaccacagcaaagacagtgacaggtgtacgtaagtaaactaagagcttctgcagagcaaaagaaaac

SEQ ID NO: 572068 - DNA, 250 bp, Homo sapiens
gggattcctttcctcgcaggtttctactccacatatcagctcatcgaaacccggaatatatcctacacaaacgcctgacccctatctattactctcatcgctacctccctaacaagcgcctatagcactcgaatcattcttctgaccctaacatcacacgccgtacgatcccctatctaggcctactgacgaggcaaaacctgtccttactcctcctagacctaacctgactagaaaagctattacctaa

SEQ ID NO: 572069 - DNA, 550 bp, Homo sapiens
ccaaggccgtcccgaaaggaaattattattaacttggttggttcaagcaccgtggaaggcaacttttaaaccgaatgggtggtaggaaattttgggtggaaaaaatcaaaagaagtttcaacttggatggaacaatttgaggtaacttttgtttaaagtggggctttaaaaagaagcaacttcaagcccctctttaaaacaaccaaccgtttggccctttaagtggtttaatttaagcctttggggcttacctaaaaatggtggcccattgcccccacgttttttctgaaatggccacccctggaggaagccaccaatggggggatggggtaggccaatggggttctttttaaaaaacaccctggggatggaatttcccccacgccaccccactccaagaaaatacttggtgccccttcttgttaacaagacttggcccctccattggtggtaattaccttgcaggtaaggaagaatccgtttttggaaacaatggggaattcttttgtattaggaaggcttaggcctttaaaaatcttaaaatggaatt

SEQ ID NO: 572070 - DNA, 898 bp, Homo sapiens
tctagcaggggcactggtcgactggtctctcgtggtgttcctgtgctctgatgcgtgaccatgttatggggacttccatgggcttggggtgcccccagcagtgggtgctccccccatttgtgggggtccccgccaagggtttctgtcgacgccctctatttttttttggcggccgcccccatttggggagcccacccttctgaatgcccgctgttctgcggttacatgttgtccgctgtttcaggtccgtctgacataatagagtgtctgtcacccccgatggttctggaccatgtagtcgggctgctgccgcattactcatcggggtaggggttcgcccggttccccgcctcagggatgatgcatgtgtctgtcgccggaaagtcaattaaatggttctcctggccccccctgttatgatatctaacgtaggaaatgccgccgtcgtgcccacgccacgtttttctgatcccccccatcagtacggccgcgacaaaccagtggcgttttgtattcgcacgttacactgcggcagcacaagagcattggtgtttcccaggtcatagctggaaacagaaatttttaccagtgtctgccaaaaagtgtttcagatcagctaaccacgatgtcttggagcactgcatttcgcaggttttcttggaacaagccgtgtgcttattatccatattttagtgaggcgaggttacaagcattctaatacttgtaggggcaccgcctacatagtaaaaatttcttggtgtttgccaactctccgtgatgttacgaactgtcgtttgtgctcgctgcggtcttgtacccccgcaggaaacaacgagtaggggaagccccgcgaatggaccccaagcggggaaaaaaaaaatattgtgtccacaagaca

SEQ ID NO: 572071 - DNA, 349 bp, Homo sapiens
agcggagacgctgcccttccgcaggcgatggcagtgccggcgtctgtgggaggggccctctggtatgtgtagtcccatgtcgcgttactgggagcgtggatgtgtgcctgtggacccagcgtgagcaacactagttgaagtactgttcatccatatgggaagactcgttgtgctcctggaggacttatgaccatggggcgattggactctgcgcaattggcagtttccaggagggccgagggcacgtctattgaatccaggccctggtgcgatgacggttggcctgagagtccccggtgttccatgtacactgacggtattggcgcatgatctgcaaattcttccctag

SEQ ID NO: 572072 - DNA, 2150 bp, Homo sapiens
aacagagttatcgaggaggggtggctgctagccattctgagctcatcccaggcccctgggtctccgggtcactcccattctgactgatcaatcaccaaaagccaaggagggcccggcacccagcccagggcacagctgagtctgcgtccagcccaacaccagcccacggcctcactccccagcctcggtctgacccttctagccctgagatccaagtgcccggcatcccgtccccaagcctcacccagaccttctttcccttcaccctcccctcctgccacccatcctctgcccccatcccttcacccacccctcctgccatctatcctcagcccccatcccttcacccacccctcctgccatccatccacagcccccatcccttcaccaccctcctgccatctatacctcagcccccatcccttcacccacccctcctgccatctatcctcagcccccatcccttcacccacccctcctgccatccacctgcagcccccatttctgcagcctgaaggcacagggaagccctctgaggccaggccacaggacagttgagggcttcgggcccctggagtgggtagagggctcccgcagccagagaaggggtttcctgcagggacagcagcgtccgacctcgtccctatgacctcgtccagcctctggcttcagcagtcctacttctttctctctgggtttcttagtaaagatccttttcacaaaccccacgtctccagagggctctgtgggaggtgtgtgtggccctggagtggctggcgggaggcaggacccctgaggacgtgcaggaggagccagaggggaaggaagggcaggggccattctggggtcctgagagccaaagtgcccaagcagtggttcccatcaatcacccctcagcaccccagagactccccagctcggccctgtcatacctggtctgctggtctccagcccagactcatgcctccttctcaggtaaagtcaaagcaacaatcaacatcgaccctttgtggcaaaaccagaagaggccatgctgtggtcagcacaggaggccaagaatgcagctgcacagtcaccaaggtggaggctggtgggggcccccaggaccactggccacacacccttggatccagcacccactgagcacagacaaagctgactccccagcccacagccgcccaccagcctggacctcctgaagagctgagaggtgacccaggagcaggctggggccccagagccatcggggccacaggtgggcttgacccacaccagtcctcagggcaaatgtgcagcctccctggctggagaggcctgcttacaagggtcttccacaacatcctaaaatgggagagaacgcatgataggcatgacaaagggcagggttccctcatatacaaagagcactcagagatcactaagaagaaaggtgagcaataggttcttcatggaaaggaaaaacccagtggccgataatataaagaaaccattttaaaatgagaaaagtgaaaggaaggaggaggggatgaagggggtggaggtgcttcttggccctgactgagggcacgtaaatcattaagaccactttttagggccagttggcaaaatgccccaatgcaggagagtcctctcacagtgatggccccacagggagagcctcgctctgtgccaggagagccacgtacactggagtctggcacaaagcggaatgaagcaagcctgcctcagtctgacagcggcacctgggccctccgccctgtcctctgctgcgacctcggagcagccgggcacgggggagaaggtgaggagcgacggctccctacagggtagaaaaccccaaagcgggcagcgctgaggccgactgggtccaaacaacaccagaggaggggcgtcgcaggacagggccaaggccacagccgctgcccagctggggtcacacactccctcattcacagacacacatgcaggcacacactcgcacatgcaaaaacacacaggttcacacacacagactcaacctctcatacacatttgcactcacacacaccaatcatgcactcacacaggctgacacgctcaggcacgctcataccaacacacacacagtctcaggaagccaggccctccatccaccccatcaccagcccagg

SEQ ID NO: 572073 - DNA, 279 bp, Homo sapiens
gctctcgtataatcgactaagtacataagaagatgtaggaccagatgagaagtctcttccattgtaattacaaagaagtgggaaggaaaggaagttagcgtccctttctgtgttttggtttttgtgaaatagacaggatagagccaggacagagcacggtgtgctcacaccgtgtaatccagagcacttatgggaggccaagtgcgggacggattgcttgagccccagcgaatttcgagaccaattcgtgggcaaacaaagtgatgaacgcctctctct

SEQ ID NO: 572074 - DNA, 429 bp, Homo sapiens
cagagacagaggccaggaggcagtgaggggagccccgcggggaggcagtggcgactgacacaggccttccagcctgtcttgctggacgacctggttcatatatgagttgaattgtactgaccctggacccagataagctgcaactttgagtctttgggggcacagaacattttggggcagtttaatgtggtaccaaactgaacataggagctattgatagatggagcatcacttacagcttcatagaaagcaatgcctatgttgaaagttacaaacgcagatatctacatagatatgctttgctgagaagttaggtctgtggtagaccataaaccacaaattgactttttatctcatgaaatatttctatttgcgggaaaaatagtaatatgtaaattaatgacatgtgacgatctctggagtgtctgt

SEQ ID NO: 572075 - DNA, 938 bp, Homo sapiens
  misc_feature (258)..(258): n is a, c, g, or t
cggccgagagctccaccgctgaggccgacgaggccaacagtttattgtcacacagatatttttattttaatgcgggctagggtggctaccttgtttcttaatttacattttgaggggtacttgatattgtcttcagttctacaaatcaaaattatgattacattcctcagttatacatataacatgatataggtttttaaaagtaaatgttttggtcttacggggggggctttttattttgtgtatattttaatgtanagatttaactttatattttttcctaaatgaaagtcagtcaaatatttcaacatgatttaatgtcttttccagtttttctctgagagaaattcagaacagttaaggagtacattatgggatgggcttatctaagagtcaaggaaaatcggtattgaatgaaggggaaaaaacacagcctcttttgagtatgagtacaaacgaataaaggggagatgagcgcagcagggcattggaattaggggagggttattgggttaatattttccaccccctcaatgagggaggacactgttagctgacggtgttcaattcagacctagaagaaagggggtccttggtgatgggttataaaagcttgtgtgtaaagtaaggagggcgtcaatgggggaccacggggcagcattttaggctttctgggctttatacgatggggggggattggtgaggggggggagtaaaaagaaaacggggtttgttccgggggggggtggggggggggtgggggtttgagggcgtgggggtttaggtgtgaagggggggggggggggatgttcgcgtatagggggatgttgaggcggggtgggtggggggcggggggagtgggagggcaggggggggaggtggggggggtggggggggacggggggggtcaggcgggagggggaacagggggacgggtg

SEQ ID NO: 572076 - DNA, 272 bp, Homo sapiens
gttgtcatggcagaccccaaagggaaggcctcccgcgttgtttgaaagtaccaccagtgaatctgttttttgtttctgtccctttccccgtgacacacagagcaggcatggaatttaatgggtgttttggacagacacttgtacatggacagacatccctactgtggatactacaagactgaaaagaaaatggtatgttgtcattttttggctatggagtgtttgtggccttcccagatttcccaggaaccaataaatccctcagagaagta

SEQ ID NO: 572077 - DNA, 392 bp, Homo sapiens
  misc_feature (2)..(2): n is a, c, g, or t
  misc_feature (13)..(13): n is a, c, g, or t
gnaattttagtanagaatggggtttcacccatctaggcccagactggtcctcgaactcctgaccctcaggtgatccacctgcctcagcctcccaaagtgttgggattacaggcgtgagccaccacacccagcctctgttctcagactcaatttctgagctacctccttggactatgagcagaggggatgcagcaactaggaggcttagtgtaaacagccagcctccttctgcaataggtgttagagtggatgtgggtcgaagctgccagtttactacaaagttgaactaattagttttttaaagtagtatgccatattaaaatttacttgagtggggactcagatcgggtttaagggattattacataaattaacatttaagtaatactaaa

SEQ ID NO: 572078 - DNA, 111 bp, Homo sapiens
  misc_feature (13)..(13): n is a, c, g, or t
tgctgatgtcagnacgtgactgctgccggttgcatggagatctgaaggggcggggtagagccaagctgcacaatttaatatatttcaagagtggggggatggagcacgcat

SEQ ID NO: 572079 - DNA, 941 bp, Homo sapiens
ggacttcaaatctactcccataatagcttttgatgacttctagcaagcctcgtaactcgctttaccccccatattaacctatggagaactctctgtgctagtaaccagttctcctgatcaaatatcatctcctacttaacaggactcaacatactagtcacagccctatactccctctacattatttaccacaacacaatggggctcatccacccaccatattaacaaataaaaccctcattcacagagaaaacaccctcatgttcataaaacctaatccccccattctcctcctatccctcaacccgatatcattaccggttttcctcaaaaaaaaaacaaaaaacagagaaaaccaacagtttgtgggagagcctgcggaaccaggaaaaaagggttaagcaagaccaatctgtgtgggggacgggggggcccaaagagtaactgtcacacgttggcacacaaggtgtgcccgaggagacacccgtggacccagcacaaggggtggggttcctccccaattaaaaaaccgggggggggaacacggcgcggttgggaaccaaccccgaagggggtcgggggcacataccggggaccacacacggggggttcagaggggaaccgaaaatacaaattgccgcgcggggggggtgagacgagaaaaacacacaaccacaaacacaccaaccgaacaaaaaccacaacaaccaacaagagaccataatcaacaaacaacaccacgaaaaaccacacacagcacagcacacacacaacaaaaaccacaacacacaaacatgaaaatacaacaacaacaacaaaaccgacacacacaacacaactacagtacaaacccacacacacaacacaaaccacaaccacaaccaaaaccaatccaacaacataaacaaaacatacatcacataaacaaacctcaataacaa

SEQ ID NO: 572080 - DNA, 164 bp, Homo sapiens
ccctattgacaagagacgagatgctggtggcaggacatcagacagcaatggttagtatcaactataaagcgttatgagaggcatatcctgtcaggggtgacgggcccatggaggacgagagctcgtaccagcaataggtagctgcaatggctagagagacctta

SEQ ID NO: 572081 - DNA, 640 bp, Homo sapiens
cttcatgaaaaaaaaaaaaaaattttaaaaaaaaaaaaaaaaaaaaaaaaaaaaaaagaaaaaaaaaaaaaaaaaaaaaaaaaaaaaaaaaaaaaaaaaaaaaaaaaaaaaaaaaaaaaaaaaaaccttggggcccccttggccccagcggtttttagcctgggcaagtttttgcctggggcccgaatttgggcccacttggccaattcccccttttggggggcggtttaccattcccgggcccgggttttaccacggcgggactgggaaaaccctgggggtccccaatttaaaccccttgggggaaaacccccttttccccggtgggggaaaagccaaagggccccccccggtgggcctttccaaaagttggccaaccctaatggccaagggaaattggaaggggtaaatttttgtgaaaattccgggtaaatttttggtaaaaccggccattttttaacccattggcccaaatggggaaaaaccctttataaccaaaaggattcccccgaatatgggttaggggttgtccaatttggaaccaggggccccttttgacgggggctccaaacgtaaagggggagtttttggggcccggggggcccaaaggccttggggacccttaagggcccccccgttt

SEQ ID NO: 572082 - DNA, 565 bp, Homo sapiens
agagcgggctgggccgggtgagcgctctgggtggcccgctgtgggccctgggccgtcgtggcgctccggcttgctgtgcggagatgagctgggtccctcggctgagctgcggcggctctgctccgctgtgggcgcggctgctgggctggcgtgtggtgccattctgggagtccacgttcagacagccgccgtgtgcagaacgcgacaccgatgccatgatcatacctcagaatggtggagtagcccaggaaaccacgacacaaaatagccgagcctcaaaaaagacatgccagcaggaagagcacgaactcaagtagaggagattagggagagcgccgatcaccagagatggctaccagcggggaactaacagaggcagtcgattggagtgaaatgcatggaaggactcgcggaacaatagagtcgtacagacgaagcactcatcccaaagttggtggcccaagcaaacaggacaagcaaagaaggacccctcaaacatgagaggaagacttaggaagtgcgccgcctagacgagagtacaatacttgaagaagcgcgcgcggac

SEQ ID NO: 572083 - DNA, 370 bp, Homo sapiens
gcacaaggcgatctctgctcactgcaacctctgactcccaagttcaagcgattctcctgcctcagcttcccgagtagctgggattacggtcacccaccaccacgcccggctaatgctttcatttttagttgagactgggtttcaccatgttggccaggctggtctccaactgctacccttaatgatccgccctcctcagccttccaaagtactgggattacaggcgtgagccactgtgccccacctatcattttgttaatgttacaaatttggtagcttattagctattgatcctctttgtatgttagatcgactccattactgttttgttgtggcaatatcatcagtataccatgatatctcgtccttt

SEQ ID NO: 572084 - DNA, 118 bp, Homo sapiens
cggcacgaggccgatccgccgcccgtccacacccgccgccagctcaccatggatgatgatatcggcgggcgcggagctctgcgcgcggctccagcgggccgggatgggcgggcggccg

SEQ ID NO: 572085 - DNA, 550 bp, Homo sapiens
gctgtataatctgagttttcttctataagatgcttttaacttagtatgttctcagtagaatcttgccgagatggagagctgcttttctctctcatgctttgggtgtctgtttcagaagggctattcatatcctgtggtttgtgtgaattacgtgggctgtcacagtgagaactcttggagcatctgcacttatcctggaaatccagcagtattttttaatgtcacaattataactagaaactgaggctgaaacactgctcccattcccattattatgaaggcacaattctatccaggaggcctacaggatctcctcatgcagctcaggctttactctctgatgtggcactggagtgctgctatggcaattggggttcatgtatgatgtgagctgccagctgtgagccctgtgctgtgagctgtgtttcagtggcagatggtaggagtcgagaggacactcgtcatcaggagagggtaagcaggagtgctctaacccagtgcttagggagtagaggagccattgctttaaaatgtcaatagccaaaaagat
